United States Patent 9,107,886 (MODIFIED POLYNUCLEOTIDES ENCODING BASIC HELIX-LOOP-HELIX FAMILY MEMBER E41) - sequence listing, part 8

SEQ ID NO: 11151 - DNA, 2598 bp, Artificial Sequence
  Description of Artificial Sequence: Synthetic coding sequence
atgttttccatgcgaattgtgtgtctcgtgctatcagtggtgggtaccgcatggacagcggactctggagaaggtgattttctcgctgagggcgggggcgtaagggggccccgagttgtggagagacaccagagtgcttgcaaggacagtgattggccattttgttctgatgaggactggaactataaatgcccctcaggctgccgcatgaagggtctgattgacgaagttaatcaagactttacaaaccgcatcaataagctgaaaaattcacttttcgagtaccagaagaataataaggactcccactcattgacaacgaatatcatggagatactccgcggagacttctcaagcgccaacaaccgggacaatacctataatagggtctccgaagacttacgcagccggattgaagtccttaagcgaaaggtgattgagaaagtgcagcacatccaactgctgcagaagaatgttagagcccagctagtggacatgaaacggttggaagtcgatattgatataaagatccgcagctgtcggggatcctgtagtcgggcgttggcaagggaggtcgacctaaaagactacgaggaccagcagaaacagttggagcaggtgatcgccaaggacttacttccctcacgcgacaggcaacatctacccctgatcaaaatgaagcccgtgccagacctagttccaggcaactttaagagccagcttcagaaggtcccgccagagtggaaggccctcacagacatgccgcagatgaggatggagctggaacggccagggggcaacgagatcacccggggagggtcaacgtcctatggcactgggagcgagactgagagtccgcggaaccccagctctgctgggagctggaactctggcagttctggtccggggtccacagggaaccgcaatcctggatcaagtggcactggaggcaccgctacctggaaaccggggtcatcaggcccaggcagcaccggttcctggaattcaggcagctctggtacaggaagtaccggcaatcagaaccccggcagccccagaccgggatcaaccggaacctggaacccagggtcgagcgagagagggagtgctggtcattggacatcggagtcttcagtgtcgggttcaactggccagtggcatagcgaatcagggagctttcggcccgattcacccggtagcggtaatgctaggcctaacaaccccgattggggcacttttgaagaggtatccgggaacgtttctcctggcaccagacgcgaataccacactgagaagctggttacgtccaagggagacaaagagcttcggaccgggaaagagaaagtgaccagtggctcaaccaccacaacacgtcgatcatgttccaagacagtaactaaaaccgtgattggtccagacggtcacaaggaggtgaccaaagaggttgtgacatcggaggacggcagcgactgtcccgaagcaatggatctcggaacactctccggtattggcaccctggatggatttcgccataggcacccggacgaggccgcatttttcgacaccgcgtccacggggaaaactttccccggcttcttttctccaatgttgggggaattcgtttcagagaccgagagccggggaagcgaatccggaatattcaccaacacaaaggagagcagcagccaccatcctggcatcgctgagtttccttcaaggggcaagtcgtcctcttatagtaaacaattcacatcatccacttcctacaaccgaggtgactccacttttgagagtaagagctacaagatggcagatgaagccggctcggaagccgatcatgagggaactcactcgactaaaagggggcatgccaagtctcggcccgttcgggactgcgatgacgtactacagacgcatccttccgggacccagtccggaattttcaatataaaactccctggcagttccaagatcttctccgtgtactgcgaccaggaaacatctctcggcggctggctgctgatacaacaacggatggatggctcactcaactttaatcgaacatggcaagactataaacggggcttcgggtcattgaacgatgaaggcgagggcgagttttggctcggaaacgactatctgcatctgctcacacaaagggggtcagtgttgcgggtcgagctagaagactgggctggaaacgaggcatatgcggagtaccacttcagggtgggttcagaagctgagggatatgccctgcaggtgtcttcatatgaaggaaccgcaggcgacgcattgatcgagggatccgttgaagaaggcgccgagtatacgtcacacaataacatgcagttttccactttcgaccgggatgctgatcagtgggaggaaaactgcgcggaagtgtacggcggcggctggtggtacaataactgccaagccgcgaacctcaatggcatctactatcccggcggtagctatgaccctcggaacaactctccctacgagatcgaaaacggtgtggtctgggtttcctttcgaggcgctgactactctttacgggcagtgagaatgaaaatccgtcctctcgttacccag

SEQ ID NO: 11152 - DNA, 2598 bp, Artificial Sequence
  Description of Artificial Sequence: Synthetic coding sequence
atgttttcaatgcggatagtatgtctcgtgttgtctgtagtcggaacagcttggacagcggatagtggggaaggggattttcttgctgaaggggggggagtcaggggacccagagtggttgaacggcatcagtcagcctgtaaagattcggattggccattttgctcagatgaagattggaactataaatgtccctccggatgtcggatgaaaggacttatagacgaggtcaatcaggattttactaaccggataaataaactcaaaaattccctgtttgaataccagaagaacaacaaggattcacactcgttaactacaaacataatggagattctgcggggagatttttcatcggcaaataacagggataatacttataatcgggtgtcagaggatctaagatctcgaattgaagtgctcaaaagaaaggtcatcgaaaaagtgcagcatatccagctgctccagaaaaacgttagagctcagttagtcgatatgaaaagattggaggttgatattgatataaaaatccgttcatgcagaggatcatgctcccgcgcccttgcccgtgaagtggaccttaaagattatgaagatcagcagaaacagttagaacaggtgatcgccaaagatttgttaccctctcgcgatcgccagcatcttcccctgattaaaatgaaaccagttcccgatctagtgcccgggaactttaagtctcagttgcagaaagtgcctcccgagtggaaagctcttactgatatgccacagatgcggatggagcttgagcgcccaggagggaacgaaataacacggggagggtctactagttatgggacaggatctgaaactgaatcaccccgaaacccttcgtccgctggatcctggaattccggaagttccggacctggatctacaggaaatcgcaatcctgggtcttctggaacaggaggaacagcaacttggaaacccgggtcttcagggccaggatccacggggtcttggaatagtgggtcctccggaactggaagtacaggaaaccagaatccaggatctcctaggccaggatcaactggaacttggaatccgggatcctccgaacgagggtctgctgggcactggacttcagaatcctcagtgtcagggagtactgggcagtggcatagtgagtctggatcctttcggccggattctcccgggtcaggaaacgccagacccaataatcctgattggggaacttttgaagaagttagtggaaacgtgtcccccgggactcggcgagaataccatactgagaaactagttacttcaaaaggagataaagaattgcggacaggaaaagaaaaagtgacttctgggtccacaacaacaacacggaggtcatgttctaaaacagtcacaaaaacagttatcggacccgatggacacaaagaagtcactaaagaagtggtcacaagtgaagacggaagtgattgtcccgaggctatggatctaggaactttgtctggaatcgggacactagatgggtttagacatcggcatccagacgaagctgctttttttgacactgcttccactggaaagactttcccaggatttttctcccctatgcttggggaattcgtgtctgaaactgaatcccgaggatctgaaagtggaatattcactaatactaaagaatcatcttcccatcatcccgggatagccgaatttccaagtcgcggaaaaagttctagttattcaaagcagtttacatccagtacatcctataacagaggggatagtacatttgaaagtaaaagttataaaatggctgatgaagctggatcagaagctgatcacgaagggactcactccactaaacgtgggcacgccaagtccaggcccgtaagggattgcgatgatgttctgcagacacatccttctgggacacagagtgggatattcaatattaaactaccaggatcatctaaaatcttctctgtgtattgtgatcaagagacttctttgggggggtggttgctgatccagcagcggatggatgggtcattgaatttcaatcggacatggcaggattacaaacggggattcgggtccctcaacgatgagggggaaggagaattctggctgggaaacgattacctccatctattaacacagcgcgggtccgtgcttagggtggagctcgaagattgggccgggaacgaagcttatgccgagtatcatttccgggtggggtcagaggcggaggggtacgctttacaggtaagttcttacgaagggactgctggagatgcacttatagaaggaagtgtggaagaaggagccgagtatactagtcacaataacatgcagttttcaacatttgacagggacgccgatcaatgggaagaaaactgcgccgaagtttatggaggaggatggtggtataataattgtcaggccgcaaacttaaacggaatatattaccctggaggatcttatgatccacgaaacaatagtccttacgaaatagaaaatggggtggtgtgggttagttttaggggagccgattactcacttagagctgttcgcatgaagataagaccactggtgacacag

SEQ ID NO: 11153 - DNA, 2598 bp, Artificial Sequence
  Description of Artificial Sequence: Synthetic coding sequence
atgttttccatgagaattgtttgtcttgtgctcagcgtggtcggcacagcctggacggccgatagtggtgagggggacttcttggctgaaggtggcggcgtgcggggaccgcgagtcgtcgaacggcaccagtcagcctgcaaggattctgactggcccttttgctccgacgaggactggaactacaaatgtccaagtggctgtcgcatgaagggcctcatagacgaggtgaaccaggattttaccaatcgcattaacaagctgaagaacagtctctttgagtatcagaaaaataataaagactcccattccctgactactaacattatggaaatccttcgcggtgacttttcctcggccaataacagagataatacgtacaatcgggtttcagaggatctccgctccaggatagaggtgttaaagcgaaaagtaattgagaaggtccagcacattcaactgttgcaaaagaacgtgagggcccagctcgtggatatgaaaagactggaagtggatattgacattaaaattaggagttgccgaggaagctgcagcagggccctggcacgagaagtagacttgaaggactatgaggaccaacaaaagcagcttgagcaggtcatcgcaaaggatctgcttccctcacgggatagacagcatctgcccttgattaagatgaagcctgtccccgatctcgttccagggaatttcaagtctcaactccagaaagttcccccagagtggaaagctttgacagatatgccccagatgagaatggaacttgagcggcccggaggcaacgagatcactaggggaggcagcaccagttatggcactggctcagagaccgagagcccacgcaatccctcatctgccggaagttggaactctggttccagcggcccggggagcactgggaatcgaaatccagggtcttctggaacagggggtacggctacttggaaaccaggatcctctggtcctgggagcacggggtcctggaactcaggctcttcggggaccggaagcacaggaaatcagaacccagggtcccctcgtccaggatctacaggcacatggaacccaggatcctccgagcgaggaagcgcaggtcattggacttcggaatctagcgtttcaggctccacagggcagtggcacagcgaatcaggctcgttcagacccgactcccctgggagcggcaacgcgcggccgaacaaccctgactggggaacattcgaggaagtttctggtaacgttagtccggggaccagaagagagtatcacaccgagaagctggtgacatctaaaggcgataaggaattgaggactggaaaggaaaaggtgacatcaggcagtactacgacaacgagaaggagttgttctaagacggtgaccaaaactgtcatcggccctgatgggcacaaggaggtaaccaaagaggtagtgacgagtgaggatggatccgactgcccagaggcaatggatcttgggacactctctggaatcggcacactcgacggatttaggcaccggcaccctgatgaagctgcctttttcgatactgcaagtactggaaagacttttccaggcttcttttctcccatgctgggcgagtttgtgtcagaaacagagagccgtgggtcagaaagtggcatcttcacaaatacgaaagagagttctagtcaccacccgggaatcgcagagttcccttcccggggtaagtcatccagttatagcaagcaattcacgtccagcacctcttataatcgtggtgactcaacgttcgagtccaagtcctataagatggcagatgaggccggtagcgaagctgatcatgaaggaacccacagcacaaaaagaggtcatgcaaagagtagaccagtacgggattgcgacgacgtactccagacccacccatctggcacgcaatcggggatctttaacataaagcttcccgggagtagtaagattttctctgtatattgcgaccaggaaacaagtctgggcggctggctcttgatccaacagcggatggacgggtctctaaattttaacagaacgtggcaggactacaagcggggctttggttccctgaatgacgagggggagggtgagttttggttgggcaacgactatttacacctgttgactcagaggggcagcgttcttcgtgtggaactggaggattgggccggaaacgaggcatacgccgagtatcatttcagagtcggctctgaagccgagggttacgccctgcaggtctctagttacgaaggaaccgctggagacgccctcattgagggcagcgtggaggagggcgctgagtatacaagtcataacaatatgcaatttagcactttcgaccgggacgccgatcagtgggaggaaaattgcgctgaggtgtacggtggtggatggtggtataataactgtcaggctgccaatcttaacgggatatactacccaggtggatcctatgacccgcgcaacaacagcccttatgaaattgaaaacggagtagtatgggtgagcttccggggtgccgactatagtttgagggcggtgaggatgaagatccgtccgctggtaacccag

SEQ ID NO: 11154 - DNA, 2598 bp, Artificial Sequence
  Description of Artificial Sequence: Synthetic coding sequence
atgttctctatgcgtattgtctgcctggtcctttcggtcgtcggcaccgcctggaccgcggactccggcgagggtgattttctcgcagagggcggaggtgtcagaggcccccgtgtcgtcgagcgtcatcagtcagcctgcaaggacagcgattggcctttctgctcggacgaggactggaactataagtgcccttccggatgccggatgaagggtcttattgacgaggtcaatcaggactttaccaatcgtatcaacaagctaaaaaactccctgtttgagtaccaaaaaaacaacaaggattctcacagtcttacaacgaacatcatggagattctgcgaggcgacttctcgagcgccaacaaccgtgacaatacgtacaaccgagtgagcgaggacctgcgatctagaattgaggtcctgaagcgcaaggtcatcgagaaggtgcaacatatccaacttctgcagaagaacgtccgcgcgcagttggtcgacatgaagagactagaagtcgacattgacatcaaaatacgctcttgccgcggctcttgctcccgcgcattggcgcgtgaggtcgacttgaaggattatgaggatcagcagaagcaattggaacaagtcatcgccaaggacctgctccccagccgtgatcgccagcatctccctttgattaagatgaagcccgtccccgatttggttccgggtaactttaagagccagttgcagaaggtgcccccagaatggaaagccctgaccgacatgcctcagatgcgcatggagttggaacgcccagggggcaacgaaatcacccgtggcggctccacgtcctacgggacgggctccgagacggagagcccgcggaacccgtcctccgcgggaagctggaactcaggctcgagcggtccgggttccaccggcaaccgcaaccctggctccagtggcaccggcggcactgcaacctggaagcccggttcctctggtcctggaagtacggggagctggaactctggttcttccggcaccggttcgaccggtaatcagaaccccggctcgcctcgtcccggcagcacaggtacttggaaccccggttcatctgagcgagggtctgctggccactggacttccgaatcctccgtttcgggtagcactggccagtggcacagcgagtcgggtagtttccgccccgattcccctggatccggaaacgcccgccccaataacccagactggggaaccttcgaagaggtctcgggaaacgtcagtccgggaacccgacgtgagtaccatactgagaagcttgtgaccagtaagggagacaaggagctccggaccggtaaggaaaaggtgacctcaggtagcaccacgacgacgcgaaggtcgtgcagcaagaccgtgacgaagaccgtcatcgggcccgatggccacaaagaggtcaccaaggaggtcgtcacttcagaggatggcagtgattgccccgaggcaatggatcttgggaccctgagcggtatcggtaccctcgatggcttccgacacagacatcccgatgaagctgcttttttcgatactgcatccacgggcaagacgtttccaggtttcttcagccccatgcttggtgaatttgtttccgagacggaatcgcgcggttcagaatctggcatcttcactaacaccaaagagagttccagtcaccatcctgggattgccgagtttccctcccgtggaaaaagcagcagttactccaagcagttcactagttctaccagctataaccgcggcgacagtaccttcgaatccaagtcctacaaaatggcggatgaggccggaagcgaggccgatcacgaaggtacccactccaccaagcgcggtcatgcgaagtcgcgaccggtgcgagactgcgatgacgtccttcagacccatcccagtggtacccagtcgggaattttcaatatcaagctccctggaagttccaagatctttagcgtctactgcgaccaggagactagcctaggcggctggctgctcatccagcaacgtatggacggttcgctgaacttcaaccgcacttggcaggactacaagcgcggttttggttctctgaatgacgagggcgaaggtgagttctggctggggaacgattacctgcatctcctcacccagagaggctctgtgctccgcgtggagcttgaggactgggccggcaacgaggcatatgccgagtaccatttccgcgtcggaagtgaggctgagggttatgctctccaggtcagctcctatgaaggtaccgctggtgacgcactgatcgagggttccgtggaagagggggctgagtacacctcgcacaacaacatgcagttttcgacgtttgatagagacgcggaccaatgggaagaaaactgcgccgaagtctacggtggcggttggtggtacaataactgccaagcggcaaacctcaatggcatttattaccccggtggcagctatgaccccagaaataactccccctacgagatcgagaacggagttgtttgggtcagtttccgtggagctgactactccttgcgggccgtccgcatgaagatcaggcccctcgtcactcag

SEQ ID NO: 11155 - DNA, 2598 bp, Artificial Sequence
  Description of Artificial Sequence: Synthetic coding sequence
atgttcagcatgaggatcgtgtgcctcgtgttgtctgtggtgggcacagcctggaccgcagattctggagaaggcgacttccttgcggaggggggcggggtgagaggacccagagtggtggaaaggcaccaatccgcttgcaaggattccgattggcccttctgttctgacgaagattggaattataagtgccctagtgggtgccgaatgaagggccttatcgatgaggtcaatcaggacttcactaatcggataaataaactgaagaactcactgttcgagtatcagaagaacaacaaagacagccacagtctgacgactaacatcatggagatcctgagaggcgatttcagctccgccaataacagagacaacacctacaacagagtgtccgaagacctgagaagccggattgaagttctgaaacggaaagtgattgagaaagtgcaacacatccagctgctccagaagaacgtcagggcacagcttgtggacatgaaaaggctcgaagtagacatcgatatcaaaattcgcagctgcagagggagctgtagtagagccttggccagggaagtggatctgaaagattacgaagaccagcaaaaacagctcgaacaagtaattgcgaaggaccttctgccgtccagagatagacagcatctgccactgattaagatgaagccagtccccgatctcgtgccgggcaatttcaagagccaactgcaaaaagtgccaccggaatggaaggctctgaccgatatgccccagatgcgcatggagctcgaacgcccggggggtaatgagattactagaggcggcagtacctcctatggaacgggctcagaaaccgagtccccgaggaatccgtcatccgcaggaagctggaatagcggaagtagcggaccgggctccacagggaacaggaaccccggctcatctgggacaggtggaaccgccacatggaagccgggctcctccgggccaggatctactgggtcctggaactccggatcctccggtactgggagcacagggaatcaaaacccggggtctccgagacctggctccactggaacctggaatccaggaagttccgagcgggggagtgcggggcattggaccagtgagtcctctgtgagtggttcaaccggccagtggcactcagaatctggcagctttcggccagactctcctgggtctggcaacgcccgacccaataaccctgactggggcacttttgaagaggtctccggaaacgttagcccaggcactaggagggaatatcacaccgagaagcttgtcaccagcaagggcgataaagagctgaggacagggaaggaaaaggtgacatctggctccactacaacaactcgacggagctgttcaaagaccgtgacgaagacggtgatcggccccgacggtcacaaagaggtcacgaaggaagtggtgacaagtgaggatggttctgattgtccggaggcaatggacctgggaaccctctctggcatcggcaccctggacggatttcgacatcggcaccctgacgaagcggcctttttcgataccgcatccaccggaaagacttttcccgggttcttctcccccatgctgggcgaattcgtttcagaaactgaaagtcgaggaagcgagtccggtatcttcaccaacacaaaggaaagctcaagtcaccatccgggaatcgccgagtttccctcaaggggtaagagtagttcctattccaaacagtttacctcctccacttcatataatagaggagattcaacctttgagtctaagtcctacaagatggccgacgaagccggctctgaagccgatcacgaggggacgcactctactaaacgaggccacgcaaagtctcgcccagtacgcgactgcgatgacgtgctgcagacacatcccagcggcactcagagcggcatcttcaacatcaagctgccggggtcatctaagattttcagtgtgtattgcgaccaggaaacgtctctcgggggatggctccttattcagcagaggatggacggaagcctcaattttaataggacgtggcaagactacaagcgcggatttggtagcttgaacgatgagggcgagggagaattttggctgggaaatgattatctccacctcctgacccaacggggatctgttctccgggtggagctggaagattgggctggaaatgaagcttatgctgaatatcacttccgggttgggagtgaggcagaaggctatgcgctgcaggtgtcttcatatgaggggacagcaggtgacgctctgatcgagggaagcgtggaagaaggcgccgaatataccagtcacaataacatgcagttcagtaccttcgacagagacgcagaccaatgggaggagaactgcgcagaggtgtacgggggtggttggtggtacaacaactgccaggccgcaaatcttaacggtatctactacccaggtggttcatacgatccgagaaacaattccccctatgagattgaaaatggagtggtctgggtgagcttccggggcgccgactacagcctgcgagccgtgaggatgaaaatccgaccgctcgttactcag

SEQ ID NO: 11156 - DNA, 2598 bp, Artificial Sequence
  Description of Artificial Sequence: Synthetic coding sequence
atgttcagtatgaggatcgtgtgcctagtcctgtccgtcgtggggacagcatggaccgctgattccggggaaggcgacttcctggctgaaggcggcggggttcggggtccacgcgttgtggagcgacaccagtccgcttgcaaggacagtgactggcctttttgctcggacgaggattggaactataagtgcccctctggttgccgcatgaaagggctaatcgacgaggtgaaccaggatttcactaaccgaatcaacaaattgaagaactctttattcgagtaccagaaaaacaataaagactcccacagtctgactactaatattatggagatcctgagaggtgacttttctagcgctaacaacagggacaacacctacaacagggtttctgaggacctacgctcacgcatagaagtgcttaaacgtaaagtaattgaaaaggtccaacacatccagcttcttcagaaaaatgtaagagcgcagctcgtggacatgaagagactggaggtggacatcgacattaagatccgctcctgccggggctcctgcagtcgggccctggccagggaggtggacctcaaagattatgaagaccagcagaaacagctcgagcaggtgatcgccaaggacctgttgccaagtcgcgacaggcagcacctcccactcatcaaaatgaagccagtgccagacttggtgcctgggaacttcaagtctcagctgcagaaagtgcccccagaatggaaagccctgaccgacatgccccagatgaggatggagctcgagagaccaggggggaacgagattacacgcggcggttccacaagttatggcaccggatccgaaactgaatccccacgcaacccgtcctcagctggcagctggaactccggaagcagtggacccgggtccacaggtaatcggaatccgggatcaagcggaaccgggggaactgccacctggaaacctggctcatctggtcctggcagcaccggaagttggaatagcggctctagtggtactggctccacgggcaatcagaatcccgggtcccccaggccaggctccacgggtacctggaacccaggttcctccgaacgggggtccgccgggcattggactagcgagagttcagtcagtgggtccactggacagtggcattcagaaagcgggtcttttagacccgactccccaggctccggcaacgcgcgtccaaataaccccgactggggaacatttgaagaggttagcggaaacgtgagtcctggcacgaggagagaatatcacactgagaagctagtcacctctaaaggggacaaggagttacgcacagggaaagagaaagtgactagcgggtcaaccacaaccacccgacgtagctgctctaagactgtgaccaagaccgtgataggaccagatgggcacaaagaggttaccaaggaggtcgtgacatccgaagacggaagtgattgccccgaggccatggaccttggcaccctctccggtatcggcacactggatggcttccgacacaggcacccggacgaggccgcttttttcgacaccgctagcactggaaagaccttccccgggttcttttcccccatgctgggcgaattcgtgtctgaaaccgagtcccgaggatcagagtctggcatttttacgaatactaaggagagtagcagccaccacccaggaatagctgagtttccttcgcggggcaagagttcgagctactcgaagcagtttactagcagcactagctacaataggggcgacagcaccttcgaaagtaagtcttacaagatggctgatgaggccgggagtgaggctgaccacgagggaacacactctacgaagcgagggcacgcaaagtcgcgccccgtgagagactgcgatgacgtgctgcagactcatccaagcggtacgcagtccgggattttcaacattaaactcccgggctcctcaaagatcttcagcgtgtactgtgatcaagagacctctctgggcggctggctgctgatccagcagcgcatggatgggagcctaaatttcaaccgaacctggcaggattacaaaaggggttttggcagccttaacgatgaaggcgagggtgagttctggctggggaatgattaccttcacctgctgactcagcgcggctccgtgcttcgagtggagctcgaggattgggccgggaacgaggcctatgctgagtatcattttagagtcgggagtgaagctgagggttacgccctgcaggtctcttcgtacgagggtaccgccggggatgcacttatcgaaggatcagtggaagagggggcagaatacactagccacaacaacatgcaattcagtacattcgacagggatgctgatcaatgggaggagaattgcgctgaggtttatgggggcggctggtggtacaacaattgtcaggcagcgaacctgaacggcatttactaccctggcggttcctacgatccccgtaataacagtccgtatgagattgaaaacggtgtcgtctgggtgtctttcaggggagccgactattccctgagagccgtccggatgaagataagacccttagtcacacag

SEQ ID NO: 11157 - DNA, 2598 bp, Artificial Sequence
  Description of Artificial Sequence: Synthetic coding sequence
atgttttcgatgcgtattgtctgcctcgtcctttcagtagtcgggacagcgtggacagcggacagcggtgaaggggactttctggctgaaggcggaggagtccgcggcccccgagttgtcgagcggcaccagagcgcctgtaaagactctgattggcctttttgctccgatgaggattggaactataaatgtcctagcggctgtaggatgaagggcctcattgatgaagtaaaccaggatttcaccaacaggattaataaactgaaaaatagtctctttgagtaccaaaaaaacaataaagattcccactcactgaccacgaacatcatggagattctgcggggcgatttctcgtccgcgaacaatcgagacaacacatataacagagtctctgaagacctgcgcagtcgtatagaagtccttaagcgcaaagtaattgagaaggtgcagcacatccagctactgcaaaagaatgtccgagctcagctggtggacatgaaacgcctcgaggtggatatcgacatcaaaattcgttcctgtcgtggatcctgttcaagggcgctggcgagggaagtcgacttaaaggactacgaggaccaacagaagcaactggagcaggttatcgctaaggatctccttccatctcgagaccgccaacacctacccctgattaaaatgaaaccggtgccagatctggtaccaggcaattttaaatcccagttgcagaaagtacccccagagtggaaggcccttacagacatgccgcagatgcggatggagttggaaagacctggtggtaacgagatcacacgaggaggaagcacctcttatggaacgggctcagagactgaatcaccccgcaatccatccagcgccggcagctggaacagcggctcaagtggccctggttccacaggaaaccgtaatcctggttccagtggcaccggtggcaccgccacttggaagccagggtccagcggccccggaagcaccgggtcttggaattctggatcctcaggaaccggcagcacaggcaaccagaatcctgggtccccgagaccgggttcaacaggaacctggaaccctggttccagcgaacgtggatcagcaggtcactggacctcagagagttccgtcagcggtagcaccgggcagtggcactctgaatccggctcatttagacccgacagcccaggcagcggcaatgccagaccaaataaccccgattggggtacgttcgaggaagtaagtgggaacgtttcacctggcacacgccgggagtatcacaccgagaaacttgttacgtccaaaggcgataaggaactacgcacaggcaaggaaaaagtgacaagcggaagcaccaccacaactaggcggagctgttccaagacggtcactaagaccgtgataggccctgacgggcataaagaggtcacaaaggaagtggtgacaagtgaagatgggtcagattgtccagaggctatggacctgggcaccctgtcaggcatcggcactctggacggatttcgccaccgccaccccgacgaggctgccttctttgacacagcctcaactggtaagaccttccccggatttttttcccctatgctcggcgagttcgtgagcgagaccgaaagccgaggcagcgagtccggaatctttacaaatacaaaagaatccagttcccaccaccctggtattgcagagttccctagtagggggaagagcagctcgtattcaaaacagttcacgtcctctacttcttacaaccgcggagattcaacctttgagtcaaaatcctacaaaatggccgacgaggctgggtccgaagccgaccacgaggggacccactccaccaaaagggggcacgcgaagtccaggcccgtacgggactgcgacgacgtcctccaaactcatccgagcgggacccagtctgggatatttaatatcaagctaccaggaagcagcaagatcttcagcgtatattgtgatcaggagacaagcctgggtggctggcttctgattcagcagcgcatggatggatctctgaatttcaacagaacctggcaggactacaagcgggggttcgggagcttgaatgatgagggcgaaggtgaattctggttgggaaatgattatctgcatttgctgacacagcgaggttccgtgcttcgcgtggagttggaagactgggctgggaacgaggcgtatgcagagtatcattttcgggtgggctccgaggctgagggttacgctctgcaagtctcttcttacgagggaaccgcaggggatgccttgattgagggctctgtggaggagggcgccgaatacacctcccacaataacatgcagttctctacctttgaccgggacgcagaccaatgggaggaaaattgcgccgaagtttatggtggcggttggtggtataacaactgccaggcggctaacctaaatggcatctattaccccggaggaagctatgatccgagaaataattctccttacgagatagagaacggcgtcgtttgggtctcctttcgaggcgcagactactcgcttagggccgtcaggatgaaaatccgaccccttgtgacacag

SEQ ID NO: 11158 - DNA, 2598 bp, Artificial Sequence
  Description of Artificial Sequence: Synthetic coding sequence
atgttctccatgcggatcgtgtgtcttgtgcttagcgtggttggaaccgcatggacagcagactcgggagagggagactttctagctgaaggtggaggagttcgtggaccacgagttgtagagcgacatcagtcggcttgtaaagattcagactggccattttgctctgacgaagattggaactataaatgtcctagcggttgtaggatgaaagggctcatagatgaagttaatcaagactttacaaaccgaatcaacaagttaaaaaattcactgtttgagtaccagaagaataataaagattcacattccctcacaactaacattatggaaatattgaggggagatttctcctccgctaacaatcgagacaatacatacaacagagtgtccgaagatctcagatcacgaatcgaagtgctaaagagaaaagtgattgaaaaagttcaacatattcaacttctccaaaaaaatgtacgagctcaacttgttgatatgaagagacttgaagtcgacatagatattaaaattagatcttgtcgtggctcatgctcacgtgcacttgcaagagaggtcgatctcaaagactacgaggatcagcaaaagcaacttgaacaggttattgctaaagacctgctgccgtcacgtgatcgtcaacatttgcctttgatcaaaatgaaacctgttccagaccttgtaccgggtaattttaaatcacagttgcaaaaagtcccaccagagtggaaggctttaacagatatgcctcaaatgcgaatggaactcgagaggcctggtggaaacgaaataactagaggaggaagcacctcatatggaactggatcagaaactgagtctccacgtaatccgtcatcagccggttcatggaatagcggctcgtcaggcccaggatcgacaggtaacagaaatccaggatcatctggaaccggaggcacagccacgtggaagccaggatctagtggaccgggttccacaggatcctggaactcaggatcatcgggaactggcagtacaggaaaccaaaacccaggaagcccacgtcccggatccaccggaacttggaatccgggctcttcggagcgtggatcagccggacattggacgtcagaatcgtcggttagtggatccacaggtcagtggcattcagaatctggatcttttcgaccagactcacccggatccgggaatgctcggccaaataatcctgactggggaacttttgaagaagtgagcggaaacgtttccccaggaacgagacgtgaatatcataccgaaaagcttgttacgtcaaagggagataaagaactgagaactggaaaagaaaaggttacgtcgggatcaacgaccacaacgcgtcgttcttgcagtaagacagttaccaagacagtcattggaccggacggacacaaggaggttaccaaagaggttgtcacatcggaagatggaagtgattgtccagaagctatggacttagggactctctccggaattggaactctagacggcttccgtcaccgtcacccggatgaagctgcatttttcgatacagcctctacgggaaaaacttttccaggatttttctctccaatgctcggagaattcgtttctgagacagaatcgcgtggctcagagtctggaatttttactaataccaaagaatcctcgagtcaccacccaggaatagcggaatttccatcgcgtggaaaaagttcatcctattctaagcaattcacaagttcaacctcgtacaatcgaggagattcaacgtttgaatcaaaaagctataaaatggctgatgaggcaggatccgaggctgaccatgagggcactcacagtactaagcgcggtcatgcaaagtcgcgcccagtgcgtgattgcgatgatgtcctacagacccacccaagcggaactcaatccggaatttttaacataaagctcccagggtctagcaagattttttcagtatattgcgatcaagagacctctcttggaggatggctactcatacagcagcgaatggacggatcactaaactttaatcggacttggcaagattataagaggggatttggaagtctcaacgatgaaggagaaggagaattctggcttgggaatgattatcttcatctgctaactcaaagagggagcgttctgagagtggaattagaagattgggctggaaacgaggcttatgcagagtaccatttcagagttggaagtgaagctgaaggttatgctctacaggtatcctcatatgagggaacggctggagatgcattgattgaaggatccgttgaagaaggtgctgaatacacgtcacacaataatatgcagttcagcacgtttgacagagatgcagatcaatgggaggaaaattgcgcggaagtgtacggaggaggatggtggtataataactgccaagctgctaatctaaacggaatttactatcctggaggaagttacgacccaagaaataactctccttatgaaatcgagaatggggtcgtgtgggtgtctttccgcggtgctgattattcattgagagctgtacgtatgaagatcagacctttagttactcag

SEQ ID NO: 11159 - DNA, 2598 bp, Artificial Sequence
  Description of Artificial Sequence: Synthetic coding sequence
atgttcagtatgcgaattgtttgtctcgttttatctgtggtcggaactgcgtggacagccgatagcggcgagggggactttttagcggaaggaggcggagtacgcgggccgagggtcgttgaacgccatcagtcggcgtgtaaagactccgactggccgttttgttctgatgaagactggaattataaatgtccgagcggctgtagaatgaaagggctgatcgacgaggttaaccaagattttacaaaccgtattaacaaactgaagaattctttatttgagtaccaaaaaaacaacaaggatagccattcgctcacaactaacattatggaaatcttaaggggagacttctcttcggccaacaaccgcgataacacctataatagagttagcgaagatctgcgctcgaggatagaagtattaaagcgaaaagtaatcgaaaaagtgcagcatatccaattattgcaaaagaacgttcgtgcacaacttgtcgacatgaagcggctggaggtcgacattgatataaagatccggagctgtcgtggaagctgctcacgcgcactcgccagagaggtagacctgaaagattacgaagatcaacaaaaacagttagagcaggtcatcgctaaagaccttttgcctagcagagatcgccagcatctaccgttgattaaaatgaagcccgttcctgatcttgtgccgggaaactttaaatcacaactgcagaaagtccctccagaatggaaagcacttactgatatgcctcaaatgcgtatggaattagagcgacctgggggaaatgagattacacgaggaggctctacttcatacgggacaggaagtgagacagaaagtccgagaaatccgtctagcgctggatcatggaattccggatcttctggcccgggctcaactggaaatagaaaccctgggagcagcggcacagggggcaccgctacatggaagccaggctcatctggcccgggctctacgggatcatggaattccggatcatccggcaccggaagcacaggaaaccagaatcctggttctcctcggcctgggtcaactgggacgtggaaccccggttcaagcgaacgagggtctgccggacactggacaagcgaatcatcagtgtctggctctacaggacaatggcattccgaatcaggatcatttaggccggatagcccgggcagcggtaacgcgcggcctaataatccggattgggggacctttgaagaggtttcaggtaacgtttcaccgggtacgcgcagagagtatcatacagaaaagttagtgacaagtaaaggagacaaagagcttcggacggggaaagagaaagtcacatcaggaagtacgaccacgacgaggaggtcgtgttctaaaactgtgacgaaaacagtcattgggcctgatgggcacaaggaggttacaaaggaagttgtcacgtctgaggacggctctgactgtccggaagcaatggatttaggcacactgtctggcattggtacgctggatggattcagacacagacatcctgatgaagcggcattcttcgacacggcatccacaggtaaaacgtttccgggattcttttcaccgatgctgggagaatttgtttcagagacagaatcacgtggctctgaaagcggaatctttacgaatacaaaagaatcctcctcacatcatccaggtatagccgagtttccgagccgcggcaaaagctcaagctattccaaacaatttacgtcatcaacgagctataacagaggggactcaacatttgagagcaaatcttataaaatggcggacgaggcgggtagcgaggcagaccacgagggtacgcatagcacgaaacgcggtcatgcgaagtctagaccagtcagagattgtgatgatgttttacagacacacccatccggaacccagagtggtatttttaatattaaactgccaggcagcagcaaaattttttctgtctattgcgatcaggagacctctttgggaggttggcttctaattcaacaaagaatggatggcagcttaaattttaacaggacatggcaagattataagaggggttttggtagccttaacgacgaaggtgaaggcgagttttggttgggcaatgactatcttcatttgctgacgcaaagaggcagtgtcctacgagttgaactggaggattgggctggcaatgaggcctatgccgaatatcattttcgcgtaggctcagaagccgaaggatatgcccttcaagtttcatcttatgagggcaccgcaggagacgcgttgattgaagggtctgtagaggaaggggcagaatacacatcgcataataatatgcagttctctacatttgatcgtgatgcagatcaatgggaagagaattgcgctgaggtttatggtggcggctggtggtacaacaattgccaagccgcaaatttgaatggaatctattatccgggtggatcctatgacccaagaaataatagcccatatgaaatcgaaaatggggtagtctgggtcagctttcgaggcgcagattattctcttcgggcagttaggatgaaaattcgccctttagtaacccaa

SEQ ID NO: 11160 - DNA, 2598 bp, Artificial Sequence
  Description of Artificial Sequence: Synthetic coding sequence
atgttctcaatgcggatcgtgtgtctggtgttgagtgtggtgggcacagcctggaccgctgatagtggcgagggcgattttctcgctgagggcggaggcgtgagaggcccaagggtcgttgaaaggcaccagtccgcctgcaaggactctgattggccattctgttcggacgaggactggaactacaagtgtcctagcggctgtcgaatgaagggactgatcgatgaggtgaaccaggatttcaccaaccggatcaacaaactgaagaatagcttattcgagtaccagaagaacaataaggactcccactcactcactaccaatattatggagatactccggggtgattttagttccgcgaataacagagacaacacctacaatcgggtgtcggaggacctgaggagtcgaatcgaagtgttaaagcgcaaggtgatagagaaagttcagcatattcaactgttgcagaagaatgtccgcgcgcaattggtggacatgaagcgacttgaggtggatatcgacattaagatcaggtcttgccgggggtcttgctctcgggcattggcccgagaggtggacctaaaagactatgaggatcaacagaagcagctggaacaagtcattgctaaggatttactgccgagcagggataggcagcatttacccctcatcaagatgaaacctgttcctgacctggtacccggtaacttcaagtcacagcttcaaaaggtgccccctgaatggaaggccttgacggacatgccacagatgagaatggagttggaacgaccaggtggcaacgagatcactaggggagggtcaacatcctatggcaccggcagcgagaccgaaagcccccgcaaccccagtagcgctgggtcttggaactctgggtcttcggggcctggatctaccggtaacaggaatcctggttcctccggcacgggcggcacagcaacatggaagcctgggagttccgggcccgggagtacaggcagctggaatagcggcagttcaggcaccggctctaccggtaaccagaaccccggatcaccacgcccaggatccacggggacttggaaccctggttccagcgaacgtggctccgctggacactggacctcggagtcttcagtgagcggttcaaccggacagtggcactcagagtctgggagctttaggccagattctccaggatctgggaatgcaaggcctaacaacccagattggggaacatttgaggaagtttccggcaacgtgtcgccaggcacgcgacgcgagtaccatactgaaaagctcgtgactagcaaaggcgacaaggagctcaggacaggcaaagaaaaggttacaagcggaagcaccacaacgacccggcggtcttgctctaaaactgtgactaaaacagttattggaccagatggacataaggaggttaccaaagaagttgtcacaagcgaggacggctccgactgtcccgaggctatggacctgggcaccctgagcggcataggtacattggacgggttccgccacaggcacccagacgaggccgcctttttcgacacggcatccaccgggaagaccttcccagggtttttcagcccaatgctgggtgaattcgtctctgagactgagagtagagggtccgaaagcggaatctttacgaacactaaagagtcaagctcccatcatccggggattgctgagtttccatcaagaggtaaatcttcctcatacagcaagcagtttacctcttcgacatcatacaaccgcggggatagcacctttgaatctaagtcttataagatggctgatgaggcaggctccgaagcagatcatgaaggcacacacagtaccaagagggggcacgctaaatcaagaccagtgagagattgcgatgacgtgctgcagacgcatccttcagggacacagagtggcatattcaatatcaagctccctggctcatccaaaatcttcagtgtctactgtgaccaagagacttccttaggtggttggttactgatccaacagagaatggatggcagtctcaattttaaccgcacctggcaagactataagaggggctttgggtcgctgaacgatgagggtgagggggaattttggctcggcaatgattatctccaccttctcacccaaaggggcagtgtgctgagagtggagctggaagattgggccggtaacgaagcgtatgccgagtaccattttcgagtgggctcagaagccgaaggatatgcgttacaggtgtcttcctacgaggggacagccggggacgccctcatcgagggatcggtggaagagggcgcggagtatacaagccacaataacatgcaattcagcacctttgatagagacgccgaccagtgggaagaaaactgtgctgaggtttacggaggtggatggtggtacaacaactgtcaggcagcgaacttaaatggcatctactatcctgggggctcttatgacccaaggaataactccccttatgaaattgaaaatggagtagtgtgggtgtcttttcgcggcgcggattactctttgagagctgtgcggatgaagatccgacctctcgtaactcag

SEQ ID NO: 11161 - DNA, 2598 bp, Artificial Sequence
  Description of Artificial Sequence: Synthetic coding sequence
atgttctccatgcggattgtctgcttagttctgtccgtagtgggaaccgcttggacagctgactctggtgaaggcgatttcttagcggagggcggcggcgtacgtggaccgcgggtggtggagagacatcaatcagcatgcaaggactcagactggcctttctgctcagatgaagattggaattacaaatgtcctagcgggtgcaggatgaaggggcttattgatgaggtgaatcaggacttcaccaaccggatcaataagctaaagaattctctgttcgagtatcaaaagaacaataaagactcacatagtttgacgacaaatatcatggaaattctcagaggcgacttctcatccgcaaataatcgggataacacatacaaccgcgtgtcagaagatttgcgctctaggattgaagtgcttaaacgtaaagtaatcgagaaagtgcagcatatccagctgctgcagaagaatgtgagagcccaactagtcgatatgaagaggctggaggtggatattgatatcaagattcggagttgtcggggttcttgcagcagagctctggctagggaggttgatctaaaagactacgaggaccagcaaaagcagctcgaacaggtgatcgcaaaggaccttttgccgagtcgggataggcagcatttacctttgatcaaaatgaagccggttcccgaccttgtgccggggaatttcaagtctcagctgcagaaggtcccaccagagtggaaagccctgaccgacatgccccagatgagaatggaactggaaaggcctggggggaacgagataaccagaggcggtagcacttcatacgggactggaagtgagacagagtcaccacgcaatccttcttccgccgggtcgtggaactctggatcctcaggacccggttccaccggaaatcgcaatccaggttcaagtggcaccggcggcactgctacctggaagcctggaagtagcggaccagggagcactgggtcctggaactccggaagctcaggaacaggttcaaccgggaaccagaatcctggaagtcccaggccgggttcaactggcacttggaatccgggctcctccgagcggggttcagccggacattggacttccgagagcagcgtaagtggttctacagggcagtggcatagcgagtccggatcattccgacccgatagccccggaagcggaaacgctcgcccaaacaaccctgattggggtacattcgaggaagtctcgggtaacgtgtcacccggaacacggcgtgaataccacacggagaaactagtaacgtcaaagggagacaaagagctcagaactggtaaggagaaagtcacgtcgggctctactacaacgactcgaagatcttgctccaaaaccgtgaccaaaactgtgatagggccggacggacacaaggaagtgactaaggaggtagtgacctccgaggacggatctgattgccccgaggcaatggatctgggtacattaagcggcatcgggacactggatgggtttcgacatagacatcccgacgaggctgcctttttcgacactgcgagcactggaaagacctttccggggtttttttccccaatgttgggtgagttcgtcagtgagacggagagtcggggttctgagtcaggtatctttacaaataccaaggagtcctcctcccaccaccccggcatcgccgaattccccagcaggggaaagagctccagctattcaaaacagttcacatccagtacttcctacaaccggggtgattctacttttgaaagcaaatcatacaaaatggccgatgaagccggcagtgaggccgaccacgagggtactcattctaccaaacgcggtcacgctaaaagtaggccagtgcgcgattgcgatgacgtcctgcagacgcacccctcaggaacccaatccggcatctttaacatcaagcttccgggcagtagcaagatcttctctgtttactgcgatcaggagacatctctgggagggtggctactgatccagcaaagaatggacgggtctctcaattttaataggacttggcaggattacaaacgcggctttggttcactcaatgatgagggggagggggagttttggttgggaaacgactatcttcacctgttgacccagaggggatccgtgcttcgggttgaactcgaagactgggcgggaaacgaggcttatgccgagtaccactttcgggtgggttctgaagccgagggctacgctttgcaggtctcaagttacgaaggaacagccggtgatgcactaattgaggggtcggtcgaagagggagctgagtatacaagccacaacaatatgcagttcagcacgtttgatcgggatgccgatcagtgggaggaaaattgtgccgaggtctacgggggaggttggtggtataataactgtcaggcggctaacttgaacggaatctactacccagggggcagctatgatccgaggaacaatagcccatatgaaattgagaatggcgtcgtgtgggtctcctttcgcggtgcagactacagcctgcgtgcagtcagaatgaagattagacctcttgtaactcag

SEQ ID NO: 11162 - DNA, 2598 bp, Artificial Sequence
  Description of Artificial Sequence: Synthetic coding sequence
atgttctcaatgcgcattgtgtgcctagttctgagcgtagttggtacggcttggacggccgactccggggagggcgactttctcgcggaaggcggcggcgtccgtggcccccgtgtggtggagcgacatcagagtgcctgtaaggacagcgattggccgttttgctcagatgaggactggaattacaaatgtccatcagggtgcagaatgaaaggcctgattgacgaggtcaatcaggacttcacaaatagaattaacaaactcaagaatagtctgtttgaatatcaaaagaataacaaggattcccactctctcactacaaacattatggaaatcctcaggggcgattttagtagcgctaacaaccgggacaacacctacaaccgtgtcagtgaggatctcagatctaggattgaggttttgaagaggaaggtgattgaaaaagtgcagcacatccaattgttgcagaagaatgtacgggcacaattagtggacatgaagagactggaggtggacattgatatcaagattaggtcatgtaggggtagctgtagccgggctctggctagagaagtggatctgaaggactatgaagatcaacagaagcagttggaacaagtcatagcaaaggaccttctgccatcacgagaccgtcagcatctcccactgattaagatgaaacctgtccctgatctcgtgcctggcaactttaagtcacagctgcaaaaagtgcccccagaatggaaggccctaactgatatgccccagatgagaatggagctcgagagacctggaggtaatgaaataactagggggggcagcacgagttacgggactgggagcgagacagaatcccccaggaatccctcttctgcaggttcctggaacagcggtagctctggacctggatctactggcaatcgtaacccggggagctcagggaccggggggactgccacatggaagcccgggtcgagcggacctgggtcgactgggtcttggaactccgggagctctggaaccgggagtacaggaaaccagaaccccggcagcccccggccaggaagcactggcacttggaacccgggctcaagcgagcgggggtctgcgggacactggacttcagaatcttccgtttccggatccactgggcaatggcacagtgaatccggaagcttcagacctgactcgcctggcagtggaaacgctagacctaataatccggattgggggacattcgaggaggtgagtggcaatgttagtcccggcaccaggcgggaataccacaccgagaaactagtaacctctaaaggcgacaaggaattaagaacgggcaaagaaaaggtaaccagtggcagtactacaactacacggagaagttgtagcaaaacagttactaagaccgtgataggaccggacgggcacaaagaagtgactaaggaggtcgtcacttccgaggatggctctgattgcccagaagcgatggacctggggacactttccggaatcggcacactggatgggtttaggcaccggcacccagacgaggccgccttctttgacacggcgtcgacgggcaagacatttcccggattcttctccccaatgctgggggagttcgtgtcagaaacggaatcccgcggatcagagtcggggatcttcaccaacactaaagagtccagcagccaccaccccggaattgctgagttcccctctcgaggtaagtcttcatcatactctaaacagttcacatctagtaccagttacaatcgaggcgattccacttttgaaagtaagtcatacaagatggcagacgaagccggctcagaggcagaccatgaggggacccatagcaccaaaaggggccatgccaagtcacgaccagttcgggattgtgacgatgtgttacagacgcatccatctggcacacagagcggcatctttaatataaaattacctgggtcatctaagatctttagtgtctactgtgatcaggaaacttctcttggcggttggttgttaatccagcaacgtatggatggcagcctgaactttaatcgaacgtggcaggactacaaaagagggttcggttctctaaacgacgaaggcgagggcgagttttggctggggaacgattatcttcatctgcttacacagagagggtccgtgctgcgcgtagagctggaagactgggcgggtaacgaggcctacgcagaataccattttagggtgggctctgaggccgagggttatgccctgcaggtgagctcgtacgagggcactgccggcgatgcactcatcgagggctcggtggaggaaggggcagaatatacaagtcataacaacatgcagttttccacgttcgaccgagatgcagaccagtgggaggagaactgcgctgaggtctacggaggaggctggtggtataacaattgccaggccgcgaacctgaatgggatctactacccaggaggatcctatgatcccagaaacaacagtccttacgaaatcgagaacggtgtggtctgggtgtcatttcgaggagccgattacagcctgagggccgtcagaatgaagattcgcccactcgtaacacag

SEQ ID NO: 11163 - DNA, 2598 bp, Artificial Sequence
  Description of Artificial Sequence: Synthetic coding sequence
atgttttcaatgagaatcgtgtgtctcgtcctctccgttgtaggtactgcatggaccgcagactcaggcgaaggtgacttcttagctgaaggcggaggcgtgcggggacccagggtggttgaacgccaccaatctgcttgtaaagacagcgactggcctttttgttcagatgaagattggaactataaatgtccgtctggctgcaggatgaagggcctgatagatgaggttaatcaagactttacgaaccgtatcaacaaactgaagaactccctgttcgagtaccaaaaaaataataaagactctcatagccttaccacaaacattatggaaattctccggggcgactttagctctgctaacaaccgagacaatacgtataaccgagtcagtgaggatctgaggagtaggatcgaggtgctgaagaggaaggtaattgagaaggtacaacatatccagctgctccagaaaaacgtgagggcccaattggtggatatgaagaggctggaagtggacattgacatcaagatacgcagttgccgcggatcctgctctcgggcgctagccagagaggttgatttgaaagattatgaagaccagcagaagcagttagaacaagttatcgcaaaggacctccttccgagccgcgatcgtcagcacctgcctttaattaagatgaaacccgtgcccgacttggtccctggtaatttcaaatcccagctgcagaaggtgcccccagaatggaaggcactgaccgacatgcctcaaatgcgcatggagctcgagaggccagggggcaacgaaattacaagagggggcagtacatcttacgggacaggttcagagactgaaagccctcggaatcctagctccgccggttcctggaactcgggtagctccggccccgggagtactgggaatagaaacccgggttctagcggcacaggggggacagccacatggaagcctggaagcagtggccccgggagcaccggaagctggaattctggctccagcggtaccggctccacgggtaatcagaatcctggatcccccagaccaggctccactgggacttggaaccctggatcttccgagcggggatccgccggccattggacatcagagagctctgtgtcaggctcgacaggccaatggcactcagaatcgggctcctttcggccagattctccagggtcggggaacgcacgtcctaacaatcccgattgggggacatttgaagaagtcagtggaaatgtgagtccaggcacccgaagagagtaccatactgagaaattggttacctctaaaggggataaggagctccggacaggcaaggagaaggtaacatccggcagcactacgaccactaggcggtcttgtagcaaaacagtaacgaagaccgtcataggtccggatggtcacaaggaggttacaaaagaagttgtgacttcagaggatggtagcgactgcccggaggcaatggatctaggcacacttagcgggattggaaccctcgacggattcaggcaccggcaccctgacgaggcggctttcttcgataccgccagtaccgggaaaaccttccctgggtttttttcccccatgctgggcgagtttgtcagcgagaccgagagtcgcgggagtgagtccggaatctttacaaacaccaaggagtcgtcttcccatcatcctggtatcgctgagttccccagtagagggaagagctcaagctactccaagcagttcacttcctccacttcatacaaccgcggagattctacttttgagagtaaatcttacaagatggccgacgaggccggttccgaagcagatcatgagggcacccatagtacgaagagaggccacgcgaaaagccgccccgtgagagattgcgacgatgtgttgcagacccatccctctggtactcagtctggaatcttcaatatcaagttgccgggctcttccaaaatcttctctgtgtattgtgaccaggaaacttcactaggtggttggctgctgattcaacaacgtatggacggttccctaaactttaatcggacctggcaggactacaagcgcgggtttggctccctgaatgatgaaggagaaggcgagttctggctcgggaatgactacttgcacctgcttactcagagaggtagcgtcctgagggtcgaactggaagattgggctggaaacgaggcttacgccgagtatcacttccgcgtggggagcgaagccgaaggatacgccctccaagtgagctcctatgaaggaactgccggtgatgccttgattgaagggtcagtggaagagggagcagagtacacaagccacaacaacatgcaattctcaacattcgacagagatgccgaccagtgggaagaaaactgcgctgaggtatacggtggaggctggtggtacaacaactgccaggccgcaaatctgaatggaatctattaccccggcggctcctacgaccctcgaaacaacagcccttacgaaatcgaaaatggggtggtctgggtcagtttcaggggggcggactacagccttagagccgttcgcatgaagattcggcccttagtgacacaa

SEQ ID NO: 11164 - DNA, 2598 bp, Artificial Sequence
  Description of Artificial Sequence: Synthetic coding sequence
atgttttctatgcggatcgtgtgcctcgtcttgtcggtagtgggaaccgcttggaccgccgactccggggagggagacttcctcgccgagggcggcggcgttaggggcccaagggtagttgagcgtcatcaatccgcatgcaaggactctgactggcccttttgctctgatgaggactggaattacaaatgtccttcaggatgccgcatgaaagggcttatcgacgaggtcaaccaggacttcacaaataggattaataagctgaagaactcactgttcgaatatcagaaaaacaataaggactcccattctctgaccactaacatcatggaaattctgagaggcgacttttccagtgctaacaatagagacaatacatataacagggtgtcagaggatctgcgtagcaggattgaagtccttaagcgcaaagtaatcgagaaggtgcaacatatccaactgttgcaaaagaatgtgagagcgcaactggtagacatgaagcgactggaggtggatatcgacatcaaaatcaggtcatgcagaggctcctgttctagggcattagctagggaggtggacctgaaagactacgaggatcaacagaaacagctggaacaggttatcgccaaggatctactcccgtcaagagaccgacagcacctgcctctgatcaagatgaagccggtaccagacctcgtccctggcaattttaaatcacagctccagaaggtaccgcccgaatggaaggccctgaccgatatgccgcagatgcgaatggaacttgaaaggccaggaggcaatgagataacaaggggcggctccacaagttatgggacagggtccgagacagaatctccaagaaacccctcaagtgcaggatcttggaactccggctcatctggcccaggctctacagggaatcgaaaccccggctcctcgggcacaggcggaacggccacatggaagcccggtagttccggccccggctccaccggctcctggaatagcggatctagcggaaccggctcgacgggtaatcagaacccgggcagtcctagacctggctctaccggtacctggaaccccggatcgtcagaacgaggctccgctggccattggactagcgaaagctctgtgtcgggcagcacgggccaatggcactctgaaagcggttcctttaggccagattcaccaggatctggaaatgcaaggcccaacaacccagactggggcacatttgaggaagtctccggaaatgtgtcgcctgggaccaggagggagtatcacacggaaaaactggtgacatctaaaggagataaggaattgagaacgggaaaagaaaaggttacctctggatccacaaccaccactaggagatcctgtagcaagaccgtcactaaaaccgttataggccctgacggtcataaagaagtgaccaaggaagtcgtcacctctgaggatggcagtgattgccccgaggccatggatctcggcacgctgtcgggaataggtactctggatggttttagacaccgccaccccgacgaagccgcattttttgacaccgcgtccacagggaaaaccttccctggtttcttcagccccatgctcggggagtttgtgtcagaaactgagtctagaggatcggaaagcgggatcttcactaacaccaaggagtccagctcccaccacccggggattgccgaatttccatccaggggcaaatctagctcctactccaaacaattcacctcttccacctcctacaaccgaggagactcaacttttgaaagtaagtcctacaaaatggccgatgaagccggaagcgaagctgatcacgaaggaacccacagcacaaagcgaggccacgccaagagcaggccggttagagattgcgatgatgtactgcagacacacccttcgggaacgcagtccggaatcttcaatatcaagctgcctggctcttctaaaatcttttccgtgtactgcgatcaggaaacttctttgggaggctggctgttgattcagcagcgaatggatggttctcttaactttaatcgaacctggcaggactataagcgaggattcggctccttaaatgacgagggggaaggggaattctggttaggtaacgactacctgcacctcctaactcagagaggctcagtgctgagggttgagttggaggactgggcagggaacgaggcgtatgcagagtaccatttccgcgtcggctctgaagccgagggctatgcgctgcaggtaagttcttacgaaggcacagcaggtgacgcattgatcgagggaagcgttgaagaaggggctgagtatacttcacacaataacatgcaattctctacctttgatagggacgcagaccagtgggaagagaattgcgccgaggtgtatggtgggggctggtggtacaacaactgccaggcagccaatttgaacgggatttactatcccggtggatcttacgatccaagaaacaattctccatacgaaatcgagaatggcgtggtgtgggtttcattccgtggagcggattattcgctgcgggctgtcagaatgaagattcgcccactggtgacacag

SEQ ID NO: 11165 - DNA, 2598 bp, Artificial Sequence
  Description of Artificial Sequence: Synthetic coding sequence
atgttttcaatgagaatagtttgcctggtgctgagtgttgtcggcaccgcctggactgcagacagcggcgagggtgatttcctggcagaggggggcggggtccgtggccctagagttgttgaacggcatcaatcagcctgcaaggattctgactggcctttttgctctgatgaagattggaactataaatgcccaagcgggtgccgcatgaaaggcttaattgacgaggttaaccaagacttcacaaaccggataaacaagctgaagaattctctctttgagtaccagaagaacaataaagactctcattctctgaccaccaatattatggaaatcttgaggggagatttcagtagtgcaaacaatcgcgataatacatacaacagagtctcagaagacttgaggtccagaattgaagttctgaaacggaaagttatagagaaagtgcagcacatccagctgttgcaaaaaaacgtgcgagcccaacttgtggatatgaaacgtttggaagtggacattgatattaaaatcagatcatgccgcggaagctgctcacgagcactggcgagagaagtcgacctcaaagattatgaggatcaacagaaacagctggagcaggtgattgccaaggatttactaccctcaagggacaggcagcatctaccactaattaaaatgaaacctgtcccagacttagtgcccggcaatttcaaatcccagcttcagaaggtgcctccagagtggaaagccctgaccgacatgccccagatgcggatggagttggaacggccaggggggaatgagatcaccaggggcggttctacaagctatggcactggctctgaaacagagtcgccccgcaaccctagtagtgcgggatcttggaatagcggaagctctggccccggctctaccggcaatcggaaccctggcagcagcggcacgggcggaaccgcaacctggaagcccggctccagcggtcccgggagtactgggagttggaactctggaagcagcggtacaggttctacaggcaatcagaacccaggctcgccgaggccaggctccactggaacttggaacccaggctcctcagagcgcggttcagccggccactggacctccgagagcagcgttagcggcagtacaggacaatggcatagcgagtccggtagcttcaggccagactcccccggctccggtaatgcgcgcccaaataaccctgactgggggacgtttgaggaagtaagtggtaatgtgagccctggaacccggcgcgagtaccatactgagaagctagtgacatctaagggcgacaaggagttgaggaccggaaaggagaaagttacctccggtagcactacgaccacccgccgatcctgcagtaaaaccgtcactaaaaccgtgatcgggccggacgggcataaggaggtgactaaggaggtggtaacctctgaggatggctcggattgtccagaagccatggacctaggcacactgtcgggcatcggcaccttggacggatttcggcacagacaccctgatgaggccgcctttttcgacacagcctccaccggaaagacgtttcccggtttcttttcacctatgcttggcgagtttgtgtccgaaacagagtctcggggaagcgagtccggcatcttcacgaacacaaaggagtcctcctcacaccaccccggaatcgctgagtttcctagtagaggcaagtcaagttcctacagtaaacaatttaccagttccacatcatacaaccgcggtgactccactttcgagtctaaaagttataagatggctgatgaggccggttccgaggctgatcatgaaggaacacactctacaaagcgtggccacgctaagtcgcggccagttagggactgtgacgacgtgctccagacacacccttccgggacccaaagcggcattttcaacatcaaattgccaggaagctctaaaatctttagcgtgtactgcgaccaggaaacgtcactcggcggctggcttctgatccaacagcggatggacggctctcttaatttcaatcgaacatggcaggattacaagcgggggttcgggtctctgaatgatgaaggagaaggcgagttttggctgggcaacgattatcttcatcttctgacccagcgaggaagcgtcctgcgagtggagctggaggactgggctggaaatgaggcctatgcggaataccacttccgagtcggatccgaagccgagggctatgccctgcaggtcagtagctacgagggaaccgccggggatgcccttatcgagggaagcgtggaagagggggcggagtatacatctcataacaatatgcagttttctacatttgaccgcgatgcagaccagtgggaggagaactgtgctgaagtgtacggcggtgggtggtggtataataactgccaagcagccaacctgaacggtatctattatccaggaggctcctatgacccgcgcaacaattcgccatacgagatagagaatggggtggtgtgggtaagttttagaggtgctgattatagcttgagggccgttcgcatgaaaattagacccttagtgactcaa

SEQ ID NO: 11166 - DNA, 2598 bp, Artificial Sequence
  Description of Artificial Sequence: Synthetic coding sequence
atgttcagcatgcgaatcgtgtgtctagtgctgagtgtggtcggaacggcctggactgctgatagtggcgagggcgacttcttggcggaggggggcggcgtgaggggaccgcgcgtagtggagcgacaccagtcagcatgcaaagactccgactggcctttctgtagcgacgaggactggaactacaaatgcccttcaggctgccgtatgaaagggctcatagacgaagtaaaccaggacttcaccaaccgcatcaacaaacttaagaactcactttttgagtaccagaaaaacaataaagacagccacagtctaaccaccaatattatggaaattctgagaggtgacttctccagcgccaataaccgcgataacacctataatcgcgtctctgaagacctccgaagtaggatcgaggtgctgaaaagaaaggtgatcgagaaggtgcagcatatccagctgcttcagaagaacgtgcgggcccagctcgttgatatgaaacgcctggaggtcgacattgatatcaaaatcaggagctgcagggggagttgctctagagctctggccagagaagtcgacctcaaagactatgaggaccagcagaaacagctggagcaggtaatcgccaaagacctcctgccctccagggaccggcagcacctaccacttatcaagatgaaaccggttccggacttagtgccagggaatttcaagagtcaacttcagaaagtgcccccagagtggaaggccttgactgacatgccacagatgagaatggaactagagagacccggcggaaacgagataacaagaggcggttctactagttacggcacagggtccgagaccgaaagtccacgtaacccgagtagcgccggtagctggaattctgggtcctcggggccaggttctactggcaatcggaaccctggctcttctggtactggcggaacagctacatggaagccaggctcttccggccccggctccactgggtcatggaactccgggtccagtggcactgggtccactggcaatcagaacccaggctcaccaagacctggctccacaggaacctggaaccctgggagctctgaaaggggatccgctggtcactggacatccgagtcaagcgtgtctggatctactggacagtggcattccgaaagtgggagttttcgccccgactctcctggtagtggaaacgcacgtccaaataatccagactggggaacctttgaagaggtttccggcaatgtctcacctgggactagaagggaatatcacaccgagaagcttgtcacgtccaagggtgataaagagctgaggaccggtaaggaaaaggtgacaagcggcagtacaaccactaccaggaggtcttgttccaagaccgttactaagacagtaattgggccagatggacacaaagaggtcactaaagaggtcgtcacttcggaagacgggagtgactgtcccgaagcgatggacttggggactctgagtggcataggaacattggatggttttcggcatcgacacccagatgaagccgccttctttgacactgcgtcaacgggtaaaacgtttcctggattcttctcacctatgctcggagagtttgtaagcgaaacagagagtcgggggtccgaatctggcattttcactaatacaaaagaatcgagctcccatcaccccggaattgccgagtttcctagtagaggcaagagcagttcttactccaagcaattcactagtagtacttcatacaacaggggcgattccacattcgaatccaagtcctataaaatggccgatgaggctgggagtgaagccgaccacgagggtacccacagcactaagagaggccacgctaagagcagacccgtgcgggactgtgatgatgtgcttcagacacacccatctggaactcagagcggaatcttcaatatcaagctgccggggagttcaaagatatttagtgtctattgtgaccaagagacctcactgggtgggtggctcctcatccagcaacgaatggacggaagtttgaacttcaacaggacctggcaggactataagagggggttcgggtcactgaatgacgagggggaaggggagttctggctgggtaacgactatctgcatctcctcactcagagaggtagcgtgctgagggtggaactcgaggattgggccggcaatgaagcttacgccgaatatcacttccgggtggggtctgaggcggaggggtatgctttacaggtgtcttcttatgagggaaccgccggagatgccctcatagaaggatcagtggaggagggtgccgaatacacgtcccacaacaatatgcaatttagcacgttcgaccgcgacgccgaccagtgggaggagaattgcgccgaggtctacggcggtggatggtggtacaacaattgccaggcagcaaatctgaatggaatatactacccaggcggctcatatgatcctcgaaacaacagcccttatgagatagagaatggcgtcgtgtgggtgtccttcagaggagctgactattccctgagggctgtccggatgaaaatcaggcccttggttactcaa

SEQ ID NO: 11167 - DNA, 2598 bp, Artificial Sequence
  Description of Artificial Sequence: Synthetic coding sequence
atgttctcaatgcgaatcgtgtgcctggtcctatcggtagtgggaacagcctggacagccgattctggggaaggagatttcctcgctgagggagggggggtaagagggcctcgggtagttgaacggcatcagtctgcttgtaaagattcagattggccattttgcagtgatgaagattggaactataagtgtccctcaggatgtaggatgaaagggcttatagatgaagtcaatcaggactttactaaccgaataaacaaactcaaaaacagtctgtttgaataccagaaaaataataaagattcccatagtctcacaactaacatcatggaaatattacggggggatttttcatcagcaaacaacagggataacacgtataacagggtgtctgaagatctgagatctcggatagaagtgctgaaacgcaaagtgatagaaaaagtacaacatattcagctgcttcagaagaacgtgcgggcccagctagtcgatatgaaaaggctagaagttgacattgatataaaaatccggtcgtgtcgcgggagttgctctagggccttagcacgggaagtcgatctcaaagattacgaagatcagcagaaacagctagagcaggtcatagcaaaggatttactcccttcacgagatagacagcacctacccctgattaagatgaagccagtgcctgatctcgtgcctggaaattttaaatctcaacttcagaaggtacccccagaatggaaagccttgactgatatgccacagatgcggatggagctggaaagacccgggggaaacgagataactcgcggagggtccacatcctatggaacagggtcggaaacagagagtccacgaaatccctcatccgcaggatcatggaattctgggtcctccggaccaggatccacagggaatcgaaaccctgggagttcagggactggggggacagccacttggaaaccaggatcttccgggcctggatccacaggaagttggaactccgggagttctgggactgggtctactgggaatcagaaccctgggtccccccgacctggatccacaggaacatggaaccccggaagttctgaaaggggaagtgcgggacactggacttccgagtcatctgttagtggatcaacaggacagtggcactctgaatcaggatctttcagaccagattcccccgggtccggaaatgcccgacccaacaatcccgattggggaacatttgaggaagtctcggggaatgtgtcacctggaacaaggcgcgaatatcacacagaaaaactagtcactagtaaaggggataaagagctacgcactgggaaagagaaagtcacttctggatctacaacaactactaggcggagttgttctaaaacagtgactaagactgtaattggaccagatgggcacaaagaagtgacaaaagaagttgttacatccgaagacgggtccgattgtcctgaagctatggatctcggaactctctcgggaatagggactttggatgggttcagacatcgacacccagatgaagccgcgttctttgatacagcatcaacagggaaaacattccctgggttcttttcccctatgctgggggaattcgtgtcagaaactgaatctcggggatctgaatcagggatatttactaatactaaagaatccagttcccaccaccctggaatagctgagttcccctctcgcgggaaaagtagtagttattcgaaacagtttacatcctcaacttcatataataggggagatagtacatttgagagtaaatcttataagatggctgatgaagctggatctgaagctgatcacgaaggaactcattcgactaaacggggacatgctaaatcccgcccagttcgggattgtgatgatgtcctccagacacacccatccgggactcagtccgggatctttaacatcaaactgcccgggtcctcgaaaatattttccgtatattgcgatcaggaaacttctttaggagggtggttacttatacagcagaggatggatgggtcgctgaattttaaccgaacatggcaggattacaaaaggggattcgggtccctcaacgatgaaggagaaggagaattttggttaggaaacgattatctgcaccttctgactcagcgggggtctgtcctcagagtggagcttgaagattgggccggaaatgaagcctatgcagaatatcatttccgagtcgggtcagaagctgaggggtatgcactacaggtatcaagttacgagggaacagcaggggatgcccttattgaggggtctgttgaagaaggggctgaatatacatcccacaataatatgcagttttccacttttgatcgggatgcagatcagtgggaagagaactgcgcagaagtttacgggggagggtggtggtataacaactgccaggcggccaatctaaacgggatctattacccagggggatcttacgatccacggaataattcaccttatgaaatcgagaatggggtggtatgggtgtctttcaggggagccgactattccctccgcgccgtacgaatgaaaataaggccactggtgacacag

SEQ ID NO: 11168 - DNA, 2598 bp, Artificial Sequence
  Description of Artificial Sequence: Synthetic coding sequence
atgttcagtatgcgtatcgtctgtctagtgctctctgtggtgggaactgcatggaccgcagattcaggcgaaggagactttttagctgagggaggaggcgtgaggggacctcgggtcgtagaaaggcaccagagcgcatgcaaagactctgactggccattttgcagtgatgaagactggaattataagtgcccatcagggtgccggatgaagggactaattgacgaagtcaatcaggattttacgaatcgaataaacaagttgaagaacagcctgttcgagtaccagaaaaacaataaagacagtcatagcctgaccactaacatcatggagattttgcgtggagatttttcctccgcaaataacagggacaacacatacaacagggtttccgaagatctgcgctcaaggatagaggtgctgaagcgcaaggtcatcgagaaggtccagcacatccagctactccaaaagaacgtcagggcacaactggtggacatgaaaaggttggaggtcgatattgatataaaaatccgctcatgcagaggctcttgctcaagagctctggcccgtgaggttgatctcaaggattacgaggaccagcagaagcagttagaacaggtcatcgctaaagacttgctaccaagccgtgaccgccagcacctgccactgataaagatgaagcctgtccccgaccttgtaccagggaattttaagtcccagcttcagaaagtgccgcccgaatggaaagcattgactgatatgcctcagatgcgtatggagctggaacggccgggtggtaacgagattaccagaggaggctccacctcttatggcacaggatccgaaacagagtccccaaggaatcctagcagcgcagggtcctggaactctggctctagcggcccgggttccacaggaaatcgtaacccagggtcctccggaactggcggcacggcaacctggaagcccggctctagcgggcccggatctactggttcctggaactctggcagctccggcactggaagcaccggcaaccagaaccctggcagccccagacccggctccaccgggacctggaatccaggtagttccgagcgaggcagtgctggccactggacatccgaatctagcgtctccggctcaaccggtcagtggcactccgagtcaggcagtttccggcctgacagcccaggctcagggaacgctcggccaaataaccctgattggggaacgtttgaggaggtctccgggaatgttagccctggcacacggcgcgagtatcatacagagaaactcgtcacgtctaaaggcgataaagaacttcggacgggaaaggagaaggttacgtctggctcaactactaccaccagacgtagctgttccaagaccgttactaagaccgtgattggacctgatggtcacaaggaagtcaccaaagaagtggtgacctcagaggatgggtccgactgcccagaggcaatggatctcggaaccctgagcggaattgggacgctagacggctttcgtcaccggcacccagacgaggctgcgttttttgacactgccagcacaggaaaaactttccccggcttctttagccccatgctgggagagtttgtgtcagaaacggagtcgagggggtcagaatcaggcatcttcacaaacactaaggaatcctcatctcatcatcccgggattgctgaattccctagccgaggcaagtcttcctcctattccaaacagttcacgtcctcaactagttataatcgtggtgacagtacattcgaaagcaagtcctacaaaatggcagacgaggcgggctcagaggcagaccacgagggcacccacagtacaaaaagaggtcacgctaaatcacggcccgttagggactgtgacgacgtactgcagacccacccaagcggcacccaaagtgggatcttcaacattaagctgccaggtagttccaagattttttcagtatattgtgatcaggaaacctccctgggagggtggctgctaattcagcagcggatggatggtagtttgaatttcaaccgtacttggcaggattacaaacgagggtttgggagtctaaacgatgaaggcgaaggagagttttggctggggaacgattacctgcacctgctgacacagagaggatctgtgctgagggtggagcttgaggattgggctgggaatgaagcttatgccgagtaccatttcagagtgggcagcgaagccgagggctatgctttacaagtgagttcttatgaggggactgctggggatgcactgatcgaaggctcagtcgaggaaggcgcagagtacacctctcacaacaacatgcagttcagcacttttgacagggacgcagaccagtgggaggagaattgtgctgaggtgtacggcggcggctggtggtacaataattgccaggctgcgaatctgaatggtatatattatcccggcggaagctatgatcctcgaaataacagtccgtatgagatagagaacggagtggtttgggtgtctttccggggcgctgattattctctgagagcagtccgaatgaaaatcaggcctctcgtcacacag

SEQ ID NO: 11169 - DNA, 2598 bp, Artificial Sequence
  Description of Artificial Sequence: Synthetic coding sequence
atgttcagcatgaggatcgtgtgcctcgtcctgagcgtggtgggaacagcttggacagctgacagcggggaaggagactttttagctgaaggaggcggcgtaaggggtcctagggtagtggagaggcatcaatcggcatgcaaggattcagactggcccttctgcagtgatgaggactggaactacaagtgccccagcggctgtcgcatgaaagggctgatcgacgaagtgaatcaagactttacaaatcgtatcaataagctgaagaactcgctgtttgagtatcaaaagaataacaaagatagtcactcccttaccactaacatcatggagatcctccgcggtgacttttcgagtgcaaataaccgagacaatacatacaaccgtgtgtccgaggatctcagatcacggattgaggtattgaagcgcaaggtcatcgagaaagtacagcatatccagttattgcagaaaaacgtgcgcgcccagctggtcgatatgaaacgacttgaagttgacatagacataaagattagatcttgccgcggctcctgtagtcgggccctcgcccgcgaggtggatttaaaagactacgaagaccagcagaagcagctggaacaagttatcgccaaggatcttctgccaagtcgagataggcagcacctccctctgattaaaatgaagcccgtgcctgatcttgtgccaggtaatttcaaaagccaactccagaaagttcctccagagtggaaagcattgactgacatgccacagatgcgaatggagctggagcgacccggaggaaacgagataaccaggggtggtagtacgtcctatggcaccggcagcgagacagaaagcccgcgcaatccctcttcagccggctcatggaacagtggcagtagcggacccggctccactggaaaccgtaaccccgggagttccggcaccggcgggacagctacatggaagccaggatcttccggacccggctccaccgggtcctggaattccgggtcatcggggactggctcgacagggaaccagaatcccggatcccctcgtcccgggtctaccggaacatggaacccaggctcttcggagcgcggaagtgcaggtcactggacaagcgagagtagtgtgagcgggagtacaggtcagtggcattccgaaagcggctcttttcgccccgattccccaggctcaggcaacgcccgtccgaacaatccagactggggcacgttcgaggaagtcagcgggaatgtgtccccagggacccgcagagaataccacacagagaagctggtgaccagcaaaggggacaaagagcttcgcacaggcaaagaaaaagtgacgagtgggtcaacgacgacgaccaggcggagttgtagcaagacagtcaccaaaaccgtgataggacctgatggtcataaagaggtcacaaaagaagtagtcaccagtgaggatggaagtgactgccctgaggcaatggatctcggtaccttatcaggaattggtaccctggatggcttcagacaccggcatcccgatgaagccgctttctttgacacagcctcaaccggaaagactttccctggttttttttctcctatgctgggcgaattcgtctccgagacagagtcaagaggttccgaatccggaatatttacaaacaccaaagagtccagtagtcatcatccgggaattgcagagtttccgtctcgcggtaagtcgagttcgtactcaaagcagttcactagtagtacctcatataaccgtggcgactccacatttgagtcaaaatcttacaaaatggctgacgaggccgggtcggaagctgaccatgaggggacccattcgacaaaaagaggacatgctaagtctcgaccagtgagggattgcgacgacgtgcttcagacgcacccttccggaacccagagtggcatcttcaacataaagctgccagggtcctcaaaaatcttctctgtgtactgcgatcaggaaacgtcattgggcggctggttgctcatccagcagaggatggatgggtccctgaactttaaccgcacttggcaggactataagcggggctttggctctctaaacgatgaaggggagggagagttctggctagggaacgattatctccatctccttactcagcgcgggtcagtcttgcgagttgaactcgaggactgggccggcaatgaggcgtatgccgagtatcattttcgggtcggctcagaagctgaaggctacgccttacaggtgagcagctatgagggaaccgccggagatgccctaattgaaggctcagtagaggaaggggccgaatacacatctcataacaacatgcagttttcaacctttgacagggacgccgaccagtgggaagagaattgtgccgaagtctacggagggggatggtggtataataattgtcaagccgcaaatctgaacggaatatattatccgggtggttcctatgatcctcgcaacaattccccctacgagatcgaaaacggagtggtgtgggtatcatttcgtggagccgactactcattgagagcagttcggatgaaaattcggcccctagtgacccag

SEQ ID NO: 11170 - DNA, 2598 bp, Artificial Sequence
  Description of Artificial Sequence: Synthetic coding sequence
atgttcagcatgcgcatcgtatgtctagtgctgtcggtcgtcggcactgcttggaccgccgactcaggtgaaggagattttctggcggagggcggcggcgttagggggccacgtgttgtcgaacgacaccagtccgcctgcaaagattcagactggcccttctgcagcgatgaggattggaattacaagtgccctagtggctgtcggatgaaagggctcattgacgaggtgaatcaggattttaccaaccggatcaataagctaaagaattctttatttgaataccagaaaaacaataaagattcgcacagtttgaccactaacattatggaaattctgcgtggcgatttttcaagtgccaataatcgagataacacgtacaaccgagttagcgaggatttacgatccagaattgaggtgcttaaacggaaggtcatcgagaaagttcagcacatccagctcctgcagaaaaatgtgcgtgcccaactggttgacatgaagaggctggaggtcgatattgatatcaagatccgctcctgcaggggctcttgctctagagcactcgcccgcgaggttgacctgaaagactacgaagatcaacagaaacaactagagcaggtgatcgcaaaggatctactcccgtccagagatcgacagcacctgcccctgattaaaatgaaaccagttccggatcttgtccccggcaacttcaaatcccagctacagaaggtgcccccggagtggaaggcactgaccgacatgccccaaatgaggatggagttggagcgcccagggggaaacgagatcacacgtggtggcagtacctcctatggaactggatccgagaccgaatctcccagaaacccgtcctctgctggcagctggaattcgggctcaagcggacctggttccactgggaaccgcaaccctggtagctctgggacagggggtactgcaacctggaagccagggagcagcggtccaggctccaccgggtcatggaacagcggttcaagcggaaccgggagtacaggcaaccaaaatcctgggagccctagacccgggagtacgggcacatggaatcccggtagttctgaaagggggtcggccggccactggaccagcgagtcgagcgtaagtgggagtactggccagtggcatagtgaaagcggctctttcaggccggactctccaggttcggggaatgcaaggcctaacaaccccgactggggcactttcgaggaagtaagcgggaacgtgtcccctggtacccgtcgtgagtatcacaccgaaaaactggttacgtctaagggcgacaaagagctaaggacaggtaaagagaaggtgacctcaggcagtacaacgaccacgaggagaagttgttctaagactgtcaccaagaccgtgatcggccccgacggccacaaagaagttacaaaggaggttgtgacatcagaggatggaagtgactgccctgaagctatggatctaggcactctgtccggcattggcaccttggatggattccggcacaggcaccccgacgaggctgcctttttcgatactgcatctactggtaaaacctttcccgggtttttttcccctatgctcggggagttcgtgagcgagacagagagtcgaggctcagaatcgggaatcttcaccaacaccaaggagtcttcttctcatcacccaggtatcgctgaatttccatcacgcggcaagtctagctcttattcgaagcagtttacaagctcaacctcatacaatagaggcgacagcaccttcgagtccaaaagctacaagatggctgacgaggcgggctcggaagcggatcacgaaggtactcatagtacaaagaggggtcacgccaagtccagaccagtgagagattgcgatgatgttctgcagacacacccaagcgggactcagagcggcatcttcaacattaaattgcctggtagtagcaaaattttttcagtgtattgtgatcaggaaacttctctgggaggctggctgctgattcagcagcgcatggacggcagccttaatttcaacaggacctggcaggactacaagcggggctttggctctcttaacgacgagggcgagggagagttctggttggggaatgattatttgcatctgcttacccagcgcggttcagtcctgcgcgtcgaacttgaagattgggccggaaatgaggcttacgcagaataccattttcgggtgggctcagaggctgaaggatatgcgttacaagttagttcttatgaaggaactgccggggatgccctcattgaaggaagcgttgaggagggcgcagaatatacttcccacaacaacatgcaattctccacctttgaccgcgatgctgaccagtgggaagaaaattgcgcggaggtatatggaggaggctggtggtacaacaactgccaggcagccaatctcaatgggatttactaccccgggggttcctacgatcctagaaataactctccttacgaaatagagaacggtgtagtttgggtcagcttccggggagccgactatagtttgagggcagtacggatgaaaatccgccctctggttactcag

SEQ ID NO: 11171 - DNA, 2598 bp, Artificial Sequence
  Description of Artificial Sequence: Synthetic coding sequence
atgttctcaatgcgtattgtttgtcttgttttatctgttgttggtacagcatggactgcagatagtggagaaggagattttcttgcagaagggggaggagtacgtggtccaagagtagtcgaaagacatcaaagcgcatgtaaagattcagactggccattttgtagtgatgaagattggaattataaatgtccatcaggatgtagaatgaaaggattaattgatgaagtaaatcaagattttacaaatagaattaataagcttaagaattcattatttgagtatcaaaaaaataataaagattctcattcattaacaacaaatattatggaaatactacgtggagatttctcatcagcaaataatagagataatacatataatagagtttctgaagatctccgttcaagaatagaagttctaaagcgtaaggttattgaaaaggttcaacatattcaattattacaaaaaaatgtaagagcacaacttgttgatatgaaaagacttgaagttgatattgatattaaaattagatcatgcagaggatcatgttcaagagctcttgcaagagaagttgatcttaaggattatgaagatcaacaaaaacaattagaacaagttatcgctaaagatttactcccatcaagagatagacaacatttacctttaattaaaatgaaaccagttccagatcttgttcctggaaattttaaaagtcaattacaaaaagtaccacctgaatggaaagctttaactgatatgccacaaatgagaatggaattagaacgtccaggaggaaatgagattacaagaggaggatcaacatcctatggaacaggtagtgaaactgaatcgccaagaaatccttcatcagctggatcatggaatagtggatcaagtggaccaggttctactggtaatcgtaatccaggaagttcaggtacaggtggaactgctacatggaaaccaggttcatcaggtccaggatcaaccggatcatggaattcaggaagtagtggaaccggttcaacgggaaatcaaaaccctgggtcaccaagaccaggatcaacaggaacatggaatccagggtcatctgagagaggatctgctggtcattggacatcagaaagttcagtctctggatctactggacaatggcatagtgaatcaggaagtttcagaccagattcaccaggaagtggaaatgcaagaccaaataatccagattggggaacgtttgaagaagttagtggaaatgtttctcctggaacacgaagagaatatcatactgaaaagttagttacttcaaaaggggacaaagaattaagaactggtaaggaaaaagtaacaagtggatcaacaactactacacgtcgttcatgtagtaagacagttacaaaaactgtaattggaccagatggacataaagaagtaactaaggaagttgttacatcagaagatggtagtgattgtccagaggctatggacttaggaacattaagtggaattggaacattagatggtttcagacatagacatccagacgaagctgcattctttgacacagcttctacaggaaaaacatttccaggatttttttcaccaatgttaggagaatttgtttcagaaacagaatctagaggatcagagagtggtatttttacaaatactaaagaatcatcttcacatcatccagggattgcagaatttccatctagaggaaaatcttcttcatattcaaaacaatttactagtagtacatcatataatagaggtgattcaacttttgaatcaaaaagttataaaatggctgatgaagcaggatcagaagcagaccatgaaggtacgcatagtacaaaacgaggtcatgcaaagtcaagaccagttagagattgtgacgatgtattacaaactcatccaagtggaactcaatcaggaatttttaatattaaattacctggatcttcaaaaatattttcagtttattgtgatcaagaaacttcattgggaggatggttactaattcaacaaaggatggatggatcattaaactttaataggacatggcaagattataagagaggttttggaagcttaaatgatgaaggagaaggagaattctggcttggaaacgattatttacatttattaacacaaagaggaagtgttttaagagttgaacttgaagattgggcaggaaatgaagcatatgcagagtatcattttagagttggttcagaagctgaaggatatgctttgcaagtttcatcttatgaaggaacagcaggtgatgctttgattgaaggaagtgttgaagaaggagctgagtatacatcacataataatatgcaatttagtacatttgatagagacgctgatcaatgggaagaaaattgtgcagaagtatatggaggtggatggtggtataataattgtcaagctgcaaatttaaatggaatatattatccaggaggaagttacgatccaagaaataactcaccatatgaaattgaaaatggagttgtatgggttagttttagaggtgcagattactcattaagagcagttagaatgaaaattcgaccattagttacacaa

SEQ ID NO: 11172 - DNA, 2598 bp, Artificial Sequence
  Description of Artificial Sequence: Synthetic coding sequence
atgttcagtatgcggattgtgtgcctcgtgctgagcgttgtcggcacagcctggaccgcagatagcggcgaaggcgatttccttgctgagggaggcggtgttaggggccctagggtggtggaaaggcaccagtccgcctgcaaagattccgattggcctttttgctccgatgaggactggaattataaatgcccatcagggtgcaggatgaagggccttattgacgaggtgaaccaggacttcacaaatcgcattaacaaactgaagaattccttgtttgaataccagaaaaacaataaggatagccactccctgactaccaatatcatggagattttgcggggcgacttttcttccgccaataaccgggacaatacttataaccgggtctctgaagacctgcgcagtagaatcgaggttctcaagagaaaggtgatcgaaaaggtgcaacatattcagctgctgcagaagaacgtcagggcccaattggtggatatgaaacggctggaggttgatattgacataaagattcgcagttgtaggggttcctgtagccgagcactggcccgagaggtggatctgaaagactacgaggaccagcagaagcagctcgagcaggtgatcgctaaagacctccttccttcccgggacagacaacatctgcccctcatcaagatgaagcctgtccctgatttggttccaggaaactttaaatcccagctccagaaagtcccacctgaatggaaagcccttactgatatgcctcaaatgagaatggagctcgagaggcccggaggtaatgaaattaccaggggcgggtccacaagctatggaaccggctccgagacagagtctccccgaaatccgagcagtgctggatcttggaatagcggcagctccggtccaggtagtacaggaaatagaaatcccggttctagcgggaccggagggactgccacctggaagccaggatcctccggaccagggagcaccgggagttggaattctggcagctctgggactggctcaacaggcaaccagaacccagggtccccgcgccccggcagcacaggaacctggaaccctggctctagtgagcgggggagcgccggacactggacttctgagagttccgtctcagggagcactgggcaatggcatagcgaaagcggcagctttagacccgacagtcctgggagcgggaacgcccgaccgaataatccggactggggaacatttgaggaggtctccggaaatgtgtcacctggaacccggcgggaataccacacggagaagttggtgacatcaaagggggacaaggagctgcgaacaggcaaggagaaggtgacttctggctccacaacaacaaccaggcgaagctgcagcaaaacagtcactaagaccgtgatcggtccggatgggcataaggaggttacgaaggaagtcgtcacgagtgaagatggcagcgactgccctgaagcaatggatctgggtacactctccgggatcggtacgctcgacggctttagacacaggcacccagatgaggccgctttctttgacaccgcaagcactgggaagacctttcccggcttcttcagccctatgttgggcgagtttgtgtccgagacagagtcccgggggagcgaaagcgggatctttaccaataccaaggagagcagctcacatcatcccggaattgccgagttcccatccagggggaaaagctcatcttactctaagcagtttacgagcagtacctcctacaatcggggcgacagcaccttcgagtcaaaatcttataagatggcagacgaagccggctcagaggcagatcatgaagggacacactctaccaaaagaggacatgccaaatcccgacccgttcgcgattgcgacgacgtgctgcagacccacccgtccggcacccagagcgggatctttaatatcaaactgcccggatcctccaaaattttttccgtgtactgcgatcaggagaccagcctcgggggatggctcctgattcaacaaaggatggatggctcattgaatttcaaccgcacctggcaggactataagcggggcttcggctcccttaatgacgagggggaaggggaattttggctgggtaacgactatttgcatctgctgacccagagaggatctgtcttgcgggtcgagctggaagactgggccgggaacgaagcgtacgccgagtatcactttcgcgtggggtctgaggctgaaggctatgctctgcaggtgagctcttatgaagggacggccggagacgcactgatagagggcagcgtagaggagggcgctgagtacacaagccataataacatgcagttctcaaccttcgatagagacgcggatcagtgggaagagaattgtgctgaagtctacggtggcggttggtggtacaacaactgccaggctgctaatcttaatgggatttactaccctggaggctcttacgacccccggaataattctccttacgagatcgaaaacggagtggtctgggtgagctttcggggtgccgactattccctgcgggctgtacgaatgaaaattagaccccttgtgacccag

SEQ ID NO: 11173 - DNA, 2598 bp, Artificial Sequence
  Description of Artificial Sequence: Synthetic coding sequence
atgttctcaatgcgcattgtgtgcctagtcctgtccgtggtcggtactgcctggaccgccgactccggcgaaggggatttccttgcagagggcggcggcgtccgcggaccgcgagttgtagagcgccaccagtctgcctgcaaagatagcgattggcctttctgctcggacgaagattggaattacaagtgcccctcgggatgcagaatgaagggacttattgatgaggtgaaccaggatttcacaaaccggatcaataagctgaagaacagcctcttcgagtaccaaaaaaacaataaggatagccacagcctgaccacgaacatcatggagatactgcgtggtgatttttcgtcggctaacaaccgcgataatacctacaaccgagtgtccgaggacctgcgaagtagaatagaagtgctaaagcgtaaggtgatcgaaaaggttcaacatatccagcttcttcagaagaatgtgagggcccagctggttgacatgaaacggctcgaggtcgacattgatattaaaatccgcagctgcagaggctcctgcagccgtgcactggcccgggaggtagacctgaaggattacgaggaccagcagaagcagctagagcaggtaatcgccaaggatctattaccatccagggaccggcaacacctcccattaataaaaatgaagcctgtcccagatctcgtccccggaaatttcaagagccaacttcaaaaggtgcctccagagtggaaagcgcttacagatatgccccagatgcgcatggagctggaacgacccggcggtaacgagattacacgaggtggtagcacgtcgtacgggaccggcagcgagaccgagtcgcccaggaatccttccagcgccggctcttggaattcaggctcctccggcccagggtccactggcaaccgcaaccccggctctagcggaactggtggaaccgcgacgtggaaaccgggtagttcgggacctggctcgaccggatcttggaactcaggaagctcaggcacaggcagcaccggaaaccagaaccctggaagcccgaggcctggttcaacgggtacttggaatccaggtagcagcgagaggggaagtgccggacattggacctccgagagctcggtgtcgggtagcacaggccagtggcacagcgaatcgggctctttccgtccagattcaccaggatctggaaatgcccggcccaacaatcctgactggggcaccttcgaagaggtcagtggcaatgtgtcgccgggaacgcgtcgtgaataccatacagaaaagctcgtcacctccaaaggtgataaggagctacgaaccggtaaggagaaggttacaagcggcagtactaccacgacccgccgcagttgcagcaagaccgtgacaaagaccgttatcggtcctgacggacacaaagaggtgaccaaagaagtagtgaccagcgaggatggatcggattgtccagaagctatggaccttgggaccctgagcggaatcggaacactcgacggctttcgtcaccgccacccggatgaggcagcgttctttgatacagctagtactggcaaaacgttccccggattcttttcgccgatgctgggagagttcgtctccgagacggagagtcgaggctcagagtccggaatcttcactaacacgaaggagtcctccagtcaccatcctggaattgcggaattccccagccgaggaaagagttccagctacagcaagcagtttacgtcttccacatcctacaatcgtggcgatagtaccttcgagtcgaaaagctacaaaatggccgacgaggccggtagcgaggcagaccatgaaggcactcactcgacaaaacgcggtcatgctaagagcaggccggtacgtgactgtgatgacgttcttcaaacccatccctccgggacacaaagtggaattttcaacataaagttgccgggtagttccaagatcttctccgtgtactgcgatcaggagaccagcctgggtggatggctcttgatccagcagcgaatggacggctctctcaatttcaaccgaacttggcaagattacaagcggggtttcggcagtctcaacgatgagggcgaaggcgagttctggctcggcaacgattatcttcacctacttacacagaggggatccgttctgcgcgtagagcttgaggattgggccggcaacgaggcatacgccgagtatcacttcagggtcggcagcgaggctgaggggtacgctttacaggtctccagctacgagggcaccgccggagacgctcttatagagggcagtgtggaggagggagcggagtatacatcgcacaacaacatgcagttttccaccttcgatcgcgatgccgatcagtgggaagagaactgcgcggaagtgtacggaggaggatggtggtataataactgtcaggccgccaatttaaacggcatctattacccgggtggcagctacgacccgcgtaataatagtccgtacgagatcgagaacggagtggtgtgggtgtcattccggggtgccgattactccctacgcgctgtgcggatgaagatccgtccattggtgacccaa

SEQ ID NO: 11174 - DNA, 2598 bp, Artificial Sequence
  Description of Artificial Sequence: Synthetic coding sequence
atgttcagcatgcggatcgtgtgcctcgttctgtctgttgtgggcactgcgtggacagcagatagtggagaaggcgactttttggctgaggggggaggtgttaggggaccacgagtggtagagcgacatcagtcagcctgtaaggatagtgactggccattctgttctgacgaggattggaactataagtgtccttcaggctgtaggatgaagggattgattgacgaagttaaccaggatttcaccaaccgcatcaataagctgaagaacagtctctttgagtaccaaaaaaacaacaaagattctcacagcttgactaccaatatcatggagatccttagaggggatttctcctcggccaacaaccgggacaacacatataatcgtgtaagcgaggacctgcgctcccgcatcgaggtgctgaagaggaaggtgattgaaaaggttcagcacatccagctattgcaaaaaaacgtcagggcccagctagtggatatgaagcgtctcgaggttgatatcgatatcaaaatccgtagttgccgcggctcttgctctagagcacttgccagggaagtcgatttgaaagattacgaagaccagcagaagcagctcgagcaggttatcgcaaaggacctgttgccctcccgtgatcggcaacacctgccgctcataaagatgaagcccgtgcccgaccttgtgccagggaactttaagtctcagttgcaaaaggttccacccgaatggaaggctctgaccgatatgccacaaatgcgcatggagctggagcgccccggtgggaacgagattacccgcggggggtcgacttcatatggcacaggttcagagacggaaagccccaggaaccccagtagtgccgggtcatggaattctggcagcagcggtccaggttccacaggtaatcgcaatcccggcagctccggcacaggggggacagcgacctggaaacccgggagttccggtcctggcagcaccggcagctggaactctggctcatccggaaccggtagtacaggaaatcagaaccctggctctccaaggcctgggtctactggaacttggaatcctggaagcagcgagcgcggttctgctggacactggactagtgaaagctcagtttcaggaagcacaggacagtggcactcagagagcggcagttttcgcccagattcgccagggtctgggaatgccaggcccaacaatcccgactggggcacctttgaggaggtctcagggaacgtcagtccaggcacgagaagggagtaccataccgagaagttagtaacgagcaaaggcgacaaggaattacgcacagggaaggaaaaggtcactagtgggagcaccaccactacccgacggtcctgctcaaaaaccgttaccaagacagtgattgggcccgacggccacaaagaagtaacaaaagaggtagtcacttccgaagacggctcagattgtccagaagccatggatttgggcaccctctcaggaatagggacccttgatgggtttcgacaccgtcacccagacgaggcagctttctttgataccgcatccactggcaagacatttcctggctttttcagtccaatgctgggggagttcgttagtgagacagagagccgcggaagcgaaagcggaattttcacgaacacaaaggagtctagtagccatcacccaggaatcgcggaattcccctccagggggaagtcttcctcatatagtaaacaatttacttcttctacatcatataatagaggtgattctacattcgaaagcaaaagttacaagatggcggatgaggctggatccgaggccgaccacgaggggacacatagcaccaaaaggggccacgcaaagtcgcggccggttagagactgcgacgacgtgctccaaacccacccatctggtacccagtctggtatcttcaatattaagctcccgggctctagcaagatcttctccgtgtactgtgatcaggagacttccttgggaggatggttactcatccagcagcggatggacggttccctcaacttcaaccgcacatggcaggactataagcgtggcttcgggtcactgaatgacgagggcgagggcgaattttggctgggtaacgattatttgcatctgctcactcagcgcggctccgtgcttagggtagaattggaagattgggccggcaacgaggcctatgccgagtaccacttcagagtgggctccgaggccgaaggatatgccttgcaggtgtcctcttatgaaggtaccgccggcgacgcactgatcgagggatcagtggaagagggggccgaatacacctcccacaacaacatgcaattttctacatttgatagggatgccgaccagtgggaagaaaactgtgccgaagtgtacggaggtggctggtggtacaacaattgccaggccgcgaacttgaatggtatttactatccgggcggatcatatgatccccggaataactctccctacgagatcgagaacggcgtggtgtgggtgtcatttagaggtgcagactacagccttcgcgctgttcgaatgaagattcggccccttgttacacag

SEQ ID NO: 11175 - DNA, 2598 bp, Artificial Sequence
  Description of Artificial Sequence: Synthetic coding sequence
atgttttctatgagaatagtctgcctagtgctgagcgtagtggggactgcttggacggccgacagcggggaaggcgatttcttagccgaagggggtggtgtgcgcggcccccgagtggtggaacgccatcaatctgcttgcaaagattctgattggcctttctgttcagacgaagactggaactacaagtgcccctccgggtgccgcatgaaagggctgatcgatgaggttaatcaggatttcacaaatcggattaacaaactgaaaaactcactgttcgaatatcaaaaaaataacaaagattcccattccttgactaccaatataatggagatcttacgcggcgatttctcctccgctaacaatagggataatacttacaaccgagtttctgaggatctgcggagccgaattgaggttttgaagagaaaggtgattgaaaaggtacagcatatacagctcctccaaaagaatgttcgggctcagttggtggacatgaaacgcttggaggtagatatcgacatcaagattcgctcctgccgcggcagctgctcacgcgccctggcaagagaagtggacctaaaagactacgaagaccagcagaagcagctggagcaggttatagccaaggatcttctcccatccagagacaggcagcacctccccctaatcaagatgaaaccagtaccagacttggtgccgggtaacttcaagtcacagttgcaaaaagttccgccagaatggaaggcgcttacagatatgccccagatgcgcatggaactagagaggcccgggggcaatgaaatcacccgcgggggttccacttcttatggcaccgggtcagagacggagtctccacggaatccatcttcagcagggtcttggaattctggaagcagcgggcccgggtcgaccggaaatcgcaatcccggaagttccggaactggaggaacagctacctggaaaccagggtctagcggcccgggatcaacagggtcttggaatagcggatcctcaggcactgggtcaacaggaaaccagaatcctgggtcaccccgccctggctcaacaggtacctggaatccgggtagtagtgagcgagggtctgcagggcattggactagcgagtcctctgtgtccggtagtactggacaatggcacagcgagagtggtagtttcagacctgattcacctgggtcgggaaacgcccgcccgaataaccccgattggggcacttttgaggaggtctctggcaatgtgtccccaggcacccgccgcgagtaccataccgagaaactcgtgacatctaaaggagataaggagctaaggacagggaaagaaaaggttacctccggatcaacaaccaccactcgtcgatcttgtagcaaaacagtgacaaagacggtgatagggcccgacggacataaagaagttacgaaggaggtggttacttcagaggacggatctgactgccctgaggccatggaccttggcacattgagcgggatcggcactttagacgggttccgccacagacacccagacgaggccgctttttttgataccgcctcgacaggcaagaccttccctggctttttcagcccaatgcttggtgagttcgtttccgagaccgaaagtagaggcagtgaatccggcattttcactaacactaaggaatcttcgtctcaccacccaggaatcgcagaatttccctcccgaggaaaatcctcatcttactccaagcagttcaccagcagtacatcctacaaccgtggcgattcaacgtttgagagtaagtcttacaagatggcagacgaagctggaagtgaagcggaccacgagggcacacatagcaccaaacgaggccacgcaaaatctcgcccagtgagagactgtgacgatgtgctgcagacgcatcctagcggaacccagagtggcattttcaatatcaaactgcctggcagttcaaagattttttctgtttattgcgaccaggagacatctcttggaggatggttacttattcagcagagaatggacggatctctcaattttaatcggacctggcaggactataaacggggcttcgggtctctaaacgatgagggggagggtgagttttggctcggcaacgactaccttcatttgttgacacagcgaggaagcgtgctgagggtggagctggaggactgggccggaaacgaagcgtatgctgaatatcacttcagagtcggcagcgaggctgaggggtacgctctgcaggtatcttcctatgaaggcactgcgggcgacgctcttatcgaaggctcagttgaggaaggggctgagtatacatctcacaacaatatgcagttttccactttcgatagagacgccgatcagtgggaggaaaactgtgctgaagtttatggcggtggttggtggtacaataattgtcaggcagctaacctgaacggaatttactacccaggcgggtcctacgaccctcgcaataatagcccctatgagatcgagaatggcgtagtttgggtgtccttccggggagccgactacagtctccgcgcagtgcgcatgaaaatccgaccccttgttacgcag

SEQ ID NO: 11176 - DNA, 2598 bp, Artificial Sequence
  Description of Artificial Sequence: Synthetic coding sequence
atgttcagcatgagaatcgtgtgccttgttctctcagtggtgggaacagcgtggacagctgacagcggggaaggagactttctcgctgagggaggaggagtgagaggaccacgggtggtcgagaggcaccaatctgcctgtaaggatagcgactggccgttttgcagtgatgaagattggaactataaatgcccttcaggatgccggatgaaaggtcttatcgatgaggtaaaccaggatttcaccaacaggatcaacaagcttaagaacagcctgttcgaataccagaagaacaacaaagacagtcactcactgacaaccaacattatggaaatacttagaggcgactttagctctgccaataaccgggacaatacctacaacagggtttctgaagacctcagatctaggatagaggtactcaaaaggaaagtaatcgaaaaagttcaacatattcaacttctgcaaaaaaacgtccgagctcagcttgtggacatgaaaagattggaggtcgatatagacatcaagattaggagttgccgcggtagttgcagtagagccttagcacgggaagtggatctgaaagactacgaagatcaacaaaaacagctggaacaggttatcgcaaaggatttactgcctagtagggataggcaacacctcccactcatcaaaatgaaaccagttcccgacttggtccccgggaacttcaaatctcagctccaaaaggtgcctcctgaatggaaggctctcaccgacatgccccaaatgcggatggagcttgagcgacctggcggaaatgagattacacgaggcgggagcacgagctatggaacaggaagcgaaactgaatctcccagaaacccatcttctgcaggcagctggaactctggaagcagcggaccaggctccactggcaacaggaaccccgggagctctggcacaggaggcaccgccacatggaagcccgggtctagcggccctggtagtactggcagttggaactctggatcctcagggaccggcagcacagggaatcagaatccaggcagtccaagaccaggatctactggaacgtggaaccctgggtcctctgaaaggggaagtgctggacactggacctcggaaagtagcgtcagcggttctacaggacaatggcactcagaatccggaagctttaggccggattctcctggctcaggcaacgctaggcctaacaacccggactgggggacatttgaagaggttagcggcaacgtcagcccagggactagaagagaatatcacacagagaagctcgtgacctccaaaggagacaaggaactcagaaccggtaaagagaaggtgaccagcggctctaccactactactcggcggtcttgttctaaaacagtcactaaaactgtgattggaccagatggacataaggaggttaccaaggaggtggtcacttcagaagatgggtcagactgtcccgaggctatggatctgggaacccttagtggaatcggtaccttagatggctttcgacaccgtcatccagatgaggcagcctttttcgacacggctagcaccggcaagacctttccaggctttttctcacccatgctgggcgaattcgtcagtgaaactgaatctaggggatccgagtccggaattttcaccaacaccaaagaaagttccagccatcaccctggcattgctgagtttccctcgaggggcaagtcgtcttcatactcgaaacagtttacctctagtacatcgtacaatagaggcgattccacatttgaatctaagtcatacaaaatggctgacgaagcaggttccgaggccgatcacgagggaactcacagcactaagcgtggacatgccaagagtcgccccgtgagagattgtgatgatgtcctgcagactcaccccagtggaacccaaagcggcatctttaatatcaagctgcctggtagttcaaagattttttccgtgtactgtgatcaggagacaagtctcggcggttggcttctgatacagcagaggatggacggttctctgaattttaaccggacttggcaagattacaaacgtggctttggctctttaaacgatgagggcgagggcgagttttggctgggcaacgattacctccatctcctgacccaacggggatcggtcttgcgagtagagctcgaggattgggcgggcaacgaggcttacgctgagtaccattttagagtggggtctgaggctgaaggctacgccctgcaagtgagttcgtacgaaggaaccgctggggacgccctgattgagggatccgtggaagaaggagccgagtatacctctcacaacaacatgcagttcagcaccttcgacagggatgctgaccagtgggaggagaactgtgccgaggtgtatggcggaggctggtggtacaacaactgtcaggctgcgaatctgaacggaatctattaccccgggggaagttacgatccgcgaaacaattctccctatgaaattgaaaacggagttgtttgggtatcttttaggggagctgattacagccttagagctgtgcgcatgaaaatcagaccgctcgtcacacaa

SEQ ID NO: 11177 - DNA, 2598 bp, Artificial Sequence
  Description of Artificial Sequence: Synthetic coding sequence
atgttctctatgagaattgtgtgccttgtgttatccgtggttggtaccgcatggacggctgatagcggagaaggagattttcttgctgagggggggggggttcgaggccctagagttgtggaaaggcaccagtctgcctgtaaagatagcgactggccgttctgttctgacgaggactggaattacaaatgcccatcaggctgccgaatgaagggcctgatcgatgaagtaaaccaggactttaccaacaggatcaacaagctgaaaaactcccttttcgagtaccagaagaataacaaagactcccattctcttaccacaaatattatggagattctgcgaggtgacttcagctctgcaaacaacagagacaacacctacaaccgagtttccgaagaccttcgatctagaatcgaagtgctgaaaagaaaagttattgagaaagtgcagcacatacagttgctgcagaaaaacgtgagagcccaactggtcgatatgaaacgacttgaagtggacatcgacattaaaatccgaagctgtcgaggctcctgttcaagggctctggctagagaggtcgacttgaaggactacgaggatcaacaaaagcagcttgagcaagtgatagcaaaagacctacttccatcaagggacaggcagcatctacctttgattaaaatgaagccggtccccgatctggttccaggaaatttcaaatctcaactgcagaaagttcctcctgaatggaaagccctgactgatatgccccagatgcgaatggagcttgagcgcccaggtgggaatgaaatcacccggggggggtcgacttcctatggtactggttcagagactgaaagccccaggaacccctcctcggcagggtcttggaattccgggtcttccggacctgggtccaccgggaaccgaaatcccggctcaagcggcaccgggggtaccgcaacttggaagcccggaagttcaggccccggcagtactgggtcatggaatagcggctcttccgggacgggttctacgggaaaccaaaaccctggatctccccggcccggctcaacaggcacatggaaccccggctcttcggagaggggctctgccgggcactggaccagcgagtcgagcgtaagcggctcgacaggacagtggcattctgaaagcggcagcttccgacccgactccccgggcagtggtaatgctcgtcccaataatcctgattggggtacattcgaggaagtaagcggtaacgtgtcgccagggacacggcgggagtatcatacagaaaaactcgtgacttccaaaggagataaggagctcaggactggtaaggagaaggtcacttcaggcagcactacaactacacgtaggtcctgtagtaaaacggtcaccaagacggtgattggacctgatggccacaaggaggtgacgaaggaagtcgtgacatcggaagatggcagtgactgtcccgaagctatggatcttggcacactgagcggaattgggaccctggatgggttccgacatcgtcatcccgatgaagcagcatttttcgataccgcctcgaccggaaagacatttccgggcttcttctctccgatgttgggggaatttgtcagcgagaccgaaagtagagggtctgaatctggaatattcaccaacacgaaggaatccagctctcatcatcctggaatcgctgaattcccgtcgaggggcaagagttcatcatatagcaagcagttcacgtcaagcaccagttataatagaggggactccaccttcgagtcaaaaagctacaagatggcagatgaagccggctctgaagcagaccacgagggcacacacagtaccaagcgaggacacgcgaagagtagaccggtgcgagattgcgatgacgtactgcagacgcacccaagcggaacccagtccggaatcttcaacatcaagcttcctggctcctcaaagatcttctccgtatactgcgatcaggagaccagcctcggagggtggcttctaattcagcagcgaatggatggatctctgaacttcaatagaacgtggcaggattataagcgtgggttcgggtcattaaatgatgaaggagagggggaattctggctcggcaatgattacctacacttgctaacacagagagggtccgttctgagagtagagctagaagattgggcgggaaatgaggcctatgctgaataccatttccgggtgggatcagaggcggaaggatacgcacttcaggtttcctcctatgaaggcaccgctggcgatgcactgatcgaaggcagcgtggaggaaggtgccgagtacacgtctcacaataatatgcaattcagcacatttgatagggacgccgatcagtgggaggagaattgcgctgaggtatacggcggggggtggtggtataacaattgtcaggctgcaaatttgaacggtatatactaccctggcgggtcctatgacccacgaaacaatagcccttacgaaatagagaacggcgtggtttgggtttcatttcgaggggcggactactcactgcgagccgtcaggatgaagatccgacccctggtgacgcaa

SEQ ID NO: 11178 - DNA, 2598 bp, Artificial Sequence
  Description of Artificial Sequence: Synthetic coding sequence
atgttttcaatgcggattgtgtgcttggttctctcagtggtcgggacagcctggaccgccgattccggcgagggggattttctcgccgaaggtggaggagtgcgcggaccccgcgtggtggagcgccaccagtctgcttgtaaggattccgactggccattttgttctgatgaggattggaactataaatgccctagtggttgccgaatgaagggattgatcgacgaggtgaaccaggacttcacgaaccgtatcaacaagctaaaaaattcattgttcgaatatcagaagaataataaagattcccactcattgaccaccaatatcatggaaatcctcagaggtgatttttcatccgcgaataatcgagataatacatacaaccgggtgtcggaagatctgaggtctaggatcgaggtcctaaaacgcaaggtaatagagaaggttcagcatattcagttactacagaaaaacgtccgggcccagttggtcgatatgaagaggctggaagtagacattgacatcaaaatcaggtcttgcagaggcagctgctccagagcccttgctagggaggttgacttaaaagactatgaggaccagcagaaacagttagaacaagtcatcgcgaaggacttgttaccctcaagggacagacaacacttaccattaataaaaatgaaacccgtacctgatctggtgcccggaaacttcaaatcccagttgcaaaaggtgccaccagagtggaaggcccttactgacatgccccagatgagaatggagttagaaagacctggaggcaacgagatcactagagggggtagcacatcctacgggacgggtagcgagacggagtctccccggaacccctcctccgcaggctcttggaactctggtagctctggacccggttcaaccggtaacaggaatcctggtagcagcggaacaggggggaccgccacttggaagcccgggtccagcggaccgggcagcaccggttcttggaatagcggcagcagtggaacagggagcaccgggaatcagaatccagggagcccccggcccgggtctacaggaacgtggaatcccggcagcagtgagcgaggatcagcaggccactggaccagtgaatcatccgtctcaggatcaaccggacagtggcacagcgagtctggctcttttaggccagattctcctggctctggcaacgccaggccaaacaatccagattggggcacctttgaagaagtgtctggaaatgtgagtccaggaacccggcgggagtaccatacagagaaactggtcaccagtaaaggagataaggaactgaggaccggaaaggagaaggtgacgagcggttccacaacaaccacgcggcggtcttgtagcaaaactgtgacgaaaaccgtgataggccccgacgggcacaaagaggtcactaaggaagtcgtcacctcagaagatggatccgattgtcccgaagctatggatctgggaacactgtctggaattggaacccttgacgggttccggcatagacaccccgacgaggcagcgttctttgacacagcctccaccgggaaaacttttccagggttcttctccccaatgctcggagagtttgtatctgagacagagagcaggggttccgagagtggaatttttaccaatacaaaggagtcaagctctcaccatccgggcattgcggagtttccctcccggggtaaatcaagctcttattccaaacagtttacctcttccacctcatacaaccgaggcgacagcacatttgaaagcaagtcctacaagatggctgacgaagctggctctgaggcagaccacgaaggaacacactccaccaaacgggggcacgccaagagtcggccggtgcgcgactgtgatgacgtcctccagacccaccccagtggcacccagtccggtattttcaatatcaaactccccggtagtagcaagatcttctcggtttattgtgatcaggagacgagcctgggcgggtggttgcttatccaacagagaatggatgggtctctaaatttcaataggacatggcaggactataagcgtggttttgggtcactcaacgatgaaggggaaggcgagttttggttgggaaacgactatctgcacttgcttacacagaggggaagcgtgctcagagtggaactggaagactgggctggcaacgaggcttatgccgagtatcattttcgcgttggaagtgaggccgaagggtatgcattgcaggtgtcgtcatacgaaggaacagccggagatgcgctcattgagggctcagtcgaggagggcgccgaatacactagtcacaataacatgcagttctccacgtttgaccgcgatgccgaccaatgggaagaaaactgcgctgaggtctacgggggaggctggtggtataataactgtcaggcagccaacctgaatggcatctattatcccggtgggagctatgacccccgtaacaactccccgtatgaaatcgagaacggcgtggtctgggtgtctttccgcggagccgattactccctgcgggcagtaagaatgaaaattcggcccctggtgacacaa

SEQ ID NO: 11179 - DNA, 2598 bp, Artificial Sequence
  Description of Artificial Sequence: Synthetic coding sequence
atgttttcaatgcgcatcgtgtgtctggtgctgagcgtagtgggcacggcctggactgccgatagtggggaaggcgacttccttgcagagggcgggggtgtgaggggacctagggtggtagaaagacaccaatccgcctgtaaggatagcgactggcctttttgtagcgatgaggattggaactataaatgcccatcaggttgcaggatgaagggcctgattgacgaggtcaatcaggatttcacaaatcggatcaacaaattaaaaaacagcttgtttgagtatcagaagaacaacaaggattctcatagcctgaccactaacatcatggagatcctccgtggggacttttcaagtgccaataacagggacaacacatataatcgggtctccgaggatttacggtctcggattgaggtgctgaaaagaaaggttatcgaaaaagttcagcatattcagctattgcagaagaatgtacgtgcccaactcgtggacatgaagagactggaagtggatatcgatattaaaatccggtcttgcagagggtcctgtagtagagccctggctcgggaggtcgacctcaaggactacgaggaccaacaaaaacagctagaacaggtgattgccaaggaccttctcccatctagagatcgtcaacatcttccgctgatcaagatgaagcccgtgcccgacctggtgcccggtaacttcaaatcgcagcttcagaaggtccccccggagtggaaggctctgactgacatgccacaaatgcgcatggagctggagcggcctggcggtaacgaaattaccagggggggcagtacctcctatggcacaggatccgagaccgaatctccccggaatccttcttccgctggctcgtggaatagcggtagttcaggccccggttcgactggaaacagaaacccaggtagtagtgggacaggcggaacagccacctggaagcctgggtccagcggacccggttcaactggctcttggaatagcggaagcagcggtactggcagtaccggcaaccagaatcccggatctcctcgcccagggagtaccgggacgtggaaccccggttcatcggaaagaggcagtgccgggcactggacgtccgagagctcagtatctggctctaccggtcaatggcatagtgaaagtggcagttttaggccagacagtcccggatctggtaacgcaagaccaaataaccctgactggggcacatttgaggaagtgtcagggaatgtgtcacctggaacgaggagggagtaccacactgagaagctggtgacgtctaagggtgataaggaactgcgaacaggaaaggagaaagttacatctgggtcaacaaccactactcggcggagttgcagcaagactgtgacaaaaaccgtgatcgggcccgacggacacaaagaagtcactaaagaagtcgtgacatctgaagatggcagtgattgtcccgaggcgatggacctaggcacactgtcgggtattggcacgctcgacgggttccggcaccgccaccccgatgaggcagcttttttcgacaccgcttctacaggtaagacattcccaggcttcttcagcccgatgctgggcgaatttgtatctgagactgagtcgaggggttcagagtctggcatctttactaatactaaggagtcttctagccaccaccctggaattgctgaatttccatcgaggggcaagagctccagctactccaagcagtttacctcaagcacatcttataaccgcggcgattcgacattcgaatccaagtcctacaagatggcagacgaggccgggagcgaggctgatcacgaggggactcattctacaaagagaggacatgccaagtctcgccctgtgcgtgactgtgacgacgtccttcagacacacccatccggtacgcagtccgggattttcaatattaaattgcctggatccagcaagatcttttctgtctactgcgaccaagagactagtctgggcggatggctgttaattcagcaacgtatggacggatccctgaacttcaaccgtacctggcaggattataagcgaggcttcggctctttgaacgacgagggggagggagagttctggttaggaaacgactatctacacctgctgactcaacgaggctccgttttgagagtggagctggaagactgggccgggaacgaggcttacgcagagtaccattttcgcgtgggatcagaggccgaggggtacgccctgcaggttagctcatacgagggcactgcaggtgatgctcttatcgagggaagtgtggaggagggagctgagtacacatcacataacaacatgcagttcagcactttcgatcgagatgcagatcaatgggaggagaactgcgcagaagtgtatggcggtggctggtggtacaataactgccaggctgcaaacctcaacggaatatactaccctggcggtagctacgacccaaggaataacagcccatatgagatagagaacggggtggtgtgggtgagtttccgaggtgctgattattccttacgggctgtacgaatgaagatccggccattggtcactcag

SEQ ID NO: 11180 - DNA, 2598 bp, Artificial Sequence
  Description of Artificial Sequence: Synthetic coding sequence
atgttttccatgaggattgtctgccttgtcctgtctgtggtggggacggcatggaccgccgactcgggcgagggagattttttggccgagggtgggggggtgaggggaccacgcgtcgtcgagcggcatcagagcgcctgtaaggactccgactggccattctgctctgatgaagactggaactataaatgcccgagcggatgcagaatgaaaggcctgatcgacgaggtgaatcaggatttcaccaatagaatcaacaagctgaagaatagtctcttcgagtatcagaaaaacaataaggacagtcactcattgactaccaatatcatggaaatcctgcgaggcgacttctcgagcgccaacaaccgcgataacacctacaaccgcgtctcagaggatctgcgctcgagaattgaagttctaaagcggaaagtgattgagaaagtgcagcatatccaactgctccagaaaaacgtgagggctcagctagtcgatatgaagcgcctcgaagttgatatcgatatcaagataaggtcatgccgggggtcatgtagtagagccctggctcgggaagtggaccttaaggactacgaagaccagcagaagcagctagaacaagtgatcgccaaagacttgttacctagcagagatcgccaacatcttcccctcatcaagatgaagccagtcccagatcttgtgccaggaaacttcaaaagccagttacagaaggtgcctcccgagtggaaagccttgacagacatgccccagatgaggatggagctggagcggccaggaggtaacgaaatcaccagaggtgggtcaacctcatatggtaccggcagcgaaaccgaaagccctcggaatccgagttccgctgggtcctggaattcggggagctccggcccaggatccacgggcaacagaaaccccggcagctccgggacaggtgggacagcaacctggaagcctggatcctccggaccgggaagtacaggatcctggaactcagggtcgagcgggacgggcagtacagggaatcagaacccaggtagtccccggcccggctccaccggaacttggaatcccggcagctccgagcgaggttcggccgggcactggaccagtgaatcgtcagtaagcggtagtacaggtcagtggcactccgaatcgggcagttttcgtcccgactcccccgggtcaggtaatgcacgcccgaataaccccgactggggtacgtttgaggaagtcagtggtaacgtgtctcccggcacccgcagggagtaccacaccgagaagctggtgacgagcaagggagacaaggagcttagaacgggtaaggagaaagtgacatccgggagcaccacaaccacacggcggtcatgcagcaaaacagtgaccaagaccgtgattgggccagacggtcacaaggaggtcactaaagaagtggtaacatccgaggatgggtccgactgtcctgaggcaatggatcttggaaccttatccgggatcggaaccttagacggatttagacacagacaccccgatgaggccgcattctttgataccgcctctaccggcaaaacctttccgggcttttttagcccgatgttgggcgagtttgtcagcgaaacagagagcaggggcagtgagtcaggaatttttaccaacacgaaagagtccagcagccaccaccctgggatcgctgagttccccagcagaggtaagagctctagttactccaaacaattcaccagctctacgagctataatcgaggggatagtacgttcgagtctaaatcttacaagatggccgatgaggcgggctctgaagcagaccacgaaggcactcactcaactaagaggggccacgccaaaagcaggccggtacgagactgcgacgatgttttgcagactcatccaagcggcacacaatcaggaatattcaacattaaactgccgggctcttcaaagatattcagcgtatactgcgatcaggagacctctctcggcggatggctgctgattcaacagcgcatggatggatctctcaatttcaatcggacctggcaggattataagcggggctttggaagcctgaatgatgaaggggagggcgaattttggctggggaatgactaccttcacctgctgacgcagcggggcagtgtgctgcgcgtggaattggaagactgggccggaaacgaggcatatgccgagtaccacttcagagtgggatccgaagctgagggttatgctctgcaagtgtcaagttatgaaggcacagccggggacgccctcatagaaggcagcgtggaagagggggctgaatatacttcccacaataacatgcagttctcaactttcgaccgggacgcagatcagtgggaagagaattgtgcggaggtgtatggcggcggatggtggtataataactgccaggccgccaatctgaatggaatttattatcccgggggctcttacgatccaagaaacaattctccatacgagattgagaacggtgtggtgtgggtttccttcaggggcgccgactatagtctgagggccgtgcgaatgaaaatccgccctctggtaacgcag

SEQ ID NO: 11181 - DNA, 2598 bp, Artificial Sequence
  Description of Artificial Sequence: Synthetic coding sequence
atgttctctatgagaatcgtttgtttggtgctctccgttgtcggcacggcttggacagctgactcaggcgagggggacttcttggctgaggggggaggtgtgcgtggccctagggttgtggaacggcatcagtctgcatgtaaagactcagattggccattctgcagcgatgaggattggaattataaatgtccgtctgggtgtagaatgaagggccttatcgacgaggttaaccaagactttaccaacaggattaataagctgaaaaactctctgttcgaataccagaagaataacaaggacagccacagtctgacgacaaatatcatggagattttacggggcgatttctcttcggccaacaatcgcgacaatacctacaaccgggtgtcggaggatcttaggtctagaattgaggtactgaagcggaaagtgattgagaaggttcagcacattcagttgcttcagaaaaacgtacgggcccagctggtcgacatgaaacggctggaggtggatattgacatcaaaattaggtcttgcaggggttcttgtagccgggcactggctcgtgaggtggacctgaaagactacgaggatcagcagaagcagttggagcaggtgatcgccaaggatttacttccgagccgcgacagacaacacctgcctcttattaagatgaaacccgtccctgatctagttccggggaatttcaaatctcagctgcagaaagtcccacctgagtggaaagccctgacggacatgccccagatgaggatggaactagaacgccctggggggaatgagatcacgcgtggagggtccacctcttatggaactggttctgaaacagagtctccgagaaatccttcatctgccggctcatggaatagtggctctagtggccctgggagtacaggtaacagaaaccccggcagctctgggactggaggaactgcaacatggaaaccgggatcatccggtccaggctctactgggagctggaactctgggtcaagcggtaccggctccacagggaaccagaacccagggtccccccggccgggctcgacagggacatggaacccaggcagttcagaacgcggctccgccggccactggacgtcggaaagcagcgtgagcggctcaacagggcagtggcattcagagtcaggctcttttcgccccgattccccaggcagtggcaatgctcgtcctaacaaccccgactggggtacttttgaagaggtgagcggtaatgtcagccctgggaccagacgggaatatcacactgaaaagctggtgacatcgaagggggataaagagctgcgaacagggaaagagaaagtcaccagtggtagcaccacaactacgcgcagaagttgctccaagaccgtaactaagacggttattgggccagatggacacaaagaggtaaccaaggaggtagtcacctccgaagatgggtcagactgccctgaagccatggatcttgggactttaagcggcatcgggacacttgacgggttccggcatcgccatcctgacgaagccgctttctttgatacagcaagtacagggaagacgtttccaggtttcttcagcccaatgttgggcgaatttgtgtcagagacagaatctcgcggttcagagagcggtatattcactaacacgaaggagagttcctcacaccaccctgggattgccgaattcccctccaggggtaagtcaagctcctactccaagcagttcactagctcaacaagctataaccggggagattccacgtttgagtcgaaatcctacaagatggcggacgaggctggctctgaagcagatcatgaggggacacatagtaccaagcgaggtcatgccaagtcacgaccagtgagggactgtgatgatgtgctgcagactcatccttccggaacgcaatccggaatatttaatattaagttgccgggatcctcgaagattttttctgtatactgcgaccaggagacatcactgggcggctggctgctgatccagcagcgaatggacgggagcctgaacttcaatcgcacgtggcaggattataaacgagggtttggtagtctcaacgacgaaggcgagggcgagttctggctgggcaatgactacctgcacctgctaacccagcggggcagcgtcctcagagttgagctcgaagactgggcaggaaatgaggcctatgctgaataccacttcagagtaggctctgaggccgaggggtatgctctccaggttagctcatacgagggtacggccggcgatgcacttattgaggggtctgtggaagaaggcgcagagtacaccagccacaataacatgcagtttagtacttttgacagagacgccgaccagtgggaggaaaactgcgcggaggtgtacggtgggggctggtggtacaataattgccaggcagccaacctcaacggaatctactacccaggaggcagttatgatcccaggaacaactccccctacgaaattgaaaacggcgtagtatgggtgagcttcaggggcgcagactacagtttgagggccgtgcgcatgaagatcagacctcttgtgacccag

SEQ ID NO: 11182 - DNA, 2598 bp, Artificial Sequence
  Description of Artificial Sequence: Synthetic coding sequence
atgtttagcatgcggatcgtttgtttggttctctcggtggtaggaacagcttggacagctgattccggtgaaggggattttcttgccgaagggggcggtgtccgagggcccagagtcgtggagaggcatcagtccgcatgtaaagattctgactggccattttgctctgacgaggactggaattataaatgtcccagtgggtgccgcatgaaaggattgattgatgaggtgaatcaggacttcactaacaggataaataagctcaagaattccctgtttgagtaccaaaagaataacaaagattcacactcactgactacgaacattatggaaatcttacgcggtgatttcagctcagccaataatagagacaatacctacaaccgggtgagtgaagacctgcggtcacggatcgaagtgttaaagagaaaagtaatagagaaggttcagcacatccaactgctccaaaagaatgttagggcccagctggtggacatgaagcgcctggaagtggatattgacatcaagattagatcgtgccgtggaagctgcagccgggcactggctcgtgaggtggatctcaaggattatgaggaccagcagaagcaattagagcaagtgatcgctaaggacctgcttccctcccgggacagacaacacctgcccctgatcaaaatgaaaccagtaccagacttggtccccggaaattttaaaagtcagctgcagaaagtgccaccagaatggaaggcgttgaccgatatgcctcagatgcgcatggagctggaaagacccggcgggaatgagatcactcggggtgggagtacttcctacggtaccggtagtgagactgagagcccaagaaacccttcgtccgcgggaagttggaattcaggctctagtggtcctggctcaaccggcaaccgcaaccctggatccagcggtacaggcggaacagctacttggaagccaggctcctccggccccgggtcaactggcagctggaactccgggtcaagcggaaccggttcaaccggtaatcaaaacccagggtcccctcgacctggctctacagggacctggaaccctggaagtagtgaaagaggtagcgcaggtcactggactagtgagagcagtgtgtccggctcgacaggacagtggcattccgagtccggcagttttaggcccgacagcccgggctccggcaacgcacggcccaataacccggattggggcacgttcgaggaagtgagcggaaacgtcagcccaggaacacgaagagaataccacaccgagaagctggtcacctctaaaggagacaaagaactgagaacaggaaaggagaaagtgacaagtggttccacaactactacccgtcgctcctgtagtaaaaccgtcaccaagacagtcatcggccctgacgggcacaaagaagtgaccaaagaggtcgtaacctccgaggacggctcggactgtcctgaggccatggacttggggaccctgtcgggcattggtacactcgacggattccggcaccgacaccctgatgaagctgccttctttgataccgcctcaaccggcaagacctttcccgggtttttcagtccaatgttgggggagtttgtctctgaaaccgaatcgcgggggagtgagagtggaatcttcacaaatactaaggagtcatcctctcatcatccaggaatcgcagagtttccctctcgaggcaaaagctcatcttactccaaacagttcacaagcagcacctcatataaccgaggcgacagtacattcgaaagcaaatcttataaaatggccgatgaagccggttctgaagccgatcatgaaggcactcactcgacaaaaagaggccacgcgaagagccggcccgtgagggactgcgacgatgtgttacagacacatccctccggaactcaatccggaattttcaacatcaaactgcccggcagttctaagatcttcagtgtctactgtgaccaagaaacctccctgggcggctggctcctgatacagcagcgtatggatggctctcttaacttcaatcgaacttggcaggattataagagggggttcggctccctcaacgatgaaggcgaaggtgagttctggctgggcaatgactatctgcacctgttgacacagagaggatcagtgcttcgggtggaactcgaagactgggccggtaacgaagcctatgccgagtaccactttcgtgtagggtcagaggcagaaggctacgcccttcaagtgtcaagttatgaaggcacagccggggatgctctgatcgaaggctctgtcgaggaaggggcagagtacaccagccacaataacatgcagttttccacttttgatagggacgccgatcagtgggaagagaattgcgccgaggtatacgggggtggatggtggtacaacaactgtcaggcagccaacctgaacgggatatactatcctggaggatcttacgacccgcgcaacaatagcccttacgaaatagaaaacggagtggtgtgggtgagttttcggggcgcagattattccctgcgagctgtgagaatgaaaatccgtcctttggtcactcag

SEQ ID NO: 11183 - DNA, 2598 bp, Artificial Sequence
  Description of Artificial Sequence: Synthetic coding sequence
atgttttctatgcgcattgtgtgcctggtgctatcggttgtcggcacggcatggacagcagacagcggagagggagacttcctcgccgagggaggaggggtgagaggaccaagagtagtcgaacggcaccaatccgcgtgtaaggattctgactggcccttttgtagcgatgaagattggaattacaagtgtccctctggctgtcgcatgaaaggcttaatagacgaggtgaaccaagacttcacaaataggatcaacaaactcaagaatagtctgttcgagtaccagaagaataacaaagacagccattcgctcacaacgaacattatggagatcttacgcggtgattttagctcggccaataacagggataatacgtataaccgcgtctctgaagacctgcgctctcgtattgaggtgctcaagcgaaaagtgatagaaaaagtgcagcacattcagcttctgcagaaaaacgtacgcgcccagcttgtggatatgaaacgcttggaggtggacattgacatcaagatccggtcttgcaggggtagctgttcccgggcactggcacgggaagtcgatctaaaggattacgaggatcagcagaaacagctcgagcaagttattgctaaggacctcctcccaagtagggaccgacagcacctgcccctgatcaagatgaaacccgttcccgacctagtgccgggcaactttaagagtcagctccagaaggtcccaccagagtggaaggccctaaccgacatgccacaaatgagaatggagctcgaacgcccaggcggaaatgagatcacaaggggtggtagcactagctatggcaccgggtcggaaacagaatcccctcgcaatccatctagtgcagggtcctggaacagtgggtcctcaggtcccggaagcaccggcaaccggaacccaggaagctccggcaccgggggcactgccacatggaagccaggctctagtggcccaggcagcaccgggagttggaactccgggtcatcagggacaggaagcaccggaaaccagaacccaggttccccccggcccggcagcaccggcacttggaacccaggatcatctgagagaggctctgcaggccactggacatcagagtctagcgtgtcaggaagcactggtcaatggcattccgaaagtgggtctttcagacctgacagcccagggtccgggaatgctcggcctaataacccagactggggcacatttgaggaggtgtcgggcaacgtatcccccggaactcgccgcgagtaccatactgaaaaattggttacttccaagggtgataaagagttgcgtaccggaaaggagaaggtgacctcgggatcaaccactaccacccgcagatcatgtagcaaaacagttaccaaaacggttatcggtccggacggacataaggaagtcaccaaggaggtcgttactagcgaagatgggtcagactgtcccgaagccatggatctgggcaccctgtccgggataggcaccctagatggattccgtcatcgtcacccagatgaggccgcattttttgatactgcgtcgactgggaagacatttcccggcttctttagtcctatgcttggagagttcgtctcagaaaccgagtcccgcggcagtgagtcaggaatctttaccaacacgaaagagtcttccagccatcaccccggtatcgcagagtttccgagccgcggcaaatcaagctcttacagtaagcagttcacatcctctacatcttataatagaggcgactctaccttcgagtccaagtcttacaagatggccgacgaggcaggtagcgaagcagaccatgaggggacccacagcaccaaacggggacacgcaaagtcgcgcccagtgcgagattgcgatgatgtgctccagacccacccgagtgggacacagtccggaatcttcaatattaaattgcctggcagctccaagattttttctgtgtactgcgaccaagaaacaagcctcggagggtggctcttgatccagcagcgaatggatgggtcactcaactttaacagaacctggcaggactacaagaggggattcggatccctcaacgacgaaggtgagggtgaattttggttgggtaacgattatctgcacctgttgacacaaaggggttccgtactacgcgtcgagctggaggactgggctggtaacgaggcctacgctgaataccatttccgcgtggggtccgaagccgaggggtacgcattgcaagtaagttcatacgagggcacagctggggatgctctgatcgagggaagtgtggaggaaggcgcagaatacacatcacacaacaacatgcaattctctacctttgaccgggacgccgatcagtgggaggagaattgtgcagaggtgtacgggggcggctggtggtacaacaactgccaagctgccaacctgaacggcatttactaccctggtggatcttatgacccaagaaataatagcccctatgagatagaaaacggtgttgtttgggtctcctttcggggcgctgactactctctgagggctgtcaggatgaaaatccggcctctggtcacccag

SEQ ID NO: 11184 - DNA, 2598 bp, Artificial Sequence
  Description of Artificial Sequence: Synthetic coding sequence
atgttctctatgagaattgtatgcctggtgctgtccgtagtggggactgcatggaccgctgattccggagagggggatttccttgctgagggcggcggggtacgcggaccacgggtggtggagcggcatcagagcgcatgtaaggactccgattggcccttttgctccgatgaggactggaattataagtgccccagcggatgccgaatgaaaggactgatcgacgaagtcaaccaggacttcacaaataggatcaacaagctcaaaaactccctgtttgaataccaaaaaaacaacaaggacagtcatagtctcacaaccaatattatggaaattcttcgcggcgatttctcatccgccaacaatcgggacaacacttacaaccgcgtgtccgaagacctgaggagtaggatagaggtcttgaaaagaaaggtgattgagaaagtgcagcacatccagttgttgcaaaagaatgtgagggcccaattggtggatatgaaaagactggaggtggatatcgatattaaaataagaagttgtcgcggaagttgctccagggcactggcccgggaggttgatctgaaagattacgaagaccagcagaagcagctcgaacaagtgattgcgaaggatcttctcccaagcagggaccggcaacatcttcctctcattaaaatgaaaccggtcccagacctggtccccggaaacttcaagagccagctgcagaaagtcccgcccgaatggaaggcccttacagacatgccgcaaatgcggatggagcttgaaagacctgggggcaatgagatcacaaggggcggctcaaccagctacggaactggttcagagaccgaaagtcctaggaacccatctagtgcagggagctggaatagtggatcatcaggccctgggagcacaggcaataggaatccaggtagcagcggaactggtgggacagctacatggaaacccgggtcatctggacctggctccacagggtcttggaacagtggcagctctggcaccgggtctaccgggaatcagaacccggggtccccacggccgggatctacaggtacctggaaccctgggagctcagaaagagggtcagccggacactggacttccgagagttcagtgtcaggcagcactggacagtggcatagcgagagcggatcttttcggccagatagtcctggaagtggcaacgcccggcccaataatcccgattggggtaccttcgaagaagtcagtgggaacgtatctcctgggacccggcgggaataccacacagagaaactggtcacttcaaagggagataaagagctccggacaggcaaggaaaaggtgaccagcggttccactacaacaacaaggaggtcttgttccaaaacggtcacaaaaacagtgatcgggccagatggacacaaggaagtgactaaagaagttgtaacaagcgaagacggctctgattgtcctgaggcgatggacttgggcacccttagcggtattggtacactggatgggtttcggcataggcatccggacgaggccgccttcttcgatacggcttctaccgggaaaacattccccggcttcttttctcccatgctgggagaatttgtgagcgagacagaaagtcgagggtctgaatcaggcattttcacaaacacaaaggagagttccagtcaccatcctgggattgctgagttccctagtaggggcaagtctagtagctacagcaagcagtttacaagttccacctcttacaacagaggagactccacctttgagtctaaaagttacaagatggccgacgaggcgggctccgaggcagaccacgaaggcactcactcaactaagagaggtcatgctaaatccaggcccgtgagggattgcgatgatgtgttgcagacacacccaagcggtacgcagagtgggatttttaacattaagctgcctggatcttctaagatcttctcagtttattgcgatcaagagaccagcctgggtgggtggctgctgattcagcagagaatggacgggtccctgaacttcaaccggacctggcaggattacaagaggggattcgggtctctgaacgacgagggggagggcgagttttggctggggaacgattatctgcatttgctgactcagcgggggagcgtattgagagttgagctcgaagactgggccggcaatgaagcttacgctgagtatcacttccgcgtcggctccgaggccgaagggtacgcactgcaggtatcttcttacgaaggaaccgccggagatgccctgatcgaggggtccgtagaggaaggggccgagtatacttctcataacaatatgcaattctcaactttcgatcgggacgcggaccagtgggaagaaaattgtgctgaggtatacggaggtgggtggtggtataacaattgtcaggccgcaaatctgaatggtatctattaccctgggggatcttatgaccctcgaaacaactctccttacgaaatcgagaacggggtggtatgggtatcttttcgaggggctgactattcattgcgggccgtccgaatgaagatacgaccactcgtgactcag

SEQ ID NO: 11185 - DNA, 2598 bp, Artificial Sequence
  Description of Artificial Sequence: Synthetic coding sequence
atgttctctatgaggattgtgtgtctagtgctaagcgtggtgggaaccgcatggacagccgactccggggagggggatttcttagccgaaggtggaggggtgagaggtccgcgcgtcgtggagcggcaccaatccgcctgcaaagactctgactggcccttctgttctgatgaggattggaactacaaatgcccttcgggctgcaggatgaaagggctcatcgatgaagtgaatcaggattttacaaaccggattaacaagctgaaaaacagcttattcgagtaccagaaaaacaacaaggacagccacagcttgaccactaacatcatggagattctgcggggcgatttttcttctgcaaataaccgagacaacacttacaaccgggtctccgaggatttgcgatcccgcatcgaggtgttgaagcggaaggtgatagaaaaggtgcagcacattcagctcttgcagaaaaacgtgcgtgcacagctagtagatatgaagcgcctcgaagttgacatcgatatcaaaataagaagctgccgcgggagctgttctcgggccttggctcgggaggttgatctgaaggactacgaagatcagcagaaacagctcgaacaggttattgccaaggacctcctgccttcaagagaccgccaacacctgcccctcataaagatgaagcccgtgcccgacctggtgcctggcaattttaagagtcagctccaaaaagtgcctccagagtggaaggccctgacagacatgcctcagatgagaatggagcttgagcgaccgggaggcaatgagatcacaagaggcgggtccacttcatatggaaccggatctgaaaccgagtcacctcggaacccgtcatctgccggaagttggaatagcggcagttccggacctggcagtactggaaacagaaacccaggatcctcgggaactggaggcacagccacatggaagccaggttccagcggtcccggcagtactggctcctggaacagcggctcctccgggacaggatctaccggcaatcaaaaccccgggtccccaagacccggatccacgggtacatggaacccagggagttccgaaaggggatctgccggccattggacctctgagtctagcgtgtctggttcaactgggcagtggcacagcgaaagcggtagctttagacccgatagtccaggctccggcaatgcccgcccaaataaccccgactggggaactttcgaggaagtgagcgggaatgtgtcccctgggactcgaagagagtatcatacggagaagctcgtgacctccaagggggataaagagttgaggacgggaaaagaaaaagtgacttccggctccaccactaccaccagaaggagctgctctaagacagtcacaaagactgtcattggacccgacggccacaaagaggtcaccaaggaggtcgtgactagcgaagacgggtctgactgccccgaagccatggatctcggaacgctctccggtatcggaaccctagatggatttaggcaccgacatccggacgaagctgccttcttcgatactgcttccacgggcaagacgttcccgggttttttctcgccaatgctcggtgaattcgtgtctgaaaccgaaagccgaggctctgaatctggaatatttaccaataccaaggaaagctcttcgcaccatccgggaatcgctgaattcccctctagggggaagagctccagctactctaagcagtttactagctctacctcatataacagaggcgacagcacttttgagtccaagtcctataaaatggccgacgaggcaggctccgaggcagaccacgaaggtactcacagtacaaaacgaggccatgctaaatcaagacccgttcgcgattgtgatgatgttttacagacacatcctagcggtacccagtctggaatcttcaatatcaagctgccaggatccagcaagattttttctgtgtattgcgatcaagagacaagtctcggtgggtggttgcttatccaacagaggatggacggtagtcttaactttaataggacctggcaggattataagaggggttttggctctctaaacgacgaaggtgagggcgagttttggctgggcaacgattatttacatctgctgacgcaaaggggcagtgttcttcgcgtggaactggaagactgggcaggtaacgaggcctatgcagaatatcacttcagggtgggctctgaggctgaagggtacgccctgcaggtttccagctacgagggcaccgccggcgacgcactgatagagggaagcgtagaggagggagcggagtacacatctcacaataatatgcaattctcgaccttcgatagagatgcggatcagtgggaagaaaactgcgccgaggtttacggagggggatggtggtataataattgccaagcagcaaacctcaatggcatatactaccccggcggaagctacgaccccaggaataatagcccatacgagatcgaaaatggggtggtgtgggtctccttcagaggagccgactattccttgcgcgcagttcggatgaagatccgccccttggtgacacaa

SEQ ID NO: 11186 - DNA, 2598 bp, Artificial Sequence; identical to SEQ ID NO: 11160
  Description of Artificial Sequence: Synthetic coding sequence

SEQ ID NO: 11187 - DNA, 2598 bp, Artificial Sequence
  Description of Artificial Sequence: Synthetic coding sequence
atgtttagcatgcgaattgtttgtctggtgctgagtgttgtgggtactgcgtggactgccgattccggagagggtgacttccttgcagaaggcggcggtgttcgcggccctcgggttgtggaaaggcatcagtccgcgtgcaaagattcggactggcctttctgtagcgacgaagactggaactataagtgtcctagtgggtgcaggatgaaaggcctgatcgatgaggtgaatcaagactttaccaaccgcatcaacaaactgaagaactccctattcgagtaccaaaagaacaacaaagattcgcattctttgaccacaaacattatggaaatcctgcgaggtgactttagctctgccaataaccgcgataacacttataaccgtgtcagcgaggatctccggagccgaattgaggtcctgaaacgcaaagtcatcgagaaggttcagcatattcaactcctgcaaaagaatgttcgcgcacagctggtcgacatgaaacgtctcgaagttgatattgacatcaaaatccggtcctgtagagggagctgtagccgcgctctggctcgcgaggttgacctgaaggactacgaggaccaacagaagcaactggagcaggtgatcgcaaaagatctcctgcctagtcgagacaggcagcacctgccattgattaagatgaaaccggtgcctgacctggtacctggcaacttcaagtctcaactgcagaaggtgccaccagagtggaaagctctgactgatatgccgcaaatgcggatggaattggaacggccaggcggcaacgagatcacccgcggcgggtctactagctatggcaccggctccgagacagaatcaccgcggaatccgtcgagcgccggcagctggaacagcggctcgagcggtccaggcagcacgggtaataggaacccgggaagcagcggaaccggtgggacagctacctggaagcctggttccagtggtcccggctccactggatcatggaattcaggcagctccggcacgggttcgacggggaaccaaaaccccggcagcccacgccctggaagcacgggcacctggaatccaggtagtagcgagcgcggaagcgccggtcactggacgtccgagagcagcgttagcggatcaactggccagtggcacagcgaatccggctcatttcgcccagacagcccaggtagcggtaacgcccgtcccaataatccggattgggggacgtttgaagaggtcagcggaaacgtaagcccaggtacccggcgggaatatcacacagaaaagttggtgaccagcaagggagacaaagagctacgcacgggtaaagaaaaagttacctccggcagcaccacgactacgcgtcgatcatgctcgaaaaccgttacaaagaccgtgatcggccccgatggacataaggaggtcaccaaggaggtcgtaacgagtgaggatgggtccgattgccctgaagcgatggacttgggcacgttaagcggaatcggcacccttgatgggtttcgtcaccgtcacccggacgaagctgcgtttttcgatacggccagcaccggtaagacctttcctggattcttttccccgatgctgggagaattcgtgtccgaaaccgagtcccgcggctctgagagtggtatttttacgaacacgaaagaatcgagcagccaccatccaggcattgcagagttcccgtcgcggggtaagagctcttcctattctaaacagttcactagctccaccagctacaaccgcggcgattctaccttcgaatctaagtcttataaaatggcggatgaagcaggcagcgaagcagatcatgagggtactcacagcactaaacgtggccatgcgaagtcccggcctgtgcgtgactgtgacgatgtcctgcagactcatcctagtggaactcaatccggcatttttaatataaaactcccaggctctagcaagatattctcagtttactgtgaccaggaaacatcccttggaggttggctgttgatccaacagcgcatggatggcagccttaattttaaccgcacctggcaggattataagagggggttcgggtcgctgaatgatgaaggtgagggtgaattctggcttggcaatgattacctgcatctgttaacacagcgaggcagcgtgctgcgcgtggaactggaagactgggccggtaacgaagcgtatgcagaataccacttccgcgtcggcagtgaagcggagggatacgcactgcaggtaagctcctacgagggtacagcgggcgatgctttgattgaggggagcgtggaggaaggtgctgagtatactagccacaataatatgcagttcagcaccttcgatcgtgacgcggatcagtgggaagagaattgcgcggaggtgtatggcggcggttggtggtacaacaattgtcaggccgcgaatctaaacggtatttactatccaggcgggagctacgatcctcgcaacaactctccatacgagatcgagaatggtgtagtgtgggtcagctttcgcggtgcagactattcccttcgcgccgtgcggatgaagattcgacccctggttacccag

SEQ ID NO: 11188 - DNA, 2598 bp, Artificial Sequence
  Description of Artificial Sequence: Synthetic coding sequence
atgttttctatgcgcatcgtttgcctggtactttcggtggtaggtaccgcgtggaccgcagattctggggaaggcgatttcctcgcggaaggtgggggggtgcgaggcccaagagtagtggagcgccatcagtccgcctgtaaagactcagactggcccttctgttcggatgaggactggaattataaatgtccctcaggatgccgcatgaagggtctgatagacgaggtgaatcaggacttcaccaatcggataaacaaactgaagaattccctgtttgaataccagaagaacaacaaggactcccattccctgacgacgaacattatggagattctcagaggcgatttcagtagcgcgaacaacagggacaacacatataacagagtgtctgaagatttaagaagtcgcatagaggtgttgaagagaaaggttattgaaaaagtgcaacatattcagttgctgcagaagaatgtgcgtgcccagctggtcgatatgaagcgtctggaagtcgacattgatattaagatacgatcatgtcgtgggagctgttcacgggcattagccagagaggtggacctgaaggactacgaggatcagcagaaacagcttgagcaagtgattgcaaaggacctgctcccatctagagatcggcagcacctccccctgatcaagatgaagcctgttcctgacctagtacccggtaacttcaaatctcagctccagaaggtgcccccagagtggaaagcactaactgatatgccacagatgcgtatggagctcgagaggcccggagggaacgaaataacccgcgggggatcaacatcttatggtaccggctcagaaacagagtctcctagaaatccctcttctgcaggatcttggaatagtgggagcagtggccccggcagtaccgggaaccggaaccctgggagttcaggcactggcgggaccgccacgtggaaacccggatccagtggccctggaagtacggggtcgtggaattcaggaagctctggaacaggttcaactgggaaccagaatccaggaagcccaaggcccggaagtaccgggacatggaaccctgggtcttcagagcgcgggtctgctgggcactggacatcagagtcaagtgtgagtggctcaactggccaatggcatagcgaatctggatcgtttcggcctgattcgccaggatcaggcaatgcaaggccaaataaccccgactgggggaccttcgaagaggtgtctggcaatgttagtcctggaacccggcgcgaataccacacagagaaattagtgacctcgaagggcgacaaggagctgcgaactgggaaggaaaaagttaccagcggcagtactaccacaacacgccggagttgttccaaaacagttacgaagacagtgatcggcccggatggccacaaagaagtgacaaaagaagtggtcaccagcgaggacgggagtgactgcccagaggcaatggatctgggaacgctgtctggtattggcactctagatggcttcagacaccgccatcctgacgaggctgccttcttcgatacagcttccacagggaagacgttccctgggtttttttcaccgatgcttggcgaatttgtgagcgagaccgagtctcgtgggagtgaatccgggatttttacgaacacgaaggagtcttcctcgcatcatccagggattgccgagttcccatcgcggggcaagtcaagcagctattctaaacagttcacgagctccacctcttataacaggggcgacagcacctttgaatccaaatcttataagatggctgatgaggccggttctgaggcggatcacgaaggtactcacagtacgaagagaggacacgccaagtcccgcccagtgagggattgcgacgacgtacttcagactcaccccagcggcacacagtcaggtattttcaacatcaaactgccggggtctagcaagatattctcggtttactgtgatcaagagactagtctgggcgggtggcttctaatacagcagcgcatggacggctcccttaacttcaaccgcacctggcaagattataagagaggatttggatcgctcaacgatgaaggggagggagagttctggctgggtaatgattacctgcaccttctgacacagagaggaagcgtgttgagggtggaactcgaagattgggccggcaatgaagcatacgcagaataccacttccgggtggggagcgaagccgaggggtatgcgttgcaggtcagctcctatgaggggacagctggagatgccctaatcgagggatctgttgaagaaggcgcggagtataccagccacaataacatgcagttctcaactttcgatagggatgcggatcagtgggaggaaaactgtgccgaggtctacgggggggggtggtggtataataattgccaggctgctaatcttaacgggatctattatcccgggggaagctacgatccccggaacaactcaccgtatgagattgaaaacggcgtggtgtgggtgtcattcaggggtgcggactactcgctcagggcagtcaggatgaagatcaggcctctggttacacag

SEQ ID NO: 11189 - DNA, 2598 bp, Artificial Sequence
  Description of Artificial Sequence: Synthetic coding sequence
atgttttccatgcggatagtatgtttggttctgagtgtcgtggggaccgcatggactgctgatagtggagagggggatttcctggctgagggcggaggagtgcggggcccaagagtcgtggagcggcaccagtctgcctgcaaggactcagactggccattctgctccgatgaagattggaactacaagtgtcccagcggttgcaggatgaaaggactcattgacgaagtgaaccaggatttcaccaatcggatcaacaagttgaagaattcgctgttcgagtatcaaaaaaataacaaagatagccacagcttgaccacaaacatcatggagatcctgcggggagacttctctagcgcaaataacagagataatacctataacagagtcagtgaggacctaaggtcaagaatcgaggtgctgaagagaaaagttatcgagaaagtccaacacattcaactgcttcagaaaaacgttcgggcccagctggtggatatgaaaaggctggaagtggacatagatattaaaatcaggagctgccgcggcagctgctccagggcattggcgcgcgaggtggatttaaaagattatgaggaccagcagaagcaactggaacaggtgattgctaaggacctactgccttcccgcgatcggcagcatctcccattgatcaaaatgaaacctgttcccgacttagtgcccggaaattttaagtcccagctccagaaggtgccaccagagtggaaggctctgacagacatgcctcagatgagaatggagcttgagaggccggggggcaatgaaatcacacgcggcggtagtacctcttacggtactggaagtgagaccgagagtcctcgcaacccctccagtgcaggtagttggaatagtggttccagtggtccaggcagcacaggcaatagaaacccaggcagtagtggcactgggggaaccgccacctggaagcccggctccagtgggcccgggtctaccgggtcttggaatagcggcagttcaggcactggcagtactggcaatcagaaccctggaagcccacgtcccggttccactggcacatggaatccaggttcctccgagcggggatctgcagggcactggactagcgagagttcagttagtggttcaactggccaatggcacagcgaaagtggctcttttcgtccagacagcccaggtagcgggaacgcaagacccaacaacccagactggggaacatttgaagaggtctccggtaatgtgtcacctggcacacgtagagagtatcacactgagaagctcgtgacttcaaagggggacaaagagctcagaacaggcaaggagaaggtgaccagcgggagtactacaacaacccggaggagttgcagcaagaccgtaactaagactgttatcgggcctgatggccacaaagaggtcacaaaggaggtggtcacgtctgaagacggctcagactgtcctgaagcaatggacttgggaacgttatcaggaatcggcacgctcgatggtttcagacacaggcatcctgatgaggccgcttttttcgacaccgcatcgacaggtaagaccttccccggttttttctctcctatgctgggggagttcgtttccgaaactgagtccaggggtagcgaatccggtattttcacgaatactaaggaatcctctagccatcacccaggcatcgccgaatttccgtcacggggcaagtcctctagttattctaagcagttcacctcctccacgagttataaccggggagactctacctttgaatccaagtcttacaagatggccgacgaagccggcagtgaggccgaccatgaggggactcactccacaaaaaggggacatgccaaatctagaccggttcgcgactgtgatgatgttctccagacccaccccagcgggactcagagcgggattttcaacatcaaactccctggtagcagcaaaatcttctctgtatattgcgatcaagagacatcattggggggctggttgctcatccagcagagaatggacggctccctgaatttcaaccgtacctggcaggattataagcgagggtttggttcgttgaatgatgaaggcgagggagaattttggctgggaaatgattatcttcacttgcttacccaacgaggctctgtgcttcgagtggaactggaggactgggctgggaatgaggcctatgccgagtatcactttcgggtggggtccgaggccgagggatacgctttacaggtgtccagttacgagggaaccgcaggcgatgccctgattgaaggttctgtggaagagggcgcagagtatacaagtcacaataacatgcagttcagcacctttgatagagatgccgaccagtgggaggagaactgtgctgaggtgtacggcgggggctggtggtacaacaattgccaggcggcaaatctgaacggcatctattacccaggtgggtcctacgatccacggaataattcaccttatgagattgagaatggcgtagtgtgggtgtcatttcgcggcgctgactacagccttcgagcagttcggatgaaaataagaccactggtgacccaa

SEQ ID NO: 11190 - DNA, 2598 bp, Artificial Sequence
  Description of Artificial Sequence: Synthetic coding sequence
atgttttcgatgcgaatagtatgtctagtactatcggtagtaggtacggcgtggacggcggattcgggtgaaggtgattttttagcggaaggtggtggtgttcgtggtccgcgagttgtagaacgtcatcaatcggcgtgtaaagattcggattggccgttttgttcggatgaagattggaattataaatgtccgtcgggttgtcgtatgaaaggtttaatagatgaagtaaatcaagattttacgaatcgaataaataaattaaaaaattcgttatttgaatatcaaaaaaataataaagattcgcattcgttaacgacgaatataatggaaatattacgaggtgatttttcgtcggcgaataatcgtgataatacgtataatcgtgtatcggaagatttacgttcgcgaatagaagtattaaaacgaaaagtaatagaaaaagtacaacatatacaattactacaaaaaaatgttcgtgcgcaattagtagatatgaaacgtctagaagttgatatagatataaaaatacgttcgtgtcgtggttcgtgttcgcgagcgttagcgcgtgaagtagatctaaaagattatgaagatcaacaaaaacaactagaacaagttatagcgaaagatttattaccgtcgcgtgatcgtcaacatctaccgctaataaaaatgaaaccggtaccggatttagttccgggtaattttaaatcgcaactacaaaaagtaccgccggaatggaaagcgctaacggatatgccgcaaatgcgtatggaattagaacgtccgggtggtaatgaaataacgcgtggtggttcgacgtcgtatggtacgggttcggaaacggaatcgccgcgtaatccgtcgtcggcgggttcgtggaattcgggttcgtcgggtccgggttcgacgggtaatcgaaatccgggttcgtcgggtacgggtggtacggcgacgtggaaaccgggttcgtcgggtccgggttcgacgggttcgtggaattcgggttcgtcgggtacgggttcgacgggtaatcaaaatccgggttcgccgcgaccgggttcgacgggtacgtggaatccgggttcgtcggaacgaggttcggcgggtcattggacgtcggaatcgtcggtttcgggttcgacgggtcaatggcattcggaatcgggttcgtttcgtccggattcgccgggttcgggtaatgcgcgaccgaataatccggattggggtacgtttgaagaagtttcgggtaatgtttcgccgggtacgcgtcgtgaatatcatacggaaaaattagtaacgtcgaaaggtgataaagaactacgtacgggtaaagaaaaagtaacgtcgggttcgacgacgacgacgcgtcgttcgtgttcgaaaacggtaacgaaaacggttataggtccggatggtcataaagaagtaacgaaagaagttgtaacgtcggaagatggttcggattgtccggaagcgatggatctaggtacgctatcgggtataggtacgttagatggttttcgtcatcgacatccggatgaagcggcgttttttgatacggcgtcgacgggtaaaacgtttccgggttttttttcgccgatgttaggtgaatttgtatcggaaacggaatcgcgaggttcggaatcgggtatatttacgaatacgaaagaatcgtcgtcgcatcatccgggtatagcggaatttccgtcgcgtggtaaatcgtcgtcgtattcgaaacaatttacgtcgtcgacgtcgtataatcgaggtgattcgacgtttgaatcgaaatcgtataaaatggcggatgaagcgggttcggaagcggatcatgaaggtacgcattcgacgaaacgtggtcatgcgaaatcgcgtccggtacgtgattgtgatgatgttttacaaacgcatccgtcgggtacgcaatcgggtatatttaatataaaattaccgggttcgtcgaaaatattttcggtatattgtgatcaagaaacgtcgctaggtggttggttactaatacaacaacgtatggatggttcgttaaattttaatcgaacgtggcaagattataaacgtggttttggttcgctaaatgatgaaggtgaaggtgaattttggctaggtaatgattatttacatctactaacgcaacgtggttcggtactacgagttgaattagaagattgggcgggtaatgaagcgtatgcggaatatcattttcgtgtaggttcggaagcggaaggttatgcgttacaagtttcgtcgtatgaaggtacggcgggtgatgcgttaatagaaggttcggtagaagaaggtgcggaatatacgtcgcataataatatgcaattttcgacgtttgatcgtgatgcggatcaatgggaagaaaattgtgcggaagtttatggtggtggttggtggtataataattgtcaagcggcgaatctaaatggtatatattatccgggtggttcgtatgatccgcgtaataattcgccgtatgaaatagaaaatggtgtagtatgggtatcgtttcgaggtgcggattattcgctacgtgcggtacgtatgaaaatacgtccgttagtaacgcaa

SEQ ID NO: 11191 - DNA, 1473 bp, Artificial Sequence
  Description of Artificial Sequence: Synthetic coding sequence
atgaagagaatggtaagctggtccttccataaactaaagactatgaaacacctgctgctgctgctgctctgcgtgttcctcgtgaaaagtcagggcgtgaacgataacgaagaagggttcttctctgcgagggggcacaggcctcttgataagaaacgtgaggaagcgccttccctgcgacccgctccacctcctatctctggcgggggatatagggcccggccagcgaaggcggcggccactcagaagaaggtagagcgcaaggccccagacgctgggggctgtttgcacgccgatccggacctgggagtgttgtgtccgactggctgccagctgcaggaagccctgctccagcaagagcggcctattaggaattcggtggatgaactcaacaacaacgttgaggccgtcagccagaccagtagtagtagctttcagtatatgtacctcttgaaggacctttggcagaaacgacagaagcaggtgaaagacaacgagaatgtggtgaacgagtactcatcagaactggaaaaacaccagctgtacatcgacgagacggtgaattcaaatatccccacgaacctgcgggtgctacgctccatcttggagaacttaaggtcaaaaatccaaaagctggagagcgacgtgtctgcacagatggagtactgtaggaccccctgcacagtgagctgtaatatccccgtagtgtctgggaaagagtgtgaggagattatcagaaaggggggagaaacctctgagatgtatctgatccagcctgactcttccgtcaagccctatcgcgtttactgtgatatgaacaccgaaaatggggggtggacggttattcaaaatagacaggatgggagtgtcgattttggacgcaaatgggatccatacaagcaaggttttgggaatgtggccactaatacagatgggaagaactactgcggactgcctggtgaatattggctgggaaacgataaaatcagccagctgacccgaatgggtcccacagagctgctgatcgagatggaggattggaagggcgataaggttaaggcccactacggcgggtttactgtccagaatgaggccaacaagtaccagattagtgtgaacaagtaccggggcactgccggcaatgctctgatggatggcgcttcccagcttatgggcgagaaccgcacaatgactattcataacggtatgttcttttcgacgtacgatcgcgacaatgatgggtggctgacaagcgatcccagaaagcagtgtagcaaggaggatgggggcggctggtggtacaataggtgccatgccgccaacccaaacgggcggtattattgggggggacagtacacgtgggacatggccaagcatggcacagacgatggagttgtgtggatgaactggaaaggaagctggtactcaatgcggaagatgtccatgaagattaggcccttctttccacagcaa

SEQ ID NO: 11192 - DNA, 1473 bp, Artificial Sequence
  Description of Artificial Sequence: Synthetic coding sequence
atgaaaaggatggtgtcgtggtcatttcataaactgaaaactatgaaacacctgctcctgttgctgctgtgtgtgtttttggttaagagccagggtgtcaatgacaacgaagaaggttttttcagcgcccgcgggcacagaccgctggataagaagcgggaagaggcccccagccttcggcccgcgcccccgccaattagcggcggaggctacagagcacgtcctgcaaaggccgcggctactcagaagaaagtcgaacgaaaggcacctgatgcaggaggttgcttgcatgcagaccctgacctgggagtgctttgtcctaccggttgtcaactgcaggaagcacttctgcagcaagaaaggcctattaggaactccgtggatgaactcaacaacaacgttgaggcagtttcacagacctcgagcagcagctttcaatacatgtacctcctgaaggatctttggcagaaacgtcagaagcaagtcaaggataacgagaacgtggtaaacgagtacagctccgaactggaaaaacatcagttgtacattgatgagactgtgaactcaaatatccctactaacttgagagtgctgcgaagcatacttgagaatctgcgctctaaaatccagaagctcgagtccgatgtgtcggcacaaatggagtactgccgcaccccttgtactgtcagctgtaacatacccgtggtttccggcaaggagtgtgaggagattatccggaagggaggtgaaaccagcgaaatgtacctcatccagcctgattcctcggtcaagccatatagagtgtactgcgacatgaacactgaaaatggagggtggacggtgattcagaacagacaagatggatcggtggactttggcaggaagtgggatccttacaagcaaggtttcggcaacgtggcgaccaatactgatggtaaaaactactgcgggcttcctggtgagtactggcttggcaacgacaagatctcgcagcttaccaggatgggaccaactgagctcctgatcgaaatggaggattggaaaggagataaagtcaaggctcactacggaggtttcactgtgcagaacgaagcgaacaagtaccaaatttcggtgaacaagtaccgcggaacggcaggaaatgccctgatggacggagcaagccaacttatgggtgaaaacagaacgatgactattcataatggtatgttcttctcaacttacgatagagacaacgatggttggctcacttcggatccccgcaagcaatgctcaaaggaagatggaggaggatggtggtataaccgctgtcatgccgcgaaccctaacggtcgatactactggggaggccaatacacttgggatatggcaaagcatggaactgacgacggtgttgtgtggatgaactggaagggttcatggtacagcatgcgtaagatgtccatgaaaattcggcccttttttccccaacaa

SEQ ID NO: 11193 - DNA, 1473 bp, Artificial Sequence
  Description of Artificial Sequence: Synthetic coding sequence
atgaagagaatggtgtcgtggtcatttcataagctcaaaacgatgaaacatctgcttctgctgctgctgtgcgtgttcctggtgaaaagccagggggtgaacgacaacgaggaaggattcttctcagcccggggccacagaccactggacaagaaacgggaagaagcgcccagcttgcggccggcacccccgcctatctcggggggcggttaccgcgcccgaccggcgaaggccgccgccactcagaagaaagtggagaggaaggcgcctgacgctggtggatgcttgcacgctgaccctgaccttggggtgctgtgcccgactggatgccaactccaggaggcccttctccagcaagaacgcccaatcagaaattcagtggatgagctcaacaataacgtggaggctgtgagccagacctcctcgagctccttccaatacatgtatctcctgaaggacctgtggcagaagaggcagaaacaggtcaaggataacgaaaacgtcgtcaatgaatactcctcagagctggaaaagcaccagttgtacatcgacgagactgtgaacagcaatatcccaacgaacctccgggtgctgcggagcatccttgaaaaccttagatcgaaaatccaaaaactggaatccgacgtgtcggctcaaatggagtactgtagaactccgtgcactgtttcctgcaacatcccagtggtgtcgggcaaagagtgcgaggaaatcatcagaaaaggaggagagactagcgaaatgtacctcatccaacctgatagctcagtgaaaccttaccgcgtgtactgcgacatgaacactgaaaacggaggatggaccgtcattcaaaacaggcaggacgggtccgttgacttcggacgaaagtgggacccgtacaagcagggattcggcaacgtggcgacgaataccgacggaaagaattactgtgggctgccgggggagtactggctgggaaacgacaaaatctcacaactgaccagaatgggtccgaccgagctcctcatcgaaatggaagattggaagggggataaggtgaaggcgcactacggaggattcactgtgcagaatgaggccaacaagtaccaaatcagcgtgaacaagtaccggggcactgccggcaatgcactgatggacggggcttcccaactgatgggcgaaaacagaaccatgactattcacaacggcatgttcttttcgacttacgaccgggataacgacgggtggttgacgtcggacccgcgaaagcagtgctcgaaagaggacggcgggggctggtggtacaaccgctgccacgccgccaaccccaatggccgatactactggggaggacagtacacctgggatatggccaaacacggcaccgatgacggcgtcgtctggatgaactggaaaggatcatggtactccatgcgcaagatgtcaatgaagatccggcccttcttcccacagcag

SEQ ID NO: 11194 - DNA, 1473 bp, Artificial Sequence
  Description of Artificial Sequence: Synthetic coding sequence
atgaagcgaatggtgtcgtggagcttccacaagttgaaaacgatgaagcacctgctgctcctgctgctttgtgtgtttctggtaaagtcgcagggtgttaacgataacgaagaaggttttttctccgcccggggacataggccacttgataagaaaagagaagaagcaccttcattgaggcctgctcctccgcctatcagcggcggcggttacagggccagacctgcaaaagcagcagcgacccaaaagaaggtcgaaaggaaggcacctgacgcaggcggatgccttcacgccgacccggatcttggagtgctgtgtccaaccggctgtcagcttcaagaagcacttcttcaacaagaaagaccaatccgaaattcggtcgacgaacttaacaacaatgtggaagcagtgtcgcagacttcctcctcgagctttcagtatatgtaccttctgaaggacctgtggcagaagaggcaaaagcaggtgaaagacaacgaaaatgtggtgaatgaatactcgagcgaactggagaagcatcaactgtacatcgatgagactgtcaactccaacattcctaccaaccttcgcgtcctgagatccatccttgagaacctgcgctcgaaaatacaaaaacttgagtccgacgtctccgcgcaaatggaatactgcagaaccccctgcacggtgtcatgcaacatccctgtggtgtcgggaaaggaatgcgaggagattatcagaaagggcggagagacttcggaaatgtaccttattcagcctgacagctcggtgaagccataccgtgtgtactgcgatatgaatactgagaatggtggctggaccgtgatccagaaccggcaagacggaagcgtcgattttggtagaaagtgggacccatacaagcagggctttggaaacgtggctactaacactgatggtaagaactactgtggtttgccaggagagtactggctgggtaacgacaagatctcccaacttacccgcatgggccctactgaactcctgattgagatggaagattggaagggggataaggtgaaggcccattatggcggatttacggtccagaacgaggccaacaagtaccaaatatctgtcaataagtacagaggtaccgcaggaaacgcacttatggatggagcctcgcaactcatgggcgaaaaccgtactatgactattcataatggaatgttcttttccacttacgatagagacaacgatggttggcttacctccgacccgaggaaacaatgctcgaaagaggatggtggtggttggtggtacaatcggtgtcatgccgcgaatccaaacggtagatattactggggagggcagtacacctgggacatggccaaacacggcactgatgacggtgttgtttggatgaattggaagggtagctggtattccatgcgtaaaatgtcgatgaagattaggccttttttcccccaacag

SEQ ID NO: 11195 - DNA, 1473 bp, Artificial Sequence
  Description of Artificial Sequence: Synthetic coding sequence
atgaagagaatggtgtcctggtcgttccataagttgaaaactatgaagcatcttctcctgctgttgctttgcgtgttccttgttaagtcgcaaggcgtcaacgacaacgaagaaggatttttctcggcacgtggacatcggccactggacaaaaagcgtgaagaagccccttcccttagaccagcccctcctcccatttccggaggaggttaccgcgcaagacctgcgaaggctgcagccacccaaaagaaagtcgagcgcaaggcccccgatgcgggcggttgcctgcacgccgaccctgacctcggcgtcctttgtcccaccggttgccagctccaggaagcacttcttcaacaagagcgacctataaggaactcggtggacgaactgaacaacaacgtggaagcagtaagtcagacctcaagctcgtcctttcagtacatgtacctgctgaaagacctctggcaaaaacgccagaagcaagtcaaggataatgaaaatgtggtcaacgagtattcatcggagctcgaaaagcatcagctgtacatcgacgaaaccgtcaacagcaacattcctaccaacctgagggtcttgaggtcaatccttgaaaaccttaggtccaagattcaaaaactggaatccgacgtttcggcgcaaatggagtactgtaggaccccgtgcaccgtgagctgtaacatccctgtagtctcggggaaggaatgtgaagagatcatccggaagggcggcgaaacctcagagatgtaccttattcagcccgattcatccgtgaaaccttaccgcgtttactgtgatatgaacacggaaaatggaggttggactgtgattcagaaccgccaagacggctccgtggactttggaagaaaatgggatccttacaagcaggggtttggaaacgtcgcaaccaatactgatggaaagaattactgtggcctccctggtgagtactggctgggaaatgataagatcagccagctcacccggatgggaccaaccgagttgcttatagaaatggaagattggaaaggcgataaggttaaggcccactacgggggcttcactgtccagaacgaggccaacaagtaccaaatttcagtcaacaaatatcggggaactgcaggaaatgctcttatggacggagcatcccagttgatgggtgaaaacagaactatgaccatacataatggtatgtttttctccacgtacgatagagacaatgacgggtggctgacttcggaccccagaaagcaatgctccaaggaagatggtggtgggtggtggtacaatagatgtcatgcagccaaccctaatggccggtactactggggagggcagtacacttgggatatggccaaacacggaactgacgatggagtggtgtggatgaactggaagggatcatggtactctatgcggaagatgtcgatgaagattagacccttttttcctcagcaa

SEQ ID NO: 11196 - DNA, 1473 bp, Artificial Sequence
  Description of Artificial Sequence: Synthetic coding sequence
atgaaacggatggtctcctggagctttcacaaacttaaaactatgaaacatttactgctgctgctgctgtgtgtcttcctcgtgaaatctcagggtgtgaacgataatgaagaagggtttttttctgcccgcggccaccgacctctggataaaaaacgagaagaagccccttccctgcgaccggccccgccgcccattagtggcggcgggtacagagcaaggcccgctaaagcggccgccactcagaagaaagtggaacgcaaagcgccagacgctggcggctgtttacacgctgatcctgaccttggggtgctttgccctacgggttgccagctccaggaagcactgcttcagcaggagcggccgattagaaattccgtcgacgagctcaacaataacgtggaggcagtgtcccaaacctcctctagcagcttccaatacatgtatctcttgaaggatctgtggcaaaagcggcagaaacaggttaaagacaacgaaaacgtggtgaatgaatattcctccgagctagaaaagcaccaattgtacatcgacgaaacagtgaactcgaatatccctactaacctccgggtattgcggtccatcctcgaaaacctgagatctaagatccagaaacttgagagcgacgtctctgcccaaatggagtactgcagaaccccctgcactgtgagctgtaacatccccgtcgtcagcgggaaagagtgcgaagagatcattagaaaaggaggagaaacaagtgagatgtacctgattcagccggattcttcagtcaagccctatcgcgtgtactgtgatatgaacacggaaaacgggggatggaccgtgatccaaaaccgccaggacggcagcgtggactttggtagaaaatgggatccatacaaacaaggcttcggtaacgtggccaccaacacagatggaaagaattactgtgggctccccggagagtactggctgggtaacgacaaaataagccagctaacccggatgggccctacggagcttttgatcgaaatggaggattggaagggagataaagtcaaggcacattatggtgggtttacagtccaaaacgaagccaacaaataccaaatctcggtcaataagtatagaggcactgccggcaatgctctcatggacggtgcctcccagctgatgggtgaaaatcgcaccatgacgattcacaacggaatgtttttttccacctacgacagagataatgacggatggctcacctctgatccccgcaaacaatgtagtaaagaggatgggggcggatggtggtataataggtgccacgcagccaacccaaatggcaggtactattggggaggacaatacacctgggacatggccaaacacggcaccgacgatggcgtggtttggatgaactggaaagggagttggtacagtatgcgcaaaatgtcaatgaaaatcagacccttctttccgcagcag

SEQ ID NO: 11197 - DNA, 1473 bp, Artificial Sequence
  Description of Artificial Sequence: Synthetic coding sequence
atgaaacgcatggtgtcctggtcgttccataagctgaaaacgatgaaacacctgctcctgttgctgctgtgcgtattcctggtaaaatcccagggagtcaacgacaatgaggagggcttcttctccgccagaggccatcgccctttggacaaaaaacgggaggaagctccatcactccggccggctcctcctccgatctccggcggaggctaccgcgccagaccggcaaaggctgccgccacgcagaagaaagtcgagcgcaaggccccggatgcgggagggtgcctgcatgccgacccagacctgggcgtcctgtgtccaaccggatgccagctgcaagaggcgctgcttcagcaagaacgcccaatcagaaacagcgtcgatgaacttaacaataatgtggaagcggtcagccaaaccagcagctcctctttccaatacatgtacctgctgaaggacctctggcagaagagacagaagcaggtgaaggataatgagaacgtggtgaacgaatattcatcggaactggaaaagcaccagctctacatcgacgaaaccgtgaactcgaatataccgacgaacctgagagtgctgcggtcgatcctcgaaaacttgaggtcaaaaatccagaagctggagtcagatgtcagcgcgcaaatggagtactgtcggactccgtgcaccgtgtcgtgcaacatcccggtcgtctcgggaaaggaatgcgaggagataattcggaagggaggcgagactagcgaaatgtacctcatccagccggactcctccgtcaagccataccgtgtatactgcgacatgaacactgaaaatggcggctggactgttattcagaatcgccaggacggatccgtggatttcggtagaaagtgggacccgtacaagcaaggttttggaaacgtggccactaacaccgacggaaagaattactgtgggttgcctggagaatattggctcggaaacgataagatctcccaactgacccggatgggaccgaccgaattgctcatcgagatggaggattggaagggcgacaaagtcaaagcacactacggaggatttaccgtgcagaacgaagccaacaagtaccaaatttccgtgaataagtaccggggaaccgccggtaacgccctcatggacggagcttcccaactgatgggagaaaaccggaccatgactatccataatggcatgttctttagcacttatgacagggacaacgatgggtggcttacttcggatccccgcaagcagtgctccaaagaggatggaggtggttggtggtacaatcgatgtcacgctgccaacccgaatgggagatactactggggaggtcaatacacttgggacatggccaagcacggaactgatgatggggtggtttggatgaactggaaggggtcatggtacagcatgcgcaaaatgagcatgaaaatcaggccatttttcccacagcag

SEQ ID NO: 11198 - DNA, 1473 bp, Artificial Sequence
  Description of Artificial Sequence: Synthetic coding sequence
atgaagcggatggtgtcgtggtcgttccacaaacttaagaccatgaagcacttgctgctgctgctcctgtgcgtttttctggtcaagtcccagggcgttaacgataacgaagaaggatttttctccgcacggggacatcgtccgctggataagaagcgggaggaggcgccaagcctgcggccggcaccgccgcccatctctggaggcgggtaccgtgcccgcccggccaaggcagcagctactcagaagaaggtggagagaaaagctccagatgcgggagggtgccttcacgcagatccggacctgggagtcctgtgtcctaccggatgtcagctgcaggaagctctgctgcaacaggagcggccaatccgcaattcggtggatgagctgaataacaatgtcgaggccgtttcgcaaacctcctcctccagcttccagtacatgtacctgttgaaagacctttggcagaagagacagaagcaagtcaaggataatgaaaacgtggttaatgaatactcgtcggagttggaaaagcatcagctgtacatcgacgagactgtgaactctaacattccaacgaacctgcgggtccttcgctcaattctcgagaacctgagaagcaagatccaaaaactcgaatccgacgtgtccgctcagatggagtactgccgcacgccgtgcactgtgtcgtgcaatatccctgtggtgtcgggaaaagaatgtgaagagatcattaggaagggaggcgaaacgtcagagatgtacctcatccaacctgactcgtcggttaaaccatacagagtgtactgcgacatgaatactgagaatgggggatggaccgtgatccagaacaggcaggacggatcggtggatttcggccggaagtgggacccatacaaacagggattcggaaacgtggcaactaacaccgatggcaagaattactgcggcctgccgggggaatactggctgggcaacgacaagatatcgcaactcacccggatgggaccaactgagcttctcatcgaaatggaagattggaaaggcgacaaagtgaaggcgcactacggaggattcaccgtgcagaatgaagccaataagtaccaaatctctgtgaacaaatacagaggtactgctggaaatgcgctgatggacggtgcgagccaattgatgggtgagaatcgcaccatgaccatccataacggtatgtttttcagcacctacgatagggacaatgatggatggctgacctccgacccccggaagcaatgtagcaaagaggacggcgggggctggtggtacaacagatgccacgccgccaacccgaacgggagatactactggggcgggcagtacacttgggatatggccaagcacggaacggatgacggagtggtgtggatgaattggaagggatcgtggtattcaatgcgcaagatgtcaatgaagatacggcccttctttccgcaacag

SEQ ID NO: 11199 - DNA, 1473 bp, Artificial Sequence
  Description of Artificial Sequence: Synthetic coding sequence
atgaagagaatggtgagctggtcgttccataaactgaagaccatgaaacatctcctcctcctgctgctctgcgtgtttctcgtcaagtcgcagggggtgaacgacaatgaggaaggattcttcagcgcgcgcggacacagaccgctggataaaaagcgcgaggaggccccttcactgcgacctgcaccaccgccaatttcaggaggcggataccgcgcgcgcccagccaaagcggctgccacccagaagaaagtcgaaaggaaggcccctgatgccggcggctgcttgcacgctgacccagacctgggagtgctgtgtccaacgggatgccagctccaggaagcgctgctccagcaagagcgccccatcaggaactcggtcgacgaactgaataacaacgtggaagctgtcagtcagacttcgtcatcctcctttcagtatatgtacctgctcaaggacctctggcagaagcgccagaagcaagtgaaggacaacgaaaatgtggtgaacgagtattcaagcgaacttgagaagcatcagctgtacatcgatgaaacggtcaattccaacatcccgacgaacctcagggtgctgcgctcaatcctggagaatctgagatcgaagatccaaaagctcgagtccgacgtgtcggcacagatggaatactgcagaactccgtgtaccgtgagctgcaacatccccgtggtgagcggaaaggagtgtgaagagatcatcagaaaaggtggcgagactagcgaaatgtatcttatccaaccggactcatcagtgaagccttaccgcgtgtactgcgacatgaataccgaaaatggaggatggactgtgatccaaaatagacaggacggatccgtggacttcggacggaagtgggacccgtacaagcagggattcggcaacgtcgctaccaataccgatggaaaaaactattgtggtctgccaggcgaatactggctgggcaacgataagatctcgcagttgacccgcatgggaccgacggaactgctcatcgagatggaggattggaagggagataaggtcaaggcgcactacggaggattcaccgtgcagaacgaagcaaacaagtaccaaatctccgtgaacaagtaccgcggcactgctggcaatgccctgatggacggtgcttctcaacttatgggagagaaccggactatgaccatccacaacggtatgttctttagcacttacgacagggacaacgacggatggctgaccagcgacccgcgcaaacagtgttcgaaggaggacggcggaggctggtggtacaacaggtgccacgcagcgaatccgaatggcagatactattggggcggtcaatacacctgggatatggccaaacacggcactgatgacggagtcgtctggatgaactggaagggatcttggtactcgatgcgcaagatgagtatgaagatccgaccattcttcccccaacaa

SEQ ID NO: 11200 - DNA, 1473 bp, Artificial Sequence
  Description of Artificial Sequence: Synthetic coding sequence
atgaaaaggatggtgtcctggtcgtttcacaaactgaaaactatgaagcatcttttgcttctgcttctctgtgtgtttctcgtgaagagccagggcgtgaacgataacgaagagggctttttctcagcaagaggtcacagaccattggataagaagcgcgaggaggctccttcgttgaggcccgcacctccacctatctccggaggtggttaccgtgcacggcctgcaaaggccgcagcaactcagaaaaaggtggaaagaaaggcccctgatgcagggggatgtctgcatgctgatcctgacctcggggtgctttgccctactgggtgtcagctccaggaagcattgcttcaacaggagcgaccgattcggaactcagtcgacgagcttaacaacaacgtggaagcagtctcccagacttcatcgtcgagcttccagtatatgtacctgttgaaggacctttggcagaaaagacaaaaacaagtgaaggataatgaaaatgtggtcaatgaatactcgtcggaactggaaaaacaccaactgtacattgatgaaactgtcaatagcaacatacccaccaacctccgagtgcttcgctcaatcctggagaaccttcggtctaaaatccaaaagctcgagagcgacgtgtcagctcaaatggaatactgtcggacgccttgcaccgtctcttgcaacattcctgtcgtgtcgggaaaagaatgtgaagagataatccgcaaggggggcgaaacctcggagatgtacttgatccaacctgattcctcggtgaaaccgtaccgggtgtactgcgatatgaataccgaaaatgggggatggacggttattcagaacagacaagacggctcggtggatttcggccggaagtgggacccctacaaacaaggttttggtaacgtggccactaacactgatggtaagaactactgtggtttgccaggtgaatactggcttgggaatgataagatttcccaacttaccagaatggggccaaccgaactgctcattgagatggaagattggaagggtgacaaagtgaaggcccattacgggggatttaccgtccaaaacgaggcaaataagtatcaaatctcggtcaataagtacagaggtaccgcaggaaatgcacttatggacggagcatcgcagctgatgggggaaaaccgcaccatgactattcacaacgggatgttcttctccacctatgaccgagacaatgacggctggcttacttcggaccctcggaaacagtgttccaaggaagatggaggggggtggtggtacaatcgctgtcatgcagctaatccaaacggtcggtactactggggtggacaatacacgtgggacatggcaaagcatggaaccgatgacggagtggtgtggatgaattggaaaggatcctggtacagcatgcgcaagatgtcgatgaagattcgaccgtttttcccacaacag

SEQ ID NO: 11201 - DNA, 1473 bp, Artificial Sequence
  Description of Artificial Sequence: Synthetic coding sequence
atgaaaagaatggttagctggagcttccacaagttaaagaccatgaaacatcttttgctgcttttgctgtgcgtgtttttggtcaagtctcaaggtgtgaacgacaacgaagagggcttttttagtgctcgggggcaccggcctttagataaaaagagggaagaggcgccttcactaagaccagcacctcctccgatctctggcggaggctatcgtgcgcggccagctaaggctgcagccactcagaaaaaagtcgagaggaaggcccccgatgccggaggatgcctgcacgctgaccccgacctgggtgtgttatgcccgaccgggtgccagctccaggaagcgttgctgcagcaggaacggcctatcaggaatagtgtggacgaattaaacaacaatgtcgaggccgtgtcccagacttcctcatcctcatttcagtacatgtacctcttgaaggatctgtggcagaagaggcaaaaacaagtgaaggataacgaaaacgtggtcaacgagtactccagtgaactcgagaagcatcagctgtatattgatgaaactgtcaactcgaatataccaaccaatttgcgtgtgctgaggagcatcctggagaacctgcgctcaaaaatccagaagttggaatcggacgtcagcgcccagatggagtactgtcgcacaccttgcactgtctcatgcaacatccctgtagtgtcgggaaaagagtgtgaagagattattcggaaaggaggggagacttctgaaatgtacctcatccagcccgacagctccgtgaaaccatacagagtatattgtgacatgaatacagagaatgggggttggactgtgatccagaaccgacaggatgggtccgtggacttcgggcgcaaatgggatccttataaacaaggtttcggcaatgtcgctactaacacagacggaaagaactattgtgggctcccgggagaatactggctgggaaatgataagatcagtcagcttacccggatgggtccaaccgagctgctcattgaaatggaggactggaagggagacaaagtgaaggcccactacggtgggttcactgtgcaaaacgaggcgaataaataccagatttcggtaaacaaataccgggggaccgccgggaatgccctcatggacggggccagtcagctcatgggagagaatcgcacaatgacgattcacaatggtatgttcttctccacttacgaccgggacaatgacgggtggctcacctcagacccaagaaagcagtgcagcaaggaagacggcggcggctggtggtataacagatgccatgcagctaatccaaatgggcggtattactgggggggacagtatacttgggacatggctaagcatggcacagacgacggcgttgtgtggatgaattggaagggttcttggtatagtatgagaaagatgagcatgaagatcaggcctttttttcctcagcag

SEQ ID NO: 11202 - DNA, 1473 bp, Artificial Sequence
  Description of Artificial Sequence: Synthetic coding sequence
atgaagcgtatggtgtcatggtcatttcataaacttaagactatgaagcatctcctcctccttcttctttgcgtgttcctggtgaagagccaaggggtcaacgataacgaagaagggttcttttccgccaggggccaccgccctctcgacaagaaaagagaggaagcgccaagcctgcgacctgcaccaccacctatctcaggcggtgggtaccgcgcaagacctgcaaaggccgcggcaactcagaagaaggtggaacgtaaagcacctgacgcaggcgggtgtctgcacgcggaccctgatctcggtgtgctctgtcctactggttgccaactccaggaagcgcttctgcagcaggagcgtccaattaggaactcggtagacgagctgaacaataacgtggaggccgttagccaaacttcgtcctcctcgtttcaatacatgtatcttttgaaggatttgtggcaaaagagacagaagcaggtgaaggataatgaaaatgtggtgaatgaatactcgtcagaactggaaaagcaccagctttacatcgatgagactgtcaattcaaacatacctaccaaccttcgggtcttgcgctcaattcttgaaaacctcaggtcgaaaatccaaaagctggagtccgatgtgtctgcccaaatggaatactgtagaaccccctgtactgtgtcgtgcaacatccctgtggtgtcgggtaaggaatgtgaagagattatcagaaaaggaggtgaaacctctgagatgtacctgattcagccagattcctcagtgaagccataccgagtgtactgtgatatgaacactgagaatgggggttggactgtcattcagaacagacaagatggttccgtggattttggtagaaaatgggacccgtataaacaaggatttggcaatgtggccactaacacggacggaaaaaactactgtgggctccctggagaatactggctcggcaacgataagatttcgcagcttacccgaatgggaccgactgaactgctcatcgaaatggaagattggaagggagataaggtgaaagcacattacggaggtttcactgtgcaaaatgaggcgaacaagtatcagatttcggtgaacaaatacagaggtaccgcaggaaacgcccttatggatggtgccagccaactcatgggagagaacagaaccatgacgattcataacggaatgttcttctcgacctacgacagagataacgacggatggctcacctcggatccaaggaagcagtgctcaaaagaagatggcggaggctggtggtacaaccgatgtcatgcggccaaccctaatggaagatattactggggcggtcagtacacctgggacatggcaaagcatggcactgatgacggggtcgtgtggatgaactggaagggatcgtggtactccatgcggaagatgagcatgaaaatccgccctttctttccacagcaa

SEQ ID NO: 11203 - DNA, 1473 bp, Artificial Sequence
  Description of Artificial Sequence: Synthetic coding sequence
atgaagcgtatggtgagctggagcttccataagctcaagacaatgaaacatttgctgctcttactgctctgcgtgttcttggtaaagtctcagggtgtgaacgacaacgaagagggattcttttctgccagaggccatcgccctcttgacaagaagagggaggaggcaccatcactgaggccagcaccaccacctatctcaggtgggggctatcgcgcccggcctgcaaaagccgccgccacccagaagaaagtcgagaggaaagcccctgacgcaggaggatgtctacatgccgacccggatctcggcgtgttgtgccccacagggtgtcaactccaggaggctctcctccaacaggagcgaccaattcgaaactctgtagacgagttgaacaataacgtggaggccgttagccagaccagcagctcttctttccaatacatgtacctgctaaaagatttgtggcaaaagcggcagaaacaggtgaaagataacgaaaacgtggtgaatgaatattcctccgaactggaaaaacaccagctatacatagacgagaccgtgaacagtaatatcccaacaaatctccgggtgctgagatccatactggaaaacttacggtctaagattcaaaaactggaatccgacgtgagtgcccagatggagtattgccgaaccccctgcaccgtctcttgcaatattcccgttgtgagcggcaaggagtgcgaagaaataatccgaaagggtggggagacttctgagatgtacttaatccagccggacagcagcgttaaaccttaccgagtgtattgtgatatgaatactgaaaatggaggctggactgttatccagaataggcaagacggaagcgtagacttcggcaggaagtgggatccgtataaacaagggttcgggaacgtggccaccaacactgacggaaagaattactgcgggctgcctggcgagtattggcttggcaacgacaagatttcccagctaacaaggatgggcccaactgaactgctcattgagatggaagactggaaaggggataaagtaaaggcccactatggcggcttcactgtgcaaaacgaggcaaataagtaccaaattagcgtgaataaatatcgtggcactgccggcaatgccttgatggacggcgcctctcagctgatgggcgagaaccggaccatgactattcacaatggtatgtttttcagtacatatgatagggataacgacgggtggctcaccagtgatccacggaagcagtgctcaaaagaggatggcggtggctggtggtataaccgatgtcatgccgccaatcctaacggtcgatactactggggcggtcagtacacctgggacatggccaaacacggcactgatgacggcgtggtatggatgaactggaagggctcctggtacagcatgagaaagatgtccatgaaaatcaggcccttttttccccagcag

SEQ ID NO: 11204 - DNA, 1473 bp, Artificial Sequence; identical to SEQ ID NO: 11196
  Description of Artificial Sequence: Synthetic coding sequence

SEQ ID NO: 11205 - DNA, 1473 bp, Artificial Sequence
  Description of Artificial Sequence: Synthetic coding sequence
atgaaacgcatggtatcttggtcctttcataaactaaaaactatgaaacacttgctgttgctcttgctttgtgttttcttagtgaaatctcaaggggttaacgataatgaggaggggtttttttctgcacgagggcacaggccactggacaaaaagcgggaagaagctcctagcctgagacctgcccccccccccatttccggcggagggtaccgcgccagaccagccaaggcggcagcaactcaaaaaaaagtagagcgcaaggcccctgatgctgggggctgtcttcatgctgatcctgatctgggagtcctgtgccctacaggctgtcagctccaggaggcccttctgcagcaagaacgcccgatccgcaatagtgtcgacgaactcaataataatgtggaagccgtgtctcaaaccagttcgtcgtccttccagtatatgtacctgctcaaggatctgtggcagaagcgtcagaaacaggtgaaggataatgagaacgtcgtcaatgagtattcatccgaactggagaagcatcagctttacatcgacgaaaccgtgaattcaaacataccaacaaatctgcgcgtgctgcgctccattctggagaatctacgctccaaaattcagaaactagagagcgatgtatctgcccagatggagtactgccgaaccccctgtactgtgagttgtaatattcctgtggtctctggaaaggaatgcgaggagatcattcgaaaaggaggggaaacgtctgagatgtacttgatacagcctgactcatccgtgaaaccctaccgcgtctattgtgatatgaataccgagaacgggggctggaccgtcatacagaataggcaggatgggtcggtagacttcggccgaaaatgggatccatacaagcaaggcttcggaaatgtcgccaccaatacagacggaaagaactattgtggactacctggtgagtactggctagggaacgataaaatctctcagctgacccgaatgggccccacagaactgctgatcgagatggaggactggaaaggcgataaagtgaaggctcattacgggggattcaccgtgcagaacgaagccaacaagtaccagatctcggtaaacaaatatagagggaccgccggtaacgctcttatggatggcgcatcccaactaatgggcgagaatcggactatgaccatccacaatggcatgttcttttccacgtacgatcgagacaacgatggatggctgacttctgaccctcgcaaacagtgtagtaaagaagacggtgggggatggtggtacaataggtgccatgccgccaatcccaacggtcgttactattggggtgggcaatatacttgggacatggcgaaacatgggaccgacgatggggttgtctggatgaactggaaagggtcgtggtatagcatgcgaaaaatgagtatgaagataagacctttctttccccagcag

SEQ ID NO: 11206 - DNA, 1473 bp, Artificial Sequence
  Description of Artificial Sequence: Synthetic coding sequence
atgaagcgcatggtgtcttggagttttcacaaactaaaaacgatgaaacatttgctccttctcttattgtgtgttttcttggttaaatcgcaaggagtgaatgacaatgaggaaggattcttctcagcacgaggtcatagaccgttagataagaaaagagaagaagcaccgtcgctacgtccagcaccaccacccatatccggaggtggatatagagctagaccagctaaagcagccgcaacgcagaaaaaggtcgagcgtaaagcaccagacgccggaggttgtcttcatgcggatccggatctcggagttctgtgcccaaccggatgccaactgcaggaagctttgctacaacaagaacgaccaatacggaactccgttgatgaacttaacaacaacgttgaggccgtatctcagacctcgtcgtcatcgtttcaatatatgtacctgttgaaggatttgtggcagaaaagacaaaagcaagtgaaggataatgagaatgtggtgaacgagtactcctcggaattggagaagcatcagttatacattgatgaaacagtgaactctaatatcccaaccaatctcagagttctccgatccatacttgaaaatctcagatcgaagatacaaaagctggagtctgacgtatcagcccagatggaatattgccgaacaccgtgcacagttagttgcaacatcccagtcgtttctggtaaagaatgtgaagagatcattcggaaaggaggagagacctcagaaatgtaccttatccaaccagactcatcggtcaagccatacagggtttattgcgacatgaatacagaaaacggaggatggactgttatccaaaatcgacaagatggatctgttgacttcggccgtaaatgggatccatataaacagggattcggaaatgtggcaacaaatactgatggaaaaaactattgcggattgccaggggagtattggttgggaaatgataaaatttcccaactcacgcggatgggtccaaccgaattgcttattgagatggaggactggaaaggagataaggttaaagctcattatggcggatttactgttcaaaatgaagcaaataaataccagatatcagttaataaatacaggggaacggccggaaatgcgttgatggatggcgcttctcagctcatgggagaaaatagaactatgacaatacacaatggaatgtttttcagtacttatgatcgggataacgatggatggctgacgagtgacccgagaaagcaatgctcaaaagaagatggaggaggatggtggtataatcgctgtcacgctgccaacccaaatggtcgatattattggggaggacaatatacgtgggatatggctaaacacggaacagatgatggagttgtttggatgaattggaagggttcgtggtattctatgcgtaagatgtcgatgaaaattaggccattcttcccccaacag

SEQ ID NO: 11207 - DNA, 1473 bp, Artificial Sequence
  Description of Artificial Sequence: Synthetic coding sequence
atgaagcggatggtgtcatggtcgttccataagctcaagacgatgaagcacctcctcctcctgcttctctgcgtctttctcgttaagtcacagggagtcaacgacaacgaggagggcttcttttcagctagaggccatcgcccactggataagaaaagagaggaagccccatctctccggccggctccgccgccgatcagcggaggaggctaccgcgcacgcccggccaaggccgcggctacccaaaagaaagtggaacgaaaggcaccggacgccggtggatgcctgcacgccgaccctgacttgggagtgctctgtccgaccggttgtcagctgcaggaagccctgctccagcaggagcggccgatcaggaactcagtggatgaactcaacaacaacgtcgaagcagtgagccagacttcctcctccagcttccagtacatgtacctgctgaaagacctttggcaaaaacgccaaaagcaggtgaaggacaacgagaatgtcgtgaacgaatactcctctgaactggagaaacaccagctgtacatcgacgaaactgtcaactcgaatatcccgacgaatctgagagtgctccgctcgatcctcgaaaacctccggtcgaagattcagaagttggaatcggacgtgtcggcgcagatggagtactgtcggacgccatgcaccgtgtcatgcaacatcccggtggtgtcaggaaaagaatgcgaggagattattcgcaagggcggagaaacgtccgagatgtacctcatccagccagacagctccgttaaaccgtaccgtgtgtactgcgatatgaacactgaaaacggaggatggaccgtgatccagaaccggcaggatggatcagtggacttcgggaggaaatgggatccatataagcaggggttcggcaacgtcgcgactaacacggacggaaagaactattgcggcctccctggcgaatactggctgggaaacgacaagatctcccagttgactcgcatgggccctaccgaactgttgatcgagatggaggactggaaaggagataaggtgaaggcacactacggcggcttcaccgtgcaaaacgaggctaacaagtaccaaatctccgtgaacaaatatcggggcactgccgggaacgctctgatggacggggcaagccagctcatgggagaaaatcgaactatgaccatccacaatggaatgttcttctcaacctacgatcgcgacaacgacggatggctgacctcagacccgagaaaacaatgctcaaaggaagatgggggcggctggtggtacaacagatgtcatgccgcgaacccaaacgggcggtactattggggaggtcaatacacctgggatatggccaagcacggaaccgacgacggcgttgtctggatgaactggaagggatcgtggtactccatgcggaagatgtcgatgaaaatcagaccgttcttcccgcaacag

SEQ ID NO: 11208 - DNA, 1473 bp, Artificial Sequence
  Description of Artificial Sequence: Synthetic coding sequence
atgaagcgtatggtcagctggtccttccacaagttgaagaccatgaagcacttgttgcttctgctgctgtgcgtttttttggtcaagtcgcaaggtgtcaatgacaatgaggagggattcttctccgcacgtggacaccgcccgttggacaagaagcgtgaagaggccccctccttgcgtccagcccctccccccatctccggaggtggttaccgtgcccggcccgcgaaagccgccgccacccaaaagaaggttgaacgaaaggcacctgacgctggcggttgtctacatgcggaccctgatttaggtgtcctgtgcccgacaggctgccagctccaggaggccctgctccagcaggagcgacccatccgcaactccgttgatgagctcaacaacaacgtagaggcggtctcccagacatctagcagcagctttcagtacatgtacctcctaaaggacctttggcaaaagcgacagaagcaggttaaggacaacgaaaacgtagtcaatgagtattcaagcgaactggagaagcaccagctctacattgacgagaccgtcaactctaacatccctacaaacctacgcgtgctccggtcgatactggagaacctgcggtccaaaatccaaaagcttgagagcgacgtgagcgcccagatggagtactgtcggaccccttgcaccgtctcctgtaacatcccggtcgtctccggcaaggagtgcgaagagatcatccgcaagggcggtgagacctctgagatgtatctgatccagcccgattcctctgttaaaccttaccgggtgtactgcgacatgaacaccgaaaatggaggatggacagtgatccagaatcgccaggatgggtccgtcgacttcggccgtaagtgggacccttataagcaggggttcggcaacgtcgccactaacaccgacggtaaaaactattgtggactcccgggtgaatactggctcgggaacgacaaaattagccaactcaccagaatgggaccaacggaactgttgattgaaatggaggactggaagggagacaaggtcaaggctcactacggcggcttcacagttcaaaatgaagcaaacaaatatcagataagtgtcaacaagtaccgtggaactgctggtaacgccttgatggatggtgcttcccagttgatgggcgagaaccgcacaatgaccatccacaacggtatgttttttagtacatacgaccgcgacaacgatggttggttgactagtgacccgcggaagcagtgctcgaaggaagatggaggcggatggtggtacaaccgatgccacgctgcgaacccaaacggacgctattactggggcggccagtacacttgggatatggcgaagcatggtactgacgatggggttgtttggatgaactggaagggttcgtggtactcgatgcggaagatgtcgatgaagatcaggccctttttccctcagcag

SEQ ID NO: 11209 - DNA, 1473 bp, Artificial Sequence
  Description of Artificial Sequence: Synthetic coding sequence
atgaaacggatggtttcgtggagctttcacaagctcaagactatgaagcacctgctcctgttgctgttgtgcgtctttctggtgaagagccagggggtgaacgacaacgaagagggattcttcagcgcgcggggccatagaccgctggacaaaaagagagaggaggctccatccctcagacctgccccgcccccgatctcgggagggggctaccgcgcacgtccagcaaaagcagccgccacccagaagaaagtggagaggaaggccccggacgccggcggatgcctgcatgcggaccctgacctcggcgtgctgtgtcccaccggttgccagcttcaggaagccctcctgcagcaagagcggccaatccggaattctgtcgacgagctcaataacaacgtggaagcagtgtcgcagacgtcatcctccagcttccaatacatgtacctgctgaaggatctgtggcagaagcgccaaaagcaggtgaaggacaacgaaaatgtcgtgaacgaatactcatcagaacttgaaaaacaccagctgtatatcgatgagactgtgaattccaacatcccgaccaacctgcgagtgctcagatccatcctcgaaaatctgcgctctaagatccagaaacttgagagcgatgtgtccgctcaaatggagtactgccgcactccttgcactgtctcatgcaatattcctgtcgtgtccgggaaggagtgtgaagaaattatccgcaagggcggcgaaacctcggaaatgtacctgatccaaccggattcatcagtgaagccgtaccgcgtctactgcgacatgaatactgagaatggaggatggactgtcatccagaaccgccaggacggatcggtggacttcggacgcaagtgggacccgtataagcagggatttggaaatgtcgcaactaacaccgatggaaaaaattactgcgggttgccaggagagtattggcttggaaacgataagatctcgcaactgacgcggatggggccgaccgagctcctgatcgaaatggaagattggaaaggagacaaggtgaaggcccactacggaggtttcaccgtgcagaatgaagcgaacaaataccaaatctccgtgaacaagtacagaggcaccgccgggaacgcgttgatggacggcgcgagccagctgatgggtgaaaatcggaccatgactatccataacggcatgttcttcagcacctacgatagggacaacgacggatggctcacctccgatccccggaaacaatgctcgaaggaggacggaggaggttggtggtacaaccggtgtcatgctgctaacccaaacggtcgctactactggggtggccaatacacttgggatatggccaaacacggaacggatgacggagtcgtttggatgaactggaagggatcgtggtactcgatgagaaagatgagtatgaagattaggccattcttcccgcagcaa

SEQ ID NO: 11210 - DNA, 1473 bp, Artificial Sequence
  Description of Artificial Sequence: Synthetic coding sequence
atgaaacgtatggtgtcctggtcattccataaactgaagacgatgaaacacctgctgctgcttctgctgtgcgtatttttggtgaaaagccaaggagttaacgacaacgaagaaggtttcttttcagctcgcggtcatcgtccactggataagaaacgcgaggaagcgccgtctctgcgccctgcgcctcctcctatcagcggtggtggctatcgagcacgcccggccaaggccgcggccacccaaaaaaaggtcgagcgcaaagcgcctgatgctggtggttgtctgcatgcagaccccgatctgggcgttctgtgtcctaccggatgccagctgcaagaggccttactgcagcaggagcgccctattcgtaatagcgtggacgagctgaataacaacgtggaggcggtgagccagacttccagctcatcttttcaatatatgtatttgctgaaagacctgtggcagaagcgccagaaacaggttaaggataacgaaaacgttgtgaacgagtactcttctgaactggagaagcatcaactgtacattgacgagactgtcaactcaaacattccaacaaatctgcgcgtcctgcgctccatactggaaaatctgcgcagcaaaattcaaaaattggaaagcgacgtgagtgcccaaatggaatattgtcgcaccccctgcacggtcagctgcaatattccggttgtcagcggcaaggagtgtgaggagattatccgcaaaggtggcgaaacctctgaaatgtatctcatccagccggacagcagcgtgaaaccataccgcgtgtactgcgacatgaacaccgagaatggcggttggacagtgattcaaaaccgccaggacggctcagtggactttggacgcaagtgggatccgtataaacagggtttcgggaatgtagcgacgaacaccgacggtaagaactactgcggtttgcctggcgagtattggcttggtaatgacaagatttctcaactgacccgaatgggtccgaccgaactgctgatcgagatggaggattggaagggtgacaaggtcaaggcccattacggtggtttcaccgtccaaaacgaggcaaacaagtaccaaatcagcgtcaataagtatcgcggcacggctggtaatgccctgatggatggtgcaagccagctaatgggtgagaaccgcacaatgactatccataacggcatgttcttttcgacctatgaccgcgataacgatggatggttgaccagcgatccgcgcaaacagtgtagcaaggaggacggcggaggctggtggtacaatcgatgtcacgcggccaaccccaacgggcgctactactggggtggccagtatacctgggatatggcgaaacatgggaccgatgacggcgtcgtctggatgaattggaagggcagctggtactcaatgcgcaaaatgagcatgaagattcgcccattcttcccccagcaa

SEQ ID NO: 11211 - DNA, 1473 bp, Artificial Sequence
  Description of Artificial Sequence: Synthetic coding sequence
atgaagcgtatggtgagttggtcatttcataaactaaaaaccatgaaacacctcttactgttgttgctatgcgtgttcctggtaaagtcccagggggtgaatgataatgaggagggcttcttctctgcgcggggccataggccattggataagaaacgcgaagaagctccatccctgaggccagcccctccacccatctctgggggcggttaccgggccagacctgccaaagcagcggccacccagaagaaagtggaacggaaagctccagatgctggcggctgtcttcacgcagaccctgacttgggtgtgctctgccccaccggttgccagctccaggaggctcttctgcagcaggagagacccatcaggaattcagtcgacgagctgaataataatgtggaggcagtatcacagacttcctcatcaagtttccagtatatgtacttgttgaaggatctctggcagaagaggcagaaacaggtgaaggataacgaaaacgtcgtcaatgaatattcatcagaacttgagaagcatcagctctacattgacgagaccgtcaatagtaacatccctactaacctgagagtcctgagaagcattttggaaaatctccggagcaaaatacaaaagttagagtccgacgtttctgctcagatggagtactgtcggacaccctgcaccgtgtcctgtaacattccagtggtgtccggaaaagagtgcgaagagataatcaggaagggcggcgaaacgagcgaaatgtatctgattcaaccagacagttctgtgaaaccctatcgagtctactgtgatatgaacacagagaatggcggatggaccgtgatccagaatcggcaggatggcagtgtggacttcggaaggaagtgggatccttataagcagggattcggcaacgtcgcaacaaatactgacgggaaaaattattgtggcttgcccggggagtattggttggggaacgacaagatctcacagttaactcgcatgggtccaaccgagcttctgatcgagatggaggactggaaaggcgacaaggtcaaggctcactacggaggctttactgtccaaaacgaggcaaacaaataccagatcagcgttaataagtacagggggaccgcaggaaatgctctgatggacggcgcttctcagctgatgggagagaaccgcacaatgactattcataacgggatgtttttcagcacatacgaccgggacaacgacggttggcttacctccgatcctcggaaacagtgctcaaaagaggacgggggaggctggtggtataacaggtgccatgccgccaaccctaatgggcgctactattggggcgggcagtatacttgggatatggcgaagcacggcaccgatgacggtgtagtatggatgaattggaaagggtcttggtacagcatgcggaagatgtccatgaagataaggcccttttttccccagcag

SEQ ID NO: 11212 - DNA, 1473 bp, Artificial Sequence
  Description of Artificial Sequence: Synthetic coding sequence
atgaaacgcatggtgtcctggagcttccacaagctgaaaactatgaaacatctgttgctgctgcttctctgcgtgttcctggtgaaaagccagggggtcaatgataacgaagaaggatttttctcagcgaggggacacagaccactggataagaagcgggaagaggccccgtcacttcggccagcaccgccacctatctcgggtggaggataccgggctaggcccgctaaggcggcagcgactcagaagaaggtcgaacgcaaagctccggacgccggaggatgtctgcatgccgaccccgaccttggggtgctgtgtcctaccggatgccagctgcaggaggcactgcttcagcaggaacgaccaatccgcaactccgtcgacgagcttaacaacaatgtcgaagcagtgtcccagacctcctcctcatcgttccaatacatgtacctgttgaaagatctgtggcagaagcggcagaaacaggtgaaagataacgagaacgtggtgaatgaatactcctccgaacttgagaaacaccagctgtatatcgacgaaactgtgaacagcaacatcccgaccaacttgcgtgtgctccgctcgatcctggaaaatctgcgatctaagatccagaagctcgagagcgacgtgagcgcacagatggaatactgcaggactccgtgtaccgtgtcttgtaacattccggtcgtgtcaggaaaggagtgcgaggaaatcattcgcaaaggcggcgaaacctccgaaatgtacctgatccaaccagactcatcagtgaaaccgtatcgcgtctactgcgatatgaatactgaaaatggaggatggaccgtgatccagaaccgccaagacggctcagtggacttcggccggaagtgggacccgtacaaacaaggattcggaaacgtggccaccaacaccgatggcaagaattactgtggactcccaggcgaatactggctgggcaatgacaagatctcccaactgactcgcatgggcccaaccgaactgctcatcgaaatggaggactggaagggtgacaaagtgaaggctcattatggaggattcactgtccagaatgaagcgaataagtaccagatcagcgttaacaagtaccggggcaccgcgggcaatgccctgatggatggggcctcgcagctgatgggagaaaaccgcaccatgacgatccacaacggaatgttcttcagcacctacgacagggataacgatggctggttgacttcggatcctagaaaacagtgttccaaggaggacggaggaggttggtggtataaccgctgccatgccgctaatccaaacggaagatactactggggaggccaatacacctgggacatggcaaagcacggcaccgatgacggagtggtgtggatgaactggaagggatcatggtacagcatgaggaagatgtcgatgaagatccgcccattctttccgcagcag

SEQ ID NO: 11213 - DNA, 1473 bp, Artificial Sequence
  Description of Artificial Sequence: Synthetic coding sequence
atgaagcggatggtgtcatggtcatttcacaagttgaaaacaatgaaacacctactgctgctgctgctttgtgtattcttggttaagtctcaaggtgtgaatgacaatgaggaagggttcttctccgcacgaggccatcggcccctggataagaagagagaggaagccccctcgcttcggcccgccccccctcccatctctggcggcgggtaccgggcacgcccggctaaggccgcagcgacccagaagaaagttgagaggaaagcgcctgacgcagggggctgtcttcacgctgaccctgatctcggcgtgttgtgccccactggatgccagctgcaggaggccttgctgcagcaggagcgccccatcagaaattcagtggacgaattgaataacaacgttgaagctgtgagtcagacatcatcctcttcgtttcagtacatgtatctgcttaaggatctgtggcagaaacgacagaaacaagtaaaggacaacgagaacgtggtgaacgaatacagctcagaattagaaaaacaccagctgtatatcgacgagactgtgaacagtaacatcccaaccaatttacgagtgctccgctccatcctggaaaacttgcggtctaaaatccagaaacttgagtcagatgtcagcgcacaaatggagtattgtaggacaccgtgtaccgtatcatgcaatatccctgtcgtatccgggaaggaatgcgaggaaatcatccgaaagggcggggagacatctgaaatgtacctgatccaaccagacagttccgtcaaaccctatagggtgtattgcgacatgaataccgaaaatggggggtggacagtcatacagaatcgacaggatgggagcgttgacttcggacgtaaatgggacccctataagcaaggattcggaaatgtggctacaaataccgacggcaagaattattgtggcttgcctggggagtactggctgggcaacgacaagatatctcagctgacccgcatgggacctactgaattactgatcgagatggaggattggaagggcgataaagtgaaagcccattacggtggtttcacagtacagaacgaagccaataaatatcagatttcagttaataaataccgtggcacagcaggcaacgcactcatggacggggcctctcagctgatgggtgagaatcgcactatgacgatacataacggcatgttcttttctacatatgacagagacaatgacgggtggctgactagcgaccctaggaagcagtgtagcaaagaggacggcggtgggtggtggtataaccgctgccacgcggcgaaccccaatggacgctattactggggggggcagtacacatgggacatggccaaacacggcacagatgacggggtggtttggatgaattggaagggttcttggtactcaatgcgaaaaatgtctatgaagattcgtcccttctttccacagcag

SEQ ID NO: 11214 - DNA, 1473 bp, Artificial Sequence
  Description of Artificial Sequence: Synthetic coding sequence
atgaaacgaatggtgtcatggtccttccacaaactgaagaccatgaaacacctgttactattgttgttgtgcgtgtttttggtgaagtcgcagggggtaaacgacaacgaagaaggtttcttctcagccagaggtcatagaccactagataagaaacgcgaggaggctccgtcattgcggcctgcaccccccccaatatctggagggggctaccgggccagacccgcaaaagctgctgctacccagaagaaggtggaaagaaaggcgccagacgctgggggttgcctgcacgcagaccctgatcttggcgtgctgtgtcccacagggtgtcagctccaggaggcgctcctgcagcaggagaggcctattcggaacagtgttgatgaattgaacaacaacgtggaggcagtaagccaaacgtcatcatctagctttcagtacatgtacctgcttaaagatttgtggcagaagcgtcagaagcaggtaaaggataacgaaaacgtggtgaatgaatatagcagtgaattggagaagcaccagctatacatcgacgagacagtgaacagtaacattcccacaaatttacgggtgctgaggtccatcctggaaaacctgcggagtaaaattcagaagttagaatccgatgtatctgcgcagatggaatattgtcggaccccttgcacggtaagttgcaatattcccgtcgtgagcggcaaggagtgcgaggagatcatacgcaaaggcggcgagacaagcgagatgtatctaattcaaccagattcctcagttaaaccttaccgggtatattgtgacatgaacaccgaaaacgggggctggacagtgattcagaaccgccaggacggctctgttgatttcggtcgcaagtgggatccttataagcagggatttgggaatgtagccacaaacacagatggcaagaactattgtggactgccgggtgaatactggctcggcaacgataaaatttcccaacttactcggatggggcccaccgagctgctgatcgaaatggaagattggaaaggagacaaggtcaaggcccactacggcggcttcacagtgcaaaatgaagccaataagtaccagattagcgtaaacaagtaccgtggaactgctgggaacgccctcatggacggcgcctctcagttaatgggcgaaaataggacaatgacgatccacaatggcatgttctttagcacctatgatcgtgataatgatgggtggctgaccagcgacccacggaagcagtgttcgaaagaggatggaggcggctggtggtacaatcggtgccacgcggctaatcccaatggcaggtattactggggcgggcagtatacttgggacatggccaagcacggcactgatgatggtgtggtgtggatgaattggaaaggcagctggtattctatgcggaaaatgagcatgaagatccggcctttcttcccacagcag

SEQ ID NO: 11215 - DNA, 1473 bp, Artificial Sequence
  Description of Artificial Sequence: Synthetic coding sequence
atgaaaaggatggtatcctggtcttttcataaattaaaaactatgaaacatttattattattattactttgtgtttttttagttaaatcacagggggtaaatgataatgaagaaggatttttttctgcaagaggtcatagaccattagataagaaaagagaagaagcaccaagtttaagaccagcaccaccaccaatatcaggaggaggttatagagctagaccagctaaagctgcagctactcaaaaaaaggttgaaagaaaagctccagacgctggtggatgtcttcatgcagatcctgatttaggagtactttgtccaacaggatgtcaattacaagaagcattacttcaacaagaaagacctattaggaattcagttgatgaattaaacaacaatgttgaagctgtttcacaaacatcttcctcaagtttccaatatatgtatttattaaaggatctttggcaaaaaagacaaaaacaagttaaagataatgaaaatgtagttaatgaatattcatcagaattagaaaaacatcaactttatattgacgaaacagttaattcaaacattccaactaatcttagagtattaagatctattcttgaaaatttaagatctaagatacaaaagttagaatctgatgtttcagctcaaatggaatattgtagaactccatgtacagtctcttgtaatattccagttgttagtggaaaagaatgtgaagaaattattagaaaaggtggagaaacatctgaaatgtatttgattcaacctgattcttcagttaaaccatatcgagtttattgtgacatgaatactgaaaatggtggttggactgttattcaaaatagacaagatggaagtgttgatttcggaagaaaatgggatccttataaacaaggattcggaaatgtagcaacaaatactgatggtaagaattattgtggacttccaggagaatattggttaggaaatgataaaattagtcaattaacaagaatgggtccaactgaacttttaattgaaatggaagattggaagggagataaagttaaagcacattatggagggtttacagttcaaaatgaagcaaataaatatcaaatctctgttaataagtatagaggtacagccggaaatgcacttatggatggtgcatcacaattgatgggagaaaaccgtacaatgactattcataatggtatgtttttcagtacttatgatagagataatgatgggtggttaacttctgatccaaggaaacaatgttcaaaggaagatggtggaggatggtggtataatagatgtcatgctgctaacccaaatggtagatattactggggaggacaatatacttgggatatggctaaacatggaacagatgatggtgttgtttggatgaattggaaaggatcttggtattctatgcgaaaaatgtcaatgaaaataagaccattttttccacaacaa

SEQ ID NO: 11216 - DNA, 1473 bp, Artificial Sequence
  Description of Artificial Sequence: Synthetic coding sequence
atgaagcgtatggtgagctggagctttcataagctcaaaacgatgaagcaccttctgcttcttctgctttgtgtgtttttggtgaagtcgcaaggagtcaacgacaacgaagaaggctttttctctgcacggggtcacaggccccttgataagaaacgagaagaagcaccatcccttcgacctgcacccccacctatctctggtggtggctacagagctaggccagctaaagcagcagcaacccagaaaaaggtggagagaaaagcgccagatgcaggtggttgtctgcacgcggatccagatcttggagtgctgtgcccaaccggatgtcagctgcaagaggcactgctgcagcaagagcgcccaattcgaaattctgtggatgaactcaacaacaacgtcgaagcggtgtcgcaaaccagctcctcctcgtttcaatacatgtaccttctcaaagacctgtggcagaagcgccaaaaacaagtgaaagataacgaaaacgtggtcaatgaatactcctcagaacttgagaaacaccaactttacatcgacgaaactgtcaactcgaacatcccgactaatctgcgcgtgctccggtcgatccttgagaacttgcggagcaagattcagaaacttgaatcggacgtgtcagcacagatggagtactgtaggactccttgcactgtgtcctgtaatatccctgtcgtgtccggtaaagaatgtgaggaaatcataagaaagggtggagaaactagcgaaatgtaccttattcaaccagacagctccgtcaagccttaccgggtgtattgtgacatgaatactgaaaatggaggctggactgtgatccagaacagacaggatggaagtgtggatttcggtcggaaatgggatccatacaaacagggctttggaaacgtggcaactaacactgatgggaagaattactgtggactgccaggagaatactggctggggaatgacaagatttcacaactgacccgaatgggtccaacggagcttctgattgagatggaagattggaaaggggacaaggtcaaagcacactacggaggctttaccgtccagaacgaggctaacaaataccaaattagcgtcaacaagtacagaggtaccgcgggaaatgcccttatggatggagcatcccaacttatgggcgaaaatcgtaccatgactattcataatggtatgttcttctcaacctacgaccgcgacaatgacgggtggctcacctccgatcctaggaagcaatgtagcaaggaagatggaggaggctggtggtataatcggtgtcacgcagctaatcctaatggtcgttattactggggcggacaatatacctgggacatggcaaagcacggtacggatgatggggttgtctggatgaactggaaggggtcatggtactccatgagaaagatgtcaatgaagattcggcccttttttcctcaacaa

SEQ ID NO: 11217 - DNA, 1473 bp, Artificial Sequence
  Description of Artificial Sequence: Synthetic coding sequence
atgaagcgcatggtctcatggtcctttcacaaactcaaaacaatgaagcacctgctcctgcttctgttatgcgtctttctggtgaaaagtcaaggggtgaacgataatgaagaaggattttttagtgcccgcgggcacagaccactcgataaaaagagggaagaggcaccatccttaaggcccgctccccctcctatctcaggcgggggatacagggctcggcccgcaaaagcagccgctacccaaaaaaaagtagaacgcaaagccccagacgcaggaggctgccttcatgctgatccagaccttggagtgctttgccccactggctgccagctgcaagaggcccttctgcagcaggaaagaccaatcagaaactctgtcgatgaacttaacaataatgtggaagccgtaagccagaccagctcgagctcgtttcagtacatgtacctgctcaaggatctgtggcaaaaacggcagaagcaggttaaggacaacgagaacgtagtaaatgagtactcgagtgagctcgaaaagcaccaactgtacattgacgaaactgtcaacagtaatatccctaccaatctacgtgtgttacgcagcatccttgagaacctccgctcgaagatccaaaagctcgaaagtgacgtcagcgctcagatggaatactgtagaactccatgcactgtcagttgcaacatcccagtagtgagtggtaaagagtgtgaagagatcatccgcaaagggggcgaaacatctgaaatgtatctgattcagcccgatagcagcgtcaagccatacagggtgtactgtgacatgaataccgagaacggcggatggaccgttatacagaatagacaggatggtagtgtggactttgggagaaagtgggacccgtataaacagggattcgggaatgtggctacaaacactgatggcaagaactactgcggcctgcccggagaatattggttgggaaacgataagatctcccagttgaccaggatgggaccaaccgagctgctcatcgagatggaagattggaaaggagataaagtgaaagctcattacggcggcttcacagtgcaaaacgaggctaacaaatatcaaatctcagtgaacaaatatagaggtactgcgggcaatgcgctgatggacggggctagccagctgatgggagaaaacagaacaatgaccatccacaacggaatgtttttcagcacctacgaccgggacaatgatggatggcttacttctgatcccaggaagcaatgtagtaaagaggacggtggcggttggtggtataataggtgtcacgccgccaacccgaatggcaggtattactgggggggacaatacacttgggacatggctaagcacggaaccgacgatggagtggtgtggatgaattggaagggaagctggtactccatgcgtaagatgtcaatgaagatccgccctttcttcccccagcag

SEQ ID NO: 11218 - DNA, 1473 bp, Artificial Sequence
  Description of Artificial Sequence: Synthetic coding sequence
atgaagagaatggtgagctggtcttttcataaacttaagaccatgaaacacttactgctgctgctgctttgcgtcttcctcgtcaagagccaaggcgtgaatgataacgaagaaggtttcttttctgcaaggggccatcgacctctggacaaaaagcgagaagaggcaccatccttgcgacccgccccaccacccatctccggcggcggctaccgagcacgtcccgccaaggcggccgctacacagaagaaggtcgaaaggaaagctcccgacgctgggggctgccttcatgctgaccctgacctcggagttttgtgccctaccggctgccaacttcaggaggcactcctgcaacaggaaagacccattagaaatagcgtagacgagctgaacaataatgtcgaggcggtctcgcagaccagtagttcctcatttcagtatatgtatcttctaaaggatctctggcagaagcgccagaagcaagtgaaagacaatgagaacgtagtgaatgaatacagctctgaactggagaagcaccagctctatatcgacgagactgtcaactcgaacatccctaccaacttgagagtgctacgaagcattcttgagaaccttaggagtaagattcagaaactggagagcgacgtgagtgctcaaatggaatattgcaggaccccttgtacggtgtcctgcaacatccccgttgtcagtggtaaggaatgtgaggaaatcattcgtaaagggggtgaaacttccgagatgtatctgatacagcccgattcttccgtgaagccatacagagtttattgcgacatgaacaccgaaaacggcgggtggaccgtgatacagaacaggcaggacggcagcgtagattttggacgaaagtgggatccatacaagcagggcttcggcaacgtcgccaccaatactgacgggaaaaactattgcggacttcccggtgagtattggcttggcaacgacaagattagccaattaacgcgaatgggcccaaccgagcttctgatcgaaatggaagactggaagggcgacaaagtgaaggcgcactatggcggatttacagtgcaaaacgaagccaataagtatcagatctccgtcaacaaatatagagggactgcgggcaatgcgctgatggacggggctagtcagttgatgggggagaatcgtacaatgacgatacacaacggcatgtttttctccacgtatgaccgagataatgatggatggctgacttcggacccaaggaaacagtgctcaaaggaggatggggggggctggtggtacaacaggtgccatgcggctaatccaaatggcagatactattggggcggccaatatacctgggatatggctaaacatggtactgacgatggcgttgtgtggatgaattggaagggctcctggtacagcatgaggaagatgagcatgaagataaggccattttttcctcaacaa

SEQ ID NO: 11219 - DNA, 1473 bp, Artificial Sequence
  Description of Artificial Sequence: Synthetic coding sequence
atgaagaggatggtgtcctggtctttccacaaactgaaaacgatgaagcatctgctgctcctcctcctctgtgtgtttctggtcaagtctcaaggggtgaatgacaacgaagagggattcttcagcgccaggggacaccgccccttggacaagaagcgcgaggaagcgcctagcttgcggccggccccgcccccgatctccggaggaggataccgcgcgcggccagctaaggcggccgctactcagaaaaaggtggaaagaaaggctccagacgccgggggctgtctgcatgcggatccggacctgggtgtgctctgtccaactggctgtcagctccaagaggccctgctccagcaggaaagaccaatccggaactccgttgacgaactgaacaacaatgtggaagccgtgtcccaaacttcatcgtcatcctttcagtacatgtacctgcttaaggacctgtggcagaagcggcagaagcaggtgaaggataacgagaacgtggtgaacgagtacagcagcgagttggaaaagcatcagctttacatagacgaaaccgttaactccaatattccgactaatctgcgagtgctgcggtccatcttggagaacctgcggagcaagatccagaagctcgaatccgatgtgtccgcccagatggaatactgtcgtaccccatgcacggtgagttgtaatatcccggtggtgtcaggaaaggaatgcgaggagattatccggaaaggcggagaaacctccgaaatgtacttgatccagccagattcatcagtgaagccgtatcgggtctactgcgatatgaatactgagaatggaggatggaccgtgattcagaacagacaggacggatcggtggactttgggcgaaagtgggacccttacaagcagggatttggaaacgtggcgaccaacaccgatggtaaaaactactgcgggctgcccggagaatactggctgggcaatgacaagatctctcagcttactaggatgggtcctaccgaactgttgatcgagatggaagattggaagggagataaggtgaaggcacactacggtgggttcactgtccagaacgaggcaaacaaataccagatcagcgtgaacaagtaccggggcaccgcgggcaatgccctgatggacggagcctcgcagctcatgggagagaacagaaccatgaccatccataacggcatgttctttagcacttacgatcgcgataacgacgggtggctgacttcagaccccagaaagcagtgctcgaaggaggacgggggaggatggtggtacaaccgctgccacgctgccaacccaaatggacgctactactggggcggacagtacacttgggacatggccaaacacggaaccgacgacggagtggtgtggatgaattggaaaggatcctggtactccatgcggaaaatgagcatgaagatccgcccgttcttcccgcagcag

SEQ ID NO: 11220 - DNA, 1473 bp, Artificial Sequence
  Description of Artificial Sequence: Synthetic coding sequence
atgaagcgaatggtgtcttggtcttttcacaaattgaaaaccatgaagcaccttctccttctcctgctctgcgttttcctggtgaagagtcagggagtgaacgacaacgaggagggcttcttctctgcccggggccacagacccctcgacaagaagagggaagaggcaccgtcactgcgaccggcgcccccaccaattagtggaggcggctatagggcccgccctgccaaggccgccgccacacagaagaaggtcgagcgcaaagcccccgatgctggcggttgcctgcatgcggatccagatttgggtgtactctgcccaactggctgtcaactgcaggaggccctcctgcagcaggaacgacctattcgcaattcggtcgatgaactgaacaacaacgtggaagcagtgagccagaccagtagttcgagcttccaatatatgtatcttctaaaggatctctggcaaaagcggcagaagcaggtgaaggacaacgagaacgtggtcaacgagtacagttccgaactggagaaacaccagctttacattgatgaaaccgttaactccaacatacccaccaatctgcgcgtactccggtccatactggagaatctacgaagcaagattcagaaactggagtctgatgtgtccgcacagatggaatattgtagaacaccatgtactgtctcatgcaatatacccgtggtcagtggaaaggagtgtgaggaaatcattcgcaagggtggagagacgtctgagatgtatctaattcagcctgactccagtgtgaagccttaccgggtatattgtgatatgaacaccgaaaacggagggtggacagtgatccaaaataggcaggatgggagcgtcgatttcggacggaaatgggatccgtataagcaggggtttgggaatgttgccacaaacaccgatgggaaaaactactgcggcctccctggcgaatactggttaggcaacgacaaaatatcacagctaacgcggatgggtcctacagagctgctgattgaaatggaggattggaaaggggacaaggtgaaagcccactacggcgggttcaccgtgcagaatgaggctaataaatatcagatatccgtgaataagtacagaggtacagccggaaatgcactgatggatggtgcttcacaactgatgggcgagaataggacaatgacaattcataacggcatgttcttctcaacatatgatcgtgataacgacggctggcttaccagtgatccacggaagcaatgtagtaaagaagacggcgggggctggtggtataacagatgccacgccgctaatccaaacggacgttattactggggtggacaatatacttgggatatggccaagcatggaaccgatgatggggttgtatggatgaattggaagggttcttggtatagtatgcgaaagatgagcatgaagatcagacccttttttccacaacag

SEQ ID NO: 11221 - DNA, 1473 bp, Artificial Sequence
  Description of Artificial Sequence: Synthetic coding sequence
atgaaacggatggtgtcttggtcatttcataaactcaagaccatgaagcatctcctgctgctcctcttgtgtgtttttctcgttaagagccagggggtaaatgataatgaagaagggttcttttccgcacgcggtcacaggccacttgataagaaacgagaagaagctccttcacttagacctgcccctccgccaatatcgggcggtggttacagagcgcgtccagcaaaggccgcagcgactcagaagaaagtggaacgcaaggcacctgacgcaggcggatgtctgcacgcagaccccgatctgggggtgttgtgtcctactggatgtcaactccaggaggccctgctccaacaggaaagaccgattagaaactccgtcgatgagctgaacaataacgtcgaggcggtgtcacagacctcgtcctctagctttcagtacatgtaccttcttaaggatctttggcaaaagcgacaaaagcaagtgaaagacaatgagaacgtagtgaatgagtactctagcgaattggagaagcatcaactgtacatcgacgagactgtcaatagcaatatcccgaccaaccttagggtgcttagatcaatcctcgaaaacttgcgctcgaagattcagaaactggaatccgatgtgtcggcacaaatggaatattgtaggactccttgcaccgtgtcgtgtaacattcccgtcgtgtccggtaaggagtgtgaagaaatcattcgcaaaggaggcgaaacctccgaaatgtaccttattcaacctgacagcagcgtgaagccttaccgcgtttactgcgatatgaacactgagaacgggggatggactgtaattcaaaatagacaagacggttccgtggatttcggaagaaagtgggatccatacaagcagggctttggtaacgtggcaaccaataccgacggcaaaaactactgcggactgcctggagaatactggcttggaaacgataagattagtcagctgacccggatggggccaaccgagcttttgatagaaatggaagattggaagggagataaggtcaaggcacattacggcggatttaccgtccagaacgaggctaataagtaccaaatctcagtgaacaaatatcgcggaactgcgggtaacgccctgatggatggtgcttcgcaactgatgggagaaaacaggactatgacgatccataatggcatgttctttagcacctatgaccgagataacgatggttggttgacttcggacccccgtaagcagtgctcgaaagaagatgggggaggttggtggtacaatcgttgccacgccgcaaacccaaatgggagatactactggggcggacagtacacctgggatatggcaaaacatggaacggatgacggggttgtgtggatgaactggaagggttcgtggtactctatgcggaagatgtccatgaaaattcggccgttcttcccccaacaa

SEQ ID NO: 11222 - DNA, 1473 bp, Artificial Sequence
  Description of Artificial Sequence: Synthetic coding sequence
atgaagcgcatggtgagctggtccttccacaaacttaagaccatgaagcaccttttgctgttgttgctctgcgttttcctcgtcaagtcgcaaggggtgaacgacaatgaggaaggattcttttcggccagagggcaccggccgctggacaagaagagggaagaagccccgtcactgcgcccggccccaccgcccatcagtggaggaggataccgggcaagacccgccaaggccgcggctacccagaagaaggtggaacggaaagctccggatgcaggaggatgccttcacgcggacccagatctcggggtgctgtgtcctaccggctgccaactgcaagaagcactcttgcagcaggaacggcctatccgaaatagcgtggatgagctgaacaacaacgtggaggctgtgtcgcagacttccagctcgtccttccaatacatgtacctgctcaaagacctctggcagaagagacaaaagcaggtgaaagataatgaaaacgtggtgaatgaatactcctctgagcttgagaagcatcaactgtacattgacgaaaccgtgaactccaatatcccaactaacctgcgcgtcctgcgcagcatactggaaaacctgcggtcgaaaatccagaaactggaatcagacgtgtccgcacaaatggagtactgcaggacgccgtgcactgtgtcgtgcaacatcccggtggtgtcaggcaaggagtgcgaagaaatcatccgcaaggggggagaaacctctgagatgtacctcatccagccggacagcagcgtcaaaccgtaccgcgtatactgtgatatgaacacggagaacggagggtggacggttatccagaatcggcaggacggttctgtggatttcggacggaagtgggatccctacaagcagggatttggcaacgtggccactaatacggacggaaagaattactgcgggctcccgggtgaatattggcttggaaacgacaaaatctcccaactcactcgcatgggccctaccgaattgctgatcgaaatggaggactggaaaggggacaaagtgaaggcccactatggggggttcactgtgcagaacgaagcgaataagtaccaaatcagcgtgaacaagtaccggggcaccgctgggaatgccctgatggacggagcttcccagttgatgggagagaatcggaccatgactatccacaacggaatgttcttctccacttacgaccgggacaacgatggctggttgacttcagacccgcggaagcagtgtagtaaggaagatggagggggctggtggtacaaccgctgccacgccgccaacccaaacggacgttattactggggaggacagtacacctgggatatggccaaacacggtaccgacgacggagttgtctggatgaattggaagggttcgtggtactcaatgagaaaaatgtccatgaaaattcggccattctttccacagcag

SEQ ID NO: 11223 - DNA, 1473 bp, Artificial Sequence
  Description of Artificial Sequence: Synthetic coding sequence
atgaagcggatggtgtcctggtcatttcataagctgaaaacgatgaaacatctgctcctgcttctcttgtgcgtgtttctggtcaagagccagggcgttaatgataacgaagaaggatttttctcggccaggggtcaccgcccgcttgataagaaacgtgaagaagcaccttcgctgcggcccgcaccaccaccgatatcgggaggtggctaccgcgcacggcctgccaaggcagcagcaacccaaaagaaggtcgaacgcaaggcgcctgatgcaggtggctgtctgcatgctgaccccgacctcggggtgctctgtcctacgggctgtcaactgcaagaggccctcttgcaacaggagaggcctattaggaacagcgtggatgagctgaacaataatgtcgaagcggtgagccagacctcatcatcctcctttcaatacatgtatctgctgaaagatctgtggcagaagaggcagaagcaagtgaaggacaatgagaacgtggtcaatgagtacagttcggagctggaaaagcatcagctttacattgatgaaacggtgaacagcaatatccctaccaaccttcgagtgctgagatcaatcctcgagaacctgagatctaagattcagaaacttgaatcggatgtgtcagcgcaaatggagtactgtcgaactccatgcactgtgagctgtaacatacccgtggtgtctggaaaagaatgtgaagagattatcagaaaagggggcgaaacctcggagatgtacctgatacagccggattcgagcgtgaagccataccgggtgtactgtgatatgaatactgaaaacggaggatggaccgtcatccaaaatcggcaagacgggtccgtcgattttggaagaaagtgggatccttacaagcaaggattcggaaacgtggctacgaacaccgacgggaaaaactactgcggccttcctggagaatactggctgggaaacgacaagattagccaacttactcggatgggtcccactgaacttcttatagaaatggaagattggaagggcgataaggtgaaagcgcattacggcggatttaccgtgcaaaacgaagcaaataagtaccagatctcggtcaacaaataccggggaaccgcaggtaacgcactgatggatggggcttcgcagttgatgggtgagaacagaaccatgaccattcataacggtatgttcttttccacctacgatagagataatgatggatggctgacctctgatccccgaaaacaatgttcgaaagaggacgggggtggatggtggtacaacagatgccatgccgcaaatccgaacggccggtactattggggtggacagtacacgtgggacatggctaagcacggaactgatgatggcgtggtgtggatgaactggaaaggatcctggtactccatgagaaagatgagcatgaagattcgaccgttttttccacagcaa

SEQ ID NO: 11224 - DNA, 1473 bp, Artificial Sequence
  Description of Artificial Sequence: Synthetic coding sequence
atgaaaaggatggttagctggtcttttcacaaattaaaaacgatgaaacatcttcttttattattactgtgcgtgtttttggttaagagccaaggagtaaacgataatgaagaaggctttttttccgcccgcggtcatcgaccgcttgataaaaaacgggaagaggcaccttcgttgagacctgctccgcctcccatctcaggaggaggttaccgcgcaagaccagcaaaggctgccgcgacgcaaaaaaaagtggaaagaaaagcgccagatgcgggcggctgcctgcatgctgatccagatttaggcgtcctatgtcctactggctgtcagctacaagaagccctgctccagcaagaaagaccgattagaaactcagttgacgaactcaataataacgtagaagctgtcagccaaacatctagttctagttttcagtacatgtatcttctcaaagacctgtggcagaaacgacaaaaacaggtgaaagataatgaaaacgttgtaaacgagtattcatctgagttagaaaagcaccaactatatattgacgaaaccgtaaattctaacattcctacgaatttacgggtgctgcgaagcattttggaaaatctgagatccaaaattcagaaactcgagagcgatgtttcggctcaaatggagtactgtcgtacaccttgtaccgtcagctgtaacattcccgtggtcagcggcaaggaatgtgaagaaattatccgtaaaggaggcgagacgagcgaaatgtatctgattcaaccggactcttcggtaaagccgtatagggtctattgcgatatgaacacggaaaacggtggatggacggtcattcaaaatagacaggacggatcagtcgactttggacgaaaatgggatccgtataaacagggctttggtaacgtcgccaccaatacagatggcaaaaactattgcgggctacctggagaatactggctaggaaatgacaaaatctcacagttgacacgtatggggcctactgaattgttaattgaaatggaggactggaagggtgataaagtgaaagcacattacggtggtttcacggtgcaaaatgaagccaacaaatatcagatctcagtgaacaaatatcgtggaacagcgggcaatgcgttgatggacggcgcctctcaacttatgggcgaaaatagaactatgaccatccataacgggatgtttttttcaacatatgatagagacaatgacggatggcttacgtcggatcctcgcaagcagtgttccaaggaagatggaggagggtggtggtataatagatgccacgccgccaacccgaacggcagatattattggggtggacagtatacatgggatatggccaaacatggtacagatgacggcgtagtttggatgaactggaaaggctcatggtattccatgcgcaaaatgtctatgaagatccgcccttttttcccgcaacag

SEQ ID NO: 11225 - DNA, 1473 bp, Artificial Sequence
  Description of Artificial Sequence: Synthetic coding sequence
atgaagaggatggtcagttggtccttccataagctgaaaactatgaagcaccttctcctgctcctgctgtgcgtgtttctcgtcaagtcacaaggggtgaacgacaacgaggaaggctttttctctgccaggggacataggccccttgacaaaaagcgagaagaggcacccagcttgcgtccggcccctccaccaatttcaggcggaggataccgcgcccgcccggcaaaggccgcggcaacccagaaaaaagtggaaagaaaagctcccgatgctggaggctgcctgcacgccgacccggacctgggagtgctgtgccctacgggatgccagctgcaagaagcgctcctgcaacaggagcggccgatccgcaactccgtggatgagctcaacaacaatgtggaggcggtgtcgcagacctcctcgtcctccttccagtacatgtacctcctgaaggatctctggcaaaaacgccagaagcaggtgaaggacaacgagaatgtcgtcaacgagtactcttcagaactggaaaagcaccaactgtacatcgacgaaactgtcaactctaacattccgaccaatctgcgcgtcctcagatcaatcctcgagaatctcagaagcaaaatccagaagctggaatctgatgtctccgcccaaatggagtattgcagaacgccttgcactgtgtcatgcaacatcccagtggtgtcgggaaaggaatgcgaagaaatcatcaggaagggaggtgaaacctcagagatgtacttgatacaaccagactccagtgttaagccgtaccgggtgtactgcgatatgaataccgagaacggtggatggaccgttattcagaaccggcaagacggttcagttgatttcgggcggaagtgggacccttacaaacaaggattcgggaacgtcgcgactaataccgatggaaagaattactgtggattgccgggagaatactggctcggaaatgacaagatctcgcagctcacgcggatgggccctaccgagttgctgatcgagatggaggactggaaaggagataaggtcaaggctcactacggcggatttactgtgcagaacgaagccaacaagtaccagatttcggtcaacaaataccgcggaactgcaggaaatgcactgatggacggagcctcacagctgatgggcgaaaatagaactatgaccatccataacggcatgttcttttcaacttacgacagggacaatgatggatggttgacttctgatccacgcaagcagtgtagcaaggaggacgggggtggctggtggtacaacaggtgtcatgcggcgaacccgaacgggagatactattggggtggacagtacacgtgggatatggctaaacacgggactgatgacggcgtggtgtggatgaactggaagggttcgtggtacagcatgcggaagatgtccatgaagatcagaccgtttttcccgcaacaa

SEQ ID NO: 11226 - DNA, 1473 bp, Artificial Sequence
  Description of Artificial Sequence: Synthetic coding sequence
atgaagcgcatggtcagttggtctttccataaactaaagaccatgaagcacttgctactgctcctgttgtgcgtgtttctggttaagagccaaggggtaaacgataatgaagagggcttctttagcgctcgtggccaccggcctctggacaaaaaacgggaggaggcaccgagcctacggccagctccccctccaatttccggcggaggatatcgggcacgacctgcaaaagctgccgcaacacagaagaaagtagagcgcaaagctcctgacgctgggggctgcctgcatgcagatccagatttgggggtcctgtgccctactggttgccagctccaggaagccctgcttcagcaggagcgacccattcgtaattctgtggacgagttgaataataacgtggaggcagtaagtcagacaagtagctcctcttttcagtacatgtatctgctcaaggatttgtggcagaaacggcagaagcaggtcaaggacaacgagaatgttgtgaatgagtattctagtgaactggaaaaacaccaattgtatatcgacgagactgtaaacagcaacatccctacaaatttacgagtcctacgatctatccttgagaacctacgcagcaaaatccagaaactggagtcagacgtctccgcacagatggaatactgtaggaccccgtgcacagtgtcctgcaatatccctgtcgtgagtgggaaggaatgcgaggaaatcatcagaaagggtggggaaacctccgaaatgtatcttatccaacctgattcgtctgtgaaaccttatcgggtctactgcgacatgaatacagagaatggtggatggactgtgatccagaacaggcaggatggatcagtcgacttcgggagaaagtgggacccatacaagcagggttttggcaatgtggctaccaacaccgacggcaagaactattgcggcttgcccggggagtattggcttggtaacgacaaaattagccagttgactagaatggggcccacggaattattaattgaaatggaagattggaaaggggacaaggtcaaagctcactacggtggatttactgtgcaaaatgaagcgaacaagtaccagattagtgttaataaataccgcggtactgcgggaaatgccctgatggacggcgcaagtcaactaatgggggagaatcgtaccatgactatccacaacggcatgttctttagcacatatgacagagataatgatgggtggctgacctccgaccccaggaagcagtgtagtaaagaggatgggggaggctggtggtataatcgctgccatgcggctaatcctaatggcagatactactggggcggacagtatacctgggatatggccaagcatggcaccgatgacggcgtcgtgtggatgaattggaaaggaagttggtactccatgcggaagatgagtatgaagattaggccctttttcccgcaacaa

SEQ ID NO: 11227 - DNA, 1473 bp, Artificial Sequence
  Description of Artificial Sequence: Synthetic coding sequence
atgaagagaatggtgtcctggtcctttcacaaactcaaaacaatgaagcacctgctgcttttgctcctctgtgtgtttctcgtcaagtcacagggtgtcaacgacaacgaagagggcttcttctcagcccgcggtcaccgccctctcgacaaaaagcgcgaggaggctccatctctccgccccgcgccccctcctatctccggcggtggctatagagctcgcccagctaaagcggctgctacacagaaaaaggtggaaaggaaggctcctgacgctggtggatgccttcacgctgacccagatctcggtgttctgtgccccactggatgtcagctgcaggaagcgctgctgcagcaggaaaggccgatcaggaactcagtggacgaattgaataataacgtggaagcggttagccaaacgagctcatcatcctttcagtacatgtacctgctcaaagatttgtggcagaagagacagaaacaggtgaaggacaacgaaaatgtagtgaacgaatactcctctgagctggaaaagcaccagttgtacatcgacgagaccgtgaacagtaacattccaacaaatctgagggtcttgagaagcatcctcgagaatctcaggagtaagattcaaaaactggaaagcgacgtcagtgcgcagatggaatattgtagaaccccttgcaccgtaagttgtaatatccccgtcgtgagtggcaaggagtgtgaggagattatacgcaagggtggtgagaccagcgaaatgtatctgatacaacccgattcctccgttaaaccatatagggtctactgcgacatgaacacggagaacggcggttggactgtaatacaaaacaggcaggatggctccgtagatttcggcaggaaatgggatccatataaacaaggattcggaaatgttgctactaacaccgacggcaagaactactgtggtctcccaggagaatactggctcggcaatgacaaaattagccagctgaccaggatgggccctaccgagctgctgatcgagatggaagattggaaaggcgacaaggtaaaagctcattatggcggatttaccgtacagaatgaggctaataagtaccagatctctgttaacaagtaccgcggaacagccggtaatgctttgatggatggtgcctcacagttgatgggcgagaacagaactatgactatccataatggcatgttctttagcacttatgatagggacaatgatggatggctgacgtccgaccctcgcaagcaatgctctaaagaagacggaggaggatggtggtacaaccgctgccatgccgctaatcctaacggtcgctactactggggtggccagtatacttgggacatggcgaagcatggcacagacgacggcgtggtgtggatgaactggaagggatcctggtactcaatgaggaaaatgtcaatgaagatcagaccttttttcccccaacag

SEQ ID NO: 11228 - DNA, 1473 bp, Artificial Sequence
  Description of Artificial Sequence: Synthetic coding sequence
atgaagaggatggtgagctggtcgtttcataagctgaaaactatgaagcacctgctgctgttgttgctttgcgtgttcctggtgaagtcccaaggagtgaatgataacgaagaaggtttcttttcagcccgtggtcatcggcctctggataagaaacgagaagaagcccctagcctccgccctgcaccacctccaatttcgggaggcggataccgcgcgcgaccagccaaggcagccgcaacccagaagaaagtggaacgtaaggcacccgatgccggaggctgtctccatgctgatccagatctgggagtcctttgcccaaccggctgccagcttcaagaagcactgctgcaacaggagcgccccataagaaacagcgtcgatgaactcaataacaacgtggaagcagtctcacagacctcctcgtcatcctttcagtatatgtacctcctgaaggatctgtggcaaaaaaggcaaaagcaagtaaaagataacgagaacgtggtgaacgaatacagctcggaactggaaaagcatcagctctacattgatgaaaccgttaattccaacattccaaccaacctgagagtgctccgctcaattctggaaaacctgcggtccaagattcagaaactggagtcagatgtgagcgcacaaatggagtactgtagaactccatgtaccgtgtcgtgtaacatccctgtggtgtcgggaaaggaatgtgaggagatcattaggaagggaggagaaacctcggaaatgtacctcatccaacctgattcctcagtcaagccttacagggtttattgcgatatgaacaccgagaatgggggatggacggtgattcaaaatagacaagatggttctgtggatttcggtcggaaatgggacccatacaagcaaggatttgggaatgtcgcaactaacaccgatggtaagaattactgtgggctgccaggggaatactggcttggaaatgacaagatttcacaacttacgcgaatgggtcctactgaacttctgatcgaaatggaggactggaagggtgataaggtgaaggcccattacggtggctttactgttcaaaatgaagcaaacaagtaccaaatatcggtgaataagtacagagggaccgcaggaaacgctcttatggatggtgcatcacagcttatgggcgaaaatcgaaccatgactatccacaacggaatgttcttctcgacctacgatagggataatgacgggtggctgacttcggatcctaggaagcaatgtagcaaagaagatggtgggggttggtggtacaaccggtgtcacgcagcgaatccaaatggcagatactactggggcggacaatacacctgggatatggccaagcatggtactgatgatggagtggtgtggatgaattggaaaggatcctggtactccatgaggaagatgtcgatgaagattcgccctttcttccctcagcaa

SEQ ID NO: 11229 - DNA, 1473 bp, Artificial Sequence
  Description of Artificial Sequence: Synthetic coding sequence
atgaaacgcatggtgagctggtcgtttcacaaactcaaaaccatgaaacatctcctgctcctgctgctgtgcgtgtttctggtgaagagccaaggagtgaatgacaacgaagagggcttcttctcggcacgcggacatcggccactcgacaaaaaacgggaggaagcgccgtctctgcgccccgcaccgcctccaatctccggcgggggatacagggcccggcccgcaaaagccgcggcaactcagaagaaggtcgaacgcaaggcccccgatgctgggggatgtctgcacgccgacccggatctgggtgtgctgtgtccgaccggttgccagctccaggaagccctcctgcagcaggaacgcccaatccgcaactcggtggacgagctgaataacaatgtggaagcggtttcccagacctcctcttcctcatttcaatacatgtaccttcttaaggacctgtggcaaaagcgccaaaaacaagtgaaggacaatgagaatgtcgtgaacgaatactcctcagaactcgagaagcaccagctctacatcgacgaaactgtgaattcaaacatcccgactaaccttagggtcttgagaagcatccttgagaacctgcgctcaaagatacagaaactggaatcggatgtgtcagctcagatggagtactgccgcactccatgcactgtgtcgtgcaatattcccgtcgtgtccggaaaggaatgcgaggaaatcatccggaagggcggggagacgagcgagatgtacctgatccagccggactcttccgttaagccgtacagagtgtattgtgacatgaatactgaaaacggtgggtggaccgtgattcagaatcggcaagacggctcggtggacttcggcagaaagtgggatccttacaagcaagggtttggaaatgttgcgaccaacaccgacggcaagaactattgcggtttgccaggcgaatactggctgggaaacgacaaaatctcgcagcttacccggatgggtccgaccgagttgctgatcgaaatggaggattggaaaggtgataaggtgaaggctcactacggcggattcactgtgcaaaacgaagccaacaagtaccaaatcagcgtgaacaagtaccgcggaactgcgggaaacgcactgatggacggagcgtcacagttgatgggagaaaaccgcactatgactatacacaacggaatgttcttctcgacgtatgatcgggacaatgatggatggctgactagcgacccgaggaagcagtgttcaaaggaagatggaggtggatggtggtacaatagatgccatgcagcgaatccaaatgggcggtactactggggaggtcagtacacctgggatatggctaagcatggaacggatgacggagtggtgtggatgaattggaaaggctcgtggtactccatgcggaaaatgtcgatgaagatcaggcctttcttcccacaacaa

SEQ ID NO: 11230 - DNA, 1473 bp, Artificial Sequence
  Description of Artificial Sequence: Synthetic coding sequence
atgaaacgcatggtctcctggtcatttcacaagttgaagacaatgaagcatctcttgcttctcttgctgtgtgttttcctcgtcaagtcccaaggagtcaacgacaatgaggagggcttcttctccgcaaggggacataggcccctggataaaaaacgtgaagaagccccctctctcaggcctgccccaccccccatctctggcggaggataccgcgctcgccccgcaaaggctgcagcaacccagaagaaggttgaaagaaaggctcctgacgctggaggctgccttcatgccgacccagacctcggcgtgctgtgccccactggatgtcagctccaggaggccctgcttcagcaggaacgccctatccgcaactctgtggatgaactgaataataacgtagaggctgtaagtcaaacctcttcttcctccttccagtatatgtatctcctcaaagatctttggcagaaacgtcaaaagcaggtgaaggacaatgagaacgtggtcaacgagtacagcagtgaacttgagaagcatcagctttatattgacgagaccgtgaattctaacatacccaccaatctcagggtgctccgttccatactcgagaacctgaggtctaagatccaaaagctggaaagcgacgtgtctgcccaaatggagtactgtcgcacaccttgcaccgtgtcctgcaatattccagttgtgtccggaaaagaatgtgaggaaattatcaggaaaggtggtgagacatctgagatgtaccttatccagccagattcctctgtcaagccctacagggtttactgtgatatgaatactgaaaacggaggctggactgtgattcaaaaccgccaggacggttcagttgatttcggacgcaagtgggacccttacaagcagggtttcggaaacgtggccaccaacaccgacggaaagaactactgtggtctgcccggagagtactggttgggcaatgacaaaataagtcagttgactagaatgggacctaccgagctgttgattgagatggaagactggaagggtgacaaggtaaaagcccactatggtggattcactgtccaaaacgaggctaacaagtatcagatatccgtgaataagtaccgtggcactgccggcaacgctttgatggatggcgcttcccaactcatgggcgagaaccgtaccatgacaatccataatggtatgttttttagcacctacgaccgtgacaacgacggttggctgacaagcgaccccagaaagcagtgctccaaggaagacggaggaggctggtggtacaaccgctgccacgccgcaaacccaaacggtcgttattattggggtggccagtacacttgggacatggctaagcacggaaccgacgatggtgtcgtctggatgaactggaagggttcctggtacagcatgcgtaagatgtccatgaagattcgtcccttcttcccacaacaa

SEQ ID NO: 11231 - DNA, 1473 bp, Artificial Sequence
  Description of Artificial Sequence: Synthetic coding sequence
atgaaacggatggtgtcatggtcttttcacaagcttaagactatgaagcacctcctcctgttgctcctgtgcgtctttttggtcaaatcacaaggcgtgaacgacaacgaagagggtttcttctccgcgagaggtcatagaccgctcgacaagaagcgggaagaggctccttccttacgtccggcccctccgcccatatcaggagggggataccgtgcccgacccgcaaaagccgctgcaactcagaaaaaggtcgagaggaaagcccccgatgcaggagggtgtctgcatgccgatccagatctgggtgttctctgtccaaccggctgtcagctgcaggaggcactgctgcagcaggagagacccatacggaattccgtcgacgaactgaacaataacgtagaagctgtgtcccagacgagcagcagcagcttccaatatatgtatctgctgaaggacttgtggcaaaagcggcaaaagcaggtgaaggataacgagaacgtggttaacgaatattcttcagaacttgagaagcatcagctgtacatcgatgaaacggtcaactctaatatccccaccaatcttagggttctgaggtctatcctggagaacctccgatccaaaattcagaaactggaatctgatgtgtccgcccagatggagtactgccggaccccctgcacggtgtcctgcaatatcccagtcgtcagtgggaaagaatgcgaagagatcatccgcaagggcggagagacttccgagatgtacctcatccagcctgactcctctgttaaaccgtatcgcgtttattgtgacatgaacacagaaaatggggggtggacagtgatacagaatcggcaagacggatcagtggatttcggccgtaaatgggacccatacaaacagggattcggcaatgtggcgactaacactgacggcaagaattactgcggcctccccggagagtactggctcggaaacgacaaaatcagtcagctcacccggatggggccaacagaacttctgatagaaatggaagactggaagggtgacaaggtgaaggcccactacggaggcttcacagtgcaaaacgaagctaacaagtaccagatttccgtaaataaataccggggaactgccggaaatgccctgatggacggcgcctcccagttaatgggggagaatcgaacgatgaccatccataacggaatgttcttctccacgtacgacagggacaacgacgggtggctcacttccgatccacggaagcagtgttctaaggaagacggaggggggtggtggtacaaccgatgccacgccgccaaccctaatgggcgctattactggggcggccagtacacttgggacatggccaagcatgggacggacgacggagtggtgtggatgaactggaagggcagctggtattcaatgcggaagatgagcatgaagatccggccattttttcctcaacag

SEQ ID NO: 11232 - DNA, 1473 bp, Artificial Sequence
  Description of Artificial Sequence: Synthetic coding sequence
atgaaaagaatggtcagctggtctttccataaactgaagaccatgaaacacctgttgctgcttcttttatgtgtgtttctggtcaaaagccagggagtgaacgacaacgaggagggatttttctccgcacgggggcatcgacctctggataagaaaagggaggaagcacctagcctcagacccgctcctccacccatcagcggaggagggtaccgggccaggccagccaaggctgcggctacacagaaaaaagtcgagaggaaggctcctgacgccggcggatgtttgcacgcagaccccgatcttggcgtgctgtgtcctacaggatgccagctccaagaagcactgctccagcaggagaggcctattcgcaactccgttgatgagttaaacaataacgttgaggctgtaagtcaaaccagttcatctagctttcagtatatgtacctcctgaaagacttatggcagaaacggcagaaacaggtgaaagacaacgagaacgtggtgaacgaatacagcagcgaattggagaaacatcagctgtacatagatgagacagtcaatagcaacatccccacaaaccttagggtgctgaggagtatccttgagaatttacggtcaaaaatccagaagctcgaatccgacgtatctgctcagatggagtattgtcggacaccatgtaccgtgtcatgcaatatacctgtggtgtccggcaaggagtgtgaggagataattcggaagggcggtgagaccagcgagatgtatctcattcagcccgatagcagcgtcaagccttatcgcgtttactgcgatatgaataccgaaaatggcggctggaccgtgatccagaacagacaggatggctccgtagatttcggtcggaagtgggatccttataagcaggggtttggcaacgtggctaccaacacggatggtaaaaattattgtggattgccaggtgagtactggctcgggaacgacaagatcagccagctcacgcggatgggcccaactgagctgctgattgagatggaagactggaaaggagacaaggtcaaggctcactatgggggttttaccgtgcagaatgaggctaataagtaccagattagcgtgaataaatacagggggaccgctgggaatgccttgatggatggcgccagtcagctgatgggtgaaaatcgcacaatgacaatacataacggaatgttcttttccacatatgatagggataacgatggatggttgacgtcagatccgaggaagcaatgttcaaaggaagatggtgggggttggtggtacaaccggtgtcatgccgcaaacccaaacggtcgttattattggggggggcagtatacttgggacatggcaaagcatggaacagatgatggcgtggtgtggatgaattggaaagggtcgtggtactccatgaggaagatgtcgatgaagattaggccctttttcccccagcag

SEQ ID NO: 11233 - DNA, 1473 bp, Artificial Sequence
  Description of Artificial Sequence: Synthetic coding sequence
atgaagcgcatggtgagctggtctttccataaattaaagaccatgaagcatttgttgctattactcctctgcgtctttcttgttaagtctcagggagtgaatgataatgaggagggcttcttttctgctaggggtcacagaccgttggataagaaacgagaagaagcaccttcattacgtccagcgcccccacccatctccggcggcggttatcgagcccgtcccgccaaagccgcagctacacagaagaaggtagaacgcaaagcacccgatgctggcggatgcttacacgctgaccctgatctcggtgttttgtgtccaacgggttgtcaactgcaggaggctcttttgcagcaggaacggccaataagaaactcggtcgacgagttgaataacaatgtcgaggcggtgtctcagaccagctcatcctcctttcagtacatgtacctgctgaaggacctttggcagaagcgtcagaaacaggtgaaggacaatgagaacgttgtcaacgagtactctagcgagcttgaaaaacaccaattatatattgatgaaaccgtaaattctaacatcccaacaaacctgcgggtcctccgttctatcttggaaaacttacgaagtaagatccaaaagttggagtcagatgttagcgctcagatggaatactgccgaaccccctgcaccgtgtcttgtaacatcccagtcgtaagtggaaaagagtgcgaggaaattatcagaaagggtggtgagacctcagagatgtatttgatccagccggattcctcagtgaagccgtaccgggtttattgcgatatgaacacggaaaacggtggctggacggtcatccagaaccgtcaggatggatcggttgattttgggagaaagtgggatccctacaagcagggcttcggaaacgtagccaccaacactgacggcaagaactattgcggcttgcctggagagtattggctaggtaacgataagatctctcaactcacacggatgggcccgacagagctgttgatcgaaatggaggactggaagggcgataaggtcaaggcgcattatggtggttttaccgtgcagaacgaggcgaacaagtatcagatttccgtcaataagtacaggggaaccgctggtaatgcattgatggacggagcatcacagttgatgggagaaaatagaactatgaccattcacaacggaatgtttttttctacctatgatcgggataatgacggttggctgacatcggatccccggaagcaatgctctaaggaagatggcggcggttggtggtataaccgatgtcatgcggccaacccgaatggacgttactactggggtggtcagtacacctgggatatggcaaagcatgggaccgacgacggcgttgtgtggatgaattggaaaggttcgtggtattcaatgcgaaagatgtcaatgaagattcgcccgttcttccctcagcag

SEQ ID NO: 11234 - DNA, 1473 bp, Artificial Sequence
  Description of Artificial Sequence: Synthetic coding sequence
atgaaacggatggtgtcctggagcttccataagctgaaaactatgaagcacctcctgcttctgctgctgtgcgtgttccttgtgaagtcccaaggcgtgaatgacaatgaggaaggattcttctccgcacggggacatagaccactcgacaagaaacgagaagaggccccatccctgcgccctgcaccgcctcctatctccggtgggggatacagagccagacctgcgaaggcagcggccacccagaaaaaggtggagagaaaagctcccgacgccgggggatgcctgcatgctgatcctgatctgggtgtgctgtgtccaaccgggtgtcagctccaggaggcgctgcttcagcaggaacgccctattcgtaactcggtggacgaacttaacaataatgtggaagcagtttcacagacctcgtcgtcctcgtttcagtacatgtaccttctcaaagacctttggcagaaaagacagaagcaggtcaaggataacgagaacgtggtgaacgaatactcgagcgaacttgaaaagcaccaattgtacatcgacgaaaccgtgaactccaacattcccactaacttgagagtgctgcgttcgattcttgaaaatcttcgctccaagattcagaagctcgagtcggatgtgagtgcccaaatggaatactgtcgcacgccctgcactgtgtcgtgcaatattcctgtggtgtcaggaaaggaatgtgaagagattattcgaaagggcggtgaaacctctgaaatgtacctgatccagcctgattcgtccgtgaaaccttacagggtctactgcgacatgaacactgagaacggaggatggactgtcattcagaatcggcaagacggtagcgtggattttggccgcaaatgggacccttacaaacaaggtttcggtaacgttgcaacgaatactgacggaaagaactactgtggacttcctggtgaatactggttgggcaacgataagatttcgcagctgacccgaatgggccccaccgaacttctcattgaaatggaagattggaagggtgacaaggttaaggcacactacggaggttttaccgttcaaaatgaagccaacaaataccaaatttcggtcaacaagtatagaggtaccgcggggaacgccttgatggacggagcatcccaacttatgggcgaaaatagaacgatgaccattcacaatggcatgtttttctcaacttatgacagggataatgatggatggctcacctcggatcctaggaagcaatgttccaaggaggacggtggtgggtggtggtacaacagatgtcatgcagctaaccctaacggcaggtactactggggtgggcaatacacttgggatatggcaaagcacggaactgatgatggagtggtgtggatgaactggaagggctcctggtactcgatgagaaagatgtccatgaagatcaggccgttttttcctcagcaa

SEQ ID NO: 11235 - DNA, 1473 bp, Artificial Sequence
  Description of Artificial Sequence: Synthetic coding sequence
atgaagcggatggtgtcatggtcctttcacaaacttaagactatgaaacatctcctgcttctcctcctctgtgttttcctcgtgaaatcccagggtgtcaacgataacgaggaaggatttttctcagcgaggggacaccggccgctcgataagaagcgggaggaagctccgtcccttcgcccggctccaccaccaatctcgggcggcggataccgggcccgcccggcgaaggcagccgcaacccagaagaaggtcgaaaggaaggccccagacgctggtggctgcctgcacgctgatcctgacctcggggtgctctgccccacgggttgccaactgcaggaggcgctgttgcaacaagaacgcccaatccgcaactcagtggatgagctgaacaataacgtcgaggctgtcagccaaacttcctcgagctcattccagtacatgtacctgctcaaagacctgtggcagaagcggcagaagcaggtcaaggacaacgagaatgtcgtgaacgaatactcttccgaacttgagaagcaccaactttacatcgacgaaactgtgaactcaaacatccctacgaatctgcgcgtgctgcgctccatcctggagaacttgcgctcaaagatccaaaaactggaatcagacgtgagcgcacagatggaatactgccgcactccgtgcaccgtcagctgcaatatcccagtggtgtcaggtaaggagtgtgaggaaatcattaggaagggtggcgaaactagcgaaatgtaccttatccagcctgatagctcagtgaaaccgtacagagtgtactgcgacatgaatactgaaaacggaggatggaccgtcatccaaaaccgccaggatggatcggtggacttcggtcggaagtgggacccatacaagcagggattcggcaatgtcgcgaccaacactgacggcaagaactactgcggactgccgggagagtattggttgggtaacgacaaaatcagccagctgactcgcatgggcccaactgaattgctgatcgaaatggaggactggaagggtgataaagtcaaggcgcactatgggggatttaccgtccagaatgaggcgaataagtatcagatctccgtcaataagtacagaggtaccgccggaaacgccctgatggatggagcctcccagctcatgggtgagaataggaccatgaccatccacaatgggatgttcttctctacctacgacagggacaacgacggatggctgacttccgatccccggaagcagtgttccaaggaggacggaggcggatggtggtataacagatgccatgcagccaacccaaacggccgctactactggggaggacaatacacgtgggatatggccaagcatggaaccgatgacggtgtcgtgtggatgaactggaaaggatcgtggtactccatgaggaaaatgtcaatgaagatccggccgttctttccgcaacaa

SEQ ID NO: 11236 - DNA, 1473 bp, Artificial Sequence
  Description of Artificial Sequence: Synthetic coding sequence
atgaagcggatggtgtcatggagtttccacaagctaaagacgatgaagcatctcctgttattgctgttgtgcgtctttctggtcaagagccagggggtgaatgacaacgaggaggggttttttagcgcgagaggtcacaggcccctggataaaaaacgcgaggaagccccctctctgaggccggcccccccaccaatcagcggcgggggctatagggctaggcccgccaaggccgcggctacccagaagaaagttgaacgcaaagctcccgacgctggcggatgccttcatgccgacccggacctgggggtactgtgtccaacgggctgtcagttacaggaggccctgctccagcaggagaggcccattagaaatagcgtcgacgaattaaacaacaatgttgaagccgtgagccagaccagtagtagtagcttccagtacatgtatctgctgaaggatctatggcagaagagacagaagcaggtaaaggataacgagaatgtggtcaacgagtatagttcagagctggagaaacatcagctttacattgacgagacagttaattccaatatacccacaaatctgcgagtgcttagatcgatcctcgaaaaccttaggtccaagatccagaagctcgaatccgatgttagcgctcagatggaatactgtagaactccttgcacggttagctgtaatattccagtggtgtcgggcaaggagtgtgaggagatcatcaggaagggtggagagacctccgagatgtacctcatccagcccgactcatctgtgaagccttaccgcgtgtattgcgacatgaacacggaaaacgggggctggaccgtgatccaaaaccggcaggatggctctgtcgactttggccgcaagtgggacccatataagcagggattcggtaacgtcgctactaacacggacggaaagaactattgtgggcttcccggcgaatactggctcggaaatgataagatcagccagctgacacggatggggcctactgaacttctgatcgaaatggaagattggaagggggacaaagtgaaggcccactacggcggttttaccgttcagaatgaagccaacaaataccagatctctgtcaataaatatcgtggaaccgccggaaatgcacttatggatggagcttcacagttaatgggagagaatcgcaccatgactatccacaacggaatgtttttcagcacatacgatcgtgacaacgacgggtggctgacttccgacccccgtaagcagtgcagcaaggaggatgggggtgggtggtggtataaccggtgccatgcagcaaacccaaacggcagatattactgggggggacagtatacctgggatatggctaaacacggaacagacgatggggtagtttggatgaattggaagggtagctggtatagcatgcgcaagatgtccatgaagattcgccctttctttccgcagcaa

SEQ ID NO: 11237 - DNA, 1473 bp, Artificial Sequence
  Description of Artificial Sequence: Synthetic coding sequence
atgaaaagaatggtcagttggagctttcacaagctcaagacaatgaagcatctgctcctactgttgctgtgcgtctttttggtgaaatcgcagggtgttaacgataacgaagagggtttcttttctgcccgcgggcacagacccctggataaaaaacgagaggaagcaccatctttacgccctgcccctccacccatcagtggaggtggctatagggcaagacctgctaaagcagctgctacacagaaaaaagtggagagaaaggcacctgacgccggaggctgcctccacgccgaccccgatttgggcgtcctgtgtccaaccggctgccaactgcaagaagctttgctgcagcaggagagacctataaggaactccgttgacgaactcaataacaacgtggaagcagttagccagacgtcctcatcctctttccagtacatgtacctgctcaaggatctctggcagaagagacagaaacaggtgaaagacaacgaaaacgttgtgaatgagtacagctctgagctagaaaagcaccagctgtatattgacgaaacagttaattcaaatattccaacgaatctgagggtgttgcggtcaatcttggagaatctcaggtcgaagatacaaaagctggaatctgatgtaagtgcccaaatggagtactgcagaactccttgcaccgtgtcttgcaatattccagtagtgtccggcaaagagtgcgaggagataattagaaagggcggcgaaacttctgagatgtacctgatccagccggattctagcgtgaagccgtatcgagtctactgtgatatgaacaccgaaaatggtggctggaccgtaatccagaacaggcaggacgggtcagtggatttcgggagaaagtgggacccatacaaacagggatttggcaacgtcgccacgaacaccgacggaaaaaactattgcggcctgccgggcgagtactggctaggaaatgacaaaatttcccagttgacgagaatgggtcccactgagttgctcattgagatggaggattggaagggggacaaagttaaggcacactacggaggatttactgtgcaaaacgaagctaataagtatcagatttcagtgaataaataccgtggtactgctggcaacgctctcatggacggtgcgtcccagctcatgggcgagaatagaacaatgacaatacataatggaatgttcttttccacctacgacagggataatgacggctggttgacttctgatccccgaaagcaatgctctaaagaggatgggggtggctggtggtacaaccgctgccacgccgccaatcctaatggcaggtattactggggcggccaatacacctgggacatggctaagcatggcacagacgacggcgttgtctggatgaactggaaggggtcttggtactccatgcgtaagatgtctatgaagatccggcctttctttcctcagcag

SEQ ID NO: 11238 - DNA, 1473 bp, Artificial Sequence
  Description of Artificial Sequence: Synthetic coding sequence
atgaaacgtatggtgtcctggtcattccataagctgaagactatgaaacatttactgttgttgctgttgtgcgtcttcctggttaagtcccagggagtgaatgacaacgaagagggcttcttttctgccaggggccatcgtccactggacaaaaagcgcgaggaggccccctcattaaggcctgcccctccgccaattagtggaggaggatacagagctagaccagctaaagccgcagctacacagaaaaaggtggaacggaaagcacccgatgccggtggttgcctccatgccgatccagaccttggggtactttgcccaacaggatgccagctgcaggaggctctgctgcagcaagaaaggccaatcagaaactctgtggacgagctgaacaataacgtggaggccgtgtcccagacctccagttcatcattccagtacatgtaccttctcaaggatctctggcagaaaaggcaaaagcaggtgaaggataatgagaatgtggttaatgaatatagttccgaactggagaagcaccagctctacattgatgagaccgtgaactctaatattccaaccaatctgcgcgtgcttcgatcaatattggagaatttgaggtctaagattcagaagctggaatcagacgtgtcagctcagatggagtattgcagaaccccctgcaccgtgagctgcaatataccagtggtcagtggaaaggaatgtgaagagattatccgtaaggggggagaaacatctgagatgtatctcatccagccagattcttctgtgaagccatatagggtgtattgcgacatgaataccgaaaacggaggctggactgtaattcagaaccgccaggacggaagcgtggattttggacgaaagtgggacccctacaaacagggcttcgggaacgtcgccacaaatacagatggcaagaactattgtggcctgcccggcgaatactggctgggcaatgataagatttctcagctgacgcggatggggccaacggaactcctaattgagatggaggactggaaaggagataaggtcaaggcacattacggaggcttcaccgttcagaatgaagcaaacaagtaccagatatccgtaaataagtaccgtggtactgccggaaatgcccttatggatggggccagccaactcatgggcgagaatagaaccatgacaattcataacggcatgttctttagcacatatgaccgagacaacgacggctggctcacttctgaccctagaaagcaatgttcgaaggaagatggcgggggttggtggtacaaccggtgtcatgctgccaaccctaacggacgctactattggggtggtcaatacacatgggacatggcgaagcatggaacagacgatggagttgtttggatgaactggaaaggctcttggtattcaatgcgtaagatgagcatgaagattcggccttttttcccccaacag

SEQ ID NO: 11239 - DNA, 1473 bp, Artificial Sequence
  Description of Artificial Sequence: Synthetic coding sequence
atgaagagaatggtgtcgtggtcgtttcataagctgaaaactatgaagcatctgcttcttcttctgctgtgcgtgttcttggtcaaatctcagggggtcaacgataacgaggaaggattcttctcagccagaggacacaggcctctcgacaagaagcgggaagaagctccatcactcagaccggcgcccccgcctatctcgggaggaggctacagagcccgcccagcgaaggccgcggcgactcagaagaaggtcgaacggaaggctcctgacgcaggcggatgtttgcacgcagatccggacctgggcgtgctctgcccgactggatgccaactccaagaggccttgctccaacaagaaagaccgatccgcaattcagtggatgagctgaacaataatgttgaggcagtgtcgcaaacttcctcctcgtccttccagtacatgtatcttctgaaggacctgtggcagaagcgccaaaagcaggtcaaggataacgagaacgtggttaacgaatactcatccgaactggaaaagcaccagctgtatatcgacgaaacggtgaattcgaacatcccgaccaatcttagggtgctgcgctcaatcctggagaatctgcgctccaaaatccagaaactggagagcgacgtgtcagcccagatggagtactgtcgcactccttgcaccgtctcatgcaatatcccggtggtttcgggaaaggagtgcgaagaaatcatacggaagggaggagaaactagcgaaatgtacctgatccagcccgatagcagcgtcaagccataccgcgtctactgcgacatgaacactgaaaatggaggatggactgtcattcaaaacaggcaagacggatcggtggattttgggcgcaagtgggacccatacaaacagggcttcggaaatgtggccaccaataccgatggaaaaaactactgcggattgccaggcgaatactggttgggtaatgataagatcagccaactgactcggatgggacccaccgagctgctgatcgagatggaggattggaaaggagacaaggtcaaggcccactacggaggattcaccgtccaaaacgaagctaacaaataccagatcagcgtaaacaagtatcgggggactgccggaaacgctcttatggacggcgcatcacagctgatgggagaaaatcgcactatgactatccataatggaatgttcttttcgacttacgatcgcgataacgacggttggctgacctcggaccctcgcaaacaatgttcaaaggaggacggaggcggatggtggtacaatagatgccacgccgccaaccctaatggtaggtactactggggaggccaatacacctgggacatggcgaaacatgggaccgatgatggggtggtgtggatgaactggaagggatcgtggtactcaatgcggaagatgtcgatgaagattagacctttctttcctcaacaa

SEQ ID NO: 11240 - DNA, 1473 bp, Artificial Sequence
  Description of Artificial Sequence: Synthetic coding sequence
atgaaaaggatggtatcttggtcttttcacaaactcaaaacaatgaagcacctccttctgctgctgctgtgtgtattcttagtaaaatctcagggggttaatgacaacgaagaaggatttttctccgcaagaggacacaggccactggataaaaaaagagaggaagccccatctctgcgcccagcccctccccccatttctgggggaggatatagagctcggcccgccaaagctgctgccacacaaaaaaaagtcgagcgcaaggcacccgatgctggggggtgtttacatgccgaccccgacctaggagtcctgtgtcccacagggtgccagctccaggaagcactgctacagcaggaacggcccattcggaatagtgtggatgaattaaataacaacgttgaagctgtcagtcagacttcttcatcatccttccagtatatgtatcttctcaaagacctctggcagaaacgacagaaacaggtgaaagataatgagaatgtggtcaacgaatactcttcagaattggaaaaacaccagctctatatcgatgaaacagtcaattctaatatacccacaaatctacgagtactaaggagtattctcgagaatctcagatcaaaaattcagaagctagaatctgatgtctccgcacagatggaatattgcaggacgccttgtactgtgagttgtaacattcctgtagtgtctgggaaagagtgcgaggagatcatccgaaaagggggagaaacgtcagagatgtacctaatacagccagatagtagtgtgaaaccatatcgcgtgtattgtgatatgaacacagaaaacggaggatggacagtaatacagaatagacaggacggatcagtggatttcggaaggaaatgggatccttacaaacaggggtttgggaatgtagccacaaacacagacgggaaaaattattgtgggctccctggggaatactggttagggaacgataaaatctcccagctcacacgcatgggaccaactgaattacttatcgaaatggaggattggaaaggggataaggtgaaagctcattatggggggtttacagttcagaacgaagctaacaaatatcagattagtgttaataaatatcggggaactgccgggaatgctctgatggatggggcctcccagctcatgggagagaataggacaatgactatacataatgggatgtttttctccacatatgatagggataacgatggatggcttacatccgatcccaggaaacagtgctcaaaagaagatgggggagggtggtggtacaacaggtgtcacgcagccaaccctaatggacggtattattggggggggcagtatacttgggatatggctaagcatgggacagatgatggagtggtgtggatgaattggaaagggtcgtggtactccatgcgaaaaatgagtatgaaaatacgaccctttttcccccagcaa

SEQ ID NO: 11241 - DNA, 1473 bp, Artificial Sequence
  Description of Artificial Sequence: Synthetic coding sequence
atgaaacggatggtatcctggtcatttcacaagttaaaaacaatgaaacatctgttgttactgttactttgtgtgtttttggtaaaatctcagggagtgaacgataatgaggaaggattctttagtgctaggggacaccgcccgcttgataaaaaaagggaagaagctccatcccttcgacctgcccccccacccatctctggagggggatacagggctcggccagccaaagccgcagctacacagaaaaaagtggaaagaaaggccccagatgccgggggatgtctgcacgccgatccagatctcggggtgctgtgtccaacagggtgtcagctccaggaagcattactccagcaggaaagacctataaggaactcagtggatgaactaaataacaacgtggaggctgtgtcccaaacttctagttcttcttttcagtatatgtatcttcttaaagatctatggcagaaacggcagaagcaggtaaaagacaatgaaaatgtggttaatgaatacagttccgaactcgaaaaacatcagttatatatcgatgaaacagtaaactccaacataccaacaaacctgcgggtactccgttctattcttgaaaatttgagaagtaagatccagaaactagaatcagatgtgtctgcccagatggaatactgcaggacaccttgtactgtttcatgtaacatccccgtagtgagtgggaaagagtgtgaggaaattatacggaaagggggggaaacttccgagatgtaccttatacagcctgatagttcagtgaaaccttatagagtgtactgtgatatgaatactgaaaatgggggatggactgtgatccagaatcggcaggatggaagtgtggactttgggcgaaaatgggatccatataaacaggggttcgggaacgttgccacaaatacagatggaaaaaactattgtgggcttcctggagaatattggctgggaaatgataaaatttcccagctcacacgcatggggcccactgagcttcttatagaaatggaagattggaaaggagataaagtgaaagcccactatggggggtttacagttcagaacgaagccaataaatatcagatatcagtgaataaataccggggaactgctggaaatgctttaatggatggggcatctcagcttatgggagaaaataggacgatgactatccacaacggaatgttcttcagtacatacgatcgagataatgatggatggcttacttccgaccctcgcaaacagtgttccaaagaggatgggggaggatggtggtacaaccggtgtcacgccgctaatcccaacgggcgctactattgggggggacagtatacttgggatatggcaaaacatggaacagatgatggagtggtctggatgaattggaaaggatcttggtattctatgcgcaaaatgtccatgaaaattcggcctttttttccccagcaa

SEQ ID NO: 11242 - DNA, 1473 bp, Artificial Sequence
  Description of Artificial Sequence: Synthetic coding sequence
atgaagcgaatggtgagctggtcgtttcataagctgaaaactatgaagcacctcctgcttctcctactgtgcgtcttcctagtgaagtcccagggggttaacgataacgaagaaggtttcttctccgcccggggtcataggccactggacaagaaacgcgaagaggccccaagcttgagaccagctcccccacccatttccggaggcggatatcgggccaggcctgccaaggccgcagctacccagaaaaaagtggaacggaaagcccccgacgctgggggttgcctacatgcagacccagatttgggcgtgctgtgcccaacagggtgccagttgcaagaggccctcttgcagcaggaaaggcccatacggaattcagtggacgaactgaacaataacgtggaggcagtcagtcagacatcgtcttcttccttccagtacatgtatctgcttaaggacctgtggcagaaaaggcagaagcaggtcaaggataatgaaaacgtggtcaacgagtactcttccgaactggagaagcaccagctgtatatcgatgaaacagtcaactcaaacatccctaccaacctgcgagtgctgcgttctatcttggagaacctgaggagcaagatccagaagttggagagcgatgtgagtgcccagatggagtactgtagaacaccatgcacggtcagctgcaatatccctgtggttagcggcaaggagtgcgaagaaatcattaggaaggggggggaaacctcagaaatgtacctcatccaacccgactcttccgtcaagccataccgagtctactgtgatatgaacacagaaaatggcggatggaccgtcatccagaataggcaggatggctcggtagactttggtaggaagtgggacccatacaaacagggctttggtaacgtcgccactaataccgatggcaaaaactactgtggcttgcctggggaatattggttggggaacgacaagatttcacaactgacccgcatgggaccaactgaactcctgatcgaaatggaagattggaagggagacaaagtaaaggcccattatggtggatttactgtacagaatgaagcgaacaagtaccagataagcgtgaacaagtacagaggaaccgccgggaatgcactcatggatggggcctcccagctcatgggagaaaaccgcaccatgacaatccacaacggcatgttcttttccacttacgatcgagataacgacggatggctgacttcagatcccagaaaacagtgcagtaaggaagacggcggcggttggtggtataaccggtgccacgccgcgaacccaaacggccgttattactggggtggtcagtacacctgggacatggccaaacacggcactgacgacggcgttgtgtggatgaattggaaagggtcttggtactctatgcgcaagatgtcaatgaaaattcggccttttttcccacagcag

SEQ ID NO: 11243 - DNA, 1473 bp, Artificial Sequence
  Description of Artificial Sequence: Synthetic coding sequence
atgaaaagaatggtctcgtggagttttcacaaactcaaaacaatgaaacatttactcctgttattgctgtgtgttttcctcgttaagtcacaaggagtaaatgataacgaagaaggcttcttctccgctagagggcataggccacttgataagaagagagaggaagctccgtctttgcgtcccgcaccaccacccatttcaggtggaggatatcgtgctcgaccggctaaggctgctgcaactcaaaagaaagttgaacgcaaagcacctgatgccggagggtgcttgcacgctgaccctgacctgggagtcctctgtccgactggttgccagctccaggaagcattgcttcaacaggagaggccgattaggaactccgttgatgaattgaacaacaacgtcgaagctgtttcccaaacgtccagctctagttttcagtacatgtatctattgaaagatctttggcaaaagcgtcagaagcaggttaaggacaacgaaaatgtcgtgaatgaatattcctctgaattggaaaaacatcaattgtatattgatgaaacagtcaactcaaatattcctaccaacctaagggtacttcgaagcattttagaaaatcttcgatccaagatacaaaagctagagagcgatgtgagtgcacaaatggagtattgtaggactccctgcacagtatcatgtaatatacctgttgtgagtggtaaagaatgcgaagagattatccgaaaagggggggagacctcagaaatgtatttgatccaaccagatagtagcgttaaaccatatagggtgtactgtgatatgaatactgaaaacgggggatggaccgttatacaaaacagacaggatggctctgtggatttcgggagaaagtgggatccatacaaacagggcttcggaaatgtcgctacaaatacagatggtaagaactactgcggactccctggagagtattggttaggaaacgataaaatctctcagttgaccagaatgggaccgaccgagcttttgattgaaatggaagattggaaaggcgacaaggttaaagcacactatggggggttcacagtgcagaatgaggctaacaagtatcagattagtgtcaataaatacaggggaacagcaggaaacgcattgatggacggggcttcacagttaatgggggaaaatcgtactatgaccattcacaatggtatgttctttagcacctatgacagggataatgatgggtggttgacatctgatccaaggaagcaatgctcaaaggaagacggaggaggctggtggtacaacagatgtcacgctgccaaccccaatggacgttattattgggggggacaatacacttgggatatggctaaacatgggacagatgatggagtagtttggatgaattggaagggctcatggtattcaatgcgaaaaatgtcaatgaagattcgtccatttttccctcagcaa

SEQ ID NO: 11244 - DNA, 1473 bp, Artificial Sequence
  Description of Artificial Sequence: Synthetic coding sequence
atgaaaagaatggtttcctggtcgtttcataagctgaaaaccatgaaacatttgctcttgttgcttctgtgtgtctttctggtgaagtcgcaaggagtcaacgataacgaggaaggatttttctcggcaagaggacaccgccctctcgataagaagcgcgaagaggcgccttcactgcggcctgcccctccacctattagcgggggaggttaccgtgcaagacctgcaaaagccgcagctacgcaaaagaaggttgagagaaaagcgcccgatgccggaggatgtctccatgcagatccagaccttggagtgctctgtcccaccggctgccagctgcaggaagcacttcttcagcaagaaagacctattagaaattctgtcgatgaactgaataacaacgtcgaggccgtctcacagacctcaagctcgtcctttcagtacatgtacctcctcaaagacctttggcagaagaggcagaagcaggtcaaggataatgaaaacgtggtcaacgaatactcctcggaactggagaagcaccaactctacatagacgaaaccgtgaactccaatattcccactaatcttcgagtgttgagatcgatcctggagaaccttcgaagcaagattcagaaacttgagtcagatgtttcagcccaaatggagtattgtaggaccccttgcacggtatcatgtaacattcctgtcgtctcgggaaaggagtgtgaagaaatcattcgcaagggaggagaaacctccgagatgtacttgattcaacctgatagctcggtcaagccctaccgcgtgtactgtgatatgaatactgaaaatgggggatggaccgtcatccaaaacagacaagacggcagcgtggattttggtagaaagtgggacccgtacaagcaaggatttggtaacgtcgcgaccaatactgatggtaagaattactgtggcctgccaggagagtactggcttggtaatgataagatttcgcagcttacgcggatgggccctaccgaactccttatcgaaatggaggattggaaaggtgataaggtgaaggcacactacggtggcttcaccgtgcagaatgaagcaaataagtaccaaatttcggtgaacaagtatcgcggtactgctgggaatgcactcatggacggtgcatcgcaacttatgggtgaaaaccggaccatgacgattcataatggcatgtttttcagcacctacgaccgagataacgatggatggctgacctccgacccaagaaaacagtgctcgaaggaggatggcggaggatggtggtacaacagatgtcatgcagccaatccaaacggtagatactactggggaggccagtacacttgggatatggcgaaacatggaactgacgatggagtcgtgtggatgaattggaagggctcctggtacagcatgcgcaagatgtcaatgaagattcgacccttcttcccacagcaa

SEQ ID NO: 11245 - DNA, 1473 bp, Artificial Sequence
  Description of Artificial Sequence: Synthetic coding sequence
atgaaacgtatggtttcgtggtcgttccataaactgaaaaccatgaagcaccttctcctccttcttctttgcgtatttctcgttaaatcgcaaggcgtgaacgataatgaggaaggtttctttagcgcacggggtcaccgacctctcgacaaaaagcgagaagaagccccctccctgaggccagcacctcctccaatctctgggggagggtacagagcgcggcccgcgaaggcagcagctacccaaaagaaggtggaacgcaaggctccagatgcaggaggctgtctccatgcagacccagacctgggtgtgctttgcccaaccggatgtcagctgcaggaagcgcttctgcaacaagaaagacctattcggaactcggtcgatgaacttaacaataatgtcgaggccgtgtcccagacttcatcatcatccttccagtacatgtatctgctgaaagatctctggcagaagaggcaaaagcaggtgaaggataacgagaacgtggtgaatgagtattcgtccgaactcgaaaagcaccaactgtatattgacgaaactgttaactccaacatcccaacgaacctgcgggtgcttagatcaatcctggagaaccttagaagcaaaattcaaaagctcgaatcggacgtgtcagcgcagatggaatactgcagaaccccttgtaccgtctcgtgtaatatccctgtcgtgtccggaaaggaatgtgaagagatcattagaaagggaggggaaaccagcgaaatgtaccttattcaacccgatagctccgtgaaaccttaccgagtctactgcgacatgaacaccgagaacggaggttggaccgtgattcaaaataggcaagatggttctgtcgatttcggtcgcaagtgggatccatacaaacaaggatttgggaacgtggccactaatacggatggaaagaactattgtggtctgccaggagagtactggcttggaaatgacaagataagtcagcttactagaatgggcccaaccgagctgcttattgaaatggaggattggaagggagataaggtgaaggcacattatggagggtttaccgtgcaaaatgaagcaaacaaataccaaatatcggtgaacaaataccgggggacggcaggaaatgcactgatggatggggccagccagctcatgggggagaacagaactatgaccattcataatgggatgtttttctccacttacgaccgcgataacgacggttggttgacttccgacccgcgaaaacagtgttcgaaggaagatggaggggggtggtggtacaacagatgtcatgcagctaaccctaacggccggtactactggggtggccagtacacttgggacatggccaaacacggcactgatgatggtgtcgtgtggatgaattggaaaggcagttggtactcgatgagaaagatgagtatgaaaatcaggccttttttcccccagcag

SEQ ID NO: 11246 - DNA, 1473 bp, Artificial Sequence
  Description of Artificial Sequence: Synthetic coding sequence
atgaagcgcatggtgtcatggtcgttccataagctgaagacgatgaagcacctgctgttactattgctttgcgtgttcctggttaagtcccaaggcgtaaatgataatgaagagggcttcttcagtgctaggggccaccgaccgttggacaagaagcgtgaagaggctccaagcttgaggccggccccgccgccgatcagtggcggcggctatcgggcccgaccggctaaagcggccgcaactcagaagaaagtcgaacgtaaggccccggacgctggcggctgcctgcacgcagaccccgacttgggagtgctatgcccgacaggatgtcagctgcaagaggcgctgcttcagcaagaacgtccgatacgcaatagtgttgacgaattgaataacaatgtcgaagccgtcagccaaacctcttcctcttcctttcagtacatgtacctgctgaaagatctctggcaaaaaaggcagaagcaggttaaggacaatgagaatgtggttaatgagtatagttcggagctggaaaagcatcaattgtacatagacgagacagtaaacagcaacatacccacaaacctacgcgtgttgcgatctatattggagaatttgcgttcgaagatacagaagttggaaagcgatgtgtctgctcagatggagtattgtcgcacgccctgcacagtaagctgcaatataccggtcgtttcgggaaaggagtgtgaagagatcattcgtaaaggcggagaaacgagcgagatgtacctgatccagcccgacagtagcgttaaaccatatcgcgtgtactgcgacatgaacacagagaatggaggctggaccgtgatccaaaatcgtcaggacggaagtgtcgatttcggccgtaaatgggacccctacaagcagggcttcggcaatgtagccaccaacacggacggaaagaactactgcggtctaccgggcgaatactggctgggcaacgataagatctcacaactcacccggatggggccaacagagctactcatcgagatggaagactggaagggtgataaggttaaagctcattatggtggcttcacagtccaaaacgaggctaacaagtaccagatttcagtaaacaagtatcgaggtacagccggtaacgccttaatggatggcgcgagtcagctgatgggcgagaaccgaacgatgacaattcacaatggaatgttctttagcacctatgacagagataacgacggctggttaaccagcgacccgcgtaagcagtgctctaaggaagatggaggtggatggtggtataaccgctgccacgcggctaatcctaatggacggtattactggggcggacagtatacatgggatatggcgaagcacggtacggatgacggtgttgtttggatgaattggaagggaagctggtactcgatgaggaagatgagcatgaagatccggccctttttcccacagcag

SEQ ID NO: 11247 - DNA, 1473 bp, Artificial Sequence
  Description of Artificial Sequence: Synthetic coding sequence
atgaagcgcatggtgtcttggtccttccacaaactaaagaccatgaagcaccttctgctcttgttgctgtgcgtgttcttagttaagagccagggagtaaatgataatgaagagggattcttcagcgctaggggccaccggcccctggataagaagagagaggaggcgcccagcctgaggccggcgccacccccaatttctggtggggggtaccgtgcacgcccagctaaagccgccgcgacccagaaaaaggtggagaggaaggctcccgatgccggtggttgtctacacgctgatcccgacctgggtgtactctgcccaacaggttgtcagctgcaggaagctttacttcaacaggaaaggcctatacgcaacagcgttgacgagcttaataataacgttgaggccgtgagccagacctcctcaagttccttccaatacatgtacctgctgaaggacctgtggcaaaaaaggcagaagcaggtgaaagacaacgagaacgttgttaatgaatactcctctgaactggagaagcatcagctgtacatcgatgagacggtaaactccaacattcctactaacctccgcgtactccgctctattctggaaaacctgaggtcaaagattcagaagctcgaaagtgatgtcagtgctcagatggaatattgtcgaacgccttgtacagtgtcatgcaacatacccgtggtgtccggcaaagaatgcgaggagattattcgcaagggcggagagacatctgaaatgtacttaatccagccggattcctcggtgaagccatacagggtctattgtgacatgaacactgagaacggggggtggacagttatccagaatcggcaggatggctccgtcgacttcggtaggaagtgggatccctacaaacaaggcttcggaaatgtcgccacaaacactgatggaaagaattactgtggcctccccggcgagtactggctgggcaatgacaagatatcccagctcacgaggatgggtcctaccgaactgctgatcgagatggaggactggaagggggacaaagtcaaggcccactacggaggatttaccgtccagaacgaagctaacaagtaccagataagtgttaataagtatcgcggcacggccggaaacgcattgatggacggagcgtcacagctgatgggggaaaaccgtacaatgactattcataacgggatgttctttagcacctatgacagggataacgatggatggctgacttctgaccctaggaagcagtgcagcaaggaagacggaggcggctggtggtacaatcgctgccacgccgccaatccaaacgggaggtactactggggaggccagtacacctgggatatggcaaaacacgggaccgatgatggagtagtgtggatgaattggaaaggaagttggtattcaatgaggaagatgagcatgaagataagaccattttttccccagcaa

SEQ ID NO: 11248 - DNA, 1473 bp, Artificial Sequence
  Description of Artificial Sequence: Synthetic coding sequence
atgaaacgcatggtcagctggagcttccataaactgaaaaccatgaaacacctccttttgctgctgctttgtgtatttctggtgaaaagtcagggagtcaatgataacgaggagggctttttctccgccagaggtcaccggcctctggacaaaaagcgcgaggaggccccgagtctgcggcccgccccccctccaatatcaggggggggctatcgcgccagacccgccaaggccgcagctacccaaaaaaaagtcgagcggaaagctcccgacgccggcggatgtttgcacgcagacccagaccttggcgtgctgtgtcctacaggatgtcaactccaggaagccctgcttcagcaggagcggcccattcggaactctgtggatgaactcaacaacaatgtggaagccgtgtctcagacatcatccagcagcttccagtacatgtatctgctgaaggatttgtggcagaagcgccaaaaacaggtgaaagacaacgagaatgtggttaatgaatactcaagcgaactcgagaaacatcagctgtacatcgatgagactgttaattctaacatcccaacaaacctcagagttctgagaagtatactggaaaacttgaggtcaaagattcagaaactcgaatcagacgtatctgcacagatggaatactgccggacgccttgtacagtttcatgcaatatccccgtcgtgagcggtaaggagtgtgaggagatcattcgcaaaggaggtgaaacgtccgagatgtacctgatccaacccgattcttctgtgaaaccttaccgcgtgtactgtgatatgaataccgagaatggcggctggacagtgattcagaaccggcaggacggaagcgtggatttcggacggaagtgggatccctacaaacaggggtttggaaatgtcgccacgaataccgatgggaagaactactgcggtctgcctggcgagtattggttgggtaatgataagatcagtcagttgaccaggatgggccctacagaactgttgatcgaaatggaagactggaagggcgataaggtcaaggctcactacggtggctttacagtgcagaacgaggccaataagtatcagatttcagtaaataagtaccgaggaactgccggaaatgcactgatggacggcgctagccaactgatgggagagaaccggaccatgacgattcataatggaatgttctttagcacatatgaccgggacaacgatggctggttgaccagtgatcctaggaagcagtgttcaaaagaggatggcggcggctggtggtacaatcggtgtcacgctgctaacccgaatggaaggtattattggggaggccaatatacttgggacatggctaagcatggtactgatgacggcgtcgtctggatgaattggaaggggtcctggtactccatgagaaagatgagtatgaagattagaccgttttttccccaacaa

SEQ ID NO: 11249 - DNA, 1473 bp, Artificial Sequence
  Description of Artificial Sequence: Synthetic coding sequence
atgaagaggatggtgtcttggtcatttcacaaactgaagacaatgaagcacctgctgctgctgcttctgtgcgtgtttttggtcaagtctcagggcgtgaacgacaatgaggagggcttctttagtgcgcggggtcacaggccactggacaagaaacgcgaagaggcgccaagtttgagaccggcaccaccgccaatatccggtggaggatatagggcccggccagccaaagccgccgctacccagaaaaaggtagagagaaaagcccccgacgcaggtggatgtctccatgcagacccggatcttggcgtgctgtgccccactggatgccaactccaggaggccctgctccagcaagagaggccaatcaggaactcagtggatgagctgaataataacgtggaggcagtctctcagacctcaagttcctctttccagtacatgtatctgctcaaggacctgtggcagaagcgacagaaacaggtgaaggataatgaaaacgtggttaatgaatattcctccgaactggagaagcaccagctgtacatcgacgagactgtgaactccaacatccctacaaacctccgggtattgagatctatcctcgagaatctgcgctcaaaaattcagaaactggagtccgacgtttccgctcagatggagtattgcagaaccccctgcacggtgtcttgtaacattcctgtggtctctgggaaagagtgcgaagaaattatcaggaaaggaggagagacaagtgaaatgtatctcattcagcctgatagctccgtcaaaccttatagggtatactgtgatatgaatactgaaaatggaggctggaccgtgatccaaaatcgccaggacggctcagtcgacttcggtcggaaatgggatccatacaaacagggctttggaaacgtggcaacaaataccgacggaaagaattactgcggcctgcccggggaatactggctgggtaatgataaaatctcccagctgacacggatgggcccaactgagctccttattgaaatggaagattggaaaggagacaaggtgaaggcacactatggtgggttcacagttcaaaacgaggcaaacaagtaccagattagtgtgaacaaatataggggcaccgctgggaatgctctgatggacggggcaagtcagctgatgggtgagaataggacgatgaccattcacaatggcatgttcttctcaacctatgatcgggacaacgatggctggctgacttctgatcctaggaagcagtgctctaaggaggatgggggagggtggtggtacaaccgctgccacgcagccaacccaaatgggcggtattactggggcggccagtatacttgggatatggccaaacacggtacggacgatggcgtggtctggatgaattggaaggggtcctggtattctatgcgcaaaatgtccatgaagatccggccctttttcccgcagcaa

SEQ ID NO: 11250 - DNA, 1473 bp, Artificial Sequence
  Description of Artificial Sequence: Synthetic coding sequence
atgaaaaggatggtgagttggtcttttcataaactgaagactatgaagcatcttctgctgctgctactttgtgtgtttttggtcaaatctcagggagttaacgacaacgaggagggcttcttctccgcacgtgggcacagacctctggacaagaagcgtgaggaggcgccaagtctgcggcccgctccccctcccatatcaggaggcggataccgggctaggcccgccaaagctgccgctacacagaagaaggtggagaggaaggctccagacgcaggagggtgcctgcacgccgaccccgaccttggggtgctttgtcccaccgggtgccagcttcaagaagcattgctccagcaggaaagaccaataaggaacagcgtggatgagctgaataataacgtggaggcagtaagtcaaacatcttctagctcatttcaatacatgtacctgctgaaggatctctggcagaaaaggcaaaaacaagtcaaggataacgaaaatgtagtgaacgaatacagctccgagctggagaagcatcagctatacatcgatgaaaccgtcaattctaacatacccacaaacctccgggtgctccgcagcatcctcgaaaacctgaggagcaaaatccaaaaactggagtcagacgtatcagcacagatggaatattgtcgcacgccttgcactgtgagctgcaacattccggtggttagcggaaaagagtgcgaagagataatccggaaagggggtgagaccagcgaaatgtacctgatccagccagacagttctgtcaaaccctaccgggtgtactgcgacatgaatacagaaaacggaggatggacagtcatccagaacagacaagatggatccgtggacttcgggcgcaaatgggatccttataaacagggattcgggaacgtcgcgacaaacactgatggaaagaactattgcggtctgcccggagagtactggctgggaaatgataagatcagtcagctgaccaggatgggacctactgaattactgatcgaaatggaagattggaagggtgataaagtaaaggcacactacggcggctttacagtgcagaacgaggcaaacaaataccagatcagcgtgaacaagtacagaggaaccgccggcaacgctcttatggatggcgcgagccaactgatgggagagaaccgcaccatgaccatccacaacggaatgttctttagtacatacgatagggataacgacggctggctgacaagcgatcctaggaagcagtgctcaaaggaggacggcggaggctggtggtacaacaggtgccacgcggcaaacccaaatggaaggtactactgggggggccaatatacttgggacatggccaagcacgggacagacgatggcgtcgtgtggatgaattggaagggttcatggtactctatgaggaagatgagcatgaaaattcggccgttttttcctcagcaa

SEQ ID NO: 11251 - DNA, 1473 bp, Artificial Sequence
  Description of Artificial Sequence: Synthetic coding sequence
atgaaacgaatggtttcgtggtcgtttcataaactaaaaacgatgaaacatctactattactattattatgtgtatttctagtaaaatcgcaaggtgttaatgataatgaagaaggttttttttcggcgcgtggtcatcgtccgttagataaaaaacgagaagaagcgccgtcgttacgaccggcgccgccgccgatatcgggtggtggttatcgtgcgcgtccggcgaaagcggcggcgacgcaaaaaaaagtagaacgtaaagcgccggatgcgggtggttgtttacatgcggatccggatttaggtgtactatgtccgacgggttgtcaattacaagaagcgctactacaacaagaacgaccgatacgaaattcggttgatgaattaaataataatgtagaagcggtatcgcaaacgtcgtcgtcgtcgtttcaatatatgtatctactaaaagatctatggcaaaaacgtcaaaaacaagtaaaagataatgaaaatgttgttaatgaatattcgtcggaactagaaaaacatcaattatatatagatgaaacggtaaattcgaatataccgacgaatttacgtgtactacgatcgatattagaaaatttacgatcgaaaatacaaaaactagaatcggatgtttcggcgcaaatggaatattgtcgtacgccgtgtacggtatcgtgtaatataccggtagtatcgggtaaagaatgtgaagaaataatacgaaaaggtggtgaaacgtcggaaatgtatctaatacaaccggattcgtcggttaaaccgtatcgagtatattgtgatatgaatacggaaaatggtggttggacggttatacaaaatcgtcaagatggttcggttgattttggtcgtaaatgggatccgtataaacaaggttttggtaatgttgcgacgaatacggatggtaaaaattattgtggtctaccgggtgaatattggctaggtaatgataaaatatcgcaactaacgcgtatgggtccgacggaactattaatagaaatggaagattggaaaggtgataaagttaaagcgcattatggtggttttacggtacaaaatgaagcgaataaatatcaaatatcggttaataaatatcgtggtacggcgggtaatgcgttaatggatggtgcgtcgcaattaatgggtgaaaatcgtacgatgacgatacataatggtatgtttttttcgacgtatgatcgtgataatgatggttggttaacgtcggatccgcgtaaacaatgttcgaaagaagatggtggtggttggtggtataatcgatgtcatgcggcgaatccgaatggtcgatattattggggtggtcaatatacgtgggatatggcgaaacatggtacggatgatggtgttgtatggatgaattggaaaggttcgtggtattcgatgcgaaaaatgtcgatgaaaatacgtccgttttttccgcaacaa

SEQ ID NO: 11252 - DNA, 1473 bp, Artificial Sequence
  Description of Artificial Sequence: Synthetic coding sequence
atgaagcgcatggtttcgtggtctttccacaagttgaaaaccatgaaacacttgctcctcctgttgctgtgcgtctttctggtcaagagccagggggttaacgataatgaggaaggcttcttttcagccaggggccaccgtcccttggacaaaaagcgggaggaggctccaagcttgcgcccggctccgcctccgatttcaggtgggggatatcgtgctcgcccagcgaaggctgcagcaacccagaagaaagttgagcgcaaggcacctgatgccggagggtgtttacacgcagatcccgacctgggcgttctgtgtccaactggttgccagctccaggaggcactactgcaacaagagcgccccattcggaactcagtcgatgaactcaacaacaacgtggaagctgtttcacaaacttcatcatcctcttttcagtacatgtacctgctgaaggatttatggcagaaacgacagaagcaggtgaaggacaatgagaatgtcgtgaatgagtattccagtgagttggaaaagcatcagttatacattgacgaaacagttaacagtaacatcccgaccaacctgagggtcctgcgcagcatcctcgagaacttgcggtcaaagattcagaagctcgaatccgacgtgagtgcccagatggagtattgtcggaccccgtgtacagtgagctgcaacattcccgttgtctccggcaaagaatgtgaggaaatcatacggaaaggaggtgagacctccgaaatgtatctgatacagccagattcctccgtgaagccttatagggtttattgcgacatgaacaccgaaaatggagggtggaccgtcatacagaacagacaggatggttccgtggattttggaaggaagtgggatccgtataaacagggattcgggaacgtggctaccaacaccgacggaaagaactattgcggactcccgggcgaatactggctgggtaatgataaaatatctcagctcaccaggatggggccaactgagctgctgattgaaatggaagattggaaaggcgacaaagtcaaagctcattacggtggcttcacagtccaaaatgaagccaataagtatcaaatttctgtgaacaaataccgaggcacagctggcaacgctctgatggacggtgctagccaacttatgggtgagaatcgcaccatgacaatccataatggcatgttcttttctacctacgaccgggataatgacgggtggctgacttccgatccacgaaagcagtgtagcaaagaggacggcggtggatggtggtacaatcgttgtcatgctgccaaccctaacggccgatactactggggaggacaatatacctgggacatggccaagcatggaactgatgatggagtggtctggatgaactggaaggggtcctggtatagtatgcggaagatgagtatgaaaattcgtccattctttccacagcag

SEQ ID NO: 11253 - DNA, 1473 bp, Artificial Sequence
  Description of Artificial Sequence: Synthetic coding sequence
atgaagcgcatggtgtcatggtcatttcataagctgaaaaccatgaaacacctgctgctcctcctgctctgcgtctttctggtcaaatcccagggagtcaacgacaatgaggaaggattcttcagcgcccgcggccacagaccgctggacaaaaagcgcgaggaggcgccaagcctgcggcctgctccaccgccgatctcaggtggcgggtaccgagcccgcccggctaaggccgccgctacccagaagaaagtggagcggaaggcgcctgatgccggaggatgcctgcatgcagacccggacctgggggtgctgtgtcccaccggatgtcagctgcaggaggcactgctgcagcaagagcgtcctatccggaattccgtggacgaattgaataacaacgtcgaggcagtgagccagacttcgtcctcctcttttcagtacatgtatttgcttaaggacctgtggcagaagcgccaaaaacaggtgaaggataatgaaaacgtcgtgaatgaatactcctccgaactggagaaacaccagctctacattgatgagactgtcaactctaacattccaaccaacctgagggtgctgcgctcaatcctggaaaacctgcggagtaaaatccaaaagttggaatcagatgtctcggcacaaatggagtactgtcggactccatgcaccgtgagttgcaatatccccgtcgtgtcgggaaaggaatgcgaagaaatcatcaggaaaggcggcgaaacttcagagatgtacttgatccaaccagacagctcagtcaagccgtatagagtgtactgcgacatgaacacggagaatggggggtggactgtcatccagaatcggcaagacggaagcgtggactttggaagaaagtgggacccgtacaagcaggggtttgggaatgtcgcgactaacaccgatggcaagaactactgcggcctccccggagaatactggctggggaacgacaaaatctcccagctgaccagaatgggaccaacggagctcctgatcgaaatggaggattggaagggagataaagtgaaagcgcactacggcggatttactgtccagaatgaggcaaacaagtaccaaatctcggtgaataagtaccgcggaaccgcgggcaatgctctgatggatggagcatcacaactgatgggagaaaaccgaactatgactatccacaacgggatgtttttctccacttacgacagggacaacgatggttggctcacctccgacccgcgcaagcagtgtagcaaggaggacggtggagggtggtggtacaatcggtgccatgcggccaacccgaacggtcgctactactggggagggcagtacacctgggatatggccaagcacggaaccgacgacggcgtcgtctggatgaattggaaaggctcgtggtactcgatgaggaagatgtccatgaagatcaggcctttcttccctcaacaa

SEQ ID NO: 11254 - DNA, 1473 bp, Artificial Sequence
  Description of Artificial Sequence: Synthetic coding sequence
atgaagcgaatggtgagttggtcctttcataagctgaagacaatgaagcatttgctgctgcttctgctgtgcgtatttcttgttaaatcacagggcgttaacgacaatgaggaaggcttctttagtgccagaggtcaccgccccctggacaagaaacgcgaagaggcgccttctctgcgccccgcaccacctcccatttctggtggaggctaccgggcgagacccgccaaagccgctgcgactcagaaaaaagtcgagcggaaagcccctgatgcaggtgggtgcctgcatgcagatccagatcttggcgtcctttgcccgaccgggtgtcagctgcaggaggcccttctgcagcaggagcggccgatcaggaactccgttgacgagttgaataacaacgtggaggctgtaagccagacatcaagcagcagcttccagtatatgtatctgttaaaggacctgtggcagaagcggcagaagcaagtgaaagacaatgaaaacgtggttaacgaatattcctccgaattggagaaacaccaactgtacatcgatgagacagtcaacagcaacataccgacaaacctgcgggtgctcaggagtatactggaaaatttgcgctcgaagatccagaagttggagtctgatgtgagtgcccagatggagtattgcaggacaccatgcaccgtctcttgcaacattcctgtggtatccggcaaagaatgcgaagagatcattaggaaggggggagaaacttccgagatgtacttaatccagcccgacagctcggtgaaaccctacagagtctactgcgatatgaataccgagaacggcgggtggaccgtgatccagaataggcaggacgggtcagtggatttcgggcgaaagtgggacccctataaacaagggttcggcaacgtggctactaatactgatggaaagaactattgtggtttgcccggcgaatactggctcggaaacgacaaaatctcccagcttactcggatggggcccactgagctgctgatcgaaatggaagattggaagggggacaaagtgaaggcccattacggtggtttcaccgtgcagaacgaggccaacaagtatcagatatccgtgaacaaatataggggaactgcaggcaatgccctgatggacggggcatcacaattaatgggcgagaacagaactatgaccatccacaatggtatgtttttcagtacgtacgatcgcgacaatgatgggtggttgacctctgatcctaggaagcagtgctccaaggaagatggcggcggttggtggtacaatcgctgtcacgcagcaaatcctaacgggaggtattattggggtggccagtatacatgggatatggccaaacacggcactgacgacggggtcgtgtggatgaattggaaaggctcctggtacagcatgcgaaagatgagcatgaagatcagacctttttttccacagcag

SEQ ID NO: 11255 - DNA, 1473 bp, Artificial Sequence
  Description of Artificial Sequence: Synthetic coding sequence
atgaagaggatggtgtcgtggtcctttcataaactgaagactatgaagcacctcttactgctgttattgtgcgtgttcctggtgaagtcacagggggtgaatgacaacgaggaggggtttttcagtgcacgtggacatcgcccgctggataagaaaagagaggaagcgccctccctaagacctgccccacccccgatctctggggggggctatcgcgcaagacccgccaaagctgccgccactcaaaagaaggtggaaagaaaggcccctgacgccggcgggtgtctgcatgcggatccagatctaggtgttctctgccccactggttgccagttgcaagaggcattattgcagcaggagcggcctattcgcaacagcgtagatgagctaaacaataatgtggaggctgtgtctcaaacctccagctccagttttcagtatatgtatctcttgaaagacttgtggcagaaacgacagaagcaggtcaaggacaatgagaacgttgtaaacgagtacagttccgagcttgagaaacaccagctctatatcgatgagacagtgaattcaaacatccctactaatctgagagtgctccgttcaattctggagaacttgcgttccaagatccagaagttagagtccgacgtgtctgctcagatggagtactgtcgcaccccgtgtactgtctcatgcaacatccccgtggtgtctggcaaggaatgcgaggagatcatcagaaagggtggggaaactagcgagatgtacctgattcagcctgactctagcgttaagccctaccgcgtgtactgcgatatgaatactgaaaacggcgggtggacagtcattcaaaaccggcaagatggaagtgtggattttggaaggaaatgggacccttataagcaaggattcggcaatgtggcgaccaatacagatgggaaaaactattgcggactgcccggggaatactggctgggcaacgataagatctctcagctcacccgaatgggtcctactgaactactgatagagatggaggactggaagggtgacaaggtgaaggcgcactacggtggattcactgtccagaacgaggcaaataagtatcagatctccgtcaacaaatacagaggtaccgcaggaaacgcactcatggatggagctagccagcttatgggtgaaaacagaaccatgactattcataatgggatgttcttctctacctacgatcgtgataatgatggttggcttactagtgatcccagaaagcaatgttctaaggaagatggtggaggatggtggtacaatcgctgccatgcagctaatcctaacggtagatattactgggggggtcagtacacatgggacatggccaagcatggaacggatgacggcgtggtgtggatgaattggaagggaagctggtacagcatgaggaagatgtcgatgaagattaggccatttttcccccagcaa

SEQ ID NO: 11256 - DNA, 1473 bp, Artificial Sequence
  Description of Artificial Sequence: Synthetic coding sequence
atgaagaggatggtgagctggtcgttccacaaactcaaaacgatgaagcacctactactgctcctgctgtgcgtattcctcgttaagtcacagggcgtgaatgacaacgaggaaggtttcttcagcgcaagggggcatcgccctcttgataagaaaagagaggaggcgcctagtctaagacctgccccgcctcccattagcggggggggctaccgggcaagacccgctaaggccgccgcgacgcagaaaaaggtagagcgcaaggcccctgacgctggaggatgtttgcatgccgacccagacttgggtgttttatgcccgactgggtgtcagctccaggaggcattgctacagcaggagcgaccaatacggaacagcgtggacgaactgaataataacgtggaggcagtctctcaaaccagctctagcagctttcagtacatgtacctgctcaaagatctatggcagaagagacagaaacaggtgaaagataatgagaacgttgtaaatgagtattcctcggaactagagaagcaccagttgtatatagatgagaccgtcaactcgaatattcccacaaacctgagagtgctgcggtcgatcctggagaatcttcgttctaagatccaaaaactagaatcagacgtcagcgctcagatggaatactgcagaacgccctgtaccgtcagttgcaacatacccgtggtttctgggaaggaatgcgaagaaattatccgaaaaggcggcgagacttcagaaatgtatctgatacagcctgacagttccgtgaaaccataccgagtgtactgcgatatgaacacagaaaatggtggctggaccgtcatccagaatcgccaagacggaagcgtggatttcggccgaaagtgggatccctataaacaaggcttcggcaatgtggccacaaatacggacggcaaaaattactgcggactgcccggcgagtattggctgggaaacgataagattagtcagctgactcgtatggggccaaccgaactcctgatcgagatggaggactggaagggcgataaagtgaaggcacattatggcggctttaccgtgcagaacgaggctaacaagtaccagatctccgtgaataaataccggggaactgcgggaaacgctctaatggatggcgcatctcagcttatgggagagaatcggacaatgacaatccacaatggaatgttcttctcaacatatgatcgggacaatgatgggtggttgaccagtgatcctaggaaacaatgctcaaaggaagacggaggtgggtggtggtataacagatgccacgccgctaaccctaacggtcggtattactgggggggccaatatacatgggacatggccaagcatggcactgatgatggggtggtctggatgaactggaaaggctcttggtactcgatgcgcaagatgtccatgaagattagaccattctttccgcagcag

SEQ ID NO: 11257 - DNA, 1473 bp, Artificial Sequence
  Description of Artificial Sequence: Synthetic coding sequence
atgaagaggatggtgagttggagcttccacaaactgaaaacaatgaaacacctgctcctactactcttgtgcgtcttcctcgtcaaatctcagggggtaaacgacaacgaagaaggttttttttctgcccgcggacaccgccctctggataagaagcgagaagaagcaccaagcctgcgcccagcccccccacccattagtggcggaggatatagagcccgtcccgctaaagccgctgctacacagaaaaaagtggaaagaaaggccccagacgctgggggatgcctgcatgcagatccagatcttggcgtcctgtgcccaaccggctgtcagctacaggaagccctcttgcagcaagagcggccaatacgcaatagtgtggatgagctaaataataacgtcgaggccgtatcccagacctcgtcctcatcattccaatatatgtacctcctgaaagatctctggcagaagcggcagaagcaagtcaaagataacgagaacgtggtgaacgagtatagttccgaattggagaagcaccaattatatattgacgagaccgtgaactcaaatatccctacaaacctccgggtactgcgctcaattcttgaaaatcttcggtctaagattcagaagttggagtctgatgtatcagcacaaatggaatactgtagaacaccctgtacagtcagttgtaatatccctgtggtaagtggcaaggagtgtgaggaaatcatccgcaaagggggcgaaaccagcgagatgtacctcatccaacccgacagttcagtcaaaccttaccgcgtgtactgcgatatgaacaccgagaatggaggctggaccgtcatccagaatagacaagacggatctgttgacttcggccggaagtgggatccttacaagcaaggcttcggaaacgttgccacaaacaccgacgggaaaaactactgcggccttccgggagagtactggctgggcaacgataagatttcacagctcacccggatgggacccactgagctcttgatcgagatggaagactggaagggtgacaaggtcaaggctcattatggagggttcaccgtgcagaacgaggccaataagtatcagatctccgtgaacaaataccgaggtacggctgggaatgccctgatggatggtgcgtcacaattaatgggagaaaacaggaccatgactattcacaatggaatgttttttagcacgtatgacagagataatgacggttggctcacctccgatcctaggaagcaatgctctaaggaagacgggggaggatggtggtacaaccgatgccacgcagcgaaccccaacggcaggtattactggggaggtcaatatacatgggatatggccaagcacggcactgatgacggggttgtgtggatgaactggaagggaagttggtactctatgagaaagatgagcatgaaaattcggccattctttcctcagcag

SEQ ID NO: 11258 - DNA, 1473 bp, Artificial Sequence
  Description of Artificial Sequence: Synthetic coding sequence
atgaaaaggatggtgagctggtcttttcacaagctcaagactatgaagcacctccttctgctcctgctctgtgtgttcctggtgaagagccaaggagtgaatgacaacgaggaaggctttttctccgcacggggccatagacctctggataagaagcgggaagaggcaccaagcctgcgacctgcaccccctccaatctccggcggaggatacagagcacggcctgcaaaagcagcagcaacgcaaaagaaggtggaacgcaaagcaccagatgcgggaggttgtctccacgcagatccggaccttggagtgttgtgcccaaccggttgccaactccaagaagcgctcctccagcaggaaagaccaattaggaattccgtggatgagctgaataacaacgtcgaagccgtctcccaaacttcctcatcatcctttcagtacatgtacctcctgaaagatttgtggcagaagagacaaaaacaggtgaaggataacgagaatgtggtgaatgagtattccagtgaacttgaaaagcatcagctttacattgatgaaaccgtgaattcaaatatcccaactaacctccgtgtgcttcgtagcattctcgaaaaccttcgctcgaagattcagaagctcgaatcagacgtgtccgcccaaatggaatactgccgcaccccttgtaccgtgtcctgtaacatacctgtggtgtccggaaaggagtgcgaggagataatcagaaaaggaggcgaaactagcgagatgtacctgatccagcccgactccagcgtgaaaccatacagagtgtactgtgacatgaataccgaaaacggtggatggactgtgatacagaataggcaagatgggagcgtcgatttcggcaggaaatgggatccatacaagcaaggttttggtaacgtcgctactaacaccgatggtaagaactactgcggactgccaggtgaatactggttggggaatgacaagattagccagcttacgcgtatgggaccaacggaactgctgattgaaatggaggactggaaaggagataaggtgaaggcccattacggaggtttcactgtgcagaacgaggctaataagtaccaaatttcagtgaacaagtacagagggaccgccgggaacgcacttatggatggagcatcacaactgatgggagaaaaccgcactatgactatccataatggcatgttcttctccacctacgatcgcgataatgacggctggctgacttccgacccgcgcaagcagtgttcaaaggaggacggcggtggttggtggtataaccggtgccatgccgccaatcctaatggccgctactactggggcggtcagtacacttgggatatggcaaaacacggaactgacgatggagtggtgtggatgaactggaagggcagctggtactccatgcgtaaaatgtcgatgaagattagaccgttctttcctcaacaa

SEQ ID NO: 11259 - DNA, 1473 bp, Artificial Sequence
  Description of Artificial Sequence: Synthetic coding sequence
atgaagcgaatggtgtcttggtccttccacaaactgaaaacaatgaagcaccttctcttgcttttgctctgtgtctttctggtcaagtctcagggagtcaacgacaacgaagaaggcttcttttccgcccgggggcaccggccactcgacaagaaacgagaggaagctccctcattacgaccggcccctccccctatttcaggcggaggctacagggcccgacctgcaaaggcagccgccactcaaaaaaaagttgagcgcaaagcccccgacgcgggcgggtgccttcatgccgacccagatctaggtgtcttgtgccctacagggtgccaacttcaggaagcactgctacaacaggagaggccaatacggaacagcgttgatgagctcaacaacaacgtggaggccgtaagccaaacaagtagttcatctttccagtacatgtatcttctgaaagacttatggcagaagagacagaaacaggtaaaagataacgagaatgtggttaacgagtactcaagtgagctggaaaaacatcagctctatatcgacgagacggtgaactccaacattccaaccaacctgcgagttctgagatcaatcctggagaacctgaggtccaaaattcaaaagcttgagtcagacgtatccgcccaaatggagtattgccgcactccttgtacagtcagttgcaatattcccgtcgtctctggtaaagagtgtgaagaaatcattaggaagggtggggagactagcgagatgtatcttatccagccggatagcagcgtaaagccctacagggtttactgcgacatgaacactgaaaacgggggatggactgtgatccaaaaccgccaggatggtagtgtagactttggtagaaaatgggacccatataagcaaggatttggcaacgtggcaactaataccgatgggaagaattattgcgggctgccaggtgagtattggcttggcaacgacaaaatatcccagctcactcgtatggggcctaccgaactgctgatcgaaatggaggactggaagggagataaggttaaagctcactacggcggttttactgtacagaacgaggcaaataagtaccagatctccgtcaataagtataggggcactgctggtaatgccctgatggatggagctagccaactgatgggtgagaatagaacaatgactattcataacggcatgttcttttccacgtatgaccgagataacgacggatggcttacctcagatccacgaaaacagtgctctaaagaagatgggggagggtggtggtacaaccgatgtcatgctgccaatccaaatgggcgttattattggggaggtcagtatacttgggatatggccaaacacggtaccgatgacggtgtggtgtggatgaattggaaagggtcttggtattccatgaggaaaatgtctatgaaaatccgaccattttttccacagcag

SEQ ID NO: 11260 - DNA, 1473 bp, Artificial Sequence
  Description of Artificial Sequence: Synthetic coding sequence
atgaagcgcatggtgtcttggtcttttcacaaattaaagaccatgaagcacctgctgcttctgctcctgtgcgtgtttcttgtaaagtcacagggcgttaacgataatgaagaagggttcttctctgcacggggacatagacccctggataaaaaacgcgaagaggccccatcactaaggcctgccccccccccaatctcaggtggggggtatagggcccgcccggctaaagccgccgccactcagaaaaaagtggagcggaaagcgcccgatgccggaggctgcctgcacgccgatccagacttgggagttctttgtcctaccggatgccagttacaggaggcgctgttacagcaggagcggccgatcagaaactctgtcgatgaattaaacaataacgtggaagctgtgtcacagaccagctctagtagcttccagtacatgtatctgttaaaggacttgtggcagaaaagacaaaagcaggtaaaagataacgagaatgtggtcaatgaatatagttccgagctcgagaagcaccaattgtacatagacgaaactgtgaactccaacattccgacgaacctacgggtccttcgctctatcctggagaacctgagatccaaaatccagaagctggagtcagacgtgtccgcccaaatggaatattgtcggacgccatgtaccgtctcatgcaatattccagtcgtctcaggtaaggaatgtgaggaaattattcgaaaagggggggagacctccgagatgtacctaattcagcctgacagcagcgttaagccataccgcgtctattgtgacatgaataccgaaaacggggggtggacagtgatccagaaccggcaagacgggtctgtcgactttggccgcaaatgggatccctataagcagggctttgggaacgttgctactaacactgacgggaagaattattgtgggctcccaggggagtactggttggggaatgataagatctcgcagcttacacgcatgggcccaactgaactactgatcgaaatggaagattggaagggtgacaaagttaaagcacattatggagggtttacagttcagaacgaggctaataagtaccaaatctccgtgaacaagtacaggggtacggccggtaatgccctcatggatggtgcaagccagttaatgggagagaatagaacgatgacaattcataatggaatgttttttagtacgtatgatagagataatgacggatggctaacttctgatccacgaaaacagtgctctaaggaggacggcgggggttggtggtacaatagatgtcacgcagccaacccgaatgggcgctattactggggcggccagtatacctgggacatggccaagcacggcacagacgacggagtggtctggatgaactggaagggcagctggtacagcatgcgcaaaatgtctatgaagatacgaccatttttcccccagcaa

SEQ ID NO: 11261 - DNA, 1473 bp, Artificial Sequence
  Description of Artificial Sequence: Synthetic coding sequence
atgaagagaatggtgagctggagttttcacaagcttaagactatgaagcatctgttgctgttgctgctgtgtgtcttcctggtgaaatcccagggcgtgaacgacaatgaagagggctttttttctgccagaggccacaggcccctggacaagaagcgggaggaggcgccaagcttgcggccagctccaccaccaatctctggggggggctatcgggcaaggccagctaaagccgctgccacccagaaaaaggtggaaagaaaggcaccagacgctggaggatgtcttcacgccgaccctgatcttggcgtgctctgtcctaccgggtgccaacttcaggaggctctgctgcagcaggagcgccccatacgaaacagcgtcgatgagctcaataacaacgtggaggctgtcagccagacatcctcctcctctttccagtacatgtatctgctcaaggatctctggcaaaagcgccagaagcaggtgaaggacaacgaaaatgtcgtgaacgaatattcaagtgagttggagaagcatcaactgtacatagacgaaactgtcaactctaacattccaaccaatctccgggtgctgcgcagtatcctcgagaaccttcggagcaaaatccagaaattggagtctgatgtgagcgcccagatggaatattgcagaaccccatgtactgtcagttgtaatatccccgtcgtgtccgggaaagaatgcgaggagattattaggaaagggggcgagactagtgagatgtacctgatccagcctgatagttccgtcaaaccttacagagtttactgcgacatgaacacggaaaacggcggctggactgtgattcaaaaccggcaggatgggtcagtggatttcggtcgcaagtgggacccctacaagcaaggatttggaaacgtcgctacaaatacggacggaaagaactattgtggtttgcccggcgagtactggctgggcaacgataagatctcacagttgacacggatgggccctactgagctgctcatcgaaatggaagactggaagggcgataaggtgaaagcccactatggagggtttaccgtgcagaacgaagcgaacaagtaccagataagcgtgaataagtacagaggaacagccgggaatgccctgatggatggggcatcccagctgatgggcgagaatagaacaatgacaattcataacggaatgtttttcagtacttatgatcgcgacaacgatggatggctgacgtcagacccccggaaacagtgctccaaagaggatgggggcggctggtggtacaatagatgccatgccgcaaacccaaatgggaggtactactggggggggcagtatacttgggatatggctaaacacggaaccgacgacggagtggtgtggatgaattggaaaggatcctggtacagtatgcgcaaaatgtccatgaagatacgacctttcttccctcagcaa

SEQ ID NO: 11262 - DNA, 1473 bp, Artificial Sequence
  Description of Artificial Sequence: Synthetic coding sequence
atgaagagaatggtgtcctggtcattccataaacttaaaacgatgaagcacctcctcctgcttctgctttgtgtctttctggtgaagtcccaaggtgtcaatgacaatgaggaaggttttttctcggccagggggcatcgacctctggataagaagagagaagaagccccgtcactccgacccgctccacctcctatttccgggggaggatacagggcacgccctgccaaggcagcggcaactcagaaaaaggtggaaaggaaggcacctgacgcaggaggttgtctccacgcggatcccgaccttggagtgctttgtcccaccggatgtcaactccaagaagcactcctgcagcaggagcgccctattaggaattcggtggacgaacttaacaataatgtggaggcagtgtctcagacctcctcgtcatcgttccaatacatgtatctcctcaaggatttgtggcaaaagaggcagaaacaggtgaaggataacgaaaacgtcgtgaacgaatacagcagcgagcttgaaaagcaccaattgtacattgatgagactgtgaactcaaacataccaaccaatcttcgagtccttcgctcgattcttgaaaacttgagatcaaagatacaaaaacttgagtccgacgtgagcgcacaaatggaatattgtagaactccatgtactgtgtcgtgcaatattcccgtggtgtccgggaaggaatgcgaagagatcatccggaagggcggagaaacttccgaaatgtacttgattcaaccggattcatcagtgaagccataccgcgtgtactgtgacatgaacaccgagaacggcgggtggactgtgattcaaaaccggcaggatggcagcgtggattttgggcgaaagtgggatccgtataagcaaggctttggtaacgtggcaactaataccgacggtaagaactactgcggattgccaggcgagtactggcttgggaacgataagatctcgcagctcacccggatggggcctaccgagcttctgatcgagatggaggactggaaaggagacaaggtgaaagcccactacggggggtttaccgtgcagaacgaagcaaacaagtaccaaatctcggtcaacaaataccggggcaccgccggaaatgcacttatggatggagcatcgcaacttatgggtgaaaatcgaacgatgaccatccataacggcatgttcttttccacctacgacagggataacgatggttggctgacgtccgatccacgcaaacagtgttccaaggaagatgggggcgggtggtggtacaaccgttgtcatgccgccaatcccaatggccgttactactggggtggtcagtatacttgggacatggccaaacatggaaccgatgatggagtcgtttggatgaattggaagggtagctggtactccatgagaaagatgagcatgaagattcggcctttctttccacagcaa

SEQ ID NO: 11263 - DNA, 1473 bp, Artificial Sequence
  Description of Artificial Sequence: Synthetic coding sequence
atgaagaggatggtttcctggtcgtttcataaactgaaaaccatgaagcatcttctgctgcttctcctgtgtgtgttcctcgtgaagagccaaggtgttaatgataacgaagaaggctttttcagcgcaagaggacaccggccccttgataagaaacgcgaggaagcaccctctcttcggcccgccccacccccaatatcaggaggcggttatagggcaaggcccgcaaaggcagccgccacccagaagaaagtggagcgaaaggcacctgatgcaggtggctgtctccacgccgatcctgatctgggagtgctttgtccaaccggttgccaactgcaagaggcactgctccagcaagagcgtcctatcagaaactcagtcgatgaactcaataacaatgtggaagcagtgtcacagacttcgtcatcgtccttccaatacatgtacctgctgaaggatctgtggcaaaaacgccaaaagcaggtgaaggataacgaaaacgtggtgaatgaatactcctcagagctggaaaagcaccaactttacattgacgagactgtgaatagcaatattcctaccaatcttcgcgtccttaggtcaattctggagaatctgcggtcaaaaatccagaaacttgagtccgacgtgtcagctcagatggagtactgtagaaccccatgtactgtgtcctgcaacatacctgtggtatcaggaaaggaatgtgaggaaatcattaggaaggggggtgaaacttctgaaatgtacctgatccaaccggatagctcagttaaaccatacagagtgtactgtgatatgaacaccgagaacggagggtggactgtcatccagaaccggcaagatgggagcgtggattttggacggaaatgggacccatacaagcaaggcttcggtaatgtcgccactaacaccgatggtaagaactactgtggtttgcccggtgaatactggcttggcaacgataagatttcgcaactgacccggatgggacccaccgagctgttgatcgagatggaagattggaagggggataaagtgaaggcgcattacggcggatttaccgtccaaaacgaggcaaacaagtaccaaatttcggtgaacaaataccggggaacggcgggcaatgcacttatggacggtgcatctcagctcatgggagagaaccgcaccatgaccattcataatggcatgttcttcagcacctacgatcgcgataacgatggatggcttactagcgaccctcgtaagcagtgttccaaggaggatgggggcggctggtggtacaacagatgtcacgccgcaaatccaaacggtcggtactactggggtggacaatacacctgggatatggcaaagcatggtactgacgatggagtggtgtggatgaattggaaagggtcctggtacagtatgcgcaagatgtcgatgaaaatcagaccattctttcctcagcag

SEQ ID NO: 11264 - DNA, 1473 bp, Artificial Sequence
  Description of Artificial Sequence: Synthetic coding sequence
atgaagcggatggtcagctggtcgtttcacaagctgaaaactatgaaacacctcctgctcctgctgctgtgcgtatttctggtgaagtcccagggagtgaatgataacgaggagggttttttctcggcgcggggccaccggccgctggacaagaagagagaagaagctccaagcctgcggccagccccgccaccgatcagcggaggtggctacagagcgcgccccgctaaagccgccgccacgcagaaaaaggtcgagcgcaaggcgcctgacgcgggtggttgtctgcacgcagatcctgacctgggggtgctgtgtcccaccggctgccagctccaggaagccctcctgcagcaggagcggcctatcagaaatagcgtcgacgaacttaacaacaacgtcgaagcggtgtcacaaacctcctcgtcgtcgttccaatacatgtacttgctgaaggatctgtggcaaaagaggcaaaaacaggtgaaggataacgaaaacgtggtgaatgaatactcgtcagaactggaaaagcaccaactgtatatcgacgaaaccgtgaattcaaacatcccgaccaacctgagggtccttaggagcattcttgagaacctcagaagcaagatccagaagctggagtccgatgtctccgcgcaaatggagtactgtcgcaccccttgcaccgtgtcgtgcaatatcccggtggtgtccgggaaggagtgtgaagagattatacggaaaggcggagagacgtccgagatgtatctgattcaacctgatagctccgtcaagccttaccgcgtgtactgcgatatgaacactgaaaatgggggctggaccgtgatccagaatagacaggacggtagcgtggacttcggacggaagtgggatccatacaaacagggattcggtaatgtggcaactaacactgacggtaagaactactgcggactgcccggcgaatactggctgggtaacgataagatctcgcagttgactagaatgggcccaactgagctgctgattgaaatggaagattggaagggagacaaggtgaaagcccattatggaggatttacggtgcagaatgaggcgaataagtaccagatctctgtcaataagtatagaggaaccgcgggcaacgccctgatggacggcgcgtcccagctcatgggggagaacaggactatgaccatccacaacggtatgttcttcagcacctacgaccgggataacgacggctggctgacctcagacccgcgcaagcagtgctccaaggaagatggaggaggctggtggtacaatagatgccatgcagcaaatccaaacggacgctattactggggaggacaatacacgtgggacatggccaagcacggcacggacgacggagtcgtctggatgaattggaaaggttcatggtactcaatgcgaaagatgtctatgaagatccggccgtttttcccacagcag

SEQ ID NO: 11265 - DNA, 1473 bp, Artificial Sequence
  Description of Artificial Sequence: Synthetic coding sequence
atgaagcgcatggtgtcatggtcgttccataagctgaaaaccatgaagcatttgctcctcctgctgctgtgcgtgttcctcgtgaagtcgcaaggagtgaatgacaacgaggagggctttttctcggcccgcggacaccgcccactggacaagaagcgggaagaagccccatcgctgcgcccagcaccgccaccgatcagcggaggaggataccgcgcaagaccagctaaagcggctgccactcagaagaaggtggaacgaaaagcacctgatgcgggaggctgcctgcatgccgacccggatctgggggtgctgtgcccgacgggctgccagctccaggaggcgctcctgcagcaggaaagaccgatccggaattcggtggatgagctcaacaataacgtggaagccgtgagccagacttcatcctcatcatttcagtacatgtacctgctcaaagacttgtggcagaagagacagaagcaggtgaaggacaacgaaaacgtcgtgaatgagtactcctcggagttggaaaagcaccaactctacatcgatgaaactgtcaacagcaacattcctactaatctccgagtcttgcgctcgatcctcgagaacctccggagcaagattcaaaagctggaatccgacgtctcagcacagatggagtactgcagaaccccttgcacggtttcctgcaacatcccggtcgttagcggaaaagaatgcgaagaaatcatccgcaagggcggagaaactagcgagatgtatcttatccaacctgattcttccgtcaaaccctaccgggtgtactgcgacatgaacacggagaacggtggatggaccgtgatccaaaaccgccaggacgggtccgtggatttcggaagaaagtgggacccatacaaacagggatttggaaacgtggcgaccaatactgacggaaagaactactgtggactcccaggcgaatactggttgggaaacgacaaaatctcgcaactgacgcgcatgggaccgacggaacttcttatcgagatggaagattggaaaggggacaaggtgaaagctcactacggaggcttcactgtgcaaaatgaagcgaataagtaccagatctcagtgaacaaataccggggcaccgccggaaatgcactgatggacggggcatcgcaactgatgggagagaatcggaccatgaccattcacaacggcatgttcttttcgacgtacgatcgcgataacgacggatggctgaccagcgatcctcgcaagcagtgctcgaaggaggacggaggcgggtggtggtacaaccgctgtcatgcggcgaatccaaatggaaggtactattggggaggccagtacacctgggacatggcaaagcatggaactgacgatggcgtggtctggatgaactggaagggaagctggtatagcatgcgcaagatgagcatgaaaatcaggccgttctttccgcaacag

SEQ ID NO: 11266 - DNA, 1473 bp, Artificial Sequence
  Description of Artificial Sequence: Synthetic coding sequence
atgaagcgcatggtctcctggtcttttcataagcttaaaaccatgaagcacttattgctattgttactttgtgtttttttggtgaagagccagggtgtgaacgataatgaagaggggttcttcagtgcccggggccaccggccacttgataaaaaacgggaagaagccccttccctgcgtcctgcccccccaccaatctctggcggtggatatcgcgcccgacctgctaaagccgccgctacccagaagaaagttgaacggaaggcgcctgacgctggagggtgcctacatgccgatcccgaccttggagtgctttgtcctacagggtgtcagttgcaggaagcactgctccagcaggagcggcccattcgaaactccgtggatgaactcaataataacgtggaagccgtttcccaaacaagcagctcttctttccagtacatgtacctcctgaaggatttatggcagaagcgccagaaacaggttaaggataatgaaaatgtcgttaatgaatattccagtgaactcgagaagcatcagctgtatatagacgaaacagtgaacagcaatatacccaccaacctgcgcgtactgagaagcatactggaaaatctgcggtctaagatccagaagttagaaagtgacgttagcgcacagatggagtactgtcggacaccatgtaccgtatcctgcaatatccctgtcgtatctgggaaggaatgcgaggaaatcatacggaagggtggagagacttccgaaatgtatctgatacagccggactcatcagtgaaaccataccgcgtctactgcgatatgaatacagagaacggcgggtggacagtcatccagaataggcaagacgggtccgtggacttcggcagaaaatgggacccatacaagcagggcttcggcaatgtggctactaacactgacggtaagaactactgtgggctcccaggcgagtattggctcggaaacgacaagatttcccagctgacacggatgggacctactgagttgctcatcgagatggaggattggaagggcgacaaggtcaaagcccattatggaggcttcaccgtgcaaaatgaggccaacaagtaccagattagcgttaataagtatagaggaacagcgggcaatgccttgatggatggcgcttcccaactgatgggggagaatcgtacaatgaccattcataacgggatgtttttcagcacttatgaccgcgacaacgatggatggttgacatccgatcctcggaagcagtgcagtaaggaggacgggggcggatggtggtataatcggtgccatgcagccaacccaaatggccggtattattgggggggtcagtatacttgggatatggcgaagcatggtaccgacgatggggttgtgtggatgaactggaagggctcctggtactctatgcgcaagatgtccatgaagattcggccattctttccccagcag

SEQ ID NO: 11267 - DNA, 1473 bp, Artificial Sequence
  Description of Artificial Sequence: Synthetic coding sequence
atgaagagaatggtgtcctggtcattccacaagctgaaaaccatgaaacatctgctcctgctgctattgtgcgtgtttctggttaaatctcagggcgtcaatgataatgaggagggctttttctcagctcgcggccatagacctcttgataagaaacgtgaggaagctccgtccctacgaccagcgcctccaccaatcagtgggggtgggtaccgggctcgtcccgcaaaggccgccgccactcagaagaaggtagagaggaaagccccagacgctggaggttgcctgcacgctgatcctgatcttggcgtcctgtgccccaccggttgccagctgcaggaggctttgctgcaacaggaacgtccaatccgtaattccgtagacgagctgaataacaatgttgaggcagtgtcccaaactagttctagttcctttcagtatatgtatctgctcaaggatctgtggcagaaacgtcaaaagcaggtcaaggataacgagaatgtggtcaatgagtacagtagtgagttggagaagcaccaattatacatagacgaaacagtgaactccaatatccctacaaacctcagagtgctacgaagtatccttgagaatctgcggagtaaaatacaaaagttggagtcagatgtcagcgctcaaatggagtattgtagaacaccatgcacagtttcttgtaatatccctgtagtgtccgggaaggagtgtgaagaaatcatccgcaagggcggagagacttctgagatgtatctgattcagcccgacagcagtgtcaagccgtatcgcgtctactgtgacatgaataccgagaatgggggatggactgtcattcagaatcgacaagacgggtccgtcgactttggccgcaaatgggatccctataagcagggattcgggaacgttgcaaccaacaccgatggcaagaattattgtggcctgcctggagaatactggctcggcaatgataaaatttcccaattgacccgcatgggccctaccgaactgttgatcgagatggaggattggaagggcgacaaggtcaaagcccactacggaggttttacggtgcaaaatgaggcaaacaaataccaaatttctgttaataaataccggggcactgctggaaatgccttaatggatggggctagtcaactgatgggggagaacagaactatgaccatccacaatggcatgtttttttcaacatacgatcgcgacaacgacggctggctcaccagtgacccacgcaaacagtgctccaaggaggacggaggtgggtggtggtacaatcggtgccatgcggctaacccaaacgggaggtactattggggcgggcagtatacttgggatatggctaaacacgggaccgatgatggagtggtgtggatgaattggaagggatcttggtattccatgcgcaaaatgtctatgaagatcagacctttcttccctcagcaa

SEQ ID NO: 11268 - DNA, 1473 bp, Artificial Sequence
  Description of Artificial Sequence: Synthetic coding sequence
atgaaaaggatggtcagctggtccttccataaattgaagacaatgaagcaccttctgcttttgttactgtgtgtgttcttggttaagagtcaaggagtgaatgataacgaggagggctttttcagtgctcgtgggcaccgcccactcgataaaaagcgtgaggaagctccatccctgcgaccagcccccccaccgatctctggcgggggttatcgggccagacctgctaaagctgccgctacacagaaaaaagtggaacgaaaagcccctgacgcaggcgggtgcctgcacgctgatccggatttgggagtgctgtgcccaactgggtgtcaactgcaggaagccctgttgcagcaggagcgcccaattaggaattccgttgatgaacttaataacaatgttgaggctgtgtcacaaacgtcgtcttctagctttcagtatatgtatcttctgaaagatctttggcagaaaaggcagaaacaagtcaaggacaatgaaaatgtagtcaacgagtattcgagcgagctcgaaaaacatcagctttacatcgatgagaccgtcaactctaacattccaactaatctccgagtgttgaggagtattctcgagaacctgcggagtaaaatccagaagctcgaatccgatgtttctgcccagatggagtattgcaggaccccctgtacggtgagctgcaacatccccgtggtctcagggaaggagtgcgaggagataattaggaaaggcggagaaacatctgagatgtacctcatacagcctgattcatccgtgaagccttaccgtgtatattgcgacatgaatacggaaaatggaggctggaccgtgattcagaaccggcaggatggctctgtagattttggtaggaagtgggatccctataaacaggggtttggaaacgtggcaaccaacacagatggaaagaactattgcggattgccaggagaatattggctgggaaacgataagattagtcaactgacaagaatgggccccactgagctgttgatcgagatggaggactggaagggcgataaagtcaaggctcactacggtggattcaccgtgcagaatgaagcaaataaatatcaaattagcgtgaacaagtatcgcggaaccgcaggaaatgcccttatggacggcgcttcacagctcatgggcgagaatcggacaatgacgatacataatgggatgttctttagcacctatgatcgagataatgatgggtggctgaccagtgaccccagaaagcagtgtagtaaggaggacgggggtggctggtggtacaatcggtgccacgcagccaaccccaacggtagatactattggggcggtcaatatacatgggacatggctaaacacgggactgacgatggcgtcgtttggatgaattggaaagggtcatggtactctatgcgcaagatgtcgatgaagattagaccctttttcccgcaacaa

SEQ ID NO: 11269 - DNA, 1473 bp, Artificial Sequence
  Description of Artificial Sequence: Synthetic coding sequence
atgaaacgcatggtttcgtggagcttccacaagctgaaaactatgaagcatctgctgttgctgctgctgtgcgtgttcctcgtgaagtcgcagggagtgaacgacaacgaggaaggatttttctcggcgcgcggccaccgccctctcgacaaaaagcgcgaagaagcgccgtcactgaggccagccccaccacctatctcgggaggtggataccgggcacgtccggcgaaggcggcggcgacccagaaaaaggtggaacggaaggctcctgacgccggaggttgcttgcacgccgacccggacctgggagtcctctgtccgaccggctgccagttgcaggaggcactgctccagcaagagcgcccgatccggaattcggtggacgaactcaataacaatgtggaggccgtgtcgcagacctcctcctcgtcattccagtacatgtacctgctgaaagatctctggcaaaagagacaaaagcaggtgaaggacaacgaaaacgtggtgaacgagtactcgagcgaacttgagaagcaccaactttacatcgatgaaactgtgaactcaaacattccaactaacctgagggtgctccgctcgatcctcgagaacctgcggtccaagatccagaagctggagagcgacgtgtcggctcagatggaatattgccgcactccatgcaccgtgagctgcaacatccctgtggtgtccggcaaggagtgcgaggaaatcattcgaaaaggaggggaaacctcggaaatgtacctgatccaacctgactcgtcggtgaagccataccgggtgtactgtgatatgaacactgaaaacggcggttggactgtcatccagaaccgccaggacggaagcgtggacttcggacggaagtgggacccctacaaacagggattcggcaatgtggctaccaatactgatggaaagaactactgtggcctgcctggtgagtactggctgggtaatgacaagatctcgcagttgacgcgcatggggccaactgaactcctgatcgagatggaggactggaagggggacaaagtcaaagcccattacggaggattcactgtccaaaatgaagccaataagtaccaaatctccgtcaataagtaccggggcaccgcaggaaacgcgctgatggacggcgcttcacagctgatgggagaaaaccggactatgacgatccacaacggaatgttcttctcgacttacgatcgcgacaacgacggatggctcacttccgatcctaggaagcagtgcagcaaggaggatggaggcggctggtggtacaatagatgtcacgctgccaaccccaatggacgctactactggggtgggcaatacacctgggatatggccaagcatgggactgacgacggagtggtgtggatgaactggaagggaagctggtactcgatgagaaagatgtcgatgaagatccgcccgtttttcccgcagcaa

SEQ ID NO: 11270 - DNA, 1473 bp, Artificial Sequence
  Description of Artificial Sequence: Synthetic coding sequence
atgaaaaggatggtgtcctggtcgttccacaagttgaaaaccatgaagcacctgcttctgctcttgctgtgtgtgtttctggtgaagtcccagggggtgaatgacaacgaagaggggtttttctccgcacgcggacatcgcccactcgacaagaaacgggaagaggcacctagcctccgcccagcaccaccacctatcagcgggggaggctaccgagcaagaccggcgaaagcagctgccactcaaaagaaggtggaacggaaggcaccggatgcgggtggatgcctgcatgcagatcctgaccttggagtgctttgccctaccggttgccaactgcaggaagccctcctccagcaggagcggccaattagaaacagcgtcgatgaactcaataacaacgtggaagccgtttcccagacttcctcaagctcctttcagtatatgtaccttctcaaggatctgtggcagaaaaggcaaaagcaggtgaaggataatgagaacgtcgtcaacgagtactccagcgaacttgagaagcatcaactgtatatcgatgaaaccgtgaacagcaatattcctaccaacttgcgagtgcttagatccatactcgaaaaccttaggagcaaaatccagaagctggaatcagatgtgagcgcacaaatggaatactgtagaaccccctgcactgtgtcatgtaacattcccgtcgtgtcgggtaaagaatgtgaagaaatcattagaaagggaggtgagacttccgaaatgtacctgattcaacccgactcatcggttaagccttaccgagtgtattgtgatatgaataccgagaacggaggctggacggtcattcaaaacagacaggacggatcggtggattttgggagaaaatgggatccctacaaacaagggttcggtaatgttgccactaatacggacgggaagaattactgtgggctgccaggcgaatactggttgggcaatgataagatctcccagttgaccagaatgggacctaccgaactgctgatagaaatggaagattggaagggtgataaagtcaaagcacattacgggggatttaccgtgcagaacgaagccaacaagtaccaaatctcagtgaacaaataccgtggcactgcagggaacgcactgatggatggagcaagccaattgatgggagagaacagaaccatgactattcacaatggaatgttctttagcacgtatgaccgagataacgatggctggcttacttccgacccccgcaagcaatgttccaaggaagatggtggcgggtggtggtacaacagatgtcacgctgcaaatccaaacggtcggtactactggggtggtcaatacacttgggacatggcaaagcatggaactgatgatggtgttgtctggatgaactggaagggatcttggtattccatgcgcaagatgtctatgaagattcggcccttctttcctcaacag

SEQ ID NO: 11271 - DNA, 1473 bp, Artificial Sequence
  Description of Artificial Sequence: Synthetic coding sequence
atgaaaagaatggtaagctggtcgttccataagctcaagactatgaagcatctgctgctcctgttgttgtgcgtttttctggtcaagtcgcagggcgtaaacgacaacgaggagggcttcttctcggcgagaggccaccggccactggacaagaagcgcgaggaagcccctagcctccgaccggctccccctcctatcagcggtggaggatacagagccaggcccgcaaaagctgcagccacgcagaaaaaagtcgagcgcaaagccccggatgccggtggctgcctccacgctgacccagacttgggagtcctctgcccaaccggatgtcaactgcaggaagcgctgttgcagcaggaacggcctatccggaactcagtcgacgagcttaacaacaacgtggaagcagtctcccagaccagctcatcatccttccagtacatgtatctgctcaaagacctgtggcaaaagagacagaagcaggtgaaggacaacgagaatgtggtgaacgagtattcctcggaactggagaagcaccaactgtacatcgatgaaaccgtgaattcgaacatcccaaccaacctgcgggtgcttcgcagcattctggaaaatcttcgttcaaagatccagaagctggaatctgatgtgagcgcacaaatggaatattgtaggaccccttgcactgtgagctgcaacatcccggtggtatccggaaaggagtgtgaagaaatcatccggaagggtggggaaacttcagaaatgtaccttattcagccagattcttcggtgaagccgtaccgcgtttactgcgacatgaacaccgaaaatggtggatggactgtcatccagaatcgccaagatggatcagtggattttggacgtaagtgggatccgtacaaacagggcttcggaaacgtggcgacgaacactgacggaaagaattactgcgggcttccaggggagtactggcttgggaacgacaaaatctcccagctgaccagaatggggcccactgagttgctgatcgaaatggaggactggaagggcgacaaggtcaaggcgcactacgggggatttactgtgcagaatgaagccaataagtaccaaatctccgtgaacaagtaccgcggaaccgccggaaacgccctcatggacggcgcgtctcaactgatgggagagaatcgcactatgaccatccacaacggaatgttcttctcgacctacgacagagacaatgacggctggctgacgagtgatccgcgcaagcaatgctcgaaagaggacgggggagggtggtggtacaaccgctgccatgcagctaacccgaatggcaggtactactggggtggacagtacacctgggatatggcgaagcatggcactgacgatggcgtggtgtggatgaattggaaagggtcgtggtattcaatgcggaagatgtcgatgaaaatacgcccgttctttccgcaacag

SEQ ID NO: 11272 - DNA, 1473 bp, Artificial Sequence
  Description of Artificial Sequence: Synthetic coding sequence
atgaaacggatggtgtcctggtctttccataagctgaagactatgaaacacctgctcttgctgctgttgtgtgtgtttcttgtgaagtctcagggggtaaatgacaacgaggaaggcttcttcagtgccagaggccacagaccactggataagaaacgggaggaagcacctagcctgaggcctgctcctcctcctattagtggcggaggttatagagccaggcctgctaaggccgcagctacccagaaaaaggtggagaggaaggctcccgacgcaggagggtgcctccacgcagacccagatctgggagtactgtgtccgactggctgccagctgcaggaggccctcctacagcaggagcgcccaattcgcaattccgtggatgagctgaacaataacgtggaagcggtctcccagacttcatcctccagttttcaatatatgtacttgctgaaggatctgtggcagaaacggcaaaaacaggtgaaggacaacgaaaacgtcgttaacgaatattcgtcggaacttgagaagcaccagctgtatattgacgaaactgtaaactcaaacatacctaccaacctgcgcgtcctcaggtccattctggaaaacctgaggtccaagatccagaagttagaatcagacgtgtcggcgcagatggagtactgtcgtactccctgcaccgtgtcatgcaatattcctgtcgtgtcagggaaggagtgcgaagaaatcattcgcaaaggtggagaaactagtgagatgtatctgatacagcccgattcctctgtgaaaccttacagagtgtactgcgatatgaacaccgagaatggcggctggaccgttatccagaaccggcaagatggtagcgtcgacttcggacgcaagtgggacccttataagcaaggttttggcaacgtggctactaacaccgatggaaagaactactgtggactgcccggggagtactggctggggaatgataagatttctcagcttacccgcatggggcctacagaactgctcattgagatggaggactggaaaggggataaagtaaaggcacattacggaggcttcaccgtccagaacgaagcaaacaagtaccagataagtgtgaacaaatatcgcgggacagccggtaacgccctcatggatggcgctagtcagttaatgggggagaacagaacaatgaccattcacaacggcatgtttttctcgacatacgaccgggataatgacggatggctgacgagtgatccaagaaagcagtgctcaaaggaggatggcggaggatggtggtataacaggtgccacgccgcgaacccaaatggtaggtattattggggaggacagtacacgtgggatatggctaagcatggtaccgacgacggtgttgtgtggatgaactggaaagggagctggtattcaatgcgcaagatgtcgatgaaaattcgtcctttcttccctcagcag

SEQ ID NO: 11273 - DNA, 1473 bp, Artificial Sequence
  Description of Artificial Sequence: Synthetic coding sequence
atgaaacgaatggttagttggtccttccacaaactgaaaactatgaaacacctccttctgctgctgctgtgcgtgttcctggtgaaatctcagggtgttaacgacaacgaggagggctttttctcagcccgcggccaccgacctctggataaaaaaagagaagaagctccgagcctgcggccagcgccgccgccgatatcagggggaggctacagggcaaggcccgcaaaagccgctgcaacccagaaaaaggtggagcggaaagcacccgacgccggtggctgccttcacgccgaccctgacttgggggttctctgccccaccggctgtcagctgcaggaggctctattacagcaggaaagaccaatcagaaactctgtggacgaactgaataataatgttgaggccgttagtcagacttcctccagcagctttcagtatatgtacctgctgaaggacctttggcagaaaagacagaagcaggtcaaggacaatgaaaacgtagttaacgagtactctagcgagctcgagaaacaccagctgtatattgatgaaacagtgaacagcaacatccccaccaatctccgagtattacggtctatcctcgagaacttaagatccaaaatccagaaactcgagtctgacgtgtctgcccagatggagtattgccggaccccctgcaccgtttcctgtaatatccccgttgtatctggcaaggagtgtgaggaaattatcagaaaaggcggcgaaacatcagaaatgtacctgatccagcccgattcctcagtgaaaccatatcgcgtgtattgcgatatgaataccgagaatggcgggtggactgtaatacagaatcgccaagatggatccgtggatttcggacggaagtgggatccttataagcagggatttgggaacgtggcaaccaataccgacggcaagaattactgcggattgcccggcgagtattggctcggcaatgataaaataagccagttaaccagaatgggtcctaccgagctgctgattgagatggaggattggaagggtgataaggttaaggcacactatggtggttttactgtgcaaaatgaggcaaataaatatcagatctccgtgaacaagtacaggggaactgccgggaatgccctgatggatggcgcctcccagctgatgggggaaaataggaccatgactatccacaacggaatgtttttcagcacgtacgatcgtgacaatgacggatggctaacctctgaccctagaaagcagtgttccaaagaggatggagggggctggtggtacaacaggtgccatgcggcaaatccaaatggaagatactattgggggggccagtatacctgggatatggctaagcacggcactgacgatggcgtggtatggatgaattggaagggatcatggtactcaatgcgcaaaatgtcgatgaagatacggcccttttttccacagcaa

SEQ ID NO: 11274 - DNA, 1473 bp, Artificial Sequence
  Description of Artificial Sequence: Synthetic coding sequence
atgaagcggatggtcagctggtcctttcacaagctcaagaccatgaagcatctcttgctcctgcttctttgtgtgtttcttgtcaagagccagggagtgaatgataatgaagaaggtttcttttccgcaagaggccaccgacctctcgacaaaaagagggaagaagcgccttcacttcggccggcacctcctcctatttcaggtgggggataccgagcacgcccagccaaggcagcagccacccagaagaaggtcgaacggaaggcaccagacgccggaggatgcctgcacgcagatccagaccttggggttctctgtccaacgggatgccaacttcaggaagcgctcctgcaacaagaaagaccgatccggaattctgttgatgaacttaacaataacgtcgaagcggtgtcccagactagctcctcctcatttcagtacatgtaccttttgaaagatctttggcaaaaacgccaaaagcaggttaaggataacgagaatgtggtgaacgaatactcctcggaactggaaaagcatcagctctacatcgatgaaactgtgaactcaaacattcctactaacctgcgcgtgctccgttcaattcttgaaaaccttagatcgaaaattcaaaagctggaatccgatgtttccgcacagatggaatactgtagaaccccatgcactgtctcatgcaatattccagtcgtgtcgggaaaggagtgtgaagagatcattaggaagggtggcgaaacgtccgagatgtaccttatccagcctgactcgtccgtgaagccctaccgagtgtactgtgatatgaacactgaaaacgggggatggaccgtgattcagaaccgacaggatggaagcgtggactttggaagaaaatgggacccctacaagcagggtttcggaaatgtggcaactaatactgatggcaagaactactgtggattgcctggagaatactggctgggaaatgacaagatctcgcaactgacccgtatgggtcctacggagctgctgattgagatggaggactggaagggtgataaagttaaggcgcactacggaggttttaccgtgcagaacgaagcaaacaaataccagatctccgtgaataagtaccggggtaccgcaggtaatgcactgatggatggagcatcgcaactgatgggggagaatcgaactatgaccatacacaatggaatgttcttttccacttacgatagagacaatgatgggtggctgacctcagaccccaggaagcagtgttcgaaggaagatggaggtggatggtggtacaacagatgtcatgcagcaaacccaaatgggagatactactggggaggacaatacacttgggacatggctaaacatggaaccgatgacggtgtcgtgtggatgaactggaaagggagctggtactcgatgagaaaaatgtcaatgaagattagaccattctttcctcaacaa

SEQ ID NO: 11275 - DNA, 1473 bp, Artificial Sequence
  Description of Artificial Sequence: Synthetic coding sequence
atgaagcggatggtgtcttggagctttcacaagttgaagaccatgaagcatctgctactgctactgttgtgcgtgtttttggtgaaatcacaaggcgtcaacgacaacgaagagggctttttctctgcgaggggccacaggcccctggataagaagcgcgaggaagcgccctctttacggccagccccaccacccatctcaggtggcggctatcgggcgcgacccgccaaagcagcagctactcaaaagaaagttgagagaaaagcccccgacgcaggaggctgtttgcacgcagaccctgacctgggggtgctctgtcccacgggatgtcagttgcaggaagcactgctgcaacaagaacgcccaattcgcaattccgtggatgaactgaataacaatgtagaggcagtgtctcaaacgtcatctagcagcttccagtacatgtacctgctcaaggatctgtggcagaagaggcagaagcaggtgaaagacaacgagaacgtggtaaacgagtattcatctgagttagaaaagcatcagttatacatagacgaaactgtgaatagcaatattcctaccaatttgcgggtgttgagaagcattctggaaaatctgagatccaagatacagaaactggagagcgatgtctcagcccagatggaatactgcaggacaccttgtaccgtcagctgtaatatcccagtagtttctggcaaggaatgtgaggagatcatccgaaaaggaggagaaacgtctgaaatgtatttgattcaacccgacagtagcgtgaaaccttaccgggtgtactgcgatatgaatacagagaacgggggctggacggtgatacagaatcgccaggatggaagtgtggatttcgggcgcaagtgggacccttacaaacaggggtttggtaacgtcgcaactaataccgatggtaaaaactattgcgggctgcccggcgagtactggcttggcaacgacaagattagtcagctaactaggatgggacccactgaactacttattgagatggaggattggaagggggacaaggtcaaggcgcattatggcggcttcacagtacagaatgaggccaataaatatcagatcagcgtgaacaagtatagaggcactgccggcaatgcactgatggacggagcctcccagttgatgggtgagaacaggaccatgaccatacacaacggaatgtttttctctacttacgatcgggacaacgatggttggcttacctcagacccacgtaagcagtgcagcaaagaggacggaggcggttggtggtacaaccgttgtcacgctgctaatcccaacggtagatactactgggggggccaatatacctgggatatggcgaaacatggaacagatgacggggtggtttggatgaattggaaaggttcttggtacagcatgcgcaaaatgagcatgaaaataagaccatttttcccacagcag

SEQ ID NO: 11276 - DNA, 1473 bp, Artificial Sequence
  Description of Artificial Sequence: Synthetic coding sequence
atgaagagaatggtgtcctggagtttccacaaactgaagacaatgaagcacctcctgcttctcctgctctgtgttttcctggtcaaatcccagggtgtcaacgacaacgaggagggcttcttcagtgcccgcggccatcggccactggataaaaaacgggaggaggccccatcactgaggcccgcccctccccctatctcgggggggggctatcgggcacgccctgccaaggcagcagctacacaaaaaaaagtggagagaaaggccccagatgctggtggctgcctgcacgctgacccagacctgggggtcttgtgccccaccgggtgtcagctgcaggaagccctgctgcaacaggagagaccgatccgtaattctgtcgacgagttaaataataatgtcgaagctgttagccagaccagttcgtcatcatttcagtatatgtacctgctcaaggatctgtggcagaaacggcagaagcaggttaaggataacgaaaatgtggtcaacgagtacagctcagaactggaaaaacaccagctgtatatcgatgaaacagtgaatagcaacatcccgaccaatcttagggtgctgcggtccattctggagaacctgaggagtaaaattcagaagctggagagtgacgtttccgcccaaatggaatactgtaggacgccttgcacggtctcttgtaatatccctgtggtgagtggaaaagagtgtgaagagataatccggaaagggggcgagacttccgagatgtatctgatacagcccgactcttcggtgaagccatatagagtgtactgtgacatgaacaccgagaacggcgggtggaccgtgattcagaatcgtcaagacgggtcagtggacttcggcaggaaatgggacccctataagcagggattcgggaatgtcgccaccaacactgatggtaagaattactgcggcttacccggggaatattggctgggcaacgacaaaattagccagctcacccgaatgggaccaactgaattgttgattgagatggaagattggaagggagataaggtgaaagcacactatggcggcttcactgtccagaatgaggcgaataaatatcagatttcagtcaataaatatagaggcaccgccggtaacgccctgatggacggggcctctcagctgatgggggagaatcgcactatgaccatccataacgggatgtttttctcgacatatgaccgagataatgatggttggctcacctctgatccaaggaagcaatgtagcaaagaggacgggggcggctggtggtataatcgctgccatgcagccaatcctaatggccggtactattggggcggacagtacacgtgggatatggccaagcacggaaccgacgacggagtagtgtggatgaattggaaaggtagttggtacagcatgcggaagatgagcatgaaaatcaggcctttcttcccacaacag

SEQ ID NO: 11277 - DNA, 1473 bp, Artificial Sequence
  Description of Artificial Sequence: Synthetic coding sequence
atgaagagaatggtgtcatggtccttccataagttgaaaactatgaagcatctgttgttgctgctgctgtgtgtctttctggtgaaaagccagggggtgaatgataacgaggagggtttcttctccgcaagaggtcatcgacccctcgacaaaaagagggaagaggcgccatcactgcgcccagccccgcctccaatctcagggggaggataccgggcgcgtccggccaaagccgccgccactcagaaaaaggtggaacgcaaggcaccagatgctgggggatgtttgcacgctgaccctgacttgggcgtgctgtgcccaaccggatgccaactgcaggaggcactgctccagcaagaacgaccaatcagaaactcggttgatgagctgaataacaacgtggaggcggtgagccagacctcgagctcctccttccagtacatgtacctgcttaaggatctttggcagaagagacagaagcaagtcaaagacaacgaaaacgtggtgaacgaatactcgtcggagctggaaaagcaccagctctatatcgacgaaactgtcaactcaaacatacctacgaaccttagagtgctccgaagcatactcgagaatctgaggtccaaaatccaaaaactggagtctgacgtgtcggcccagatggaatactgccggactccatgtaccgtgtcatgcaatatcccggtggtgtcggggaaggaatgcgaagagatcattcggaaaggcggggaaacttcggaaatgtacctgatccagccggactcctccgtgaagccgtaccgcgtgtactgcgatatgaacacggagaacggcggatggaccgttatccagaatcggcaagatggctcggtggactttggccgcaagtgggacccgtacaaacagggcttcggcaatgtggccactaacactgatggaaagaactactgcggcctgccaggcgagtactggctcgggaatgataagatttctcaactcactaggatgggcccgacggaattgctcatcgaaatggaagattggaagggagataaagtgaaggcccactatggagggttcaccgtccaaaacgaggcgaacaagtaccaaatcagcgtgaacaagtacaggggtactgcgggaaatgccctgatggacggtgcgagccaactgatgggcgaaaatcgcaccatgaccatccataacggaatgttcttttctacctacgaccgcgataacgacggatggttgacctccgatccgcggaagcagtgctcaaaggaggacggaggtggatggtggtacaatagatgccacgcagcgaacccgaacggacgctactattggggagggcaatacacttgggatatggctaagcacggaaccgacgacggagtggtctggatgaattggaaaggtagctggtactccatgcgcaaaatgtcgatgaagatccgcccgttctttccccagcag

SEQ ID NO: 11278 - DNA, 1473 bp, Artificial Sequence
  Description of Artificial Sequence: Synthetic coding sequence
atgaagagaatggtctcttggagtttccacaaactcaagacaatgaagcacttgctgctcctcctcctctgtgttttccttgtcaagtcacaaggggtcaatgacaatgaggaaggatttttctctgctaggggccatcgacctcttgacaagaaacgcgaggaggcaccatccttgcggcccgccccgccgccaatttcaggcggcggctacagagcacgaccggctaaagcagccgccacccagaaaaaagtcgagagaaaggccccggatgccggcggatgcctgcacgctgatccagatctgggggtgctctgccccaccggatgtcagctgcaggaggctctccttcagcaggaaagacctatccggaattcagtcgatgagttaaacaataacgtggaggcggtgagccaaactagttcttcttcatttcagtatatgtacttgctgaaagacttatggcagaagcgacaaaaacaagtgaaagataacgaaaacgtcgttaacgagtatagtagcgagctggaaaaacatcagctatacattgatgagacggtgaattccaacatccccacaaacctgagagtgctgcggagtatccttgagaacctgcggtccaagatccaaaagctagaaagtgatgtttctgctcagatggaatattgccggaccccttgcaccgtgagctgtaacatcccagttgtctcgggtaaggagtgtgaggagattatcaggaaggggggtgagactagtgaaatgtacctcatccagcctgacagctcagtgaaaccatacagggtgtactgcgacatgaacactgagaacgggggttggaccgtgatccagaaccgacaagatggcagtgtggattttggtagaaaatgggacccctacaagcagggctttggcaatgtggccacgaacaccgacggaaagaattactgtggcctcccaggggaatattggttgggaaacgataaaatctcccagttaactcgcatgggcccaactgagctccttatcgaaatggaagattggaaaggggacaaggtgaaggcacactacggtggctttactgtgcagaatgaggccaataagtaccagatctctgtgaataaatacaggggaaccgccggtaacgccctgatggacggcgcctcccaactgatgggggaaaatcgaacgatgaccattcacaacggaatgttttttagcacatatgacagagataatgatgggtggctgacatccgatccacgtaagcagtgcagcaaggaagatggaggaggctggtggtataaccggtgccacgccgccaatcccaatggcagatactactgggggggtcagtacacgtgggacatggccaaacacggaaccgacgatggtgtcgtgtggatgaattggaaagggagttggtattctatgcgaaagatgtcaatgaaaatccggccatttttcccacagcaa

SEQ ID NO: 11279 - DNA, 1473 bp, Artificial Sequence
  Description of Artificial Sequence: Synthetic coding sequence
atgaaaaggatggtgtcgtggtcttttcacaagctaaagacaatgaagcatctgctcctgctgctgctctgtgtcttcttggtcaagtcccagggggttaacgataatgaggagggttttttcagcgcccgtggacaccggcctctcgacaagaaaagagaggaagcgcccagcctgcgccccgcccccccccccatttctggcggcggctacagagctcggccggctaaggcggcagcgacccagaagaaggtggagcggaaggccccagatgcaggcggttgcctccacgccgaccccgatctgggggtgctttgccctacggggtgtcagctgcaggaagcattgcttcagcaggagaggccaattaggaattctgtcgacgagcttaacaataatgtcgaagccgtctcccagacctccagctcttccttccaatatatgtaccttcttaaagatctttggcagaagcggcagaaacaggttaaagacaatgagaatgtcgttaatgagtattcatcagaactagagaagcatcagttatatattgacgagacggtcaactccaacatccctacaaatctacgggtcctgcggtcaatcctcgaaaatctcaggagcaagattcagaagctggagtctgatgtaagtgcacaaatggaatactgccggaccccgtgtacagtcagttgcaacattcctgttgtcagtgggaaagaatgcgaagagattatccggaaagggggcgaaacctccgagatgtatctgattcaacctgactcatcagtgaaaccttacagggtgtactgcgatatgaataccgaaaacggtgggtggaccgttatccagaatcgacaggatggctcagtagactttgggcgcaagtgggacccatacaagcagggcttcggtaacgtagcgacgaatactgacggtaagaattattgcgggttacccggcgagtactggctcggtaatgacaaaatttcccaactcactcgcatgggtcccaccgagctgcttatcgaaatggaagattggaaaggtgacaaagtaaaagcacattacggcgggtttacggtgcagaatgaagctaacaagtaccagatttcggttaataagtaccgcggcaccgctgggaatgctctcatggacggggcttcccagctcatgggagagaaccggacaatgaccatccataacgggatgttcttctcgacctatgatcgggacaatgatggttggctcacctctgatcctcgcaagcagtgctccaaggaggatgggggaggttggtggtacaaccgctgccacgctgcgaaccccaacggccgctactactggggcggccaatacacttgggacatggcaaagcacggcacagacgatggggtggtatggatgaactggaaggggtcttggtattccatgaggaagatgagcatgaagatccggcccttctttccgcaacag

SEQ ID NO: 11280 - DNA, 1473 bp, Artificial Sequence
  Description of Artificial Sequence: Synthetic coding sequence
atgaaaagaatggtcagttggtcattccacaagctcaagacaatgaaacacctactgttgctcctgctctgtgtttttttggtcaaatctcagggcgtgaacgacaacgaggaaggatttttcagcgcacgtggccatcgcccgctggataagaagcgggaagaggcacccagcctccggcccgcgccaccgccaatcagcggcggcggatatagggcacgtccggcaaaagctgccgccacacagaaaaaggtggaaaggaaagcccccgatgccggcgggtgcttgcacgccgatcctgacctgggagttctttgcccaaccgggtgtcagctgcaggaagccctgttgcagcaggaaagaccaatacgtaactcggttgatgagttgaataataacgtcgaagctgtctcgcagacttccagcagctcttttcaatacatgtaccttctgaaggatttatggcagaagcggcagaagcaggtaaaggataacgagaatgtggttaacgaatactctagcgagcttgaaaagcaccagctttacatcgacgaaacagtgaactcgaacattcccacgaacctgcgggttttgaggtctatcctggagaatttgaggtctaagatacagaaattggagtctgacgtgtccgcccagatggagtactgcagaacaccgtgtaccgtcagctgtaatattccagttgtatcaggcaaagaatgcgaggagatcattcgcaaaggaggggagacgagcgagatgtacctaatccagccagattcctcagtgaagccgtaccgggtatactgtgatatgaacactgagaacggcggttggacagttatccagaaccgacaggacggatccgtggactttggcaggaagtgggacccctacaaacagggtttcggaaatgttgccactaacacggatggcaagaattactgtggcctcccgggggaatactggctgggaaacgacaagatcagccaattaacacgcatggggcctacggagctgctgattgagatggaggactggaaaggcgacaaggtgaaagcccactatggcggattcacggtgcagaacgaggcgaacaagtatcagatttcagttaacaaatacagggggactgccggcaatgctctgatggatggtgcctcacagcttatgggcgaaaaccgaaccatgacgattcataatggcatgttcttctccacatacgatagggacaacgacggctggttgacctctgaccccagaaagcagtgcagcaaagaagatggcggcggctggtggtataatcgttgtcatgctgccaatcccaatggcagatattattggggaggacagtacacctgggacatggccaagcatgggacggatgacggtgtggtgtggatgaattggaaaggcagctggtatagcatgcgtaaaatgtctatgaagatccgacctttcttcccacagcag

SEQ ID NO: 11281 - DNA, 1473 bp, Artificial Sequence
  Description of Artificial Sequence: Synthetic coding sequence
atgaagcggatggtttcctggtctttccataagttaaagactatgaagcaccttctgctgttgctgctgtgtgtgttccttgtgaaatctcagggtgtcaatgataatgaggaagggttcttctctgccaggggtcatagaccactggataagaagcgggaagaggcccctagtctgcgcccggctccaccccccatttctggtggtgggtatagggcccgcccagccaaggctgcggcgacacaaaaaaaagtggaacgcaaggcgcctgacgcaggtgggtgcctacacgcagaccccgatctgggcgtgctgtgtcccacgggatgtcagcttcaggaagcattgcttcaacaggagagacccatacggaactcggttgatgaactgaataataatgttgaagcggtttcccagacatccagctcctcttttcagtacatgtatctcttaaaagatctgtggcagaagaggcagaagcaggttaaagataacgaaaatgtcgtgaatgagtactcttccgagctggaaaagcatcagctctatatcgacgaaaccgtgaattccaatattcccaccaatctgagggtgttgagaagcattctcgagaacttacggagcaaaattcagaaactggagtccgacgtgtcagcccaaatggaatactgtagaaccccttgtaccgtgtcgtgtaatataccagtggtgtctggcaaggaatgtgaggaaatcataagaaagggcggggaaacttctgagatgtacctgatccagcctgactcctctgtgaagccttatagggtgtactgcgatatgaacaccgagaacggcgggtggaccgtcatccagaaccgacaagatggatccgtcgacttcggacggaagtgggatccctacaagcagggctttggaaatgtggccaccaacaccgatggcaagaattattgcggtctacctggtgagtactggctgggcaacgacaagatttctcagctaacacgtatggggcccacagaactactgatcgagatggaggattggaagggggacaaagtgaaggctcactacggcggcttcaccgtacagaacgaggccaacaaataccagatttccgtcaacaaatatcggggaacagcaggaaatgccctgatggacggagctagccagttaatgggagaaaaccgtaccatgactattcacaacggtatgtttttcagcacgtacgaccgggacaatgatggatggctgacctctgaccctcgcaagcaatgctcaaaagaggatggcggtgggtggtggtacaatagatgccacgccgcaaaccccaatggacggtactattggggcggccagtacacctgggatatggctaaacacggtacagatgacggagtggtgtggatgaactggaaagggtcatggtattccatgcgtaagatgtctatgaagatacgacctttctttccacagcag

SEQ ID NO: 11282 - DNA, 1473 bp, Artificial Sequence
  Description of Artificial Sequence: Synthetic coding sequence
atgaagcggatggtttcctggtcatttcataaacttaagacaatgaaacatctcctcctacttctgctctgcgtgtttctagtgaagagccagggggttaacgataacgaggaaggattcttttcagcgcgaggccatcgccccctggataaaaagagagaggaggctccatccctacgaccagctccaccccccatctcagggggcggctacagagctcggcctgcgaaagcggctgctacccagaagaaagtcgaacggaaggccccggacgcaggaggttgccttcatgcagacccggacttgggagtgttatgtccaaccgggtgtcagctgcaagaagccctcctgcaacaggaaagacccatccggaactccgttgacgagctgaacaataacgtcgaagccgtaagtcaaacctcaagcagtagttttcagtatatgtatcttctgaaggatctctggcagaagcgacagaaacaagttaaggacaatgaaaacgtggtgaatgaatattcttcagagcttgaaaagcatcagctgtatatagatgaaaccgtgaattctaatatccctacaaacttacgtgtgctacgcagcattctcgaaaatctcaggtctaagattcaaaagttagagtcagatgtctcagcccagatggaatattgccggaccccgtgtaccgtgagctgtaatatcccggtagtctcaggaaaagagtgcgaagagatcattaggaaaggaggagagacatccgaaatgtacctcatccagcctgacagctctgtcaagccatatcgcgtctactgcgacatgaataccgagaatggaggatggacagtcatccagaatcgccaggatgggtcagtggacttcggtcgcaagtgggacccctataaacagggattcgggaacgttgccaccaacacggacggtaaaaattactgtgggttgccgggtgagtactggctgggcaacgacaagatttcgcagttgacccgtatgggtcccaccgagttgctgatagaaatggaggactggaagggagataaggtgaaggcacattacggaggctttaccgtacagaatgaagcgaataaatatcaaattagtgtcaataagtacagggggaccgcgggaaatgcgctcatggatggcgcgtcccagctaatgggggagaaccgtacgatgaccatccacaacggcatgttcttctccacttacgatcgtgacaacgacggatggttgacgtcagatccacgcaagcagtgttcaaaggaggacggtggtggatggtggtataaccgttgtcacgcagctaatcccaatggacgctactattgggggggtcagtatacgtgggatatggctaaacatggcacagatgatggtgtagtgtggatgaactggaaaggttcctggtactctatgcgtaagatgtcaatgaagattcgcccgttcttcccgcaacag

SEQ ID NO: 11283 - DNA, 1473 bp, Artificial Sequence
  Description of Artificial Sequence: Synthetic coding sequence
atgaaaaggatggtgtcttggtccttccacaaattgaagacaatgaaacacctattgttacttctgctgtgcgtgtttctcgtaaaatctcagggagtgaacgacaatgaagaagggtttttctccgcaaggggacatcggcccctagataaaaaacgagaagaagccccttcgctgcgacccgctccaccccctatttccggaggagggtatagagctaggcccgccaaagctgccgcaacacagaaaaaagtcgagaggaaggcccctgacgctggagggtgtctccacgctgatcctgacctcggagtcctctgccccacaggatgtcagttgcaggaagccctcttacagcaggaacggcccatccggaatagtgtcgacgaactgaacaacaacgtagaagcggtgtctcagacttcttcttccagtttccagtatatgtatttattaaaggatctctggcagaaacggcagaagcaggtgaaagataacgaaaacgttgttaacgaatattcctctgaactggaaaaacatcagctatacatcgatgaaactgtgaattctaacatacccacaaatctccgggtcttacgctctatactggaaaatctaagatctaaaatccagaaacttgaatctgacgtcagtgcacagatggaatattgcaggactccctgcacagtgtcttgtaatatccctgtggtgtcagggaaagaatgcgaagaaataataagaaaaggaggggagacatccgaaatgtatctaatccaacccgactcttctgtaaaaccctatagagtatactgtgatatgaacacagaaaacgggggatggactgtgatccagaatcgccaggatgggtcagtcgattttggaaggaaatgggatccttacaaacagggatttggaaatgttgcaactaatacagatgggaaaaactattgtgggctgccaggagaatattggcttgggaatgataaaatttcacagctaacacgcatgggacccacggaactcttaatcgaaatggaagattggaaaggggataaagtgaaagcccattacggagggtttacagttcagaacgaggctaataaataccagatctcagttaataaatatagggggacagcggggaatgctctgatggatggggcatctcagttaatgggagagaatcggacgatgacaatacataacgggatgtttttctctacatatgatagggataatgacgggtggcttacaagtgaccctcgcaagcagtgttcaaaagaagacggagggggatggtggtacaaccggtgccacgctgctaaccctaacggacggtattattgggggggacagtacacatgggatatggctaaacacggaacagatgatggggtggtgtggatgaactggaaagggtcttggtatagtatgcggaagatgtcaatgaaaattcgaccttttttcccacagcaa

SEQ ID NO: 11284 - DNA, 1473 bp, Artificial Sequence
  Description of Artificial Sequence: Synthetic coding sequence
atgaagcggatggtttcctggtctttccacaagcttaaaacaatgaagcacttgctcttgttgttgctctgcgtgtttctggtcaaatcccagggcgtgaacgataacgaggaggggttcttcagcgcccgggggcaccgacctttggacaagaaacgtgaggaagctccctccttacgccccgctccccctccgatttccggtggtggttaccgtgcgcgcccagccaaggccgctgcaacccagaagaaagtggagaggaaggctcccgacgccggcggctgtcttcacgctgaccccgatctgggcgtcctttgtcccactggctgccaactccaggaggccctgttacaacaggaacggcccatccgcaattcggtggatgagcttaacaacaacgtcgaggcggtttcccagacctcctcctcctcctttcagtacatgtatttgttgaaagatctgtggcagaagaggcagaaacaggtcaaggacaacgagaacgtcgtcaatgagtactcttcggaactggagaagcatcagctctacatcgatgagaccgtgaatagtaatatccctaccaacctgcgcgttctgcgtagtatacttgaaaaccttcgcagcaagatccagaagttggaatccgatgtctctgcccagatggaatattgtcgcacgccctgcaccgtctcctgtaatatccccgttgtgtcgggcaaggagtgcgaggagatcatccgtaaggggggtgagactagcgagatgtaccttatccagccggatagcagcgtcaagccgtaccgcgtctattgtgatatgaacaccgagaatggtggctggaccgtcatccagaaccgtcaggatggctccgtcgacttcgggcgtaaatgggacccctacaagcagggcttcggaaacgtagctactaacacggatggtaagaattattgtggtcttcccggtgagtactggcttggcaacgacaagatctctcagttgacacgaatgggtcccaccgagctgctcattgagatggaggactggaagggcgataaggtgaaagcccattacggcggattcaccgttcagaacgaggccaacaagtaccagattagtgtcaacaagtaccgcggcactgccggcaatgcccttatggacggggccagccagctgatgggcgagaatcgtactatgacaatacataacggcatgtttttcagcacctacgatcgagataatgacggctggctgaccagcgatccccgtaagcagtgctccaaggaagatggtggtggctggtggtacaaccgctgccacgctgctaacccaaacggtcgttattattggggtggtcaatacacgtgggatatggctaagcacggcaccgacgacggcgtcgtctggatgaactggaaaggaagttggtattccatgcgcaagatgtccatgaagattcgccccttcttcccccaacag

SEQ ID NO: 11285 - DNA, 1473 bp, Artificial Sequence
  Description of Artificial Sequence: Synthetic coding sequence
atgaagcgcatggtttcatggtcctttcacaaactcaaaacaatgaagcacttgctgttgctgcttttatgcgtgtttctcgtgaaaagtcagggcgtgaatgacaacgaggaaggatttttctccgcacgtggacaccgcccgttagataagaagcgcgaagaggcgccctcactcaggcctgccccaccacctatttccggaggaggttacagggcccggccagcaaaagccgcggcgactcagaaaaaagtggaacgtaaagcgcctgatgccggcggttgtttgcacgcggacccagatctcggggtcctctgtcccactggttgccagctgcaggaagccttgctgcaacaggagaggccgattcgcaactccgtagacgagctgaataacaacgtcgaggctgttagccagacatcatcgtcaagctttcagtacatgtatctcctcaaggacctctggcagaagcgacagaaacaggtgaaagacaacgagaatgtggtgaacgaatattcatccgaactggagaaacatcagttatacatcgatgaaaccgtgaactccaacatcccaaccaatttgcgcgtgctcagaagcattttggaaaaccttaggtcaaagattcagaaactggaaagtgatgtctcagctcagatggagtattgccggacaccctgtacagtctcttgcaacattcccgttgtcagtggcaaggagtgcgaggaaatcatcaggaaggggggcgagactagtgagatgtacctcatccaacccgactctagtgtgaagccctacagagtgtactgcgatatgaacactgagaatggcgggtggactgttatccagaatcgccaggatggaagcgtggactttggccggaaatgggacccttacaagcaaggtttcggcaacgtggccactaacaccgacggaaaaaactactgtgggctgccaggggagtactggctgggtaacgacaagatctcacagcttactaggatgggtcccactgaactcctgatagagatggaagattggaagggggacaaagttaaggcccactatggaggattcactgtgcagaacgaggccaataagtaccagatctccgtaaataagtatcgcgggaccgctggcaacgctctgatggacggcgcatcccagctgatgggcgagaaccggactatgaccattcataatggcatgttctttagcacgtatgacagagacaatgatgggtggctgaccagtgatccccgcaaacagtgtagcaaggaggacgggggaggctggtggtacaaccggtgccacgcagctaaccctaacgggcgctattattggggtggccagtatacctgggatatggcaaagcacgggactgacgacggcgtggtgtggatgaattggaagggctcttggtacagtatgaggaagatgtccatgaaaatacgcccgtttttcccacagcag

SEQ ID NO: 11286 - DNA, 1473 bp, Artificial Sequence
  Description of Artificial Sequence: Synthetic coding sequence
atgaagagaatggtctcctggagtttccacaaattgaaaactatgaaacatttactactcctgctgctttgtgtattcctggttaagtcccagggagtaaatgataacgaggaagggtttttttcagcacggggccatcggcccctcgataagaagcgcgaagaggctccctccctcaggccagcaccaccccccatcagtggcggaggatacagagctcgcccggcaaaggctgccgccacccagaagaaggtggagcgtaaagccccggacgccggtggttgcctacacgccgatccagatttgggcgtactgtgtcccacagggtgtcaactccaagaagcactgcttcagcaggagagacccattcgtaactctgttgatgagctgaataataacgtcgaagctgtcagccagacctcctcctcctccttccagtatatgtatctattaaaagatctctggcagaaacgccaaaagcaggtaaaagataatgaaaatgttgtgaatgagtatagcagcgagctggaaaaacaccagctatatatagatgagactgttaactcaaatatacctactaatctgagggttcttaggagcatccttgaaaatctccgatcgaaaatccaaaaactggagagcgacgtgtcagcccagatggagtattgccgaactccttgcactgtctcctgtaacataccggtggtttcaggtaaagaatgtgaggagatcatccggaagggcggcgagacatcggagatgtatctgatccagcctgacagtagcgtgaagccttacagagtatactgtgatatgaatactgaaaatgggggctggaccgtcatccagaaccgtcaggacggatccgtcgattttggccgcaaatgggatccatacaaacagggattcggtaatgtcgccaccaacacagacggcaagaattattgcggcctgcccggggagtactggctgggcaacgacaagatttcccagcttacacgaatgggcccaactgaactgttgatcgagatggaggactggaagggggacaaggttaaggcccactatggcggttttacagtccagaacgaggccaacaaatatcaaatttctgtgaataaataccggggaacagctggcaatgcattaatggacggagcatctcagctgatgggcgaaaatcgaactatgacgattcacaacgggatgtttttttccacatatgatagagataatgatggctggctgaccagcgacccgcggaaacagtgctctaaagaagacggcggcggatggtggtataatcgttgccacgccgccaatccaaatggacggtactactggggcggacaatacacctgggatatggccaaacatgggacggacgatggtgtcgtatggatgaactggaagggctcttggtactcaatgcgcaaaatgtccatgaaaattaggccatttttcccacagcag

SEQ ID NO: 11287 - DNA, 1473 bp, Artificial Sequence
  Description of Artificial Sequence: Synthetic coding sequence
atgaagcgaatggtatcttggagtttccataaactgaagacaatgaagcatcttctccttttgttgctctgcgttttcttagtaaaatcccaaggagttaatgataatgaagaaggatttttcagcgcacgtggacacagacctttggataagaagcgcgaggaggcaccaagcttgaggccagccccaccaccaatatctggtggcggatatcgtgcccgtccagcaaaagcggcagctacacagaagaaagttgaaagaaaagcaccagatgctggaggatgtttacatgcggatccagatctcggtgttctctgtccaactggatgccaacttcaagaagctcttcttcaacaggaaaggccgatccgtaattcagtggacgagcttaacaataatgttgaagccgtcagtcaaactagttcaagttcctttcaatatatgtacctcctaaaagatctctggcaaaagcggcaaaaacaagtcaaagataatgaaaatgttgtgaatgaatactcatcagaactcgaaaagcatcaactgtatatcgacgaaacggttaattcaaatataccaactaatctcagagtcttacgttcaattctagaaaacttaagatctaagatacaaaaacttgagtccgacgttagtgctcaaatggagtattgtcgcaccccatgcacggtctcctgcaacatcccagtcgtctcaggtaaagagtgtgaggaaattatccgcaaaggaggagagacttccgaaatgtatctcattcaacctgattcctcggtaaaaccatatagagtctattgtgatatgaacactgaaaatggagggtggactgtcattcagaatcgtcaagatggatcggtagattttggacgaaagtgggatccttataaacaaggattcggaaacgtcgccactaacactgatggcaaaaattactgcggactgcccggggagtattggctcggtaatgataaaatctctcagcttacccgtatgggaccaaccgaactattaatcgaaatggaggattggaaaggtgataaagtaaaagcgcattatggtggttttacagtccaaaatgaggctaataaatatcaaatttcagtaaataagtatcgagggaccgcaggtaatgcacttatggatggagcctcgcagttgatgggagaaaatagaaccatgacaattcacaatggaatgttcttttcgacttacgatcgcgacaatgacgggtggctgacttctgatccacgaaaacaatgtagtaaagaggatggcggaggatggtggtataaccgatgccacgctgcgaacccaaatggaagatactactggggaggacagtatacctgggatatggctaagcatggtacggatgacggagttgtctggatgaattggaaaggatcgtggtattcgatgcgtaaaatgtctatgaaaatcaggccgttctttccacaacaa

SEQ ID NO: 11288 - DNA, 1473 bp, Artificial Sequence
  Description of Artificial Sequence: Synthetic coding sequence
atgaagcggatggtgtcctggagcttccacaagctgaagactatgaagcacctgcttctgctcctgctgtgcgtattcctggtcaaaagtcaaggagtgaacgacaatgaagaggggttttttagcgcacggggacataggcccttggacaagaagagagaggaggctccttccctgaggccagcaccccctccaatctctggtggaggttacagggctaggccagcgaaagcggctgctactcaaaagaaggttgaaaggaaggccccggacgcagggggatgtctgcatgccgatcccgatctgggtgtgctgtgccctactggatgtcagttgcaggaggctctccttcagcaagagcggcccattagaaatagtgtggatgagctcaacaataatgttgaagccgtgtcccaaacctcctcttcctcattccagtatatgtacctcctgaaggatctctggcagaaaaggcagaaacaggttaaggataatgagaatgtggttaacgagtattctagcgaactcgagaagcaccagttgtacattgacgaaaccgttaatagtaacatcccaacaaatctgcgagttctgcgatcaatcctggaaaatctccgatctaaaatccagaaattggagagcgatgtgtcagcacagatggagtactgccggacaccatgtacagtgtcttgcaacatcccggtggtgagcggaaaggagtgcgaggagatcattagaaagggtggagagaccagcgagatgtacctgatacagcctgatagctctgtgaagccttatagagtgtactgcgacatgaacactgagaacggcggatggacagtcattcagaatagacaagatggtagcgtagactttggcagaaagtgggacccctacaagcaggggttcggtaatgttgccacaaatactgatggaaagaattattgtggtctgcccggggagtattggctgggtaacgacaagatatcccagctgacgcggatgggacccactgaactcctgattgagatggaagactggaaaggtgataaggtgaaggctcactatgggggcttcaccgtacagaatgaggctaataaatatcagatatctgtgaacaagtacaggggaactgcagggaacgccctgatggatggcgcatcacaactgatgggcgaaaataggactatgactattcacaacggcatgttctttagcacatacgatagagacaatgatggatggctgacgtctgatccccgcaagcagtgcagtaaggaagacggcggaggatggtggtacaaccgctgtcacgccgctaacccaaatggccggtactattgggggggccagtacacctgggatatggcgaaacatgggaccgacgatggggtcgtttggatgaactggaagggaagctggtatagcatgagaaagatgagtatgaagatcaggccctttttcccacaacag

SEQ ID NO: 11289 - DNA, 1473 bp, Artificial Sequence
  Description of Artificial Sequence: Synthetic coding sequence
atgaagcgcatggtttcctggtcttttcacaagctaaagacaatgaagcaccttctgttactgttgctttgtgtttttctcgtcaagtcacagggagttaatgacaatgaggagggtttttttagtgctaggggacaccgccccctggataaaaagcgggaagaagcacctagtctaaggccagcccctcctccaatatccgggggcgggtatagggctagacccgccaaggccgctgcgacccagaagaaggtagaaagaaaggccccggacgctggcggctgtttacatgccgatcctgacttgggagttctctgccccaccgggtgtcagcttcaggaagccctactgcaacaagaacggcctatccgaaattctgttgacgagctcaacaataacgttgaggcagtgagccaaaccagctccagctccttccagtacatgtaccttctgaaagatctctggcagaagcggcaaaaacaagttaaagataacgagaacgtggtgaacgagtattcatccgagttagaaaagcatcagttatatattgatgagaccgtcaattctaacattccaacaaatttgagggtcttacgctccatccttgagaacctccggagtaagattcagaaactagaatctgatgtgtcagcccagatggagtactgtcgcaccccttgcacagtgtcttgcaacatcccggtggtgagcgggaaggagtgtgaagagatcattaggaagggcggagagaccagcgaaatgtatctgatccagccggactcttccgtaaagccatatcgagtgtattgtgatatgaacaccgaaaacggcggatggactgtaatccagaataggcaagacggcagcgtagactttgggcgcaaatgggacccttataaacagggatttggtaacgtagctaccaatactgacggcaaaaattactgcggactaccgggggaatattggttaggaaacgacaagatctcccagcttactcgaatggggccgaccgaacttttaatcgaaatggaggattggaagggggataaagtgaaggcacattacgggggatttacagtgcagaacgaggctaataagtaccagatttccgtgaacaaatatagaggcacagcaggcaatgccttaatggacggcgcctcccagttgatgggcgaaaacaggacaatgacgatccacaatggcatgtttttttcaacttacgacagggacaacgatggatggctgaccagtgatcccagaaaacagtgttccaaagaggacggcggaggatggtggtacaaccgatgccacgccgccaacccaaacggaagatattattggggcgggcagtatacgtgggatatggccaagcacggaacagatgacggcgtggtgtggatgaattggaagggatcctggtattcgatgcgaaaaatgagcatgaagattaggccattcttccctcaacag

SEQ ID NO: 11290 - DNA, 1473 bp, Artificial Sequence
  Description of Artificial Sequence: Synthetic coding sequence
atgaagcggatggtgtcctggtcgttccacaaactcaagactatgaaacacctcctgctattgctgctatgtgtattcttagtgaaatctcagggagtaaatgataacgaggaagggtttttctcagcacgggggcaccgacccctagacaaaaagagagaagaagctccctcgcttcgccccgcaccaccgcctatctccggagggggatatcgagccagacctgccaaagcggctgccactcagaaaaaagtcgaaagaaaagcccctgacgccggggggtgtcttcacgccgatccagatctcggagtcttatgtcctacagggtgtcagttacaggaagcacttcttcaacaggaaagaccgattaggaattctgtcgacgagctgaataacaatgtggaagctgtctctcaaacatcatcctcgtcattccagtatatgtatctcctaaaagacctctggcagaaacgacagaaacaggtaaaagataatgagaatgtcgtcaatgaatattcttctgaactagaaaagcatcagctttatatcgatgaaactgtaaacagtaatatccctactaacttgagagtattgcggtcaatactggagaatctccggtccaaaatccagaaacttgaatccgatgtgtctgcccagatggagtactgtaggactccttgcacagtgtcctgcaacatccccgtggtctccggaaaagaatgtgaagagataatcagaaagggaggagaaactagtgagatgtatcttatccagccagatagttcagtgaaaccatatagggtgtattgcgatatgaatacagagaacggagggtggactgtgatccaaaaccggcaagatggatctgttgactttggaaggaaatgggatccatacaaacaagggtttggaaacgttgccactaatacagatggaaaaaattactgtgggcttcctggggaatactggctgggaaacgacaagattagtcagctaacacggatggggcctactgaactgctgatcgaaatggaggattggaaaggggataaagtgaaggctcactatggggggtttacagtacagaatgaagctaataagtatcagatttccgttaataagtacagagggacagctgggaacgctctaatggatggggcttcccagctcatgggagaaaaccggactatgacaatacacaacggaatgttcttctcaacttatgatagggataatgatggatggctaacttctgatccccgaaaacaatgttcaaaagaagatgggggaggatggtggtataaccggtgtcacgcggccaaccctaacggaagatactactggggagggcaatacacgtgggacatggccaagcacggaacagatgatggagttgtatggatgaactggaaaggatcctggtattctatgcgcaaaatgtccatgaaaataagacccttttttcctcagcag

SEQ ID NO: 11291 - DNA, 1473 bp, Artificial Sequence
  Description of Artificial Sequence: Synthetic coding sequence
atgaaaagaatggtaagttggagttttcataaattaaaaacaatgaaacatcttcttttattacttttatgtgtttttttagtaaagtctcaaggagttaatgacaacgaagaaggatttttttcagcaagaggtcatagaccattagataaaaaaagagaagaagctcctagtttaagaccagcaccaccaccaatttctggtggaggttatcgtgcaaggcctgctaaagcagctgcaactcaaaaaaaagtagaaagaaaggcaccagatgctggaggatgtttgcatgcagatccagatttgggtgttctttgtccaactggatgtcaattacaagaagctttattgcaacaagaaagaccaattagaaatagtgttgatgaacttaataacaatgtagaagctgtttcacaaacttcatcttcaagttttcaatatatgtatttattaaaagatctttggcaaaaaagacaaaaacaagttaaagataatgaaaatgtagttaatgaatattcaagtgaattggaaaaacatcaactttatattgacgaaactgtgaattctaatattccaactaaccttagagttcttagatcaattcttgagaacttaagatcaaagattcaaaaattagaatcagacgtttctgctcaaatggaatattgtagaactccatgtacagtttcatgtaacattccagttgtttctggaaaagaatgtgaagaaattattagaaagggaggagagacaagtgaaatgtatttaattcaaccagactcttctgttaaaccatacagagtttattgtgatatgaatactgaaaacggtggatggactgttatacaaaatagacaagatggttcagttgattttggaagaaaatgggatccatataaacaaggatttggaaatgttgctactaatactgatggtaaaaactattgtgggttaccaggagaatattggttaggaaatgataagattagtcaattaacaagaatgggaccaacagaattattaatagaaatggaagattggaaaggggataaagttaaagcacattatggtggatttacagtacaaaatgaagcaaataaatatcaaatttcagttaataaatatagaggaacagctggaaatgcattaatggatggagcatcacaacttatgggagaaaatagaacaatgactattcataatggtatgttcttttctacttatgatagagataatgatggttggttgacttctgatccaagaaagcaatgtagtaaagaagatggaggtggatggtggtataataggtgtcacgccgcaaatccaaacggaagatattattggggaggtcagtatacttgggacatggcaaaacatggaactgatgatggagttgtatggatgaattggaaaggaagttggtatagtatgcgtaaaatgagtatgaaaatacgtccattttttccacaacaa

SEQ ID NO: 11292 - DNA, 1473 bp, Artificial Sequence
  Description of Artificial Sequence: Synthetic coding sequence
atgaagagaatggtttcgtggagttttcataagctgaagaccatgaaacaccttttattgttacttctatgtgtctttttagttaagagtcagggcgtgaatgacaacgaagaaggctttttttcagcaaggggtcacaggcccctggacaaaaagcgggaagaagctccatcgctgcgccccgctccgcctccaatcagcgggggtggatacagagctaggccagctaaagccgcagccacacagaagaaggtagagagaaaggcacctgatgcaggagggtgtttgcacgccgatccagacctcggtgtgctttgtcccacaggctgccagctgcaagaggccctacttcagcaggaacgcccaatcagaaacagtgttgatgaattgaacaacaatgttgaggcagtttcccaaacctcctcatcatcctttcagtacatgtatctcctcaaggatctgtggcagaagaggcagaaacaagttaaggataacgagaatgtggttaacgagtattcctccgagctggaaaagcaccagttgtacattgatgaaacagtgaacagcaatatcccaacaaacttgcgggtgctccgatctatcctggagaacctaaggtctaaaatccagaaactggaaagcgacgtgtcagctcagatggagtactgccgtaccccgtgtacagtctcctgtaatataccagtagtgagcggcaaggaatgtgaagaaatcatcaggaaggggggagaaacctcagaaatgtatctgatccagccagacagctcagtgaagccatatcgggtttattgcgatatgaacactgagaacggcggctggaccgtgatccagaatcgccaggatgggtctgtagattttggtcggaaatgggacccgtataaacagggattcggaaacgtggccaccaacaccgatgggaaaaactattgtgggttacctggggagtattggctcggcaacgacaagatctcccagctgacccggatgggtcccacagaacttctgatcgaaatggaagattggaagggcgataaggtgaaggcccattacggaggcttcaccgtgcagaacgaggctaacaagtaccaaatttctgtcaataaataccggggaactgctgggaacgccttgatggacggagcctcccagttaatgggagaaaatagaacaatgacaatacataatggcatgttttttagcacatacgacagagacaatgacgggtggcttacctccgatcccaggaaacagtgcagtaaggaagatggaggcggctggtggtacaaccggtgccatgctgctaaccctaacgggcgttattattgggggggccagtacacttgggatatggcgaagcacgggaccgatgacggcgtggtctggatgaactggaagggatcttggtacagcatgcggaagatgagtatgaaaattcgtcctttctttccacaacaa

SEQ ID NO: 11293 - DNA, 1473 bp, Artificial Sequence
  Description of Artificial Sequence: Synthetic coding sequence
atgaaacgaatggtctcttggagcttccataagcttaagacaatgaaacacttgctgcttctgttactgtgcgtgttcttggtgaagagtcaaggggtgaatgataacgaggagggattttttagcgcgcggggccaccgcccgttggataagaagcgcgaagaggctccatcgctgcgcccggccccaccaccgatcagcggcggaggttatcgtgcgcgtccggctaaggccgcagccacccaaaagaaggttgagaggaaggcgcccgacgcgggcggatgcctgcacgcagatccagacctcggggtattgtgtcctacaggctgtcagctgcaggaagccctgctgcagcaggaacgtccgattcggaactctgtggatgaacttaacaataacgtggaggccgtgtctcagacgtccagcagcagcttccagtatatgtatctcctgaaggatctttggcagaaacggcagaagcaagtgaaagataatgagaacgtggtaaatgaatactccagtgaattagagaaacaccagctctatattgatgaaaccgtgaattcgaacatacctacgaacctacgtgtgctacgcagcatactagagaatctgcgaagcaagatacagaagttggagtcggacgtgtctgcccagatggaatattgccgtaccccatgcaccgtgtcctgcaatatccccgtggtcagcggaaaggagtgcgaggagataatccgaaaaggcggagagacctccgagatgtatctgattcagccagattcgagcgtgaagccttaccgcgtgtattgtgatatgaataccgagaatggaggctggaccgtgatacagaatcgtcaagatggatcagtcgatttcggtcgcaagtgggatccctacaagcaaggcttcggtaatgtggccacgaacacagacggcaagaactattgcggtctacccggagaatactggctcggaaacgataagatctcgcagctgacccgaatgggcccaacagagctgctgattgagatggaagactggaaaggtgacaaggtgaaagcccactatggaggttttactgtgcagaatgaggcgaacaagtaccagatatctgttaacaagtaccgcggaacagccggcaatgcacttatggatggagcgtcccagttgatgggcgagaaccgcaccatgaccatccacaacggtatgtttttctcgacctacgaccgagacaatgacggatggctgacaagcgatccgcgcaaacaatgctccaaggaggacggtggcggctggtggtataaccgatgtcatgctgccaatcccaacggacggtactactggggtgggcaatacacctgggacatggccaaacatggcaccgatgacggcgtcgtatggatgaactggaagggttcttggtactcgatgagaaagatgagcatgaagattcggcccttttttccccagcaa

SEQ ID NO: 11294 - DNA, 1473 bp, Artificial Sequence
  Description of Artificial Sequence: Synthetic coding sequence
atgaaacgtatggtctcttggtcttttcataagctcaagacaatgaaacacctcctgcttctcctgttgtgcgtctttctggttaaaagccagggagtgaacgacaacgaggagggatttttctcagcccgggggcatcgcccactggacaagaaacgagaggaggccccctctctgaggcccgcccctcctccaatctcgggtggtggctatagggcccgtcccgcaaaggccgctgctacccagaagaaagtggagcggaaggcacctgacgcaggcggatgtcttcacgccgatccagatctgggggttctctgccccacagggtgccaactccaagaggcattgctccagcaagaacggccaattcggaacagcgtcgatgagctgaacaacaatgtcgaagcagtgagtcagactagctcttcttccttccagtacatgtatctgcttaaagatttgtggcaaaaaaggcagaagcaggtaaaggataacgagaacgtggtgaatgaatattcaagcgaattggaaaagcaccagctctatattgacgaaacagtgaactcaaacatacccaccaatcttcgcgtcctgcggtccattctggagaatcttcggtctaagattcagaagcttgaatccgacgtgtctgcacagatggagtactgccgcacaccgtgcactgtgtcgtgtaatattccagtcgtctcgggtaaggagtgcgaggaaatcattagaaaaggaggtgagacaagcgagatgtacctcattcagcctgattccagcgtcaaaccttacagagtgtattgtgatatgaataccgaaaacggaggttggaccgttatccagaatcgccaggacggttctgtcgacttcggtaggaagtgggatccttacaagcagggctttgggaatgtggctaccaatacagacggtaagaactattgcggccttcccggagagtactggctcgggaatgacaagatctcccagctgacccggatgggcccaacagagctgcttatcgaaatggaggactggaagggggataaagtcaaagcgcattacggggggttcactgtccaaaacgaagctaacaagtaccagatttccgtcaacaagtaccggggcactgcaggaaatgcactgatggatggcgctagtcaactgatgggggagaacaggacaatgaccatacacaacggaatgtttttctccacatacgaccgcgacaacgacggttggctaacaagcgatccgcggaagcagtgtagcaaggaagacgggggaggatggtggtataatcggtgccatgccgctaaccctaatggccgttactactggggggggcaatacacctgggatatggcgaagcacggcactgatgatggggttgtgtggatgaattggaaaggcagctggtattctatgcggaaaatgtccatgaagatccgcccattttttccacagcag

SEQ ID NO: 11295 - DNA, 1473 bp, Artificial Sequence
  Description of Artificial Sequence: Synthetic coding sequence
atgaagcgaatggtctcctggagttttcataagcttaagaccatgaagcatcttttgttactgctgttatgcgtgtttctggttaagagccagggcgtgaacgacaacgaagagggctttttctccgcccgaggacatcgccctttagataagaagcgggaagaggcaccttccctgcggcctgcacccccccctatctcggggggggggtaccgcgcccgccccgctaaggctgctgccacccagaagaaggttgagagaaaggcgccggatgccggcgggtgcctccatgccgatccagatcttggggttctgtgtcctacaggatgtcagctgcaggaagctcttctgcaacaagaacgtcctattagaaactcagtggacgaactgaacaataatgtcgaggccgtttcccagacatcctcttcgagtttccagtacatgtatcttctcaaggatctgtggcagaaaagacagaagcaggtgaaggataacgaaaacgtggttaacgaatattcaagcgaattagagaagcaccagctgtacatagacgaaacggtgaattccaatatcccaaccaatctacgggtacttaggagtatcttggagaatctgcgcagcaagatccagaaactcgaatccgacgtttcggcccagatggagtactgtcggacaccatgtactgtttcttgtaacatcccagtcgtttctggaaaagagtgcgaggaaatcatcaggaagggcggtgaaacctcagagatgtatctgattcagcccgattcctctgtgaagccttacagggtgtactgtgatatgaatactgagaacggcggatggactgtaatccagaacaggcaggatggctctgtcgacttcggacgcaagtgggacccttataagcagggattcggtaacgtggcgaccaacaccgatgggaagaattactgtggcctccccggcgagtactggttaggtaacgacaagatatcacagttgacaagaatggggccaaccgagctattgatagaaatggaggattggaagggggacaaggtgaaggcccattacggcggtttcacagtccagaatgaggcaaataagtatcagatttcggtgaacaagtacaggggcacagctggaaacgcactaatggacggtgcttctcagctgatgggcgagaacagaaccatgacgatccacaatggtatgtttttttcgacgtacgacagggataacgatgggtggctcacttccgacccaaggaaacagtgttccaaagaagatggcggcggatggtggtataatcgctgccacgcggcaaaccccaacgggcggtactactggggcgggcaatatacctgggatatggccaagcacgggaccgatgacggcgtggtttggatgaactggaaaggttcttggtacagcatgaggaagatgagtatgaagatccgcccgttcttcccccagcag

SEQ ID NO: 11296 - DNA, 1473 bp, Artificial Sequence
  Description of Artificial Sequence: Synthetic coding sequence
atgaaacggatggtgtcttggtcctttcataaattgaagaccatgaagcatctgcttctcctgttgctctgcgttttcctggtgaaatcccagggtgttaacgataacgaggagggtttcttctctgcccgcggccatcgcccactagataagaaacgcgaagaagcgccgtcgctgagacctgcacctccacctatctcaggaggtggttacagggcacgtcctgcgaaggctgcagcgacccagaaaaaagttgaacggaaggctccggacgccggtggctgtctgcatgccgatccagatcttggagttctgtgtcctactgggtgtcaactgcaagaggcgctgctgcaacaggagcgccctatccgaaatagtgtcgacgagctgaataacaatgtggaggcggtgagccagaccagctcctccagcttccaatatatgtaccttctgaaagacctgtggcagaaaagacaaaagcaggttaaggacaacgaaaatgttgtgaacgagtattcgagcgaactggagaaacatcagctgtacatcgacgagacggtgaacagcaacatcccgacaaacctccgcgttctgcgtagcatactcgaaaacctgcgcagcaaaatccaaaagctggagtcagacgtgtccgcccagatggaatattgccgcactccttgtacggtgagctgtaacattcctgtcgtcagcggcaaggagtgtgaggagataattagaaaaggtggcgaaactagcgagatgtacttaatccagccagacagcagcgttaaaccgtaccgcgtgtattgcgacatgaataccgagaacggtggctggacagtgattcaaaaccggcaggatggcagcgttgactttggtcgcaaatgggacccttacaagcaaggctttggcaatgtcgccaccaacactgatggtaaaaattattgtgggctgccgggtgagtattggcttggtaatgataagatcagccagctcacccgcatgggccctacggagctgctgatcgaaatggaagactggaaaggcgacaaggtcaaagctcactatggtggttttaccgtgcaaaatgaggcgaacaaataccagatttcagtgaacaagtatcgcggcactgctggtaacgccctgatggacggcgcgtcccaactcatgggtgagaaccgcactatgaccatccataatggaatgttcttcagcacctacgaccgcgacaatgatggttggctgactagcgaccctcgcaagcagtgcagcaaggaggatggtggcggttggtggtataaccgctgtcacgctgcgaacccaaacggccgctactactgggggggtcaatacacatgggacatggcgaaacatggcacggacgatggcgttgtttggatgaattggaaaggttcttggtacagcatgcgcaagatgagcatgaagattcgcccgttcttcccacagcag

SEQ ID NO: 11297 - DNA, 1473 bp, Artificial Sequence
  Description of Artificial Sequence: Synthetic coding sequence
atgaaacgaatggttagttggtccttccataagcttaaaactatgaaacatctgctgttactcctcttgtgcgtgtttctggtgaagtctcaaggcgtcaacgacaatgaggaaggcttcttctccgcccgaggccatagaccgctagacaaaaaaagagaagaggccccctcacttcgacctgctccaccacccatctcaggcgggggatatcgagcgcgacctgccaaggccgctgccacacaaaagaaagttgaacgaaaggcgcccgatgctgggggctgcctgcatgctgacccagacctcggagtactctgccccaccggatgtcaactgcaagaagccttactgcaacaggaacggcccataagaaacagcgtggatgaactgaataataacgtggaggctgtgagtcaaacctcctctagctcgttccagtacatgtaccttttaaaggatttgtggcagaagcgtcagaagcaagtgaaggacaacgaaaacgtggttaacgagtattctagcgaactcgagaagcaccagctgtacatcgacgaaaccgttaacagcaacatacccaccaatcttcgagttctccgatccattctggagaacttgagaagtaaaatccaaaagctcgaatctgacgtgagcgcacaaatggaatattgcagaacgccgtgcacagtgtcctgcaatatcccagtggtctccggaaaagagtgcgaggaaatcattaggaaaggaggggaaacgtcagaaatgtacctgattcagccagactcgagcgtcaaaccttaccgagtgtactgtgacatgaacactgaaaatggagggtggacagtaattcaaaaccgacaggatgggtcagtcgatttcgggaggaaatgggacccttacaaacaggggtttgggaatgtcgcgaccaatacagacggaaaaaattactgtggtctgcctggcgaatactggttgggcaacgataaaatatcacagcttacccgtatggggcctaccgaactactgatcgaaatggaggattggaagggggacaaagtgaaagcacattacggtgggttcaccgtgcagaacgaggcgaataagtatcaaatctcagtaaacaagtacaggggcactgccggcaatgccctgatggatggagccagtcaattgatgggggaaaaccgaacaatgacaatccacaacggtatgttcttttctacctatgatcgcgacaatgatggatggctcacatcagacccacgaaaacagtgctctaaggaggacggcggagggtggtggtataatcgatgccacgcagcaaaccctaacgggcgctactactgggggggccagtatacttgggatatggccaagcatggcacggacgacggcgtggtttggatgaactggaaaggtagttggtattctatgcgaaaaatgagcatgaagattcgaccttttttccctcagcaa

SEQ ID NO: 11298 - DNA, 1473 bp, Artificial Sequence
  Description of Artificial Sequence: Synthetic coding sequence
atgaagcggatggtgtcttggagttttcataagcttaagacaatgaaacatctactgcttctgctgttgtgtgtgtttcttgtgaagtctcaaggtgtgaatgacaatgaggaagggttcttctctgcacgcggccaccggccactcgataagaaaagggaggaagctccgtctctgaggccagcccccccccctatcagcggtgggggctatcgcgcgcgtcccgcaaaagctgcagcgacgcagaaaaaggtcgagaggaaggcacctgacgcaggaggctgcctacatgctgacccagatttgggcgtgctctgtccaacgggttgccagctccaggaggccctcttgcagcaagagcgcccaatcagaaactcagtagacgagctgaacaataacgttgaagccgtgagtcagacctcttcttccagctttcagtacatgtacctgctaaaggacttgtggcagaagcggcagaaacaggtgaaagacaacgaaaatgtggttaacgagtattcttccgagctagagaaacaccaactctacattgacgaaaccgtgaatagtaacattccaactaacctgcgcgtgctgaggagcatcctggagaatttgagaagcaagattcagaagctagagagcgacgttagcgcccagatggagtactgcagaacaccttgcaccgttagctgcaatattccggttgtttctgggaaagagtgtgaggaaattattcgcaagggcggggaaaccagcgagatgtacctgattcagccagactcttccgtcaagccctaccgggtgtattgtgatatgaacaccgagaacggcgggtggaccgtgatacagaacagacaagacggaagcgtagattttggtcgcaaatgggacccctataagcagggctttgggaatgtggccactaataccgatggaaaaaattattgtgggttaccgggggagtactggctgggtaatgataaaatttctcagctgacccgcatgggaccaactgagctgctgattgagatggaagactggaagggtgataaggtgaaagcacattatggggggtttactgttcaaaacgaggccaacaaataccaaataagcgtgaacaaatacagggggacagcgggaaacgcgctgatggatggggcctcacaacttatgggagagaatcggacaatgaccatccacaacggtatgttttttagcacttatgatcgagataatgacgggtggctgacaagcgacccacgtaaacagtgttccaaagaggatggaggcggatggtggtacaataggtgtcatgccgcaaatccaaatggaagatattattggggcgggcagtacacctgggacatggcaaaacacggcacggacgacggcgtggtctggatgaactggaagggctcctggtattctatgcgaaagatgtccatgaaaatcaggccctttttcccgcagcaa

SEQ ID NO: 11299 - DNA, 1473 bp, Artificial Sequence
  Description of Artificial Sequence: Synthetic coding sequence
atgaagagaatggttagttggagcttccataagctcaagacaatgaaacatctcctgttactgctcctgtgtgttttcctggtgaaatctcagggcgtgaacgacaacgaagaggggttctttagcgcccgggggcaccgacccctcgataagaaaagggaggaagctcctagcctgaggcccgcccccccacccattagcggcggcggatacagagctcggcccgccaaagccgccgcgacacagaagaaggtagaacggaaagccccagatgccggaggttgtctacatgctgacccagaccttggagtgctatgtcctactggctgccagctccaggaagctctcctccagcaggagcgtcccattcgaaactcagtggatgagctgaataataacgtcgaggcggtgagccagacctcaagctcctcattccagtacatgtacctgctgaaggacctatggcagaaacgtcagaaacaagtcaaggataacgagaacgtcgtaaatgagtactcgtctgagttagagaagcaccagctgtatattgacgagaccgtgaattccaacataccaactaatttgcgagtgttgcgctcaattctggagaatctgcgctctaagatccagaagcttgagtctgatgtctctgcccagatggaatactgccgaactccttgcaccgtctcgtgcaacatcccggttgtgtccgggaaagagtgtgaagagattatcaggaaaggtggagaaaccagcgaaatgtacctgatacaaccggattccagcgtcaaaccctatagggtgtactgcgacatgaacacagagaacggagggtggaccgttattcagaatagacaggatggctccgtcgattttggcagaaaatgggacccctacaagcaaggttttggcaacgtggctaccaatacagacggcaaaaactactgcgggctgcctggcgagtattggttggggaatgataagatctcccaacttacaagaatgggcccaactgagcttcttatcgagatggaggactggaaaggtgataaagtgaaggcccattacggtggattcactgttcaaaacgaggctaacaaataccagattagcgtcaacaagtatcgcggtacggccggaaacgctctgatggacggcgcaagtcaacttatgggagaaaaccggacgatgaccattcataacggaatgttcttcagtacctacgatcgtgacaacgacggttggctgacgagcgacccacggaaacaatgttcaaaagaggacggcggcggctggtggtataatcggtgccacgccgccaatcccaacggccggtattactggggaggacagtatacctgggacatggctaagcacggcaccgacgacggggttgtctggatgaattggaagggctcttggtactcaatgcgcaaaatgagcatgaagatccgtccatttttcccccagcag

SEQ ID NO: 11300 - DNA, 1473 bp, Artificial Sequence
  Description of Artificial Sequence: Synthetic coding sequence
atgaagcgtatggtcagctggtcttttcacaagttaaagacgatgaagcatctgttgttactcctactttgcgtgttccttgtgaaaagccagggtgttaatgataatgaagaaggtttcttctccgcccgcggtcaccggccgctggataaaaaaagagaagaagctccatctctaaggcccgcaccccctcccatctctggaggtggctatagagcccggccggcaaaggctgccgcgactcagaagaaggtggagagaaaagcccctgacgcaggtggctgcctgcacgctgacccagacttaggcgtcctctgtccaacaggatgccagctgcaggaggccctcctgcaacaggaacggcccattagaaattctgttgatgaactgaacaacaacgtggaagccgtgtctcagacttcgagctcctctttccaatacatgtacttattaaaagacctgtggcaaaaacgccagaagcaggtgaaggacaacgaaaacgtggtcaatgagtattcgtctgagctggagaaacaccagctgtacatcgatgagactgtcaacagcaacataccaacaaacttgcgggtattgcgaagtatcctggaaaacctgagatcaaagatacaaaaactggagtcggacgtaagcgcacagatggagtactgtaggacaccctgtactgtgagttgcaatatcccagtggtgtcaggtaaggagtgtgaggagattatccgaaaaggtggtgagacatcagagatgtacctcatacagccagatagttcagtgaaaccttatagggtatactgcgatatgaacactgaaaatgggggctggacagtcatccagaatcggcaagacgggagcgtcgatttcggcaggaagtgggacccatataaacagggttttggtaacgtcgccaccaatactgacggaaagaattattgcggtctgcccggcgagtattggttgggaaacgacaagatcagtcagctgacaagaatggggccgactgagctgttgattgaaatggaagactggaagggagacaaagtaaaggcccattacggaggctttaccgtccaaaatgaggctaacaaatatcagatcagcgttaataagtatcgaggcacggcggggaatgcgctgatggatggcgccagccagttgatgggcgagaaccggacaatgacgatacacaacggcatgttttttagtacatacgaccgcgacaacgatggatggctgacgtcagaccccagaaaacagtgtagtaaagaggacggaggggggtggtggtataacagatgccacgccgcaaacccgaatgggcgatattactggggtggacaatatacctgggacatggccaaacacgggacagatgatggtgtcgtgtggatgaactggaaagggtcatggtactctatgaggaagatgtctatgaagatcagaccatttttcccccaacag

SEQ ID NO: 11301 - DNA, 1473 bp, Artificial Sequence
  Description of Artificial Sequence: Synthetic coding sequence
atgaaacggatggtaagttggagcttccataaactgaagactatgaagcatctgctgttgctgttactgtgcgttttcctcgtaaagtcccagggggtgaacgataacgaagagggtttttttagtgcaaggggtcatcggcctctggacaaaaaacgggaagaagctccctctttacgtcctgcacctccacccataagcgggggaggttaccgggcgaggcccgccaaagcggccgcaactcagaagaaagtcgaaagaaaggcgcctgacgccggcggctgtttacatgcggaccccgatctaggtgtactgtgtcccacaggatgccagctgcaggaagctctcttgcagcaggagaggccaatacgaaactccgtggacgagttgaataacaatgtggaggctgtgtcacagacttcaagttccagctttcagtacatgtatctgctgaaagacctctggcagaagcgccagaaacaggtaaaggacaacgagaacgtggtgaatgagtacagcagcgaactggaaaagcaccagctgtatatcgacgagaccgtgaattccaacatccctacaaatctgcgggttctgcgctctatccttgagaatctcaggagcaagatccagaaactggagagtgacgtatcagcgcaaatggaatactgcagaacgccctgtactgtcagctgtaatattcccgtagttagcggcaaagagtgcgaggaaatcatcaggaaggggggcgagacatcggagatgtacctcattcaaccggattcaagcgtgaagccctaccgcgtatattgcgacatgaacactgaaaatggaggatggacagtgatccagaacagacaggacggcagtgtagacttcggacgcaagtgggatccatataaacagggattcgggaatgtggccaccaataccgacggcaagaattattgcggcctccccggtgaatactggctgggaaacgataagatctctcagctgacccgcatgggacccaccgaattgctgattgagatggaggattggaaaggggataaagttaaagcacattacggaggcttcacagtccagaatgaagcaaataaataccaaatctccgtgaataaatatcgcggaaccgccggcaatgcgcttatggatggcgcgtcccagctgatgggcgagaatcgtaccatgacaatccataacggcatgtttttttcaacatacgaccgggacaacgatggctggcttacctcagacccccgcaagcagtgctccaaggaggacggcggcggctggtggtacaaccgatgtcatgccgccaaccccaacgggcgctattactggggcggacagtatacttgggacatggccaaacatggcacagacgatggcgtggtgtggatgaactggaagggctcttggtactctatgcgcaagatgtcgatgaagattcgcccgttttttccccagcag

SEQ ID NO: 11302 - DNA, 1473 bp, Artificial Sequence
  Description of Artificial Sequence: Synthetic coding sequence
atgaaaagaatggtgagctggtcatttcacaaactgaagacaatgaagcacctcctgcttcttttgctttgcgtcttcctggtaaagagccagggagtgaacgacaacgaagagggcttcttcagtgccaggggacatcgccctctagataaaaagcgtgaggaggcaccttccttgcggccagcccccccgcccattagtggaggcggttacagggcgcggcccgctaaggccgccgccacacaaaagaaggtcgagcgcaaagcccctgatgccgggggttgtctacatgccgaccccgatctgggcgttttgtgtcccaccggatgtcagctacaggaggctcttctgcagcaagagcgccccatccgaaactccgtggacgaactgaataacaatgtggaggccgtgagccagacttcgtcctcatccttccagtatatgtacctgttgaaagatttatggcaaaagcgacagaaacaggtaaaagacaatgagaacgttgtgaatgaatacagcagtgaactcgagaaacatcaattgtacattgacgaaacagtgaatagcaatatcccaactaacctgcgcgtactgcggtctatcctggaaaacttgcgaagtaagatacagaagcttgagagcgacgttagcgcgcagatggaatactgcaggactccgtgtactgtgagctgtaacattccagtcgtttccggaaaagagtgcgaagagattatccgcaaagggggcgaaacttcggaaatgtacctcatccagccggattcttcggtgaagccttacagggtctactgtgatatgaacactgaaaacggagggtggactgtcatccaaaatcggcaggatggaagtgtggatttcggccgcaagtgggacccatacaagcaaggctttggcaatgtcgctacaaacactgacggcaaaaactattgcggtctcccaggcgagtactggctcggaaatgacaaaatctcccaattgacacggatgggtcctaccgagctgctcatcgagatggaggattggaaaggcgacaaggttaaagctcactatgggggatttacagtgcagaatgaggctaataaataccagatttctgtcaacaaatacaggggaaccgcaggcaatgccctcatggatggtgcttcccagcttatgggtgaaaacaggactatgactattcataacgggatgttctttagcacctatgaccgggacaatgatggctggctgacttccgacccgaggaagcagtgctccaaagaagatggcggaggctggtggtataatcgatgtcacgccgctaaccctaacggccggtactactggggtggtcagtacacctgggatatggctaagcatggcaccgatgatggagttgtgtggatgaattggaagggcagctggtattccatgaggaaaatgtcgatgaagatcagaccttttttcccccagcag

SEQ ID NO: 11303 - DNA, 1473 bp, Artificial Sequence
  Description of Artificial Sequence: Synthetic coding sequence
atgaaacgcatggtttcttggtccttccataagttgaaaacaatgaagcacctgttgcttctcctcctgtgtgtctttctagtgaagagtcagggcgtgaatgacaacgaagagggctttttctctgccagaggtcatcgaccccttgataagaaaagggaagaggcacccagcctgcgccctgctcctccaccgatatccggtgggggctatcgcgcaaggcctgctaaggccgccgctacgcaaaaaaaggtggagaggaaggccccagatgcagggggatgtctgcatgccgatccagatctgggagtcctgtgtccgactggatgccagcttcaagaagctctgttacaacaagaacggccaatcaggaattccgttgatgagttgaataacaacgtcgaagccgtctcccagacttccagctcgtcgttccagtacatgtatttgctcaaggacctatggcagaaacggcagaagcaggtgaaagataatgaaaacgtcgttaatgaatactcgagcgaattggaaaaacaccaactttacatcgatgaaacagtgaactccaatatccccacaaacctgcgtgtgcttagaagcattttggagaatctcaggagtaagatccagaagctagagtctgacgtatctgctcagatggagtattgtaggactccttgcacggtgtcctgcaacattcccgtcgtgtccgggaaagagtgcgaagagatcatccggaagggcggggagactagcgagatgtacctgatccaaccagatagctccgtgaagccatatagagtgtactgtgacatgaataccgagaacggaggctggacggtgattcaaaacaggcaggacggatcagtggattttgggagaaagtgggacccttacaagcagggttttggaaatgtcgccacgaacacagatgggaagaactactgtggcctgcctggtgagtattggctgggaaacgataagatctcccagctgacccggatgggtccaaccgaactcctgattgagatggaagactggaagggggacaaagtgaaagcccactacggaggcttcactgtgcagaacgaggcgaacaagtaccagatttctgtaaacaagtatcgaggaacggccggcaatgctctcatggatggggcgtcccagctcatgggtgagaacagaaccatgactattcataacgggatgttcttcagtacctatgatagggacaacgatggctggcttaccagcgacccccgcaaacagtgttctaaggaggatgggggcggctggtggtataatcggtgtcatgcagcaaacccgaacgggaggtactattggggcggacagtacacatgggatatggcgaaacacgggaccgatgatggggtagtgtggatgaattggaagggcagttggtacagtatgaggaaaatgtccatgaaaatacgccccttctttcctcagcag

SEQ ID NO: 11304 - DNA, 1473 bp, Artificial Sequence
  Description of Artificial Sequence: Synthetic coding sequence
atgaagagaatggtgagctggtcttttcacaaattgaagacaatgaagcacctgcttctgcttcttctgtgcgtctttctggtcaaatcacaaggagtgaatgataatgaggaagggttcttcagcgcaagaggccatagaccgttggataaaaaaagagaggaagcacccagcctgcggcctgctccgccccctatctctggcgggggctacagagcccggcccgcgaaggcagcggccacccagaagaaagtcgagagaaaagcccctgatgcggggggatgcctccatgccgatcccgatttgggtgtgctgtgtcccactggttgccagctgcaggaagcgttgctccaacaggagaggccaatcagaaactctgttgatgagttgaacaacaacgtcgaggccgtgagccagaccagttcaagttccttccagtatatgtaccttctgaaggatctttggcaaaagcggcagaaacaggtgaaggacaacgagaacgtggtaaacgagtactcctcagagctcgagaaacatcagctttatatcgatgagaccgtgaattctaacattcccaccaatctgcgagtgctgcggagcatactcgaaaatctcaggagtaaaatacagaaactcgagagcgatgtgtccgcccaaatggagtactgtcgcaccccgtgcactgtcagctgcaacatccctgtggtcagcgggaaagaatgtgaggaaatcatcaggaaaggaggagagacctccgagatgtaccttatccaaccagacagcagtgttaagccctatagggtatattgcgacatgaatacagagaatggtgggtggaccgtgattcagaacagacaggacggcagtgtggattttggaaggaaatgggacccgtacaagcaggggttcggtaatgttgccactaataccgacggaaaaaattactgtggcctgcctggtgagtattggctcgggaacgacaagattagtcaactcactcggatgggacccaccgagctgcttatagagatggaggactggaagggggacaaggtgaaagcgcattatggggggttcaccgtgcagaacgaagccaacaagtatcaaatctccgtaaataagtaccgcggtaccgccggtaatgcccttatggatggtgcgagtcagctgatgggagaaaatcggactatgaccattcacaatgggatgtttttctccacctatgacagggacaacgacggttggctcacctccgatccccgcaagcagtgctccaaagaggatggcggcggctggtggtacaaccggtgtcacgccgcaaaccccaacggccggtactactggggtggacagtatacatgggacatggctaaacatggaaccgacgatggcgtggtgtggatgaactggaaaggctcctggtattctatgcggaaaatgagcatgaagatccggccattctttccccaacag

SEQ ID NO: 11305 - DNA, 1473 bp, Artificial Sequence
  Description of Artificial Sequence: Synthetic coding sequence
atgaaacgaatggtgtcttggagttttcacaaactaaagacaatgaagcatttgctgcttctgctcctctgcgtctttttggtcaaaagccagggagtcaacgataatgaagaagggtttttctccgcccgcggccacaggccactagataagaagcgcgaagaagctccgagtcttcgccctgctccgccgcccatcagtggaggcggttatagagcgagacccgctaaggccgctgcaacccagaaaaaggtcgaacgcaaggcacccgacgctggcggttgtctgcatgccgatcctgacctgggagttttatgccccacaggatgtcagctgcaggaggcactgctgcagcaggaacgtccaattcgaaactccgtggatgaattgaataataacgtcgaggcggtcagtcagacctctagctcatcctttcagtacatgtacttgcttaaggacctctggcagaagagacagaaacaggtgaaggataacgaaaacgtcgtgaatgagtactcatccgagctagagaagcatcagctatacatagacgagactgtgaactctaatatccctaccaatttgagagtgttgaggtcaattctcgagaacctgaggagtaagattcaaaagctcgaatctgacgtcagcgcgcagatggagtactgccgtacaccgtgcactgtgtcatgtaatataccagtggtgtctgggaaggagtgcgaggaaattatccgcaaaggcggggagacaagtgaaatgtaccttatccagcctgactcctcggtgaagccttacagagtatattgcgacatgaacaccgagaacggaggatggactgtgatccagaacagacaagatggcagtgttgattttggccgcaaatgggacccatataaacagggattcggcaacgtggcaactaacaccgacggtaagaactattgtggactccctggagagtattggctcggcaacgataagattagccaactcaccagaatgggccctaccgagctgcttattgagatggaggattggaaaggcgacaaagtcaaggcccattacgggggtttcactgtgcaaaacgaggccaataaatatcagatttctgttaataaataccgagggacggcgggcaatgctctaatggatggggcaagtcagctgatgggtgaaaacagaaccatgactatccacaacggaatgtttttctccacctatgatcgagataacgatggctggctgacttccgacccccgcaagcagtgctcaaaagaagacgggggcggatggtggtataatagatgccacgccgcaaaccccaatggccgctactactggggcggtcaatacacctgggacatggccaagcacggtaccgacgatggggtcgtgtggatgaactggaaagggagctggtacagcatgagaaaaatgagcatgaagattaggccatttttcccacagcaa

SEQ ID NO: 11306 - DNA, 1473 bp, Artificial Sequence
  Description of Artificial Sequence: Synthetic coding sequence
atgaagcgcatggtgtcttggtccttccataagttgaaaacgatgaagcacttgctcctgctccttctctgtgtgtttctcgtcaagtcgcagggcgtcaacgataatgaggagggctttttcagcgctcgggggcaccgacctctggataagaaaagagaagaggccccatcactcagaccagccccgccacctatcagtggcggcggctatcgggcacgacctgcaaaggctgccgctacccaaaagaaagttgagcggaaggctcccgacgccgggggatgtctccatgctgatccagatctaggtgtgttatgtcccacagggtgccaactgcaagaggccctgctccagcaggaaagacccatccgaaattcagtggatgagctgaataacaacgtagaagcggtgtctcagacctcatccagttcctttcagtacatgtatctgctgaaagatctgtggcagaagcgacaaaagcaggttaaggacaacgagaatgtggtgaatgagtacagcagcgaacttgagaaacaccagctctacattgatgagaccgtgaattctaacatccctacaaatctgagggtcctccgatctattttagagaacctgcggtccaaaatccagaaactggaatctgatgtgagtgcccagatggaatactgcagaaccccttgcaccgtgagctgtaacatccccgtggtaagtgggaaagaatgcgaagagatcatccggaagggaggcgagacctcggagatgtatctgattcagccagacagttcagtgaagccgtaccgggtgtattgcgacatgaacactgagaacggtgggtggacagtgatacaaaacaggcaagacggctccgtcgactttgggaggaaatgggacccttataagcagggcttcggcaacgtcgccacaaatacagatggcaagaattactgcgggctcccgggagaatattggctcggcaatgataaaatttctcaattgactcgcatggggcctaccgaactgctgatagagatggaggactggaaaggggataaggtcaaagctcattacggagggtttactgtgcagaacgaggcgaataagtatcagattagtgtgaacaagtatcgggggaccgccgggaatgcgctgatggacggggcctctcagcttatgggtgaaaacaggacaatgaccatacacaacggaatgtttttcagcacctatgatagggacaatgacggctggctaacatctgatccccggaaacagtgtagcaaagaagacggggggggctggtggtataaccggtgccatgccgcaaacccaaacggacggtattattggggtggccaatatacctgggacatggcaaagcacgggacggatgacggagtggtttggatgaattggaagggatcttggtattcaatgcgcaagatgagcatgaagattaggccattcttcccgcaacag

SEQ ID NO: 11307 - DNA, 1473 bp, Artificial Sequence
  Description of Artificial Sequence: Synthetic coding sequence
atgaagcgaatggtctcgtggtcattccacaaactgaaaacaatgaagcatcttctgcttcttctcttgtgtgtctttctggtcaaaagtcagggtgtgaatgacaatgaggagggcttcttttccgctaggggacatcgccccctcgataaaaagcgcgaagaagccccaagccttagaccagcgcctccacccatatccggaggcgggtaccgagcacggcctgccaaggccgccgcaacacaaaagaaggtggagaggaaagcccctgatgcaggaggatgcctgcacgccgatcccgacctgggagtactgtgccctaccgggtgccaactgcaagaagccctgctccaacaggaacggcccatcaggaacagcgtcgacgagttgaataataacgtggaggccgtgtctcaaacatcatcctcgtccttccagtacatgtacttgctgaaggacctttggcaaaaacgccaaaaacaagtcaaagataacgagaatgtcgtgaatgagtattcttcagagctggagaaacatcagttgtatattgacgaaactgtgaactcaaatattcccactaacttaagagtgctgaggtctatcctggaaaacttgcggtctaagatccagaagctggagtcagacgtatctgcccaaatggaatattgtaggacgccatgcaccgtgtcatgtaacatccctgtcgtaagcgggaaggaatgtgaagaaataatccggaaggggggcgaaaccagtgaaatgtatcttattcagccagatagttcggtgaagccctatagagtgtactgcgacatgaatactgaaaacgggggttggacagtaatacaaaaccggcaggacggtagtgtggactttgggcgcaaatgggacccctataaacaggggtttgggaacgtggcgaccaataccgatggaaagaattactgcgggttgcctggggagtattggctgggtaacgacaagatttctcagttgacccgcatgggccctacagaattactgattgagatggaggactggaagggcgacaaagtcaaggcgcactatggggggtttacggtccagaacgaagcaaataaatatcagataagtgtcaataagtaccggggaacagccggtaacgcccttatggacggagcatcacagctgatgggcgaaaatcgcaccatgaccatccacaacggcatgttcttttccacatacgatcgagacaacgacggatggctgacgagcgaccctaggaaacagtgcagtaaggaggatgggggaggctggtggtataatcgctgccatgccgccaatcctaatggccggtactactggggcggacagtacacttgggacatggcaaaacacggcacagacgacggagtcgtttggatgaattggaagggcagctggtactcgatgcggaagatgagtatgaagatcagaccctttttccctcaacag

SEQ ID NO: 11308 - DNA, 1473 bp, Artificial Sequence
  Description of Artificial Sequence: Synthetic coding sequence
atgaagcgcatggtctcatggtctttccataagctaaaaacaatgaagcatcttcttctgctgctgttatgtgtattcttagtcaagagccagggcgtgaatgacaatgaagaaggtttcttcagcgcaagaggtcaccgacccctggacaaaaagagagaggaggcaccgtcactgaggcctgcccctcccccaatatctggaggaggctacagagcccgccctgcaaaggctgctgccactcagaagaaggtggaacgcaaggcgcccgacgctggagggtgcttgcatgctgaccctgatctgggcgtgctgtgccctacaggatgccagctgcaggaagcgttactgcaacaggagcggcccatccggaactccgtggatgaattgaacaacaacgtcgaggccgtctctcaaacatctagtagctcctttcagtatatgtacttgctgaaagacctgtggcagaaaagacaaaagcaggtgaaagacaacgaaaacgtggtgaacgagtattccagtgagctggaaaagcaccagctgtatatagacgaaaccgtgaactcaaacatcccaacgaatttgcgggtgctccggtctatacttgaaaatctgcgatcgaagattcagaagctggagagcgacgtctccgcgcagatggagtattgtaggacaccatgcactgtctcttgtaatattcctgtcgtgagcgggaaggagtgcgaggagatcattcgaaagggcggggaaacctcagagatgtatctgattcagcctgactcctccgtaaaaccctacagagtttattgcgacatgaacaccgaaaatggcgggtggaccgtgattcaaaaccgtcaagacggctccgtggacttcggacgcaagtgggacccctacaaacagggctttggaaatgttgctaccaatactgacggaaagaattattgcggcctccccggcgagtactggctaggtaatgacaagatttcacagctgacccggatgggtcctacagagcttctaatcgaaatggaagattggaaaggtgacaaggtcaaggcgcactacggcggattcaccgtgcagaacgaggccaacaagtatcagatcagtgtcaataagtaccgcgggactgcgggaaatgcactgatggatggagcctctcagctaatgggcgaaaatagaaccatgaccattcacaatggcatgtttttctccacttacgacagagacaacgacgggtggctgacttctgatccaaggaaacagtgtagtaaagaggatggcgggggatggtggtataatcgctgccatgctgctaacccaaacggaaggtactactggggaggtcagtatacttgggacatggcaaaacacgggaccgacgacggcgtggtgtggatgaattggaagggcagctggtactcaatgaggaagatgagcatgaaaatccgcccgttttttccacagcag

SEQ ID NO: 11309 - DNA, 1473 bp, Artificial Sequence
  Description of Artificial Sequence: Synthetic coding sequence
atgaaacgaatggtgtcttggtcctttcacaagttgaagaccatgaagcaccttctcctgctgctgctgtgtgtgttcctcgtaaaaagccagggagtgaacgacaatgaagaaggtttcttttcagccaggggccaccgccctctggataagaaacgggaagaagcgccatctctgcgtcctgctcctcctccgatcagcggaggtggatacagggctcgccctgctaaagctgctgctacccagaaaaaagtggaaagaaaggctccagacgctggcggatgcctgcatgctgatccagaccttggcgtgctgtgccctacaggttgtcagctgcaagaagctctcctgcagcaggaacggccaatcaggaattcagtggatgaactgaacaacaatgtggaagctgtgagtcaaacctccagcagcagcttccagtatatgtatcttctgaaggacctgtggcagaaaaggcaaaagcaggtcaaggataatgaaaacgtcgtgaacgagtatagctccgagctggaaaaacaccaactgtacatagacgagactgtaaacagcaacattccaactaacctgagggtccttcgcagcatcctggaaaacttgaggagcaaaattcagaaattggagtcagatgtctcagcgcaaatggagtactgtcggaccccatgcaccgtcagctgcaacatccctgtggtgagcggaaaggaatgcgaagaaatcatacggaagggcggggagaccagcgagatgtaccttattcagcccgatagttctgttaagccgtacagagtgtactgtgacatgaacactgagaacggaggctggactgtgatccaaaacaggcaagacggcagcgtggatttcgggagaaaatgggacccatacaagcagggctttggaaatgtggctaccaacacggatggaaagaattattgtggactccccggtgaatattggcttggaaacgacaaaatcagtcagctcacccgcatgggccctacagaactgctgatagagatggaggattggaaaggcgataaagtgaaggctcattatggagggttcaccgtccagaatgaggcaaacaagtaccagataagcgtgaataaatatagagggaccgctggcaacgcactgatggatggcgcctcccaactgatgggcgaaaaccggaccatgacaatccataacggcatgtttttcagcacatatgatagggataacgatggatggctgacatcagacccgaggaaacaatgttcaaaggaggacggaggaggatggtggtacaataggtgtcacgctgcaaacccaaatggacgctactactggggagggcagtatacctgggacatggcaaagcatggcacagacgatggagttgtctggatgaactggaaaggaagctggtactccatgcggaagatgagcatgaaaatcagaccattctttccgcagcag

SEQ ID NO: 11310 - DNA, 1473 bp, Artificial Sequence
  Description of Artificial Sequence: Synthetic coding sequence
atgaaaaggatggtgagttggtcctttcacaagttaaagacaatgaagcacctattactgctgctgttgtgcgtcttcctggtgaagagtcagggtgtgaatgacaatgaagaaggctttttcagcgcccgcgggcaccgcccacttgacaagaagagagaggaggcccctagcctgcgaccagctcctcctcctatcagtggagggggatacagagcccggcccgctaaggccgcagctacacagaagaaagtggagcggaaggcccccgacgcagggggatgcctgcacgccgatccagatctgggggtactctgtccaaccggctgtcaactgcaagaggccctgctgcagcaggagcgacccattcgtaactccgtggatgaactaaataataatgtcgaagccgtttcacagacatcttccagctcctttcagtatatgtatctgctgaaggatctatggcaaaagaggcaaaagcaggttaaggacaatgaaaacgtcgtaaatgaatactcttccgagcttgagaaacaccagttatatatcgacgagacagtgaactctaacattcccaccaacctgcgtgtgctccgatcaatactggagaatctccggtctaagattcaaaagctggagtctgatgtgtccgcacaaatggagtactgtcgaacaccttgcaccgtgtcttgtaacatccccgtggtttccggtaaggagtgtgaggagattatccggaagggaggggagacctccgaaatgtaccttatccagcctgacagtagcgttaaaccatatcgagtatactgcgacatgaacaccgaaaatggcgggtggactgtgatccaaaacagacaggacggcagcgtggacttcgggcggaagtgggacccatacaagcaaggctttggcaacgtggctactaataccgatggtaaaaactactgcggactgcccggcgaatactggcttgggaatgacaagatctctcagctgacccgcatgggcccaactgagctgctcattgagatggaggactggaagggcgataaagtgaaggcccactacggtgggttcacagtgcagaatgaggccaacaaataccagataagcgttaacaaataccggggaaccgcagggaatgcactcatggatggcgccagtcagctgatgggggaaaacaggactatgacaatacataatggcatgtttttttctacctatgacagggacaacgacggatggcttacatccgatccaagaaaacaatgttctaaggaagacggggggggatggtggtacaatagatgccacgctgccaaccccaacgggcgctattactggggcggtcagtacacttgggatatggccaaacacggcacagacgatggggtggtctggatgaactggaaaggctcttggtatagtatgcggaagatgagcatgaagatacggccttttttcccccagcag

SEQ ID NO: 11311 - DNA, 1473 bp, Artificial Sequence
  Description of Artificial Sequence: Synthetic coding sequence
atgaaacgcatggtgagctggagcttccataagttgaaaaccatgaagcacctcctcctcctgttgctgtgcgttttcctggtcaagtcccagggggtcaatgacaatgaggaggggtttttttccgctagaggtcatcgaccccttgataagaagcgagaagaagcccctagcctgaggcctgccccgcctcctatcagcggaggcggctacagagctcggccggccaaagcagctgcaacacagaagaaagttgagcgcaaggctcccgacgccggaggatgcctccatgccgatcccgatttaggagttctgtgcccaaccgggtgtcagctgcaggaagctctgctacagcaagaacgaccaatcagaaatagtgtggacgagctaaataataatgtggaggccgtatctcagacaagctcgtcctcattccagtacatgtatctgttgaaagatctgtggcagaagaggcagaaacaagtcaaagataatgagaatgtggtgaatgaatacagcagcgagttggagaagcatcagctgtacattgacgagactgtgaattcgaatatccccacaaacttacgggttctccggtccattctggagaacctaaggtccaagatacagaagctggagagcgatgtgtctgcacaaatggagtattgcaggacaccctgtactgtctcttgtaatatcccggttgtcagcggaaaggagtgcgaggagattattcggaaaggaggcgagaccagcgagatgtacctcattcaacctgactcttccgttaaaccttacagagtgtactgtgacatgaacactgagaatggtggatggacagttatccaaaaccgccaagatgggtctgttgattttgggcggaaatgggacccatacaaacaggggtttggtaatgtggcaaccaatacggacgggaagaactactgcggcctgcccggagaatactggctggggaacgacaagatcagccaactgacaaggatgggacccaccgagcttttgatcgagatggaggattggaagggggataaagtcaaggcacactatggggggtttacagttcagaatgaggccaataaataccagattagcgtgaataaataccgcgggaccgcaggaaacgctctgatggatggagcctcacagcttatgggagaaaataggacaatgacaattcacaacggcatgtttttttccacctacgatagggacaatgatgggtggctaaccagcgacccaaggaagcaatgctctaaagaggatgggggggggtggtggtataaccggtgccatgctgctaaccccaacggcaggtactactggggtggccagtacacatgggacatggcaaaacatgggaccgacgacggggttgtgtggatgaactggaaaggatcatggtattcaatgagaaagatgtccatgaagattagaccattttttccacagcag

SEQ ID NO: 11312 - DNA, 1473 bp, Artificial Sequence
  Description of Artificial Sequence: Synthetic coding sequence
atgaagcggatggttagctggtcatttcacaaacttaaaacgatgaaacatttgttactgcttttgttgtgtgtatttttggtgaagtcacaaggtgtcaatgacaacgaagagggattcttctcagcgagaggacatagaccgctcgataaaaagcgggaggaagcgccttcgctgcgtccggcgccaccgccgatctcaggaggtggttatcgcgcccgaccggcgaaagccgccgcaacccagaagaaagttgagcgtaaggcgccggatgcaggaggatgccttcatgccgatccggacctgggcgtgttatgcccaacaggctgtcagttacaagaagccctgttgcaacaggaaagaccgattcgcaatagcgtagatgaactgaataacaatgtggaagctgtgtcgcagacctcttcctcgagtttccaatatatgtatcttttgaaagatctttggcagaagcgccaaaaacaggtgaaggacaatgagaatgtggtcaatgaatatagcagtgaattggagaaacaccagctgtatattgacgaaaccgtgaacagtaacatccctaccaaccttcgagtactgcggtcaattttagagaatctgcggtcaaagatccagaaacttgaaagcgatgtgtcagcccaaatggaatattgtagaacgccatgcacggttagttgcaatattccagtggttagcggtaaggaatgtgaagaaatcatcagaaaggggggggaaactagcgagatgtatctaattcagcctgattcatcagtaaaaccgtatcgtgtctactgcgacatgaatactgaaaatggaggatggacagtcattcaaaatcgccaagatggttccgtcgatttcgggagaaagtgggatccgtataagcaaggctttggtaacgtcgctacgaatacggacggtaagaattattgcgggcttcctggcgaatactggcttggcaatgataaaatctcgcaactgactaggatggggcctacggaactgcttatcgaaatggaagattggaaaggcgataaagtgaaagcacactatggcgggtttacagtgcaaaacgaagccaataaataccagatttcagttaataaatatagaggtacagcgggaaatgcacttatggatggggctagccagttaatgggggaaaatcggactatgacgattcacaatgggatgttcttctctacatacgaccgtgacaatgatggatggttgacgtctgatccgcgcaaacaatgtagtaaagaagatggcggcggatggtggtacaatcgttgtcacgcagccaatccaaatggtagatactattggggtggacaatatacatgggacatggcgaagcatggtacagatgatggtgtagtatggatgaactggaaaggctcctggtattcaatgcggaagatgtctatgaaaatccgtccatttttccctcaacaa

SEQ ID NO: 11313 - DNA, 1473 bp, Artificial Sequence
  Description of Artificial Sequence: Synthetic coding sequence
atgaagcgcatggtgtcttggagtttccacaagctcaagaccatgaagcacctgttgctgttgttgctttgtgtgtttctcgtgaagtcacagggtgttaacgataatgaggagggatttttctctgccagaggtcacaggcctctcgataagaaaagagaggaggccccaagcctgcgccctgccccacctcccatatcaggaggaggatacagggcccgccctgctaaagccgctgctacgcagaagaaggtagagagaaaggcgccagatgcaggaggctgcctgcacgctgaccctgacctcggtgttctgtgtccgaccggatgccagctgcaggaagcactgctgcagcaggaaagaccaattaggaacagtgttgacgaactcaataataacgtcgaagcagttagccagacatcctcttccagtttccaatatatgtacctgttgaaggatctgtggcaaaaaagacagaagcaggtaaaggacaacgaaaatgtagtgaatgagtattctagtgagcttgagaagcatcagctgtacatagacgagacagttaatagtaacatccccactaacctcagggtgctgagatcaatcttggaaaatctccgcagcaagatccaaaaattggaatctgatgtatctgctcaaatggagtactgccgcaccccgtgtacagtttcttgtaatattccggtggtttccggcaaggagtgcgaggagatcattaggaaaggaggagagacttccgaaatgtatctgatccaaccagactccagtgtgaagccttaccgcgtgtactgtgacatgaacaccgagaacggtggttggactgtgattcagaataggcaagacggttccgtagactttggtagaaagtgggacccttacaagcagggattcggtaacgtggctacgaatacagacggtaagaactattgtggtctgcctggagagtattggttgggaaatgacaaaatttcccagcttaccagaatgggtcccactgagctgctcatcgagatggaagattggaaaggagacaaagtgaaagctcattatggcggttttactgttcagaacgaggcgaacaaataccaaattagcgttaacaagtataggggtacagctggaaatgccctcatggatggcgcctcccaattgatgggagagaacagaaccatgaccatccacaatggtatgttcttcagcacttacgacagagataatgacggttggctgacctctgaccctaggaaacagtgcagcaaggaagacggcggaggctggtggtacaacaggtgtcacgctgccaacccaaacggtaggtactactggggaggtcagtacacatgggatatggcgaagcacggaaccgacgacggagtcgtttggatgaattggaagggctcatggtactccatgcgcaaaatgtctatgaagatacgcccattcttccctcagcag

SEQ ID NO: 11314 - DNA, 1473 bp, Artificial Sequence
  Description of Artificial Sequence: Synthetic coding sequence
atgaagcgcatggtgtcctggtctttccacaaactaaagaccatgaagcacttgcttctcctgctgttgtgtgtttttctggtgaaatcccagggggtcaacgacaacgaagaggggtttttttctgcacgtggccacagaccactagacaagaagagggaagaggcacccagcctgcggcctgcacccccccctatttcgggaggagggtacagagctcggcccgccaaagctgccgctactcagaagaaggttgagcgcaaggcaccggatgccggaggctgtttacatgccgatcctgacttaggggtactctgcccgacgggttgccaacttcaggaagcacttcttcagcaggaacgcccaatcaggaactccgtcgacgaacttaataacaacgttgaagcggtcagccagacctcaagctcgtccttccaatatatgtacctgcttaaagacttatggcaaaagagacagaagcaggtgaaggataacgagaacgtagtgaatgaatactcatcagagctagagaagcaccagctttacatagatgaaacagtcaacagtaatattcctactaacctccgagtcttacgaagcattttagagaatttgaggtcaaaaatccagaagttggagtctgatgtatcagctcagatggagtactgccgcaccccatgcactgtatcctgcaacattccagtggtgtctgggaaggaatgtgaggagatcatccgtaaaggcggtgagacttcagaaatgtatcttatccagcccgacagctctgtcaagccttacagggtatactgtgatatgaacaccgaaaatggaggctggaccgtgattcagaatcggcaggacggatctgtggattttggtaggaagtgggacccttacaagcagggtttcggtaacgttgctaccaataccgatggaaagaattactgcggcctgccaggcgagtactggttaggcaacgacaaaatttctcaactcacacggatggggcccacagaactgcttattgaaatggaagactggaagggcgacaaagtgaaggctcattatggggggttcaccgttcaaaatgaggcgaacaaatatcaaattagcgtgaataagtaccgcggaaccgccgggaatgccctgatggacggagcgagtcagttaatgggggagaacaggacaatgacaattcacaatggaatgttctttagtacctatgatagagacaatgatggctggctgacaagcgatccgcgaaagcagtgctcaaaggaggatggtggcggttggtggtacaaccggtgccacgctgcgaatcccaatggtcgatattattggggaggccagtatacatgggatatggcgaagcacggcacagacgacggagtcgtgtggatgaattggaaaggatcatggtactccatgcgtaaaatgtctatgaaaatcagacctttcttccctcagcag

SEQ ID NO: 11315 - DNA, 1473 bp, Artificial Sequence
  Description of Artificial Sequence: Synthetic coding sequence
atgaaaagaatggttagttggtcattccataagcttaaaacgatgaaacacctgctgttactgctgttatgcgtcttcttggtgaaaagccagggtgtcaacgacaacgaagaggggttttttagcgctaggggtcataggcctttggataaaaagagagaagaagccccaagccttagaccagctccgccgcctatctcggggggtgggtatagagctaggccagccaaggcggccgccacccagaaaaaagtcgagcgtaaggctcctgacgcgggcggctgtctccacgccgacccggatcttggggtcttgtgccctactggctgccagctgcaggaagcccttctgcagcaggagagacctattcgcaatagcgtcgacgagctcaataacaatgttgaggccgtgtcacagactagtagttcatctttccagtacatgtacctgctgaaagacttgtggcaaaagaggcagaagcaggtcaaagataatgagaatgtggtaaacgagtattccagcgaactcgagaaacaccagctgtacatcgacgaaacagtgaactctaatattcctaccaacttgagggtgctccgatccatcctggagaacctgcgcagtaagatccaaaagctcgagagcgatgtgtccgcccagatggaatactgccgaaccccgtgtacagtgtcctgcaatatacctgtggtatcaggtaaggaatgtgaagagattattcgaaagggtggagagacatccgagatgtatctcatccagccagactcctctgttaagccctatcgagtgtactgcgacatgaacaccgaaaatggggggtggactgtgatccagaatagacaggacgggtccgtcgatttcggcaggaaatgggatccctacaaacagggtttcggcaatgtcgccactaacactgacggtaagaactactgtggacttcccggtgagtattggctggggaacgataaaatttcgcagctgactaggatgggacccaccgagttgcttattgaaatggaggactggaagggggataaagtaaaggcgcactatggaggctttacagtccagaatgaagccaataagtatcagatatcagtgaacaaatatcggggaacggctggcaatgctctgatggatggtgctagccagcttatgggagagaaccggactatgacaattcacaacgggatgttcttctccacttatgaccgggataacgacgggtggcttacctcagacccgcggaaacagtgcagcaaggaggatggaggcggttggtggtacaatcgatgtcatgccgcgaatcccaacggacggtactattggggcggtcagtacacctgggatatggcaaaacatggaacggacgatggagtggtctggatgaattggaaagggtcctggtactctatgagaaaaatgtcaatgaaaattcggccgttctttccacaacag

SEQ ID NO: 11316 - DNA, 1473 bp, Artificial Sequence
  Description of Artificial Sequence: Synthetic coding sequence
atgaagcggatggtgtcatggtcgttccataaactgaaaaccatgaagcatctgctcctcctgttgctttgcgtctttctggttaaatcccaaggcgtcaacgacaacgaggagggattcttttctgcgcgcggccatcgcccgctcgacaagaaacgggaggaagccccttcgcttcggccagctccgccgcctatctcaggcgggggataccgcgcacggccggctaaagcggcagcgactcagaagaaggtggaaagaaaggcgcccgacgccggaggatgcctgcatgccgatccagacctcggcgttctctgccctactggatgccagctgcaagaggcgctgctccagcaagaacgcccaatccgcaactcggtcgacgaactcaacaacaacgtggaggccgtgtcccagacttcatcgagttcgttccagtacatgtatctgctcaaggacctgtggcagaagagacaaaaacaggtgaaagacaatgagaacgtcgtgaacgaatactcgagcgagctggaaaagcaccagctctacattgacgaaaccgtgaactccaacatcccaactaacctgagagtccttcgatcgattcttgagaatctgaggagcaagatccagaagctggaatcggacgtgtccgcccaaatggagtattgcagaacgccctgcaccgtcagctgcaatatcccagtggtgtcgggtaaggagtgtgaagaaatcatcaggaagggcggagaaacctccgaaatgtatctgatccaaccggattcctcagtgaagccataccgcgtatactgcgacatgaataccgagaatggagggtggactgtcatccaaaaccgccaggacggaagcgtggatttcggaaggaagtgggacccgtacaagcagggtttcgggaacgtggccaccaatacggatggcaagaactactgtggattgccgggtgagtactggctgggaaacgacaagatcagccaattgacgagaatgggccccaccgaactgctgatagagatggaagattggaaaggggacaaggtcaaggctcactacggaggattcactgtgcagaatgaagctaacaagtaccagatctccgtgaataagtaccggggaaccgccggaaacgccctcatggatggtgcatcacaactgatgggggagaatcgcactatgaccattcacaatggaatgttcttcagcacctacgatcgcgataacgacggctggttgacttccgacccgcggaaacagtgttccaaggaagatgggggcgggtggtggtacaataggtgccacgccgcaaatcctaacggacggtactactggggaggccaatacacttgggacatggcaaaacacggtaccgatgatggagtggtgtggatgaactggaagggaagctggtactcaatgcggaaaatgtctatgaagatcagaccgttctttccgcagcag

SEQ ID NO: 11317 - DNA, 1473 bp, Artificial Sequence
  Description of Artificial Sequence: Synthetic coding sequence
atgaagaggatggtctcctggtccttccacaaactcaagaccatgaaacaccttctgctcttgctgctctgcgtcttcttggtcaaatctcagggggtcaatgataacgaggagggcttcttctccgctagggggcatcgccccctggataaaaaacgggaggaagctcctagcctgcggccagcccctcccccgatctcaggaggggggtatagagcacgacccgctaaggctgccgctacacagaagaaagtagagcggaaggcacctgatgcaggcggttgcctgcacgctgatccagacttaggagtgctgtgccccaccggctgtcagctgcaagaggctctcctgcaacaggaaaggccgatcagaaattccgtggacgaactgaacaataacgtggaagcggtctcgcagaccagctcttcgtcctttcaatatatgtacttacttaaagatctgtggcaaaagcgccaaaagcaggtaaaggacaatgaaaatgtggtcaatgaatattcctccgagctagagaagcaccagctttatatcgatgagacagttaattccaacatcccaacaaatctccgcgtgcttcggagtatactcgaaaatctgaggtccaaaattcagaagctcgaatccgatgtctcagcacagatggaatactgccgaaccccttgcactgtgtcctgtaacatcccagtcgtgtccggcaaggagtgtgaagagattattcgaaaaggcggagaaacttccgaaatgtatctgatacagcctgattcaagtgtcaaaccttatagagtttattgtgatatgaatacagaaaatggaggttggacggtcatacaaaataggcaggatgggtctgttgacttcggaagaaaatgggacccgtataagcaggggttcgggaatgtcgccacaaacacagatggaaagaactattgcggccttccaggagagtactggcttggtaacgataagatttcacagttaaccagaatgggacctaccgaactgctcatcgagatggaagactggaagggagacaaggtgaaggcacattacggcggattcaccgtgcagaacgaggccaataagtaccagatatcagttaacaaatacagggggacagctgggaacgcactgatggacggtgcctcccagctcatgggggaaaacaggactatgacaatacacaatggcatgttctttagcacctacgatagggataatgacgggtggttgacgtctgaccctcgaaagcagtgctccaaagaggacggtgggggctggtggtacaaccgatgccacgctgcgaacccaaatggtcggtactactggggcggccagtacacatgggacatggctaagcacggcactgacgacggtgtggtttggatgaattggaaaggctcctggtacagcatgaggaagatgtctatgaaaattaggcccttcttcccccagcag

SEQ ID NO: 11318 - DNA, 1473 bp, Artificial Sequence; identical to SEQ ID NO: 11292
  Description of Artificial Sequence: Synthetic coding sequence

SEQ ID NO: 11319 - DNA, 1473 bp, Artificial Sequence
  Description of Artificial Sequence: Synthetic coding sequence
atgaagaggatggtgagctggagctttcacaaactcaaaaccatgaagcacctgctcctcctgctgctctgcgttttcctcgtcaaaagtcagggtgtgaatgacaacgaggaaggattcttctccgcccgtggccataggcccttagataaaaagcgagaggaagctccaagcctgcgccctgcaccccccccaatcagcggcggcggatatcgcgctcgaccggccaaggcggcagctacacagaaaaaagtggagagaaaagctccagatgctggaggatgcctacacgctgatccagaccttggtgtgttgtgtccgaccggctgtcaattgcaggaggccttgctccaacaggagagacctatcagaaatagcgtcgacgaattgaacaataacgtggaagctgtatcacagacctccagctcaagcttccaatatatgtaccttttgaaggacctttggcaaaagagacaaaaacaggtaaaagataatgagaacgtggtgaacgagtatagcagcgaactggaaaagcaccaactgtacatcgacgagacagttaacagcaacattcccaccaacttgcgtgtcctccgcagtatacttgaaaaccttcgcagtaagatccaaaaactcgagtcggatgtctctgctcaaatggagtactgtagaactccgtgcactgtaagctgtaatattcccgttgtatccggaaaagaatgcgaggagatcatcaggaaaggtggagagacctctgagatgtacttaattcagcctgattcatcagtcaaaccttatcgagtgtactgtgatatgaacactgagaatggtggatggactgtcattcagaaccggcaagacggctctgtcgacttcggacgcaagtgggatccgtacaaacaaggctttggcaatgtggccacgaacaccgacggtaagaactactgtggcttaccaggagagtattggcttggaaatgataaaatatctcaactaacacgtatgggcccaaccgaactgctcattgagatggaagattggaaaggtgataaggttaaagcacactacggcgggttcaccgtccaaaatgaggctaacaaataccaaatctcagtcaacaaatataggggcactgccggaaacgcactgatggatggtgcctcacaactcatgggggagaacagaacgatgacgattcataacggcatgttctttagtacttatgaccgggacaacgacggatggctgactagcgacccccgaaagcagtgttccaaggaggatggcggaggttggtggtacaaccgatgccacgccgctaaccctaacggaaggtactattggggcggtcagtacacttgggacatggctaaacatgggactgatgacggcgtcgtgtggatgaactggaagggcagttggtactcaatgaggaagatgtcgatgaaaatccggccattctttccacagcag

SEQ ID NO: 11320 - DNA, 1473 bp, Artificial Sequence
  Description of Artificial Sequence: Synthetic coding sequence
atgaagcggatggtgtcctggtcctttcacaagctcaaaaccatgaagcatctcctgctcctccttctctgtgtatttctggtgaaatcccaaggagtcaatgacaatgaagagggcttctttagtgccagggggcaccggccactggacaaaaaaagagaagaagcaccgagcctgcgccctgctccacccccgataagtggtgggggttatcgggcgagacccgccaaggctgcagctacccagaagaaggtggaacgcaaggccccagacgcgggcgggtgcttgcacgccgaccctgacctcggagtcctgtgtcccactgggtgccagcttcaggaggctttgctgcagcaagaacgccccatccgaaattcagtagacgaactgaataataacgtggaggctgtgtcccagacatcctcatcctcttttcagtacatgtatctgctcaaagacctctggcaaaagcgccagaagcaggttaaggataacgagaatgtcgtgaacgagtattccagcgagctggaaaagcatcagttgtacatcgatgagacagtcaattccaatatccccacaaatctgagggttctgaggtcaatccttgaaaatttgcggagcaaaatccagaagttggagtctgacgtgagcgctcagatggagtactgcaggaccccttgtaccgtgtcttgcaacataccagttgtgtccggaaaggagtgtgaggaaatcattcgcaagggcggagagacaagtgagatgtacctgattcaacccgattcttctgttaagccatatagggtctactgtgacatgaataccgaaaacgggggttggacagttattcagaaccggcaggacggatctgtggactttggccggaaatgggacccttacaagcagggattcggtaacgtggccacgaataccgacggcaagaactactgcgggctgccaggtgaatattggttgggtaacgacaagattagtcagctgacacggatgggaccaaccgagttgctcattgagatggaggactggaagggagacaaggtgaaggcacattatggcgggtttacagtgcaaaacgaagcaaacaagtatcagatttctgtgaataagtataggggcacggcaggcaatgcactgatggacggggcatctcagctgatgggggaaaaccggacaatgaccatacacaatggaatgttcttctctacatatgatcgggacaacgacggctggcttacaagtgacccaaggaaacagtgcagtaaagaagatggcgggggctggtggtataataggtgtcacgccgcgaaccccaacggccggtattactggggcggacaatacacatgggatatggcaaaacacggcacagatgacggagtggtatggatgaactggaagggatcttggtacagtatgaggaagatgagtatgaaaatcaggccattctttcctcagcag

SEQ ID NO: 11321 - DNA, 1473 bp, Artificial Sequence
  Description of Artificial Sequence: Synthetic coding sequence
atgaaacggatggtgtcctggtcattccataaactcaagaccatgaagcatctgctcctattgctgctgtgtgtatttttggtgaagtcacagggcgtcaatgacaacgaggagggatttttctccgctagaggtcaccggcctctggataagaaacgcgaagaagcaccctctctgaggccggctccgccacccatcagcggtgggggttatcgggctcgccccgccaaagccgccgctacacaaaagaaagttgagagaaaagctccagatgctggcggctgtctgcacgctgatcctgatctgggtgtgctgtgtccaacgggctgtcaactgcaggaagcactcctccagcaagaaaggcctataagaaactccgtcgacgagttgaacaacaacgtagaagccgttagccagacctcttcctccagtttccaatatatgtatcttttaaaggacctttggcaaaaacgccagaagcaggttaaggataatgaaaatgtcgtcaatgaatatagctcagagctggaaaagcatcagctgtacatagacgagacggtcaacagcaacatacccacaaacttgagggtgctgagatcgatcctcgagaatctgcggagcaaaatccagaaactggagtccgatgtgtctgcccagatggagtactgccgtacaccgtgcaccgtctcatgcaacattccagtcgtcagtgggaaagagtgtgaggaaataatcagaaaagggggggagacgtccgaaatgtatctgattcagccagactcttcagtgaagccctacagagtgtactgtgatatgaatactgagaacggcggttggaccgtcatacagaatcgtcaagacggaagtgtcgattttggtaggaagtgggacccttacaagcagggattcgggaatgtggctaccaacaccgacggcaaaaactactgcggcctccctggagaatactggctggggaatgacaagatcagtcagctgacacgaatgggacctaccgagctccttatagaaatggaggattggaagggggacaaggtgaaggctcactatgggggattcaccgtccagaacgaggctaacaaataccagatctcagttaacaagtaccggggcaccgctggaaatgcacttatggacggagcgagccagttaatgggagaaaatcgcacaatgacgatccacaatgggatgttcttctcgacgtacgatcgtgataatgatggttggttaacctctgatccccgtaagcaatgtagtaaggaggatggcggcggatggtggtataaccggtgccacgccgctaatcccaacggcaggtactactggggaggtcaatatacctgggacatggctaaacatggcacagatgacggggtggtatggatgaactggaagggaagctggtattctatgaggaaaatgagtatgaagatcagacctttctttcctcagcag

SEQ ID NO: 11322 - DNA, 1473 bp, Artificial Sequence
  Description of Artificial Sequence: Synthetic coding sequence
atgaaacggatggtgtcttggagcttccataagctgaaaactatgaagcatttattactcttgctgctttgcgtgttcctggttaagagtcaaggcgtaaacgataatgaagaggggttcttctcggctagaggccatcgcccgctcgacaagaaaagagaagaggctccatcgttaagaccggccccacctcctatatccggtggaggatacagagcaagacctgccaaggccgccgcgacacagaagaaggtggagcgcaaagctcccgacgccgggggctgtctgcacgccgatcctgatctcggggtactctgtcctaccgggtgccaacttcaggaagctttgttgcaacaggagcgcccaattcggaactccgtggacgagctcaataataacgtggaggcggtgtctcagacgtccagttcgtcctttcagtatatgtatctattgaaagacctgtggcagaaaaggcaaaagcaggtaaaggataacgaaaatgtggttaacgagtattcctccgaactggaaaagcaccagttgtacatcgatgaaacggtgaatagcaacatccccacaaacctgcgtgtgctgaggagcatcctcgagaatctgaggtcaaagatacagaaattggagtctgacgttagcgcacagatggagtactgtagaaccccttgtactgtgtcttgtaacattccagtggtgtctggaaaggagtgcgaagagattatccgtaagggtggagaaactagcgagatgtacctgatccagccggactccagtgtgaaaccatatagggtgtactgcgatatgaatacggagaatggcggttggaccgtgattcagaatcgacaggacggctccgtggacttcggacgcaagtgggatccttacaaacagggatttggcaatgtggctacaaacactgacgggaagaattactgcggtctaccaggagagtattggctgggaaatgataagatctcccagctgacccgaatgggccctaccgagctgctgattgagatggaagactggaagggagataaagtcaaggcccattacggcgggtttacagttcagaatgaggctaataagtaccaaatttcggtgaataagtacagaggaaccgctggaaatgctctcatggacggtgcctctcagcttatgggcgaaaacagaacgatgactattcataacggaatgtttttctctacttacgatcgcgacaacgacggctggctgacctccgacccaaggaaacagtgctccaaagaggatggggggggctggtggtacaaccgatgccacgccgctaacccgaatggtcggtactactggggcggccagtacacatgggacatggccaagcacggcacagatgacggcgtggtgtggatgaattggaaggggtcctggtatagtatgaggaagatgtccatgaaaataaggcctttcttcccacagcag

SEQ ID NO: 11323 - DNA, 1473 bp, Artificial Sequence
  Description of Artificial Sequence: Synthetic coding sequence
atgaaacgaatggtgtcatggagtttccacaaacttaagacaatgaagcacttgttgctattgttgctctgcgtgttcttggtcaagagccaaggtgtaaacgataatgaggaagggtttttttctgctagaggtcatcgacctttggataagaagcgagaagaggcacctagcctaagacccgcgcctccgccaatatctgggggtggatacagagctagaccagctaaagccgcagctacacagaagaaggtggaacgtaaagcgccagatgctggaggatgcctgcatgctgacccagatttgggcgtattgtgtccaactggatgtcaacttcaagaggctttgctgcaacaggagaggcctattcgtaactccgttgacgaattaaataataacgtcgaggcagtgtcccaaacatcgagctcatcttttcaatacatgtacctactgaaggacctctggcaaaagcgtcaaaagcaagttaaggataatgaaaatgttgttaacgagtactcttctgaattggagaagcatcaattatatattgatgagactgttaattctaacataccaacaaatttgagggttcttcgttctattctagaaaatttacgaagcaagatccaaaaattagaatcggacgtctctgcacagatggagtattgccgtacaccttgtaccgtaagttgcaacatccccgtcgttagtggcaaagaatgtgaggaaattatcagaaagggcggcgaaacttccgaaatgtatttgattcagccagattcttctgttaagccatacagggtgtactgcgatatgaatacagagaacggagggtggaccgtcatacagaaccggcaggatggatcagtcgattttggccgcaagtgggatccgtacaagcaaggttttggaaatgtagctacaaacacggatggtaagaattattgcggtctccctggggaatactggcttggaaatgataaaattagtcagctcacacgcatggggccaaccgagctgttgatagaaatggaggattggaaaggtgacaaagtgaaggcacactacggggggtttactgtgcaaaatgaggctaataaatatcagatctcagtcaacaaatacaggggcactgctggtaatgcgctcatggatggtgcaagtcaacttatgggagagaatagaacaatgactatccataatggtatgtttttctcaacatatgaccgtgataatgatggctggctgacttctgatccacgaaaacagtgttctaaggaagatgggggcggatggtggtacaacagatgccatgctgcgaacccaaatggtagatactattgggggggccagtacacgtgggacatggctaaacatggaacagacgacggagtagtttggatgaattggaaggggtcatggtactccatgagaaaaatgtcaatgaaaataagacccttcttccctcaacag

SEQ ID NO: 11324 - DNA, 1473 bp, Artificial Sequence
  Description of Artificial Sequence: Synthetic coding sequence
atgaaaaggatggtcagctggagctttcataagcttaagacaatgaagcatctcctcctgcttctgttgtgtgtgttccttgtgaagagccagggagttaacgataacgaagaaggttttttcagcgccagagggcacagaccactggacaaaaagcgagaagaagctccaagcctgaggccagcccccccgcctattagtggcggcggctaccgggcaagacccgctaaggctgctgcaacccagaaaaaggtcgaacgaaaggcgccagacgccggtggttgcctgcacgccgacccagatctgggcgttctctgccccacagggtgccagttgcaagaagcactactgcaacaggaacgacctatccgcaatagtgtagacgagctgaataacaacgtcgaggctgtgagtcagactagttcctccagttttcagtacatgtatctcttgaaggatctgtggcagaaaagacaaaagcaggtaaaagacaacgaaaatgtcgtaaacgagtactcaagtgagctggagaaacatcagctgtatattgatgagactgtgaactccaatatcccaacaaacttgcgcgtcttgcggagtatcctagaaaatttgagatcgaaaatccagaaactagagtctgacgtgagcgctcaaatggagtattgtcgaacgccctgtaccgtctcatgcaacatacccgtcgtgagtgggaaagaatgtgaagaaataatcaggaaaggaggggagacctctgagatgtacctgatacagcctgacagctctgtaaagccctaccgggtgtattgcgacatgaataccgaaaacgggggctggacagtgattcaaaatagacaggacgggtcagttgactttggcagaaaatgggacccgtataagcaggggttcggtaacgtggcgacaaatacagatgggaagaattattgcgggctgcccggcgaatattggctgggaaatgataaaatcagccagttaacgaggatggggcccacagagttgctgatagaaatggaagattggaagggggataaggttaaagcccattatggcgggttcactgtccagaatgaagctaacaagtaccagatcagcgtgaataaatacaggggcactgcgggcaacgccctgatggatggagcctctcagctcatgggcgaaaatagaaccatgactatccacaacggaatgttcttctccacatacgatcgagataacgacgggtggctgactagtgatcctagaaagcagtgcagcaaagaagacggcggaggctggtggtacaacagatgccatgccgccaaccctaatggaagatactactgggggggacagtatacgtgggacatggcaaaacacggcacagacgatggcgtggtttggatgaactggaaagggtcctggtacagcatgcggaagatgtccatgaagattcgaccattcttcccacaacaa

SEQ ID NO: 11325 - DNA, 1473 bp, Artificial Sequence
  Description of Artificial Sequence: Synthetic coding sequence
atgaagcgcatggtttcctggagtttccataagctcaagacaatgaagcaccttcttcttctactgttgtgcgtgttcctggtgaagtctcaaggagtaaacgacaacgaggaggggttcttctcagccagggggcatcgcccactggacaagaaaagagaggaggccccatccttgagacctgctccccctcctatttcaggcggaggttatcgggcccggccggcgaaggccgccgcaacacaaaaaaaagtggagcgaaaggctccagacgccggtggatgtctccacgctgatcccgatttaggagtgttatgtccaacggggtgccaactgcaagaagctcttctgcagcaggaacgaccaataaggaactccgttgacgagctgaacaacaatgtggaagccgtcagccaaacaagtagctcctcctttcagtacatgtatttgctcaaggacttgtggcagaaaagacagaagcaggtaaaggacaatgagaacgtggtcaatgagtactcctccgagctggagaagcaccaactgtatattgacgaaactgtgaactccaacattcccacaaaccttcgggtattaagatccatacttgagaatctccggagcaagatacaaaagctggaaagcgatgtgtctgcccagatggagtattgccggacaccctgcacggtatcatgtaatattcccgttgtgagcggtaaagaatgtgaggaaattatacgcaaaggcggggagactagtgaaatgtacctgattcagcctgattcgtcagtgaaaccttacagggtgtactgcgacatgaacactgaaaatggcgggtggaccgtcattcagaacaggcaggatgggtctgtggattttggtaggaaatgggatccctataagcaaggcttcgggaatgttgcgactaacacggacggtaagaactattgcggcttgcctggagaatattggctgggaaacgataagatttcacagttgacccgaatggggccgaccgagctgttaatagaaatggaggactggaaaggggataaagttaaagcccactacgggggctttaccgttcagaacgaggcgaataaatatcagatatcagtaaataaatacaggggcaccgccggtaacgccctaatggatggcgctagccagcttatgggcgaaaaccgcactatgacaattcacaacggcatgtttttttccacgtacgacagggacaatgacggatggctcacctctgatcctcggaagcagtgcagcaaggaagatgggggaggctggtggtacaatcgctgccacgcggccaatccaaacgggcggtattattggggcggacagtacacatgggacatggccaagcatggcaccgatgacggggttgtatggatgaactggaagggatcatggtactccatgcgaaagatgagcatgaaaatcaggccattttttcctcagcag

SEQ ID NO: 11326 - DNA, 1473 bp, Artificial Sequence
  Description of Artificial Sequence: Synthetic coding sequence
atgaaaaggatggtgagctggagttttcacaaactcaagacaatgaaacatttgttgcttctactactctgtgtgtttttggtcaagtctcagggtgtgaatgataatgaggagggttttttttcagcaaggggacacaggcctctcgataagaagcgggaagaagcaccatcactcaggccggccccgcctcctatatccggcggtgggtatcgggcaaggccggcgaaggccgcagccactcagaagaaagtcgagaggaaggccccagacgcagggggttgtctgcatgccgaccccgatctaggagtgctctgtcccacaggctgtcagctgcaggaggctctgcttcaacaggagcgcccaatccgcaacagcgtggacgagctgaacaataatgttgaggctgtctctcagacttcttcttcttccttccagtacatgtatctcctcaaagatctttggcagaagaggcaaaaacaggttaaggacaacgagaacgtggtcaacgaatattctagtgaactcgagaagcaccaattgtatatcgacgagacagtcaactcgaacattccaaccaacctcagggtgttacgttcgatactggagaacctgaggtccaagatccagaaactggaatccgatgtgtccgcacagatggagtattgtagaactccatgcaccgtgagttgcaatattcctgtagtgagtggcaaggaatgtgaggagattattcgtaagggaggcgagacgagcgagatgtaccttatccagcctgacagcagcgtcaagccctaccgcgtttattgtgatatgaacactgagaacggggggtggaccgtcatccagaaccgtcaggatggctccgttgatttcggccgaaagtgggacccatacaaacaggggtttggaaatgtggccaccaatacggacggcaagaattactgtggtctgccaggcgaatactggctgggaaatgacaagatcagccaactgacccggatgggccccaccgagttactgatcgaaatggaggattggaagggtgacaaagtgaaagctcattacggggggttcactgtccagaatgaagctaataagtaccaaatctcggtgaacaagtaccgcgggactgcaggaaacgctctgatggacggggcgtctcagcttatgggggagaaccgtacgatgactatacacaacggcatgttcttttcaacatatgatagggacaatgacgggtggctcactagcgacccccgaaaacaatgctctaaggaagacgggggaggttggtggtacaatagatgtcacgcggccaacccaaacggtcgctactactggggggggcagtacacatgggacatggccaagcacgggactgatgatggcgtcgtttggatgaactggaaggggagttggtatagcatgcgtaagatgagcatgaagatcagacctttttttccccagcag

SEQ ID NO: 11327 - DNA, 1473 bp, Artificial Sequence
  Description of Artificial Sequence: Synthetic coding sequence
atgaaacgtatggtttcgtggtcgtttcataaattaaaaacgatgaaacatctattactactattattatgtgtttttttagtaaaatcgcaaggtgttaatgataatgaagaaggttttttttcggcgcgtggtcatcgaccgttagataaaaaacgagaagaagcgccgtcgttacgtccggcgccgccgccgatatcgggtggtggttatcgagcgcgtccggcgaaagcggcggcgacgcaaaaaaaagttgaacgtaaagcgccggatgcgggtggttgtctacatgcggatccggatctaggtgttctatgtccgacgggttgtcaattacaagaagcgttattacaacaagaacgtccgatacgtaattcggtagatgaattaaataataatgtagaagcggtttcgcaaacgtcgtcgtcgtcgtttcaatatatgtatttactaaaagatctatggcaaaaacgacaaaaacaagtaaaagataatgaaaatgttgtaaatgaatattcgtcggaattagaaaaacatcaactatatatagatgaaacggttaattcgaatataccgacgaatctacgtgtactacgatcgatattagaaaatctacgttcgaaaatacaaaaattagaatcggatgtttcggcgcaaatggaatattgtcgaacgccgtgtacggtatcgtgtaatataccggtagtatcgggtaaagaatgtgaagaaataatacgaaaaggtggtgaaacgtcggaaatgtatttaatacaaccggattcgtcggtaaaaccgtatcgagtttattgtgatatgaatacggaaaatggtggttggacggttatacaaaatcgtcaagatggttcggtagattttggtcgtaaatgggatccgtataaacaaggttttggtaatgtagcgacgaatacggatggtaaaaattattgtggtttaccgggtgaatattggttaggtaatgataaaatatcgcaattaacgcgtatgggtccgacggaattattaatagaaatggaagattggaaaggtgataaagttaaagcgcattatggtggttttacggttcaaaatgaagcgaataaatatcaaatatcggttaataaatatcgaggtacggcgggtaatgcgttaatggatggtgcgtcgcaactaatgggtgaaaatcgtacgatgacgatacataatggtatgtttttttcgacgtatgatcgtgataatgatggttggttaacgtcggatccgcgaaaacaatgttcgaaagaagatggtggtggttggtggtataatcgttgtcatgcggcgaatccgaatggtcgttattattggggtggtcaatatacgtgggatatggcgaaacatggtacggatgatggtgtagtttggatgaattggaaaggttcgtggtattcgatgcgaaaaatgtcgatgaaaatacgaccgttttttccgcaacaa

SEQ ID NO: 11328 - DNA, 1473 bp, Artificial Sequence
  Description of Artificial Sequence: Synthetic coding sequence
atgaagaggatggtcagctggtcctttcacaaactgaagaccatgaagcatcttctgctccttctgctgtgtgtgtttttggtgaaatcacagggcgtgaacgataacgaggaaggattcttttccgcacgtggccaccgcccactggataagaagcgcgaggaggccccctccctgcgcccagcccctccccctatctctggaggcggatacagagcacgccctgctaaggctgccgccacacagaaaaaggtggaaaggaaggctccagatgccggcggctgcctgcatgccgaccccgacttgggtgtgctctgccctacaggctgtcaattgcaggaggctctgctccaacaagagcgcccaattaggaacagcgtggacgaactcaacaacaacgtcgaggctgtgagtcagactagttcctcttctttccagtatatgtacctgcttaaggacctgtggcagaagaggcaaaagcaagtgaaggataacgagaacgttgttaatgagtactcctccgagcttgagaaacaccagctctacattgacgagactgttaacagtaatattcctactaacctccgtgttctgcgctcaatcctcgaaaatttgaggagcaaaatacagaaacttgaatctgacgtgtccgcccagatggagtattgccgtaccccctgcaccgtaagttgtaatatccctgtggtcagcggcaaagagtgcgaagagatcatacgtaaaggtggcgagacttcagaaatgtatctcattcagcctgactcatcagtgaagccctatcgcgtatactgcgatatgaacacagaaaacggaggctggaccgttattcaaaaccgtcaggatggttccgtggactttggacgcaagtgggacccttataaacaaggcttcggaaatgtcgctaccaacaccgacggtaagaactattgtggacttcccggcgaatactggctcggcaacgacaagatctcccagctgacccgcatgggacctaccgagctcctgatcgagatggaagattggaagggagacaaagtgaaggcccattatggcggatttactgtgcagaatgaggctaataagtatcagatttcagtgaataagtaccgtggcacagctggtaatgccctgatggacggagcttcacagctgatgggtgagaacagaaccatgacaattcataacggaatgttcttcagtacctatgaccgcgacaacgatggttggttgaccagcgatcctcgcaagcaatgttccaaggaagacggaggtggttggtggtacaacaggtgtcacgcagccaaccctaacggcagatactattggggcggccagtacacatgggacatggcaaaacatggtaccgatgacggagtggtatggatgaactggaagggcagctggtattccatgcgcaagatgtctatgaagatccgtcctttcttccctcagcag

SEQ ID NO: 11329 - DNA, 1473 bp, Artificial Sequence
  Description of Artificial Sequence: Synthetic coding sequence
atgaagcgaatggtcagctggtctttccacaagctgaaaaccatgaagcacctcctgctcttgctcctgtgtgttttcctagtcaagagtcagggagtgaacgataacgaagagggttttttttccgcgcgaggacaccggcctttggacaagaaacgagaggaagccccctcccttcgccctgcaccacctcctatcagtggagggggataccgggcaagacctgccaaggctgccgctacccagaagaaagtggagcgcaaggcccccgatgctgggggctgcctgcatgctgaccctgatcttggggtcctgtgtcctacaggttgtcagctgcaggaagcgctactgcagcaagaaaggcccatccgcaattctgttgatgagttaaataacaacgtcgaagccgtttctcaaacaagctctagttctttccagtacatgtacctgctgaaagatttatggcagaaaaggcagaagcaagtaaaggacaacgagaatgtagtgaacgagtactccagcgagcttgagaaacaccagttgtatattgatgaaacagttaactcgaacatccccactaatctgagagtacttaggtcaatcctggagaacctgaggtccaagattcagaaactggagtccgacgtttccgctcagatggaatattgtagaactccctgtacggtgagctgtaacattcctgtggtgtcagggaaagagtgcgaggagattatccgtaaaggtggagaaacttccgaaatgtatctgatccagccagactcctccgtgaaaccgtatcgtgtttattgcgacatgaacactgaaaatggaggctggaccgtgatacagaacaggcaggatggtagtgtagactttggccggaaatgggacccatataaacagggattcggcaatgtggcaacaaacacagacggtaaaaattactgtgggttacctggagagtattggctcggcaatgataaaatcagtcagttgaccaggatggggccgaccgagctcttaattgaaatggaggactggaagggtgacaaggtgaaagcccactacggcggcttcactgtccagaacgaagcgaataagtaccagatctcagtgaacaagtataggggaacagccggaaatgcactcatggacggggcgagccagcttatgggagagaacagaaccatgaccatacacaacgggatgttcttctccacgtatgatagagataatgatggctggcttaccagtgatccgcgcaagcaatgctcaaaagaagatggggggggatggtggtacaataggtgccacgcagctaaccccaacggtcggtactactgggggggccagtatacctgggacatggcaaagcatggaaccgacgacggagtcgtatggatgaattggaagggctcctggtatagtatgagaaagatgtctatgaagattcggccattttttcctcaacag

SEQ ID NO: 11330 - DNA, 1359 bp, Artificial Sequence
  Description of Artificial Sequence: Synthetic coding sequence
atgagctggtccctgcacccaagaaatctcattctgtacttttacgcacttctcttcctgagcagcacctgcgtcgcatatgtggcaaccagagataactgttgtatcctggacgaaaggttcgggtcgtactgtcctactacctgcggcattgcagattttctttcaacttaccaaactaaggtggataaggaccttcagtccctcgaggacatacttcatcaagtcgaaaacaagacgtccgaagtgaaacaactgattaaggcaattcaactgacttacaatcctgatgaatcctcaaaaccaaacatgattgatgccgctacccttaagtctcgtaaaatgctggaggagattatgaaatacgaagcctcaattcttacccatgattcgtcaatccgctacctgcaagaaatctacaactccaataaccaaaagatcgtgaatctgaaagagaaggtcgctcagctcgaggcgcagtgtcaggaaccttgtaaagataccgtccaaatccatgatataactggcaaggattgccaagacattgccaacaagggggcaaagcagagcggcctgtactttatcaagcctcttaaggcgaaccaacaatttcttgtgtactgcgagattgacggatcgggcaacggatggacggtgtttcagaagcggctggatggatcggttgactttaagaagaattggattcaatacaaagagggtttcggtcacctgagccccaccggaaccaccgaattttggctcggcaacgaaaagatccatctcatttccactcagtccgcaatcccttacgcacttagagttgagcttgaggactggaatgggcggactagcaccgcagattacgcaatgtttaaggtgggccctgaagcggacaaataccgactgacttacgcgtactttgcgggtggagatgcaggtgacgcattcgatggttttgattttggcgacgacccctcagataagtttttcacttcgcataacggaatgcaattctcgacttgggacaatgataacgataagttcgagggtaattgtgccgaacaagatggatcaggatggtggatgaacaagtgccatgcaggtcatctgaacggagtctattaccaaggcggcacgtactcgaaggcgtcaactccgaacggctatgataacggaattatctgggcaacctggaaaactcgctggtacagcatgaaaaagaccactatgaaaatcatcccttttaaccggttgactatcggcgagggtcagcaacatcacctcggaggtgcgaaacaagtgcgtccggagcatcccgcagaaaccgaatacgattcactctacccggaggatgatctt

SEQ ID NO: 11331 - DNA, 1359 bp, Artificial Sequence
  Description of Artificial Sequence: Synthetic coding sequence
atgagctggtccttgcatcctaggaatctgatcctgtatttctacgcactcctgtttctttcgtccacttgcgtggcctatgtcgcaactcgtgataattgttgtatccttgatgagagatttggctcgtattgtccaaccacctgcggaatcgcagattttctgtcgacgtaccagaccaaggtcgacaaagatcttcaatcacttgaggacattctgcaccaagtggagaacaagacctctgaagtcaagcaacttatcaaggccattcaacttacttacaatccagacgaatctagcaagcccaacatgattgatgcagcaactcttaagtcgcgcaaaatgctggaagagattatgaagtacgaggcatcgattcttacccatgattctagtattcggtacctccaagagatttacaattcaaacaatcagaagatcgtgaatctgaaggaaaaagttgctcagctggaggcccaatgtcaagagccttgtaaggataccgtccagattcatgacataactggaaaggactgtcaggacattgcaaacaagggagcgaaacagtccggcctgtactttatcaaacctcttaaagcaaaccagcaatttcttgtgtactgtgaaattgatggctccggaaatggatggaccgtgtttcaaaaaagattggatgggtcagtggacttcaaaaagaactggattcaatacaaggaggggtttggtcacctgtccccgaccggaacgactgaattttggcttggaaacgaaaagatacacctgatttcgactcagtctgccatcccatacgcgctccgcgtagagttggaagattggaacggtagaacctctaccgcggactacgcaatgtttaaggtgggaccggaagcagataagtaccgtctcacttacgcatacttcgcaggcggtgatgccggagacgcattcgatggcttcgactttggggatgatccatcggataagttctttacctcacacaacggaatgcaattttccacctgggataacgataatgacaagtttgaaggtaactgcgcagaacaagatggatccggctggtggatgaacaaatgccacgctgggcatcttaacggggtgtactaccagggagggacctactcaaaggcaagcactcccaatggttacgataacgggataatctgggcaacgtggaaaactcgatggtacagcatgaaaaagaccaccatgaagataatccctttcaaccgccttactatcggggaaggacagcagcatcatttgggtggagcgaagcaggtgcggcctgaacatcctgccgaaacggagtacgattcactgtatccagaggacgacctc

SEQ ID NO: 11332 - DNA, 1359 bp, Artificial Sequence
  Description of Artificial Sequence: Synthetic coding sequence
atgtcttggtctctgcatcctcggaacctaattttgtacttctatgcactgctgtttctctctagcacttgtgtggcttacgtggcaacacgcgataactgctgcattctggacgagcgctttggaagctattgtcctaccacttgcggtatcgctgactttctgtccacataccagaccaaagtggataaagatttacagagtctagaagacatcctgcaccaggtggaaaacaagacttctgaagtgaagcagttgatcaaagccatccagctgacatacaacccagatgagtcctcaaaacctaacatgattgacgctgccaccctcaaaagtagaaaaatgctagaggaaattatgaagtacgaagccagtattctgacccacgactcttcaatacgctatctacaagagatctacaattctaataatcagaagatagtgaatcttaaagagaaagtggcacagttggaggctcagtgccaggaaccatgtaaggataccgtgcagattcacgacattaccggcaaggactgccaggatatagctaataaaggcgctaagcagtctggcctgtatttcataaaacctctgaaagcaaatcagcagttcctagtatattgtgagatcgatggtagcggaaatggctggacagttttccagaaaaggctggacgggtccgtggattttaagaagaactggattcaatacaaggagggcttcgggcacctgagccctacaggcactaccgagttttggctgggcaatgagaaaatacacctgattagtactcaatcagccattccatacgccctgagggtggagcttgaagattggaacggccggacttctactgctgactatgcaatgtttaaagtaggccctgaagcagataaatacagattaacatacgcctacttcgctggaggagatgctggcgacgcttttgatggcttcgactttggcgatgacccaagcgataagttctttaccagccacaatggaatgcagttttctacctgggataacgacaacgacaaattcgagggaaattgtgccgagcaagacggcagcgggtggtggatgaataagtgccacgccgggcacctcaatggtgtgtattaccaaggaggaacatatagcaaggcttccacacccaacggctacgataatggcatcatatgggccacctggaagacacgttggtactccatgaagaaaactactatgaaaataatacctttcaatcgcttaactattggtgagggtcagcaacaccacttaggcggcgccaagcaggttagaccagagcacccagccgaaaccgaatatgacagcctgtaccctgaagacgatttg

SEQ ID NO: 11333 - DNA, 1359 bp, Artificial Sequence
  Description of Artificial Sequence: Synthetic coding sequence
atgtcctggtcacttcatccacgtaatctcatcctttacttttacgccctgttgtttctcagctctacttgcgttgcatacgttgcaactcgcgacaattgctgtattctggacgagcggttcgggagctactgtccaactacatgtgggatcgcagactttttaagcacatatcagactaaggtcgataaagatctacagtcgctggaagacattctgcaccaagtggagaataagacttctgaagtaaagcagctgatcaaagctatccagttgacatacaaccccgatgaatccagcaaacctaatatgatcgacgcagcaaccctgaaaagtcggaaaatgcttgaggagatcatgaagtatgaggcctcaatcctaactcacgactcctctatacggtacctacaggagatctacaattcaaataaccagaaaatcgtcaatctaaaagaaaaggtcgctcagttggaagcacagtgccaggaaccctgtaaagacaccgtacagatccacgatattaccggcaaggactgccaagacatcgctaacaaaggcgctaagcagtcgggcctttatttcattaaacccctgaaggccaatcagcagttccttgtgtattgcgagatcgacggctccggaaacggatggacagttttccagaaacggcttgatggctctgtcgacttcaagaagaactggatccagtataaagagggcttcggacacctcagccctacggggacaactgagttctggctgggcaatgaaaagattcacctgatttccactcaatctgctatcccctacgccctacgggtagagcttgaggactggaacggcagaacgtctacagcagactacgcaatgttcaaggtggggccagaggccgacaagtaccgactgacgtacgcttatttcgcaggcggcgatgctggtgatgccttcgatgggttcgatttcggtgacgacccatctgataagtttttcacctctcataacgggatgcagttctctacctgggacaatgacaacgataaattcgagggcaactgcgcggaacaggatggcagcgggtggtggatgaacaaatgccatgcaggtcacctgaatggcgtctactaccaaggaggaacatatagtaaggcttccacccctaatggctacgataatggtatcatctgggcaacctggaaaacacgatggtacagcatgaagaagaccaccatgaagattattccatttaaccgactgaccataggggagggacagcaacatcatcttggcggcgccaaacaggttcggcctgaacatccagctgaaactgagtatgactcactatatccagaagatgacctt

SEQ ID NO: 11334 - DNA, 1359 bp, Artificial Sequence
  Description of Artificial Sequence: Synthetic coding sequence
atgagttggagccttcatccacgaaatctgattttatatttctatgccctgctgtttctgtcaagcacatgcgtcgcctacgtggcaaccagggataactgttgcattttggatgaacggtttgggtcatattgcccaaccacatgcggcatagcggactttttgagcacctaccagacgaaagtggacaaagatctgcagtcgttggaagacattttacaccaggttgagaataagacaagcgaggtgaagcagctgatcaaagccattcaattgacttacaaccctgacgagagcagtaagcctaacatgattgatgcggctactctgaaaagtcggaaaatgctggaggagataatgaaatatgaggcctctatcctgactcacgacagctcaattaggtacttgcaggagatctacaacagcaataatcagaaaatcgtgaatttaaaggagaaagttgcccagttagaggcacagtgccaagaaccctgcaaagatacagtacagatccatgacattacaggcaaagattgtcaggatatcgccaacaagggtgccaagcagagtggcctatatttcatcaagccactgaaagctaatcagcagttcctggtctactgcgagatcgatgggtcaggaaacggatggacagtgtttcaaaaacggctggatggtagtgtcgacttcaagaaaaattggatccagtataaggagggcttcggacatttgagccccactggaacaaccgagttttggctcggaaacgagaaaatacacttgatctcgacccagtcagctattccctacgctctcagggtcgaactggaagattggaatggacgaactagcacagctgattacgccatgtttaaagttggtccggaggctgacaagtaccggctaacatacgcttatttcgcagggggagacgccggcgacgcctttgacgggtttgactttggggacgaccccagcgataagttttttacatcacacaacggaatgcagttctccacatgggacaatgacaacgataagtttgaaggaaattgtgccgagcaggatgggtcgggctggtggatgaacaagtgccacgccggccacctcaacggagtgtactaccaaggaggcacttactcgaaggcttccacacccaacggctacgacaacgggatcatttgggccacatggaagaccaggtggtacagcatgaagaaaactaccatgaagatcataccattcaaccgtctcacaatcggcgaaggccaacagcaccatctggggggagcgaagcaggttagacccgaacatcctgctgaaacggaatatgactccctgtatccagaggatgatctt

SEQ ID NO: 11335 - DNA, 1359 bp, Artificial Sequence
  Description of Artificial Sequence: Synthetic coding sequence
atgagctggtccctgcatccaagaaatttgatcttgtatttctacgccctcctgtttctctcaagcacttgtgtcgcgtacgtggcgacgcgcgacaactgctgcattcttgatgagcggttcggatcgtactgtccaaccacctgtggtatcgcggactttttgtcgacctaccagactaaagtggataaggacctgcaatccctcgaggatatcttgcaccaagtcgaaaataagacttctgaagtcaagcagttgatcaaggccatccagttgacttacaacccggatgaatcgagcaagccaaacatgatcgatgccgccaccctgaagtcgagaaagatgctggaagaaatcatgaaatacgaagcatccattctgacccacgacagctcaatcagatacctgcaggaaatctacaactcgaacaatcagaagatcgtgaatctgaaggagaaggtggcacaactggaagcccagtgtcaggaaccgtgcaaagacactgtgcagatccatgatattactggaaaggattgccaggacatcgcaaataaaggcgccaagcaatcgggcctgtacttcatcaagccgctgaaggccaatcagcaattcctggtgtactgcgaaatcgatggatcggggaatgggtggaccgtgttccaaaaacgcctggatgggagcgtcgactttaagaagaactggatccaatacaaggaaggttttggacacctgtcacctactggcaccaccgagttctggttgggcaacgaaaagatccacctcatcagcactcagtcagctatcccatacgcccttcgggtggaattggaggactggaacggtcgcacttccactgctgattacgctatgttcaaagtgggcccggaagcagacaagtaccgcctcacctacgcctacttcgcaggcggcgatgcaggagacgccttcgacggcttcgacttcggagatgacccgagcgacaaattctttacctcccataatggcatgcaattctcaacctgggataatgacaatgacaagtttgagggcaactgcgccgaacaagatggttcgggatggtggatgaataagtgccatgccgggcacctcaatggtgtgtactaccagggcggaacttacagcaaggcttcgaccccaaacggttacgacaatggcatcatctgggctacttggaagacgcggtggtactccatgaagaaaaccactatgaagatcattccgttcaacagactgaccatcggcgaaggacagcagcaccacctggggggagccaaacaagtgcggccagagcatcctgcagagacggaatacgattccctctacccagaggatgacctt

SEQ ID NO: 11336 - DNA, 1359 bp, Artificial Sequence
  Description of Artificial Sequence: Synthetic coding sequence
atgtcctggagcctccatcccagaaatctgatcctgtatttctatgcattgttgttcctgtctagtacctgtgtggcgtacgtggccacgcgggataattgctgcatactcgacgagcgttttggaagctattgccccacgacttgcggaatagcagactttctgtccacctaccagacaaaggtggataaggaccttcaatccctggaagacattttgcatcaagtcgagaataagacgagcgaagtgaaacagcttatcaaggcgatccagcttacctacaaccctgatgaaagctccaagcccaatatgatcgatgcggcaacccttaaatcgaggaaaatgcttgaagagattatgaaatacgaggcaagcatactgactcacgattcctccattagatacctccaggaaatttataatagcaataaccagaaaatagtaaacctgaaagaaaaggtcgcccagctagaagcccagtgccaggagccctgcaaagataccgtacagattcacgatatcaccggcaaggattgccaggatatagctaacaagggcgctaaacagtcaggactgtacttcatcaagccattgaaggcgaatcagcaattcctggtttactgcgaaattgatgggtcgggcaatggctggaccgtcttccaaaaaaggttggatgggtccgtggatttcaagaaaaactggattcaatacaaagaagggttcgggcatttgagccctacaggaacaactgaattttggctgggaaacgaaaagatccacctcataagcacccagagcgctatcccttatgctttgagggtggaactagaagattggaacgggcggacttcaacggccgactacgctatgttcaaggtcggcccagaagccgacaagtataggctcacgtatgcttatttcgcgggcggagatgcaggtgatgcgttcgacgggttcgattttggggacgatccaagcgataagttttttaccagccataacgggatgcagtttagcacatgggacaacgacaacgataagttcgagggtaactgtgcagagcaggacgggagtggctggtggatgaataagtgtcatgcaggccatcttaacggagtatactatcagggaggaacatattccaaggccagcacccccaatggatacgacaatgggatcatttgggccacctggaaaacaaggtggtactccatgaagaagactacaatgaaaattatcccgtttaaccgccttactatcggtgagggacagcagcaccatctaggtggcgcaaaacaggtcagacccgagcaccccgctgaaaccgagtacgactctctttatcctgaagatgacctg

SEQ ID NO: 11337 - DNA, 1359 bp, Artificial Sequence
  Description of Artificial Sequence: Synthetic coding sequence
atgtcctggtccctacacccaaggaacctcatcctgtacttctacgccctactgtttcttagcagtacttgtgtagcgtatgtcgctaccagggacaattgctgcatcctggacgagcggttcggcagctactgccccaccacctgcggtatagctgatttcctctccacctaccagacaaaggtcgacaaagatctacagtcactggaggatatcttacatcaggttgaaaataagacctcagaggtgaaacagttgattaaggcaatccagttaacctataaccctgacgagtccagtaagccaaatatgattgacgccgccaccctcaagagcagaaaaatgctcgaggagattatgaaatatgaggcctcaatcctgacccacgactctagtatccgctacctgcaggagatttataactccaataatcaaaagatcgtcaaccttaaggaaaaagtcgctcagttggaggcacagtgccaggaaccatgcaaggacactgtccagattcatgacattactggtaaggactgccaggacattgccaacaagggcgccaaacaatccgggctttacttcattaagccactgaaggcaaatcagcagttccttgtctactgcgagatcgacggttctggtaacggctggaccgtgttccaaaaaaggcttgatgggagtgtcgattttaagaagaactggatccagtacaaggagggcttcggacatctgtctccaactggtacaacggaattttggctgggaaatgagaagatccatctcatctcgactcagagtgcgatcccatatgctctgcgggtggagttagaagattggaacggcagaacaagcacagctgactacgcgatgttcaaggttggtcctgaggctgacaaataccgactcacttacgcctactttgctggcggggatgcaggcgatgccttcgacggcttcgacttcggtgacgatcctagcgataaattctttacgtcccataacgggatgcaattttccacgtgggacaacgataatgacaagttcgaggggaattgcgcagaacaggatggttcgggttggtggatgaataagtgtcacgccggacatttgaatggggtgtactatcagggcgggacatactccaaggcctctaccccaaatgggtacgataacggcattatatgggcaacatggaaaacccggtggtactccatgaaaaagaccacgatgaaaatcatccccttcaaccggttgacaatcggcgagggacagcagcaccacctgggcggagccaagcaggtcaggcccgaacaccccgccgagaccgagtatgattctctttatcctgaggacgacctg

SEQ ID NO: 11338 - DNA, 1359 bp, Artificial Sequence
  Description of Artificial Sequence: Synthetic coding sequence
atgagctggtcgctgcacccacggaaccttatcctctacttctacgccctcttgttcctctcatcgacttgcgttgcatacgtcgccactagggataactgctgtattttggacgaacgcttcggaagttactgcccaacgacctgtggcatcgcggatttcctctcgacctaccagaccaaggtggacaaggacctccagtcgcttgaggatatcctgcaccaggtcgaaaacaagacgtccgaggtcaaacaattgatcaaagcaatccagctgacgtacaacccagatgagtctagcaaacctaatatgattgacgcggcgacgctgaagagcagaaaaatgcttgaagagataatgaagtacgaggccagcattctcactcatgattcctcgattagataccttcaagaaatctacaattcgaacaaccaaaagatcgtcaacctgaaggaaaaggtggctcaactggaggcccaatgtcaggaaccctgcaaagataccgttcagatccacgacatcactgggaaggactgccaggatatcgctaacaagggtgccaagcagtcaggactctactttatcaagcctctgaaggctaaccagcaattcctggtgtattgcgagatcgacggatcaggaaacgggtggactgtgttccagaagcgcctggacggatcagtggatttcaaaaagaattggattcagtacaaggaaggattcgggcacttgtccccaactggcactactgaattctggctgggaaacgagaagatccacctgatctccactcagtcggcgataccgtacgcactccgagtcgaactggaagattggaatggccggacctctactgcagactatgccatgttcaaggtcggccctgaagccgacaaatacaggctcacctacgcgtacttcgctggtggggacgccggcgacgcctttgacggattcgatttcggcgacgacccaagcgacaagttcttcaccagccataacggaatgcagttctcaacctgggacaacgacaacgacaaattcgaggggaattgcgcggaacaagacggatcgggatggtggatgaataagtgccacgctggccacctgaacggtgtatactaccagggcggaacttacagcaaggcaagcactccgaatgggtatgacaacggaatcatctgggccacctggaaaactagatggtactcgatgaaaaagactactatgaaaatcatcccattcaaccggctgaccatcggggagggccagcagcatcatctcggaggtgccaagcaagtgcgccctgaacatccagccgagacggaatatgacagcctgtacccagaagatgatctt

SEQ ID NO: 11339 - DNA, 1359 bp, Artificial Sequence
  Description of Artificial Sequence: Synthetic coding sequence
atgtcatggtcacttcatccaagaaaccttattctttacttttacgcgcttctgttcctctcgtccacttgcgtggcgtacgtcgcaacccgggacaactgctgtatactcgacgaaaggttcggatcgtactgcccaacgacgtgcggaattgctgactttctgtcgacctaccagactaaggtggataaggatcttcagtctcttgaagatattctgcatcaagtggaaaacaagacttctgaagtgaagcagctgattaaggcaattcaactcacttacaaccccgatgaaagttcaaaaccgaatatgattgatgcagccaccctgaagagcagaaagatgctggaggagataatgaaatatgaagcctcgatccttacccatgattcctcgatcaggtacctccaggagatctacaactcgaataatcagaaaattgtgaatcttaaagaaaaggtcgcacagctggaggcgcaatgtcaggagccgtgtaaagatacggtgcaaatccacgatatcaccggtaaggattgtcaagatattgccaacaagggagcaaagcagtccggcctctactttatcaaacctctgaaggctaatcagcaatttctcgtctactgtgaaatagacgggagcggtaacggatggaccgtctttcaaaaacggttggacggtagcgtcgactttaagaagaactggattcagtacaaagaaggctttggtcatttgtcgcctactgggactacggaattttggctggggaatgagaagattcatctcatctccactcaatcagccattccctacgctctgcgcgtggaacttgaggattggaacgggagaacttcgaccgcagattatgcgatgtttaaagtaggacctgaagcagacaagtaccggttgacctatgcgtacttcgcaggcggtgatgcgggtgatgcttttgatggattcgattttggtgatgacccatcagataagttcttcacctcccacaacggtatgcaattcagtacctgggataacgataatgataagttcgaaggtaattgtgcagaacaagacggctccgggtggtggatgaacaaatgtcacgcagggcatctgaatggtgtgtactaccagggaggaacttacagcaaggcatctaccccaaacggatacgacaacggaatcatttgggcaacttggaaaactaggtggtactccatgaagaaaaccactatgaagataattccttttaaccgcctcactatcggcgagggccagcaacaccatcttggcggagcgaagcaagttagacccgaacaccctgcagaaactgagtacgattcactctaccctgaggacgatttg

SEQ ID NO: 11340 - DNA, 1359 bp, Artificial Sequence
  Description of Artificial Sequence: Synthetic coding sequence
atgtcatggtccctccatccgagaaatcttatcctatatttctatgcgctgctgtttctgtcaagcacctgcgtagcctacgttgctacaagggataattgctgtatcctcgacgaacggtttggctcttattgtcctactacctgtggaattgccgacttcttatcgacatatcaaactaaggtagataaggacctgcagtcgctcgaggatattctacaccaggtggagaataaaaccagcgaagtgaagcagttgatcaaggccatccagcttacctacaatccggatgaaagctccaaaccaaacatgatcgatgccgccaccttgaagagcaggaaaatgttagaggaaataatgaaatatgaagccagtatcctgactcatgactccagtatccggtatctgcaggaaatctataattccaacaatcagaagattgtcaacctcaaagagaaggtggctcaactggaggctcaatgtcaggagccatgcaaagacacagttcaaatacacgacattaccgggaaggactgccaggatatcgccaacaagggggcaaaacaaagcggtctttacttcataaaacctctgaaagccaaccagcagtttttggtgtactgcgaaatagacggatcggggaatgggtggactgtgttccagaagcgtttagatggctctgtcgatttcaagaaaaactggatccagtacaaagaagggtttggtcacctcagccccacaggtacaaccgagttttggctggggaatgagaaaattcaccttatctccacacaatccgcgatcccatacgccttgcgcgtggagctggaggattggaatgggcggacctcgacagctgactacgccatgtttaaggtgggacctgaggcggataagtacagactgacctacgcttactttgccgggggggacgcgggggacgcatttgacggcttcgacttcggtgacgatccctctgataagttttttacctcccacaatggcatgcagttttcaacgtgggacaatgacaacgataagttcgagggcaactgcgcagagcaggacgggtcagggtggtggatgaataagtgccacgcaggtcaccttaatggagtatattaccagggcggtacatattcaaaagccagcactcccaacggctacgacaacggtattatttgggccacctggaaaacccgctggtacagcatgaagaagactactatgaagatcatcccgtttaacaggctgactatcggggagggccagcaacaccacctgggcggcgcaaaacaagtgcgtcctgaacaccccgcggaaacggagtacgattccctttatcccgaggatgatctt

SEQ ID NO: 11341 - DNA, 1359 bp, Artificial Sequence
  Description of Artificial Sequence: Synthetic coding sequence
atgtcttggagtctgcatccaaggaatttaattttgtacttctatgccctccttttcttgtcatctacctgtgtggcctatgtggcgaccagggacaattgctgcatcctggacgaacgcttcggctcctactgccccaccacctgcgggatcgcagatttcttgtcaacataccagacaaaagtcgacaaggatctgcagagcctggaagacattctgcaccaggttgaaaataagaccagcgaggtgaagcaactcattaaagccatacagctaacctataatcccgacgagtcctcgaagcccaacatgattgacgccgcaacactgaaaagcaggaaaatgcttgaagaaattatgaagtatgaagcatcaattttaactcacgatagctccatccggtatttgcaggaaatctacaattctaataatcaaaaaatcgtgaacctcaaagagaaggttgctcaattagaggctcagtgccaggaaccttgcaaggataccgtgcaaatccatgatatcactggcaaagattgtcaagacattgcaaataagggtgcaaagcagagtggcttatactttataaagccactaaaggctaatcagcagtttctggtgtactgtgagatcgatggcagtggcaatggatggacagtctttcagaagaggcttgatggctctgtggattttaagaaaaattggatccaatacaaggaagggtttggccatctctctcccacgggcaccaccgagttttggctgggaaacgagaagatacacctcatcagcacacagagcgcaattccctatgctctgcgggtggagttggaagattggaacggacgtaccagcacagcggactatgcaatgttcaaggtgggcccggaggcggataagtacaggctaacatatgcttatttcgctggaggcgatgccggcgatgcgttcgacggattcgactttggtgatgacccaagcgacaagttctttacatcccataatgggatgcagttttccacgtgggataatgacaacgacaagttcgagggaaactgtgcagagcaggacggctcgggctggtggatgaacaaatgtcacgctggtcaccttaacggcgtctactatcagggtggcacctattctaaagcgtcgaccccaaatggatacgataacgggatcatatgggctacctggaagactcggtggtattccatgaaaaagaccaccatgaagatcattccatttaatcgcctgacaataggggagggacaacaacaccatttgggcggagcaaagcaagtgcgccctgaacaccccgcagaaactgaatacgactcgctgtacccagaggatgatctg

SEQ ID NO: 11342 - DNA, 1359 bp, Artificial Sequence
  Description of Artificial Sequence: Synthetic coding sequence
atgtcttggtctctacacccaaggaatctgatcctgtatttctacgcactgctgttcttgagttctacctgtgttgcttacgtcgccacccgtgataactgttgcattctagatgaaaggttcgggagctactgcccgaccacttgtggcattgctgatttcctctcaacataccagacaaaagtcgacaaggatctgcaatccctagaagatatcctccaccaagtcgagaataaaacatcagaggttaagcaactgattaaagcgattcagttaacttataaccctgatgagtcttccaagcctaacatgattgatgccgccaccctaaaatcacgcaagatgttggaggaaattatgaagtatgaagcgtctattttaactcatgactccagcattcgctatctacaggagatttataatagtaacaatcagaaaatagttaatctaaaagagaaagtcgcccaattggaagcgcaatgccaggaaccatgtaaggataccgtccaaattcacgacatcactgggaaagactgccaagatatcgctaacaagggggctaagcagtctggtctgtacttcatcaagcctctaaaggcaaaccaacagttcttggtttactgtgaaatcgatggttctggcaacggatggacagtgttccaaaaacgcctggatggctccgtagattttaagaaaaactggatccagtataaggaaggcttcggccatctgtcgcctaccgggacgactgagttttggctaggcaatgagaagatccacttaatcagcacgcaatccgctattccgtacgccctcagagtggaacttgaggattggaacggccgtacatcaaccgcagactacgcgatgttcaaagttggacctgaagccgataaataccggttaacgtatgcttacttcgccggaggcgatgcaggagacgcctttgatggattcgacttcggcgatgatccttcggataaatttttcactagtcacaatggaatgcagttcagtacatgggacaatgataatgataaattcgagggcaattgcgcggagcaggatggcagcggatggtggatgaataaatgccacgcaggtcatttgaacggtgtgtactaccagggcggcacctactccaaggcatcaactcccaatgggtacgataatgggataatctgggcaacatggaaaactcgttggtactcgatgaagaagactaccatgaagattattccgtttaatcgcctaacgatcggagaaggacaacaacaccatttaggtggagccaagcaagttcgcccggaacatccagctgagaccgagtatgactccctttatccggaggatgatctt

SEQ ID NO: 11343 - DNA, 1359 bp, Artificial Sequence
  Description of Artificial Sequence: Synthetic coding sequence
atgtcatggtcccttcatccaagaaatctgattctttatttttacgcacttttgtttcttagctctacgtgtgtggcatatgttgctacgcgcgacaactgttgcatactggatgaaagattcgggtcatattgcccgacaacgtgcggaattgctgactttctttcaacttatcaaactaaggtcgataaagatttacagagcttagaagatatcttacatcaagtggagaacaaaacatcagaagttaaacagttaattaaagcgattcagctgacttacaacccagatgaatcatctaaaccgaacatgattgatgccgcaacccttaaaagtcgcaaaatgcttgaagaaataatgaagtacgaggcctccattcttacacatgattcatcaatccgttatttacaggaaatttataactcaaacaaccagaaaattgtaaacttaaaggaaaaagtcgcacagctggaagcacaatgccaagaaccctgtaaagatactgtccaaattcatgatatcacgggcaaagattgtcaagatattgcaaacaaaggagctaaacagtcgggcctttactttattaagccattaaaggcaaaccagcagtttctggtctactgcgagatagatggaagcggaaatggctggaccgtgtttcagaaacgtctcgatggcagcgttgactttaaaaagaactggattcagtataaagaaggctttgggcatttgagcccaaccggcaccacagagttctggctgggaaacgaaaaaattcatcttatctcaacacagtcggctatcccttacgcgctgcgggtagaattggaggattggaatggcagaacatcaacggccgattatgcaatgtttaaagtcggacctgaggcggataagtacagattaacatatgcatatttcgccggaggcgatgctggcgatgcttttgatggttttgatttcggagacgatccgtcagataaattttttacatctcataacggtatgcagttttcaacgtgggataacgacaacgataaattcgaaggcaactgcgctgaacaggatggttctggatggtggatgaacaaatgccatgcggggcatctgaatggcgtctactaccaaggtgggacatattcgaaagcgtcaacgccaaatgggtatgacaatggcataatatgggccacttggaaaacccgctggtattctatgaaaaaaaccacaatgaaaattattccatttaatagattgaccattggagaaggccaacaacatcatctcggcggagctaaacaagtgcgccctgaacatcctgcggagacagaatatgattcactgtatccagaagatgatctc

SEQ ID NO: 11344 - DNA, 1359 bp, Artificial Sequence
  Description of Artificial Sequence: Synthetic coding sequence
atgtcctggtcgctgcatccgcggaacctgatcctctacttttacgcgctgctcttcctttcgtcgacctgcgtcgcgtacgtcgccacccgcgacaactgttgcatccttgatgagcggttcggatcctactgcccgaccacttgtggtatcgccgatttcctgtcgacgtaccagaccaaggtggataaggacctgcagtcactggaagatattctgcaccaggtggaaaacaagacctcagaagtaaagcaacttatcaaagccatccagctgacctacaacccagacgagtcatccaagcctaacatgatcgatgcagctactctcaagtcacgtaaaatgcttgaggagatcatgaaatacgaggcttcaatcctgactcatgattccagcatccgctacctccaagagatatacaactcgaacaatcagaaaatcgtgaatctgaaggaaaaagttgcccaattggaagcacaatgccaagagccgtgcaaggacaccgtgcagattcacgacatcactggaaaagactgccaggatatcgcaaacaagggagccaaacagtcgggactgtacttcatcaagcccctgaaggccaatcaacaattcctggtgtattgcgaaattgacggatcgggaaatgggtggactgtctttcagaagcggctggatggatcagtggacttcaaaaagaactggattcagtacaaggagggttttgggcacttgtctccaacgggaaccacggaattttggctcggaaacgagaaaattcacctcatctcaactcagtcggccatcccatacgccctgcgggtcgaactcgaggattggaacggacgaaccagcaccgccgactacgccatgttcaaggtcggacccgaagccgacaagtaccgcctcacttacgcgtactttgctggtggagacgctggagatgcgttcgacggattcgatttcggagacgatccgtccgacaaattcttcaccagccataacgggatgcagtttagcacttgggacaatgacaatgacaagttcgaagggaattgcgccgaacaggacggctctggatggtggatgaacaagtgccatgcgggacacctcaatggggtgtactatcagggagggacctactccaaggccagcactccaaacggttacgataacgggatcatttgggccacttggaaaacccggtggtactcaatgaagaaaaccaccatgaagatcatcccctttaatcggctgaccatcggagagggacagcagcatcacctgggaggagcgaagcaggtgcgccctgaacacccggcggagacggaatacgactctctgtacccagaagatgacctg

SEQ ID NO: 11345 - DNA, 1359 bp, Artificial Sequence
  Description of Artificial Sequence: Synthetic coding sequence
atgagctggagcctgcatccaagaaacctgattctttacttctacgcactcctattcctctcatcaacttgcgtggcttacgtcgccacccgagacaactgttgtattttagacgagcgctttggaagttattgtccaactacctgtggaatagctgatttcctatcgacatatcagacgaaagtcgataaagatctgcagagtctcgaagacatattgcaccaggtggaaaataagacgtcagaagttaagcagttaatcaaagccatacagcttacatacaacccagacgaaagttctaaaccaaacatgattgatgcggcaactcttaagtcccgtaagatgctcgaggaaatcatgaagtatgaggccagcattctgacgcatgattctagcatccgctatctacaagaaatatacaactccaataaccagaagatcgtcaatctcaaggagaaggtcgctcagctggaagcccaatgccaggaaccgtgtaaggataccgtgcagatccatgacatcacaggaaaggattgtcaagacatcgccaacaagggcgccaagcaatcaggactgtacttcattaagcccctgaaggccaaccagcagtttctggtttattgtgagatcgatggctctggtaatggatggaccgtgttccagaaaaggctggatgggagcgtggatttcaagaaaaactggatacaatacaaagaaggctttggccacctgagtcctactgggaccaccgaattttggctcggaaatgagaaaatacatctcataagcacccagagcgccatcccctatgctttgcgggtggagctggaagactggaacggccgaacgagtacagccgattacgctatgtttaaggtgggcccagaagcagacaaatacaggttaacttacgcatacttcgccggcggcgatgcaggagacgcctttgacggttttgattttggagatgatccttccgacaagttcttcaccagccataacggcatgcagttcagtacatgggataacgacaacgacaaattcgagggtaattgcgcagagcaggacgggtccggatggtggatgaataaatgccacgctggccacctgaacggagtttactaccagggcggcacatacagtaaggcatctacaccaaatggatatgataatgggatcatctgggcaacatggaagacccgctggtattctatgaaaaagacaaccatgaagatcatcccatttaaccggctgaccataggtgaaggccaacaacatcatctgggcggggccaagcaggtgcggccagagcaccctgctgagacagaatacgactcactttatcccgaagatgatcta

SEQ ID NO: 11346 - DNA, 1359 bp, Artificial Sequence
  Description of Artificial Sequence: Synthetic coding sequence
atgagttggagcttacacccacgcaatcttatcctctacttctatgccctgctattcctttccagcacatgcgtggcttacgtggctactcgggataattgctgcatactggatgaacggtttggcagctattgccccactacatgtgggattgctgatttcttgagtacataccaaacgaaagtggataaagatctccagagcttggaggacatactacatcaggttgagaataaaacatccgaagtgaaacagcttatcaaagcaatccagctcacgtacaaccctgacgagtcttcaaagccaaatatgattgacgcagcgacactcaagagccgcaagatgctcgaggaaatcatgaagtatgaggcaagcatcctgacacacgacagcagcattagatatcttcaggagatatacaacagtaacaatcaaaagattgtgaatcttaaggagaaagtggcacagctggaggcacagtgccaggaaccgtgtaaagacaccgtccagattcacgacattaccggcaaggattgccaggacattgcaaataaaggggccaagcagtctggcctgtacttcatcaaacccctcaaggccaaccagcagttccttgtgtactgtgagatagatgggtccggcaacgggtggacggtattccagaagagattggacggcagtgtggactttaagaaaaactggatacagtataaggaaggattcggtcacctgagccctaccgggacgactgagttctggctcgggaacgagaagatccacctgatctctactcaaagcgctattccatacgccctgagagtggagctcgaggactggaatgggcgtacaagcaccgctgattacgctatgtttaaggtgggtcctgaggctgacaagtaccgtctgacttatgcatacttcgcaggaggagacgcaggggatgcttttgacggatttgatttcggcgatgatccctctgataaattttttacttcacacaacggaatgcagttttcgacgtgggataacgacaatgacaaatttgagggtaactgcgccgagcaagatggaagcggctggtggatgaataagtgccacgctggccatttgaacggagtttattatcaggggggcacttatagcaaagcgtctacccccaacggatatgacaacggcattatttgggccacatggaagacacgatggtactctatgaagaaaacgaccatgaagatcattccattcaatcgcctcaccatcggcgagggacagcagcatcatttggggggggctaaacaggtccgcccagagcacccagcggaaacagagtacgattccctgtaccccgaagatgatcta

SEQ ID NO: 11347 - DNA, 1359 bp, Artificial Sequence
  Description of Artificial Sequence: Synthetic coding sequence
atgtcatggtcgcttcacccccgaaacttgattttgtacttttatgctcttcttttcttgtcatctacgtgcgttgcctacgtcgctacccgagataattgctgtatccttgacgaaagattcggttcttattgtcccacgacatgtggaattgcggacttcctttccacatatcagaccaaagtcgataaagatcttcagtcgctggaagacatccttcaccaagtggaaaataagaccagtgaagttaagcagctgatcaaggccatacaacttacctacaatccagatgaaagcagtaaacctaatatgatcgatgcagcaacattaaaatcgagaaaaatgcttgaagaaatcatgaaatatgaagcaagtattcttacccacgactcatcaattagatatcttcaggaaatatacaattccaataaccaaaaaatcgtgaatcttaaggaaaaagtcgcccagcttgaagctcaatgtcaagaaccgtgcaaggacacagttcaaatacatgacattaccggaaaagactgccaggacattgcaaataaaggagcaaagcagagcgggctttattttattaaacccctgaaggcaaatcagcaattccttgtatattgtgagatagacggatctggcaatggatggactgttttccagaagcgactggatggaagtgtggacttcaaaaaaaattggattcagtataaggaaggatttggtcacctgtcaccgacaggaacaactgaattttggttgggaaatgaaaagatccacctgattagtactcaaagtgccattccttacgccctacgagttgaattggaggactggaatggacgaacatcaaccgctgattatgctatgtttaaggtcggaccagaagcagataaataccgtttaacctacgcctactttgctggtggtgatgctggagacgcatttgatggtttcgacttcggtgatgatccatcagacaaatttttcacatcccataatggaatgcaatttagcacatgggacaacgataatgataagtttgagggaaactgtgcagaacaggacggatcgggctggtggatgaataagtgccatgcaggacaccttaatggagtctactatcagggaggaacttacagtaaggcatctacgccaaacggatatgacaatggaattatttgggccacatggaagacaagatggtatagcatgaaaaaaacgactatgaagattatcccatttaaccgattgacgatcggagagggacaacaacatcatctgggaggtgctaaacaggttaggccagagcacccagcagaaactgaatatgatagtttgtacccagaggatgacctc

SEQ ID NO: 11348 - DNA, 1359 bp, Artificial Sequence
  Description of Artificial Sequence: Synthetic coding sequence
atgtcttggtccttacatccaagaaaccttatcttgtatttctatgccctcctgttcctctcaagtacctgtgtggcgtacgtggcaacccgggacaattgttgtatcttggatgagcgttttggctcctattgtcccaccacatgcggaatcgcagatttcctctccacttatcagactaaggttgataaagacctgcaaagcctggaggacatcctccaccaagtggagaataagactagcgaagtgaaacagctgatcaaagccatccagctgacttataatcctgatgaaagctctaaacccaacatgatcgacgccgctactctgaaatcaagaaaaatgctggaagaaatcatgaagtatgaagcctcaattctgacccatgattcctctatccggtatctgcaggagatttataactcaaacaaccagaagatcgtcaacctcaaagagaaagttgcccagttggaggcccagtgtcaggagccctgtaaggacaccgtgcagatccacgatatcacaggtaaggattgtcaggacattgctaacaagggtgctaagcagagcgggttatatttcataaagccattgaaagctaaccaacagttcctggtgtattgcgagatcgatggcagcggcaatggttggacggtgttccagaaacgcctggacggctcggttgactttaaaaagaactggatccagtacaaagaaggatttgggcacctgtccccaacaggtacaacagagttttggctggggaacgagaaaattcacctcatctccacccagagcgccattccgtacgcgctccgagtggagctggaagattggaatgggagaacttctaccgcagactatgccatgtttaaggtggggccggaagccgacaagtaccgcctcacatatgcatattttgcaggaggcgatgccggcgacgcattcgacgggtttgactttggggacgatccatcagacaagtttttcacaagccacaatggaatgcagttttcaacgtgggacaacgacaacgacaaatttgagggaaactgcgctgagcaggatggaagcggctggtggatgaataaatgccatgcaggccatctgaacggggtttactaccaggggggaacttatagtaaggcttccacaccaaatgggtatgacaacggcatcatttgggctacctggaagaccagatggtatagtatgaaaaaaacgacaatgaagattatccctttcaatcgcttaaccattggcgaggggcagcaacatcatctcggtggagccaaacaggtgaggcctgaacatccggcggagacagaatatgactccctgtacccggaggatgacctg

SEQ ID NO: 11349 - DNA, 1359 bp, Artificial Sequence
  Description of Artificial Sequence: Synthetic coding sequence
atgtcgtggtcgctgcacccccgtaacctgatcctctacttctatgccctcctgtttctgagcagtacctgcgtcgcctacgtcgctacgcgcgacaattgttgtatcctcgatgaacgattcggttcctactgccccaccacatgcgggatcgctgatttcttgagcacctaccagaccaaggtggacaaggatctccaatccctggaggacatcctccaccaggtcgagaacaagaccagtgaggtcaagcagcttatcaaggccatccagcttacgtataacccggatgagtcttcgaaacccaacatgatcgacgccgctacgctcaagtcccgtaaaatgctcgaggagattatgaagtacgaagcatctatactgacgcacgattcctccatccgttacctccaggagatttataactctaacaaccagaagatcgtgaacttgaaggagaaggtcgcccagcttgaggcccaatgccaggaaccctgcaaagatactgtccagattcacgatatcaccggcaaggactgccaggacatcgctaacaagggtgctaagcagtccggcctgtactttatcaaacctctcaaggccaaccagcagttcctggtatactgcgagatcgatggttcaggcaacggttggactgtgttccaaaagcgcctggatgggtctgttgatttcaagaaaaactggattcagtacaaggagggcttcggccacctgtcccccaccggcaccactgagttctggctcggaaacgagaagatccacttgatctccacgcaatccgccatcccctacgctctccgcgtcgaactggaagattggaacggtcgaacatctactgcggactacgcgatgttcaaagtgggccctgaagccgataagtaccgtttgacttatgcctatttcgctgggggtgacgccggtgatgccttcgacggattcgatttcggagatgacccgtcagataagttcttcacctctcacaatggcatgcagtttagcacctgggacaacgacaatgacaagttcgagggcaattgcgccgagcaggacggcagcggttggtggatgaataagtgtcacgctggccacttgaatggcgtgtactaccagggcggcacctacagcaaagcgagcacgcctaacggctacgacaacggaattatttgggctacctggaaaacccgctggtattccatgaagaagaccacgatgaagatcatccctttcaaccgcctgaccattggagagggacagcagcatcacctcggcggagccaagcaagtgcgtcccgagcaccctgcagagaccgagtacgactccctttacccagaagacgacttg

SEQ ID NO: 11350 - DNA, 1359 bp, Artificial Sequence
  Description of Artificial Sequence: Synthetic coding sequence
atgtcatggagcttacaccctaggaatctcatcctgtacttttacgccctcctgtttctgtcatccacatgcgtcgcttacgtggcaactcgggataactgctgcattctcgatgaaagatttgggtcatactgccctacaacttgcggtattgccgatttcctgtcgacataccagaccaaggttgacaaggacctgcagagcctagaggacatcctgcaccaggtggaaaataaaactagcgaggtaaaacagctgataaaggccatacagcttacttacaacccggatgagtcgagcaagccaaacatgattgacgccgctacacttaaaagcagaaagatgctcgaggagattatgaagtatgaggcctcgattctgactcacgattcatcgatcagatacctgcaagagatttataatagtaataaccaaaaaatcgtgaacctaaaagagaaggttgctcagcttgaagcgcagtgtcaagagccatgtaaggacacggtgcaaattcacgatattacgggcaaggactgtcaggatatcgcaaacaagggcgccaaacagagcggcctgtactttatcaaaccactgaaagctaaccagcaatttctggtctattgcgaaatcgacggatccggtaatggttggacagtgttccagaagcggctcgatgggtcggttgacttcaaaaagaattggattcagtacaaagaaggattcggccatctgtctcccacaggaacaacggaattctggttaggaaatgagaagattcacctcatctccacacagtcagccattccttatgcactcagagtggaactggaggactggaacgggcgtacttccacggcggactatgccatgtttaaagttggacctgaggcagataaataccgcctgacctacgcctatttcgcaggcggcgatgcaggtgacgcattcgatggctttgattttggtgacgacccatccgacaagttctttacctcccacaacggaatgcagttttctacatgggacaatgacaatgataagttcgaagggaattgcgctgaacaggatggatcaggctggtggatgaataagtgtcacgccggccatctcaatggagtgtattatcaggggggtacttactcaaaggcatcaactcccaacgggtatgacaacgggattatctgggcgacctggaaaacccgctggtactctatgaaaaagaccacaatgaagataattcccttcaacagattaaccatcggagagggtcagcagcatcatctggggggagccaaacaagtgcgaccagagcatccagccgagactgagtatgattccttatatccggaagacgatctc

SEQ ID NO: 11351 - DNA, 1359 bp, Artificial Sequence
  Description of Artificial Sequence: Synthetic coding sequence
atgtcttggtcactccacccgcgaaatcttatcctttacttctacgcccttctgttcctgtccagtacatgtgtggcgtacgtggcaacccgcgataattgctgtatcttagacgagcgcttcggatcatattgcccaacgacttgcggcatcgccgacttcttgtcaacgtatcagaccaaggttgacaaagatctccaatcgctcgaggacatcctccaccaggtcgagaataaaacatcggaggtgaagcaactcatcaaagccatacagctgacttacaatccagatgagagttccaaacctaatatgattgatgcggccactctcaagtctcgaaagatgctagaggaaatcatgaagtacgaggccagcatacttacgcatgactcgtccatccgttacttgcaggagatctacaacagtaacaaccaaaagattgtgaatctgaaggagaaggtggcgcagctggaggcacaatgccaggagccctgcaaggatacagtgcagatacatgacatcacaggcaaagattgccaagacatcgccaacaagggcgcaaagcagtcgggcctgtacttcatcaaaccactaaaagccaaccaacagttcctggtgtactgcgagatcgacggttcgggaaatgggtggaccgtgttccagaaacgcctagatggttcggtagactttaagaagaattggatccagtacaaggagggtttcggtcacttgagccccacagggactaccgaattctggctgggtaacgagaagatccacttaatttctactcaatcggccatcccctacgcgctgagggtggagctagaggactggaatgggcgcaccagcacagccgattacgcgatgttcaaggtgggccccgaggctgataagtaccggctcacatacgcctacttcgcaggcggcgatgccggcgatgctttcgatggcttcgacttcggcgacgatccctccgataaattttttacgtcccataatggtatgcagttcagtacgtgggataatgacaacgacaagtttgaaggcaattgcgccgagcaggatggttccggctggtggatgaataagtgccacgccggccacctgaacggagtgtactaccagggtggcacatactctaaggcctcgactccgaacggttatgacaatggcattatttgggctacgtggaagaccaggtggtactccatgaagaagaccacgatgaagattataccctttaaccgtttgacgatcggcgagggccaacaacaccacttgggcggcgctaagcaagtgagaccggaacacccagcagaaactgagtatgatagtttgtaccctgaggatgatctc

SEQ ID NO: 11352 - DNA, 1359 bp, Artificial Sequence
  Description of Artificial Sequence: Synthetic coding sequence
atgtcctggtccctgcatcctcgtaacctcattttgtatttttacgcgctactctttctctcaagcacctgcgttgcgtacgtcgccacacgcgataattgttgcatactggatgagcgcttcggtagctattgtccgacgacctgcggcattgctgattttctgtccacgtatcagaccaaggtagacaaagacctccagtccctcgaagacatcttgcaccaagtggagaacaaaacctctgaggttaagcagctgattaaggcaatccagctcacgtacaacccagatgagtctagcaagcctaacatgatcgatgcagctaccctgaagagccgcaaaatgctggaagagattatgaaatatgaggcgtctattctgacccatgactccagcatccgctacctgcaggaaatctataactcgaataatcaaaagatcgtgaacctgaaggagaaagtggctcagctggaggcacaatgccaggagccgtgtaaggatacggtgcagatccacgacataaccgggaaggactgccaagatatcgctaataagggcgccaagcagagtggcctgtactttattaagcctctgaaagcgaatcaacagttcctggtttattgtgagattgacggttctggcaatggatggaccgtttttcaaaaacgtcttgacggcagcgtcgactttaagaaaaactggattcagtacaaagagggtttcggtcacctgagccctaccggcacgactgaattttggctgggaaatgagaaaatccacttgatcagcactcaaagcgctatcccctatgccttacgcgtggagctggaggactggaacggtagaacctctactgctgattatgctatgtttaaggtgggtcctgaagcggataaatatagactgacctacgcctactttgcaggtggcgacgcgggtgatgcatttgatggtttcgacttcggcgacgacccgagcgataagttcttcactagccataatggtatgcagttcagtacgtgggataacgacaacgacaagtttgaaggtaactgcgctgagcaggacggttcaggttggtggatgaacaaatgtcacgctggtcacctgaacggtgtttattaccagggcggcacgtacagtaaagcaagcactcctaatggctacgataacggaataatctgggccacttggaagacgcgttggtatagcatgaagaagaccaccatgaaaatcattccatttaatcgtctgaccattggtgagggccagcaacaccacctgggtggagcaaaacaggtgcgaccggaacaccctgctgaaactgaatatgactccctgtatccagaggatgacttg

SEQ ID NO: 11353 - DNA, 1359 bp, Artificial Sequence
  Description of Artificial Sequence: Synthetic coding sequence
atgtcctggtctctgcaccctcggaacctcatcctgtatttttacgcccttctatttttatcaagtacctgcgtggcctacgttgccacacgggataattgttgcatcttggatgagcggttcggatcttactgtccaactacctgtgggattgcagacttcctgtctacctatcagacaaaggtggataaggacctccagtcactggaggatatcctgcaccaggttgaaaacaagacgtcagaggtgaagcaattaattaaggcaattcagctgacctataaccctgacgaaagttccaagccaaacatgattgacgcagcgaccctgaaatccaggaagatgcttgaagagattatgaagtacgaggcctctatcttgacccacgacagttctatccggtatctgcaggaaatttacaattctaataaccagaaaatagttaacctaaaagagaaagtggcacagctggaagcccagtgccaagaaccatgcaaggatacagtccaaattcacgacattactgggaaggattgccaagatattgccaataagggcgccaagcagtctggactgtattttattaagccactgaaagcgaaccagcaattccttgtgtactgtgagatcgacggcagcggaaacggctggacggttttccagaagcgtctcgatggctcggtagatttcaagaagaattggatccagtacaaagagggattcgggcacctgtcacccacaggaacaaccgagttctggttgggaaacgagaagatccacctcatctccacacagtccgccataccttatgcgctgcgcgtcgagctcgaggattggaacggtaggacctccactgccgattatgccatgtttaaggtgggacccgaggccgacaagtatcgcttaacctacgcatattttgctggcggagatgctggcgacgcctttgatggctttgacttcggagacgatcctagtgataagttcttcacaagccataacggtatgcagttctcgacctgggacaacgataatgacaagttcgaaggaaattgtgccgagcaggacggcagcggatggtggatgaacaagtgccacgctggccatctaaacggcgtgtattatcaaggcggcacctacagcaaagcgtccacacctaatggttatgacaatggtatcatctgggcaacctggaaaactcggtggtattccatgaaaaaaaccacaatgaagatcatccctttcaacagactcactatcggcgagggtcagcagcatcacttaggaggcgccaagcaggtgcggccagagcatccagcagagacggagtatgatagtctctaccctgaagacgacctc

SEQ ID NO: 11354 - DNA, 1359 bp, Artificial Sequence
  Description of Artificial Sequence: Synthetic coding sequence
atgtcctggtccctccacccccgcaacctgattctgtacttttatgcgctcctgtttctatcctccacttgtgtggcgtacgttgctactcgggataactgttgcattctggacgaaaggtttggcagctactgtccaacaacgtgcgggatcgcagacttcctgtcaacttatcagaccaaggtcgacaaggatttacaatcgctggaagacatcttgcaccaggtagaaaacaaaacctctgaagtgaaacagttgatcaaggcaatccagttgacatataacccggacgagtccagtaagcccaacatgatagatgcagccactctgaagagccgcaagatgcttgaagaaataatgaagtacgaggcttcaatccttactcatgatagcagcattcgctacctgcaagaaatctacaactccaacaaccaaaagatcgtgaacctgaaggagaaggtggcccagctggaggcacagtgccaagagccttgcaaggacaccgtgcagatacatgatataaccggtaaggactgtcaggacatcgcaaataaaggcgccaaacagagtggcctgtatttcatcaagcccctgaaggcaaatcagcagtttctggtgtactgcgaaattgacggaagtggcaatggctggactgtgtttcagaagcggcttgatgggtctgtggattttaaaaaaaactggatccaatacaaggagggttttgggcacctttcgccaaccggtaccactgagttctggttaggcaacgaaaagatccacttaatcagtacccagagcgcgataccctacgcactgcgagtggaactcgaggattggaatggccggacatccacggctgactatgcaatgttcaaggttggacctgaggccgataagtatcggctcacctatgcctactttgccggaggcgatgccggcgacgcatttgatggcttcgacttcggcgatgacccatcagacaagttcttcactagtcataatggcatgcaattctctacttgggacaacgataacgataagtttgaaggcaattgcgcagaacaggatggttcaggctggtggatgaataagtgtcacgccggccacctgaatggggtgtattatcaaggcggcacttacagcaaggcttccacaccgaacgggtacgataatggaattatatgggcaacttggaagacgagatggtattccatgaagaagactacgatgaaaataatcccttttaatcgtctaacaatcggggagggacaacaacaccacctcggcggagccaagcaggtgcgacctgagcatcctgccgaaactgagtacgatagcctgtatcccgaggatgatctg

SEQ ID NO: 11355 - DNA, 1359 bp, Artificial Sequence
  Description of Artificial Sequence: Synthetic coding sequence
atgtcttggagcttgcacccccgcaacctcatcctgtatttctacgccttgctcttcctctcgtccacctgcgtagcctacgtggccaccagagacaattgctgtatcctggatgagagatttgggtcatattgtccgaccacttgcggcatcgctgatttccttagcacctatcagaccaaagtggataaggacctgcagtcgctggaagatattctgcatcaagtggaaaacaagacctccgaagtgaaacagttaattaaggcaatccagctgacgtataacccagatgaaagctccaaacccaatatgattgacgcagcaaccttaaagtcacgtaaaatgcttgaggaaatcatgaagtacgaggcttccatactgactcatgattccagcatccggtaccttcaggaaatctataatagcaacaatcagaagatcgttaaccttaaagaaaaggtagcccagctagaagctcagtgccaggaaccatgtaaggatacagtgcagatccatgatattactgggaaggactgccaggacatagctaacaaaggtgcaaagcagtccgggctgtatttcattaaacccttgaaggcaaaccagcagttcctcgtgtactgcgagatagacgggagtggaaatggctggacagttttccaaaagcgccttgacggtagcgtggatttcaagaaaaactggatacaatataaggaaggctttgggcacctctctccaactggcactactgagttctggctggggaacgaaaaaatccatctgatttccacccaaagcgccatcccctacgcattacgcgtggagctggaggactggaacggaagaaccagtactgcagactacgcaatgttcaaggtcggacccgaagccgacaagtaccgtctgacgtacgcctatttcgccgggggggatgccggcgatgcgtttgatgggtttgactttggagacgacccatccgacaaattctttaccagccacaatgggatgcagtttagcacgtgggacaatgacaatgataagtttgagggcaattgcgcagagcaggacggttcaggctggtggatgaacaaatgtcacgcagggcatctcaatggggtttattatcagggcggaacttactccaaggcaagcaccccaaacgggtatgataacgggattatttgggctacctggaaaacacgatggtatagcatgaaaaagacgaccatgaagataattcccttcaaccgtctaaccatcggtgaaggacagcagcatcacctggggggtgcaaagcaggtgagaccagagcacccagctgaaaccgagtatgatagcctttacccagaggatgatctc

SEQ ID NO: 11356 - DNA, 1359 bp, Artificial Sequence
  Description of Artificial Sequence: Synthetic coding sequence
atgtcctggagtctgcaccccagaaatctcatactctatttttacgccctgcttttcctgtcctccacctgtgtcgcttacgttgctacaagggacaattgctgcatcttggatgagaggtttggtagctactgccctaccacctgcggaatcgccgattttctgagcacgtatcagaccaaagttgacaaggacctccagagcctcgaggatatcctccaccaggtggagaataagacctccgaggtcaagcagctgatcaaggctatccaacttacttacaatccggatgaatcctccaaacctaacatgatcgacgctgccacactgaaaagcaggaagatgctggaagaaatcatgaagtatgaagcctcaattctgacacacgactcatccatcaggtaccttcaggagatttataatagcaataaccaaaagattgtgaatctcaaagagaaggtggctcaactcgaggcccagtgtcaggagccctgcaaggacactgtgcaaatccacgatatcacaggtaaagattgtcaggacatcgctaataagggcgcaaagcagagcggactttacttcatcaagcctctgaaagctaaccagcagttccttgtgtactgtgaaatcgacggttcaggcaacggttggaccgtgtttcagaaaaggctcgatggttctgtcgattttaaaaaaaactggatccagtataaggagggtttcggtcacttgtctccaactggaaccaccgagttttggctgggcaatgagaagattcacctcatctccacccagtctgccatcccctatgctctgagagtcgagttggaggattggaacggtagaacgagtacagctgattacgcaatgtttaaagttggaccggaggccgacaaatatagattgacgtacgcctacttcgcaggaggtgacgctggcgacgcctttgacggctttgatttcggagacgaccccagtgataaatttttcacctctcacaatggaatgcagtttagtacatgggataacgataatgacaaattcgagggaaactgtgcagaacaggacggttctggctggtggatgaacaagtgtcacgcgggtcacctgaatggagtctactaccaaggcggaacctatagtaaagccagcacacctaatggctacgacaacggcattatatgggccacttggaagacacgctggtacagtatgaaaaagactaccatgaagataatcccctttaatcgcctgacaatcggcgagggacagcagcatcaccttggaggagctaagcaagttcgcccagagcatcccgccgagactgagtatgattcactgtacccagaggacgatctc

SEQ ID NO: 11357 - DNA, 1359 bp, Artificial Sequence
  Description of Artificial Sequence: Synthetic coding sequence
atgagttggtcactgcatccgcgcaatctgatactttatttctatgctctcctgtttctgagctcgacctgtgtggcgtacgtcgccacgcgggataactgttgcattttggacgagcgtttcggaagctactgccctactacttgtggaatcgcggatttcttgtccacctatcagactaaggtagacaaggatctacagtcgctggaagacattctgcaccaggttgagaataaaacttccgaggtgaagcaacttatcaaagcaatacagctcacatacaaccctgacgagtctagcaaaccaaacatgatcgacgccgctacactcaaatctcgaaagatgctggaggagatcatgaaatacgaagcatccatactcacgcacgactcttcaattagatacctgcaggagatctataatagcaacaatcagaagatcgtaaacctcaaggaaaaagtggcgcagctggaggcgcagtgccaggagccttgtaaagatacggtgcaaatccacgatattacagggaaggactgccaggatatcgcgaacaagggcgccaaacaaagcggattgtacttcataaagcccctgaaggccaaccagcagttccttgtttattgtgaaatcgacggctccggcaatgggtggacagtctttcagaagcggctggacggctctgtggacttcaagaagaattggattcagtacaaggagggatttggtcacctgtctccgacaggcacaacagagttctggctaggcaacgagaaaatccatctgatttctacccagagtgctattccctatgctctccgggtagaattagaggactggaacgggcgcacctccaccgccgattacgccatgtttaaagtaggtccggaagccgataagtaccgcctgacctacgcctactttgccggaggtgacgctggtgatgccttcgatggatttgatttcggtgatgacccgagtgacaagtttttcacgtcccataatggaatgcagttctccacctgggacaatgacaacgataaattcgagggcaactgtgcggaacaagacggctctggatggtggatgaacaagtgccacgctggccatctgaacggggtttactaccagggaggaacttactcaaaggcatccactcctaacgggtacgataatggaataatttgggccacatggaagaccagatggtactccatgaaaaaaacaaccatgaaaatcatcccctttaataggctaacaatcggggaaggacagcaacaccatctgggaggcgcgaagcaggttcggcctgagcacccggctgagaccgagtatgatagcttataccccgaggatgatctg

SEQ ID NO: 11358 - DNA, 1359 bp, Artificial Sequence
  Description of Artificial Sequence: Synthetic coding sequence
atgtcctggtccctgcaccctcgtaacctgattctgtacttctacgccctgctcttcctttcgtccacttgtgtggcgtacgtggcaaccagagataactgttgtattctggatgagcggtttggttcctattgtcccactacctgtggaatagccgatttcctctccacttaccagactaaagtggacaaagaccttcaatcgctcgaggatattcttcatcaagtggagaataagacctccgaagtgaagcagctcataaaagcaattcaattgacgtacaacccggatgaatcctcgaaaccaaatatgattgacgcagcaactctgaagtcacgcaagatgctggaagagattatgaagtatgaagctagcatcttgactcacgactcgtccattagatacctccaagagatttacaactcgaataaccaaaagattgtgaatctgaaggaaaaagtggcacagctcgaagcacagtgtcaagagccgtgtaaggatactgtccaaatacatgatataaccggtaaggactgccaggatattgcgaataaaggggctaagcagtcgggtctgtactttatcaagccactgaaggcgaatcaacaattcctggtgtactgtgagatcgacggtagcgggaacggatggactgtgtttcagaagagactcgatggatccgtggatttcaagaaaaactggattcaatacaaggagggttttggtcaccttagcccaactggaactaccgaattttggcttggaaacgaaaagatccacctgattagcactcaatcggccatcccatacgcgctgagagtcgaactggaagattggaacggccgaaccagcaccgctgattacgctatgtttaaagtgggtccggaggcagataagtaccgtcttacttacgcgtactttgcgggaggcgatgctggtgatgcattcgacgggtttgattttggcgatgatccgtcggacaagtttttcacttcgcataacggaatgcaatttagcacctgggataatgataacgacaagtttgaaggaaactgcgcagagcaggatggatcggggtggtggatgaacaagtgtcatgcagggcatcttaacggcgtgtactaccagggcggaacctactcaaaggcctcgacgccaaatggatacgataatggaattatctgggcaacctggaaaactcgctggtattcgatgaaaaagaccaccatgaagattattccttttaacagacttaccattggagaaggccaacagcatcatctggggggagcaaaacaagtgcgcccggagcatccagccgaaactgagtacgactccctgtaccctgaagatgatttg

SEQ ID NO: 11359 - DNA, 1359 bp, Artificial Sequence
  Description of Artificial Sequence: Synthetic coding sequence
atgtcttggtcacttcaccccagaaacctaatcctatatttctacgccctgctgttcctgtcttctacatgcgttgcctatgtggcaacccgcgataattgctgtatcctggatgagcgcttcggttcgtactgccctactacctgcgggatagctgattttctatccacctaccagacgaaagtagataaggacctacagtcactagaagacattttacatcaggtagagaataaaacttcagaagtgaaacagttgatcaaagccatccagctgacttataatcctgacgaatctagcaagcccaatatgatcgacgcagccacattaaaaagtcggaagatgctggaggaaatcatgaagtatgaggcatccattctcactcatgactcatcaattcgctacctgcaggagatctataactcgaataatcagaagatagtaaatctcaaagagaaagtggcccagctggaagcccagtgtcaggaaccttgcaaagacacagttcaaattcacgacatcacaggaaaggattgtcaagatatcgcaaacaagggcgcaaagcagtcaggtctgtactttattaaaccccttaaggcaaaccagcagttcttggtatactgtgaaattgatgggagtggtaatggttggacagttttccagaaacgccttgacggtagtgtcgatttcaaaaagaactggatccagtataaagaggggttcggtcacctgagtccaacagggaccacagagttctggctgggcaatgaaaagattcatctgatcagcacgcaaagcgccattccttacgccctgagagtcgaacttgaggactggaacggaagaacatcgaccgcagactacgccatgttcaaggtcggtcccgaggccgataaataccggctgacctatgcttatttcgcaggaggtgacgccggagacgcattcgatgggttcgatttcggcgacgacccctcagataagttttttactagccacaacggcatgcagttcagcacttgggataatgacaacgacaaatttgagggtaactgcgctgaacaggacggtagtgggtggtggatgaataagtgtcatgcgggtcatctcaatggggtctactatcaaggcggaacgtattctaaggctagcacacctaacggctacgataacggaattatctgggccacatggaaaaccaggtggtattcgatgaaaaagacaaccatgaaaatcattccattcaaccgtcttaccatcggcgaaggccagcagcaccacctcggaggggccaaacaggtgaggccagaacacccagcagaaacggagtacgattccctgtaccctgaagacgatctc

SEQ ID NO: 11360 - DNA, 1359 bp, Artificial Sequence
  Description of Artificial Sequence: Synthetic coding sequence
atgtcctggtcattgcaccctcgaaatcttatactttacttttacgcacttctgttcctttcctccacctgtgtcgcctacgtggccactcgggataattgttgtatcctggacgaaagatttggatcttactgtcctactacctgtgggatagcagatttccttagcacttaccaaacgaaagtcgacaaggatcttcagagcctggaggacattcttcatcaagtcgaaaacaaaacctcggaagtcaagcagctgatcaaagccattcaattgacgtacaaccctgacgaatcatccaagccaaacatgattgatgcggcaacccttaagtcgagaaagatgctggaggagattatgaagtacgaagcatccatactcactcatgattcgtccattagatacctgcaggagatttacaactccaacaatcaaaagatagtgaaccttaaggagaaggttgcacaactcgaggcccagtgtcaagaaccttgtaaagacactgttcaaatccatgatattaccggaaaggattgccaagatattgcaaataagggtgcaaagcagtcgggactttacttcattaagcctctgaaggccaaccaacaatttctggtttactgtgaaattgacggatcgggtaacggttggaccgtgtttcaaaaacgtctggacgggtcagtggactttaagaagaactggatacagtacaaagaaggctttggacacctgtcccctaccggtacgactgaattttggcttggcaacgaaaagatccaccttatatcaacccaatctgcaatcccatacgcactcagagtggaactggaagattggaatggtcggacctcaactgcggactatgccatgttcaaggtcggccctgaagcggacaagtaccgactgacctacgcatactttgccggcggtgatgccggagatgcattcgatggctttgatttcggcgatgacccatcagataagttctttacctctcacaatggcatgcaatttagcacctgggacaacgataacgacaagtttgaaggtaactgtgcagagcaagatggttcaggttggtggatgaacaagtgtcatgccggacatctgaacggggtgtactatcaaggtggtacttacagcaaagcgagcaccccaaacggatacgataacgggattatctgggcaacctggaaaacccggtggtactcgatgaagaaaactactatgaagattattcccttcaataggcttactatcggagaaggtcagcagcaccatctgggtggagccaagcaagtgcgcccggagcatccagctgagactgaatacgatagcctgtatcctgaagatgatctt

SEQ ID NO: 11361 - DNA, 1359 bp, Artificial Sequence
  Description of Artificial Sequence: Synthetic coding sequence
atgagttggagtttacatccacgtaatttaattttatatttttatgcacttttatttctttcatctacttgtgttgcttatgttgctactagagataattgttgtattcttgacgaaagattcggaagctattgtcctactacatgcgggattgctgattttctatctacatatcaaacaaaagttgataaagatttacaatcattagaggatattttgcatcaagtagaaaataagacatcagaagttaaacaattaattaaagctattcaattaacttataatcctgatgaaagtagtaagccaaatatgatcgatgcagcaactttaaaatcacgtaagatgttagaagaaattatgaaatatgaagcatcaattcttactcatgatagtagtattagatatttacaagagatttataattcaaataatcaaaaaattgtgaatcttaaggaaaaggttgcacaattagaagcacaatgtcaagaaccatgtaaagatacagttcaaatccatgatataactggtaaagattgtcaagatattgctaataaaggggcaaaacaaagtggattatattttattaaaccattaaaggctaatcaacaatttcttgtttattgtgaaattgatggatcaggaaatggttggactgtttttcaaaaaagacttgacggatctgtagatttcaaaaaaaattggattcaatataaggaaggatttggacatttatcacctactggtactactgaattttggttagggaacgaaaaaattcatcttattagtacacaaagtgcaattccttacgcacttagagtcgaattagaagactggaatggaagaacttcaactgcagattacgccatgtttaaagttggaccagaagctgataaatatcgtcttacctatgcttattttgcagggggagatgctggagatgctttcgacggattcgactttggagacgatccatctgataaatttttcacatctcataatggaatgcaatttagtacatgggataatgacaatgacaagtttgagggtaattgtgctgaacaagatggatcaggttggtggatgaataaatgtcatgcaggacatttgaatggtgtttattatcaaggtggaacttattctaaagcctcaactccaaatggatatgataatggaattatatgggctacatggaaaactagatggtattctatgaaaaaaacaactatgaagattataccttttaacagattaacaatcggagaaggacaacaacatcaccttggtggagctaaacaagttaggcctgaacatcctgctgaaactgagtacgattcattatatcctgaagatgattta

SEQ ID NO: 11362 - DNA, 1359 bp, Artificial Sequence
  Description of Artificial Sequence: Synthetic coding sequence
atgagttggtcactgcaccccaggaatttaatactgtatttttacgccctgctgtttctgtcttccacatgcgtcgcatacgtggccactagggacaattgctgcatactggacgagcggtttggcagctactgtcccaccacatgtggcattgcagacttcttgtctacttaccaaactaaagtcgataaggatctacagagcctggaagacatccttcaccaggtggaaaataaaacatccgaggtcaaacagctgatcaaagcaatacaactcacctacaaccctgacgaaagcagtaaaccaaacatgatagatgctgccacacttaagagcaggaaaatgcttgaggagatcatgaaatacgaggccagcatcttgacccacgactccagcatccggtacctgcaggagatatataactcaaataaccagaagatcgtaaacctgaaggaaaaggtcgctcagctagaggcgcagtgtcaggaaccttgcaaggacaccgttcagattcatgatattacaggcaaggactgtcaggatatagctaacaaaggtgctaaacagagtggattgtactttatcaagcccttgaaggctaaccagcagtttttggtctactgtgaaatcgacgggagcgggaatggctggaccgtgttccagaagcggctcgacggttctgtcgattttaaaaaaaactggatacagtacaaggagggcttcggacatctaagtcccaccgggaccaccgaattttggctcggtaatgaaaagatccaccttatcagtactcagtcagcaataccctatgcgctgcgggtggagctcgaggactggaatggcagaactagtacagccgactatgccatgtttaaggtgggcccggaggccgacaagtacagattgacctatgcatatttcgcgggaggcgatgctggcgacgcttttgatggattcgattttggggatgatccttcagacaagttcttcacctctcataacgggatgcaatttagtacatgggacaacgacaatgacaaatttgagggaaattgcgccgaacaagacgggagtgggtggtggatgaataagtgccacgctggacatcttaacggcgtgtactaccagggaggcacgtacagcaaggcctcaacacccaacggctacgacaacggcattatctgggccacttggaaaacgcgctggtattcaatgaagaagaccacaatgaagattattccatttaataggctaacaatcggagagggacagcagcatcacctgggaggagcaaagcaggttagaccagaacatccagccgaaaccgagtatgactcactgtaccctgaggacgatttg

SEQ ID NO: 11363 - DNA, 1359 bp, Artificial Sequence
  Description of Artificial Sequence: Synthetic coding sequence
atgagttggtctttacatcctagaaacctgatcctgtacttttatgcccttctcttcctctcttcaacatgcgtagcctatgtcgctactcgagataattgctgtattttagatgagcggttcggcagctactgccccacaacatgtggaatagcggatttcctgtcaacttatcagactaaggtggacaaggaccttcaaagcctggaggatatcctccaccaggtcgagaacaagacatccgaggtgaagcagttgataaaggcaatacagctgacatacaacccggacgagtcctcgaagcctaacatgatcgatgccgccacgctgaagtctaggaaaatgctggaggagatcatgaagtatgaagccagcatcctgacacacgacagtagcatcaggtatctgcaggaaatttataattctaacaaccagaaaattgttaatttgaaagaaaaagtcgctcagctggaggcccagtgtcaagaaccttgcaaagatacagttcaaatacacgacatcacaggtaaggattgccaggatatagccaataaaggcgccaagcagagtggtctgtatttcattaaacctctaaaagccaatcagcagttcctggtttattgtgagattgatgggtcgggcaacggctggaccgtgttccagaaacggctggatgggagcgtagatttcaaaaagaactggattcaatacaaggaaggcttcgggcacctgtcgcccaccgggactactgaattctggctgggcaatgaaaagatccaccttattagtacgcaaagcgccattccgtacgccttgagagtggaactggaggactggaacggtcgcacatctactgccgattatgcaatgttcaaggtgggacccgaagccgacaaataccgcctgacctatgcctatttcgccggaggcgatgcaggggatgcctttgatggtttcgatttcggagatgatccaagtgacaaatttttcacttcacataatggtatgcagttttccacctgggacaacgacaacgataagtttgaaggtaactgtgcagagcaagacgggtctggatggtggatgaacaaatgtcacgccggccatctgaacggcgtttactaccaaggagggacgtactccaaggccagtacaccaaatggatatgacaacggcatcatttgggcaacctggaaaacccggtggtattctatgaagaagaccactatgaaaatcatcccatttaatagactcactatcggagaaggacaacaacatcacctggggggagctaaacaggtacgccccgagcacccagcagagactgagtatgactccttatatcccgaggacgatctc

SEQ ID NO: 11364 - DNA, 1359 bp, Artificial Sequence
  Description of Artificial Sequence: Synthetic coding sequence
atgagctggtcgctgcatccccgcaacctcatcctttacttctacgcgctgcttttcctcagctctacttgtgtcgcatacgtggctaccagagataattgttgtatccttgatgaaagattcggatcctactgccctactacctgtggaatagccgatttcctgagcacttaccaaactaaggtggacaaggatctgcagtccctggaggacattctgcatcaggtggaaaacaaaacttcggaagtcaagcaattgattaaggccattcagctgacttacaaccctgacgaaagctccaagccgaacatgatagacgcggcaaccctcaagagccggaagatgcttgaggaaatcatgaagtacgaagcctcgattctcacgcatgattcgtctattagatacttgcaagagatttacaattcaaacaatcagaaaatagtgaaccttaaggaaaaggtggcgcagctggaggcccagtgtcaggaaccatgtaaggacacggtccagattcatgatataactggcaaggactgtcaggacattgcgaataagggggcaaagcaatctggtctttacttcataaaacctctcaaagcgaatcaacagttccttgtgtactgcgaaatagacgggtccggcaatggctggaccgtttttcaaaagcgacttgatgggtccgtggatttcaagaagaactggattcagtacaaggaaggattcggtcatctgtcgccaaccgggaccaccgagttttggcttggtaatgagaagatacatcttatcagcactcaaagcgcaataccttacgcactgcgagtggagttggaagattggaacggaagaacctccactgcagactacgccatgtttaaagtcggacctgaagcagataagtatcgtctgacctacgcatactttgcaggaggtgatgccggagatgcatttgatggatttgattttggtgatgaccccagcgataagtttttcacttcgcataacggaatgcagttttcaacttgggataacgacaatgacaagtttgaaggaaactgcgctgagcaggatggatccggatggtggatgaataagtgtcatgcaggccatttgaatggtgtttactaccagggtggaacctactccaaggcgtccaccccgaatggatatgataacggaatcatttgggcaacctggaaaacccggtggtactccatgaaaaagactaccatgaagatcatcccatttaaccggctgaccattggggagggacaacagcaccatctggggggagcaaagcaagtgcgcccagaacaccctgcagaaaccgagtacgactccctctaccctgaagatgatctg

SEQ ID NO: 11365 - DNA, 1359 bp, Artificial Sequence
  Description of Artificial Sequence: Synthetic coding sequence
atgtcttggtcactgcatccacgtaatctaatactgtatttttacgcactcctgtttttgagttccacgtgtgtggcatatgtggcaacccgcgacaactgttgtattcttgatgagcgtttcgggagttactgtccgaccacttgtggtattgccgactttctgtccacctatcagaccaaggtggacaaagatttgcaatccctggaagacatccttcaccaagtcgaaaacaaaacttctgaggttaaacagttgattaaagccattcaactcacgtataatccagacgagagttccaagcccaacatgatagatgccgccacattaaaaagtcgaaaaatgctcgaagaaattatgaagtacgaagcctcaatcttaacccacgattcctcaatacggtatctgcaagagatctataattccaacaatcagaaaattgttaatctgaaagagaaggtggcccaattggaagcgcagtgtcaggagccgtgtaaggatactgtccagatccatgacataaccggcaaggattgccaggacattgccaataagggggcaaaacagtctggattgtactttataaagcccctgaaggccaatcagcagtttctcgtttattgcgagatcgacggctcagggaatgggtggactgtcttccagaaacggctcgatgggagtgtggactttaaaaaaaattggatacagtataaggaggggtttgggcacctgtcacctactggtacaacagagttctggttggggaacgaaaaaattcatctaatctctactcagtctgctatcccttatgccctgcgtgtggaactagaagactggaacggtcgtacctctactgcagactacgccatgtttaaggtgggcccagaagctgacaagtatcgactgacctatgcttatttcgccgggggtgacgctggagacgctttcgacggtttcgatttcggcgacgacccatccgacaaatttttcacgagccacaatggcatgcagttcagtacctgggataatgacaatgataagtttgagggcaactgtgcagaacaggatgggtccgggtggtggatgaacaaatgccacgccggccatttgaatggagtgtattatcagggaggaacctactccaaagcctccactcccaacgggtacgacaatggaattatatgggccacatggaaaacgcgatggtacagtatgaagaaaactactatgaaaataatcccgtttaacagactaaccataggagaaggccagcaacaccacctgggcggggccaagcaggtgcggccagaacacccagctgaaacagaatatgatagtctgtatcccgaggatgatcta

SEQ ID NO: 11366 - DNA, 1359 bp, Artificial Sequence
  Description of Artificial Sequence: Synthetic coding sequence
atgtcctggtcgctgcatccccggaacttgattctctatttttatgcgctgttgtttctgagtagcacctgtgtagcgtacgtcgccaccagggataactgctgcattttagacgaacgcttcgggagctactgccccacgacctgcgggatcgcagactttttaagcacttatcagactaaggtagataaagatctccaatcgctggaagacatccttcatcaggtggaaaacaaaacaagtgaagtcaagcaactcattaaagctatacagctgacatataacccggacgaatcctcgaagcccaatatgatcgacgctgccaccctgaaatcacgcaagatgctcgaagaaattatgaagtatgaggccagtatactcacacacgatagcagcatccgatatttgcaagaaatttataattccaacaatcaaaaaattgttaacctgaaagagaaagtcgcgcagctggaagcgcagtgtcaggaaccttgtaaggacaccgtccagattcacgatatcactggcaaggactgccaggacatagccaataagggggccaagcagtctggattgtacttcataaagcctctcaaggcaaaccagcaatttctggtgtactgtgaaattgatggctccggaaatggctggactgtctttcagaagcgattggatgggtctgtggactttaagaaaaattggatacaatataaggagggcttcggacacttatccccaacaggcaccacagagttttggctggggaatgagaagattcatctgatatcaacccagtctgcaattccctatgccctcagagtcgagctggaggattggaatgggcgcacatctacagccgattatgcaatgttcaaggttgggcctgaagcagataagtacaggctcacgtatgcatacttcgccgggggggatgccggcgatgcctttgacggattcgactttggggacgatccttctgataagttctttaccagtcacaacggtatgcagtttagcacctgggataacgacaacgataagttcgagggcaactgcgctgagcaagacggctcagggtggtggatgaataaatgccatgctggccatttgaatggggtatactaccagggggggacctactcaaaggccagcacccctaacgggtacgacaacggtattatttgggcaacttggaagacccggtggtattccatgaaaaaaacgaccatgaaaatcatccccttcaaccggctcaccattggggaagggcagcaacatcacctcgggggggctaagcaggtgcggcctgagcaccctgccgagacagaatatgactccctctatcctgaggacgatctc

SEQ ID NO: 11367 - DNA, 1359 bp, Artificial Sequence
  Description of Artificial Sequence: Synthetic coding sequence
atgtcctggtctctgcatcccagaaatctcatactctatttctatgctcttctcttcctttcttcaacctgcgttgcctacgtcgccacacgtgataattgttgtatccttgacgaacgtttcggtagctactgcccaacaacttgcggtatcgctgactttctgagcacttaccagacaaaggtcgataaggacctccagtctctggaagatattctgcatcaggtagaaaataagaccagtgaggtcaaacagctgattaaagctattcagcttacctacaatcctgatgagagttccaagcccaatatgatcgacgcagctacactgaagtctcgcaagatgctcgaggagatcatgaagtatgaggcctctattctgacacacgattcctctatccgctatcttcaggaaatctacaactctaacaatcagaagatcgtcaacttgaaagagaaggtggctcagctggaagcccagtgtcaagaaccttgtaaagatacagtgcagatacatgacatcaccggtaaggactgtcaagacatcgccaacaagggcgccaagcagtcaggactttacttcatcaagcctctcaaagctaaccaacagttcctggtttactgcgaaattgacggttccggaaatggctggactgtatttcagaagagacttgacggatctgtggactttaagaagaactggatccaatacaaagaaggctttggtcacctctctcctaccggaaccacagagttttggctcggaaatgagaagatccacctcatctccacccagtccgccattccctacgctttgagagttgagttggaagactggaatggccgtacatctacagcagactatgccatgtttaaagtcggacctgaggcagacaagtacaggttgacatacgcttatttcgctggaggcgacgccggagacgctttcgatggctttgacttcggtgacgacccctcagacaagttctttacatcacataacggcatgcagtttagcacatgggacaacgacaacgataaattcgaaggaaactgcgctgagcaagacggcagcggctggtggatgaacaaatgtcatgcaggacatcttaacggtgtctactaccagggcggcacatactctaaagcttcaactcccaacggctatgacaacggtataatctgggcaacatggaagaccagatggtactctatgaagaagactaccatgaaaatcattcctttcaatcgccttacaattggtgagggacagcaacaccatttgggtggcgctaagcaggtgaggcctgagcatcccgccgaaactgaatatgacagtttgtatcccgaggacgacctc

SEQ ID NO: 11368 - DNA, 1359 bp, Artificial Sequence
  Description of Artificial Sequence: Synthetic coding sequence
atgagttggtccctgcacccaaggaacctcattctgtacttctacgcactgctcttcctttccagcacctgcgtggcgtacgtggcgacccgagacaactgctgcatcttggacgaacgcttcggatcctattgcccgacgacctgcggtatcgctgatttccttagcacctaccagacgaaggtggataaggatctgcagtcgctggaagatatcctgcaccaggtggagaataagaccagcgaagtgaagcaattgatcaaagccattcagcttacttacaaccccgatgaatcctcaaagcctaacatgatcgatgccgccactctcaagtctcgtaagatgctggaggagatcatgaaatacgaagcctccatcctcacccatgactcgagcatccggtacctgcaggagatctacaactctaataaccaaaagatcgtcaacctcaaggaaaaagtggcgcagctggaagcacagtgtcaggaaccatgcaaggacacggtccagatccacgatatcaccggaaaagattgtcaggacatcgccaataagggggccaagcagtcggggctttactttatcaagccgctgaaggccaatcagcagttcctggtttactgcgaaatcgacggtagcggcaatggatggaccgtctttcagaaaagattggacggatctgtggacttcaagaaaaactggatacagtataaagaaggttttggtcatctgtcacctactggcactaccgagttctggctgggaaacgagaagatccacctgatttccacccaatcggcaattccgtacgcgcttcgcgtcgagctggaggactggaacggtcgcaccagcaccgcggattatgcgatgttcaaggtgggcccggaagcagacaaataccggctcacctacgcctacttcgcaggaggggatgctggagacgcattcgacggctttgacttcggagacgacccctccgataagttcttcacctcccataacggaatgcagttttcaacttgggacaacgacaatgacaaatttgagggcaactgtgctgagcaagacggatcaggatggtggatgaacaaatgccacgcggggcacctgaacggagtgtactaccaaggcggaacgtactcgaaggcgagcactcctaacggatatgataatgggatcatctgggctacttggaaaactagatggtactccatgaagaaaaccactatgaaaatcatccctttcaatcgtttgactataggagaaggacaacaacatcacctgggaggcgccaagcaagttcgaccggaacatccagccgaaacggaatacgactctttgtaccccgaggacgacctc

SEQ ID NO: 11369 - DNA, 1359 bp, Artificial Sequence
  Description of Artificial Sequence: Synthetic coding sequence
atgagctggagtttgcacccccgtaaccttatcctgtacttttatgcccttctttttctgagctccacctgtgtggcatatgtggctacaagggacaattgctgcatccttgacgaacgctttggctcttattgtcccaccacctgtggtattgctgactttctcagcacttaccagactaaggtggacaaggacctgcagtcactggaggacatcctacatcaggtggaaaacaagacttcagaggtgaagcagctcatcaaagccatccagctgacctataatcctgatgagagctccaaacccaacatgatcgatgccgccactcttaagagccgaaagatgcttgaggagatcatgaaatacgaggcatcaattttgacacacgattctagcatccgttatctgcaggaaatatataactccaataaccagaagatcgtgaatctgaaagaaaaagtggcacaactggaagcccagtgtcaggaaccttgtaaagacaccgtgcagatacatgacatcactgggaaggattgccaggacatcgcaaacaaaggggcaaagcagagcggcctctatttcatcaagcctttgaaggccaaccagcaatttcttgtctactgcgaaatcgatggaagcgggaatggatggaccgtattccagaaaaggctcgatgggagtgtcgacttcaagaagaactggatccagtacaaagaaggatttggacacctgagccctactggcaccactgagttctggcttggaaacgaaaaaatccacctgatttccacacagtctgccatcccatacgccctgagagtggaacttgaggattggaacggacggactagcacggccgattacgctatgtttaaagtggggcctgaggctgacaaatatcggttgacctacgcttatttcgcgggaggcgatgcaggtgatgcctttgatggctttgactttggcgacgaccccagcgacaagttttttacctcgcataacgggatgcaattcagcacctgggacaacgacaacgataaatttgagggcaattgcgctgaacaagacgggagtgggtggtggatgaacaagtgtcacgcgggacacttaaatggagtttattaccaggggggtacatacagcaaggcaagtacacccaacggatacgataacggaatcatttgggcaacttggaaaacccgatggtactccatgaagaaaacaaccatgaagatcatcccatttaaccggctgaccatcggcgagggccaacagcaccatctcggcggggctaagcaagttagacccgagcatcccgccgaaaccgaatacgattctctgtaccctgaggatgacctt

SEQ ID NO: 11370 - DNA, 1359 bp, Artificial Sequence
  Description of Artificial Sequence: Synthetic coding sequence
atgtcgtggtcgctacatccgcgtaatttaatactatatttttatgcgttactatttttatcgtcgacgtgtgttgcgtatgttgcgacgcgagataattgttgtatattagatgaacgatttggttcgtattgtccgacgacgtgtggtatagcggattttctatcgacgtatcaaacgaaagtagataaagatttacaatcgctagaagatatactacatcaagtagaaaataaaacgtcggaagtaaaacaactaataaaagcgatacaattaacgtataatccggatgaatcgtcgaaaccgaatatgatagatgcggcgacgctaaaatcgcgtaaaatgttagaagaaataatgaaatatgaagcgtcgatactaacgcatgattcgtcgatacgttatctacaagaaatatataattcgaataatcaaaaaatagttaatttaaaagaaaaagttgcgcaactagaagcgcaatgtcaagaaccgtgtaaagatacggtacaaatacatgatataacgggtaaagattgtcaagatatagcgaataaaggtgcgaaacaatcgggtctatattttataaaaccgttaaaagcgaatcaacaatttctagtttattgtgaaatagatggttcgggtaatggttggacggtttttcaaaaacgactagatggttcggtagattttaaaaaaaattggatacaatataaagaaggttttggtcatttatcgccgacgggtacgacggaattttggctaggtaatgaaaaaatacatctaatatcgacgcaatcggcgataccgtatgcgttacgtgtagaattagaagattggaatggtcgtacgtcgacggcggattatgcgatgtttaaagttggtccggaagcggataaatatcgtttaacgtatgcgtattttgcgggtggtgatgcgggtgatgcgtttgatggttttgattttggtgatgatccgtcggataaattttttacgtcgcataatggtatgcaattttcgacgtgggataatgataatgataaatttgaaggtaattgtgcggaacaagatggttcgggttggtggatgaataaatgtcatgcgggtcatctaaatggtgtttattatcaaggtggtacgtattcgaaagcgtcgacgccgaatggttatgataatggtataatatgggcgacgtggaaaacgcgttggtattcgatgaaaaaaacgacgatgaaaataataccgtttaatcgtctaacgataggtgaaggtcaacaacatcatttaggtggtgcgaaacaagtacgtccggaacatccggcggaaacggaatatgattcgttatatccggaagatgatcta

SEQ ID NO: 11371 - DNA, 1359 bp, Artificial Sequence
  Description of Artificial Sequence: Synthetic coding sequence
atgtcatggtcgctgcatccccggaatctgatcctgtacttttacgccctgctcttcctgtcctctacttgcgtggcatacgtggccactcgagacaactgctgcatcctggacgagagatttggatcctactgcccgaccacgtgtggcatcgccgatttcttgagtacctaccagactaaggtcgacaaggaccttcagtcgctcgaagatattctgcaccaagtggagaacaagacctccgaggtgaagcagctgattaaggctatccagctgacttacaatccggacgagtcgtcgaagccaaacatgattgatgcggccaccctgaagagcagaaagatgctcgaagaaatcatgaagtacgaggcttccatcctcactcatgactcctccattcggtacctgcaggaaatctataactctaacaaccagaaaatcgtgaacctgaaggagaaagtggctcagctggaagcacagtgccaggagccgtgcaaggacactgtgcagatccacgatatcaccgggaaagattgccaggatatcgctaataagggagcgaaacagagcgggttgtacttcatcaagccgctcaaggccaaccagcagtttctggtgtactgcgagatcgacgggagcggaaatgggtggaccgtgtttcagaagcgcctcgatgggtccgtcgacttcaagaagaactggatccaatacaaggaaggatttggacacctgtccccgaccggaaccactgaattctggctgggcaatgaaaagatccacctcatctcgacgcaaagcgcgattccttacgcgctgagagtggagctcgaggactggaacggacgcacctcgaccgcagattacgccatgtttaaggtgggacctgaagccgacaagtaccggctgacctatgcctacttcgctggcggagacgcaggcgacgcttttgatggatttgacttcggagacgacccgtctgacaagttctttacttcacacaacggaatgcagttctcgacgtgggacaatgataatgataagttcgagggaaattgcgcagaacaggatggctcaggctggtggatgaacaaatgccacgctggccatcttaacggagtgtactaccaaggagggacttactcgaaggcgtcgacccctaatggctacgataatggcatcatctgggccacctggaaaactcgctggtactcgatgaagaaaactactatgaagattatccctttcaatcgccttaccatcggcgagggccaacaacaccaccttggaggagccaaacaggtgcggcccgaacatccagctgaaactgagtacgactccctctaccctgaagatgacctg

SEQ ID NO: 11372 - DNA, 1359 bp, Artificial Sequence
  Description of Artificial Sequence: Synthetic coding sequence
atgagttggagtctacacccccggaatctaatcctttatttttacgcgctgctatttttgagttccacctgtgtcgcctatgtcgctacacgcgataactgttgcattttggatgaacggttcgggtcgtattgcccaactacttgtggaatagcagatttcctgtctacataccagaccaaggtggacaaagatttgcagtccttggaggacatactccatcaggtggagaacaaaaccagtgaggtgaaacagttgatcaaagcgattcagctgacatataatccagacgaaagctcgaagcctaatatgattgacgctgcgactctgaagtcccggaagatgctggaggaaataatgaagtatgaggcttccatcctgacccatgactctagtataaggtatttacaggaaatttataactccaacaatcagaagattgtcaatttaaaagagaaggtggctcagttggaggcacagtgccaggaaccctgtaaagacaccgtccagattcacgacataactggtaaggactgtcaagacattgccaataaaggagccaaacaatccggtttatacttcataaaacctctgaaggcaaatcagcaattcctcgtgtactgcgagatcgacggttcgggcaatggctggacagtgttccaaaaaagactggacgggtccgtcgacttcaagaaaaactggattcagtacaaggaaggctttggacacctgagtccaacaggcacaacagagttttggctggggaacgaaaagattcatcttatttccacacaaagtgctatcccttacgccctcagagtggaactggaagattggaatggtcggactagtactgccgactacgccatgttcaaggtaggtccagaagctgacaagtatcggctgacatacgcatatttcgccggaggcgatgcaggagatgctttcgacgggtttgactttggcgatgacccctccgacaagttcttcacatctcacaatggtatgcaatttagtacctgggacaatgacaacgataagtttgaaggcaactgtgctgaacaagatggctcaggatggtggatgaacaaatgccacgcaggtcacctaaacggcgtgtattaccagggtggtacctactctaaggcatcaaccccgaatggctacgataacgggatcatctgggctacatggaaaacccggtggtacagtatgaaaaaaactactatgaaaatcattcctttcaatcgcctgacaatcggcgaaggccaacagcaccacctgggcggagcgaaacaggtgcggcctgagcatcccgctgaaacagagtacgacagcctttatcccgaagatgatctc

SEQ ID NO: 11373 - DNA, 1359 bp, Artificial Sequence
  Description of Artificial Sequence: Synthetic coding sequence
atgagctggtctcttcatccacgtaatctgattctctatttctatgccttgctcttcctaagctccacatgtgtggcctacgtggccaccagggacaattgctgcatcctcgacgaacgctttggatcttattgccctactacatgtggcattgccgatttcctgagcacataccagacaaaggtggacaaagatctccagtctctcgaggacattttacatcaagtcgaaaacaaaacctctgaggtaaagcagctcataaaagcaatccagctgacctataacccagatgaatcttccaagccgaatatgatcgatgctgccaccctgaagtcgcgaaaaatgctcgaggaaataatgaaatacgaggcctccatcctgacccacgactcttccattcgataccttcaagaaatctacaattccaacaatcagaagatagttaaccttaaggagaaggttgcccagcttgaagcacagtgtcaagagccatgtaaagataccgtgcagatccatgacattactgggaaggattgtcaagacattgccaataaaggtgcaaaacagagtggactgtacttcatcaagcccctgaaagcaaatcagcaattcttggtgtactgcgagatagatggcagcggcaacggttggactgtgtttcagaagagactggatggaagcgtcgacttcaagaagaattggatccagtacaaggaagggttcggacatttaagccctacaggaacaaccgagttttggctgggaaatgaaaagattcacctgatctccacgcagtccgcgattccttacgcacttagggtggaacttgaagactggaatgggagaaccagcaccgccgattacgccatgttcaaggttggtccagaagccgataaatatagactcacttatgcctactttgccgggggcgacgctggtgacgcattcgatggattcgactttggggatgatccaagcgataaattttttacatcacataacgggatgcaattcagcacctgggacaatgataacgataaattcgagggcaattgtgcagaacaagacggcagcggctggtggatgaataaatgccacgccgggcacctgaatggcgtgtactaccaaggcggaacctacagcaaggcatcaacgcccaatgggtatgataatggcataatctgggctacttggaaaaccagatggtattctatgaaaaagaccaccatgaagatcattcctttcaaccgcctcacaatcggagaggggcagcagcatcaccttgggggcgcgaagcaggtgcgtccagagcatcccgccgaaacggagtacgacagtttgtaccctgaggatgatctg

SEQ ID NO: 11374 - DNA, 1359 bp, Artificial Sequence
  Description of Artificial Sequence: Synthetic coding sequence
atgagctggtccctgcatcctcgcaaccttatcctgtatttctacgcgttgttgttcttgtctagcacgtgcgtggcctacgtggccactcgcgataattgctgcattctggatgaacggttcggatcgtactgcccgactacttgcggaattgcggatttcctttcgacctaccagaccaaagtggacaaagatctccaatcgctcgaagatatcctgcaccaagtggaaaacaaaaccagcgaggtcaaacagcttatcaaagccatccagctcacctacaatccggacgaatcgtccaagccaaatatgattgacgcagccaccctcaagagtagaaagatgctggaggagatcatgaagtacgaagcctcgatcctgactcacgactcaagcatccgctacctgcaggagatttacaactccaacaaccagaagatagtgaatctgaaggaaaaagtggcccaattggaagcacaatgtcaagaaccatgcaaggacaccgtccaaatccatgacatcaccggcaaggattgccaagacatcgctaataagggggccaagcagtccggtctgtactttatcaagccgctgaaggctaaccagcagtttctggtctactgtgagatcgatgggtccggaaacggttggactgtttttcagaagaggctcgatggtagcgttgacttcaaaaagaattggattcagtacaaagaaggcttcggccacctctcccccaccggaactactgaattctggcttggtaatgagaaaatccacctgatctcgacccaatccgcgatcccatacgccctccgggtggagttggaggactggaatggacgcacctccaccgcagattacgctatgtttaaggtgggacctgaagctgataagtatagactcacgtatgcctacttcgccggcggagacgccggggatgccttcgacggattcgattttggagacgacccttcagacaagttcttcacttcccacaatggaatgcaattctcgacttgggataacgataacgataagttcgagggaaactgtgctgaacaagacggatcaggatggtggatgaataagtgccatgccggacacttgaacggggtctactaccaaggaggaacttactccaaagcatcgacccccaacggatacgataacgggatcatctgggccacctggaaaactaggtggtacagcatgaaaaagaccacgatgaagatcattcctttcaatcggcttactatcggagaaggtcaacaacatcacctcggaggtgccaagcaagtccgcccagaacaccctgccgaaaccgagtacgactcgctgtaccctgaggacgatctg

SEQ ID NO: 11375 - DNA, 1359 bp, Artificial Sequence
  Description of Artificial Sequence: Synthetic coding sequence
atgagctggtcactccaccctcggaacctcatcctgtacttctatgcactgctgtttctctcttctacttgcgtcgcctacgtggctacccgagacaactgttgcatcctggatgaaaggtttggcagctattgtccaacgacctgcggaattgcagatttcctgtccacctatcagacaaaagtggacaaggacttgcaaagccttgaggacattctccatcaggttgagaataagacttctgaagtcaagcaacttattaaagcgatccagttgacatataatccagatgaatcttccaagccaaatatgatagacgccgccacgcttaagagcaggaagatgctggaggagatcatgaaatatgaggctagtatactgacgcatgactcatccatcagatacttgcaggaaatctataatagcaataatcagaagattgtgaatctcaaagagaaagtggctcagctggaagcccagtgtcaggagccctgcaaggacaccgtgcagattcacgacatcaccggcaaggactgccaagatatcgccaataagggggccaaacaatctggcctgtacttcatcaagccactgaaagcgaaccaacagtttctggtctattgcgaaatagacgggtccggaaatggatggacagtgttccagaagagacttgacgggtccgtagactttaagaaaaactggattcagtataaggaaggatttggtcacctctcacctaccggaaccaccgagttctggctcgggaatgaaaagattcacctgatctcaacgcagtcagctatcccttacgcccttcgagtcgagctggaagattggaatggcagaacaagcactgccgactacgccatgttcaaagtcggcccagaggcagacaagtatcgactgacttacgcatacttcgcaggcggtgatgctggcgatgcattcgatggcttcgacttcggggacgatccaagtgataagttcttcacatcccataacgggatgcaatttagtacttgggacaatgacaacgataagttcgagggcaattgcgcagaacaggatggctccggctggtggatgaacaaatgccacgctggccatctgaatggcgtgtattaccagggcggaacttatagtaaggcttccacgcctaacggttatgacaacggtataatctgggctacatggaaaacgcggtggtattccatgaaaaagacaaccatgaagataatcccctttaatcggcttaccatcggggaagggcagcagcaccatctcgggggcgctaaacaagttcggcccgagcaccccgctgagaccgaatatgatagcctgtatccggaagacgacctt

SEQ ID NO: 11376 - DNA, 1359 bp, Artificial Sequence
  Description of Artificial Sequence: Synthetic coding sequence
atgagctggagcctccatccaagaaacctgatcctgtacttctacgctctgctttttctgtcctctacatgcgtcgcttacgtagctaccagggataactgttgcatactggatgaaagatttggaagctactgtcccacaacctgcggtattgctgattttctgagcacctaccagactaaggtggataaagatttgcagtccctcgaagacatactccaccaggttgagaataaaacaagcgaggtgaagcaactgatcaaagccatacagctcacctataaccccgacgagagcagcaagcccaacatgattgacgctgctaccctcaagtcacgcaaaatgctggaggagatcatgaaatacgaagcgagtattctgactcatgactcatcaatcaggtatctgcaggaaatctacaactccaacaaccagaaaatagtgaacctgaaggaaaaggtggcccaactcgaggcacagtgccaggagccttgcaaggataccgtgcagatacacgatatcaccggaaaagactgccaggacatcgctaataaaggggctaagcagtccgggctttacttcatcaagccactcaaagcaaaccagcagttcctggtttactgtgaaatagacggttccggaaacgggtggacagtgttccagaagaggctggatggttctgtggacttcaaaaaaaactggattcagtacaaagagggatttggccatttgagcccaaccggcacaaccgagttttggctcggcaacgagaaaatccacctcatcagcacacaatctgctattccctatgccctcagagttgaactagaagattggaacgggcgcacatctaccgccgattatgcgatgtttaaggtggggcctgaagcagataaatataggcttacatacgcatacttcgcaggaggcgatgccggggatgctttcgatggctttgactttggagacgacccttcggacaaattcttcacttcacacaacggtatgcagttttccacttgggacaatgacaacgataaattcgagggcaactgcgcagaacaggatggatctggatggtggatgaataaatgtcatgcaggacatttgaacggagtgtactatcaaggcggaacctacagcaaggctagcactccaaatgggtatgacaatggaatcatctgggctacatggaaaacgcggtggtacagtatgaagaagactactatgaagatcatcccttttaatcgactgacaatcggtgagggccagcagcaccatttagggggcgccaagcaggttaggcctgagcatccggcagagaccgagtacgatagcctgtatccagaggatgacttg

SEQ ID NO: 11377 - DNA, 1359 bp, Artificial Sequence
  Description of Artificial Sequence: Synthetic coding sequence
atgtcctggtccctccatccgcggaatctcatcctttacttctatgcattgctgttcctttcctccacctgtgtggcgtatgtggccacccgggacaattgctgcatcctggacgagcggtttggttcttactgtccaacaacctgcggaatcgcagactttttgagcacctaccagactaaggtggacaaggatctgcagtccctggaggatatcctgcaccaggtcgaaaacaaaacatccgaagtaaaacagttaatcaaggctattcagctcacctacaatcccgacgaatcatctaaacccaatatgatcgacgctgctaccctgaagtccaggaagatgctagaagaaatcatgaagtacgaagcttcaatactaacccacgattcatcgattcgctatttgcaggaaatctataacagcaataatcaaaaaatagtgaatctgaaggaaaaagtcgcccagctagaggcccagtgccaggagccatgcaaggatactgtgcagattcacgacatcacagggaaggattgtcaagacatcgcgaataaaggagcgaaacagtcaggtctctacttcattaagcccttgaaggcgaatcagcagtttctcgtgtactgtgagatagatggttctggaaacggctggacggtcttccagaagagactggatggttccgttgacttcaagaagaattggatacagtataaagaagggtttggtcatttgtcccccacagggaccaccgaattctggctgggtaacgaaaagatacatctcatttcaactcaaagcgcaattccctatgccttgcgggtggagctggaggactggaacggaagaacttccactgccgactacgctatgttcaaggttgggcctgaagcagacaaataccggcttacatacgcctactttgccggtggggacgccggagacgcattcgatgggtttgactttggcgacgatccttccgataaattctttacgtcccacaatggtatgcagttttccacttgggacaacgacaatgataagtttgaaggaaattgtgccgaacaagacgggtccggctggtggatgaacaagtgccacgctggccatctgaatggagtatattaccagggcggcacatactctaaagcatccactcccaatggatacgacaatggcatcatctgggctacgtggaagacccgatggtactccatgaaaaagaccactatgaaaataatcccatttaacaggctcactatcggcgaaggccagcagcaccacttaggcggcgccaaacaagttaggccggaacacccggcggagaccgaatacgacagcctgtatcccgaggacgacctg

SEQ ID NO: 11378 - DNA, 1359 bp, Artificial Sequence
  Description of Artificial Sequence: Synthetic coding sequence
atgtcctggtctctgcaccctcgaaatctcattctgtacttttatgcgctgctgttcttatcttctacttgcgtggcctatgttgcaaccagggataactgttgcatattggatgagagatttgggtcctactgtccaactacatgtgggatagccgattttttgagcacttatcaaactaaagtcgataaagatctccagagccttgaggacattctccatcaagtggagaacaagacatcagaagtgaagcagctcatcaaggctattcagttgacttacaaccccgacgaatcctcaaagcctaatatgattgatgctgccaccctgaaaagccgaaaaatgctggaagagatcatgaagtatgaggcaagtatccttactcatgatagttcaattcgatacttacaggagatctataatagcaataaccagaaaatcgtgaacttgaaggaaaaggtcgcccagctggaggcgcagtgtcaggaaccctgcaaggataccgtgcagattcatgacattaccggaaaggactgtcaggacatcgccaacaagggggccaaacagtccggactttattttattaagccgctgaaggctaatcaacagtttctggtgtattgtgaaatcgatgggagtgggaatggctggactgtgttccagaaacgactggatggaagcgtggactttaaaaagaactggattcagtataaagagggcttcggccatctgagccccaccggcaccactgagttctggttaggtaatgaaaagatccatttgatctccacgcagagtgccatcccttacgccctgcgcgtggaacttgaagactggaacggacgcacgtcgacagcggattacgccatgttcaaggttggacctgaggcggataagtaccgactcacctatgcttatttcgccgggggcgacgccggtgacgccttcgacgggtttgactttggagatgatcccagcgataaattctttaccagccataacggaatgcagttttcaacctgggacaatgataatgataaatttgaggggaactgtgccgaacaggatggttccggatggtggatgaataaatgccatgcaggccaccttaacggcgtctattatcagggggggacttatagcaaggcgagcacccccaatggctatgataacggcattatctgggcaacgtggaagacacggtggtattcaatgaagaagaccaccatgaaaataattccatttaatagattgactattggagaagggcagcaacaccacttgggcggcgcgaaacaggtccggccagaacatcctgccgaaaccgagtacgatagtctgtatccagaagatgacctg

SEQ ID NO: 11379 - DNA, 1359 bp, Artificial Sequence
  Description of Artificial Sequence: Synthetic coding sequence
atgtcgtggagtctccacccaagaaatttaatactttatttttacgctctcctcttcctgtcttctacttgcgtcgcttatgtagctactagggataactgttgcatattggatgaacgatttgggtcatattgcccaactacttgtggaatcgcagattttctgtctacttatcagactaaagttgataaagatctgcagtcccttgaagatatactgcaccaggtggaaaataaaacatcagaggtcaagcagctcatcaaggcaatccagctgacatataatcccgatgaatcatccaaaccaaacatgatcgatgccgcaactctgaaatcacgaaaaatgctcgaggaaatcatgaaatatgaagcctctatcctcacacacgattcctccattcgctaccttcaggaaatctacaattctaataatcagaaaatcgtgaatctcaaagaaaaggtggctcagcttgaagcacagtgtcaggaaccctgtaaagatacagtccagattcatgatatcacagggaaagactgtcaggatatcgcaaacaaaggggccaaacagtcgggactgtattttatcaaaccccttaaagccaaccagcagttcttggtttattgtgagatcgatggatcgggaaacggatggacggtgtttcagaaaaggttagatgggtccgtagattttaaaaagaattggatccagtataaagaaggattcgggcacctttctcccacaggaacaacagaattctggctcggaaacgagaaaatacatctcatctcaactcagtctgccatcccatacgcacttcgcgtggaattagaagactggaacgggcggactagtacagccgattacgccatgttcaaagtaggaccagaagccgataagtaccgactcacatatgcatattttgctggaggggatgcgggagacgctttcgatgggtttgatttcggagatgatcctagtgataaatttttcacttctcacaatgggatgcagtttagtacatgggataacgataacgataagttcgaagggaattgcgctgagcaggatggatcgggatggtggatgaacaaatgtcacgcgggacatctcaacggagtgtattatcagggggggacttattctaaagcatctacaccaaatgggtatgataacgggataatctgggccacttggaaaactagatggtattctatgaagaaaacaactatgaagatcatccccttcaatcgactgactattggagagggacagcagcaccacctgggaggagctaaacaggtgcggcctgaacatcccgccgaaactgaatatgacagtctatatcctgaggatgatctc

SEQ ID NO: 11380 - DNA, 1359 bp, Artificial Sequence
  Description of Artificial Sequence: Synthetic coding sequence
atgtcctggtcgcttcatccaagaaaccttatcttgtacttctacgcacttctttttctctcttcgacgtgtgtggcttatgtggccacccgagacaactgttgtatccttgatgaacggtttggctcgtactgtccaactacttgtgggatcgctgattttctttcgacgtatcaaacgaaagttgataaggatcttcaatcccttgaggacattttgcaccaagtggagaataagacgtcggaagtcaagcagcttatcaaggcaattcaactgacctacaacccagacgaatcatccaaacctaacatgattgatgctgcgactctgaagtcaagaaaaatgctcgaagagattatgaaatacgaggcatccatactgacccacgactcatccatcagataccttcaagaaatctacaatagcaacaaccagaagattgtgaacctcaaggagaaggtggcacaacttgaagcgcagtgtcaagagccgtgcaaagacacggtgcaaattcacgatattaccggtaaggactgtcaggatattgccaacaaaggggcaaagcagtcaggactgtacttcatcaagcctctgaaggccaatcagcagttcctggtgtattgcgaaatagacggctcaggtaatggatggaccgtctttcagaagcgactcgatggctccgtggacttcaagaaaaactggattcaatacaaggagggttttggacatctgagcccgaccggaaccactgaattttggttgggtaatgagaagatccatcttatttcaacccaatcggctatcccttacgccttgagggtcgaactggaagattggaacggtcggacttcaaccgcagattatgcaatgtttaaggtgggacctgaggcagataagtatcgtctgacctatgcctactttgcgggcggtgacgcaggagatgcgttcgatgggtttgatttcggcgatgatccctcagataagtttttcaccagccacaatgggatgcagttttccacttgggataacgataacgacaagtttgaaggtaactgcgcggaacaggatggctccggatggtggatgaacaaatgccatgccggacatttgaacggggtgtactaccaaggaggaacttactcgaaggcatccactcccaacggctacgataatgggattatctgggctacttggaaaacccgctggtactccatgaagaaaaccaccatgaagattatccctttcaatcgccttactattggtgagggtcaacaacaccatctgggaggagcaaagcaagtcagaccagaacatcctgctgaaaccgagtacgattccctctacccggaagatgatctc

SEQ ID NO: 11381 - DNA, 1359 bp, Artificial Sequence
  Description of Artificial Sequence: Synthetic coding sequence
atgtcctggtcccttcacccccgaaaccttattctttacttctacgcacttctgtttctctcgtcaacctgtgtggcctacgtcgcaacgagagacaactgttgtattctcgatgagcggtttggaagctactgcccaaccacctgcggcattgctgattttctgtcaacctaccagactaaagtggataaggatctgcagtcccttgaggatatccttcatcaagtggaaaacaagacttcggaggtcaagcagttgataaaggcaatccaactgacttacaatcccgatgagtcgtcaaaacctaacatgattgatgccgccacgctgaaatcacgtaagatgctcgaagaaatcatgaaatacgaagcatcgattcttacccatgactcctcgatccggtacctccaagagatttacaactccaataatcaaaagatcgtgaatctgaaggagaaagtggcacagctggaagcacagtgtcaagaaccttgcaaggataccgtgcagatccatgatatcactggaaaggactgccaggatatcgccaataagggtgccaaacaatccggactgtactttatcaaaccacttaaggcaaaccaacaatttctcgtgtattgcgaaattgacgggtcaggaaacggctggacggtgtttcaaaagagattggatggaagcgttgactttaagaagaactggatccaatacaaggagggttttggtcatctctccccaactggaacgaccgaattttggctgggtaacgagaaaattcatctgatttctactcagtccgcaattccttacgcccttagggtcgaacttgaagattggaatggcaggacctctaccgcagactatgccatgtttaaggtcggcccagaggcagataagtaccgactcacttatgcctacttcgctggaggcgacgctggagatgcatttgatggctttgactttggagacgatccctcggacaagtttttcacttcccataatgggatgcagttttcaacctgggataacgacaacgacaaatttgaagggaactgcgcagaacaagacggctccgggtggtggatgaataagtgtcatgcaggtcacctgaatggggtgtactaccagggtggaacctactcaaaagcatcgaccccaaacggatacgataatggaatcatttgggcgacttggaaaactcggtggtactcgatgaaaaagaccactatgaagataatcccgtttaacagacttactattggggaaggtcaacaacaccatctgggaggagcaaagcaagtgaggccagaacaccctgccgaaaccgaatatgatagcctctatccagaggacgacctg

SEQ ID NO: 11382 - DNA, 1359 bp, Artificial Sequence
  Description of Artificial Sequence: Synthetic coding sequence
atgtcctggagccttcatccacggaatctcatcctctacttctacgccctgcttttcctctcatccacttgtgtggcctacgtcgcaacccgcgataactgttgcatccttgacgagagattcgggtcgtattgccccaccacctgtggcattgccgacttcctctcgacctaccagaccaaggtggataaagatctgcagtccctggaagatatccttcaccaagtggagaacaagacttccgaggtgaagcaactgatcaaagcaatccagctgacctacaatccggacgaatcgtcgaagccaaacatgatcgacgcggctacgttgaagtcgcggaagatgcttgaagaaatcatgaagtacgaggcgtcaatactgacccatgattcctcaatccgctacctgcaagaaatctacaactcgaacaatcagaagattgtgaatctcaaggaaaaggtggcgcagctggaggcacagtgccaggagccatgcaaggacaccgtccaaatccacgacatcacgggaaaagactgccaggacatcgcgaataaaggagctaaacagtcgggcctgtacttcattaagcccctcaaagccaaccagcagttcctcgtctactgcgagatcgatggaagtggaaacggttggactgttttccaaaagcggctggatggatccgttgacttcaagaagaactggatccaatacaaagaaggatttggacacctgtcgccaaccgggactaccgagttttggctcggaaatgagaagatccatttgatttcgactcaatccgcaattccgtacgcacttagagtcgaactcgaagattggaacggtcggacctcaacggccgactacgccatgttcaaagtcggtcccgaggcggataagtaccgtctcacttacgcgtactttgcaggtggagacgccggagacgccttcgacggatttgatttcggtgatgatccatcggacaagttctttacctctcacaacggcatgcagttctccacctgggataacgacaatgacaaattcgagggaaactgcgctgaacaagatggcagcggatggtggatgaataagtgccatgcgggccacctgaacggagtgtactaccaaggaggtacctactccaaggcttccactcccaatggatacgacaatggaattatctgggcaacgtggaaaactcgctggtacagcatgaaaaagaccactatgaagattatcccttttaaccgcctgactatcggtgaaggacaacaacatcatttgggaggagccaaacaggtgcggccggaacatccagctgaaactgagtacgattccttgtatccagaagatgacctt

SEQ ID NO: 11383 - DNA, 1359 bp, Artificial Sequence
  Description of Artificial Sequence: Synthetic coding sequence
atgagctggtcattgcaccctaggaatctgattctttatttctatgccctgttgtttttgagcagtacgtgcgtggcgtatgtggccacaagagataattgttgcatcctggacgaacgcttcgggagctactgcccgactacctgtgggatcgctgatttcctctcaacttatcagaccaaggtcgacaaggatcttcagagtttggaggacattctgcatcaggtagagaacaaaacctctgaggtgaagcagcttatcaaagcaattcagcttacatacaacccagacgaatccagtaagcctaatatgattgatgctgccactctgaaatctaggaagatgctcgaagagattatgaagtacgaggcatcaatccttacccacgatagcagtatacggtacctccaagagatttacaacagcaataatcaaaaaatcgtgaatctgaaagagaaggtcgcacagctggaagcacaatgccaggagccatgtaaggataccgtacagatccatgatatcactgggaaggattgccaggatatcgcgaacaagggtgctaagcagtctggcctctatttcatcaaacctctgaaagccaatcagcagtttctcgtatactgtgaaatagacgggtctgggaatgggtggactgtgttccagaagagactggacggaagtgtcgacttcaagaagaactggattcagtacaaggagggattcggacacctgtctcccaccggaacaaccgagttctggctcggtaatgagaagatccatttgatcagtactcagagcgcaatcccctacgcgttgagggtcgaattggaggattggaatggccggacctccaccgccgactacgccatgtttaaggtggggcctgaagctgataagtatcgactgacatacgcatactttgccgggggggacgccggtgacgcttttgacggatttgacttcggcgatgacccatcagacaagttctttacttcccacaacgggatgcagtttagtacttgggataatgacaatgacaaattcgaaggaaattgtgccgagcaggatggaagtggatggtggatgaataaatgtcacgcggggcatctgaacggcgtatactaccagggaggtacatatagtaaagctagtacaccaaatggctacgataacggtatcatatgggccacatggaagactcgatggtatagcatgaagaagacaacaatgaaaatcatccccttcaatcgcctgaccatcggcgaggggcagcagcaccatcttggaggagcgaagcaggtgcgccccgagcacccagcggaaacagagtatgatagtttgtatccagaagacgatctg

SEQ ID NO: 11384 - DNA, 1359 bp, Artificial Sequence
  Description of Artificial Sequence: Synthetic coding sequence
atgtcctggtcgttgcatccccggaatctgatactgtacttttacgctctgctctttttgtcctccacttgtgtggcatacgtcgccactagagataactgctgcatactcgatgagcggttcggatcgtactgccccaccacttgcgggatcgcagattttctgtccacctaccaaaccaaggtggataaagatcttcagtccctcgaagatattcttcatcaggtggaaaacaaaacctccgaggtcaagcagctgattaaggcaatccaactgacttacaaccctgatgaatcctcaaagccaaacatgattgacgcagcaaccttgaaaagccgcaagatgctcgaagagatcatgaaatacgaagcctctatcctcacgcacgattcatccatcaggtacctgcaagagatttacaacagcaataatcagaaaatagtgaaccttaaggaaaaggtcgctcagcttgaagcccaatgtcaggagccttgtaaggataccgtgcaaattcacgatatcactggaaaggattgtcaggatattgccaacaaaggagcgaagcagtcggggctctacttcattaagcccctcaaagcgaatcaacaattcctggtctactgtgaaatagatggcagcgggaacggctggaccgtgtttcagaaaagactggatggatcggtggatttcaaaaagaactggattcagtacaaggaggggttcggtcatctgtcacccaccggtaccactgaattttggctcggtaacgagaaaatacacctgatttcgacccagagcgcaattccatacgccctcagagtcgagctggaggattggaacggcagaacttcgaccgcagactacgcgatgttcaaggtgggtcctgaagcagataagtatcgacttacttacgcctacttcgcaggcggtgacgccggagatgcatttgatggttttgattttggagacgacccaagcgacaagttctttacctcgcacaacgggatgcaatttagcacttgggataacgataatgacaagtttgaggggaattgcgcagaacaggacggttcaggatggtggatgaacaaatgtcatgcaggtcatcttaacggtgtgtactaccagggtggtacctactcaaaggcgagcacccctaatggctacgacaacggtataatctgggcaacctggaaaacccggtggtactcaatgaaaaagacgaccatgaagattattccttttaaccgcttgactatcggagaaggccagcagcaccacctcggtggggccaagcaggtgcggcccgagcatcccgccgaaactgagtacgactccctttaccccgaagatgacctg

SEQ ID NO: 11385 - DNA, 1359 bp, Artificial Sequence
  Description of Artificial Sequence: Synthetic coding sequence
atgtcgtggtcattgcaccctcgaaaccttattctgtacttctatgcacttctgttcctttcctccacctgtgtcgcatacgtggcgactcgagataactgttgtattctggacgagcggttcggctcgtactgtcctaccacctgtggaattgcagactttctctctacctaccagactaaggttgataaagatttgcagtccctggaagatattcttcatcaagtggaaaacaagacttccgaagtcaagcagctgatcaaggcaatccaattgacctacaacccagatgaatccagcaagccgaatatgatagacgccgcaaccctgaagtcccggaaaatgctggaagaaatcatgaagtacgaagcctcaattctcactcatgactcgtcaatccgctatcttcaagaaatctacaactcgaacaaccaaaagattgtgaacctgaaagaaaaggtggcccagctggaggcacaatgccaggaaccatgtaaagataccgtgcagattcatgatattactggaaaagactgccaagatatcgcaaacaagggtgcgaagcagtcaggcctgtatttcatcaagcctctcaaggccaaccaacaatttctggtctactgcgaaattgatggatcaggcaatggatggaccgtctttcaaaaaagactcgatggcagcgttgatttcaagaagaattggattcaatacaaagagggcttcggccatttgtcccctaccgggactactgaattctggctgggaaacgaaaagatacacctgatcagcactcagtcggcaattccttatgcactgcgggtggaactcgaggattggaatggacggacttcgaccgcagactacgcaatgtttaaagtgggaccagaagcagacaagtacaggcttacctatgcctactttgcaggtggtgacgcaggagatgcctttgatggctttgactttggtgatgatccaagtgacaagtttttcacttcccataatggcatgcaattctccacttgggataacgacaatgacaagtttgagggcaattgtgcggaacaggatggatcaggatggtggatgaacaagtgccacgcgggacatctgaacggggtgtactaccagggaggaacctactccaaagcctcgaccccgaatggatacgataatggaattatctgggcaacctggaaaacgagatggtactccatgaaaaagaccacgatgaagatcatcccttttaacagacttactattggggagggacaacaacatcacctgggtggggccaaacaggttcgaccagagcaccctgcagagacggaatatgattccctctaccccgaagatgatctt

SEQ ID NO: 11386 - DNA, 1359 bp, Artificial Sequence
  Description of Artificial Sequence: Synthetic coding sequence
atgtcctggagcctgcacccgcgcaacctcatcctgtacttctacgccttgttgttcctttcctcaacttgcgtggcatacgtggcaactcgcgataactgctgcatcctggacgaaaggttcggctcgtattgtccgaccacttgtggaatcgcggatttcctgtcaacctaccagaccaaggtggacaaagacctgcagtcgctggaagatatcctgcaccaagtggagaacaagaccagcgaagtcaagcagctgattaaggccatccaactgacctacaacccggacgaatcgtcgaagcccaatatgattgacgccgccaccttgaagtcccgcaagatgctggaagaaatcatgaagtatgaggcgtccatcctgactcatgactcgagcatcaggtacctgcaggaaatctacaactccaataaccaaaagattgtgaacctgaaggagaaggttgcacagcttgaagctcagtgccaggaaccatgtaaggatacggtccagatccacgacattaccggcaaagactgtcaagatatcgcaaacaagggagccaagcagtcaggcctgtatttcattaagccactcaaggcaaaccaacagttcttggtgtactgtgaaatcgatggaagcggcaacggatggacggtgttccaaaagagactcgatggcagcgtcgatttcaagaagaactggatccaatacaaggaaggtttcggacacctctcgcccactggcaccacggagttctggttgggaaacgaaaagatccacctcatctccactcaaagcgcaatcccatacgctctgcgggtggagctggaggactggaacggaagaacttcaaccgctgactacgcgatgtttaaagtcggcccggaggctgacaaatatcgtctgacctacgcgtatttcgcgggaggagatgccggcgacgctttcgacggattcgacttcggtgacgatccgagcgacaaattcttcacttcccacaatggaatgcaattttctacctgggataatgacaacgacaagttcgaagggaactgcgcagaacaggatgggtccgggtggtggatgaacaagtgtcatgcaggacatctcaacggagtgtactaccagggcgggacgtacagcaaggcgtccaccccgaatggatacgacaatggcatcatttgggcaacctggaaaacgaggtggtactcgatgaaaaagaccactatgaagattataccgttcaaccgcttgaccatcggagaaggacaacagcatcacctcggcggggctaaacaggtgcgcccagaacatcctgcagaaaccgagtacgattcgctgtaccctgaggatgacctg

SEQ ID NO: 11387 - DNA, 1359 bp, Artificial Sequence
  Description of Artificial Sequence: Synthetic coding sequence
atgtcctggtccctccatcctaggaacctcatattgtacttttatgcgctcctattcctcagttccacatgcgtagcttatgtggctacaagagataactgctgcatcttagacgagagatttggatcttattgtccaactacttgcgggattgcagacttcttatctacttatcagacaaaagtggacaaagaccttcagtcactagaagatatacttcatcaggttgaaaataaaacttccgaagttaaacagctcatcaaagccattcagttgacatataaccccgacgaatcatccaaacctaatatgatcgatgcggccactcttaaatctagaaaaatgctcgaagaaatcatgaaatacgaagcgtccatccttactcacgattcttccattaggtatctacaggaaatatacaattctaacaatcagaaaattgtgaatctcaaagaaaaagtagcgcagctggaagcccagtgccaggaaccttgcaaagatacagtgcagatacatgacataactgggaaagactgtcaggatatagctaataaaggggccaaacagtcaggactttattttattaaacctctgaaagctaaccagcagttcttagtgtactgcgaaatagatgggtctgggaacggatggacagtttttcagaaacgcctcgatggatctgtggattttaaaaaaaattggatccagtataaagaaggattcggacatctctcccctactgggacaacagaattttggcttggaaacgaaaagattcatctgatatccactcagtctgccatcccatatgcgctaagggtggagttagaagattggaacggaagaactagtacagcagattatgcaatgtttaaagtgggacccgaggccgataaatatcggcttacatacgcttatttcgccggaggggacgccggggacgcattcgatggatttgattttggggatgatccatcggataaattcttcacatctcacaacgggatgcagttttcgacatgggataacgataacgataaatttgagggaaactgtgctgaacaggatgggtcagggtggtggatgaacaagtgtcatgcaggacaccttaatggggtatattaccagggagggacgtattctaaagcgagtactccaaatggatacgataacgggatcatatgggcgacatggaaaacacgatggtactcgatgaaaaaaactacaatgaaaatcattccctttaacagactcactatcggggaaggacagcagcaccatcttggaggggccaaacaggttagacctgagcacccagctgaaactgagtacgattcactctatccagaggatgatctg

SEQ ID NO: 11388 - DNA, 1359 bp, Artificial Sequence
  Description of Artificial Sequence: Synthetic coding sequence
atgtcctggtctctgcatccccgaaatttaattctctatttctatgctttgttgttcctttcgtctacatgtgtagcgtacgtagccacccgcgataactgctgtattctggatgagcgtttcgggtcctactgtcctacaacctgcggaatcgccgatttcctgtcaacataccagactaaggtcgataaagacctgcagagcctggaggacattctgcaccaagtggaaaacaaaacttccgaggtgaaacagcttataaaggcgatccagctcacgtataatccggatgagtcatccaaaccgaacatgattgatgcagccactctgaagtcccgcaaaatgttggaagagattatgaagtacgaggcctctattttgacgcatgatagttctatcaggtatctgcaggaaatatataacagcaacaaccagaaaattgtaaatctcaaggagaaggtagcccagctagaagcacagtgtcaggagccctgtaaggatacggttcagatacacgatattacgggcaaggattgccaggatattgccaataaaggggccaagcagagcggtctttactttattaagccacttaaagcgaatcagcagttcctcgtgtactgtgagatcgatgggtcgggcaacggctggacagtcttccaaaagaggctcgatggatcagttgatttcaagaagaattggattcaatacaaggagggcttcggtcacctgagcccgacaggtaccacggagttctggctggggaatgaaaagatccacttaataagtacccaatccgctatcccgtacgccctccgtgtcgagcttgaggactggaacggacgtaccagcacggcagattacgccatgttcaaggtgggcccggaggctgataagtataggctgacgtatgcgtacttcgcagggggggacgctggcgatgcttttgatggcttcgacttcggcgacgacccaagcgataagttctttacgagtcacaatggcatgcaattttccacgtgggacaacgacaacgacaaattcgagggcaactgcgccgagcaggacggaagcggctggtggatgaacaaatgtcacgccggtcatcttaacggcgtgtactaccagggggggacctactcaaaggccagcaccccaaatggctatgataatggcatcatctgggctacatggaaaacaaggtggtactccatgaaaaagaccaccatgaaaatcatacctttcaacagattgaccatcggcgaggggcagcaacatcatttgggcggtgctaagcaggtacggcccgagcatccagcggaaaccgaatatgattcactgtaccccgaggatgatctg

SEQ ID NO: 11389 - DNA, 1359 bp, Artificial Sequence
  Description of Artificial Sequence: Synthetic coding sequence
atgagctggtccctgcacccacgcaacctgatcctgtacttctacgctctcctgttcctgagctcgacctgtgtggcatacgtggcgaccagggacaactgttgcatcctggacgaacgcttcggaagctactgtcccaccacctgcggcatcgccgatttcctgtcgacttaccaaactaaggttgataaagatctccagagcctggaggatatcctgcaccaagtggaaaacaagacttcggaggtgaagcaactgatcaaggccatccagctgacctacaatcccgatgagtcctccaagccaaacatgatcgatgcggccaccctcaagtcacggaagatgctggaagaaatcatgaaatatgaggcctcgatcctgacgcacgactcgtcaatccgctatctgcaggagatctacaactccaataaccagaagatcgtgaacctcaaggaaaaggtggcccagctcgaggcgcagtgccaggagccatgcaaggatactgtgcagatccacgatattactggcaaagattgccaggacatcgctaacaaaggcgcgaagcaatccggactctacttcatcaaaccgctgaaggcaaaccaacaatttctggtgtactgcgagatcgacgggtccgggaatggatggaccgtgttccagaagcggctcgacggatcggtggatttcaagaagaactggattcagtataaggaaggattcggccacctgtcaccgacgggcaccaccgaattctggctgggaaacgaaaagatccatctgatctccactcagtcggcgatcccgtatgctctgagagtcgagctggaagattggaacggtcggacctcaaccgcagattacgccatgttcaaagtgggacctgaagcggacaaataccggctcacctacgcctatttcgcaggaggcgatgcgggcgacgccttcgacggtttcgatttcggagatgacccatcggacaagttcttcacttcgcacaacggcatgcagttcagcacctgggacaacgataacgacaaatttgaaggcaactgtgcagaacaggatgggtccggctggtggatgaacaagtgccatgctggtcatctgaatggggtgtactaccaaggaggaacttactcgaaggccagcaccccgaatggatatgacaacggaatcatctgggctacctggaaaacccgatggtactcaatgaaaaagacgaccatgaagatcattcccttcaatagactgaccattggagaaggtcaacagcatcatcttggaggagctaagcaggtgcgcccggaacacccggcagagacggagtacgattccctgtacccggaagatgacctc

SEQ ID NO: 11390 - DNA, 1359 bp, Artificial Sequence
  Description of Artificial Sequence: Synthetic coding sequence
atgtcctggagcctccacccacgcaatctgattttgtacttctacgcactgttgttcctgtcatcgacgtgtgtggcctacgtggccactagagacaattgttgcatcctggatgagcgcttcggaagctactgccccactacgtgcggaattgccgatttcctgtccacctaccaaaccaaggtggacaaggacttgcagagccttgaagatatcctgcaccaggtggagaacaaaacttcggaggtgaagcagcttatcaaggccatccaactgacttacaacccggatgaaagctccaagccaaatatgatcgatgctgccactctcaagtcccgcaaaatgttggaagaaatcatgaaatacgaagcgtcgatcttgactcatgatagctccatccgatacttgcaagaaatctacaatagcaacaaccagaagatcgtcaatctcaaggaaaaggtcgctcagctggaagcgcagtgccaagagccttgcaaggataccgtgcagatccatgacatcactggcaaggactgccaggacatcgcaaataagggagcaaagcaatccggactctacttcatcaagccgctgaaggcgaatcagcagttcctggtgtactgtgagattgatgggtcgggaaacgggtggaccgtgttccagaaacggctggacgggtctgtggacttcaaaaagaattggatacaatacaaggagggctttgggcacctgtccccgaccggaactactgagttttggctcggtaacgagaaaatccacctcatctccacgcagtccgccatcccgtacgccttgagggtggaactcgaagattggaacggacggacttcgaccgcagactacgctatgttcaaagtcggcccggaagctgataagtatcggcttacctacgcatacttcgcgggcggtgacgccggagacgcttttgacggatttgacttcggcgatgatccgtcggacaaattcttcacgagccataatggaatgcagttcagcacttgggacaacgacaacgacaaatttgaaggtaactgcgcagagcaggacggctccggatggtggatgaacaagtgccatgccggacaccttaatggtgtgtactaccagggaggcacttactcaaaggcatcaaccccgaacggatacgacaatggaatcatctgggccacttggaaaaccagatggtacagcatgaagaaaaccaccatgaagataattccattcaacagactcactatcggagaaggacaacagcatcacctgggcggagccaagcaagtgcgccccgaacaccccgcggaaacggagtacgactcgttgtacccggaagatgacctg

SEQ ID NO: 11391 - DNA, 1359 bp, Artificial Sequence
  Description of Artificial Sequence: Synthetic coding sequence
atgtcgtggtcgctgcacccgcggaacctgatcctgtacttctacgctctgctctttctgtcatccacctgcgtcgcctacgtggcgaccagggataactgttgcatcctggacgaacgctttggatcatactgcccgaccacttgcggaattgctgacttcctgtcgacctaccagactaaagtcgataaggatctccagagccttgaagatatccttcatcaggtggagaataagacctccgaagtgaaacaactgattaaggcaatccagctgacctacaatccagacgagtcctcgaagcctaatatgatcgacgctgctaccctcaagtcccggaagatgttggaagagattatgaagtacgaagcgtccatcctcactcacgactcttcaatccggtaccttcaagaaatctacaattctaacaatcagaagatcgtcaatctgaaggagaaggtcgcccagctcgaagcacagtgccaagaaccatgtaaggacactgtgcagattcacgacatcaccggaaaggactgccaagacatcgccaataaaggtgcgaaacaatcggggctctacttcattaagccgctgaaagcgaaccaacagtttctcgtgtactgcgagatcgacggctcaggcaacggatggacggtctttcaaaagcggctcgatggcagcgtcgacttcaaaaagaactggatccaatacaaagagggatttggacatctgagccctaccggaaccaccgagttctggctgggtaacgaaaagattcacctgatcagcacccagtcagctattccgtacgccttgcgcgtggaactggaagattggaacggccgcacttcgacggcggactatgctatgttcaaggtgggtccggaagccgacaagtacagacttacttacgcctacttcgcgggaggcgatgccggcgacgccttcgacgggttcgactttggggatgacccttcagataagttcttcactagccacaacggcatgcagttttccacctgggataacgacaatgataagttcgaaggaaactgcgctgaacaggacggttcaggatggtggatgaataagtgccacgctggacatctgaacggcgtgtattatcagggcgggacttattccaaagcctcaaccccaaacggatacgataacggcatcatctgggctacctggaaaactcggtggtatagcatgaagaaaacgactatgaaaatcataccgttcaaccgcctcactatcggagagggccaacagcaccaccttgggggagcgaagcaggtgcgccctgaacatccggccgaaactgagtacgattccttgtacccggaagatgacctg

SEQ ID NO: 11392 - DNA, 1359 bp, Artificial Sequence
  Description of Artificial Sequence: Synthetic coding sequence
atgtcgtggtccctccatccaaggaatctgattctctatttctacgcactcctgtttttgtcatcgacgtgcgtggcgtacgtcgcgaccagggacaactgctgcatcttggacgagcggttcgggagctactgccctactacgtgcggcatcgcagattttctgagcacttatcagaccaaggtggacaaggatctgcaaagcctcgaagatatactgcatcaggtggagaataagacgtcggaggtgaaacagttgatcaaggcgattcagttgacttacaatcctgacgaatcgtccaagccgaacatgatcgacgccgccaccttgaagtccaggaagatgctcgaagagatcatgaagtacgaagcaagcatcctcacccacgacagctcgattcgctacctgcaagagatctacaacagtaataaccagaaaattgtcaaccttaaggaaaaggtggctcagctggaagcccaatgccaagaaccttgcaaggacacggtgcaaatccacgacattaccggaaaggattgtcaggacattgcaaacaagggggcgaagcagtcgggcctctacttcattaaacccctcaaagcgaatcagcaattcctcgtgtactgtgagatcgatggaagcggcaatggttggactgtgtttcagaagagactggacggatccgttgactttaagaaaaactggatacaatacaaggagggattcggccacctgtcacccactggaaccaccgagttctggttgggtaacgagaaaatccacctcatctcaacccagtccgcaatcccgtacgcactgcgcgtcgagctggaggattggaacgggcggacttcgaccgcagattacgcgatgttcaaagtgggaccagaggctgataagtaccggctgacctacgcctacttcgctggaggagacgcaggggatgcgttcgacgggttcgatttcggtgatgacccgtcagataagtttttcaccagccacaacggcatgcaattctccacttgggacaacgataacgataagttcgaaggtaactgcgcagagcaggacggatccggctggtggatgaacaaatgccatgctggacatctgaatggtgtgtactaccaaggtggaacgtactcaaaagcgtcgaccccgaacggatacgataacggcattatctgggccacttggaaaaccagatggtactctatgaagaaaactaccatgaagatcatcccgtttaatcgcctgactataggagagggacagcagcaccatctgggcggcgccaagcaggttagaccggaacacccggccgagactgagtatgactcactctacccagaggacgatctt

SEQ ID NO: 11393 - DNA, 1359 bp, Artificial Sequence
  Description of Artificial Sequence: Synthetic coding sequence
atgtcctggtccttgcacccgagaaaccttatcctctacttctacgccttgctttttcttagttctacctgtgtggcttacgtggccacacgggataactgttgtatcctcgacgagagatttgggtcatactgcccgactacttgcggcattgctgacttcttatccacttaccagaccaaggtggataaagatctgcagtctcttgaggatatactccaccaggtggagaacaaaacttcagaagtgaaacagctgattaaagcgatccagctgacttacaatcctgatgagtcatctaaaccgaatatgattgacgcggccactctcaaatccaggaagatgttagaagaaataatgaaatatgaggcctccatcctgacccacgacagctcaatccgctacctgcaggagatctacaacagcaacaatcaaaagatcgttaatttgaaggagaaagtagcccaattagaggcacagtgtcaggagccctgtaaagacaccgtgcagatccatgatattaccggtaaagattgccaagatattgcaaacaagggggcgaagcaatcaggcttgtattttatcaagcctctcaaggctaatcagcagttcctcgtgtactgcgaaattgatggatcgggcaatgggtggaccgtattccaaaagcgtctagacggaagcgtggactttaaaaagaattggatacagtacaaggagggattcggccatctgtctccaaccggtactactgaattttggctcggaaacgaaaaaatccatctgattagcacccaaagcgctattccatacgctcttcgagtcgagctcgaagactggaacgggagaacaagcactgccgactacgcaatgtttaaagtcggaccggaggctgataaatatcggttaacctacgcctactttgctgggggagatgccggagatgcattcgatgggtttgattttggggacgaccccagtgacaaattcttcacatcccataacggaatgcagtttagcacctgggacaacgacaacgataagtttgaaggaaattgcgctgagcaggatgggtctggctggtggatgaataagtgccatgcggggcacttgaatggggtgtactatcagggtgggacatactctaaagcctctactccgaatgggtacgataatgggatcatctgggccacatggaaaacgagatggtactctatgaagaaaacgactatgaagattataccattcaaccgcctgacaattggggagggtcagcagcatcacttaggcggagccaagcaggtcagaccagagcaccccgctgaaaccgaatacgactctctttatccagaggatgattta

SEQ ID NO: 11394 - DNA, 1359 bp, Artificial Sequence
  Description of Artificial Sequence: Synthetic coding sequence
atgagctggtctctgcaccccagaaacttgatcctctacttctacgcccttctgttccttagcagtacttgcgtggcatatgtggccactagggacaattgttgtatattggacgagcggtttgggagttactgccccacgacttgtggtattgcagactttctgagcacttatcagacgaaagtggataaggatctgcaatctctggaggacattctgcatcaggtggagaacaaaacctctgaggtgaaacagttgataaaggctattcaattgacctacaacccggatgaatcgtccaaacccaatatgatcgatgcggccaccctgaagagcaggaagatgctcgaggaaatcatgaagtacgaggcttccatcctgacgcatgattccagcattcggtatcttcaagaaatctataattcgaacaaccagaagattgttaaccttaaagaaaaggtggcacagcttgaggctcagtgtcaggagccctgcaaggacacagttcaaattcatgacattactggcaaagactgtcaagatatagccaacaagggggcgaaacaaagcggattgtatttcatcaagcccctaaaggccaaccagcagtttcttgtctattgcgagatcgacggttctggaaacgggtggaccgtgtttcagaagcgcttggacggctctgtcgacttcaagaagaactggatccaatacaaggaaggattcggacacctatcaccaaccgggacgacagaattttggctgggcaatgaaaagatacacctgatttctactcaatccgcgattccatacgcactgagagtcgaattagaggattggaacggtcgaactagtaccgccgactacgccatgtttaaggttggaccggaggcggataaatatcggctgacttacgcttactttgctgggggtgatgctggggatgcgttcgacggtttcgacttcggcgatgaccccagtgacaagttttttaccagccacaacggaatgcagttttccacttgggataatgacaacgataagtttgaggggaactgcgcggagcaggacgggagcggatggtggatgaataaatgccatgccgggcacttgaacggtgtttattaccaggggggcacctactctaaagcctcgacccccaatgggtatgataatggaatcatttgggccacatggaaaacacgctggtatagcatgaaaaaaaccaccatgaagattattcctttcaaccggctgacaatcggggagggccagcagcaccacttgggaggcgctaagcaagtgcgcccagaacaccccgccgagacagagtatgattctttgtaccctgaagatgacctc

SEQ ID NO: 11395 - DNA, 1359 bp, Artificial Sequence
  Description of Artificial Sequence: Synthetic coding sequence
atgagctggtccttgcaccccagaaacctcattctgtacttttatgccctgctattcctaagttccacctgcgtcgcttacgtagcaacacgcgataattgctgtattctggacgagcggtttgggtcctactgtccgactacctgcggtatcgctgacttccttagcacttatcagactaaagtggataaagacttacagagtctggaagacattctgcatcaggtggagaataagacctcagaggtcaaacaactcataaaggctatccagttaacatataatccagatgagagctcaaagccaaacatgatcgacgctgctaccttaaagtctcgcaagatgcttgaggagatcatgaaatacgaagcgtctatcctcacgcacgacagtagtattcggtacctacaggagatctacaacagcaacaaccagaaaatagtgaatttaaaggagaaggtcgcgcagctggaagcacagtgccaggagccttgcaaggacaccgttcaaattcacgatatcacagggaaggactgtcaggacattgcgaataaaggtgcgaagcaatcaggtctttatttcatcaagcccctcaaggccaatcagcagttcctcgtctattgtgaaatcgatggatctggcaacgggtggaccgttttccaaaagcggctggatggctctgtagatttcaagaagaattggatccagtacaaggagggcttcggacatttgagccctaccggaaccactgagttctggctgggcaacgagaagattcacctcatatctacacagagtgccataccatacgccctgcgtgttgaactggaggactggaatggccggacgagtactgcagactatgccatgtttaaagtggggcccgaagcagataaataccgcctgacatacgcttactttgcaggcggcgatgctggggatgcttttgatggcttcgactttggagatgatcccagcgataaattttttacatcccacaacggtatgcagttttccacatgggacaacgacaacgataagtttgaaggtaactgcgcagagcaagacggcagtggctggtggatgaacaagtgccacgcgggccacctgaatggggtttactaccaggggggaacttatagtaaggcatccacgcctaacggatatgataatggcatcatttgggcgacatggaagacccgatggtattcaatgaagaagacaaccatgaaaatcattcccttcaaccgactgaccataggcgaaggccagcagcatcatctgggcggcgcaaaacaagttagaccagagcatcccgccgagactgaatacgattcactgtaccctgaggacgacttg

SEQ ID NO: 11396 - DNA, 1359 bp, Artificial Sequence
  Description of Artificial Sequence: Synthetic coding sequence
atgtcctggtccctgcatccacggaatctgatcctctacttttacgcacttctgttcctgagctccacctgcgtggcgtacgtcgccaccagagataactgttgtatcctcgatgagcggtttggatcctactgcccaaccacctgtggaatcgcagatttcctctcgacttaccaaaccaaggtcgataaagacctccagtcactcgaagatattctgcatcaggtggaaaacaaaacgtcggaagtgaagcaactgattaaagccatccaactgacgtacaaccctgacgaatcttcaaaacccaatatgattgatgcagcaacccttaagagcagaaagatgctggaagagattatgaaatatgaagcgtcgattctcacccacgattcctcgattcgatacctgcaggaaatctataacagcaacaaccagaaaatcgtgaaccttaaagaaaaggtggcacagcttgaggcccaatgtcaagaaccttgcaaggatacggtgcaaattcatgatataaccggtaaagattgtcaggatattgcgaataaaggcgctaaacagagcggtctgtacttcattaaaccactgaaggccaatcaacaattccttgtgtactgcgaaatagatggatcaggaaatggatggaccgtctttcagaagcgcctggatggttcggtcgacttcaagaagaactggatacagtataaagaaggatttggacatctgtctcctactggtaccaccgaattttggctgggtaacgaaaagatccacctgatctccactcaaagcgccattccttacgcactccgcgtggaactggaagattggaacggtcggacctccactgcagattacgcaatgtttaaggtgggacccgaggcagataagtaccgactgacctacgcttactttgcaggaggagacgcaggggacgcctttgatgggtttgattttggggacgatcctagcgacaaattctttaccagccataatggtatgcagttttccacttgggacaacgataacgataagttcgagggtaactgtgcagagcaggacgggtccggctggtggatgaataagtgtcacgcgggacatctgaacggagtgtactaccagggtggcacgtactcaaaggcttcgactcctaacggatacgacaatggcattatctgggcaacctggaaaacgaggtggtattcgatgaagaaaaccactatgaaaatcataccctttaaccggctgactatcggtgagggccagcaacatcatctgggaggtgcaaagcaagtaagacccgagcatcctgcagaaaccgagtacgactcactttaccctgaggatgatctt

SEQ ID NO: 11397 - DNA, 1359 bp, Artificial Sequence
  Description of Artificial Sequence: Synthetic coding sequence
atgtcgtggagcctccacccgcgaaacctgattctgtatttctacgcgctgctgttcttgtccagcacttgcgtggcatacgtcgctacccgcgacaactgttgtatactggatgagcgattcgggtcgtactgcccgaccacgtgcgggatcgcagatttcctgtccacttatcaaactaaggtcgacaaggacctccagtcgctggaagatatcctccaccaggtggagaacaagaccagcgaagttaagcaactgattaaggcgatacagctgacgtacaaccctgacgagtcctcaaaacctaacatgatcgacgccgccactctgaaatcaagaaaaatgctcgaggagattatgaaatacgaggcatccatcctcacccatgactcatcgattaggtatctgcaagaaatctacaattcgaacaaccagaaaatcgtgaatctcaaagagaaggtggcccagctcgaggcgcagtgccaagaaccatgcaaggatactgtccagatccatgacatcaccggtaaagattgccaagatattgctaacaagggagcaaagcaatccggactgtacttcatcaagccgctgaaggcaaaccaacagttccttgtgtactgcgaaatcgacggttcaggcaatggctggaccgtgtttcagaagcgcctggatggatcggtcgactttaagaaaaactggatacagtacaaggaaggattcgggcacctctcgccaaccggcactactgaattctggttgggaaacgaaaagatccatctcatttccacccagagcgccattccgtacgcgttgagggtggaactggaagattggaatggtcgcacctcgacggccgactacgcgatgttcaaggtgggaccggaggctgacaagtacagactgacttatgcatacttcgccggcggggacgccggagacgcgtttgacggcttcgactttggagacgacccctcagacaagttctttaccagccataatggcatgcaattcagcacctgggataatgataacgacaaatttgaaggtaactgcgcagaacaggacggcagcggatggtggatgaacaaatgtcacgccgggcacctgaatggagtgtactaccagggagggacttactccaaggcttcgaccccaaatggctacgataacggaatcatctgggccacttggaaaacccggtggtactccatgaaaaagacgactatgaagatcatcccattcaatagactgaccatcggagagggtcagcagcatcacctgggcggagctaagcaggtcagacccgaacacccggctgaaactgagtatgattctctctacccggaagatgacctt

SEQ ID NO: 11398 - DNA, 1359 bp, Artificial Sequence
  Description of Artificial Sequence: Synthetic coding sequence
atgtcttggtccctccacccccgcaatctcatcctttacttctatgctctcctgttcctgtcctccacatgtgtggcctatgtggccactagagataattgttgtattctggatgagcggttcggctcctattgtccaacaacttgcggcatagcagacttcttgagtacgtatcagactaaggtcgacaaggatctgcagagccttgaggacatactccatcaggttgaaaacaagacctccgaagtgaaacagttgataaaggctatccaactgacctataatcccgatgaaagctcaaaaccaaatatgattgacgccgccaccctgaagagccggaaaatgctggaagagataatgaagtacgaagcctctatcctgacacacgattcatcaatccggtatctccaggaaatttacaatagcaacaatcaaaagattgtgaaccttaaggaaaaagttgctcaactggaagcccagtgtcaggaaccgtgcaaggacacggttcagattcatgatatcacaggaaaagattgccaagatattgcaaataagggagccaaacagtccgggctgtatttcataaaacccctgaaggctaaccagcaattcctggtgtattgcgagatcgatggatctgggaatggctggaccgtgttccagaaacgactggacggatcagtggattttaagaagaactggattcagtataaagaggggtttggacatctgagccctacaggcacaactgaattctggcttggaaacgagaagattcacctgatttccacgcaatccgcaatcccatacgccttgcgcgttgaactcgaggattggaacggccggacttcaactgcagactatgccatgtttaaagtaggtccggaggccgataagtacaggctgacctacgcttacttcgccggaggcgacgcaggcgatgcattcgacggcttcgatttcggtgatgacccaagcgataagttcttcacctcacacaacggaatgcagttctcaacctgggataacgacaacgacaaattcgaaggcaactgtgcggaacaggatggaagtgggtggtggatgaacaagtgccatgccgggcatctgaatggcgtgtactaccaaggaggaacctatagcaaggcctcaacccctaatggttacgacaatggtattatttgggccacctggaaaacacggtggtatagtatgaagaagacaacaatgaagattatccctttcaatcgcctgacgattggagaggggcagcagcatcatttgggaggagcgaaacaggtgcgcccagaacacccagccgagacagaatatgattccctctatcctgaggacgacctt

SEQ ID NO: 11399 - DNA, 1359 bp, Artificial Sequence
  Description of Artificial Sequence: Synthetic coding sequence
atgtcctggagcttgcatcctaggaatctgatcctttacttctacgctctgctgttcttatcttccacgtgcgtagcctatgtggctacccgggataattgttgtatcctagacgagaggttcggatcatattgcccaactacatgtggtatcgctgactttttatctacttaccaaactaaggttgacaaggacctgcagtccctagaagatatccttcatcaagtcgagaataagacaagtgaagtcaagcaactcataaaagcaattcaactgacttacaaccctgatgagagttccaagcctaacatgattgacgccgcgaccctgaaaagtcggaagatgctggaggagattatgaagtacgaagcctctatactcacccacgatagctccattaggtaccttcaagagatttataactccaacaaccagaagattgtaaacttgaaagagaaggtggctcagctggaggctcagtgccaggagccttgcaaagatacggtacagattcacgacataactggaaaggactgtcaggatattgccaataaaggggctaaacagagtggcctgtacttcatcaaacctctgaaggccaaccagcagttcctcgtgtactgtgagatagacggctctggcaatggttggacagtctttcaaaagagactggatggctccgtagattttaaaaaaaattggattcagtataaggaggggtttgggcacctcagccccaccggcactaccgaattctggcttggcaacgagaaaattcacttaatcagtacacagtccgccatcccttacgcccttcgggtcgaactcgaagactggaacggccgcacctctaccgccgactatgccatgtttaaagtggggcctgaagcggacaagtaccggctaacatacgcttatttcgcaggtggtgacgcaggcgacgcgttcgacgggtttgatttcggtgacgaccctagcgacaagtttttcacctcccataacgggatgcagttttcaacctgggataacgataacgataagtttgagggtaactgtgccgaacaggatggcagcggttggtggatgaataaatgtcacgccggacatctgaacggtgtgtactaccagggtggcacatactccaaggcctccactccaaacggctatgacaatggcatcatttgggctacatggaagacccggtggtactccatgaaaaagacaacaatgaaaattatcccctttaacaggctgactatcggggagggccagcagcatcacttgggaggagctaagcaggtgaggccggaacaccccgcagagacagaatacgacagcttgtaccctgaggacgacctg

SEQ ID NO: 11400 - DNA, 1359 bp, Artificial Sequence
  Description of Artificial Sequence: Synthetic coding sequence
atgtcgtggtctcttcatccccggaatctcattctttatttttacgctctcctgtttctttcctccacttgtgttgcctatgtcgccaccagagataactgctgtattcttgatgaacggtttggttcctattgccctaccacatgcggtattgctgactttctgagtacatatcagactaaggtggacaaggatttacagagcttagaagatatactccaccaagttgaaaataagacctcagaggttaagcaactgattaaggctattcaactaacctacaacccggatgagtcttccaaacctaatatgatagatgcagctactctgaaatccagaaagatgttggaggaaatcatgaagtatgaggctagcattcttacccacgattcttcgattcgctatctgcaagaaatctataacagcaacaatcagaagattgtgaacctgaaagagaaggtggctcagttagaagcacagtgccaggagccgtgtaaagatactgttcagattcacgatataacaggcaaagattgccaggatatagcaaataagggcgcaaagcaatcaggtctttacttcatcaagccactgaaagccaatcagcagttcttggtttattgtgaaattgatggctctggaaacggttggactgttttccaaaagaggcttgatggaagtgtagatttcaagaagaactggatccagtacaaggaaggatttggtcatctaagtccaactggcactacagagttttggttggggaacgaaaagatccatttgatcagtacccagagcgctataccctatgcgcttcgggtcgagttggaggattggaatggccgtacttccaccgccgattatgcaatgttcaaggtcggccctgaagccgataagtataggcttacttatgcatactttgccggtggagatgcaggagacgcttttgatggcttcgatttcggcgatgatccatccgacaaattcttcacatcccacaacggcatgcagttctccacctgggacaacgataacgataaattcgaggggaattgtgctgagcaagatggttccggctggtggatgaacaagtgtcatgctggccatctcaacggcgtttactatcaaggaggcacatatagtaaggcctccactccgaatgggtacgataatggaattatttgggcaacttggaagaccaggtggtattcaatgaaaaaaactaccatgaaaattatcccttttaataggcttactataggtgaaggtcagcagcaccacttgggaggcgcaaaacaggtacgaccagaacatcctgctgaaacagaatatgattccttatatcctgaagatgacttg

SEQ ID NO: 11401 - DNA, 1359 bp, Artificial Sequence
  Description of Artificial Sequence: Synthetic coding sequence
atgtcctggtcactgcatccaaggaacctgatcctctacttctacgccctcctcttcctgtcgtccacttgcgttgcgtacgtggcgaccagggataactgttgcatcctggacgaacgctttggatcctactgtcccaccacttgcggaatcgcggacttcctctcgacgtaccagactaaagtggataaggatctccaaagcctggaggatatactccaccaggtggagaataagacgtccgaagtgaagcaactgatcaaggccatccaattgacttacaatccagacgaaagcagcaagcctaacatgatcgacgctgcgaccttgaagtcccgcaagatgctggaagagatcatgaagtacgaagcctccatcctgacccacgactcaagcatccgctacctccaagaaatctacaactccaacaatcagaagatcgtcaacctgaaggaaaaggtcgcacaactggaagcccagtgccaggagccgtgtaaagataccgtgcaaattcacgatatcactggaaaggattgtcaggacattgcaaacaaaggagcaaagcagagcggactctacttcattaaaccattgaaagcaaaccagcagttcctggtgtactgcgaaatcgatggaagcgggaatggatggacggtgtttcagaagcggcttgatggaagcgtcgatttcaagaagaattggatccagtacaaggaaggattcggtcacctgtcgccgaccgggactaccgaattctggttgggtaacgaaaagatccacctgatttcaacccagtccgccatcccttacgcgctgagagtggagctcgaggactggaatggacggacctcaaccgcggattacgcgatgttcaaggtgggccccgaggccgataagtacaggcttacctacgcctatttcgcaggaggagacgccggagatgcattcgatggcttcgattttggcgacgatccgtcggacaaattcttcacgagccataacggcatgcagttttccacctgggacaacgataacgacaagttcgagggaaactgcgccgaacaggacggatcgggatggtggatgaataagtgtcacgccggacacctgaacggtgtttactaccaggggggtacttactctaaagcctccactccgaacggttacgacaacggcatcatatgggcgacctggaaaacccgctggtactccatgaagaaaaccactatgaagattatcccattcaaccgcctgaccatcggtgagggtcaacaacatcatctgggaggggccaagcaggtgcggcccgaacacccagcagagactgaatacgattccctgtacccggaagatgacctg

SEQ ID NO: 11402 - DNA, 1359 bp, Artificial Sequence
  Description of Artificial Sequence: Synthetic coding sequence
atgagttggagcctccacccccgtaacctgatcctttacttctacgccctgctgtttctatcatcgacatgcgtggcatatgtcgccactcgcgacaactgctgcattctcgatgaacgattcggttcttactgtcctactacgtgtggcatcgccgacttcttgtccacctaccagaccaaggtggataaggatttgcagtcactggaggatattctacatcaagtcgaaaataaaacctcagaggtgaaacagttgatcaaggccattcaattgacctataaccctgacgagtcctccaagccaaacatgatcgacgctgccaccctaaagtcaaggaaaatgcttgaagaaattatgaagtacgaagccagcattctgactcacgattctagcattcggtatcttcaagaaatttacaacagtaataaccaaaaaattgttaatctgaaagagaaggttgcacaactagaagcccagtgccaggagccatgtaaagataccgtacagatccacgatataacgggcaaagactgccaggacatagctaacaaaggggccaaacaaagtggcctgtattttatcaaaccactgaaggccaaccaacagtttctcgtatactgcgaaatcgatggctctggcaacggctggaccgttttccaaaaacgccttgatggatcggtcgatttcaagaaaaattggattcagtataaagaaggattcggccatctgagtccaaccggaacaaccgagttctggctgggaaacgaaaagattcatctgatcagtacccagtcagcgatcccatacgcacttcgcgtggagttggaggactggaatggtcgtacttctaccgccgattatgctatgttcaaggtaggtcctgaagctgataagtacaggttgacctacgcctattttgctggaggggacgccggggatgcctttgacggattcgacttcggcgatgatcccagcgataagttctttaccagccacaacggaatgcagttctctacttgggataatgataacgacaagttcgaaggaaactgtgccgagcaggatgggtctgggtggtggatgaacaaatgtcacgcaggtcatcttaatggagtgtattatcaggggggcacatactccaaggcttccaccccaaatgggtacgataacggcatcatctgggccacctggaagactcgctggtacagtatgaaaaaaaccacaatgaagataatccctttcaacagactcacaataggggaaggccagcagcatcacttaggtggtgccaagcaagtccgtccggaacacccagccgagactgagtacgattctctatacccagaagatgatctg

SEQ ID NO: 11403 - DNA, 1359 bp, Artificial Sequence
  Description of Artificial Sequence: Synthetic coding sequence
atgagctggagcctgcacccgcgaaatctgattctgtacttctacgctttgctcttcctctcctccacttgcgtggcttacgtggctaccagagacaattgctgcatcctcgatgagcggtttggatcgtactgccctacgacctgtggaatcgcggacttcctgtcgacttaccaaaccaaggtggacaaggacctccaatcattggaggatatcttgcaccaagtggaaaacaagaccagcgaagtgaagcagctgataaaagccatccagctgacctacaacccggatgaatcctcgaagccaaatatgattgatgccgctacccttaaaagcagaaaaatgctggaagagatcatgaagtacgaggcgagcatcctgacccatgacagctcaattagatatctgcaggagatctacaactcaaacaaccaaaagatcgtcaatctcaaggaaaaggtcgcccagttggaggcgcagtgtcaggagccatgtaaggatacggtccaaatacatgacattactggaaaggactgccaagacattgcaaacaaaggagcaaaacagtcgggactctatttcatcaaaccgcttaaggccaatcaacagttcctggtttactgcgagatagacggatcgggcaacggttggactgtgtttcagaagcgcctggacggatccgtggactttaagaagaactggatacagtataaggaaggcttcggacacctctcaccaaccgggactactgagttctggctgggtaacgaaaagatccacttgatctcaacccaatccgctatcccgtacgccctgcgggtcgaacttgaggactggaatggacggactagtacggcggactacgccatgtttaaggtggggccggaggcagataagtaccggctcacgtacgcatacttcgcggggggagacgccggggatgcatttgacggtttcgatttcggcgacgacccctccgacaagttcttcacctcacataatggcatgcagttctcgacctgggacaacgataacgataagttcgagggcaactgcgccgagcaggatgggtccggctggtggatgaataagtgtcacgccggacacctgaatggcgtctattaccagggaggaacctactctaaagcctccacccctaacggatacgataatggcatcatctgggctacttggaaaacccgctggtactcgatgaaaaagacgactatgaagatcattccgttcaataggctgaccatcggagagggtcaacaacatcatttgggcggcgcgaagcaggtaaggcctgagcacccggcggagactgaatacgattcgctgtaccctgaggatgacctg

SEQ ID NO: 11404 - DNA, 1359 bp, Artificial Sequence
  Description of Artificial Sequence: Synthetic coding sequence
atgtcctggtcccttcaccctaggaatcttattctgtatttttacgctttgctgttcctcagctccacatgcgttgcttacgtggcaacccgagacaactgctgtatcctcgatgagcggttcggttcgtactgccccactacatgtgggattgctgacttcctctcaacctatcaaacgaaagtcgataaggacctgcagtccttggaggacatattgcaccaggtcgagaataaaacctccgaagtcaaacagcttattaaggccatccaactgacctataacccagacgagtcttccaagccaaatatgatcgatgcggccaccctgaagtccagaaagatgctggaggaaattatgaagtatgaagcgtccattcttacccacgactctagcataaggtacctgcaggaaatctataactccaacaaccagaagattgtgaatttgaaggagaaggtggcacaattggaggctcaatgtcaggagccatgtaaggacacagtacagatccatgatatcactggcaaagattgtcaggatattgcgaataagggggcgaaacagtcaggcctatatttcattaaaccactcaaggccaaccagcaatttttggtgtactgtgaaatcgatggcagcgggaatggatggacagtctttcagaaacgtcttgacggatccgttgacttcaaaaagaactggatccagtacaaagaggggttcggacatctcagcccaactggcactactgagttttggctggggaacgagaagatccatttaataagtacccagagcgccataccgtatgctctgagagtggaactggaggattggaatgggagaaccagcacagcagactacgctatgttcaaagtcggtcccgaagccgataaataccggttgacctatgcttattttgctggcggagatgccggagacgcttttgacgggttcgacttcggggacgacccatccgacaagttcttcacctcccataacgggatgcaattctcaacctgggataatgacaatgacaaatttgaaggaaactgcgccgaacaggacgggtcaggttggtggatgaacaagtgtcatgcaggccacttaaacggagtgtattaccaaggcggaacctatagcaaggctagcaccccaaatgggtacgacaacggcataatctgggcgacctggaaaacaaggtggtattcaatgaagaaaacaaccatgaaaatcatccccttcaacaggctcactattggagaaggacagcagcatcatctcggtggagcaaagcaggtgaggcccgagcaccctgctgagacagagtacgacagtctgtatcccgaagatgatttg

SEQ ID NO: 11405 - DNA, 1359 bp, Artificial Sequence
  Description of Artificial Sequence: Synthetic coding sequence
atgtcgtggagcctgcatccgcgaaacctcattctgtacttctacgcactgctttttctctccagcacgtgcgtggcctacgtcgccacccgggacaactgctgcatcctcgatgaacgatttgggtcctattgtcctaccacttgtgggatcgcggattttctgagcacctaccagaccaaggtggataaggatcttcaatccctggaggatattctgcatcaggtcgaaaacaaaacctcggaggtgaaacaattgattaaagcaattcaactcacctataacccagatgaaagttcgaagcccaacatgatcgatgccgcaactttgaagagcaggaaaatgctggaagagattatgaagtacgaagcatccatcctcactcatgacagctccataagatacctccaagaaatctacaattcgaacaatcagaaaatcgtgaacctgaaggagaaggtcgcacagctggaagcccaatgccaggaaccatgtaaggacaccgtccagattcatgacattactggtaaggactgtcaagatattgcgaacaaaggagccaagcaatccggactgtacttcattaaaccgctgaaggctaatcaacaattccttgtctactgtgagatagatgggagcggaaatggatggactgtctttcaaaagcggcttgatggttcagtcgatttcaagaagaattggattcaatacaaggaaggatttggccatctctcgccgaccggcaccactgaattctggcttggcaacgagaaaatccatctcatatccactcaatccgcaattccttacgcactgagagtcgaactggaggattggaacggtcggactagcaccgctgactacgcgatgtttaaggtgggtcctgaagcggacaaataccgtctgacttacgcgtacttcgcaggaggtgacgcaggggatgccttcgacggctttgatttcggagatgacccatccgataagttctttacgagtcataatggaatgcaattttcgacttgggataacgacaacgataagtttgagggtaactgtgcagaacaagatgggtccggatggtggatgaacaagtgtcacgcaggacatctgaacggagtgtactaccaaggaggaacctactcaaaggcgtctacccctaatgggtatgataatggtatcatttgggcgacctggaaaactagatggtactcgatgaaaaagacgaccatgaagatcatcccctttaatcgtcttaccataggagaaggacagcagcaccacctgggcggtgcaaaacaagtcaggcccgaacatcctgcggaaactgagtacgactccctgtacccagaagatgacctt

SEQ ID NO: 11406 - DNA, 1359 bp, Artificial Sequence
  Description of Artificial Sequence: Synthetic coding sequence
atgagttggagcttgcacccaaggaatttgatcctctacttttacgcgctgttatttctgtctagtacctgtgtcgcttacgttgctacaagagacaactgctgcatcttggacgagaggtttggcagttactgtcctactacatgcggcatcgctgacttcctgtccacttaccaaaccaaggtagataaagatttgcagtcgctggaagatatccttcaccaggtggaaaacaagacctccgaagttaaacagctgatcaaggcaattcagttaacttataatcccgacgaaagcagcaaacctaacatgattgacgccgctaccctgaaaagcagaaagatgttagaagaaattatgaaatatgaggcgagcatactgacccatgactcttccatccgttacctgcaggaaatctataacagcaacaaccagaaaattgtgaatctaaaggaaaaggtggcccagctcgaagcccagtgccaggaaccctgtaaggataccgtgcagatacacgacataacagggaaggactgccaggatatcgccaataaaggcgcaaagcagtctggcctgtactttatcaagcccctgaaggccaatcagcagttccttgtgtactgcgagatagatggatcgggaaacggatggactgttttccagaagcggcttgacggcagtgttgacttcaaaaaaaactggattcagtacaaggagggcttcgggcacttaagtccaacgggaacaacggaattctggctgggcaacgaaaagatccacctcatcagcacacagtcggcgatcccatacgccttacgggttgagttagaagattggaacggccggacaagcacagccgactacgctatgttcaaggttggtccggaggctgacaagtaccgccttacctatgcctacttcgccgggggggatgcaggcgatgcctttgacgggtttgattttggcgacgaccctagcgacaagtttttcacctctcataacggcatgcagttctcaacctgggataacgataacgacaagttcgaagggaattgtgcagaacaggatggcagtggatggtggatgaacaagtgtcatgctgggcatctaaacggcgtgtactaccagggcgggacttacagcaaagcttcaacaccaaacgggtatgataatgggattatctgggcaacttggaagaccagatggtactccatgaaaaaaacgacaatgaaaatcattccatttaatcgactcacaattggcgaaggacagcagcaccatctgggaggcgctaagcaggtacgcccagagcatcccgctgaaacagaatacgactccctctatcccgaggacgatttg

SEQ ID NO: 11407 - DNA, 1359 bp, Artificial Sequence
  Description of Artificial Sequence: Synthetic coding sequence
atgagctggtccctgcatcccaggaacttgatactctacttttatgcccttctctttttgtcgtcgacctgtgtggcatacgtggcaactcgggataattgctgtattcttgacgaacgctttggttcgtactgtcctaccacctgcgggatcgcagattttctgtccacctaccaaaccaaagtcgataaggacctgcaatcactcgaggacattctgcaccaagtcgagaataagacgtccgaagtgaaacagctcataaaggcgatccagctcacctacaacccggatgagtctagtaaacctaatatgattgacgctgcaactctgaagtcaaggaaaatgctggaagaaatcatgaagtacgaagcaagcattctcacccatgattcgtcgatccggtacctgcaggagatctacaattcaaacaaccagaagatcgtcaaccttaaggagaaggttgcccagctggaagcacaatgtcaagagccatgcaaagatactgtgcaaatccatgatattactggaaaggattgtcaagatattgcaaataagggtgcaaaacaatcgggactgtactttatcaagccacttaaggcaaaccaacagttcctcgtttactgtgaaattgatggatccggcaacggatggactgtgtttcaaaagcgtctcgacggatccgtggatttcaagaaaaactggatacagtacaaagaaggatttggtcatcttagcccgaccggcactaccgagttttggctgggtaacgagaaaatccatcttatctcgacgcaatccgctatcccttacgcactccgggtcgaactcgaagattggaacggtaggacttcaaccgctgattacgcgatgtttaaggtgggacccgaagcagacaaatacaggcttacctacgcatactttgcaggtggcgatgcgggggacgcttttgatggctttgacttcggggatgatccttcggacaagtttttcacctcccataacggtatgcagttttcgacttgggataatgataacgacaaatttgaaggaaactgtgcagagcaagatggatcgggatggtggatgaataagtgccatgcaggacacctgaatggggtgtactaccaaggggggacttacagcaaagcctcaactcccaacgggtacgataatggtatcatctgggcaacgtggaaaacccggtggtacagcatgaagaaaactactatgaaaatcattccattcaaccgtttgacgattggtgagggacagcagcatcatctgggaggtgcaaagcaggtcagaccggaacaccctgcagagacggagtatgattcgctgtatcctgaagatgatctg

SEQ ID NO: 11408 - DNA, 1359 bp, Artificial Sequence
  Description of Artificial Sequence: Synthetic coding sequence
atgagctggtcgctgcatccccgcaacttgattctgtacttttacgcacttcttttcctgtcctccacctgtgtggcgtacgtggctaccagagacaattgttgtattcttgatgaacgatttgggtcctactgtccaactacttgcggaatcgctgatttcctgtctacgtatcagacgaaagtggataaggatctgcagtcactggaggacattttgcaccaagtcgaaaacaagacctcggaggtgaagcaactgattaaagccattcagctgacctacaaccctgatgagtcatcaaaaccgaacatgatagatgcagcaacgttgaagtcgaggaaaatgctggaagagattatgaagtacgaagcgagcatcttgactcacgactcgtccatcagataccttcaagaaatctacaactcgaacaatcaaaagattgtgaatcttaaggaaaaggtggcacaacttgaagcacaatgtcaggaaccatgcaaggacacggtccagatccatgacatcaccggtaaggattgccaggatattgctaacaaaggggcaaagcaaagtgggctgtacttcataaaaccattgaaggcaaaccaacagtttctggtctactgtgaaattgatggttcgggtaatgggtggaccgtgtttcaaaaaaggcttgatggcagtgtggacttcaagaagaattggattcagtacaaagaaggatttgggcacctgtcccctaccggtactaccgagttttggcttggaaacgaaaagattcatctgatctccacccagtccgctattccttacgcgcttcgggtggaacttgaagattggaacggccgcaccagcactgccgattacgctatgtttaaggtgggtccagaggctgataagtacaggctcacttacgcgtacttcgccggaggtgatgcgggtgatgcctttgatggatttgactttggggacgatccatccgacaaattcttcacttcacataacggcatgcaatttagcacttgggataacgacaatgataagtttgaaggtaactgcgccgaacaagacggatcgggttggtggatgaacaagtgtcatgcaggacatcttaacggcgtctattatcaaggtggaacctattctaaagcatccaccccaaacggctacgataatgggatcatttgggccacttggaaaacccggtggtactccatgaaaaagaccactatgaaaatcatcccttttaacagactgaccataggggaggggcagcagcatcatctcggcggagctaagcaagtcagacccgaacatccagctgagacggagtacgacagcctttacccggaggatgatctc

SEQ ID NO: 11409 - DNA, 1359 bp, Artificial Sequence
  Description of Artificial Sequence: Synthetic coding sequence
atgtcctggtcgctgcatccgcgcaacctgatcctgtacttttacgcgcttctcttcctgtcatcgacctgtgtggcatacgtggccaccagagacaattgctgcatcctcgacgaacgcttcggttcctactgcccgaccacctgcgggatcgccgattttctctcaacgtaccaaaccaaggtggacaaagatctccagtccctggaggatattctgcaccaagtagaaaacaagacttccgaggtcaagcaattgatcaaggccatccaactgacttacaatcccgatgagtcgtcgaaacctaacatgatcgacgcggcgactctgaaatcccgtaaaatgctggaggagattatgaagtacgaagcgtcgatccttactcacgactcgtccatccgatacctccaggagatatacaattctaacaaccagaaaattgtcaacctgaaagagaaagtggcccagctggaagcccaatgtcaggagccgtgcaaggatactgtgcaaatccacgacatcaccggaaaggactgccaggatatcgcaaataagggggcaaagcaaagtggcctgtatttcatcaaaccactcaaggcaaatcagcaattcttggtgtactgcgagatcgatggcagcggtaatggatggactgtgttccagaagcgcctcgatggctctgtcgacttcaagaagaactggatccaatacaaagaaggttttggacatctttcgccgactggaaccaccgagttttggttgggaaacgaaaagatccatctcatctcaacccagtcggcgatcccttacgccctgagagtcgaactggaggactggaacgggagaacctcgaccgcagactacgcaatgttcaaggtcggacccgaggctgacaagtacaggctgacttacgcctatttcgctggaggggatgcgggcgatgcctttgatggattcgacttcggtgacgatccttcagacaagttcttcacttcacataacggtatgcaatttagcacttgggacaacgacaatgacaagttcgaaggaaactgcgccgaacaagacggaagcggctggtggatgaacaagtgtcatgcgggccatctcaatggagtgtactaccagggaggtacctactccaaagcatctaccccgaacggatacgacaacggaatcatctgggcgacctggaaaacgcggtggtactccatgaaaaagactaccatgaagataatcccattcaaccggctcaccatcggtgagggtcagcagcatcatctcgggggcgctaagcaagtgcgcccggaacatccggccgaaacggagtacgactccctgtacccagaggacgatctg

SEQ ID NO: 11410 - DNA, 1359 bp, Artificial Sequence; identical to SEQ ID NO: 11359
  Description of Artificial Sequence: Synthetic coding sequence

SEQ ID NO: 11411 - DNA, 1359 bp, Artificial Sequence
  Description of Artificial Sequence: Synthetic coding sequence
atgtcctggtcgctgcacccaaggaacctcatcctctacttttacgccctgctcttcctgtcgtcaacctgcgtggcgtacgtcgcaactcgtgataactgctgcatcctggatgagagatttgggtcttattgtccaactacttgtggaatcgcggacttcctcagcacctaccaaaccaaggtggacaaggatctccaatcgctggaagatatcttgcatcaggtggagaataagacgtcagaggtgaagcagctcatcaaggcgatccagctgacctacaatcccgacgaatcaagcaagcccaacatgatcgatgccgctactctcaagagccgcaaaatgctcgaagagatcatgaagtacgaagcctcaattttgacccatgactcctcgattcgctacttgcaggagatctataactcaaacaatcaaaagatcgtgaacctgaaagaaaaggtcgcgcaactggaagctcaatgccaggaaccgtgcaaggacacggtccaaatccatgacatcactggaaaggactgccaggacattgcgaacaaaggcgccaaacagagcggactgtacttcatcaagccgctgaaggcaaaccaacaatttctggtgtactgtgaaattgacggatccggaaacggctggactgtgtttcaaaagaggctcgacggttccgtggacttcaagaagaattggatccagtacaaggaaggattcggacatctgagcccaacgggaaccaccgagttctggctgggaaatgaaaagatccacctcatctccacccaatcggccatcccatacgctcttcgggtggaacttgaggactggaacgggcgcactagcaccgccgactatgccatgttcaaggtggggccggaggccgacaaataccgcctgacttatgcatacttcgcaggtggagatgcaggcgatgcctttgacggctttgatttcggagatgacccatccgacaaattcttcacttcgcataatggaatgcagttctcaacttgggataacgacaatgataagtttgaaggcaactgcgcagagcaggatgggtcaggatggtggatgaacaagtgccacgcgggtcacctgaatggcgtctactaccaagggggaacttacagcaaggcctccacgccgaacggctacgataatggtatcatctgggccacttggaaaacgaggtggtactccatgaagaaaactaccatgaagattatccctttcaacagactcactattggcgaaggacagcagcaccacttgggaggagcaaaacaggtgcggccggagcatccagcggaaaccgaatacgactcgctgtaccctgaggatgatttg

SEQ ID NO: 11412 - DNA, 1359 bp, Artificial Sequence
  Description of Artificial Sequence: Synthetic coding sequence
atgtcttggtcattgcatcctcggaaccttatcttgtacttctacgcactgctctttctttcgtcaacttgtgtcgcatacgtcgcgacccgagacaactgctgcatcctggatgaacgatttggatcatattgtcccaccacctgtgggattgcagactttctctccacctaccagaccaaggtggataaagacctgcagagcctggaggacatactccatcaagtggaaaacaaaacttccgaagttaaacagctgattaaagcgatccagcttacctacaaccccgatgaatccagcaagcccaatatgattgatgccgccaccttgaaatcacgcaagatgctcgaggagatcatgaagtatgaggcctcaatccttacgcacgattcctccattagatacttgcaggagatttacaattcaaataaccagaaaattgtgaacctcaaagagaaggtggcgcaacttgaagcgcagtgtcaggaaccgtgcaaagatacggtgcaaattcatgacataacggggaaggattgtcaagatatagcgaataaaggtgcaaagcaaagtggtctttacttcattaagcccttgaaggcgaaccagcaatttcttgtgtattgtgaaattgacggatcgggtaatggatggaccgtgttccagaagagactcgacggttcggtggatttcaagaagaactggatccaatacaaggagggatttggccacctgagccctaccggcaccaccgaattctggctcggaaatgaaaagatccacctgatctcaacgcagtccgcaataccatacgccctgcgagtcgaacttgaagattggaacggtcggactagcaccgcagactacgccatgtttaaggtgggacctgaagctgacaaatacagactgacttacgcatactttgctggcggtgacgccggcgacgcattcgacggtttcgattttggagatgatcctagcgacaagttctttacctcgcataacggaatgcagttcagcacttgggataatgacaatgataagttcgagggcaattgcgcagaacaggatggatcgggttggtggatgaataagtgccatgccggacatctgaacggagtctactaccaggggggcacctactcgaaggcgagcactcctaacggatacgacaacgggatcatttgggcaacttggaaaacccggtggtacagcatgaaaaagacgactatgaagattatcccatttaacagacttaccattggagagggccagcaacatcaccttggaggtgctaagcaggtgcgtccagaacatcctgcagaaacggagtacgattcgctttacccagaggacgacttg

SEQ ID NO: 11413 - DNA, 1359 bp, Artificial Sequence
  Description of Artificial Sequence: Synthetic coding sequence
atgtcctggtcgttgcatccgagaaatctcatcctgtatttctatgccctcctcttcctgtcctcgacttgcgtggcgtacgtggcaacccgggataattgctgcatcctggacgaaaggttcggatcatactgtccaaccacctgtggtattgccgatttcctctcgacttaccagaccaaggtcgacaaggacctgcagtccctggaggacatcctccaccaggtggaaaacaagactagcgaagtgaagcaactgatcaaggcgatccagctgacttacaatccagatgaatcctcaaagccgaacatgattgatgccgccacgctgaagagccgaaagatgcttgaggaaatcatgaaatacgaagcgtcaatcctgacccatgatagctcaatcagatacctgcaggaaatctataattcgaacaaccagaagatagtcaatcttaaggaaaaagtggcacagttggaggcgcagtgtcaagaaccgtgcaaggatactgttcagattcatgacatcactggaaaggactgccaggacatcgccaataaaggcgcaaagcaatcgggattgtactttatcaaaccactcaaggcaaaccagcaatttctcgtctactgcgagatcgatggatcgggaaacggatggacggtgttccaaaagcgcctcgacggaagcgtggacttcaagaaaaattggatccagtacaaggagggattcggccacctgagccccactggaaccaccgaattctggctcgggaacgagaagatccacctgatctcaactcagtccgccatcccttacgctctgcgggtcgaactggaagattggaatggtcgcacctcgactgccgactacgcgatgtttaaggtgggcccggaggcagataagtacagactgacctacgcttactttgccggaggagatgctggcgacgcgttcgacggatttgatttcggggacgacccgtccgacaaattcttcacttcccataacgggatgcagttctcaacttgggacaacgataatgacaagttcgagggcaactgcgctgagcaagacggcagcgggtggtggatgaacaaatgccacgccggacacctgaacggagtgtactaccaaggtggcacctactcgaaggcatctacccccaacggttacgacaacggtatcatctgggccacttggaaaacccggtggtacagcatgaagaaaaccacgatgaaaatcattccttttaaccgcctgaccattggcgagggacaacaacatcacttggggggagctaaacaggtccgccctgaacacccggccgagacggaatacgactccctttacccagaggatgatctc

SEQ ID NO: 11414 - DNA, 1359 bp, Artificial Sequence
  Description of Artificial Sequence: Synthetic coding sequence
atgtcatggagccttcatcctcggaacctcatcctgtacttctacgccctcctgttcctgtcaagcacttgcgtggcttacgtggctactcgggacaactgttgcatcctggatgaaagattcggttcctactgcccaaccacctgcggcatcgcggacttcctgtctacgtaccagactaaggtcgataaggacttgcaatcgctcgaagatatccttcaccaggtcgaaaacaaaaccagcgaagtgaagcagctgataaaggccattcagctgacgtacaatccggatgaatcttcgaagccaaacatgatcgacgccgcgacgctcaaatcacggaaaatgctggaagaaatcatgaaatatgaggcttcgatcctgacgcacgactccagcatcagatacctccaagaaatctacaactccaataaccagaagatcgtgaatcttaaggagaaggtggcgcagttggaggctcaatgtcaagagccatgcaaagataccgtacaaatccacgatatcactggaaaggactgccaagatatcgcaaacaagggtgctaagcagtcgggactctacttcatcaagccgctgaaggccaaccagcagttcctcgtctactgcgaaatcgatgggagtggaaacggatggaccgtttttcagaaacgcctggatggttccgtggactttaagaaaaactggatccaatacaaggaaggtttcgggcacctttccccgactggaactacggagttctggctgggcaacgaaaagatccatctgatctcaactcagtctgccatcccttacgcgcttcgcgtggaattggaggactggaatggaaggacttccactgccgattacgctatgttcaaagttggtccggaggccgacaaatatcgcctcacttatgcatacttcgccggaggagatgccggcgatgcgtttgacggttttgacttcggagatgacccgtctgacaagttctttacgtcccataatggaatgcagttttccacctgggacaatgacaatgacaaattcgaggggaactgcgcagaacaggatggtagcggatggtggatgaataagtgtcatgcgggacacctgaacggcgtgtactaccaaggaggaacgtactcaaaggcctccaccccaaatggatacgacaatggcatcatctgggccacttggaaaacccgctggtattccatgaaaaagactaccatgaagatcatcccatttaaccggctcaccatcggagaaggccagcagcaccacctgggcggggccaagcaggtgcggcccgagcaccctgccgagactgagtacgactcgctgtaccccgaggacgatttg

SEQ ID NO: 11415 - DNA, 1359 bp, Artificial Sequence
  Description of Artificial Sequence: Synthetic coding sequence
atgtcctggtcactgcatcctaggaaccttattctttacttttacgcgctgctcttccttagctccacctgcgtggcctacgttgccactagggacaactgttgtatcctcgatgaacggttcggatcatattgtcctaccacctgcgggattgccgattttctttccacctaccagaccaaggtggacaaggatctgcaatcactcgaggacattctccatcaagtggagaacaagacttcggaagtcaaacaactgatcaaggcaatccagcttacgtacaacccagatgagagctcaaagccaaacatgattgacgctgcaactcttaagtcgcgcaagatgctggaggaaatcatgaagtacgaagcatccattctgacccatgactccagcattagatacctgcaggagatatacaactccaataatcagaaaatagtcaacctgaaagagaaggtggcgcagttggaagcgcaatgtcaggagccttgtaaggacactgtccagattcacgacattactggcaaggattgtcaagatattgctaataagggagcaaaacagtctgggctgtacttcattaaaccacttaaagcgaaccagcagttccttgtctactgcgaaatcgatggatccggcaatggctggaccgtttttcagaagaggctggatggttccgtggacttcaaaaagaattggatccagtataaggaggggttcgggcacctctcacctaccggcacgactgagttttggcttgggaatgaaaagatccacctgatctccacccaaagcgcaattccgtatgcactgagggtggaactggaagattggaacggacgcacctcaaccgctgactacgcaatgttcaaagtgggacctgaggcagacaagtacaggctgacctacgcttacttcgcaggtggcgacgcaggggatgccttcgatggatttgatttcggagacgatccctccgataagttctttacttcacataacggcatgcaattttccacctgggacaatgacaacgacaaatttgaaggaaattgtgcagagcaagatggatcaggttggtggatgaacaagtgccatgcagggcatctgaacggcgtgtactaccaaggcggtacttactcaaaggccagcacccccaatggttacgataatggaatcatttgggctacttggaaaacgcgctggtactcgatgaagaaaactaccatgaagattatacctttcaatcgtttgactattggagaaggtcaacaacaccatctgggaggggccaagcaggtcagacctgaacatcctgcggaaaccgaatacgattcgctctacccagaggacgatctg

SEQ ID NO: 11416 - DNA, 1359 bp, Artificial Sequence
  Description of Artificial Sequence: Synthetic coding sequence
atgtcctggagcctgcacccaagaaatcttatactctatttctacgcactgttgtttctttcgtccacttgtgtcgcatacgtcgccactagagataactgttgtattcttgatgaaagattcggctcgtactgcccgactacttgcggtattgctgatttccttagcacctaccaaactaaggtggacaaggatcttcagtccctggaggatattctgcaccaagtggagaacaagacctccgaggtcaagcagctgattaaggcaatccaactcacttacaaccctgatgaatcatcgaagccgaacatgattgatgcagccacgctcaagtcgagaaaaatgctcgaagagattatgaagtacgaggccagcatcctcactcatgattcctcaatccgataccttcaagaaatctataactcgaacaaccaaaagattgtcaaccttaaggagaaggtggcccagctcgaagcacaatgtcaagaaccttgtaaggataccgtgcaaattcatgatatcactggaaaggattgtcaagacatagcaaacaaaggtgcaaaacagtccggtctttactttatcaagcctcttaaggcaaaccaacaatttctggtgtactgcgaaattgacggaagcggtaacggttggactgttttccaaaaaaggctggatggttcggtggacttcaagaagaattggattcagtacaaagaggggtttggtcacctttcgccaactggaactaccgaattctggctgggaaacgagaagattcacctgattagcactcagtcagccatcccttacgctctgcgggtggagcttgaggactggaacggccgaacctcgaccgcagactacgcgatgtttaaggtgggtccagaagctgataagtacagattgacttacgcatactttgcaggcggagacgcaggcgacgcatttgacggatttgattttggagacgatccttcagacaagttctttacttcgcataatggtatgcagttttcgacctgggataatgacaacgacaaatttgaaggtaactgtgcagagcaggacggtagcggatggtggatgaacaagtgtcacgcaggacatctcaacggtgtgtactaccaaggaggaacctacagcaaagcatccacgccaaacggttacgataacgggatcatttgggcaacctggaaaacgcgctggtactcaatgaagaaaaccactatgaaaatcatcccgtttaacaggcttacgattggtgaaggacagcaacatcaccttggtggagcgaagcaggtgcgccccgaacaccctgccgaaactgaatacgattccctctaccctgaggatgatctt

SEQ ID NO: 11417 - DNA, 1359 bp, Artificial Sequence
  Description of Artificial Sequence: Synthetic coding sequence
atgtcgtggtcgctgcatccacgcaatctcatcctctatttttatgcgctgctgttcctttcctctacatgcgtggcctacgtggcaacaagggacaattgctgtatcctcgacgagcgttttggaagttattgtcctactacctgtggaattgctgatttcctgagcacctatcagaccaaagtggacaaagacttgcagtccctcgaggacatcctgcaccaagttgagaacaagacaagcgaggttaagcagcttattaaggcgattcaactcacctacaaccccgacgagtcctccaagccaaacatgatcgacgcagccaccttaaaatcccgcaagatgttagaggagattatgaaatacgaggcatcaatcctaacccacgactcttcgatcaggtacttgcaagaaatttacaattcaaataatcagaagattgtgaatctgaaagagaaggtagcccagctggaggctcaatgtcaggagccctgtaaggacactgttcagatccatgatattactggaaaggattgtcaagatatagccaacaagggggcaaaacagagtggactgtattttattaagccattgaaggcgaatcaacaatttttggtctattgcgaaattgatgggtcaggcaacggttggacggtctttcagaaacggctagacggttccgtcgactttaaaaagaactggattcagtacaaggaggggtttggccatctctcaccaacaggaacaaccgaattctggttgggcaatgagaaaatccatctgatctccacacagtccgccattccatacgccctgagagttgaactggaggactggaatggacgcacttctaccgccgattacgcaatgtttaaggtgggccctgaagctgacaaatatagactaacgtatgcctatttcgccgggggcgacgctggcgatgcctttgacggttttgatttcggcgacgacccttctgataaattttttacctctcataatggaatgcagttttcgacctgggataatgacaatgacaaatttgagggcaactgtgctgagcaggatggctcaggctggtggatgaacaagtgtcatgctgggcatctgaatggagtgtattaccagggcggaacctattccaaggcatccactcctaacgggtacgacaatggaattatatgggcaacctggaaaaccagatggtatagcatgaaaaagacgactatgaaaatcatcccttttaatcgactcacgattggagaagggcagcaacaccacttaggaggtgcgaaacaggtcagacccgagcatcctgccgagacggagtacgactccctgtatccagaagatgacctt

SEQ ID NO: 11418 - DNA, 1359 bp, Artificial Sequence
  Description of Artificial Sequence: Synthetic coding sequence
atgagttggtcgctgcatccccgcaacctgatcctgtacttctatgcgttactgtttctttccagtacttgcgtagcctatgttgccacaagagacaattgctgcatcctggatgaacggtttggcagttactgtcctaccacctgcgggattgctgatttcctgtccacttaccagactaaggtggacaaagacttacagtcactggaagatatattacaccaggtcgaaaataaaacctccgaagtaaaacagttaatcaaggcaatccagctgacatataacccagatgagtcttcaaaaccgaacatgatcgatgctgccaccctgaagtcccgtaagatgctggaggaaattatgaagtacgaggcctccatactgactcacgattcttccattagatacttgcaggagatctacaatagcaataaccaaaagattgtcaacctgaaggagaaggtggcccaactggaggcacagtgtcaagagccttgtaaagacacagtgcaaatacatgatattacagggaaggattgtcaggacattgccaataaaggcgccaagcaatctgggctctatttcatcaaaccgctgaaagccaatcagcagtttctcgtgtattgcgaaatcgacggcagcgggaatgggtggacagtgttccaaaagagactcgatggatcagtcgactttaagaagaattggatacaatataaagaggggtttggccacttatcccctacagggacaacagagttctggctggggaacgaaaaaattcacttgattagcacgcagagcgcaattccatacgcactaagggtggagttggaggactggaatggcagaacttcaaccgctgactatgctatgtttaaggtcggccctgaggcagataaatacaggcttacatatgcctactttgccgggggtgacgcgggagacgccttcgatgggttcgactttggggatgatccctctgacaaattctttacgtcacacaatggaatgcagttcagcacatgggataatgacaatgataagtttgaaggtaactgcgctgaacaggatggttcaggttggtggatgaacaagtgccacgcggggcatttgaacggtgtgtactaccaggggggaacctatagtaaggcatcaaccccaaacggctacgataacggtataatttgggcaacctggaaaactcggtggtattcaatgaaaaagacaactatgaagattatcccctttaaccgcctaacgataggcgaagggcagcaacatcatctaggcggagctaagcaggtcaggcctgagcaccccgctgaaaccgagtacgattccttgtaccctgaagacgacctt

SEQ ID NO: 11419 - DNA, 1359 bp, Artificial Sequence
  Description of Artificial Sequence: Synthetic coding sequence
atgtcctggtcgctgcatccgcgaaaccttatcctgtacttctacgcactgctgtttttgtcgtcgacttgcgtggcctacgtcgctacgcgggacaattgctgcatcctcgatgagaggtttggatcctactgccctaccacctgtggcattgcggacttcctgagcacttaccagaccaaagtggacaaggatctccagtccctcgaggacatcctccaccaagttgagaataaaacttcagaggtcaaacagttgattaaggcaatccaactgacttacaaccctgacgagtcctccaagccgaacatgattgatgccgccaccttgaagagcaggaaaatgctcgaggaaatcatgaaatacgaagcgtcgatccttactcacgattccagcatccgctatctgcaagaaatctacaactcgaacaatcagaagatcgtgaaccttaaggaaaaagtggcccagcttgaggcacagtgccaagaaccgtgcaaagatacggtgcagatccatgatatcactggaaaggactgccaggatatcgccaacaagggcgcaaagcaaagtggcctgtactttatcaagccgctgaaggccaaccagcaattcctcgtgtactgtgaaatagatggatcaggtaacggttggaccgtctttcagaagagactggatggctcggtcgacttcaaaaagaattggattcaatacaaggaaggcttcggacatctgagcccaaccggtaccactgaattctggctcggaaacgagaaaatccacctgatctcaactcagtcagccatcccctacgctctgcgcgtggaactggaagattggaacggaagaacctcaactgctgactacgccatgttcaaggtcggacccgaagcggacaagtaccgcctgacctacgcttacttcgcaggaggcgacgccggcgacgccttcgatggattcgacttcggcgacgatccttccgacaagttcttcacctctcataatggtatgcaattttcgacctgggacaatgataatgacaagtttgagggaaactgtgctgaacaggacgggagcgggtggtggatgaataagtgccacgcggggcatctgaacggagtgtattaccaaggaggcacttacagcaaggcgagcactccaaacggatacgacaatggaatcatctgggccacctggaaaacgcgctggtattccatgaaaaagaccacgatgaagatcatcccgttcaaccggctcaccattggggaagggcagcagcaccacctgggaggagcgaagcaggtgcggccggaacacccagcagagactgagtacgattcgctctacccagaggacgacttg

SEQ ID NO: 11420 - DNA, 1359 bp, Artificial Sequence
  Description of Artificial Sequence: Synthetic coding sequence
atgtcatggtcactgcacccaaggaatctcatcctgtacttctatgccttgctgttcttgagctccacctgcgttgcttacgtcgccaccagggacaactgctgtattctcgacgaacgctttggctcctactgtccaacaacttgtggtatcgctgacttccttagcacttaccagacaaaggtggataaggatctgcaaagtctggaagatatccttcaccaggtagaaaacaagacatctgaggttaaacaactcatcaaggcaatacagctgacctacaacccagacgagtcttctaagccaaacatgatcgacgcagctactctgaagtctcgcaagatgctggaggagatcatgaagtacgaggcttctattctgacccacgactcctccatacgctacctccaggaaatctataactccaacaaccagaaaattgtgaacttgaaggaaaaagtggcccagttggaagcacagtgccaagaaccttgcaaagacacagtccagatacacgatattaccggtaaggattgccaagatattgccaacaaaggcgccaagcaatccggactgtatttcatcaagcccctgaaagcaaatcaacaattcctggtgtattgcgaaatcgacggttctggtaacggctggactgtcttccaaaagcgtctggatggttcagtcgacttcaagaagaattggattcaatacaaagaaggctttggccacctgagccctaccggtaccactgagttttggttgggtaacgagaagattcacctcatttctacccaaagtgccattccttatgccctgcgtgtggagctggaggattggaacggtcgcaccagcactgctgattatgctatgttcaaggtgggaccagaggccgacaagtacagactgacttacgcttatttcgcaggtggcgacgcaggagacgcttttgacggttttgacttcggcgatgatccttcagataagtttttcacatctcacaacggcatgcagttttcaacttgggataatgataacgataagttcgagggcaattgtgccgaacaagacggttccggctggtggatgaacaaatgccacgcaggacacctgaatggagtttactaccaaggaggtacatactcaaaagcatcaacacccaatggctacgataacggtatcatttgggctacttggaaaacaagatggtattctatgaaaaaaaccactatgaagataatccccttcaacaggcttactatcggcgaaggacagcagcatcacctgggtggtgccaaacaagtaagaccagagcatcctgctgaaaccgagtacgactctttgtaccccgaggacgatctg

SEQ ID NO: 11421 - DNA, 1359 bp, Artificial Sequence
  Description of Artificial Sequence: Synthetic coding sequence
atgagctggtcattacatcctcggaatttgattttgtatttttatgcattgcttttcctgagcagcacatgtgtcgcatatgtggcgacgcgggacaactgctgcatacttgacgaaaggtttgggtcgtattgccccaccacatgtggtattgccgatttcctttccacctatcagacaaaagtcgacaaggacctgcaatctttagaagatatcctccatcaagttgagaacaagacttctgaggtcaagcagctaatcaaggctatccaactgacctacaatcccgacgagtcctcaaaacccaatatgatcgatgccgctacactgaagtcgaggaagatgctggaggaaatcatgaagtacgaggcctcaatcttaacgcatgattcttcaattcgctacctgcaagaaatttacaactcgaataatcagaagatcgtcaacctaaaagagaaagtagcccagctcgaggctcagtgccaagaaccatgtaaagatacagtccagatccacgacatcacaggtaaagattgccaggacatagccaataaaggggcaaagcagagtgggctgtattttattaagccactaaaggcaaatcagcagtttttggtatactgtgagattgacggcagcggaaacgggtggaccgtgttccagaagcgcctcgatggctcggtggatttcaaaaaaaattggatccagtataaggaaggatttggtcatcttagcccaacgggaactactgagttttggttgggaaatgagaagattcatctgatctccacacaatctgcaattccttacgcattacgtgtggagctggaagactggaacggaaggacatcaactgctgactatgccatgttcaaagtcggcccagaggcggataaataccgcttaacgtacgcctattttgctggcggtgacgctggagacgccttcgatgggttcgacttcggggatgaccctagcgacaaattctttacaagtcacaatggcatgcagttctcaacgtgggataatgacaacgataagttcgagggaaattgtgccgaacaggatggttctggctggtggatgaacaagtgccacgccggccatttgaatggcgtgtactatcagggcggcacgtacagcaaggcaagcaccccgaacgggtacgacaacgggatcatttgggctacctggaaaactaggtggtactcaatgaagaagacaacaatgaaaattatcccatttaatcgcctgacaattggagaaggtcagcagcatcacttgggcggcgcaaaacaggttcgccctgaacatccagcagagacagagtacgattccctctacccagaggatgatttg

SEQ ID NO: 11422 - DNA, 1359 bp, Artificial Sequence
  Description of Artificial Sequence: Synthetic coding sequence
atgagttggtcccttcacccccgtaaccttatcctctacttttacgccctgttatttctaagttcaacttgcgtggcatacgtggcgacgcgggacaactgttgtattctcgatgagagatttggtagttattgccccaccacatgtgggattgccgacttcctgtccacttaccaaaccaaggtcgataaggatttgcagagtctggaggacatcctccaccaagtcgagaacaaaactagcgaagtgaagcaactgattaaagctatccagctgacctacaatcctgatgaaagctccaaaccgaacatgatcgatgccgccaccctcaaaagcaggaaaatgctggaagagattatgaaatacgaggccagcatcctaacccatgactcttccataaggtatcttcaggaaatctataactcgaataatcagaagatagtgaacctcaaagagaaagtcgcccaactcgaggcacagtgtcaggagccatgtaaggacaccgtgcagatccacgacattacaggcaaggactgccaggacattgcaaacaaaggtgccaagcaaagcggtctgtacttcataaaaccactgaaggctaaccagcaatttcttgtttattgtgaaatcgacgggagcggcaatggatggaccgtcttccagaagcgtttagatggtagtgttgacttcaaaaaaaactggatacaatacaaagagggcttcggacacctgagccctactgggacaacagagttctggctgggcaacgagaaaatccacttgattagcacacagtccgctattccttatgccttgagagttgaactcgaggattggaacggccgcacgtcaacagctgactacgccatgttcaaggtaggaccagaagcagataagtataggttgacatacgcatattttgccggaggagacgcgggcgatgcgtttgacgggtttgattttggggacgatccttcagacaaatttttcacaagccacaatgggatgcagttctcaacttgggataacgataacgacaaattcgagggtaactgcgccgagcaggacggatctggctggtggatgaacaagtgtcatgctggacacctgaacggagtgtattaccagggcggaacatattcaaaggctagtacccctaacgggtacgacaatggaattatttgggccacctggaagacccgatggtatagcatgaagaaaactacaatgaagataatccctttcaacaggctcaccatcggtgaagggcagcagcaccacctggggggtgcgaaacaggttaggccggaacatccagccgagacggagtatgatagcctgtatcccgaagacgatttg

SEQ ID NO: 11423 - DNA, 1359 bp, Artificial Sequence
  Description of Artificial Sequence: Synthetic coding sequence
atgtcttggtccctccatcctcgcaatcttattctctatttttatgcacttctgttcttaagttccacatgtgtggcttacgtcgcgactcgcgacaattgctgcatcctggatgaaaggttcggcagctattgtccgacgacatgcgggattgcagacttcctttctacataccaaacaaaagtcgataaagacttgcagagtttggaagatatcttgcatcaggttgagaacaaaacatctgaagtaaaacagttaattaaagccattcaattaacgtacaatccggatgaatcgtcgaaaccgaatatgatagatgcagcaacattgaagtcaaggaaaatgttagaggaaattatgaagtacgaggcatcaattttaacgcacgatagctcgatccgttacttacaagagatttacaattctaacaatcaaaaaattgttaacctcaaagaaaaagtagcacaattggaagcgcagtgccaggaaccttgtaaagacactgtccaaatccatgacatcacaggcaaagattgtcaagatatcgcgaataagggagccaagcaaagtggtctctactttatcaaaccgcttaaagcaaatcaacagttcttggtctactgcgagattgatggttccggcaatggctggacggtctttcagaagagacttgacgggagtgtggatttcaagaaaaattggatccagtataaagaaggctttggtcatttgtcaccgacaggaaccaccgaattttggctcggcaatgaaaaaattcatttgattagcacccaatccgcaattccgtatgcgttgagagtggagttggaggactggaatggtcgaacatcaaccgcagattatgcaatgtttaaagtaggtcctgaggcagacaaatatagattaacctatgcgtatttcgcaggaggggacgcgggtgacgcattcgatggttttgattttggagatgatccatcggacaaattctttacgagccataatggcatgcaatttagcacatgggacaatgataacgacaaattcgaaggtaattgcgcagagcaggatggatctggctggtggatgaacaaatgccatgccggacacctgaacggggtctactatcaaggcggaacctatagcaaagcttctactccaaatggctatgataatgggattatttgggcaacctggaaaacacgctggtatagcatgaagaaaaccaccatgaaaattataccatttaatcgcttgacgatcggtgaaggccaacagcatcatctagggggggccaagcaggtcaggcccgagcacccagcagaaacagaatatgactccctgtatccagaggatgaccta

SEQ ID NO: 11424 - DNA, 1359 bp, Artificial Sequence
  Description of Artificial Sequence: Synthetic coding sequence
atgtcctggtccttgcaccctagaaacctgatcctttatttctatgccttactgttcctttcaagcacctgtgttgcttatgtcgcaacacgggacaactgctgtattcttgatgagcggtttggctcgtattgccctaccacgtgtggcatcgcagactttttgtctacatatcagaccaaagtggacaaggacctgcagtcacttgaggatattcttcaccaggtggagaataaaactagtgaggtgaaacagttgataaaggcaatccagctgacatacaatccggacgagagctcaaaaccaaatatgattgatgccgcgacgctgaagtcaagaaagatgttggaagagattatgaagtacgaggcctctattctgacccacgattcctcaatccggtacttacaggaaatttataacagtaacaaccagaagatcgttaatttaaaagaaaaggttgcccagttggaggcacagtgtcaggagccatgcaaagacacggtacagattcacgatatcacggggaaagactgccaggatatagccaacaagggagcgaagcagtccggattgtactttatcaaacccttaaaagccaaccagcagtttcttgtgtactgcgaaattgacggcagtggcaatggctggactgtgttccagaagaggctagacggctccgtcgatttcaagaagaactggatccagtacaaggaaggttttggacatctgtcccccacaggaacaacagagttctggcttggtaacgaaaagatccacctcataagcacacagagcgctatcccgtacgccttaagagtcgagttagaggactggaacgggagaaccagcaccgccgactatgcgatgttcaaagtgggcccggaagctgataaatataggttaacgtatgcctactttgctgggggcgacgcaggggacgcatttgatggttttgactttggggacgatccatccgacaagttcttcacatctcacaacggaatgcagttctctacttgggacaatgacaatgacaagtttgagggcaattgtgctgagcaggatggcagtggctggtggatgaataagtgccacgctggacacttgaatggggtttattaccaggggggcacatactcaaaggcgagcaccccaaatgggtatgacaatgggataatatgggccacatggaaaacccgatggtattccatgaagaaaaccaccatgaagatcattccttttaatcgactaaccattggtgagggccagcaacaccacctcggtggggcaaaacaggtgaggccagaacatcccgccgagaccgaatacgactcactgtatccagaggacgatctc

SEQ ID NO: 11425 - DNA, 1359 bp, Artificial Sequence
  Description of Artificial Sequence: Synthetic coding sequence
atgtcctggagtcttcacccgagaaatttgatcttgtacttttatgcacttttattcctgagttctacttgtgttgcctatgtggcgacccgagacaactgctgcatcctggacgagaggtttgggagctattgtcccacaacttgtggcatcgctgattttctttcgacgtatcaaacaaaggttgataaggacctccagagcctggaagacattctgcatcaagtggaaaacaagacgtcagaagttaaacagctgattaaggcaattcagctgacctataatccagatgagagctcaaagcccaacatgattgatgccgcgacccttaagtcacgtaagatgctcgaggagatcatgaaatacgaagcctccatactgacgcatgacagttcgattcggtatctgcaagagatctacaactcaaacaaccagaaaatcgtaaacctgaaagaaaaggtggctcagctcgaggcacagtgccaagagccatgcaaggacaccgtgcagatccatgacataaccgggaaggactgtcaagacatcgccaacaagggagcgaagcagtccggactctatttcatcaagcccttgaaggcaaatcagcagtttctggtttactgtgagatcgatggaagcggaaacggatggacagtgtttcagaagcggctggacgggtccgtggacttcaagaagaattggattcaatataaggaagggttcggccacctctcccccactggtaccacagaattctggcttggaaacgagaaaatacatctgatcagtactcaatccgcgatcccatatgctctacgggtggagctggaagattggaatggccgaacaagcacagcagactacgctatgttcaaggtaggcccagaggctgacaaataccgcctaacatatgcgtacttcgccggaggggatgcgggggacgccttcgacggctttgattttggcgacgaccccagtgataaattctttacctcacacaatggaatgcagttttctacatgggacaatgataatgacaagtttgaaggcaactgcgcagaacaagatgggagcgggtggtggatgaacaagtgccatgccggccatttaaatggcgtctactatcaaggcggcacatacagtaaggcaagcacccctaatggatatgacaacggcattatatgggcaacgtggaagacacggtggtattccatgaagaaaaccaccatgaaaatcatacccttcaataggctgactatcggcgaagggcagcagcaccacctcggtggcgctaagcaagtgagacccgaacaccccgcagaaacagagtacgattccctatatcccgaggatgatctc

SEQ ID NO: 11426 - DNA, 1359 bp, Artificial Sequence
  Description of Artificial Sequence: Synthetic coding sequence
atgtcctggagcctgcaccctcgcaatctcatcctttacttctacgccctcctcttcttgagtagtacctgtgtcgcctacgttgccaccagagacaactgctgtatcctcgacgagaggttcggctcctactgtccaaccacttgcgggattgcggacttcctctctacataccagactaaagtggacaaggaccttcagagcctggaagatatcctgcatcaggttgagaataagacaagcgaggtgaagcagctgataaaggctatccagctcacctacaatccagacgagtccagcaagcccaacatgatagacgccgccactctgaaaagtcgaaagatgttggaggagatcatgaagtatgaagcatcaatcctgacacacgacagctccatccgctatctgcaggaaatttacaattctaataaccagaagatcgtcaacctgaaggagaaagtagcccaactcgaggcacaatgccaggagccctgtaaggacaccgtacagattcacgatattactggtaaggattgccaagacatcgccaacaagggtgcaaaacagtccggtttgtacttcatcaagccgctgaaagccaaccaacaattcctggtttactgtgaaatcgatggctctggcaatggctggactgtcttccagaagcgactggacggaagcgtcgacttcaaaaagaattggatacagtataaggaggggtttggacatctgtccccaaccggaacgactgaattctggctgggaaacgagaagattcatctgatcagcacccagtccgcaattccctatgcactcagagtggaattggaggactggaacggccgcacatccacagctgattatgcaatgttcaaggtgggacccgaggctgataagtataggctgacttatgcctatttcgccgggggtgatgctggggacgcttttgatggattcgactttggagacgacccatctgataagtttttcacgagtcacaacgggatgcaatttagtacctgggacaacgataatgacaaattcgagggaaattgcgccgaacaggatggcagcggttggtggatgaacaaatgccatgccggccatctgaatggggtatattatcaggggggcacttattccaaggctagtactcctaatggttatgacaacggtattatctgggccacctggaagactaggtggtattctatgaagaaaactaccatgaaaatcatcccgtttaaccgactgacgatcggggagggtcagcagcatcatctcgggggggcgaaacaagtgcggcccgaacatcctgcggagactgaatacgatagcctctatccagaagacgatctg

SEQ ID NO: 11427 - DNA, 1359 bp, Artificial Sequence
  Description of Artificial Sequence: Synthetic coding sequence
atgagttggtctctgcaccctagaaatctaattttgtacttttatgccctgctttttctgtcgtctacttgcgtggcatacgtggcaactagagacaattgttgcattttggacgagcggttcggatcatattgccctaccacttgcggaatagcagactttctgtccacctatcagacaaaggttgataaggatttgcagagcctcgaggatattctccaccaggtcgagaataaaacatcagaggtcaagcagttgattaaagccatacagttgacttataaccccgatgagtccagcaagcctaatatgatcgacgccgccacactgaagtctcgcaagatgttggaagagatcatgaagtatgaagctagtattctcacccacgattcatcgatccggtacctgcaagagatatataatagtaacaaccagaaaatcgtgaatttgaaggagaaggtagcacagctagaggcccagtgtcaggagccttgtaaggatactgtacagattcacgacattacaggaaaagattgccaggacattgcgaacaaaggcgccaaacagagcggcctgtactttatcaagccgctaaaagccaaccagcagttcctcgtatactgtgagatcgacggatccgggaacggctggaccgttttccagaaacgtctcgatggctctgtagacttcaaaaagaactggatccagtataaggaagggtttgggcacctaagtcctaccgggactacggagttttggcttgggaacgagaaaatccacctcatctctacccagagtgcaattccctatgcgctgcgggtagagttagaggactggaacggtagaacctcgacagccgattacgcaatgttcaaggtgggcccggaggcggacaaatatcggctgacttatgcctactttgccggcggcgacgcaggggatgccttcgacggatttgatttcggagatgatccttccgacaagttttttacttctcacaacggcatgcagttcagtacatgggataacgacaatgacaagtttgagggtaactgtgcggagcaagacggatcaggttggtggatgaataaatgtcatgcaggccaccttaatggagtttactaccagggcggcacgtactccaaagccagtacccctaacgggtacgataatggtattatatgggctacatggaaaacaaggtggtattctatgaaaaaaaccacaatgaagataattccttttaatcggctgactattggtgaaggtcaacaacaccacttgggcggggccaagcaagttcgtccggaacaccctgctgaaactgagtatgattcattataccccgaggatgacttg

SEQ ID NO: 11428 - DNA, 1359 bp, Artificial Sequence
  Description of Artificial Sequence: Synthetic coding sequence
atgtcttggtcgctacacccccggaacctcatcctgtatttttacgctttgctgtttctatcaagcacatgcgtggcttatgtggccacacgcgacaactgctgcattctagacgaaagatttgggtcatattgccctactacctgtggcattgccgatttcctgtccacctaccagacgaaagtcgataaagacttgcagagcctggaagatatcctgcatcaggtcgagaataagacctccgaagtgaaacagcttataaaagctatccagctgacatataatcccgacgagtcctccaagccaaacatgattgacgccgctacactgaagtccaggaagatgctcgaggagattatgaagtatgaggcttctattctgacccacgattccagcatccggtacttacaggagatctataactcaaacaaccagaagattgtgaatctgaaggagaaggtggcccagcttgaagcgcagtgtcaggagccatgtaaggataccgtgcagattcacgacatcacggggaaggactgccaagatattgctaacaagggcgcaaagcagagcgggctgtactttatcaagccactcaaagccaaccaacagttcctggtgtactgtgaaattgatggatcgggcaacggttggacagtgtttcaaaagcggctagatgggagcgtggattttaagaaaaactggattcagtataaggaaggctttgggcaccttagccccaccggcactacagaattttggctcggaaacgaaaagatacatctgatcagcacgcagtccgccataccttatgccttgagggtggagttagaagactggaatggaaggacctcaaccgctgactatgcaatgttcaaagtgggacctgaggcagataagtaccgtctgacttatgcctattttgccggaggagatgccggggacgccttcgacgggtttgattttggagatgatccttcagacaagttttttacttctcacaacggcatgcagttttcaacatgggacaacgacaacgacaagttcgagggaaattgtgccgaacaggatggcagcggctggtggatgaacaaatgtcacgccggccacctgaatggagtgtactaccagggagggacatactccaaagcgtctacgcctaatggttacgacaatgggatcatctgggccacgtggaaaacaaggtggtactctatgaagaagactacaatgaaaatcatcccgttcaacagactcacgatcggcgaagggcagcagcaccacttgggtggtgctaagcaagtcaggcccgagcatcccgccgaaacggaatacgatagtttgtaccctgaggatgacttg

SEQ ID NO: 11429 - DNA, 1359 bp, Artificial Sequence
  Description of Artificial Sequence: Synthetic coding sequence
atgagttggtcattgcatcctaggaacctcatcctgtatttttacgccctcctctttttgagctcaacctgtgtagcttacgtggccacccgggacaattgttgcatcctggatgaacgcttcggctcatactgcccaaccacctgtggtatcgcagactttttgtcaacctaccagaccaaggtcgacaaggacctccaatcgctggaagacatcctacatcaagttgaaaataaaacatcagaggtgaaacagctgatcaaggctatccaattaacttacaacccagatgagagtagtaaaccaaatatgatcgacgcggcaactcttaagagccgtaagatgctggaggagatcatgaaatacgaggcttccatcctgacccacgattcaagcatcagatacctgcaggaaatctacaattccaacaaccaaaaaatagtgaaccttaaggaaaaggtggcccaactcgaggctcaatgccaggaaccatgcaaagataccgttcagatccacgacattaccggcaaagattgccaagatattgcgaataagggtgctaaacagtctggactttattttataaaaccacttaaggcaaaccagcaatttctcgtgtactgcgagatcgatggtagcgggaacggctggactgtcttccagaagcgccttgatgggtctgtcgacttcaaaaagaactggatccagtataaagaggggttcggtcacctgagcccaacgggaacaactgagttctggctcgggaacgaaaagatccatctgatcagcacccaatccgccatcccgtatgcactgcgcgttgagctggaggactggaacggaaggacatctactgccgattacgcaatgttcaaggtcggaccagaggctgataagtacagactgacttacgcttacttcgctgggggggacgctggcgatgccttcgacggattcgattttggagacgatccttccgataaattctttacatcacacaacggcatgcagttcagtacctgggataacgacaacgacaagttcgagggcaactgtgccgagcaggatggcagcggctggtggatgaacaaatgtcacgcaggccacctgaacggagtttactaccaggggggcacctacagtaaggccagcacccccaacgggtatgacaatggcatcatctgggccacttggaaaaccagatggtattccatgaagaaaactactatgaaaatcatcccctttaatcgccttacaatcggggaaggccagcagcaccacctgggaggagccaagcaggtgagaccagaacatccagccgaaacagagtatgatagcctgtaccctgaagatgatctt

SEQ ID NO: 11430 - DNA, 1359 bp, Artificial Sequence
  Description of Artificial Sequence: Synthetic coding sequence
atgagctggtccctccacccgcggaatcttattctgtacttttatgcacttctcttcctgtccagcacctgcgtggcctacgtagcaaccagagacaattgctgtatcctggatgaaaggttcggatcgtactgccccaccacctgcgggatcgctgactttcttagcacctaccagacgaaggttgataaggatctgcagagcctcgaggacatactgcaccaggttgagaataagacttccgaggtgaagcagctaattaaggcaatacaactgacctacaatccggacgagagcagtaagccaaacatgattgatgctgccacactcaaatctcggaaaatgctagaggaaataatgaaatacgaagcgagtattctgacacatgattccagcataagatacctgcaagaaatctataatagtaacaaccagaaaatcgtgaatctgaaggaaaaagtggcacagcttgaagcacagtgtcaggagccttgcaaggacactgtccagatacatgacatcactggaaaagattgccaggacatagcgaacaagggagcaaagcagagcggactctatttcataaaacccctcaaagccaatcagcagttcctcgtttattgcgagattgatggaagcggaaacggttggactgtgtttcagaagcggctcgacggctccgtagatttcaaaaaaaactggatccagtacaaggaaggttttggtcatctgtcccctactggaaccacagagttttggttgggaaacgagaagatccatcttatctccacccagagcgccattccttatgcccttagagtggagctagaagactggaatggacgcacgtcaactgcggattatgccatgttcaaagtgggccctgaagcagacaagtatcggctgacctatgcatattttgctggcggagatgctggagacgccttcgacggttttgatttcggagacgatcctagcgataagtttttcacatcacacaacgggatgcagttcagcacatgggataacgacaatgacaagtttgaggggaattgcgcggagcaggacggatcaggatggtggatgaataagtgtcacgctggtcacctgaacggcgtctattaccagggaggaacctactcaaaagcctctactcctaacggctacgataatggtatcatatgggcaacatggaaaacacgctggtactccatgaaaaaaaccacaatgaagatcatacccttcaaccgattgaccataggcgaagggcagcaacaccacttagggggggcgaagcaggttcggccagaacaccctgcggagacggagtacgatagtttgtacccagaggatgatctt

SEQ ID NO: 11431 - DNA, 1359 bp, Artificial Sequence
  Description of Artificial Sequence: Synthetic coding sequence
atgtcatggtctttgcatcccaggaatctgatcttgtacttctatgctctcctcttcctctcttcgacttgcgttgcctacgtggccacacgagacaattgttgcatcttagatgaaagattcgggtcctactgtcctaccacctgtgggattgccgatttcttatcaacataccagaccaaagttgataaggacctacagagtcttgaggacatcttgcaccaagtcgagaataagacgtcagaagtgaaacaactgattaaggctatccagctgacctataacccggatgaatcttcaaagcccaacatgatcgacgccgccacactgaagtcgcgtaagatgcttgaggaaatcatgaagtacgaggctagcatccttacccacgattcgtccatccgatacctacaggaaatctacaacagcaacaaccagaagattgtcaatctcaaagagaaagtggcacagttggaagctcagtgtcaggagccttgcaaggataccgtccaaatccacgacatcactggcaaggactgtcaagacatcgcaaacaagggcgctaagcagtccgggctctacttcattaaacccctgaaggctaaccagcagttcttagtgtattgcgaaattgatggctcaggaaatggctggactgtgtttcagaaaaggctggatggatccgtggacttcaaaaagaactggatccagtacaaagagggcttcggccatctaagtcccaccggtactacagagttctggcttggcaacgaaaaaatccacctcatctctacgcaaagcgctataccctatgctctccgggtggagctcgaagattggaatgggaggacctctacagccgattacgctatgtttaaggtgggtcctgaggccgacaagtatcggctgacctacgcttattttgcaggaggggacgccggggatgcatttgatggattcgactttggggacgacccttctgacaagttctttacaagccacaacggaatgcagttttcaacatgggataacgacaatgacaagttcgagggtaattgcgcagagcaggacggttcgggatggtggatgaataaatgtcacgctgggcatctcaacggcgtctactaccagggtggcacctactcgaaagcgtctacaccaaacggttatgataacgggataatctgggccacttggaaaactagatggtattccatgaaaaagaccaccatgaaaataatcccgtttaacaggcttactattggcgaggggcagcagcatcacctcggcggtgcaaagcaagtgagaccagaacatcccgctgaaacagagtatgactctttgtaccctgaggatgacctc

SEQ ID NO: 11432 - DNA, 1359 bp, Artificial Sequence
  Description of Artificial Sequence: Synthetic coding sequence
atgagctggagcctgcatcctcgaaacctgatcctctacttctacgccctgctgttcctgtcatccacatgtgtggcttatgtcgctacaagggacaattgttgcatcctggacgagcgctttggatcatactgccccaccacatgtgggatcgctgacttcttaagcacatatcagaccaaggtagacaaagacctacaaagtctcgaggacattctccaccaggtagagaataagactagcgaagtcaagcagttgatcaaggccatccaattgacatataatcccgatgagtcctctaagcctaacatgatcgatgccgccactttaaaatcacggaagatgcttgaggagatcatgaaatacgaagcttccatactgacacacgactccagtattcgttacttgcaggaaatctataattctaacaatcagaagatcgttaacctgaaggagaaggttgcgcagcttgaagcccagtgccaggaaccttgcaaggatacggtccagatccacgatatcactggcaaggactgccaggatattgccaataagggggcaaagcagagtgggctttacttcattaaacctctaaaagccaatcagcaattcctggtgtactgcgagatcgacggtagcggcaacgggtggaccgtcttccagaagagactcgacggatcggtcgatttcaaaaagaactggattcagtacaaagaaggatttggccatctctccccaacaggcactaccgagttttggcttggcaacgagaagatccatctgattagtacccaatcagctatcccatatgccctgcgggtggaattggaagactggaacggccgcacttccacggccgactatgccatgttcaaagtgggcccagaagctgacaagtatagactgacttatgcatacttcgctggaggcgatgctggtgatgccttcgacggctttgacttcggggatgatccgagtgacaagttcttcaccagtcataacggcatgcagttctccacttgggataatgataatgataaattcgaaggcaactgtgccgaacaggatggtagtggatggtggatgaacaagtgtcatgctggccacctgaacggcgtttattatcagggaggcacgtactcaaaggcctccactcccaatggatacgataatggaataatctgggccacatggaaaactcgctggtactctatgaagaagacaaccatgaaaattattcccttcaaccgactaacgattggggagggtcaacagcaccaccttgggggcgctaagcaggtccgtcccgagcatcctgccgagacagagtacgacagcctatatcccgaggacgatctg

SEQ ID NO: 11433 - DNA, 1359 bp, Artificial Sequence
  Description of Artificial Sequence: Synthetic coding sequence
atgagttggtcactacatccaagaaacttgattctgtacttttacgccctgttgtttctgtcctcaacctgtgtggcatacgtagccacgcgcgataactgctgcatactcgacgagcggtttggctcatactgtccaactacttgcggtattgcagattttctatcaacttaccagaccaaggtcgataaggacctccagagcctggaagacattctgcaccaggttgaaaacaaaactagcgaagtcaaacagttgatcaaggccatccagctaacatacaaccctgacgagtcttcgaagccgaatatgatcgacgctgcaaccttgaaatcacgaaagatgctcgaggaaataatgaagtatgaggcctctatactcacccacgactcttccataaggtatctccaggagatttataactctaacaaccagaaaattgttaacttgaaggagaaggtggctcaattggaggcccagtgtcaggagccatgtaaggataccgtccagattcacgatataacgggcaaggactgtcaggacattgctaacaaaggagcaaaacagtccggcctgtacttcatcaagccgctgaaggctaaccaacagttcttggtttattgtgaaatagacgggagcgggaacggttggactgtctttcagaagagacttgatggaagcgttgatttcaaaaaaaactggattcagtataaagaaggctttggccacctctccccgactgggactacagagttctggctgggaaacgaaaaaatacatttgatctccactcaaagtgctataccttacgcactgcgggtcgagctggaggactggaacgggaggacatctactgcggattacgctatgttcaaagttggcccagaggccgataagtatcgactgacctacgcctatttcgccggaggagacgccggcgatgcctttgatgggtttgattttggagatgatccctctgacaaattcttcacatcccataatggaatgcagttctctacatgggataacgacaacgacaagtttgagggtaattgcgccgagcaggacggctccggatggtggatgaataaatgtcatgctggacatcttaacggggtctactaccaaggcggcacttatagcaaagcctccacgcctaacggctacgataacggtattatttgggccacatggaagacacgatggtatagcatgaagaagaccactatgaagattattccttttaacagactgacaattggggaaggtcagcagcaccatctgggcggcgccaagcaagtgaggccagaacatcccgcagagactgaatatgattccctatatcctgaggacgaccta

SEQ ID NO: 11434 - DNA, 1359 bp, Artificial Sequence
  Description of Artificial Sequence: Synthetic coding sequence
atgagctggtccctgcacccgaggaatctgatcctctacttttacgcattactttttctttcgagtacctgtgtggcttatgtcgctactcgtgataactgttgcatccttgatgagaggttcgggtcctactgccctaccacatgcggaattgccgatttcctgtccacttatcagactaaagtggacaaagatctccagagcctggaagacatcttgcatcaagtggaaaacaagacgtccgaggttaagcagctgatcaaggcaatccagttgacttacaatcccgatgagagtagtaaaccgaacatgattgatgccgctacactcaaatccaggaagatgttggaagaaatcatgaagtacgaagcttctatcctgactcacgacagttccattagatatctccaagagatctacaactctaataatcagaaaattgtcaatctgaaggaaaaggtggcccagttggaggcacaatgtcaggaaccgtgtaaggacactgtgcagattcatgatatcaccggaaaagattgccaggatattgccaacaagggagcgaaacaatccgggttgtactttatcaagcccttgaaagcgaatcagcagtttctggtgtactgcgaaatcgacgggtcaggcaatggctggaccgtatttcagaaacggttagatgggtcagttgatttcaagaagaactggatccaatacaaagagggattcggccacctttcgcccaccggaacaacagagttctggctgggaaacgaaaagatccacctcatcagtacacagagcgctatcccctacgctttgagagtggaactggaggactggaatggcaggacgtctacagccgactatgccatgtttaaagttgggcccgaggccgataagtataggctgacgtacgcatatttcgcgggcggcgatgccggtgacgcctttgacggcttcgatttcggagacgatccctccgacaaattcttcactagtcacaacggcatgcagttctccacatgggataatgataatgacaaattcgagggcaattgtgccgaacaggatgggagcggctggtggatgaacaagtgtcatgctggccacctgaatggtgtgtattatcaagggggtacgtactctaaggcgagcacccctaacggctatgacaatgggattatatgggcaacgtggaagaccaggtggtattccatgaagaaaacaaccatgaaaattatcccgttcaaccgacttaccataggggaagggcaacaacaccacctaggcggggctaaacaagtcagaccagagcatccagccgagaccgaatacgattccctgtatccggaagatgatctc

SEQ ID NO: 11435 - DNA, 1359 bp, Artificial Sequence
  Description of Artificial Sequence: Synthetic coding sequence
atgagctggagtctgcacccacgaaacctgattttgtatttttacgctctgctctttctcagctctacatgcgtggcatatgtcgccactcgagacaattgttgcattcttgatgagaggtttggcagttattgcccaacgacatgtggcatcgcggactttctctcaacctaccaaaccaaggttgataaggacctgcagtctctggaggatatccttcaccaagtagaaaacaaaacttccgaagtgaaacagctgattaaagctatccagttgacctataatcctgacgaaagctcaaagccaaacatgattgacgccgcaactttaaaaagtcgaaagatgctagaagagatcatgaagtatgaagcaagcatcctgacccacgattcatcaattcgttatctccaggagatttataattcaaataatcaaaaaatagtgaacttgaaagagaaggtggctcaattggaggcacagtgtcaggaaccctgtaaagatacggtccagatccacgatataactgggaaggactgccaggatattgccaacaagggcgctaagcagagtggtctgtattttattaagccgctgaaggcaaaccagcagtttcttgtgtactgtgagatcgacgggtccggcaatgggtggacggtgttccagaagcgtcttgatggctcagtggattttaagaaaaattggattcagtacaaagagggatttggacacctgagtccaacagggactaccgaattctggctcggtaacgaaaaaatacacctgattagtacccaatctgctatcccttatgctctacgcgttgagctggaagattggaacggccgcaccagtaccgcggattacgctatgttcaaggtgggcccagaggctgacaagtacaggctgacctacgcttattttgcaggtggcgatgcgggcgacgcgtttgacggttttgatttcggggatgatccctctgataaattttttacctcccataatggaatgcagttttctacatgggataatgataacgacaaattcgagggcaactgcgcagaacaggacggcagcgggtggtggatgaacaagtgccacgctggacatctgaacggcgtgtactaccagggcggtacctattcaaaagcctcaactcccaacgggtacgataacgggatcatctgggctacatggaagactagatggtatagcatgaagaagacaaccatgaagatcatacccttcaaccgtctgaccatcggggagggtcagcagcatcaccttggtggagctaagcaagttcgtcccgagcaccccgctgagaccgaatatgatagtctttaccctgaggacgacctg

SEQ ID NO: 11436 - DNA, 1359 bp, Artificial Sequence
  Description of Artificial Sequence: Synthetic coding sequence
atgtcttggagcctgcacccgcgaaacctcattctgtatttctatgcactgttgttcttgtctagcacttgcgtggcgtatgtggctaccagggacaactgctgtattttggacgagcggttcggcagctactgtccaaccacatgtggtattgccgattttctgagcacctatcaaactaaagtggataaagatctccagtctctggaggacatactccatcaagtggaaaacaaaacctcagaagttaagcaactcattaaagctattcagctcacttacaatcctgatgaatcttccaagcccaatatgatcgatgctgcaacactcaagagtagaaagatgctggaagaaatcatgaaatacgaggccagcattcttactcacgactcaagtatcagatacctgcaagaaatctacaattccaataatcaaaagatcgtaaacctgaaggagaaagtcgcacagctggaagctcagtgtcaggagccctgcaaagataccgtccagattcacgacatcactggaaaggattgccaagacattgcaaacaagggcgccaagcagtctggcctgtacttcatcaagcctctcaaagcaaatcagcagtttctggtctactgtgagatcgacggctctggcaatgggtggactgtgttccagaaaagactggatggatccgttgactttaagaagaattggatccaatataaggagggctttggtcatctcagtcccaccggcacaactgaattttggctcggaaatgagaaaatccatctgatatctactcagtcagcgatcccgtacgcacttagggtggagctcgaagactggaatgggcgaaccagcactgcggactatgcaatgtttaaggtgggacccgaggccgataagtacaggcttacctatgcttactttgcagggggcgacgccggcgacgcctttgacgggtttgactttggcgatgatccctccgataaattctttactagtcacaacggtatgcagttcagcacatgggacaacgataatgacaagttcgaggggaattgtgccgagcaggacggttctggatggtggatgaacaagtgccacgcgggtcacctcaatggcgtgtactatcagggaggaacatacagcaaggccagtactccgaatgggtacgataacgggattatttgggccacttggaaaacccgatggtactcaatgaaaaagacgactatgaaaatcattccgtttaacagacttacaattggcgagggacagcagcaccatctgggcggagcaaaacaggtaagaccggagcaccctgccgaaaccgaatacgactccctgtacccagaagacgatctc

SEQ ID NO: 11437 - DNA, 1359 bp, Artificial Sequence
  Description of Artificial Sequence: Synthetic coding sequence
atgtcttggtctttacatccaaggaatttaattttatatttttatgcacttttatttttatcatcaacttgtgttgcatatgtcgctaccagagataattgttgtattcttgatgaaagatttggaagttattgtccaacaacatgtggaattgcagattttctttcaacatatcaaacaaaggttgataaagatttacaatctttagaagatattcttcatcaagttgaaaataagacaagtgaagtaaagcaattaattaaagcaatacaacttacatataatccagatgaatcttctaaaccaaatatgattgatgctgctactcttaaatcaagaaaaatgttagaggaaattatgaaatatgaagcatccattttaactcatgattcatctattcgttatttacaagaaatatataattcaaataatcaaaaaattgtaaatcttaaagagaaagtagcacaacttgaagcacaatgtcaagaaccatgtaaagatactgttcaaatacatgatattacaggaaaagattgtcaagatattgcaaataaaggtgctaaacaatctggtttatattttattaaaccacttaaagctaatcaacaattcttagtatattgtgaaatagacggatcaggaaatggatggactgtatttcaaaaaagacttgatggatcagtcgattttaaaaagaattggattcaatataaagaaggattcggacatttatcacctacaggtactactgaattctggttgggtaatgaaaaaattcatttaatttcaactcaatctgcaattccatatgctttaagagttgaattagaagattggaatggtagaaccagtacagcagattatgcaatgtttaaggttggacctgaagcagataagtatagattgacatatgcttattttgcaggaggagatgcaggagatgcattcgatggttttgattttggtgatgatccatctgataaattttttacatcacataatggaatgcaatttagtacatgggataatgacaatgataaattcgaaggaaattgtgcagagcaagatggatccggatggtggatgaataagtgtcatgctggacatcttaatggagtttattatcaaggtggaacatattctaaagcatctactccaaatggatatgataatggaattatttgggcaacatggaaaacaagatggtattcaatgaaaaaaacaaccatgaaaattattccatttaatagattaacaataggagaaggacaacaacatcatcttggaggagcaaaacaagttagaccagaacatccagctgaaacagaatatgatagtctttatccagaagatgatttg

SEQ ID NO: 11438 - DNA, 1359 bp, Artificial Sequence
  Description of Artificial Sequence: Synthetic coding sequence
atgtcatggtcactccatccaaggaatctgatcctctatttttatgccctcctattcttatcttctacatgcgtggcatatgtcgcgacacgcgataattgctgtatcttagatgagaggtttggatcctattgccctactacatgtgggattgccgattttttatctacatatcagacaaaagtggataaagaccttcagtcccttgaagacatcttacaccaggttgaaaacaaaacatccgaagtaaaacagctcatcaaagccatccagctaacatataaccccgatgaatcctcgaaacctaatatgatcgatgcggctacacttaaatctaggaagatgcttgaagaaatcatgaaatatgaggctagtatacttacacatgatagttccattaggtatttgcaggagatatataactcaaataaccaaaaaatcgtgaatctgaaagagaaagtggcacagctcgaggctcagtgccaggaaccctgtaaagatactgtgcagatacatgatattacagggaaagattgccaggatatcgcaaataaaggagctaaacagtcaggactatatttcataaaaccacttaaagcaaatcagcagtttctggtgtattgtgaaatcgatggaagtggaaatggatggactgttttccagaaacgtctcgatgggagtgtcgattttaagaaaaattggatccagtacaaagaaggattcggacacctgtcccccacaggaacaacagaattttggttagggaatgaaaaaatccacctaatctccactcagtccgcaattccctacgctttgagggtggaactggaagattggaacggaagaacaagtacagccgattatgcaatgttcaaagtagggccagaagctgataaatatcgccttacttatgcctatttcgcaggaggagatgccggggatgcattcgatggatttgatttcggagacgacccctccgacaaattcttcacttcccataatggaatgcagttttccacatgggataatgataacgacaaattcgaaggaaattgcgccgaacaggatggatccgggtggtggatgaataaatgccacgcaggacaccttaatggggtgtattatcaggggggaacatattctaaagcctctactccaaacggatacgataatgggattatatgggctacatggaaaactcggtggtattccatgaaaaaaactacaatgaaaatcatcccgttcaaccgactaacaataggagaagggcagcagcatcatctcgggggagccaaacaggttaggcctgaacatcctgctgaaacagaatatgattccctgtaccctgaagacgacctt

SEQ ID NO: 11439 - DNA, 1359 bp, Artificial Sequence
  Description of Artificial Sequence: Synthetic coding sequence
atgtcttggtcactccatcctaggaatctaatcctatacttttatgccctgctcttcctcagctcaacctgcgtggcatacgtggctactagagataactgttgcattcttgacgagcgattcgggtcctactgcccgaccacctgcggcatcgctgatttcctgtccacataccagaccaaagtggacaaggatcttcagtcactggaggacattctccatcaggtggagaataagactagcgaggtcaaacagttaatcaaagccatccagctgacatacaatcccgacgaatcttctaagcctaatatgatcgacgccgcgaccctaaagtcccgtaaaatgctagaagagataatgaaatacgaggcttcaatactgacgcatgactcctccattcgctatctgcaggagatatacaactcaaataatcagaaaatcgtgaacctgaaggaaaaagtggcgcagctggaagcccagtgccaggagccatgcaaggacacggtccagattcacgatattaccggcaaggattgccaggacatcgccaacaagggggccaagcagtccggcctgtatttcattaaaccacttaaggcgaatcagcagtttctcgtttactgtgagatagacggatctgggaatggatggacggtgttccaaaaaaggctggacggatccgtcgactttaagaagaattggatccaatacaaagaggggttcgggcacctctccccaaccggaacgaccgagttttggctgggcaatgaaaaaatacacctgatctctacacagagcgccatcccctatgcccttcgcgtggaactggaagactggaacgggaggacatccaccgcagattacgcgatgtttaaagtggggcccgaggccgacaaataccgtctaacatacgcatatttcgcgggcggcgacgcgggagacgccttcgacgggttcgatttcggagatgatccttctgacaagttcttcaccagccacaacggtatgcaattctctacgtgggacaacgacaacgataagttcgaagggaactgcgcagaacaggatggcagcgggtggtggatgaacaagtgtcatgccggacatctgaatggagtgtactaccaagggggcacatattctaaggcaagcaccccaaatggctatgataatggcataatctgggcaacctggaagacccgatggtactcgatgaagaagaccacaatgaagattatcccctttaatagactgaccatcggcgagggacagcaacaccacctgggcggcgccaaacaggttcgacccgagcacccagccgagaccgagtatgactctctgtatccagaagatgacttg

SEQ ID NO: 11440 - DNA, 1359 bp, Artificial Sequence
  Description of Artificial Sequence: Synthetic coding sequence
atgtcatggtcactccaccctcgaaaccttatcctttacttttatgctctgttgttcttaagttcaacttgcgtggcttatgttgcaacacgtgacaactgctgcatattggatgaaagatttggctcttactgcccaactacttgtgggatagccgacttcctgagtacttaccaaactaaagtcgacaaggatttacagtcattagaagacatccttcaccaagttgagaacaagacatctgaagttaagcagcttataaaggcaattcagcttacttataacccagatgagtcctcaaagcctaacatgattgacgcagcaactcttaaaagcaggaagatgttggaggagattatgaagtacgaggcttcaatcctcacccatgattcctcgataaggtatctccaagagatctacaattctaacaatcaaaaaattgttaaccttaaggaaaaagttgcccagttagaggcgcaatgtcaggaaccttgtaaggatacagtgcaaattcatgacattacagggaaagactgtcaagacattgcaaataaaggtgctaagcaatcaggactttactttattaagcctttgaaggccaaccagcagttccttgtttattgtgagatcgacggtagcggcaatgggtggacagtgtttcaaaaaaggcttgatgggagtgtcgattttaagaaaaattggatacaatataaggaggggtttggacatttatcgccaacaggaacaaccgagttttggcttggtaatgaaaaaatccaccttatttctacccaaagcgctattccgtatgctcttagggtcgagcttgaagactggaacggaaggacctcaacagcagattacgctatgtttaaagtgggacctgaagctgacaagtacaggcttacatatgcctattttgcgggaggtgatgctggggacgcattcgatggttttgattttggtgatgatccttcagataagttcttcacctcgcataatggtatgcagttttcaacttgggacaacgataacgacaagtttgaggggaactgcgcagagcaagacgggtcaggatggtggatgaacaaatgccacgctggacatctgaacggggtgtattatcagggagggacgtattcgaaagctagtacacctaacggctatgataatggcatcatctgggctacttggaagactcgctggtacagcatgaagaaaaccactatgaagatcataccttttaacaggcttactattggggaaggtcagcaacaccatttgggtggggcaaaacaggtccgtcctgaacatcctgcagagaccgaatacgactctttgtaccctgaggatgatctg

SEQ ID NO: 11441 - DNA, 1359 bp, Artificial Sequence
  Description of Artificial Sequence: Synthetic coding sequence
atgtcgtggagccttcacccacgcaatttgatcctttatttctatgccctgttatttcttagtagcacatgcgtggcgtatgttgcaaccagggacaactgttgtatattggacgagcgcttcggatcgtactgccctacaacctgcggtatagctgacttcctgtcaacctatcagacaaaggtcgacaaagacctccagtcactggaagatattttgcatcaggttgagaataagacaagcgaagtcaaacaactgattaaagcgattcagctaacctacaatcccgatgaaagcagtaagcccaacatgatcgatgcggctacattaaagagccgcaagatgctggaagagattatgaaatacgaggcaagcatcctgacccatgacagtagtattcgctacctccaggagatctacaatagcaataatcagaagattgttaacctgaaggaaaaagtggcccaattagaagcacagtgtcaggaaccttgtaaggataccgtgcaaattcatgacattaccggcaaggattgccaagacatcgccaacaagggcgcgaaacaaagtggcctctatttcattaaacccctcaaggctaatcagcagtttctggtgtactgtgaaattgatgggagcggcaatggatggaccgtcttccagaaacgactggacgggagcgtggacttcaagaaaaattggattcagtacaaggaaggcttcggtcacctgtcccctacaggcacaacagaattctggctgggcaatgaaaagatccacctgatatctacacagtctgcaattccctacgctctgcgggtggagctcgaagactggaatggtcgcacgtctaccgcagattacgccatgttcaaggtcgggcctgaggctgacaagtatcgtctgacctacgcttatttcgctggtggggacgccggggatgctttcgacggattcgactttggtgatgacccttcagacaaatttttcactagccataacggcatgcagttttccacttgggataatgataatgataagtttgaaggaaattgtgcagaacaggatgggtcaggttggtggatgaacaaatgccatgcaggacacctgaacggggtttattaccagggcggtacttacagcaaagcttctactccaaatggctatgacaacggcattatttgggcaacttggaagactaggtggtacagcatgaagaagacgactatgaagattatcccctttaataggctgactataggcgagggccaacagcatcatttgggcggcgcaaagcaggtccgcccagaacatccggcagaaacagagtatgactcattatacccggaagacgatctt

SEQ ID NO: 11442 - DNA, 1359 bp, Artificial Sequence
  Description of Artificial Sequence: Synthetic coding sequence
atgagctggagcctgcatcctaggaatctcatcctgtacttctatgccctgctcttcctctcctcaacctgcgtagcttacgtcgccacccgcgataattgttgcattctggacgaaaggtttggtagctactgtcccactacttgtggtatcgctgactttctctcaacttaccaaaccaaagtggataaggacctgcagtctctggaggacattttgcatcaggtggagaacaagacatccgaagttaaacagctgatcaaggccatacagttgacatataaccctgatgaatcatcaaagcctaatatgatcgatgctgctactctcaagagcaggaagatgctggaagaaatcatgaaatatgaggctagcattctgactcatgactccagcatcaggtatctgcaggagatttacaattctaacaatcagaaaatcgtcaacttgaaagaaaaagtggctcagctggaagcgcagtgccaagagccctgtaaggacactgtccaaattcacgatatcactggaaaagactgccaggacatcgcgaacaagggcgccaaacagagcggactgtatttcatcaagcctttgaaggccaatcaacaattcctggtgtactgcgaaatcgatggatccggtaacggatggacggtattccagaaaaggctcgatggctcagtggacttcaagaagaactggattcaatataaagaaggattcggacacctttctccgacgggcacgacagagttctggctcggcaacgagaaaatccacctcatctccacccagtctgccatcccatatgcattgagggtcgagttggaagattggaacggtagaactagcactgctgattacgccatgttcaaggttggccctgaggcggacaagtacagattgacttacgcctacttcgccggaggagatgccggcgacgcatttgacggtttcgacttcggcgacgatccatctgataagttcttcactagccataacggtatgcagtttagcacttgggacaacgataacgacaagttcgagggcaactgcgctgagcaggatggatcaggatggtggatgaacaagtgccatgcaggtcacttgaacggagtgtactaccaaggtggtacatactcaaaggcatctactcccaacggatacgacaacggtatcatttgggctacctggaagaccaggtggtactctatgaaaaagactacaatgaagatcataccatttaatcgcctcactattggtgagggccaacagcaccatctgggaggtgccaaacaagtgaggccagagcacccagctgagaccgagtatgattccctgtaccctgaggacgacctt

SEQ ID NO: 11443 - DNA, 1359 bp, Artificial Sequence
  Description of Artificial Sequence: Synthetic coding sequence
atgtcctggtcgctgcacccaaggaatcttatactgtatttctacgcattactgttcttgtctagcacctgcgtggcctatgtagccacaagggataattgttgcatcctggacgagcgctttggaagctactgcccgaccacatgcgggatagcagacttcctatccacataccagaccaaggtagataaagacctgcagtccctggaggatatcctgcaccaggtcgaaaataaaacctccgaggttaaacagctgattaaagccattcagctcacatacaaccctgatgaatcgtcaaaaccgaatatgatcgatgcggccacattaaagagtcggaagatgctggaggaaattatgaagtacgaggcctccatactgacccacgactctagtatcagatacttgcaggaaatctacaactctaacaaccagaaaatcgtgaatttgaaagagaaggtggctcagctggaagcccaatgccaggaaccctgtaaagataccgtgcagattcatgatatcactggcaaagattgtcaggacattgccaacaagggtgccaagcagagcggcctctacttcattaaaccattaaaagctaatcagcagtttctggtgtactgtgagattgatggatcggggaacggttggaccgtctttcagaaaagacttgacggctcagttgactttaaaaagaactggatccagtacaaagaaggcttcgggcatctatcaccgaccgggaccacggaattttggctgggcaatgagaagatccacctgatcagcacacagtcagcaataccgtatgcacttcgagtcgagttagaagactggaacgggcgcaccagtaccgccgactatgcaatgttcaaggtgggacctgaagccgataagtaccgattaacctatgcctacttcgccggaggtgacgcgggagacgcatttgacgggttcgacttcggcgatgatccctcggataagttctttacttcgcacaatggaatgcagttttccacttgggacaatgataatgataaatttgagggaaactgcgcagaacaagacggatcgggctggtggatgaacaaatgtcacgcagggcatctgaatggtgtgtactaccagggcggtacctattccaaggcttctacccccaatggatacgacaacggcattatctgggccacctggaagacaaggtggtactccatgaagaaaacaacgatgaagatcattccctttaatcgccttaccataggcgagggacagcagcatcacctcggcggggcgaagcaagtgcggcccgagcacccagccgaaactgagtacgacagcctctaccccgaagatgatttg

SEQ ID NO: 11444 - DNA, 1359 bp, Artificial Sequence
  Description of Artificial Sequence: Synthetic coding sequence
atgtcttggagtctgcaccccagaaaccttatcctgtacttttacgcccttctattcctgtcctcaacttgcgtggcgtatgtggcgacaagggataattgctgcatcctggatgagcgatttgggagctactgtccaactacctgcgggattgctgactttctgtccacgtaccaaaccaaggtggataaagatcttcagagtttagaggacatccttcatcaggtggagaataagaccagcgaggtgaaacagctgatcaaggccatccagctgacttataaccccgacgaatctagcaaacccaatatgatcgacgcggcaacactcaagtcccgcaagatgctcgaggagatcatgaagtacgaggcgagcatactgacccatgattccagtatccggtatctccaggagatctataactctaataatcagaagatcgtgaacctcaaggagaaggttgcccagcttgaagctcagtgtcaagagccctgcaaggacaccgtgcagattcacgatatcaccgggaaggattgtcaggacattgccaataagggtgcaaagcagtcaggactctactttattaaacctttgaaagcaaatcagcagtttctggtctattgcgagatcgacggatcaggcaacggctggacggtattccaaaagagacttgacgggagcgtggactttaaaaagaattggatccagtataaggaaggtttcggtcacctctccccgacaggcacgactgagttttggctcggtaatgagaagattcaccttatttccacacagtcagcgattccttacgctctgagagttgagctagaggattggaacggcagaactagcacggcagactacgcgatgttcaaagtgggtccagaagcagacaagtacaggctaacgtatgcgtatttcgccggtggggatgcgggcgacgcctttgatggcttcgatttcggggacgatccaagcgacaaatttttcacctcacataacgggatgcagtttagcacttgggataatgataatgataagttcgaaggaaattgtgcggaacaggacgggtctggctggtggatgaataaatgccatgcgggccatcttaacggagtttattatcaggggggcacatactcaaaagcctccaccccgaacggttatgacaacggcatcatttgggccacctggaaaacccgctggtacagcatgaagaagactactatgaagattataccctttaaccggctgaccatcggggaggggcagcaacatcacctgggcggcgcaaaacaggtgcgtcccgagcatccagccgagactgagtacgattctctgtatcctgaggacgatctc

SEQ ID NO: 11445 - DNA, 1359 bp, Artificial Sequence
  Description of Artificial Sequence: Synthetic coding sequence
atgagctggtctctgcaccctcggaatctaatactctacttctatgctctgctctttttgagctccacttgtgtagcgtacgttgcaactagagacaactgctgcattctagatgagagattcggttcctattgcccgacgacttgtggcattgctgactttctgagtacgtatcagaccaaagtcgacaaggatcttcagagtctggaggatatacttcaccaggtggagaacaaaacaagtgaggtgaagcagttgattaaggccatacagctgacctataatccagacgaatcatctaagccaaatatgattgatgcagctaccctgaaatcaagaaagatgctggaggagattatgaaatatgaggctagcattctgacccatgatagtagcatccggtacctgcaggagatatataacagcaataaccagaagatcgtgaacttgaaagagaaagtggcacagctcgaagcccagtgccaggagccatgcaaggacaccgttcaaattcacgatatcaccggcaaggactgccaggatatagcgaacaagggtgcaaaacagtctgggctctacttcataaaacctctgaaagctaaccagcagttcctggtgtactgtgagatcgacggaagcggaaacgggtggactgtcttccagaagagactcgatggatctgtggacttcaaaaaaaattggatccaatataaagagggctttggccatttatcgcccacaggcactaccgagttttggctgggcaatgaaaagatccacctgataagcacccagagtgctatcccatacgcgttgagagtcgagctggaggattggaacggccgtacgtcaaccgctgattatgccatgtttaaggtcggcccagaggcagataagtaccgactcacctacgcttatttcgccggtggggatgctggtgacgcttttgatggcttcgactttggagatgacccaagcgacaaatttttcactagccacaacggaatgcagttctccacctgggataatgataacgacaagtttgagggaaactgcgcggagcaggacgggtccggctggtggatgaataagtgccacgcaggccacctgaacggcgtctactatcagggagggacttacagcaaggcctctaccccgaatggatatgacaatggcattatttgggctacttggaaaacaagatggtactctatgaagaagacaacaatgaagattatcccctttaacaggctcactatcggcgagggccagcagcaccatctggggggagcaaaacaagttcgccccgagcacccagccgaaacggagtatgatagcttgtaccccgaggatgatctg

SEQ ID NO: 11446 - DNA, 1359 bp, Artificial Sequence
  Description of Artificial Sequence: Synthetic coding sequence
atgtcgtggagcctgcacccacggaacctgattctgtatttctatgcattactatttctgagcagcacctgcgtggcatacgttgctacacgtgacaattgctgcattcttgatgaaagattcggctcatattgcccgacgacctgcggcattgcggattttctgagcacttatcagaccaaggtcgataaggacctgcaatccctggaggacatcctgcaccaggtcgaaaacaagacctctgaggtgaaacagctgatcaaagctattcaattgacctataatccggacgagagctctaaacctaatatgatcgacgccgcgacgctgaagagccgcaagatgctggaggaaattatgaaatacgaggcgagcatccttactcatgatagctctattcgctatctccaagaaatctacaattccaataaccaaaagatagtcaacttgaaggagaaagtggctcagctggaggcacagtgccaggaaccttgtaaggataccgttcagattcatgatatcacaggcaaggattgtcaggacatcgctaataagggggcgaagcagtctggcttgtatttcatcaagcctctgaaggcgaatcaacagttcctggtgtactgcgaaattgatggctctggcaatggatggacggtttttcagaaacgattggacggtagcgtggatttcaagaaaaattggatccaatacaaagaaggctttggccatttgagtccgaccggtaccacggagttctggctggggaatgagaaaatccacctgatctctacacaaagcgccatcccatatgctttgagggtcgaactggaggactggaacggccgtacgagcactgcggactatgcaatgtttaaagtcggtcctgaggcggacaaataccgcttgacctatgcgtactttgctggcggtgacgcaggcgacgccttcgacggttttgatttcggtgatgatccaagcgataagtttttcacttcgcacaatggcatgcagttttctacctgggacaatgacaacgacaagttcgagggtaactgcgcagaacaggacggtagcggctggtggatgaacaaatgccatgccggtcacttgaacggagtctactaccagggtggtacctacagcaaagcttcaaccccgaatggttacgacaacggtatcatctgggcgacttggaagactaggtggtacagcatgaagaagaccacgatgaaaatcatcccgtttaaccgactgacgatcggtgagggtcagcagcatcaccttggtggagcgaagcaagtccgtcctgagcatccagctgaaaccgaatacgatagcctgtatcctgaagatgactta

SEQ ID NO: 11447 - DNA, 1359 bp, Artificial Sequence
  Description of Artificial Sequence: Synthetic coding sequence
atgagctggtccctacatccgcgcaatctgatattgtacttttatgccctgcttttcctatcctcaacttgcgtggcctacgtcgctacacgggacaactgctgcattctcgacgagcgcttcggaagctattgcccaacaacctgcggaattgcggacttcttgtctacctatcagaccaaggtcgacaaggacctgcagtctctggaggacatcctgcaccaggtggaaaacaaaacatcggaggtcaagcagctgatcaaagcaattcagctgacctacaatcccgatgagagctccaagcctaacatgatcgacgccgcaacccttaaatccaggaaaatgctcgaggaaatcatgaaatacgaagccagcatactgacccacgattcatctatacggtacttgcaggagatttacaattccaataatcagaagatagtgaacctgaaagaaaaagtggcccagctggaggcccagtgtcaggagccatgcaaggacaccgttcagattcatgatatcactggtaaggattgccaggatatcgccaataaaggcgccaaacagtctggcttgtactttataaaaccactcaaagccaatcagcagttcctggtgtactgtgaaatagatggctcgggaaatggatggaccgtgttccagaagcgtctggatgggtcggtcgacttcaaaaaaaactggatccaatataaagagggcttcggacatctgtcacctacaggcacgaccgagttctggctgggcaatgaaaagattcatctgatttctacccagagcgctattccctatgctttgcgtgtggagctggaagattggaatgggcggactagtaccgctgactatgctatgttcaaggtgggaccagaagctgataagtatcgcctgacgtacgcctacttcgcggggggggacgctggtgatgccttcgatgggtttgattttggagatgacccctctgacaagttcttcacttcacataacggaatgcaattttcgacctgggataacgataacgacaagttcgagggaaactgcgccgaacaagacggtagcgggtggtggatgaataagtgccatgcaggacatctaaacggcgtttactaccagggcggaacatatagcaaagcgagcacacccaacggttatgacaatgggattatctgggccacatggaagacccggtggtattctatgaaaaagacgaccatgaagatcattcccttcaatcgcttgaccatcggggagggccagcaacaccacctggggggtgcaaaacaggtccggccagagcaccccgctgaaacggagtatgattctctatacccggaggatgatttg

SEQ ID NO: 11448 - DNA, 1359 bp, Artificial Sequence
  Description of Artificial Sequence: Synthetic coding sequence
atgtcttggagtttgcatcctagaaacctgattctctacttctatgctctgctgttcttgtccagtacttgcgtggcctacgttgcgactcgggataattgttgcatcttggacgaaagattcggttcatattgccctactacctgtgggattgccgatttcctgtccacgtaccagacaaaggtggataaggacctgcagtctctggaggatatcctccaccaggtggaaaacaaaacttcggaagtcaagcagctgattaaggctattcaacttacctacaatcctgatgaaagctccaagccgaacatgatagacgcggccacgcttaaatccagaaagatgttggaagagattatgaagtatgaagcctctatactgacccatgattcatccatccgatatctgcaggagatatataacagcaacaaccagaaaattgtgaacctaaaggaaaaagttgctcagttggaggcccaatgccaggaaccatgcaaagatactgttcagatccatgatatcacagggaaggactgccaggatatagctaataagggggcgaagcagagcgggttgtatttcattaagccactcaaggcaaatcagcagttcctggtgtactgtgagatagatggtagtggtaacggctggaccgtctttcagaaacggctcgacggcagtgttgattttaaaaaaaattggattcagtataaggaaggctttgggcatctctctcctactggcaccaccgagttttggctgggaaatgaaaagattcatctaatcagcacccagtctgccattccctatgcattacgtgtcgagttagaggattggaatgggcggacctctaccgccgactacgcaatgtttaaagtgggccccgaagccgataaatatagattgacctacgcgtatttcgcaggaggcgacgctggagacgcattcgatggcttcgatttcggggacgatccatcagacaaattctttaccagccataatgggatgcagttcagtacgtgggataacgataacgataagttcgagggtaactgtgccgaacaagatgggtccggatggtggatgaataaatgccatgccggacatctgaacggagtctattatcagggtgggacctattccaaggcgtctactccgaacggctatgataatggcatcatttgggctacgtggaagacgagatggtacagcatgaagaagaccacaatgaaaattatcccgttcaaccgactgaccatcggggagggccagcaacaccacttaggcggggcaaagcaagtgcgacctgaacacccagcagaaacagagtatgatagtctctatcctgaagatgatctg

SEQ ID NO: 11449 - DNA, 1359 bp, Artificial Sequence; identical to SEQ ID NO: 11427
  Description of Artificial Sequence: Synthetic coding sequence

SEQ ID NO: 11450 - DNA, 1359 bp, Artificial Sequence
  Description of Artificial Sequence: Synthetic coding sequence
atgtcatggtctctccaccctaggaatcttatattatatttttatgcactccttttcttgtcgtccacatgcgtggcttacgttgctactcgcgataattgttgtatccttgacgaacgattcggtagctactgtccgacaacctgcggtatcgccgacttcctaagcacataccagacaaaggtagacaaagatcttcaatcgttagaggatatacttcaccaggttgaaaataagacgtcagaggtcaaacaacttataaaggctatccagcttacttacaatccagatgagtcgtctaaaccaaacatgattgatgctgctactcttaaatctagaaaaatgcttgaagagatcatgaagtacgaggcaagtattctaactcatgacagttccatcaggtatcttcaagaaatttataactccaataatcagaaaatagtgaatttgaaagaaaaagtagcccaattggaagctcagtgtcaggaaccgtgtaaagatactgttcaaatacatgatattactggcaaggattgccaggacatcgcaaataagggagcaaaacaatcgggcctttatttcatcaaaccacttaaagccaaccagcaatttctggtttattgtgaaattgatggatctggtaacggctggactgttttccagaaacgattggatggatctgtagatttcaagaaaaattggatccagtacaaagagggattcggacacctatccccaaccggtaccaccgaattctggcttggaaacgagaagattcacctcatttcgacgcaatcagcaattccctatgctttacgcgtcgaacttgaagattggaacggacgtacttcaacagctgactatgccatgtttaaagttggaccagaagccgataagtatcgtttaacgtacgcttacttcgcaggaggcgacgcaggagacgcattcgacggatttgattttggagatgatccatcagacaaattctttacatcccacaatggaatgcaattctccacatgggataacgacaacgacaagtttgagggaaactgtgcagaacaagacggttcaggatggtggatgaataaatgccatgcaggacatttgaacggagtgtattaccaaggaggaacttactctaaggcaagtacgccaaacggatatgacaacggaattatttgggctacttggaagactagatggtatagtatgaaaaagaccactatgaagattataccgtttaatcgtttgacgattggagagggacagcaacaccatctaggaggagcaaaacaggttcgaccagaacatcctgctgaaactgaatacgattctttgtacccagaagatgatctc

SEQ ID NO: 11451 - DNA, 1359 bp, Artificial Sequence
  Description of Artificial Sequence: Synthetic coding sequence
atgtcatggtcactccacccccgtaacctgatcctgtacttctatgcccttctgtttctgagttccacgtgtgttgcctacgtggctacccgggacaactgctgcatcctggacgagcggttcggcagctactgcccaactacatgcggcattgccgacttcttgagtacctatcagaccaaggtggacaaggatctgcagagcttggaggatatcctgcatcaggtggagaacaagacctccgaggtaaagcagctgattaaagccattcagttaacttataatccagacgaaagttccaaaccgaatatgattgacgccgcaacgctgaagtccagaaaaatgctggaggagatcatgaaatacgaggcttccatcctcacacatgatagttcaatacgctacctacaggagatttacaatagtaataatcagaagattgtgaatctaaaagaaaaggtagcgcagctggaggcccagtgccaggagccttgcaaagacacagttcagatacacgatattaccggtaaggactgccaggatatcgctaacaaaggcgcaaagcagagcggactgtatttcataaagcctttgaaggccaatcaacagttcctggtttattgtgagatcgatggaagcggcaatggatggactgtgtttcagaagcgactcgacgggtcagtcgattttaagaagaattggatccaatacaaggaagggttcgggcatctgtcacccacgggaaccaccgaattttggttgggaaacgaaaagatccacctgattagtacacagagtgcaatcccatatgcactcagagtagaactcgaggattggaatggccgcacctccactgccgactatgcaatgttcaaagttggaccagaagctgacaagtaccgcctcacatacgcatattttgcaggtggcgatgctggcgatgctttcgacggctttgattttggcgacgatcccagcgacaaattctttacatctcacaacggaatgcagttttctacatgggataatgacaacgataagttcgaaggcaactgcgcagagcaagacggatccggctggtggatgaataaatgtcatgccggccatctcaacggggtatactaccaagggggcacgtattccaaggccagcacgccaaatggttacgataacggaatcatttgggcgacctggaagacgcggtggtactcaatgaaaaagaccactatgaaaattatcccctttaaccgcctcaccatcggagaaggtcagcagcatcacctcgggggagccaaacaggtgagaccagagcaccccgcggagacagagtatgattctctatatcccgaggacgaccta

SEQ ID NO: 11452 - DNA, 1359 bp, Artificial Sequence
  Description of Artificial Sequence: Synthetic coding sequence
atgtcctggagcttacaccctaggaatcttatattgtatttttatgctttgctgttcctctctagcacctgtgtggcttatgtggccactagggataactgttgcattctggatgagagattcgggagttactgccccaccacttgtggtatcgccgatttcctgtctacttaccagacaaaagtcgacaaggatctgcagtccctggaagacatattgcatcaggtcgaaaacaagacctcagaggtaaaacaactgatcaaggccattcaactcacatacaatccggacgagtctagcaagcccaatatgatcgacgcagcaaccctaaaatctcggaaaatgctcgaagagatcatgaagtatgaagccagcatcctaactcacgatagtagtatacgctatctccaagagatctacaactccaataatcagaagattgttaatctcaaggaaaaagtagcacagcttgaggcgcagtgccaggaaccttgcaaggacaccgtccaaatacatgacattaccgggaaggattgtcaggacattgccaacaagggcgccaaacagtctgggttgtacttcatcaagcctttaaaggcgaaccaacaatttctggtgtattgcgagatcgatggaagcggaaatggctggaccgtttttcaaaagcgcttggacgggtcggtcgatttcaagaagaattggatccagtataaagaaggctttggccatttgagcccaacaggcacgactgagttctggctgggtaacgagaaaatccatctgatctcaacgcagagcgcaattccctatgccttgagggtggaattggaggactggaatgggaggacatcaaccgccgattacgccatgttcaaggtaggacccgaggccgataagtacagactgacatatgcatacttcgcgggcggggacgcaggagatgcatttgacggattcgattttggtgatgacccatcggataagttttttaccagccataacgggatgcagttctctacttgggacaatgacaacgataagtttgagggaaactgcgccgagcaggacggctccggatggtggatgaataaatgccacgctggacacctgaatggagtctactaccaaggcgggacgtatagcaaggcctccactcccaatggatacgacaatggaatcatttgggctacatggaaaacgcgctggtattcgatgaagaaaaccacaatgaagataattccattcaatcgtctgaccataggcgaaggtcaacaacatcatctgggcggggcaaaacaagtgaggccagagcacccagctgagactgaatacgacagtctctacccagaggacgacttg

SEQ ID NO: 11453 - DNA, 1359 bp, Artificial Sequence
  Description of Artificial Sequence: Synthetic coding sequence
atgtcctggtcactgcaccctaggaacctgatattgtatttctatgccctgctcttcctatcaagcacttgcgttgcatacgttgcaactcgggacaattgctgtatactagatgagaggttcgggtcttactgcccaaccacatgtggcattgccgattttttaagcacttaccagacaaaagtggacaaggacctgcaatccctagaggacatcctgcatcaggtcgaaaataagacctccgaggtcaaacagctgatcaaagctatccaactgacatataaccccgatgagagctcaaaacccaatatgatcgacgccgcaactctgaagtctcggaagatgttagaggagataatgaagtacgaggcttctatacttacacacgattcctctataaggtatctgcaggagatctacaatagtaataaccagaagatcgttaatttaaaagagaaagtggcacaactggaggctcagtgtcaggagccatgcaaggacacagtacaaatccacgacattaccgggaaggactgccaggatattgccaacaaaggcgcaaaacaaagtggcctctatttcataaaacctctcaaggctaaccaacagtttctcgtttattgcgaaattgatggatccgggaacggctggacagtctttcagaagaggttagatggcagtgtagactttaagaagaattggattcagtacaaagaggggttcggccacttatcccccaccggaactactgaattctggctaggtaatgagaaaatccacctgattagtacacagagtgcaattccctacgcactgagagtggaactagaggactggaacggcagaacatctaccgctgactacgcaatgtttaaggtcggccccgaagccgacaaataccgactcacctacgcctacttcgccggcggtgacgcaggcgacgcctttgacgggtttgacttcggcgacgaccccagcgataaattcttcacttcccacaatggcatgcagtttagtacatgggacaatgataatgataagttcgagggcaactgtgcagaacaggatggttctggatggtggatgaataaatgtcacgccggacacctgaatggtgtatactaccaaggcgggacttatagcaaagcttctactcctaacggctacgacaatggaatcatctgggctacttggaaaacacggtggtacagtatgaaaaaaaccaccatgaaaataataccctttaatcgtttaacaatcggagaaggtcagcaacatcatctggggggggccaaacaggttcggccagagcaccccgcagagaccgagtatgattccctgtacccagaagatgatctc

SEQ ID NO: 11454 - DNA, 1359 bp, Artificial Sequence
  Description of Artificial Sequence: Synthetic coding sequence
atgagctggtcactgcatccacgcaatctgattctgtacttttacgctttgcttttcctgagcagcacctgtgtggcctatgtcgctacacgcgacaactgttgtattctggacgaaaggttcggaagttactgcccgaccacctgcggaattgctgatttccttagcacctaccagacgaaggttgataaagacctgcaaagcttagaggatatcctccatcaagtcgagaacaaaactagcgaggtgaagcagctgatcaaagcaattcagctcacgtacaatccagacgagagctccaagccaaacatgatcgatgctgcgacactcaagagtaggaagatgctcgaggaaatcatgaaatatgaagcatctatactgacccatgactccagcatacggtatctgcaggagatctacaattcgaataatcagaaaatagtgaatctgaaagaaaaggtggcccagttagaagcgcagtgccaagagccttgcaaagatactgtgcagatccatgatatcactgggaaggactgtcaggatattgccaataaaggagcaaagcagagcggactgtacttcatcaaacccttgaaagctaatcagcaatttttagtctactgcgaaatcgacggatctggcaatggatggacagtctttcagaagaggctcgacggcagcgtagacttcaaaaagaactggatacagtacaaagagggtttcggacatctgagcccaactggcactacagaattctggctgggcaacgaaaagatccatctcatatctacacagtctgctatcccatacgcacttcgtgtcgaactcgaagattggaatggcaggacatcaaccgctgattacgcaatgttcaaggtgggcccagaagcagataagtaccgcttgacctacgcatatttcgcaggcggcgacgctggggacgctttcgacggatttgatttcggtgacgatcctagtgataaattctttacaagtcataacggcatgcagttcagcacttgggataacgacaatgataaattcgaaggcaactgcgccgagcaagacggctctggatggtggatgaacaaatgtcatgccggccacttgaatggtgtttactatcagggcgggacctactcaaaggcttccactccaaacggatacgacaacggaataatttgggcgacatggaagacccgatggtactccatgaagaaaaccaccatgaaaatcataccatttaatagacttactatcggggagggacagcaacaccacctggggggcgcaaagcaggtcagaccagaacaccctgccgagacagagtatgattcactctatcccgaggatgatctt

SEQ ID NO: 11455 - DNA, 1359 bp, Artificial Sequence
  Description of Artificial Sequence: Synthetic coding sequence
atgtcatggagtctccatcctcgcaacctcatcctctacttctacgcgttgttattcctcagcagcacctgcgtagcatatgtagctaccagggataactgctgcatactggatgagcgctttggctcgtactgtcctactacctgcggcatcgcagacttcctgagtacgtaccagacgaaagttgacaaggatctacaaagcttggaggacatcctccaccaagtagaaaacaaaacatcagaagtaaaacagcttatcaaggccatacaactgacttacaaccctgacgaatcgtccaagcccaacatgatcgatgcagcgacattgaagagccggaagatgttggaggaaatcatgaaatacgaagcctccattctgactcacgacagctctatcagatatctccaggaaatttacaattcgaacaaccagaagatcgtgaatctcaaagaaaaagttgctcaacttgaagctcagtgccaagaaccgtgtaaggatacggtgcagatccacgatataacgggcaaagattgccaggacatcgcaaataagggggccaagcaatcaggactctacttcatcaaacccctgaaagctaaccagcaatttttagtatactgtgaaatcgatgggagtgggaacgggtggactgtgttccagaaacgcctcgacggctccgtagatttcaagaaaaattggattcagtacaaggagggtttcggtcatctaagtccaacgggaaccactgagttctggctgggaaatgagaaaatccacctcatatctacccagagtgccatcccctacgccttgagggtggaattggaggattggaatggccggacttcaaccgccgattatgcaatgtttaaggtcggaccggaggccgataagtaccggctgacatatgcatactttgctggaggggacgctggagacgcttttgatggattcgactttggcgatgaccccagtgataaattttttacctctcacaatgggatgcaattttccacatgggacaacgacaacgacaagttcgagggaaattgtgccgagcaagatggatctgggtggtggatgaataagtgccacgcggggcacctcaacggcgtatattaccagggcgggacttacagtaaggctagcacgccaaacggctacgataatggaatcatttgggccacttggaaaaccaggtggtattctatgaaaaagacgaccatgaagatcattccgttcaaccggctgactatcggcgaaggccagcagcaccatctagggggcgcgaaacaggtccgccccgagcatccggcagagaccgagtacgattctctgtaccctgaggacgacctc

SEQ ID NO: 11456 - DNA, 1359 bp, Artificial Sequence
  Description of Artificial Sequence: Synthetic coding sequence
atgagctggagtctgcatcccagaaatttaattctgtacttttatgcactactcttcctctcctctacatgcgtcgcctatgtggcaacccgggataactgctgtatcctggacgaacggttcgggagctattgcccaacgacctgtgggatcgcagattttttgtctacataccagacaaaagtggacaaggatctgcagagtctggaagatatcctgcaccaggtggaaaacaagacaagtgaagtgaagcagctcataaaggcaatacagctaacgtacaatcccgacgaatcctccaagccaaatatgatcgatgccgccactctgaagtcccggaagatgttagaggaaatcatgaagtacgaagcttccatcctcactcatgactccagcatccgatacctgcaggagatttacaattcaaacaaccagaaaattgtgaatctgaaggagaaggtggctcagttagaggctcagtgtcaggagccatgtaaggacacagtacagatccatgatattaccgggaaggattgccaagacatcgcaaataaaggcgctaagcagagcggcctgtacttcataaagcccttgaaggccaatcagcagtttctggtgtattgtgagatagacgggtccggaaatgggtggacagtgttccaaaagcgtctggacggatccgtagactttaagaagaattggattcagtacaaagagggcttcggccacctttcacccacaggcaccacagagttctggctgggaaacgagaagatccatctgatcagtacgcaaagtgcaatcccttacgcattgagagtggagttggaggactggaatggccgcacaagcactgcagactacgcgatgttcaaggtgggaccagaggctgacaagtaccggcttacctacgcatactttgccgggggagacgccggagatgcatttgacgggttcgattttggggatgaccccagtgacaagttcttcacatcacataatgggatgcaattttcaacatgggataatgataatgataagttcgagggcaactgcgcggagcaggacgggtctggatggtggatgaataagtgccacgccgggcatctcaacggtgtatactatcagggggggacctattcaaaggcatcaacacccaatggatacgacaacgggataatctgggcgacctggaagaccaggtggtactcaatgaaaaagactactatgaagattatccctttcaaccggctgacaattggagagggtcagcagcaccacttggggggcgcaaaacaggttcgcccagagcatccagcggagactgaatacgatagcctctatccagaggacgatctc

SEQ ID NO: 11457 - DNA, 1359 bp, Artificial Sequence
  Description of Artificial Sequence: Synthetic coding sequence
atgtcatggagtctgcaccctaggaacctgatactgtacttttatgctctcctgttcctcagctcaacctgtgtggcctatgtcgctacaagagataattgttgcatccttgacgagcgcttcggaagttattgccctacaacctgcggtattgccgactttctttcaacctatcagaccaaagtggataaagatctgcagagcctcgaggatatccttcaccaggtcgagaataagaccagtgaggtgaaacagctgattaaggctattcaactgacctacaatcctgatgaatctagtaaacccaacatgatcgatgctgcaacactgaaatccaggaagatgctcgaggaaattatgaagtatgaggccagcatcctgacacacgactccagtattagataccttcaagagatttacaacagcaataaccagaaaatagttaatttgaaagaaaaagtcgcccagttggaagcacagtgccaagagccgtgtaaagatacagtgcaaatacacgatattacgggtaaagactgccaagacatcgctaacaaaggcgccaaacaaagtggactgtattttatcaagcctctgaaggcaaatcagcaattcctggtgtattgcgagatcgacggaagtggtaacggctggaccgtttttcagaaacggcttgacggttccgttgactttaagaagaactggattcaatataaagagggatttggacacttgtctccaaccggaactacagagttttggctgggcaatgaaaaaatacaccttatctctacccagagcgccattccctacgccctgcgggttgaactggaggattggaacggccgaacgtctactgcggattacgccatgttcaaggtcgggcctgaggctgataaatacaggttgacttatgcttattttgccggcggggacgcgggtgatgcctttgacgggtttgatttcggcgatgacccttctgacaaatttttcacttcacataatggcatgcagttctctacatgggacaacgacaacgataagttcgaaggaaattgcgccgaacaggatggtagtggatggtggatgaacaaatgccacgctggccacctgaatggtgtgtattaccagggaggaacgtatagcaaggcttccaccccgaatggttatgataatggcataatttgggccacctggaagaccagatggtatagcatgaagaagaccacaatgaagatcatccccttcaatcggttgaccattggcgaaggtcagcagcatcacctcggcggcgcaaagcaggtcaggccagaacaccccgccgagactgagtacgacagtttgtaccctgaggacgacctg

SEQ ID NO: 11458 - DNA, 1359 bp, Artificial Sequence
  Description of Artificial Sequence: Synthetic coding sequence
atgtcatggtccctacaccctcggaatttgatcctgtatttctacgctttattgtttctgtcatcaacctgtgtcgcttatgtagcaacccgggataattgctgtattttagacgaacggtttggctcctattgtccaacaacctgcggcatagccgactttttatctacctaccagactaaagttgataaggacctccagagcctcgaggatattctgcaccaagtggaaaacaagacatccgaggtgaagcagctgattaaagcaatccagttgacctacaaccctgacgaatccagcaaacccaacatgatcgacgccgccacactaaaatcacgcaagatgcttgaggagattatgaagtacgaagctagcatcctcacccacgacagctctatcaggtacctccaagaaatttataactctaataatcagaaaattgtcaatctgaaggagaaagtggctcagcttgaagcacagtgtcaggaaccttgtaaagacacagtgcagatacacgacatcacaggaaaggattgccaggatattgccaacaagggcgcaaaacagtctgggttgtactttattaagcctctgaaggccaatcagcagttcctggtctattgcgagatcgacggctcagggaacggctggacagttttccagaaaagattagacgggagcgtcgacttcaaaaagaattggatccagtataaagaaggctttgggcacctgagtcctaccggtaccacggagttctggttaggcaacgagaagatacatctgatttcaactcagagcgctatcccttatgctttgcgcgttgaactagaggattggaatggcaggacaagcaccgcagactacgcgatgtttaaagtggggcccgaggctgacaaatacaggttgacctacgcttattttgccggaggagatgctggcgacgctttcgatggtttcgactttggcgacgatccatcagacaaattctttacgagccacaatggaatgcagttttcgacttgggacaacgataatgataaatttgagggaaattgtgccgaacaagacggttctgggtggtggatgaacaagtgccacgccggccacctaaacggtgtgtattaccagggaggcacctattcaaaggccagcacccctaatgggtatgataatggcattatctgggcaacttggaagacaaggtggtactccatgaagaaaactaccatgaaaatcatccctttcaacaggctgaccatcggggagggtcaacagcatcaccttgggggcgccaaacaagtgcgacccgagcaccccgctgagacagagtatgacagcttgtatcccgaggacgatctt

SEQ ID NO: 11459 - DNA, 1359 bp, Artificial Sequence
  Description of Artificial Sequence: Synthetic coding sequence
atgagctggtcgcttcatccccgcaatctcattctgtacttttacgccctgttattcctgagttcgacctgcgtggcgtacgtggccacccgcgacaactgttgcatactggacgagcgcttcggtagctattgtcctactacttgcggtatcgccgactttctctctacgtaccaaactaaggtggataaggacctgcagagtttggaagacatcctccaccaagtggaaaacaagacgagtgaggttaagcagttgatcaaggcgatccagttgacatataaccctgatgagagctctaaacccaacatgattgacgccgcgactttgaagagtagaaagatgttggaagaaatcatgaaatacgaggcgagcattctgacgcacgattcgtccatccggtatctgcaagagatctacaactcaaataaccagaagatcgtcaacttaaaggagaaggtagcccagctggaggcccaatgccaggagccctgtaaagacaccgtgcaaatacatgatatcacaggaaaggactgccaggacattgccaataagggcgccaagcagagcggactgtactttattaagcctttgaaagccaaccagcagttcctagtttactgcgagatagatggtagcggcaatggctggaccgtgtttcagaagcgtctcgacggttctgttgacttcaaaaaaaattggattcagtacaaagagggattcggacacctgtcgcctacggggacaaccgaattctggctgggcaacgaaaagatccacttgatctcgacccagtccgccattccctacgccctgcgagtagaactcgaggattggaatggacgtacgtccacggccgactacgctatgttcaaggtcggcccagaggctgataagtaccgtctcacatacgcttacttcgccggcggagacgcgggcgacgcgttcgatggattcgacttcggcgacgacccgtctgacaagttctttacaagccataacggcatgcagttctccacctgggataatgataacgataaattcgaaggtaactgtgccgaacaggacggtagtggatggtggatgaacaaatgccacgccggccatctcaacggtgtatattaccagggcggaacctattctaaggcttccacacctaatggctatgataacggcatcatctgggccacctggaagacccgctggtattccatgaagaaaaccacgatgaagataatccccttcaaccgcctaaccattggcgaaggccaacagcaccacctcggaggcgcgaagcaggtccgtccggaacatccggccgaaaccgaatacgattcgctatacccggaggacgatctg

SEQ ID NO: 11460 - DNA, 1359 bp, Artificial Sequence
  Description of Artificial Sequence: Synthetic coding sequence
atgtcctggtccctccacccccggaacctcatcctatacttttacgccctactcttcttgagttcgacctgcgtcgcctatgtcgcaactcgggataattgctgcattctggacgagcgttttggtagctactgtcctacgacctgcggcatcgctgattttctgagcacgtatcagaccaaggtggataaagacctccagtcgttggaggatatcctccaccaggtcgaaaataagacctcggaggtaaagcaactaatcaaggcgatccagctaacctacaacccggacgagagctctaaacccaatatgattgatgctgctacgttgaagtctcgtaagatgctagaagagatcatgaagtacgaagcctcaattttgacccacgattcgagcatccgttacctccaggagatctataactcgaataaccaaaagattgtcaacttgaaggagaaggtggcccaacttgaggctcagtgccaggagccgtgcaaggacactgtccagatccacgacatcactggcaaggattgccaggacatcgcaaacaagggagctaagcaaagtggcctctacttcatcaagccgctgaaggctaatcagcagttcctggtgtactgtgagatcgacggttccggcaacggctggaccgtcttccagaagcgcttggacggatccgttgatttcaagaagaactggatccaatacaaggaaggcttcgggcacctctcgcctactggcacgactgagttctggctgggcaatgagaagatccacctcatcagcactcagagcgcaatcccgtatgccttgcgtgtagagctggaagactggaacggacgcacttccactgcggattacgccatgttcaaggtcggcccggaggctgacaagtaccgccttacctacgcctacttcgccggaggtgatgccggcgacgcattcgacggttttgattttggggacgatccctcggacaaattcttcacgtcccacaacggtatgcagtttagcacttgggataatgataacgacaagttcgagggaaactgcgcggaacaggacggttctgggtggtggatgaataagtgccatgctggtcacctgaacggggtttactaccagggtggcacctacagtaaggcgtccacccccaatggatacgataatggcatcatctgggctacctggaagactcgctggtacagcatgaaaaagactaccatgaagatcatccctttcaacaggttgaccatcggagagggccaacagcatcacctcggtggagctaagcaggttcgccccgaacacccagccgagaccgagtacgactctctctaccctgaggatgatctg

SEQ ID NO: 11461 - DNA, 1359 bp, Artificial Sequence
  Description of Artificial Sequence: Synthetic coding sequence
atgagctggtcactccacccccgaaaccttattctgtacttctacgccctgttgtttctgtcatccacttgtgtagcttatgtcgctacacgggataattgttgcatccttgatgagaggtttgggagctactgtccgacgacgtgcggtatcgccgatttcctatcaacataccagactaaggtagataaggacctacagtccttagaggacattctgcatcaggtggaaaacaagaccagcgaggtaaaacagcttatcaaggccattcagctcacttacaaccctgatgagtcctcaaaacctaacatgatagacgcggccaccctgaagtcgcgcaagatgttggaggagattatgaagtacgaggcatcgatcttaacacacgactcctcaattaggtacttgcaggagatctataactctaataatcagaagattgtgaatctgaaagagaaggttgcccaactcgaagctcagtgtcaggaaccatgtaaagataccgtccaaatccacgatattacaggcaaggattgccaggacattgcaaacaagggcgcgaagcagagtggcctgtatttcataaaacccctgaaagcgaaccagcagtttcttgtgtattgcgaaattgacgggtcgggtaatggctggacggtgttccagaagcgcttggacggctccgtggactttaaaaagaattggattcagtataaggagggctttggccatctttcgccaactggcacaaccgaattctggctgggtaatgaaaagatccatctgatcagtacgcaatccgctatcccatacgcattgcgcgtcgagcttgaggattggaatggaagaacttcaacggctgactatgccatgttcaaagtcgggcccgaagctgataagtaccgactgacgtacgcatacttcgctgggggcgatgcaggcgacgcgttcgacggattcgattttggggacgaccccagtgacaagttctttacatcccacaacggcatgcaatttagcacatgggacaatgacaacgataagtttgaagggaactgtgccgagcaagacgggagtggctggtggatgaacaagtgccatgctgggcacctcaatggtgtatactatcagggaggcacgtacagtaaggcatccacaccgaacggatatgataatggcattatttgggccacctggaagactaggtggtattccatgaagaaaacaaccatgaaaatcatccctttcaacagactgacaatcggcgagggacagcagcaccacctggggggcgctaagcaagttcgtccagaacaccctgcagaaaccgagtacgactctctgtatcccgaggacgacctc

SEQ ID NO: 11462 - DNA, 1359 bp, Artificial Sequence
  Description of Artificial Sequence: Synthetic coding sequence
atgtcatggtctctgcatcccaggaacctgattttgtacttttacgccttgcttttcctgtcctctacctgcgtggcgtacgtggcgactagagacaattgctgtattttggacgaaaggtttggttcctactgccctacgacctgtggcatcgccgattttctcagcacatatcagaccaaggtcgacaaggaccttcagtccctggaggatatccttcatcaggtcgagaacaagacgtctgaggttaagcagctgatcaaggccatccagttgacatacaaccctgatgagagctccaagccaaatatgattgacgcggctaccctcaagtccaggaagatgctggaggaaatcatgaagtacgaagctagtattctgacccatgactcctccatccggtacctccaggaaatctacaatagtaacaaccaaaagattgtgaatctcaaggagaaggtggcccagctggaagctcagtgccaggagccatgcaaggacactgtgcagatacacgacatcactggcaaagactgccaggacatcgctaataagggggccaaacaatctggcctttacttcattaagccgctgaaggcgaaccagcagttcctggtctattgcgaaatagacgggtccgggaatggctggacggtgttccagaaaagactagatgggtctgtggacttcaagaaaaactggatccagtataaggaaggatttgggcatctgtctcccactggtacaaccgagttttggctgggcaacgagaaaattcacctcatttcaacccagtccgccataccctacgctttgagggtggaactggaggactggaacggacgcactagcaccgccgactacgctatgtttaaggtagggccagaggctgacaagtacaggctgacatacgcttacttcgctggcggtgacgctggcgacgcttttgatgggttcgactttggtgatgacccctcagataagttttttacctcccacaacggcatgcagttttccacctgggataacgacaacgataagttcgagggtaactgcgccgagcaggatggctccgggtggtggatgaataagtgtcacgctggtcacctcaatggtgtgtactatcaaggcggcacttatagtaaagcctcgactccgaacggctacgataatggtatcatctgggctacgtggaagaccaggtggtatagtatgaaaaaaacaactatgaagattattccctttaaccggctaacaatcggcgagggacagcagcatcatctcggaggagcaaaacaggtccggcccgagcatcccgctgaaacagagtacgacagcctgtaccccgaggacgacctc

SEQ ID NO: 11463 - DNA, 1359 bp, Artificial Sequence
  Description of Artificial Sequence: Synthetic coding sequence
atgtcatggtctctccatcccagaaatctaatcctgtacttctatgctctgctcttcttgagctcaacgtgtgtcgcctatgttgccaccagggacaattgctgtattttagacgaacggtttgggtcatattgccccactacttgcggaatcgcagacttcctttctacttaccaaacgaaagttgataaagatctgcagtctcttgaggacatactgcatcaagtcgaaaataaaacgagtgaagttaaacagctgatcaaggcaattcagctgacttacaatcctgacgagtcatccaaacctaacatgatcgacgcggctacactcaagtcgcgtaaaatgctcgaggaaataatgaaatatgaggcatccatcctgacccatgattccagcattcggtatttgcaggagatttataactctaataatcaaaaaattgttaaccttaaagagaaagtggctcagctggaggcgcagtgccaagagccatgcaaggataccgtacagatacatgacattacaggaaaggattgtcaggatatagccaataagggggccaagcagtcaggcctgtactttataaaacctcttaaagcaaaccagcagttcctggtgtactgcgaaattgatggcagcggcaatggatggaccgtgtttcagaaaaggctggatgggagtgttgatttcaagaagaactggatccaatacaaggagggcttcggtcatctgtctccaaccgggacaaccgaattctggctcgggaacgagaagatccatttgatatcaacacaatctgccataccatacgccctcagagtggagttggaggactggaacgggcgcacctccacagccgattatgcgatgttcaaagtgggaccagaggctgacaagtacaggctcacgtatgcatactttgccggaggagatgcgggtgacgcatttgatggctttgattttggcgatgaccctagtgataaattcttcacctcacacaatggcatgcaattcagcacttgggataacgacaacgacaaatttgaggggaattgtgccgagcaggacggcagcgggtggtggatgaataagtgtcatgccggccacctgaatggcgtgtactaccagggcggcacatacagcaaagcatccaccccaaacggatatgataatggcataatttgggctacctggaaaacccggtggtattctatgaaaaaaacaaccatgaagataattccattcaataggctcaccataggtgaaggccagcagcaccacctcggcggggcaaagcaagtcaggcctgagcatccagctgagaccgaatatgactccctctatcctgaggatgatctg

SEQ ID NO: 11464 - DNA, 1359 bp, Artificial Sequence
  Description of Artificial Sequence: Synthetic coding sequence
atgtcttggtctttgcaccctcggaacctcattctgtatttctatgcccttctgtttctcagttccacatgtgttgcctatgtcgcaacaagagataactgttgtatcctggatgaaaggttcgggtcctattgtcctacaacttgtggaatagctgattttctttctacttatcagactaaagtggataaagatctccaatccttagaagacatactccatcaggttgaaaacaaaacatcggaggttaaacagctgataaaagctatacaactcacttataacccagacgaatcttccaaaccaaacatgatcgacgcagctactctgaaaagtaggaaaatgctcgaagaaatcatgaaatacgaagcgtctatcctaacacatgattcatccataaggtaccttcaggaaatctacaactcaaataaccagaaaatcgttaatctcaaggaaaaagtggcccagcttgaagcccagtgtcaggagccatgcaaagatacagttcagatacatgacataactggaaaagattgtcaggatatcgcgaacaagggagctaaacaatcagggctttactttattaagccactgaaagctaaccagcagttcctcgtgtactgcgaaatcgatgggtctggaaatgggtggacagtgttccagaaaaggctggatggatctgtcgatttcaagaaaaattggattcagtataaggagggattcgggcacctctctccaacaggaacaactgaattctggttgggaaatgagaagatccacttgatcagtactcagtcagctataccttacgccttacgggtagaattggaagattggaatgggagaacttctactgcagattatgcaatgttcaaagtcgggcccgaggctgataagtatcggcttacatatgcatactttgctggaggagacgcaggggatgcttttgatggattcgacttcggagatgatccctccgacaaattttttacatctcataatggaatgcagttttcaacatgggacaatgataatgataaattcgaagggaactgtgctgaacaggatggatcaggatggtggatgaacaaatgccatgcaggacacctgaatggggtttattatcaggggggaacatactcaaaagcctccacacccaacgggtacgacaacgggataatatgggcaacttggaagacaagatggtattctatgaaaaaaactacaatgaaaataataccatttaaccggctaactatcggggagggacagcagcatcatctcgggggagccaaacaggtgcggccagagcaccccgccgaaactgaatatgattccctttatcccgaagatgatctg

SEQ ID NO: 11465 - DNA, 1359 bp, Artificial Sequence
  Description of Artificial Sequence: Synthetic coding sequence
atgtcctggagcctccatcctagaaaccttatattgtatttttatgccctcctgtttttgtcgtctacgtgtgtcgcttatgtggcaacacgtgataattgctgtatcctcgatgagcggtttggatcttactgccccacaacttgtggcattgcggatttcttgtcaacttaccaaaccaaagttgacaaggatttgcagagtttggaggacatccttcatcaagtagagaacaagacatcggaggtgaagcagctaattaaggccatccaactgacgtacaatccggacgaatcgtccaagccgaatatgatcgatgcggccacattgaaatcaagaaagatgctagaggaaatcatgaagtacgaggcctctatactaacccatgattcttcaattagatatctgcaggagatttataacagcaacaatcagaaaatcgtaaacctcaaggaaaaagttgcgcagcttgaggcgcaatgtcaagaaccatgtaaggacaccgtgcagattcacgacattactggtaaggactgccaggacatagcgaataagggagccaaacagtcgggactgtattttattaaacccctgaaggctaatcaacagtttcttgtctattgtgaaattgacggatcgggaaatggctggaccgttttccagaagcgactcgatggctcagttgatttcaagaagaattggatccaatataaggagggcttcggacatttgtcacccacaggaaccaccgagttctggctgggcaacgaaaagatccacctgatttctacacaatctgctatcccttatgctctccgtgtcgagcttgaggactggaacggtcgaacatcgacggccgactacgcaatgtttaaggtcggtccagaggctgacaagtaccgcctcacctacgcatactttgctggtggtgatgcaggcgatgccttcgacggtttcgacttcggggatgatccttccgacaagttctttacttctcataatggtatgcagttctcgacctgggataatgataatgataagttcgagggaaactgtgcggagcaggatgggtcaggttggtggatgaacaagtgccatgcaggccatctcaacggtgtttactatcagggtgggacgtacagcaaggcgagcactcctaatggctatgacaatggcattatctgggcgacctggaagactcgctggtactcgatgaagaaaacgacgatgaaaattatcccttttaacaggctcaccatcggcgaaggacagcaacaccacttaggaggggctaagcaagttcgccccgaacaccctgccgagaccgaatatgattctctttaccccgaagacgacctt

SEQ ID NO: 11466 - DNA, 1359 bp, Artificial Sequence
  Description of Artificial Sequence: Synthetic coding sequence
atgtcatggtcactccatccaaggaacttgatactgtatttctacgctttactcttcctgtcctctacttgcgtggcctacgtggctacgagagataactgttgcatccttgacgagcggttcggatcatactgtccaacaacctgtggcatcgccgacttcctgtctacataccagaccaaggtggacaaggatttgcagtctctagaggacattctgcaccaggtggagaacaagacgtcggaggttaagcagctgatcaaagccatccagctgacgtacaacccggatgagtcctcaaaacccaatatgatcgatgcagctacgctaaaatcacggaagatgctcgaagagattatgaagtatgaggcgtctattcttacccatgacagttctatccgctacttgcaggaaatttataattctaataaccagaaaatcgtcaatctgaaggagaaggttgcacaactggaggcgcagtgccaggagccatgcaaggacacagtgcagattcacgacattaccggtaaggactgtcaagacatcgccaataagggtgctaagcaatccgggctgtattttatcaaacctctcaaagctaatcaacagttcctggtgtattgtgagattgatggatctgggaacggatggaccgtatttcaaaagagattggatggaagtgtagatttcaaaaaaaattggatccagtataaggaggggttcggtcatctcagcccgactggaaccacagagttctggctcgggaatgagaaaatccacctaatcagcacccaatccgccattccatacgcattgcgagttgagctcgaggactggaacgggagaacctccacagccgattacgctatgtttaaggttggcccggaggccgacaagtacaggctgacctatgcatactttgcaggcggggacgctggcgatgccttcgacggcttcgattttggagacgatccttctgataagtttttcacatctcataacggcatgcagttctctacctgggataacgacaatgataagtttgaggggaactgcgcagagcaggatgggagcggttggtggatgaataagtgtcacgctgggcatcttaacggtgtctactaccagggagggacttacagcaaagcttctaccccgaatgggtacgacaacggcattatctgggcaacctggaaaactcgctggtacagcatgaaaaaaaccactatgaaaatcatcccatttaacaggttaacaatcggtgaggggcaacagcaccacctggggggcgctaagcaggtaaggcctgagcacccagctgagaccgagtatgatagtctgtaccctgaggacgattta

SEQ ID NO: 11467 - DNA, 1359 bp, Artificial Sequence
  Description of Artificial Sequence: Synthetic coding sequence
atgtcgtggtcgttacatccgcgaaatctaatattatatttttatgcgttattatttttatcgtcgacgtgtgtagcgtatgtagcgacgcgtgataattgttgtatattagatgaacgttttggttcgtattgtccgacgacgtgtggtatagcggattttttatcgacgtatcaaacgaaagtagataaagatctacaatcgttagaagatatactacatcaagtagaaaataaaacgtcggaagtaaaacaattaataaaagcgatacaattaacgtataatccggatgaatcgtcgaaaccgaatatgatagatgcggcgacgctaaaatcgcgtaaaatgttagaagaaataatgaaatatgaagcgtcgatattaacgcatgattcgtcgatacgttatctacaagaaatatataattcgaataatcaaaaaatagttaatttaaaagaaaaagttgcgcaattagaagcgcaatgtcaagaaccgtgtaaagatacggtacaaatacatgatataacgggtaaagattgtcaagatatagcgaataaaggtgcgaaacaatcgggtttatattttataaaaccgctaaaagcgaatcaacaatttttagtatattgtgaaatagatggttcgggtaatggttggacggtatttcaaaaacgtctagatggttcggttgattttaaaaaaaattggatacaatataaagaaggttttggtcatctatcgccgacgggtacgacggaattttggttaggtaatgaaaaaatacatctaatatcgacgcaatcggcgataccgtatgcgctacgagtagaattagaagattggaatggtcgaacgtcgacggcggattatgcgatgtttaaagttggtccggaagcggataaatatcgactaacgtatgcgtattttgcgggtggtgatgcgggtgatgcgtttgatggttttgattttggtgatgatccgtcggataaattttttacgtcgcataatggtatgcaattttcgacgtgggataatgataatgataaatttgaaggtaattgtgcggaacaagatggttcgggttggtggatgaataaatgtcatgcgggtcatttaaatggtgtttattatcaaggtggtacgtattcgaaagcgtcgacgccgaatggttatgataatggtataatatgggcgacgtggaaaacgcgatggtattcgatgaaaaaaacgacgatgaaaataataccgtttaatcgtttaacgataggtgaaggtcaacaacatcatttaggtggtgcgaaacaagtacgtccggaacatccggcggaaacggaatatgattcgttatatccggaagatgatcta

SEQ ID NO: 11468 - DNA, 1359 bp, Artificial Sequence
  Description of Artificial Sequence: Synthetic coding sequence
atgagctggtccctgcaccctagaaaccttatcctgtacttttacgcattgctgttcctgtcgtcaacctgcgtggcttatgtggcaacccgagataactgctgcattctcgatgagcgattcgggtcttactgccccaccacttgcggcattgccgattttctgagtacttaccagactaaggtggacaaggatctgcagtccctggaggacatattacaccaggtcgagaacaaaacgagcgaagtgaaacagcttattaaggctattcaactcacatataatcctgacgagtcctcaaagccaaacatgatcgatgcagctacgctcaagagtcgcaagatgttagaggagattatgaagtacgaagcctctatacttacccatgactcttccattaggtacctccaagagatttacaactcaaacaatcagaagatagtaaacttgaaagaaaaggtcgcgcaactcgaagctcagtgccaggaaccatgcaaggatacagtccagatccatgatatcaccgggaaggattgccaggatatcgccaacaagggagcgaagcagagcggcctgtatttcatcaaacccctgaaggccaatcaacagttccttgtgtactgcgaaattgacggctccgggaacggatggacagtatttcagaagagattagacggttctgtggattttaagaaaaactggatacagtacaaggaggggttcggtcacctgtcccccacaggcacaacggagttttggctcgggaacgaaaagatccacttgatttccacgcagtcagccattccttatgccttgagggttgaactcgaggattggaacgggcgaacaagcaccgctgactatgccatgttcaaagtggggcccgaggccgataaatatcgactcacctatgcctattttgctggtggcgatgctggcgatgcttttgatgggttcgatttcggggatgacccctccgacaagttctttacgtcgcacaacggcatgcagttcagcacctgggataacgataatgacaagtttgagggcaactgtgcagagcaagacgggtcaggatggtggatgaacaaatgccatgcagggcatcttaatggggtctactaccagggaggcacttactcgaaagcttcaactccgaacggatacgacaatggaatcatttgggccacatggaagactcgctggtatagtatgaagaagaccacaatgaaaataatccccttcaaccgattaaccattggcgagggccagcaacatcatctggggggggccaaacaagtgagacccgaacacccggccgaaaccgagtatgattcactgtaccccgaggatgaccta

SEQ ID NO: 11469 - DNA, 627 bp, Artificial Sequence
  Description of Artificial Sequence: Synthetic coding sequence
atggactccgatgaaaccggctttgaacatagcggattgtgggtgtcggtgctcgccggactcctgctgggcgcgtgtcaagcccacccgattccggatagctcgcctctcttgcagttcggtggtcaggtcagacaaaggtatctgtacactgacgatgcccagcagacggaggcacatctcgagattcgcgaagatggcactgtcggaggagcagcggatcaatcaccagaatctctgttgcagctcaaggcactcaagccgggagtgatccaaatccttggagtcaagacttcccgcttcctctgccagaggccggacggggcgctctacggatcactccacttcgaccctgaggcatgcagcttccgcgaactgctgctggaggacggatacaacgtgtaccaatcggaggcgcatggcctcccactgcacctgccgggcaacaaatccccacacagagatccggccccaagggggcctgcccgcttcctgcctctcccgggacttccacctgctctgccggagccaccggggatcctcgctcctcagccgcctgatgtgggatcgtcagatccgctgagcatggtcggaccaagccaaggccggagcccttcgtacgcctcc

SEQ ID NO: 11470 - DNA, 627 bp, Artificial Sequence
  Description of Artificial Sequence: Synthetic coding sequence
atggattcggatgaaaccggttttgaacactctggtctttgggtgtccgtgctcgccggcttgctgcttggagcatgtcaggcccaccctatccctgattcgtctccgcttctgcagtttgggggccaagtgcgtcaacggtatctctacacggacgatgcacaacagactgaagcgcatctggaaattcgagaggatggcactgtcggtggggcagctgaccaaagccctgagagtctcttgcagctgaaggctctgaagccaggtgtgatacaaatacttggagttaagaccagcaggtttctctgtcaacgtccagacggagcgttgtacgggtccttgcattttgaccccgaggcatgcagcttccgggaactccttctggaagatggatacaatgtctaccagtcagaagcccatggactcccactgcatcttccgggcaacaaatcgccccaccgggatccggcacctaggggaccggcgcgattccttccactccctggcctgccacccgcgcttcctgagccaccgggtattcttgcaccgcagccacctgacgtagggagcagtgatcctctttccatggtgggtccatcgcaagggcgctccccatcgtacgcatca

SEQ ID NO: 11471 - DNA, 627 bp, Artificial Sequence
  Description of Artificial Sequence: Synthetic coding sequence
atggactcagacgaaaccggatttgagcactcagggctgtgggtatcagtgcttgccgggcttctgctgggagcgtgccaggcacatcctatcccagattcttcccctcttcttcaattcggaggacaagtgcgtcaacgctacctctacacggacgatgcacagcagaccgaagcacacttggagattcgtgaagatggcaccgtgggaggggcagcagaccaatccccagagtcattgctgcagcttaaggccctgaagccaggagtgattcaaatcctgggtgtcaagacttccaggtttctgtgtcaaaggccggatggtgcgctgtacgggtcgctgcattttgatcctgaagcgtgtagcttcagggagctgttgctcgaagatggttacaacgtgtaccagtccgaagctcatggacttcccttgcacctgccaggcaataagtcgccccacagagatcccgcccctagaggtccggcgcgcttcctgcctcttccaggacttccacccgcactgcctgaaccacctggaatcctggcccctcagcctcctgacgtgggttcgtcggaccccctgagcatggtcggcccttcacaaggaaggagcccatcctatgcatcc

SEQ ID NO: 11472 - DNA, 627 bp, Artificial Sequence
  Description of Artificial Sequence: Synthetic coding sequence
atggatagtgatgaaacgggtttcgaacactcaggcttgtgggtcagcgtgttggccggactgctgctgggcgcatgccaagcacaccctatacccgacagctccccgctgcttcagttcgggggacaagttcgccaacgctacttgtacacggacgatgcgcagcagacagaggcccatctggagattagagaggacgggacagtcggcggggccgcggatcagagcccggagtcgctgctgcaattgaaagccctgaagcccggtgtgatccagatattgggggttaagaccagccgctttttgtgccaacgcccagacggcgctttgtacggtagcctgcatttcgacccggaggcctgctcctttcgagagctgctgctggaagatggatataatgtgtatcagagtgaggctcacggcctgcccctacacctaccgggcaacaagagtccgcatcgcgatcccgcaccacgcggccccgctagatttctgcccctgcccggattgcccccagcattgcctgagcccccaggcatcctggcaccacagccaccggatgttggctcaagcgacccgctgtccatggttggcccgagccaggggcggagccctagctacgcaagc

SEQ ID NO: 11473 - DNA, 627 bp, Artificial Sequence
  Description of Artificial Sequence: Synthetic coding sequence
atggactccgatgaaactggattcgaacactcgggactctgggtgagtgtcctcgctgggctgcttctcggagcctgccaggcccaccctataccagactcttccccgctgctccaatttggcggccaggtgcgccagagatacctgtacacagacgacgcccagcaaactgaggctcatctggaaattcgggaagacgggactgtgggcggcgccgcagatcagagtccggaatccctactccaactcaaggccctgaagcccggggtcatccagatcctcggcgtcaagacaagtcgcttcctctgccagcgaccagacggcgccctatacggttcattgcactttgatcccgaggcatgtagcttcagagagttgttgcttgaggacggctacaatgtatatcagtcagaggctcacggactgccgctgcacctgcccgggaacaaaagtccacatagagatcctgcaccccgagggccagcacgcttcctgccacttcctgggctcccccccgccctgccagagccgccagggattttggcgccgcagccccccgacgtggggtctagcgacccgctgtccatggttggcccctcgcagggcagaagccctagttacgccagt

SEQ ID NO: 11474 - DNA, 627 bp, Artificial Sequence
  Description of Artificial Sequence: Synthetic coding sequence
atggattccgacgagacggggtttgaacactctggtttgtgggtctcggtcctcgctggtttattgttgggtgcatgccaggcacacccgattccggatagctctccacttctgcagtttggtggccaggtgcgccagagatacctgtatacagatgatgctcagcagacggaagcacaccttgaaattagagaagacggtacggtgggcggagcggcggaccagagccctgaatcgctcttgcagctgaaggcgctgaaacccggcgttattcaaatattgggggtcaagacgtcgcgttttctgtgtcaacggccggatggggcactttacggctcattacattttgatccagaggcctgttcatttagagagttactgttggaagacggctataacgtgtaccaatctgaggcacatggacttccgctgcatttgcctgggaataaatcgccgcatcgtgacccggctcctagaggacctgcgagatttcttcccctgccgggcctaccaccggctcttccggaaccgccggggattttggctcctcagccaccggacgtagggagttccgatccattatccatggtgggaccgagccagggtagatcacctagctatgcatca

SEQ ID NO: 11475 - DNA, 627 bp, Artificial Sequence
  Description of Artificial Sequence: Synthetic coding sequence
atggattccgatgaaacgggatttgaacattctggcctgtgggtatcggtccttgcaggacttctgctgggagcatgccaagcacaccctataccggattcgtcccccctgctccagttcggaggacaggtgcggcaacgttacctgtacaccgatgacgcccagcaaactgaagcgcatcttgagattagggaggatggtactgtgggtggggcggcagaccaatcgcccgagtcactgctgcagctcaaggctctgaaaccaggtgtgattcaaatccttggagttaagaccagcaggtttctgtgtcaaaggcccgatggggcattgtacggttcactgcactttgatcctgaagcgtgtagcttccgtgaactgcttcttgaagatgggtacaatgtctaccagtcagaagcacatggacttccgcttcaccttcccggaaacaagtcccctcatcgcgacccagcgcctcgtggcccggcaagatttttgcccttgccagggctcccacctgcattgcctgagccgccaggaatccttgctcctcaacctcccgatgtgggctcgtctgacccactttcaatggtgggaccatcccaggggcgaagcccttcatatgcttca

SEQ ID NO: 11476 - DNA, 627 bp, Artificial Sequence
  Description of Artificial Sequence: Synthetic coding sequence
atggattctgacgagaccggtttcgagcatagtggcttatgggtgagcgtgctcgctggccttttgctaggcgcctgtcaggctcatccaatcccagatagttccccgctgctgcagtttggcggccaggtgcggcaacgctatctttacaccgacgatgctcaacagactgaagctcacctggaaattcgagaagatgggactgtggggggagccgctgatcagagcccagagagtcttctgcagctcaaagctctgaaacctggggtgattcagatccttggtgttaagacttccaggtttttgtgccagcgtcccgacggagccctctatggctccttgcacttcgatcccgaggcatgctccttcagggagctcctgcttgaggacggctacaatgtgtatcagagtgaggcacacggcctgcctctccacctcccggggaacaagagtccgcaccgagatccggccccccgtgggcctgccaggttcctccctctgccaggtttaccgccagcgctaccagagccgccaggaatactggctccacagccccccgacgtgggctcaagcgatcccctcagtatggtgggaccttcccaggggagaagcccatcttacgctagc

SEQ ID NO: 11477 - DNA, 627 bp, Artificial Sequence
  Description of Artificial Sequence: Synthetic coding sequence
atggattcggatgagacggggttcgaacactccggtttgtgggtgtcagtcttggccggattgcttctgggggcctgtcaggcccaccctatcccggactcgtcaccacttctccagtttggcggccaggtcaggcaacggtacctgtacaccgacgatgctcagcaaaccgaagcgcacctcgaaatccgcgaggacggaaccgtggggggcgctgctgaccaatcgccagagtccttgctccagcttaaggcgttgaagccgggagtgatccaaatactgggagtcaaaacttctaggttcctgtgccaacgaccggatggtgccttgtacggctcgctccacttcgatccggaagcatgctcgttccgggaacttttgctggaggacggatacaatgtgtaccagtccgaggcacatggcttgccactgcatttgccgggaaacaagagcccgcatagggacccggcaccgcgcggaccggccagatttctgcccctccccggactcccgccggcgcttccagaacccccagggattctggccccgcagcctccggacgttggatccagcgaccccctctcgatggtgggaccatctcaaggacggtccccctcgtatgcatcc

SEQ ID NO: 11478 - DNA, 627 bp, Artificial Sequence
  Description of Artificial Sequence: Synthetic coding sequence
atggacagcgatgagacaggtttcgaacatagcgggttgtgggtgagcgtattagctgggttactcctaggagcttgccaggcccaccctattcccgactcttctcctctgttacagttcggcggacaggttaggcagaggtatctgtataccgatgatgcacagcagaccgaagctcatctggagattagagaggatgggaccgtcggcggcgccgccgatcagagccccgagtccctattgcagctgaaggcactgaagcctggggtgatccaaattctaggcgtgaaaacttccaggtttttgtgtcagaggcctgatggcgccctgtacggctcacttcacttcgaccctgaggcttgcagcttcagagaactgctcctggaggacggctacaatgtgtaccagtctgaggcccatggcttgccattgcatctgcccggaaacaagtctccacaccgcgaccctgctcctcgaggcccagcgaggtttctccccctcccaggcctgccacctgcccttcccgagccgcctggaatcctggctccccagccccctgatgtcgggtcctctgacccattaagcatggttggaccctcacaaggcagaagcccatcttatgcctca

SEQ ID NO: 11479 - DNA, 627 bp, Artificial Sequence
  Description of Artificial Sequence: Synthetic coding sequence
atggactcggacgagaccggattcgaacactccggattgtgggtctctgtgctggcaggactcctccttggcgcttgccaagctcatcctattcccgactccagcccacttctacagtttgggggacaagttagacaaaggtacctgtacacagatgatgctcagcagactgaagctcatcttgaaattcgggaagacggcacagtagggggtgccgccgatcagtctccagagtccctgctgcagctcaaggctttgaaacccggcgtgatccagattctcggcgtcaagaccagccgcttcctctgccaacggcccgatggcgccctatatggttctttgcatttcgacccagaagcttgcagtttccgggagctcttgctcgaggacgggtacaacgtctatcaatctgaagcccacgggttaccccttcacctgccaggcaataaatcaccccaccgcgaccccgcaccccgcgggcctgctcggtttcttcccctgcctggactgcctcccgctctacccgaaccacccggcattctggcccctcagccccccgatgtcggcagtagcgacccactaagcatggtgggccccagtcaggggagaagtccctcatatgcgagt

SEQ ID NO: 11480 - DNA, 627 bp, Artificial Sequence
  Description of Artificial Sequence: Synthetic coding sequence
atggacagcgacgagactggatttgaacattcagggctctgggtgtcagtcctggccggcctgcttctgggagcgtgtcaagcccacccgattcctgactctagcccactcctgcagttcgggggtcaagtgcgccagcggtatctctacaccgacgatgctcaacagactgaagcacacctcgaaatccgcgaagatggaaccgtgggaggcgctgcagaccagagcccggagtccctgctgcaacttaaggctctgaaaccaggagttatccagatcctcggtgtcaagacctcgcgatttctgtgccagcgaccagatggagctttgtacggctccctgcatttcgaccccgaagcgtgctccttccgtgagctgctgctcgaggacggatacaatgtttaccagtcagaagcccacggattgccgctgcatcttccgggcaacaagagcccacacagagatcccgcccctcggggcccggcacggttcctgcctcttcctggactccccccggccctgccagagcctcctggaatccttgcgcctcagccgccagacgtgggatcaagcgatccattgtcaatggtggggccgagccaggggcgctccccgtcctacgcgagc

SEQ ID NO: 11481 - DNA, 627 bp, Artificial Sequence
  Description of Artificial Sequence: Synthetic coding sequence
atggacagcgatgagacgggcttcgagcactcaggactttgggtgtcagttctagctggcttactgctgggggcgtgccaggcacaccctatccctgatagttctcccttgttgcagttcggtgggcaggtgcggcaacgatacctgtacaccgatgacgctcaacagaccgaggcacacctggagatccgtgaggatggcactgtggggggtgccgctgatcagagtccagagtccctccttcagctaaaggctctaaagcccggggtgattcaaatactgggggtcaagacatctcgcttcctttgccagcggccagatggcgcactctacgggtccctccattttgacccagaggcctgcagtttccgtgagttattgttggaggatggttacaacgtgtaccagagcgaagctcatggcttaccccttcatctgcccgggaacaagagccctcaccgtgatcccgcaccaaggggccccgcccgatttttgcctctgccgggactgcccccggcactccccgaacctcccggcatcctggccccacagcctccagacgttggaagttcggaccctctcagcatggtaggtccatcccagggcaggagtccttcatatgctagt

SEQ ID NO: 11482 - DNA, 627 bp, Artificial Sequence
  Description of Artificial Sequence: Synthetic coding sequence
atggattccgacgaaaccggattcgaacatagcgggctgtgggtgagcgtgctggcagggcttcttctgggtgcatgccaggcacatcctattccagactcaagccctcttctccagtttgggggtcaagtcagacaacgatacctgtacaccgatgatgcacagcagacggaagcacatctcgagatacgtgaagatggtactgtcggtggtgcggcagatcaatcccctgagtcactgctccaacttaaggcactgaagcctggagttatacagattctgggcgtgaaaacgtcccgatttctttgtcaacgcccagatggagccctgtacggatcgctgcactttgatcctgaggcatgttcctttcgggaactgcttcttgaagatggctacaatgtctatcagtcggaagcccatggcctcccactccacctgcctggcaataagtcgccccaccgcgacccagcacctaggggacctgcaagattccttccattgccgggacttccacctgcgctccccgagccccccggtattctcgcccctcagccccccgatgtcggctcgtctgacccactgtccatggtgggtccttcacagggacgttcgccgtcatacgccagc

SEQ ID NO: 11483 - DNA, 627 bp, Artificial Sequence
  Description of Artificial Sequence: Synthetic coding sequence
atggactctgacgagactggattcgagcacagcggcttatgggtctccgttctggctggccttctactgggggcttgtcaagcccaccctatccctgattctagtcctctcttacagttcggcggacaggttcggcaaagatatctgtacaccgatgatgcccagcaaaccgaagcccacctcgaaattcgcgaggatggcaccgtgggcggtgctgccgaccaatcacccgagtccctcctgcagcttaaagccctgaagcctggcgtgattcagatactgggggttaagacctcacgctttctctgccagcgccccgacggtgccttgtacggtagcctgcattttgatcctgaggcttgctcctttagggagctactgctggaggatggctacaatgtgtaccagtcagaagctcacggcttgcctctgcacctaccaggcaataagagtcctcacagagatccagcacctaggggccccgcccggtttctgccactccctggtctgcccccagccctgccggagcctccaggcatactggcccctcaaccacctgatgtgggaagttctgaccccctaagcatggtgggccctagccagggacgctcccctagttatgctagt

SEQ ID NO: 11484 - DNA, 627 bp, Artificial Sequence
  Description of Artificial Sequence: Synthetic coding sequence
atggatagtgatgaaacagggtttgagcactccgggctgtgggtctctgtgcttgccggactgttgctcggagcctgtcaggcccatcccattcccgattcatcacccctacttcagttcggaggacaggttagacagcgctatctgtatactgatgacgctcagcagactgaagcccacttagaaatccgcgaagatggaacagtcgggggggcggccgatcaatctcccgagagtttgcttcaactaaaagcactaaagcccggggtgatccagatcttaggagtgaaaacttcaagatttctatgtcagaggccagatggagcactctacggatctcttcattttgatccagaagcctgttcttttcgggagctattgcttgaggatggatacaatgtgtatcaatccgaagcccacgggctgccactccatcttcccgggaacaaatccccgcatagagatccagcccctagagggccagctaggttcctgcccctccctggactccccccagccctgccagaacctcctggaatactagcaccacagcctccagatgtcgggtcatcagatcctctgtctatggtggggccatctcagggacgatctccttcttacgcatcc

SEQ ID NO: 11485 - DNA, 627 bp, Artificial Sequence
  Description of Artificial Sequence: Synthetic coding sequence
atggactcagacgaaaccggattcgagcactccgggctctgggtgtccgtgctggcagggttgctgctgggagcgtgccaggcacacccaatcccagattcgtccccgctcctccaatttggcggacaggtgagacagaggtatttgtacactgacgatgcgcaacagaccgaggcacatctggaaattcgggaggacggtacggtcggaggagcggctgaccaatcccctgagagcctcctgcagttgaaggccctgaaaccgggagtcattcagatcttgggcgtcaagacctcgaggtttctgtgccagcggccggatggtgctctgtacggttcgctccatttcgatcctgaagcatgttcgttcagggaactgctccttgaagatggttacaacgtataccagagcgaagcccatggtctgcccctccatcttccagggaacaagtcgccgcaccgcgaccccgcaccacgaggcccggcccgcttcctgcctctccctggactgccgccagcactgccagagccgccaggaatcctcgcaccccagccccctgacgtgggaagctcggaccccctgagcatggtgggaccgtcgcaagggaggtcgccgtcgtacgcaagc

SEQ ID NO: 11486 - DNA, 627 bp, Artificial Sequence
  Description of Artificial Sequence: Synthetic coding sequence
atggactcagatgaaaccgggtttgagcattccgggctctgggtgtctgttctggctggcctattgctgggggcgtgtcaggctcacccaattccagacagttcccctctgctgcaattcggtggtcaagtgaggcagagatatctgtataccgatgacgctcagcagaccgaggctcacctcgagattcgcgaagatgggaccgtaggcggagccgctgatcagtccccagaaagcctcctccagctgaaggcattaaagcccggcgtaattcagatacttggcgtcaagactagccggttcctctgccagagacccgatggcgcactgtatggttcacttcactttgaccctgaagcctgcagcttccgggagttgttgctggaggatggctataatgtctaccagtctgaggcccacggactaccactacatctcccaggaaacaaatcacctcatcgggaccccgcaccaagaggaccagcaagattcctgccactcccaggcttgccgcctgccctgcctgaacctcccgggattctagccccccaacctcctgatgtcggaagctccgaccccctgagtatggtcggtccatctcaagggaggtcaccatcttacgcttca

SEQ ID NO: 11487 - DNA, 627 bp, Artificial Sequence
  Description of Artificial Sequence: Synthetic coding sequence
atggacagcgacgagaccgggttcgagcacagtgggctctgggtgtccgtcttggcggggctgctgctgggggcttgtcaggcgcaccccatacctgattcatcccccctgttgcagtttggcgggcaggtcagacagcggtatctgtacactgatgatgctcagcagaccgaagcccacctcgagattcgcgaggatggcacggttgggggcgcggccgatcagtccccggagtccctgctccagctcaaagccctcaagcctggggtaatacagattctcggagttaaaacctctagattcttgtgtcagcgtcctgatggggcactgtacggaagcttgcactttgatcccgaggcttgtagctttcgcgaactgctccttgaagatgggtacaacgtctaccagtccgaagcacacgggcttcccctccatctaccaggaaataagagcccccaccgcgaccccgcaccgcggggtccagcccgctttctccctttgcctggactcccgccagcgctgcctgagcctcccggcattcttgctcctcagccaccagatgtcggttctagcgatcctctgtctatggtggggccttcacaagggaggagtcctagctatgccagt

SEQ ID NO: 11488 - DNA, 627 bp, Artificial Sequence
  Description of Artificial Sequence: Synthetic coding sequence
atggacagcgatgaaaccggcttcgagcattccggactgtgggtgtcagtcctggccggtctgcttttgggagcttgccaggctcacccgatccccgattcctctccgcttctgcaattcggaggtcaggtcagacaacggtacctctacactgatgacgcccagcaaacggaggcacatctcgagatccgggaagatggaaccgtgggtggagccgctgatcaatccccggaatcgctgctgcagctcaaagcgctgaagcctggagtgatccagatcttgggagtcaaaactagccggttcctgtgccagcgcccggacggagcgttgtacggatccctgcattttgatccggaagcctgctccttccgcgagctgctccttgaggacggttacaatgtgtaccagtccgaggctcatggcctgccgctccatttgcctggaaacaaatcgccacaccgggaccccgcgccgcgaggcccggcgagattcctgcctctccccggactgcccccagcgctgcctgagccgccgggaattctggccccgcaacctcccgacgtggggtcgtcggatccgctgtccatggtgggaccgtcgcagggccggtcgccatcctacgcgagc

SEQ ID NO: 11489 - DNA, 627 bp, Artificial Sequence
  Description of Artificial Sequence: Synthetic coding sequence
atggactccgatgagaccgggttcgagcactcaggactttgggtttccgtgttggccgggctactgctgggggcctgccaggcccacccaatccctgatagcagcccgctactccaatttggaggccaggtaagacaacgatacttatataccgatgacgctcagcagactgaagcacatcttgaaattcgagaggatggcacggttgggggcgcagccgatcagtccccggagtccctcttgcagctgaaagccttgaaacctggcgtcattcagattctgggtgtcaagacttctcgattcctttgccagcggccagacggcgcgttatacggtagcctccatttcgatccagaagcctgcagttttagggagttactgttagaggatggttacaatgtttaccagtcagaagcgcatggtctacctctgcatttgcctggcaataagtctccacatagagaccccgccccacggggtccagcgcgatttcttccactcccgggtcttccgcccgctctcccagaaccaccaggaattctggccccacaaccccctgatgtgggcagttccgacccgctgagcatggtgggtccctcacagggtagatcaccatcttatgcaagc

SEQ ID NO: 11490 - DNA, 627 bp, Artificial Sequence
  Description of Artificial Sequence: Synthetic coding sequence
atggacagcgatgagactggatttgaacattcagggctgtgggtgagcgtgcttgcaggtctgctccttggagcctgtcaggcacacccaattccggatagctcgcctcttttgcaattcggaggccaggtcagacagagatacctctacaccgacgatgctcagcagaccgaagcccatctggaaatcagggaggacgggactgtgggtggggcagcagatcaatcgcctgaatccctgttgcaactgaaagcactgaaacccggggtcatccaaattctcggggtgaaaacgagtcggtttttgtgccagaggcccgacggcgcgctgtacggctccctccatttcgatccagaagcatgttcctttcgagaactcttgcttgaggatggctataatgtgtaccagagcgaagcccacgggttgccccttcatttgcctggaaataagtcaccacacagagatcccgcacctcgaggacctgcacggttccttcctttgcctggtctgccccctgcactgccagagccgcccggtatcctggccccacaacccccggacgtcgggtcctcagatccactttcgatggtggggccatcccaaggacgctcaccatcctacgcttca

SEQ ID NO: 11491 - DNA, 627 bp, Artificial Sequence
  Description of Artificial Sequence: Synthetic coding sequence
atggactcagacgagacagggttcgagcactcgggtctgtgggtctccgtcctggcaggactgctgctgggggcttgtcaggcccacccaatacccgacagctcccccctgctgcagtttggcggccaagtgcggcagcggtacctgtataccgatgatgcgcagcagaccgaggctcacctggaaattagggaggacggtactgttggtggagctgccgatcagagtcccgagtcattgctgcagctgaaggccctgaagcccggggttattcagattctgggagttaagacctcacggttcctatgtcagcgcccagacggagctttgtacggaagcttgcatttcgaccctgaagcttgctcctttcgggagctactgctggaagatgggtacaacgtgtaccagtctgaggcccacgggctgcccttgcatctccccggtaacaaaagcccccatagggatccggctcctcggggccccgcaaggttccttcctctgcctggtttgccgccagctctcccagaaccaccaggaatcctggcaccccagcctccagacgtagggtcttctgatccgctgagcatggtgggtccgagccaagggcggtccccaagctatgcctca

SEQ ID NO: 11492 - DNA, 627 bp, Artificial Sequence
  Description of Artificial Sequence: Synthetic coding sequence
atggattcagacgaaacgggattcgagcattcaggactgtgggtgtcggtcctcgccggactgctgctgggggcatgtcaggcccatccaattccggacagcagcccgctgctccagttcgggggacaggttcgacaacggtacctgtacactgatgacgctcagcaaactgaggctcacttggaaatcagagaggacggaaccgtgggtggagccgctgatcagtcgcctgaaagcctgcttcaactgaaggccctcaagcccggtgtgatccagatcctgggggtgaaaacctcgcggttcctctgccaaagaccggatggagcactgtatggatctctgcatttcgacccagaggcctgctcctttcgcgagcttctgcttgaagatggctacaacgtctaccagtcggaagcgcacggtttgcctttgcacctcccgggcaataagtccccgcacagggaccctgcgccgcgcggacccgcgcggtttctcccgctccctggcctgccgccagcgctgcccgaaccgccaggcatcctggccccgcaacctccagacgtgggctccagtgacccactctcgatggtcgggccatcccagggacgctcaccgagctacgcatcc

SEQ ID NO: 11493 - DNA, 627 bp, Artificial Sequence
  Description of Artificial Sequence: Synthetic coding sequence
atggactctgacgagacaggttttgagcattccggattgtgggtcagcgtgctagctggacttttactgggtgcctgccaggctcacccgatcccagactcctcaccgctgctgcaatttggcggccaggtcagacagcgttacctctacacggacgacgcccagcagactgaagctcatttggagattcgagaggatggtactgtgggaggtgctgcggatcagagcccagagtctctattacagcttaaggccctcaaacccggggttatccagatactgggcgtgaagacatcgaggttcctatgccagcgccccgacggggcactgtatggttctttgcatttcgaccctgaggcttgtagtttccgcgagctgctgttagaggacgggtacaacgtataccaatccgaggcccatggactgcctctccatctgcctggcaataaaagcccccaccgggaccccgcgcctcgcggccccgctagattccttccactgccaggcctccccccagcgttgcctgagccccctggaatactggccccccaaccaccggatgtcgggtcatcagaccccctgagtatggtgggcccatcccaggggaggtcaccttcctatgccagc

SEQ ID NO: 11494 - DNA, 627 bp, Artificial Sequence
  Description of Artificial Sequence: Synthetic coding sequence
atggattctgacgaaactggcttcgagcactctggactctgggtgagcgtattggcggggcttctcttgggtgcttgccaggcccacccaatcccagattcgagcccactgctgcagttcggaggacaggtgaggcagcgctatctctacacggatgacgcccagcagactgaggcacatctggaaattagggaggacggcaccgtgggaggagccgcggatcagtcacctgaaagcctgctccagctcaaggccctgaagccgggtgtcatccaaatcctgggcgtgaaaacctcccggttcctgtgtcaacggcctgacggtgcactttacggatctctgcattttgacccggaagcctgctcgttcagagagctgctgcttgaggatggttacaacgtctaccagtcggaagcacatggactcccgttgcacctgcctggcaataagtcgccccatagggaccccgccccgcggggaccggcacgctttctgccacttcctggactcccgccggctctgccggagcccccgggaatcctcgctccgcagcctccggacgttggctcctccgatccgctgtccatggtgggaccctcccaaggtagaagcccaagctatgcctcc

SEQ ID NO: 11495 - DNA, 627 bp, Artificial Sequence
  Description of Artificial Sequence: Synthetic coding sequence
atggactccgacgagacaggctttgaacattccggactgtgggtgtccgtgctggctggacttctgcttggggcttgccaggctcatcccattcccgatagcagccccctgttgcagtttggtgggcaggtgcggcagcgctacctgtacacagacgacgcgcagcagactgaagcccacctggagatcagagaagatgggacagtggggggtgccgccgaccagagccccgagtcccttctacagctcaaagctcttaaacccggtgttattcaaattctgggagtgaaaacatcacgatttttgtgccagcggcccgacggagctctgtacggttcactccattttgacccagaagcgtgctcctttcgcgaactgcttttagaggacggctataatgtctaccagtctgaagcgcatggattgccactgcacctgcccggcaataagtcacctcaccgcgaccccgctccgcgcggccccgctcgctttctaccattgccaggcctgcctcccgcgttgcctgaaccaccaggaattctagctcctcaaccgcctgacgtgggctcaagcgatcccctgagtatggtcggaccgtctcagggcagatccccgtcatacgcatcc

SEQ ID NO: 11496 - DNA, 627 bp, Artificial Sequence
  Description of Artificial Sequence: Synthetic coding sequence
atggacagcgacgagactgggtttgaacatagcggcttgtgggtttcggtcctggcagggctcttgttaggtgcctgtcaggcccatccgatacctgacagctcacccttactgcagttcggcgggcaggtccggcagaggtatctttacacagatgacgcccagcaaacggaggcacatctcgagatcagagaagacggaacagtgggaggtgctgctgatcagtcaccagaaagcctcctacagctgaaggccctgaaaccgggcgtgattcagatcctcggagtgaaaacttcccggttcctttgccaaaggcccgatggagctttgtacggctccctccactttgatcccgaggcttgctccttccgggaattgcttctggaggatggttataatgtctaccagtccgaagcccacggactgcctctccacctgcccggaaacaaaagcccacaccgggacccagccccgaggggtccagctcgatttctacccctgcccggattacctccagctctgccggagccccctggcatcctcgccccccagccacccgatgtcgggtcctctgacccgctgagtatggtaggccccagccaggggcggtctccatcatacgcttca

SEQ ID NO: 11497 - DNA, 627 bp, Artificial Sequence
  Description of Artificial Sequence: Synthetic coding sequence
atggattcggatgaaaccgggtttgagcactctggcctctgggtgtcggtcctggccggtctgcttctgggagcttgtcaggcccaccctattccggactcaagcccacttctgcaatttggaggccaagtgaggcagcggtacctttacaccgatgatgcgcaacaaaccgaggcacatcttgaaataagggaggatggcactgtgggtggggccgcagatcagtcccccgagtcgctccttcaattgaaagcactcaagcctggagtcatccaaatcctcggcgtgaaaacttcgaggtttctttgtcagcgccctgatggggcactctacggctccctgcattttgatccggaagcatgtagcttccgggaactgctcctggaggacgggtacaacgtctatcagagcgaagcccacgggctccccttgcatctgccaggtaataagtcccctcacagggacccagccccaaggggtcctgcgagatttcttccactccctgggcttccccctgcattgcccgaaccaccaggaattctggcaccacagccacccgacgtgggatcgtccgaccccctctcaatggtcggaccctctcagggtagatcgccatcctacgcatcg

SEQ ID NO: 11498 - DNA, 627 bp, Artificial Sequence
  Description of Artificial Sequence: Synthetic coding sequence
atggattccgacgagaccgggttcgaacactccggtttgtgggtgtccgtcctggcgggcctgctgctgggtgcttgccaggcccacccgatcccagattcaagccccctcctacaatttggcgggcaggtcagacagaggtatctctatacagatgatgctcagcaaacggaggcacatctggagatccgggaggacggcacagtaggaggcgcagccgaccagtcaccagaatccttgttgcagctcaaggctttaaagcctggcgtcatccagatcctgggtgtgaagacttctaggttcttgtgccaacggcccgacggcgccctgtatggaagtctgcacttcgatcctgaagcttgtagcttcagggagctgctgctggaggacgggtataatgtctatcaatcggaagctcatggattgccactccacctacctggaaataaatccccccatcgcgaccccgctcccaggggtcctgctcgattcctacctttacctggcctccctccggctttgcctgagccccccggtatcttggcccctcagcctcccgatgttggaagctcagaccctctgtctatggtgggcccctcccaggggcggtcccctagctacgccagc

SEQ ID NO: 11499 - DNA, 627 bp, Artificial Sequence
  Description of Artificial Sequence: Synthetic coding sequence
atggactcagacgagaccggttttgagcatagtgggctgtgggtgagtgtgctggctgggctactgctcggggcgtgtcaggcccatcccatccccgactcctcacccctccttcagttcggagggcaggtgaggcaaagatacttgtatacagacgatgcacaacaaaccgaggcacatctggaaatccgcgaggacggcaccgtagggggcgctgcggaccagagccctgagtcactgctgcaactgaaggcgttgaagcccggcgtcatccagatcctgggggtcaagactagcagattcctgtgtcagcgcccagatggcgcactatacgggagtctgcacttcgacccggaagcctgctcttttcgcgagctactgctggaagatggatataacgtgtatcaatctgaggctcacggcctgccattgcacctgcctgggaataaatctccccatcgtgatcctgcaccccgggggcccgcccgcttccttccactgccaggcctgcctccagcactccccgagccacccgggatcctggccccacaacctcccgatgtcgggtcttctgaccccttgtctatggttgggcccagccagggcaggtctccaagctacgcctca

SEQ ID NO: 11500 - DNA, 627 bp, Artificial Sequence
  Description of Artificial Sequence: Synthetic coding sequence
atggatagtgacgagacagggtttgaacatagtgggctgtgggtaagtgtcctagcagggctcttactaggcgcttgtcaggcgcatcctatacctgatagctctcctcttctccagtttgggggtcaggttcgccaaagatatttatacactgatgacgcgcagcagacagaggctcaccttgaaatcagagaggatggtaccgttggcggcgctgcagatcaaagcccagagtcccttctccagctaaaggctcttaagccaggggttattcagatattaggtgttaagacaagccgtttcctttgccaaaggcccgacggtgctctctatggatctcttcacttcgatcctgaggcttgctcttttagggagttgcttctagaggatggttataatgtctaccagtccgaagcacatggcctcccccttcatctccctggtaacaaaagtcctcatagagaccctgcaccaagaggcccagcaagattcctcccactgcctgggcttcctcctgccttacctgagccacccggaatccttgcgccacaaccgccggatgttggttcgtcagatccgttatcaatggttggaccctcgcaggggcgctccccttcctacgctagt

SEQ ID NO: 11501 - DNA, 627 bp, Artificial Sequence
  Description of Artificial Sequence: Synthetic coding sequence
atggactcagatgagactgggttcgagcactctggactgtgggtcagtgtgctggccgggctgctcctgggcgcctgccaggcacatccaatacccgactcttcacccctgttgcagttcggaggccaggtacgacagcggtacctctatactgacgacgcccagcagaccgaggcccatctggaaatcagggaagatggcaccgtgggcggcgctgccgatcagagccctgagtctcttctccagctcaaggccttgaagccaggagtgatccagatcctcggggttaaaacctcccggttcctgtgtcagcggcccgacggcgcactgtacggatcgctccacttcgaccccgaagcgtgctcttttagggagttactgctcgaggacgggtataacgtgtaccaatccgaagcccatggactcccacttcatttgccaggtaacaaatctcctcacagggatcccgctccccggggacctgcgagattcctacccttgccggggctgccgccagctctgccagagccgccgggtattctcgcaccacagcccccagatgtggggagtagcgaccctctgagcatggtagggccgagccagggcagatccccaagttacgcatcc

SEQ ID NO: 11502 - DNA, 627 bp, Artificial Sequence
  Description of Artificial Sequence: Synthetic coding sequence
atggatagcgacgagacgggctttgaacactcaggcctatgggtttccgtcctggctggcctgctgttaggggcctgccaagcccaccccattcctgactcgagcccgctccttcagttcggagggcaagtcagacagcggtacctgtataccgacgatgcacaacaaactgaggcccaccttgagatccgcgaggatggcacggtcggcggcgctgcggaccagagtcccgagagcctgctgcagttgaaggccctcaagccgggtgtgatccagatccttggcgtgaagacatcgcgcttcttgtgccagcgccccgatggcgctctgtacggttctcttcactttgatccggaggcctgttcgttccgtgaactacttctcgaggatggatacaacgtgtaccagtctgaggcccacggcctccctctacatctgcccggcaacaagagcccgcaccgggatcctgccccccgtggtcctgcgagattccttcccctgcccggccttcctcccgctctccctgaacctcctggaatcctcgctcctcagccacctgatgtgggcagctcggacccgctgtccatggttggaccttcccagggtcgtagcccttcgtacgccagt

SEQ ID NO: 11503 - DNA, 627 bp, Artificial Sequence
  Description of Artificial Sequence: Synthetic coding sequence
atggattccgatgagacaggttttgagcactccgggctgtgggtgtccgtgctggctggactcctgttgggtgcgtgtcaggcacaccccatcccagacagcagccccctgttgcagttcggtgggcaagttcggcagagatatttgtataccgatgatgcgcagcaaactgaagcccacctggaaattagagaggatggtaccgtcggcggtgcagcagatcagtccccagagagcctcctgcagctgaaagcactgaagcccggcgttattcagatcctgggagtgaaaacctctcggttcctctgccagcgccccgacggcgccctctatggctctttgcattttgatcccgaagcatgcagctttcgggagttgctgctcgaggatgggtacaatgtttaccagagtgaggctcatgggctgccccttcaccttccaggtaataagtctcctcatcgggatcccgctcctaggggcccagcccgcttcttgccacttcccggactgcccccggcactgcccgagcctcccggaattctggctccccagccccctgacgtgggaagctctgacccacttagtatggtggggcccagccaggggagaagcccctcttacgcttcc

SEQ ID NO: 11504 - DNA, 627 bp, Artificial Sequence
  Description of Artificial Sequence: Synthetic coding sequence
atggattcggatgaaacgggttttgaacattcgggtttatgggtatcggtactagcgggtctattactaggtgcgtgtcaagcgcatccgataccggattcgtcgccgttattacaatttggtggtcaagtacgtcaacgttatttatatacggatgatgcgcaacaaacggaagcgcatctagaaatacgtgaagatggtacggttggtggtgcggcggatcaatcgccggaatcgttattacaattaaaagcgctaaaaccgggtgtaatacaaatattaggtgtaaaaacgtcgcgatttctatgtcaacgtccggatggtgcgttatatggttcgctacattttgatccggaagcgtgttcgtttcgtgaattactactagaagatggttataatgtatatcaatcggaagcgcatggtctaccgttacatctaccgggtaataaatcgccgcatcgagatccggcgccgcgtggtccggcgcgatttttaccgttaccgggtttaccgccggcgctaccggaaccgccgggtatattagcgccgcaaccgccggatgttggttcgtcggatccgctatcgatggtaggtccgtcgcaaggtcgttcgccgtcgtatgcgtcg

SEQ ID NO: 11505 - DNA, 627 bp, Artificial Sequence
  Description of Artificial Sequence: Synthetic coding sequence
atggatagcgatgaaacaggcttcgagcacagcgggctctgggtctctgtgctggctgggcttctgcttggagcttgccaagctcacccgattcccgattctagccctctcctgcagtttggaggtcaagtgaggcagagatatctgtacactgacgatgcccagcagacagaggcacacttggagataagggaggatggcaccgtcggaggcgctgcagatcagtccccagagagcttgctgcagctgaaagccctgaagcccggcgtgattcagatcctgggcgtcaaaactagtcgatttctctgccagagacctgacggggccctctacgggagcctccacttcgatcccgaagcctgctcattccgcgagctgttgctggaggacggatacaatgtgtaccagagcgaggcccacggactccccctgcacctcccagggaataaatcaccccatcgagatcctgcaccaagaggccctgccagattccttccacttccgggactgcctccagccctgcccgagccccctggaatcctcgccccccagccccccgacgttggctcttctgacccattgtccatggttggacccagccagggcagatctccatcatacgccagc

SEQ ID NO: 11506 - DNA, 627 bp, Artificial Sequence
  Description of Artificial Sequence: Synthetic coding sequence
atggactctgatgaaaccgggttcgagcattcaggactttgggtatctgtcctggccggactcctgcttggagcttgccaggcgcaccctatccccgactcctcccccttattgcagttcgggggacaggtccgccagagatacctgtacaccgacgacgcacagcaaaccgaggctcacctggagatcagagaagatggaacggtcggaggcgccgctgatcaaagccccgagtcactgctccagctgaaagccctcaaaccaggcgtgatacaaatactgggggtcaaaacgagtcgcttcttgtgccaacgaccagacggagccttgtacggaagcctccacttcgaccctgaggcatgcagcttccgggagctgctcctggaagacggctacaacgtgtaccaaagcgaagcccacggcctcccattacatttaccaggaaacaaatcacctcaccgtgacccggccccaaggggacctgcccgcttcctgccgctcccagggttgcccccagcccttcccgaaccgccaggaatactggccccacaacctcctgacgtgggaagttccgaccctctctctatggtcggcccatcacaaggaaggagtccatcttacgccagc

SEQ ID NO: 11507 - DNA, 627 bp, Artificial Sequence
  Description of Artificial Sequence: Synthetic coding sequence
atggatagcgatgaaactggctttgaacattcgggattgtgggtgtcagtgctggccggactgctcctcggtgcatgtcaggcacatcctataccagactcatcccccctgctccagtttggtgggcaggtgcgtcaacgatacctgtataccgatgatgcgcaacaaactgaagctcatctggagattagagaagatggaactgttggtggtgcggctgaccaatcgcccgagagtctgctgcagcttaaggcacttaagcccggcgtaatccagattcttggggtcaagaccagtcgctttctctgtcaacggcccgacggtgcactgtacggttctctccacttcgatcccgaagcctgctcctttcgtgaactgcttcttgaggatggatacaatgtgtaccaatcggaggcacacggacttcccttgcatctgcctggaaacaaatcgccgcatagggatccagcgccacggggccctgccaggttcctcccgctccctggacttcctccagcactccctgaacctccaggtatcctggcacctcaaccgccagacgtcggatccagcgatccactctctatggtcggaccgtcacagggccgctcaccgtcgtacgcaagc

SEQ ID NO: 11508 - DNA, 627 bp, Artificial Sequence
  Description of Artificial Sequence: Synthetic coding sequence
atggacagcgacgagacaggatttgaacattccggcttgtgggtgagcgtgttggccgggctgctgcttggcgcatgccaggcgcatcccataccagattcttctcctctactgcagttcggtggccaggtgagacagagatatctttataccgacgacgcacagcagacggaggcccacctcgagatcagagaggacgggactgtggggggtgctgctgaccaatcgccagaatccttgctgcagctgaaggctctgaagcctggtgtcattcagattctcggtgtgaagacatctaggttcctgtgtcagcggccggacggggccctctacggaagtctgcattttgaccccgaggcctgtagctttcgggaactcctgcttgaagatggttataatgtatatcagtctgaggcccatgggttgccgttacacctgccaggtaacaaatcgcctcaccgggaccctgcccctaggggcccagcaagattcctacccctgccaggactgcctccagctctgccagagcctcccggaatcctagcaccccagcccccagatgtgggctccagcgacccactcagcatggtggggccctcccagggaagatctccaagctatgccagt

SEQ ID NO: 11509 - DNA, 627 bp, Artificial Sequence
  Description of Artificial Sequence: Synthetic coding sequence
atggattcggacgagactggatttgaacacagtggactgtgggtgtccgtgctggcgggtttgctgcttggagcgtgtcaagcgcatccgatcccggactcatcgcctctgctgcagttcgggggtcaagtccggcaaagatacctgtacaccgacgacgcgcagcagacggaggcccatctggagatccgcgaagatggcactgtgggaggggcagctgaccaatcgccagagtcgctgctgcagctgaaagcgcttaagccaggcgtgatccaaatcctgggcgtaaagacttcgagattcctgtgccagcggccagacggcgccttgtacggatccctccacttcgacccggaagcgtgcagctttcgcgaactgctgctggaggatggctacaacgtgtaccagtcggaagcccatggactcccattgcacctgcctggaaataagagcccccatagggacccggcacctcgcggaccggctaggttcctgcctcttcctggactgccaccggcactcccggaaccgcctggaatcctcgccccacaacccccggacgtgggaagctccgatccgttgtcgatggtgggaccttcgcaggggcgctctccctcgtatgcgtca

SEQ ID NO: 11510 - DNA, 627 bp, Artificial Sequence
  Description of Artificial Sequence: Synthetic coding sequence
atggattcagacgaaactggattcgaacactcagggctctgggtgtcggtgctcgctggactgctcctcggcgcatgtcaggcacatcctattcctgatagctccccccttttgcagtttggcgggcaggtgcgccaacggtacctgtataccgacgatgcccagcagaccgaagcccatctggaaattcgagaggacgggactgtgggtggtgccgcagatcaatcacccgaatccctgcttcaactcaaggcacttaaaccaggcgttatccagatcctcggtgtaaagacgtcaagatttctttgccaaagacctgatggagcgctttacggtagcttgcattttgatccagaggcttgttctttcagggaactgcttctggaggacgggtacaatgtctaccagtctgaggcacacggacttcctctgcacctgccgggaaacaagtcgccacatcgggatccagcacctcgcggtccggcaaggtttctgccacttcctggcttgcctccagctctgccggagcctcccggtatactggcaccgcaaccccctgatgtgggcagttcggacccactcagcatggttggaccatctcaaggacgatccccttcgtacgcctct

SEQ ID NO: 11511 - DNA, 627 bp, Artificial Sequence
  Description of Artificial Sequence: Synthetic coding sequence
atggattccgatgaaacgggcttcgaacattccggactctgggtgtccgtgcttgcaggacttctcctcggcgcatgccaagcacatccgattcctgactcatccccccttttgcagtttggagggcaggttagacagcggtacctctacaccgacgacgcacaacaaaccgaagcacacctggagattagagaagatggtaccgtcggcggagccgcagatcaatcgcctgaaagcctgctgcagctgaaagcgctgaagccaggcgtgatacagatccttggtgtgaaaacttcgcggttcctctgtcagcgtccagatggtgcgctgtacggatccctccattttgatcctgaggcgtgcagcttccgggaacttctgctcgaagatggctataatgtgtaccagtcggaagctcatgggcttccgcttcaccttcctgggaacaaatcacctcatcgagatcccgctcccagaggaccagcaaggttcctcccgcttcctggacttccgccagctttgccagagcctccaggaattcttgcaccccagccaccagatgtgggttcgagcgatcctctgtccatggtgggcccctcccagggcaggtccccgtcatacgcatcg

SEQ ID NO: 11512 - DNA, 627 bp, Artificial Sequence
  Description of Artificial Sequence: Synthetic coding sequence
atggattcagatgaaacaggttttgaacattctggtctttgggtttcagttttagcaggtttattgcttggtgcttgtcaagcacacccaattccagattcaagtccactattacaatttggaggtcaagtaagacaaagatatttatacacagatgatgcacaacaaacagaagctcatttggaaattagagaagacgggactgtaggtggagctgcagatcaatcaccagaaagtttacttcaattaaaagcacttaagccaggagtaattcaaattcttggagttaaaacaagtcgttttctttgtcaaagaccagatggtgcattatatggaagtttacatttcgacccagaagcatgtagtttcagggagttacttcttgaagatggttataatgtatatcaaagtgaggcacatggattaccattacatttacctggaaataagtctccacatagagatcctgcaccaagaggacctgcaaggtttttaccattaccaggtcttccaccagcattacctgaaccacctgggattcttgctccacaaccacctgatgttggaagttctgatcctttaagcatggtgggaccaagtcaaggaagatctccaagttatgcttca

SEQ ID NO: 11513 - DNA, 627 bp, Artificial Sequence
  Description of Artificial Sequence: Synthetic coding sequence
atggacagcgacgagactggctttgaacatagtggactgtgggtctccgtccttgcggggctcctacttggagcctgccaagcccacccaatacccgacagctccccactcctccagtttggcggccaggtcaggcaacgatacctttataccgacgacgcccagcagacggaagctcaccttgagattcgggaagacggcacagtggggggcgccgccgaccagtcacctgaaagcctgctccagctcaaggcactgaagccgggcgttatccaaatactcggggtgaagacctcaaggtttttgtgccagcgccccgacggcgccctgtacggttcactgcacttcgacccggaagcctgcagtttccgggaactgttgctggaagacgggtataacgtttatcagtcagaggcccacggcctgccgctccacctgccaggcaacaagagcccgcaccgggacccagccccaagaggacccgcgaggttcctgcctctgcctggattgcccccagccctccctgaaccccccggaatattggccccacagccccccgatgttggcagcagcgaccctctcagcatggtagggccctcccaaggcagatcaccttcctacgcctca

SEQ ID NO: 11514 - DNA, 627 bp, Artificial Sequence
  Description of Artificial Sequence: Synthetic coding sequence
atggattcggatgaaactggattcgaacatagcgggctctgggtgtccgtgcttgcaggactgcttctgggagcgtgtcaagcccaccctattcccgactcatccccactccttcagttcggaggacaagtgagacaaaggtacttgtacactgatgacgcacagcaaactgaagcacatctcgaaatccgtgaggacggaactgtcggcggagcggcagatcagagccctgagtcgctgctgcagcttaaggcactgaagcctggagtgatacaaatacttggtgtgaaaacgtcgagatttctgtgccaacgccctgatggtgcactgtacggcagcctccactttgaccccgaagcatgttcgttccgagaacttctgctggaggatgggtacaatgtgtaccaatcagaagcacatggactgcctctgcatctgccaggcaacaagagcccccatagagatccagctccaaggggtcctgcgcgatttttgcctttgcccggactgccacctgcacttccagaacctccagggattctggcaccccaacctccagatgtgggatcttcggatcctctctccatggtcggaccatcccaggggcggagcccttcatacgcctcg

SEQ ID NO: 11515 - DNA, 627 bp, Artificial Sequence
  Description of Artificial Sequence: Synthetic coding sequence
atggactcggatgagacaggcttcgagcatagtggtctgtgggtgtcggtcttggccggtctgctgctaggagcttgccaagcacacccaatccccgatagtagccccctgttacagtttggaggccaggtgcgccagcgatacttgtacactgacgacgctcagcagacagaagcccacctcgagatcagggaggacggtacggttggaggggcggcagaccaatcacctgagagcctcctgcagctgaaggcgctgaaaccaggtgtaattcagatccttggcgtgaaaacatcaagatttctgtgccagagaccagacggcgccctgtatggctctctccactttgacccggaggcttgttcctttcgcgaactgttgctggaagatgggtacaacgtataccagtcggaggctcacggcttacccttgcacctcccaggcaataaatcaccccatagagaccccgcgcccaggggcccagctaggttcctgccactccccgggctgcctcctgccctaccagagccacctggtattctggccccccagcctcccgacgtgggcagctctgaccccctgagtatggtggggcctagtcaggggcgaagtcctagttatgccagc

SEQ ID NO: 11516 - DNA, 627 bp, Artificial Sequence
  Description of Artificial Sequence: Synthetic coding sequence
atggacagtgatgaaacagggttcgagcactccggactttgggttagcgtactcgccgggctccttctcggggcttgtcaagcccatcctatacctgattcaagccctctgctgcagtttggagggcaggttcgccagcggtatctttataccgacgatgcccagcaaacggaggcccacctcgagattagagaagatgggactgtgggaggggccgccgatcagagccctgagagtttgctccagctgaaagcattgaagccaggtgtgatccagatacttggagttaagacctcccggtttctctgccagcggcctgatggtgccctgtatggcagcctgcatttcgaccccgaggcttgctcctttcgcgagctgctccttgaggatggatacaacgtgtatcagtctgaagcccacggactccctctgcacctgcccgggaataaatcacctcaccgagatcccgctccgcgaggccccgcaaggtttctgccactgcctggtttgcctcccgctctgcctgagccacccggcatactggcgcctcagccccctgatgtgggaagtagcgatcccttgtctatggttggccctagccagggccggagcccaagctatgcctct

SEQ ID NO: 11517 - DNA, 627 bp, Artificial Sequence
  Description of Artificial Sequence: Synthetic coding sequence
atggactccgatgaaacaggttttgaacatagcggtctgtgggtgtccgttttggcaggcttactgctgggcgcgtgtcaagcacatcccattccggattcgtccccgctgttgcagttcggtggtcaggtccgtcagcgatacttgtacaccgatgatgctcagcagaccgaagcacatctcgagatacgggaggatggaaccgtaggtggagcggctgatcagtctccggagtctttgctccagctcaaagcccttaagcccggagtaatccagatccttggagtcaagaccagtcggtttctatgtcaacgtccagatggagccttgtacgggtcgctacacttcgaccccgaggcctgctctttccgggaactacttctcgaagacggctataatgtctatcaatccgaggcacatggcctgcctttgcacctccccggtaacaaaagtcctcaccgtgatccagccccgcgcggccccgcacggttcctgccattgcctggtttgccacctgctctccccgaacctccgggcatcttggctccgcagccacctgacgttggaagctcggatcccttatcgatggtcgggccatcgcaaggtcgatctccctcatatgcatcg

SEQ ID NO: 11518 - DNA, 627 bp, Artificial Sequence
  Description of Artificial Sequence: Synthetic coding sequence
atggattcagatgaaaccggttttgaacactccggactctgggtatctgtcctcgcaggactcctcctgggggcctgccaagcacatcctattccagattcgtcccctcttctgcaattcggtggacaagtgagacagcgatacctgtacactgatgacgcgcaacaaaccgaagctcacctggaaataagggaagatggaactgtggggggagctgcagatcagtcacctgagagccttcttcagctgaaagcacttaaaccaggagtgattcagatactcggagtgaaaacttcccgcttcctctgtcagaggccagatggtgcgctttacggtagcctgcattttgatccagaggcttgttccttccgcgagctgctgctggaagatggttataacgtctaccagtccgaggcacatggacttccactccacctgcccggcaataagtcgccacatcgagatcctgcgcctcgcggaccagccagattcttgcctctgcccggtctgcccccagcacttcccgaaccgccaggtatccttgcacctcaaccacctgatgtgggctcgagcgatccactgtccatggtcggtcctagccagggccggtcgccaagctacgcgtcc

SEQ ID NO: 11519 - DNA, 627 bp, Artificial Sequence
  Description of Artificial Sequence: Synthetic coding sequence
atggattcggatgaaactggattcgagcatagcgggctctgggtgtccgtgcttgctggactcctccttggtgcctgtcaggcgcatccaatacccgactcgtcaccgctcctccaatttggaggacaagtgcgccagcgatacttgtataccgatgacgcccagcaaaccgaagctcaccttgaaattcgagaggacggcactgtgggaggtgcagcagatcagtccccagaatcgctgcttcaactgaaagcacttaagccaggagtgatacaaattctcggggtcaaaactagccgttttctgtgtcaaagaccagacggtgcactttatggtagcttgcattttgacccagaagcgtgctcatttagggaactgctcttggaggacggttacaatgtgtaccagtccgaggcacatggacttcctcttcacctgccgggtaacaagtcgcctcacagagatcctgccccaaggggaccagcacgctttctcccgcttccggggttgcctcccgctcttcctgagcctccaggaattctggcaccacagcccccagatgtcggctcgtccgatccattgtcgatggtgggaccttcgcaaggtagaagcccctcgtacgcatcg

SEQ ID NO: 11520 - DNA, 627 bp, Artificial Sequence
  Description of Artificial Sequence: Synthetic coding sequence
atggactccgacgaaaccggcttcgagcacagcgggctgtgggtgtcggttctcgcgggcttgctcctgggtgcctgtcaagcccacccgatcccggactccagccccctcttgcagtttggcggacaggtgagacaaagatacctgtacactgatgatgcccagcagactgaagcgcatctggagatccgcgaggacggcaccgtcggtggggccgctgaccagagcccggagtcgttgctccagttgaaggctctcaagcccggagtgatccagattctgggagttaagacgtccagattcctgtgccaacgcccggacggagcgctgtacggctcactgcacttcgatcccgaagcctgctcgtttcgggagctgcttctggaagatggctacaacgtgtaccaatcggaggcccacggcctccctctgcacctgcccgggaataagtcgccacaccgggatcctgcaccacggggacctgctcgatttttgccactgccaggactgccgccggccctgcctgaaccgccgggcatcctcgccccacagccgcctgacgtgggatccagcgacccattgtccatggtgggaccatcacaggggcggtcgccgagttatgcctcc

SEQ ID NO: 11521 - DNA, 627 bp, Artificial Sequence
  Description of Artificial Sequence: Synthetic coding sequence
atggactcagatgagacgggcttcgagcactcgggattgtgggtcagtgtcctggcaggactgctgcttggagcgtgtcaagcccacccaatcccggactcaagtcccctgctgcaattcggaggtcaggtgcggcagcgctacctgtacaccgacgacgcgcagcaaactgaagctcacctggaaatccgagaagatggaactgtgggaggggccgccgaccaatcgccagagtcgcttctgcagttgaaggccctgaagccaggcgtcatccagatccttggggtgaaaacttctcgctttctctgccaacgcccagatggcgccctttacggctcgctccatttcgaccccgaggcctgctcattccgggaactgttgcttgaagatgggtacaatgtgtatcagtcggaggctcatggactcccgctgcatctgcctggaaacaagagcccccatagggacccagcaccgcgtgggcctgcacgctttctgcctctcccgggacttccgccagcgctcccagaacccccaggcatcctggctccacagccgcctgatgtgggctccagcgacccgctgtccatggtgggaccatcacagggacggagcccatcatacgccagc

SEQ ID NO: 11522 - DNA, 627 bp, Artificial Sequence
  Description of Artificial Sequence: Synthetic coding sequence
atggactcagatgaaaccggattcgaacatagtgggctgtgggtgagcgtattagccgggctgctactaggcgcgtgccaggcccaccctattcccgacagctccccgttgctacagtttgggggccaggtacggcaacgttatttgtacacggatgatgcccagcagactgaggcccacttggagatccgtgaggatggaactgtcggcggagccgccgaccagtctcccgagtcactgctgcagctgaaggccctgaagcccggcgtgattcaaattttgggagtcaagacctcaaggtttctctgtcagcgacctgacggagccctgtatgggtccttgcattttgatcccgaggcctgctctttccgcgagctgctcctcgaggacggttacaatgtgtatcaatctgaggctcatggcctacctctgcatctcccaggcaacaagtctccccatagagacccagctcctaggggaccagctcggtttcttcctctcccaggtctgccccctgccctgcctgagccacctgggattttggccccgcaacctcctgacgtcggctctagtgacccactcagcatggtaggcccgtctcagggaaggtcaccgtcatatgcctcc

SEQ ID NO: 11523 - DNA, 627 bp, Artificial Sequence
  Description of Artificial Sequence: Synthetic coding sequence
atggacagcgacgaaactggtttcgaacactccgggttgtgggtgtcagtgctcgcgggactgctccttggagcgtgccaggctcatccgattccagacagctcacccctgcttcagttcggcggacaagtgcggcaaagatacctgtacacggacgatgcccagcaaacggaggcgcacctcgagatccgggaagatggcaccgtgggaggagcggccgatcagtccccagagtccctcctgcagcttaaagcgcttaagccgggagtgatccaaattctcggggtcaaaacttcccggttcctctgtcagaggcccgacggagctctctacggaagcctgcacttcgacccggaggcgtgcagctttagagagctcctgctggaagatggatacaacgtctatcagtcagaagcacatggcctgccgctgcacctgccagggaacaagagcccccatcgcgacccagcgccacggggccctgcgcgctttctgccgctgccgggcctcccaccggcccttccagaaccgccgggcatccttgccccacaacctccagacgtgggatcatccgacccactctcgatggttgggccctcccaggggaggtccccatcgtacgcttca

SEQ ID NO: 11524 - DNA, 627 bp, Artificial Sequence
  Description of Artificial Sequence: Synthetic coding sequence
atggactctgacgaaacagggttcgagcactcgggcctgtgggtttctgtgctggctggtctactcttgggagcatgtcaagcacatcccattcctgactcctcccctctgcttcagtttggtgggcaggtacggcagcgatatctgtacactgacgacgcccagcagacggaggcccacctagagattcgagaagacgggaccgtgggcggagccgctgatcagtcccccgagtccctattgcagttgaaagctctaaagccaggcgtgattcagattttgggagtcaagactagtaggttcttatgtcagcgtccagacggggctctctacggtagcctgcacttcgacccagaagcctgcagctttcgtgaactgttgctcgaggacgggtacaacgtgtaccagtcagaggcacatggcctccctttacacttgcccggtaacaaatcaccccatcgggatccagccccaagagggcctgctcgattcttgcccctgccggggctgccgcccgcactgcccgagcctcctggcatactcgccccccaacccccagacgtgggctcatccgaccccctgagtatggtagggccttcccaggggcggtcccctagctatgctagc

SEQ ID NO: 11525 - DNA, 627 bp, Artificial Sequence
  Description of Artificial Sequence: Synthetic coding sequence
atggatagtgatgaaacaggattcgaacactctggactgtgggtatccgtacttgcgggactgctgctgggagcgtgccaggcacaccccatacccgatagtagtccactccttcagttcggggggcaggtacggcagaggtacctgtacacagatgatgcccagcaaacagaagcacatctcgagatacgggaagatgggacagtggggggagcagcggatcagtctcccgagtcgctccttcaattgaaagccctcaagcctggggtaatacagatactaggggtgaaaacttctaggtttctctgccagagaccagatggggctctctatggatccctccactttgatcccgaagcctgttctttccgggaactcttgcttgaagatgggtacaacgtgtatcaatcagaagctcatgggctcccccttcatttgcccgggaacaaatccccgcaccgggatcccgctccccgaggacctgccagatttctccccttgccagggttacctcctgcactccccgaaccaccagggatcctcgcccctcagccgcctgacgttggatcttctgaccccctatcaatggtgggaccttctcaggggagatcgccttcttatgcatcc

SEQ ID NO: 11526 - DNA, 627 bp, Artificial Sequence
  Description of Artificial Sequence: Synthetic coding sequence
atggactcggacgaaactggatttgagcactcgggactgtgggtgtcggtcctcgccggtctgcttcttggagcttgtcaagcacacccaattcctgactccagccccctgcttcagtttgggggtcaggtcagacaacggtacttgtacacggatgatgctcaacaaactgaagcccatcttgagatccgggaagatggaaccgtgggaggcgccgcagaccagtcgcctgaatccctcctgcaactcaaagctcttaagccaggcgtcattcaaatacttggagtgaaaacctcgagattcctgtgtcaacgccctgatggcgcgttgtacggaagcctccattttgaccccgaagcctgttcctttagggagcttctcctcgaggatgggtacaatgtgtaccagtctgaggctcatggtttgccactgcatctcccggggaacaagtctccacatagagatccagcaccacgtggtccggcgagatttcttcccctgcctggattgcctccggccctccctgaaccacctggcattcttgcacctcagccccccgatgtggggagctccgatcctttgtcaatggtgggtccgagccaggggcgttccccatcatatgcaagc

SEQ ID NO: 11527 - DNA, 627 bp, Artificial Sequence
  Description of Artificial Sequence: Synthetic coding sequence
atggactccgacgaaaccggattcgaacactcggggctttgggtgtccgtgctggccggactgctgttgggtgcgtgccaagcccacccgatccctgacagctcaccgctgttgcagtttggaggtcaggtcagacagcggtacctgtacactgacgacgctcaacagactgaggcacacctggagatccgggaagatggcaccgtcggcggcgcagccgatcagtcgccggaaagcctgctccagctgaaggcattgaaaccaggtgtgatccagattttgggcgttaagactagccgctttctctgtcagcgcccagacggtgccctctacggatcgctgcactttgatccagaagcatgttcgttccgcgagctgctgctggaagatggatataacgtgtaccaatccgaggcccatggactgcctctgcatttgcctggaaacaagagcccgcatagggacccggcgccaagaggaccggcgcgattcctgccactgccgggcttgccgccggctctgccggaaccgccgggcatcctggcgccgcagccgccggacgtcggatcgagcgacccattgtccatggtgggaccaagccaaggaagatcgccgagctacgcctcc

SEQ ID NO: 11528 - DNA, 627 bp, Artificial Sequence
  Description of Artificial Sequence: Synthetic coding sequence
atggactcggatgagactggatttgaacactccggcctgtgggtgtctgtgctcgcgggcttattgctcggcgcctgtcaggctcatcccataccagacagttcgccgctgctgcagtttggaggtcaggtgaggcaacgctacctctacacagacgacgcccaacagactgaggcacacctagagattagagaggatggaaccgttggcggcgccgcagaccagtcaccagagtctctgttgcagctgaaggcattgaaacccggggtgatccagattctcggcgtgaaaacctctcggtttctctgccagcgaccggacggggcgttgtatggaagcctccacttcgatcctgaggcatgttcattccgcgagctcctgctggaggatggatacaatgtgtatcagagcgaggctcatggactgccgttgcatcttcccggcaataaatcaccacatagggatcctgctcctcgcggaccggctaggttcctgcccctgcctggccttcctcccgccctgcccgaaccccctggtatattagcacctcagccacccgatgtggggtcgtccgaccctctgagtatggtcgggcccagccagggaagaagccccagctacgccagc

SEQ ID NO: 11529 - DNA, 627 bp, Artificial Sequence; identical to SEQ ID NO: 11499
  Description of Artificial Sequence: Synthetic coding sequence

SEQ ID NO: 11530 - DNA, 627 bp, Artificial Sequence
  Description of Artificial Sequence: Synthetic coding sequence
atggattcggacgaaacaggctttgagcatagcggcttgtgggtcagcgtactagccgggctgctgctaggcgcttgtcaggcgcacccgattccggattccagtcccctgttgcaattcggagggcaggtgcgtcaaaggtacctctatacggatgacgcacagcagacagaggcacacctggagattcgtgaagatggaacggttggcggtgcggcagatcagtcccccgagagccttctccagctgaaagcactgaagcctggagtcatccagatactcggggtcaagacctcccgctttctgtgccagcggcccgatggagctctctacggatctctgcacttcgatccagaggcctgctccttccgggagctccttctcgaagatggatataatgtttatcagtcggaggcccacggtttgccgctgcatctacctggcaacaagtcaccacacagagaccctgcccctcgagggccggcaagatttctccctcttcccggcctgcctcccgcactgccggaacctcccggaattttggccccccagcctccagacgtggggagcagtgaccctctcagtatggttggtcctagtcagggtagaagccctagctacgcatcc

SEQ ID NO: 11531 - DNA, 627 bp, Artificial Sequence
  Description of Artificial Sequence: Synthetic coding sequence
atggacagtgatgagaccgggtttgagcactccgggctgtgggtctcggtgctggcagggctcctcttaggggcatgtcaggcccatccaatccccgacagcagcccactgttgcagtttgggggtcaggttagacagcggtatctgtacacagacgacgctcagcaaaccgaggcgcacctggagattcgcgaggatgggaccgtcgggggcgcagctgaccagtcccctgagtctctgttgcaactaaaagctctaaagcctggcgtgattcagattttgggagtgaagacctcccggttcttatgccagcgaccagatggggcgctgtacggaagtctgcatttcgatccggaagcctgctcattccgggaactgctcttagaggatggctacaatgtgtatcaatcagaggcgcatgggttaccactgcaccttccaggaaacaaaagcccgcacagggatcccgcgccccggggaccagcaaggtttctgccattgcctggcctgccgccggctctgcctgagccacctggaatcctggccccccagccacctgatgttggatcaagcgatcccctctcaatggtgggcccgtctcagggcagatctccatcctacgccagt

SEQ ID NO: 11532 - DNA, 627 bp, Artificial Sequence
  Description of Artificial Sequence: Synthetic coding sequence
atggatagcgatgaaaccgggttcgagcactcaggtttatgggtatcagtactggccggactgctgctcggtgcctgtcaggcccatcctattcccgatagttcccccctgctgcagttcggtggtcaggtccgacagaggtacctgtatacagacgatgcccagcagacggaggcccacctcgagattcgggaagacgggactgtgggcggcgcagcagaccagagccctgaaagcctgctgcagctcaaagcgttgaagcccggtgtcatacagatccttggcgttaagaccagtaggtttctgtgtcagcgacccgatggtgctctttacggcagtttgcattttgacccggaggcgtgttcttttcgtgagctgcttctggaagatggctacaacgtgtatcagtccgaagcccatggcctgccactgcatttgccgggtaacaagtctccacatagagacccagccccccgaggtcctgcacggttcttgccactccccggcctcccccccgctctgccagagccccccgggatcttggctccacagccccccgatgtcggtagctcggatcccttgtccatggtggggccctcccagggcagaagcccttcctacgcgtct

SEQ ID NO: 11533 - DNA, 627 bp, Artificial Sequence
  Description of Artificial Sequence: Synthetic coding sequence
atggatagcgacgaaactggattcgaacactcggggctgtgggtgagcgtgttggcggggctcctcttgggtgcatgtcaggctcacccaatcccggattcatcgccgcttctccaattcggaggccaggtccgccaaagatatctgtacaccgacgacgcgcagcaaaccgaggcgcacctcgaaatccgtgaagatggaactgtgggcggagctgcggaccaaagcccagaatcgttgttgcagcttaaggcacttaaaccgggagtgatccagatactgggcgttaagacgagtcgcttcctgtgccaaaggccggatggtgctctgtacggaagtctgcattttgacccagaggcatgcagctttcgcgagcttctgctggaggatgggtacaacgtgtaccagtcagaggcccacgggttgccgctgcacctccctgggaacaagtccccgcatcgcgacccagccccccggggaccagctcggttccttcccctgccaggactgccacctgccctccctgaaccacccggaattcttgccccgcagccgcccgacgtcggaagctccgatccactcagcatggtcggtccctcacaggggcggtcgccttcatacgcttcc

SEQ ID NO: 11534 - DNA, 627 bp, Artificial Sequence
  Description of Artificial Sequence: Synthetic coding sequence
atggacagcgatgagactggattcgaacactcgggactgtgggtgagcgtcctggctggcctgctgctgggagcctgtcaggcccacccgatcccagattccagtcccttgctgcagttcggtggtcaggtccggcagcggtacctttacaccgatgacgcccaacagaccgaggcacatctcgagatccgagaggacggaaccgtgggcggggccgcggaccagagcccagagtccctgcttcagctcaaagcactgaaaccaggcgtcatccaaattctgggagtcaagacctcgaggtttctctgccaaagacccgacggagccctctacggatcgttgcactttgacccggaagcgtgctcgttccgcgaactgctcctggaagatggttacaacgtgtatcagtccgaagcacacggactgcccttgcacctgccgggcaataagtcaccccaccgggacccggccccacggggaccggctcgcttcctgccgttgccgggactgcccccagctctgccagaaccgcctggaatcctggcaccacaacctccggatgtggggtccagcgacccgctgtccatggtgggcccgagccaaggaagatcgccatcgtatgctagc

SEQ ID NO: 11535 - DNA, 627 bp, Artificial Sequence
  Description of Artificial Sequence: Synthetic coding sequence
atggactctgacgagaccgggtttgagcattctgggctgtgggtctctgtcctagctggcttgctgttaggggcttgccaggcccaccctattcccgattcaagtccgttgttgcagtttggggggcaggtgagacagaggtacttgtacacggacgatgctcaacagaccgaggcacacctggaaatacgcgaggatgggactgtaggtggagccgctgaccagtcccctgaaagtctcttgcagctgaaggcactgaaacccggcgtcattcagatccttggagtaaagaccagtcgcttcctttgccaaaggcctgatggagcgctgtacggaagcctgcacttcgaccccgaggcatgtagcttccgcgaactcctgttggaggacgggtataatgtttaccagagcgaggcccatggcctcccactccacctgcctggtaataaaagtccccaccgggatcccgcgcctagaggtcccgccagattccttccgctgcctggactgcctcctgcgctgcccgaacctccgggcattctggcaccacaaccccctgatgtggggtcatccgacccgctgagtatggtcggcccctcgcaagggcgctcccctagctacgcgagt

SEQ ID NO: 11536 - DNA, 627 bp, Artificial Sequence
  Description of Artificial Sequence: Synthetic coding sequence
atggactcggacgaaaccggatttgagcacagcggactctgggtgtcagtgttggctggactgctgctgggagcatgccaagctcacccaattccggattccagccccctcctccagttcggaggacaggtgcgccaacggtacctctacaccgacgatgcccagcagacggaggcccacctcgagattcgcgaagatggaactgtggggggagctgctgatcagtcgccggagtccttgttgcagctcaaggcgctgaagcctggtgtgatccaaattctgggcgtcaagacctcacggtttctgtgccaaagacctgatggagcgctgtacggttcccttcatttcgacccagaggcctgttcgttcagggagctgttgctggaggacgggtataatgtgtatcaaagcgaggcccacgggctcccactgcacctgcctggaaacaaatccccacacagggatccggccccgcggggtccggcgcgctttctgccgctgccggggctcccgcctgccctcccggagcctccgggcatcctcgcgccgcaaccgccggacgtcggctcatccgacccgctcagcatggtgggaccgtcacaaggccggagcccatcatacgcctcg

SEQ ID NO: 11537 - DNA, 627 bp, Artificial Sequence
  Description of Artificial Sequence: Synthetic coding sequence
atggactccgacgaaaccggattcgaacacagcggactgtgggtgtctgtgctggccggccttcttctcggtgcttgtcaagctcacccgattccagattcatcaccgcttctgcagtttgggggccaggtccgccaaaggtacctgtatacggacgacgcccagcagactgaggcacacctcgaaatcagagaggatggaaccgtgggtggcgctgcggaccagtcaccggaatccctgttgcaactgaaggctctcaagccgggagttatccagatccttggtgtgaaaactagccgcttcctgtgccaacggccggacggggcgctttacggatcactccatttcgatcccgaggcgtgcagctttcgagaacttctcctggaggatgggtacaacgtgtaccagagcgaggcccatggccttccattgcacctccccggtaataagagcccgcatcgggatccagcaccccgcgggccggcacggttcctgcctctcccggggctgccacctgcgcttccagaaccgccagggattctcgcgcctcagccccctgacgtcggaagttccgaccctttgtcaatggtgggcccgtcgcaaggaagaagcccatcgtacgcaagt

SEQ ID NO: 11538 - DNA, 627 bp, Artificial Sequence
  Description of Artificial Sequence: Synthetic coding sequence
atggactctgatgagaccggattcgagcactccgggctgtgggttagcgttcttgcaggcctgttgctgggtgcatgtcaggcgcaccctatcccggactcttctccattgctgcagtttggaggccaggtgagacagcgatacctttacacggacgatgcacaacaaactgaagcgcacctggagattcgcgaagatggaaccgtaggtggagcagcggatcagtctccggagtctctcttgcagctgaaggctctgaagccaggtgtgatccaaatccttggtgtcaaaacctcacgcttcctgtgtcagcgaccggatggtgcgctctacggtagtcttcactttgatcctgaggcctgcagctttcgcgagctgttgctggaggacggctataatgtctaccaatccgaggctcatggactgccgctccacctgccgggcaacaaatctccacacagagacccggcgcctcgcggcccggcgcgtttcctgccgctgccaggcctgccgccagccctgcctgaacctccaggcattctggcgccccagccgcctgatgtgggcagctcagacccacttagcatggtaggtccatctcagggccgtagccctagctacgctagt

SEQ ID NO: 11539 - DNA, 627 bp, Artificial Sequence
  Description of Artificial Sequence: Synthetic coding sequence
atggattcagacgaaaccggcttcgaacatagcggactgtgggtgtcagtgcttgccgggcttctgctgggggcgtgccaagcacatcctattcccgactcatcccccttgttgcagttcggaggccaggtccggcagcggtacctttacactgacgatgcacaacaaaccgaagctcatttggaaataagagaggacggaactgtgggtggtgccgcagatcaatcccctgagtcccttctgcaactcaaggcccttaagccgggtgtgatccaaatcttgggagtcaaaacgtcgcgcttcctttgtcagcgtcccgatggtgccttgtacggcagcctccattttgatccagaagcatgcagctttcgtgagcttcttctcgaagatggttacaatgtgtaccagtctgaagcacacgggttgcctctccatctgccaggtaataagtccccgcacagagatcctgcgcctaggggaccagcccgatttcttccactgccaggactgccccctgcgcttcctgagcctccgggaatccttgcaccgcagcctccggatgtgggatcgagcgaccccctctcaatggttggaccctcccaaggccggagcccatcctatgcatcg

SEQ ID NO: 11540 - DNA, 627 bp, Artificial Sequence
  Description of Artificial Sequence: Synthetic coding sequence
atggacagtgacgagacaggtttcgaacattctgggttatgggtgagtgtgctggcgggcctccttctgggagcttgtcaggctcatccaattcccgactcaagtcccctactgcaattcggcgggcaggttagacaacgctacctatacactgacgatgcccagcagaccgaggctcacttagaaattagggaagacggaactgtagggggggccgcggaccagagcccggagtctttattgcaactcaaagctcttaaaccaggggtgattcagattctgggcgttaagacctcccggttcctgtgtcaacgcccggatggagccctctacggatccctgcacttcgatccggaggcgtgtagttttcgtgagctactcctcgaggacgggtacaatgtgtaccagtccgaggcccacggactgcctctccatttgcctggcaataaaagcccccaccgggatccagctccacgcggtcctgctagatttctccccttgccaggcctgccacccgccctgcccgaaccccccggaatcctcgctccccagccccccgatgtaggcagctcagatccactgtctatggtggggcctagtcaaggaaggagtccaagctacgctagc

SEQ ID NO: 11541 - DNA, 627 bp, Artificial Sequence
  Description of Artificial Sequence: Synthetic coding sequence
atggactcagacgagacgggattcgaacatagtggcctctgggtgtcagtcctggccggcctgttgctgggagcatgtcaagcccatcctattccggatagctcgccactgctgcagttcggcggtcaggttagacagcggtacctgtacactgatgacgcacaacagaccgaggctcatttggagattcgcgaggatggaaccgtgggaggagcagccgaccaatcgccggaaagcctgctgcagctgaaggcgctcaagccgggggtcattcaaatcctgggagtaaaaacttcacggttcctgtgccagcgacccgatggagcactctacggatccttgcattttgaccctgaagcgtgttcctttcgagaacttcttctcgaagatggctacaatgtttatcaatcagaagcacacggacttccgcttcaccttcctggcaacaagagccctcatcgggacccagcacctagaggtcctgcccgatttctgccacttcctggactcccaccagctcttcccgaaccccctggcattttggcacctcagccaccagatgtcggttcgtccgatcccctcagcatggtgggaccttcgcaagggcgcagccctagttacgcgtct

SEQ ID NO: 11542 - DNA, 627 bp, Artificial Sequence
  Description of Artificial Sequence: Synthetic coding sequence
atggactctgacgaaactggctttgagcacagcggactttgggtttcagttctcgctggacttctccttggagcttgtcaagcccatccaatcccagactcctcgcccttgctgcagttcggtggacaagttcgtcagcgatatttgtacacagatgacgctcagcagacagaagctcatcttgagattagagaagatggtaccgtgggaggagctgctgatcaatctccggagtctttactacagcttaaggctcttaagccaggggtcatccagatccttggtgttaagacgtcaagattcttgtgtcagcggcctgatggagcattgtacggatcgttgcactttgatccagaagcgtgttcttttagggaacttcttttggaggacggatataacgtttaccagtcggaagcgcatggcctaccgcttcatcttccggggaacaaatcgccacatcgcgatccagctccgaggggtccagccagattccttcctctgccgggtcttccgccggcgctaccagagccaccaggaattctggcaccgcaaccacctgatgttggatcaagtgacccgttgtctatggttggaccatctcaggggaggtcgccatcctatgcttct

SEQ ID NO: 11543 - DNA, 627 bp, Artificial Sequence
  Description of Artificial Sequence: Synthetic coding sequence
atggacagcgacgagacgggttttgaacacagcggcctctgggtgagcgttctggctgggctcctcttgggtgcttgtcaagcgcacccaatccccgactcttctccactcttgcagtttggaggccaggtgaggcagcgctacctttatactgacgacgcgcaacaaactgaagcccacctggaaatcagagaggacggaaccgtcgggggcgctgccgatcagtccccagagtctttattacagctgaaagctcttaaacctggggtcattcagatactgggcgttaaaacatcaaggtttctttgtcagaggcctgatggagcattgtacgggtcgctccactttgacccagaagcatgctcatttcgggagctgctgctggaggacggctataatgtgtaccagagtgaggcacatggcctcccactgcacctccctggcaacaaaagccctcacagagatcctgccccacggggacccgctcggtttcttccactgcctggactgccccccgcactgcccgagcctcccgggatcctcgccccgcagcctcctgatgtcgggtcgagcgacccgttgagtatggtcggcccgtctcaggggaggtctcctagctacgccagc

SEQ ID NO: 11544 - DNA, 627 bp, Artificial Sequence
  Description of Artificial Sequence: Synthetic coding sequence
atggactctgacgagactggtttcgagcactctggcctgtgggtgtctgtgctcgctggcctgctgttgggagcttgtcaggcacatccaatccctgactcgtccccccttcttcagttcggcggccaagtccgccaacggtatctttacactgatgacgcacagcagactgaggctcaccttgaaatccgagaggatggcacagtggggggcgctgccgatcaaagtccagagagcctattgcagctgaaggcgttgaaacccggagtcatccaaattttaggggtgaaaacatctcgctttctgtgtcaacgtccagacggcgcactgtacggttccttacactttgaccctgaggcctgtagcttcagggaactgcttctcgaggatggttacaacgtttatcagagcgaagcgcatgggttgccattgcatctgccaggaaacaaatcaccacatcgcgatccagcgcctagggggcccgcacggtttctaccacttccaggcctgcctcccgcattgcccgaacctcccggcatcctcgcacctcagcccccggatgtggggtcatccgatccactgagcatggtgggtcctagtcaaggacggtccccctcatatgcctct

SEQ ID NO: 11545 - DNA, 627 bp, Artificial Sequence
  Description of Artificial Sequence: Synthetic coding sequence
atggatagcgatgagaccggttttgagcatagcggtctctgggttagcgtcttggctggcctcctgttgggcgcctgccaggctcatccgatccctgacagtagccctcttttgcagtttggaggtcaagtaaggcaaaggtacttgtataccgatgacgctcaacaaacggaagctcacctcgagattcgcgaagacggaaccgtgggtggtgcggctgatcagtcacccgagtcactgttgcagctcaaggccttgaaacctggcgtgatccaaattctgggtgtaaagacttcacgcttcctttgccagagacccgacggtgccttgtacggcagtctgcactttgaccccgaagcctgtagctttcgcgagctgctcctcgaggatggctataacgtctatcagagtgaggctcacggactgcccctgcacttgcctggcaataaaagcccacacagagaccctgcaccccgcggacccgccaggttcttgcccttgcctggcctgccacctgctcttccagagcccccaggcattctggcgcctcagccccctgacgtgggttccagtgatccattgtccatggttggcccttctcagggacgctctccatcttacgcaagc

SEQ ID NO: 11546 - DNA, 627 bp, Artificial Sequence
  Description of Artificial Sequence: Synthetic coding sequence
atggatagtgatgaaaccggatttgagcacagcggcctatgggtatctgtgctggccggtttgctgctgggggcctgccaagcccatcccattccggactcctctccacttctgcagttcggaggccaggtgagacagcgatacctgtacactgatgatgcccagcaaaccgaggcacatctcgaaatccgtgaggatgggactgttggaggggcggccgaccagagtcctgagagtcttttacagcttaaagccttgaaaccgggcgtgatccagatattaggagtgaagacgtctcgttttctgtgtcaaagaccggatggagcactctacggctctttacattttgatcctgaagcctgttctttccgcgagctgctgctggaggatggttataatgtgtaccagtcagaggcacacggcttgcctctgcatttgcctggtaacaagtctccacatcgtgaccctgccccccggggaccagcccggttcctcccattacccgggctgcctcctgccctgccagaacccccaggtatcctggcacctcagcccccagacgtaggttcctccgatccactgtcaatggtgggacctagccaggggaggtctccctcctatgcttcc

SEQ ID NO: 11547 - DNA, 627 bp, Artificial Sequence
  Description of Artificial Sequence: Synthetic coding sequence
atggattccgatgaaaccggcttcgaacatagcggtttgtgggtgagtgtcttggcagggcttcttcttggcgcatgtcaggctcatccaatcccagattcatcgcctctgctgcaatttggtggacaagtgcgccaacgctacctgtacactgatgacgcccaacaaaccgaagcacatctggagatcagggaggacgggacggtgggaggagctgcggaccagagccctgagtcgctgctgcaattgaaggcactgaaacctggtgtgatccagatcctgggcgtcaaaacctcacggttcttgtgtcagcgtcccgatggcgccctttacggtagcctgcactttgatccagaagcatgttcgtttagagaactgctgctcgaggacggatacaacgtgtaccaatccgaagcccacgggctgcccctgcacctgcccggaaacaagtccccccatcgagatccggcaccccgtgggccagccagatttctgccactgccagggcttcctcctgcactgcctgagcccccaggaatactcgcacctcaaccacctgacgtcggatcaagcgatcctctctcgatggttggtccatcacagggaagatccccttcgtacgcctct

SEQ ID NO: 11548 - DNA, 627 bp, Artificial Sequence
  Description of Artificial Sequence: Synthetic coding sequence
atggattctgatgaaaccggattcgagcactccggcctgtgggtgagcgtgctcgccggtctgctgctgggtgcatgccaggcacaccccatcccagattcaagtcccctgctccaatttggtggccaggttcgccaacgctacctgtacactgacgatgcacaacaaaccgaggcacacctggagattagggaggatggcactgtcggcggagctgccgaccagagccctgaatctcttcttcagctcaaggctctcaagcccggtgttatacagatactcggtgtgaaaacatctaggttcctttgtcagaggcccgacggagccctgtatggatctctccactttgaccctgaagcttgctcctttcgtgagctccttctggaggatggttacaacgtttatcaaagcgaggcacacggactccccctccacttgcctggtaataagagccctcacagggatcctgccccccgtggcccagcacgctttttgcctctccctggcctgcctccagctttgccagagccacccggcatcctcgcaccacagccccccgatgtcggatcctctgatccactgtccatggtcggacccagccagggccgttctccctcatatgcttct

SEQ ID NO: 11549 - DNA, 627 bp, Artificial Sequence
  Description of Artificial Sequence: Synthetic coding sequence
atggactccgatgagactggcttcgaacattccggtctttgggtgtccgtcttggccggcctgctgttgggggcatgccaggcccacccaatcccggacagctccccgctcctccagtttggtggccaggtgagacagaggtacctgtacaccgacgacgcgcagcagactgaggcccatctggaaatccgcgaagacggaacggtcggaggagcggcggaccagagtcctgagtcactcctgcaactgaaagcccttaagccgggagtcatccagatcctcggcgtgaagacctcaagatttctctgccaaaggccagatggcgccctgtacgggtcgttgcacttcgatcctgaagcctgctcatttagagagctgttgctggaagatggatacaacgtgtaccaatccgaagcgcacggactccctctccatctgccagggaacaagagcccacaccgggacccggccccgcgcggaccggcccgctttctcccactgccgggactccctcctgccctcccggaaccaccgggaatccttgcgccgcaaccacccgacgtgggatcctcggaccctctgtccatggtgggaccttcgcagggaagaagcccatcttacgcatcc

SEQ ID NO: 11550 - DNA, 627 bp, Artificial Sequence
  Description of Artificial Sequence: Synthetic coding sequence
atggattcagatgaaaccggattcgagcacagcggactgtgggtgtcggtgttggccggacttctcctgggggcttgtcaggcgcaccccattccagactcctcaccgctgctccagttcggcggacaggtgcggcaaagatacctgtacacggacgacgcacaacagactgaagcgcatctcgaaatcagagaggatggaactgtgggcggagccgccgaccagtccccggagagcctgctgcagctcaaagcgcttaagccaggagtgatccagatactgggagtcaagacttcgagattcctgtgccagcgcccggacggagccctttacggaagcctgcatttcgacccggaagcatgttccttcagggaactgttgctcgaggatggatacaatgtgtaccagtccgaagcgcacggactgccgcttcacctgccaggtaataagtctcctcatagagatcccgcgcctaggggcccggcaaggtttctgccactcccaggcctgccacccgcattgccagaaccacctgggatcttggcccctcagcctccagacgttggttctagcgatccgctgtcgatggtggggccgtcgcaagggagatccccgtcgtacgcttca

SEQ ID NO: 11551 - DNA, 627 bp, Artificial Sequence
  Description of Artificial Sequence: Synthetic coding sequence
atggactctgacgaaacaggattcgaacactcaggcctctgggtgtcagtgctagctggactactcctgggcgcttgccaggcacacccaatacctgactccagccctctcctgcagttcggcggccaggtcaggcagcgttatttgtatactgacgacgcccagcagactgaggcccacttggagatccgcgaggatggcacagtcggaggggcagcagaccagtctccagagagtctcctgcaacttaaggccctaaagcccggagtaatccagatcctgggggtgaaaacatctcgctttctatgtcagaggcccgacggagcgctatacggcagtctgcacttcgacccagaggcctgtagcttccgcgagctcctcctcgaagatggatataatgtgtatcagagcgaggcacacggcctgcccctacacttgcccgggaataagtccccacacagagatcctgcacccaggggccccgcaaggttcctgcccttgcccgggctgccacccgccctaccagaacctccaggcattctcgcaccacagcctcccgacgttggttcatccgaccccctgagcatggtcggccctagccagggccgaagcccgagttatgccagc

SEQ ID NO: 11552 - DNA, 627 bp, Artificial Sequence
  Description of Artificial Sequence: Synthetic coding sequence
atggattcagacgaaaccggatttgaacattcaggactctgggtgagcgtcctggcgggactgctgttgggtgcctgccaggctcatcccatcccagattcctccccgctgctgcagtttgggggtcaggtgagacagcggtacctctacactgacgacgcccagcagaccgaagctcatctggaaatccgcgaagatggaactgtgggaggagcggctgaccagtcgcccgaatccctcttgcagctgaaggcactgaagccaggagtgatccagatccttggcgttaagacctccaggtttctttgccagaggcctgacggagcgctgtatggatcgctgcactttgacccggaggcctgttcgttccgggagcttttgttggaagatggatacaatgtgtaccaatccgaagcacacgggctgccactgcatcttcctggaaacaagtcgccacaccgggaccctgccccacgggggcccgcacgcttcctgcctctgccgggtctgccaccggctctcccagagccaccgggtatcctcgcaccgcaaccgcctgatgtcgggagctcagacccgctgtcgatggtgggaccatctcagggaagatcgccatcgtacgcgtcg

SEQ ID NO: 11553 - DNA, 627 bp, Artificial Sequence
  Description of Artificial Sequence: Synthetic coding sequence
atggattcagatgagactggatttgaacacagcggactatgggtatctgttttggcggggctcctgctgggcgcttgccaggcccacccaattcccgattcttcacctctactgcagttcggcgggcaggttaggcagcgctatctgtacaccgatgacgcacaacagacagaggcgcatctcgaaatccgtgaggacggcacagtagggggggccgcggaccaaagccctgaatcactccttcaactgaaggcactgaaacctggagtgatccaaattctgggggtcaagacttctaggttcctatgccaaaggccagatggcgccttgtatgggtccctgcactttgatcctgaggcttgttccttcagagaactcctgttggaagatggatacaacgtgtaccagtctgaggcccatggtctccccttgcacctgcccggtaacaagtctccacatagggatccagcaccccgaggccctgccaggttcctgccactgcccggccttcctcctgctcttcccgaaccacctgggatcttggcccctcagccaccagacgttgggtctagtgatccactgagcatggtggggccatctcagggtcggagtccaagctatgcttca

SEQ ID NO: 11554 - DNA, 627 bp, Artificial Sequence
  Description of Artificial Sequence: Synthetic coding sequence
atggattccgatgaaactggattcgaacactcgggcctgtgggtcagcgtgctggccggactcctgcttggggcgtgtcaggctcaccctattcccgactcatcgcctcttctccaattcggtggccaagtccgtcagaggtacttgtacactgatgatgcacaacaaaccgaggcacacttggaaatccgagaggacggcacggtgggtggggctgccgatcagagcccggaatcactgctgcaattgaaagcgcttaagcctggtgttatccagattctgggagtgaaaacttcccgctttctgtgccagcggcctgacggagcgttgtacggctcactccatttcgatccggaggcatgttcctttcgggaacttctcttggaggacggatacaatgtgtaccaatcggaagcacatggattgcctcttcatctgcctggtaacaagtcgccacatagagatccagcgccaaggggtccagcaaggtttctgccccttcctggcttgccgccagccttgcccgagccaccaggtatactcgcgccccagccgccagacgttggatcgagtgatcctctgtcgatggtgggcccttctcaagggagatcgccctcttatgcatca

SEQ ID NO: 11555 - DNA, 627 bp, Artificial Sequence
  Description of Artificial Sequence: Synthetic coding sequence
atggactccgatgagaccggctttgagcactccggattgtgggtgtctgtgctggctgggctgcttctgggtgcctgccaggcacacccaatcccagactcatctcctctcttacagttcggcggtcaggtacggcagcgctacctgtacactgacgatgcacagcagacagaggcccacctggagattagggaggacgggaccgtaggaggagcagccgatcagagccctgagagtctcctgcaactgaaggccctaaagcccggcgtgatccaaatcctaggcgttaagacatcccggttcctctgccaaaggccagacggagctctctacggctctctgcacttcgatcccgaggcatgtagcttcagagaactcctgcttgaggatggatataatgtgtatcagagcgaagcacatggtctcccactgcacctccctggaaataagtcccctcatcgtgacccagcaccacggggtcccgctcggttcctcccactcccaggcctcccacctgcactgccagagcctcctggcattctggctcctcagccaccagacgtcggctctagtgatcctctatctatggtagggccctcacagggccgatccccttcttacgcgtcc

SEQ ID NO: 11556 - DNA, 588 bp, Artificial Sequence
  Description of Artificial Sequence: Synthetic coding sequence
atgcgcagatggctgggatgcgtgtgcttcgcgttggtgcaggccgacagcccttcagcgcccgtgaacgtgaccgtgcggcatcttaaggccaactcagcagtggtgtcctgggatgtgctggaggacgaggtggtcatcggtttcgccatcagccaacagaagaaggacgtgcgtatgctgcgattcatccaggaagtcaatactactactcgctcgtgcgccctctgggacctggaagaagatacggaatacattgtgcacgttcaggcaatctccatccaaggacagtccccagcgtccgaacccgtattgtttaagacccccagggaagctgagaagatggcctcaaagaacaaggacgaagtcactatgaaagaaatgggtcggaatcagcagctccggaccggagaggtgctgatcatcgtggtggtgcttttcatgtgggccggagtgattgccctgttctgcaggcagtacgacatcatcaaagataacgagccaaacaacaataaggaaaagaccaagtccgctagcgaaaccagcaccccagagcaccaaggtgggggacttctgagatcgaagatt

SEQ ID NO: 11557 - DNA, 588 bp, Artificial Sequence
  Description of Artificial Sequence: Synthetic coding sequence
atgcgcaggtggctcggatgtgtatgtttcgcactggtccaagccgatagtccatcagcacctgtgaatgttaccgtcagacatctcaaggcgaattcagctgtcgtgtcctgggacgtgctggaagatgaggtcgtgatcggttttgcaatttcgcaacaaaagaaagatgtgcgaatgcttcggtttatccaggaagtgaataccaccactcgatcgtgtgctctgtgggatcttgaagaggatactgaatacattgtgcacgtgcaggccatttcgattcagggacaatccccggcgtctgagcctgttctgttcaaaactcctagggaagcagagaaaatggcttccaagaataaagacgaagtcaccatgaaggaaatgggtcggaaccaacagcttcggactggggaagtgttgattatagtcgtggtgctgtttatgtgggcaggagtcatagcattgttttgtcggcaatacgacattatcaaggacaacgagccgaacaacaacaaagaaaaaaccaagtcggcatctgaaacctcgactcccgagcatcagggcggagggcttttgcgctcaaaaatc

SEQ ID NO: 11558 - DNA, 588 bp, Artificial Sequence
  Description of Artificial Sequence: Synthetic coding sequence
atgcgacgatggctggggtgcgtctgcttcgccctagtgcaagcagacagtccatccgcccccgtgaacgtcacagtgcgccatttgaaagctaatagcgcagtcgtatcatgggacgtgctggaagacgaggtggtaatcgggttcgctatctctcaacagaaaaaagacgttcgcatgctccggttcattcaagaagtgaataccaccactcgctcatgcgccctttgggacctggaggaggatacagaatacatcgtgcatgtacaggccatcagcatccagggccagtccccagcctcagagcctgtactctttaaaacaccccgggaagctgagaagatggcatctaaaaataaagatgaggtgaccatgaaggagatggggcgtaaccaacaactaaggaccggcgaagtgttgataattgtcgtggtgttgtttatgtgggccggggtgatcgcacttttttgtagacaatatgatattatcaaggacaatgagcccaacaacaataaggaaaagaccaagtcagcaagcgaaacaagtactcccgagcaccaaggcggggggctgctacgtagtaaaatt

SEQ ID NO: 11559 - DNA, 588 bp, Artificial Sequence
  Description of Artificial Sequence: Synthetic coding sequence
atgaggcgctggttgggttgcgtttgtttcgccctggtgcaggcggactccccgtccgccccggtcaacgtcacggtgaggcacttgaaagctaattccgctgtggtgtcatgggacgtgttggaggatgaggttgtcatcggattcgccatctcacagcagaagaaggacgttaggatgctgagattcatccaagaggtgaacaccactactagatcatgcgccctctgggacttggaggaagacactgagtatatcgtccatgtccaggctatctccattcagggacaaagtccggcgagcgagcccgtcctgttcaaaaccccacgcgaggccgagaaaatggcatccaaaaacaaggacgaggtgactatgaaggagatgggtcgcaatcagcaactgagaaccggagaggttttgatcatagttgtcgtgctgttcatgtgggccggcgtaattgccctgttctgtaggcagtacgacatcatcaaggacaatgaacctaacaacaacaaagagaagactaaaagcgcatccgagactagcactcctgaacatcaaggtggtggattgctgagatccaagatc

SEQ ID NO: 11560 - DNA, 588 bp, Artificial Sequence
  Description of Artificial Sequence: Synthetic coding sequence
atgagaaggtggctgggctgtgtatgtttcgccctagttcaggcagactcccctagcgcccccgtgaacgtaaccgttcgtcacttaaaagccaacagtgctgtcgtttcttgggatgttctagaagatgaggtggtgattggcttcgctatctctcagcagaagaaagacgtgcgaatgctgaggtttatccaggaagttaataccactacacggagctgcgcattatgggacctagaagaggatactgagtatatcgtccatgtgcaagctatatctatacagggccagagccccgcttccgagccagtcctgtttaagacaccacgagaggccgagaagatggcaagcaagaacaaagatgaagttactatgaaagaaatgggccgaaaccaacagcttaggacaggcgaagtcctcattatcgttgtggtgctcttcatgtgggccggcgtgatagccctattttgccgccagtacgacattattaaggacaacgaaccaaacaataataaggaaaagaccaagagcgcctcagagaccagcacccctgagcatcaggggggcggcctactacgctccaagatc

SEQ ID NO: 11561 - DNA, 588 bp, Artificial Sequence
  Description of Artificial Sequence: Synthetic coding sequence
atgcggcggtggcttggatgtgtctgtttcgcgcttgtgcaagccgactctcctagcgctccagtgaacgtgaccgtgcgccacttgaaagccaattccgccgtggtgtcctgggatgtcctggaggacgaggtggtgatcggattcgccatttcccaacagaagaaagatgtgagaatgctccgctttattcaggaagttaacaccaccacgcggtcatgtgcgctgtgggatttggaagaggataccgaatacatagtgcacgtgcaagcgatctccatccaaggacagtcgcctgcatccgaaccagtgctctttaagacccctagagaagcagagaagatggcgagcaaaaacaaggatgaggtcactatgaaggaaatgggcagaaaccaacagctccgaactggtgaagtccttatcattgtggtggtcctctttatgtgggccggtgtgattgcactgttctgcaggcagtacgacattatcaaggacaacgagccgaataacaataaagaaaaaacgaagagcgcatcagaaacttcgactcctgagcatcagggaggtggacttctcagatcgaaaatt

SEQ ID NO: 11562 - DNA, 588 bp, Artificial Sequence; identical to SEQ ID NO: 11558
  Description of Artificial Sequence: Synthetic coding sequence

SEQ ID NO: 11563 - DNA, 588 bp, Artificial Sequence
  Description of Artificial Sequence: Synthetic coding sequence
atgagaaggtggctgggatgtgtgtgtttcgcgctggttcaggcggactcgccttcagcaccagtcaacgtgaccgtgagacatcttaaagctaattccgccgtcgtgtcgtgggatgtgctggaagatgaagtcgtgattggattcgctatttcccagcaaaagaaggatgtaaggatgctgcgatttatccaggaggtgaacactactaccagatcgtgcgcattgtgggatctggaagaggacactgagtacattgtgcatgttcaagcaatttccatccagggtcaatcccccgcatcggaaccagtcctgttcaagacccctagagaagctgagaagatggcatcgaagaataaagacgaggtcaccatgaaagaaatggggcggaatcaacagctccgcactggagaggtgctgatcattgtggtcgtgctctttatgtgggctggtgtcattgcacttttctgccggcagtacgacataatcaaggataacgagccgaacaacaataaggagaaaaccaagtcagcctcagagacttcgactcctgaacatcagggaggagggcttctgcggtctaagatt

SEQ ID NO: 11564 - DNA, 588 bp, Artificial Sequence
  Description of Artificial Sequence: Synthetic coding sequence
atgcggagatggctcgggtgcgtgtgcttcgctctggtgcaggccgacagccctagcgcacccgttaacgttaccgttcgccaccttaaagcaaactccgccgtggtatcctgggatgtgctggaggacgaagtcgtcattggttttgctataagtcagcagaagaaggacgtcagaatgctgcggttcattcaggaggtgaacaccacaacacgttcttgcgcgctttgggacctggaggaggatacggaatatatcgtgcacgtacaagccatctccattcagggccagtctcccgcgtctgagcctgtcctcttcaaaacgccacgtgaagctgagaagatggcaagcaagaacaaggatgaggtgactatgaaagaaatgggccgcaaccagcagctgcgaaccggtgaggtgttgattattgttgttgtgcttttcatgtgggccggagttatcgcattattctgccggcagtatgatattattaaggataacgagcctaataacaataaggagaaaactaaatcggcgtctgagacgtcaacccccgaacaccagggagggggcttgttgcggtctaagatc

SEQ ID NO: 11565 - DNA, 588 bp, Artificial Sequence
  Description of Artificial Sequence: Synthetic coding sequence
atgcggcggtggcttggttgtgtctgcttcgcccttgtacaggcggacagtccatcagctcctgttaacgtcaccgtcaggcacctgaaggcgaattcggcggttgtcagctgggacgtactggaagacgaagttgtgatcggtttcgccatctcacaacaaaagaaggacgtaagaatgcttcggttcatccaggaggtcaatactaccactcgatcctgtgctctatgggacctagaggaagacaccgagtacatcgtgcacgtgcaggcaattagcatccagggccaatccccagcctccgaaccagttctcttcaagactccgagagaagccgagaagatggcctcgaaaaacaaagatgaagtgacgatgaaggaaatgggacggaatcaacagctccgtacgggagaggttctgatcattgtagtcgtccttttcatgtgggccggcgtcattgcactgttctgtcgccaatatgatatcatcaaggacaacgagcccaacaataataaggaaaagactaagagtgcgtcggagacctcaacgccagaacaccaaggtgggggtcttttgcgatccaagatc

SEQ ID NO: 11566 - DNA, 588 bp, Artificial Sequence
  Description of Artificial Sequence: Synthetic coding sequence
atgcggcggtggttgggttgtgtgtgcttcgccctggtacaggctgatagcccctctgcccctgtgaacgtcacagtgcgacatctcaaagctaattctgcggtggtctcgtgggacgtccttgaggatgaggtggtcattggattcgctatatcccaacagaagaaggacgtcaggatgctgcgcttcatccaggaggtcaataccaccactagaagctgcgcactgtgggacctcgaagaggacactgaatatatcgtgcacgtgcaggcgattagtatacaggggcagtccccagcaagcgagcccgttcttttcaagaccccaagagaagccgagaaaatggccagcaaaaataaagacgaggttacaatgaaagaaatgggccgaaatcaacaattaaggacgggcgaggttctgattatcgttgtggtgttgtttatgtgggccggagtcatcgcgctgttttgtaggcagtacgatattataaaggataatgaacccaacaacaacaaggagaaaaccaaaagtgctagtgaaacaagcacacccgagcaccagggaggtggtctgttacgctccaagatt

SEQ ID NO: 11567 - DNA, 588 bp, Artificial Sequence
  Description of Artificial Sequence: Synthetic coding sequence
atgcgtcgatggcttggctgcgtctgctttgcgctggtacaggccgactccccgagcgcacctgtgaacgtgactgtacggcatctgaaggctaatagtgccgttgtgtcctgggacgtccttgaagacgaggtggtaattggtttcgccatttcacagcagaaaaaagatgttcgcatgctgcgtttcatccaggaggtcaacactactaccagatcgtgcgccttgtgggatttggaggaagacacagaatacatcgtccacgtccaggcaatcagtattcagggacaaagcccggcctccgagcccgtgctctttaaaacacctcgggaggctgaaaagatggcctctaagaataaggacgaagtgaccatgaaagagatgggacgcaatcagcagctgaggacaggcgaggtgctcatcatagttgtggtactgttcatgtgggccggcgtgatcgccttattttgcaggcaatacgacataatcaaggacaacgaaccgaacaataacaaggagaaaaccaagtccgccagcgagacgtctacgccagagcaccagggaggcgggttacttagatccaagatt

SEQ ID NO: 11568 - DNA, 588 bp, Artificial Sequence
  Description of Artificial Sequence: Synthetic coding sequence
atgcgccggtggttaggctgcgtgtgctttgccctcgtgcaggccgactcccctagcgcacctgtgaacgttaccgtgcgtcatttgaaggcaaactctgccgtggtatcttgggacgttctagaagacgaagtcgtgattggcttcgccatctcgcagcagaagaaggacgttcggatgcttcgatttatccaggaggtgaacacaacaacgaggagttgtgccctctgggacttggaagaagatacagagtatatcgttcacgttcaggcaattagcatccagggacaatcccctgcatccgagcctgtcttgtttaagacacctcgcgaggctgaaaaaatggccagcaagaacaaggatgaggtgactatgaaggagatgggcagaaaccaacagttacgcacaggagaagtcttaatcattgtcgtggttctgttcatgtgggcaggtgttatcgcgctgttctgtcgccaatatgatattattaaagataatgaacccaataataacaaagagaagaccaagtccgcatccgagacaagtacccccgagcaccagggcggtggactgttaaggagtaaaatt

SEQ ID NO: 11569 - DNA, 588 bp, Artificial Sequence
  Description of Artificial Sequence: Synthetic coding sequence
atgcgccggtggctgggatgcgtgtgcttcgcgcttgtgcaggcagatagcccatccgcgccagtcaatgtgactgttcgccatcttaaggctaactccgcagtggttagctgggacgtcttggaagatgaagtggtgattggctttgccatctcgcagcagaaaaaagacgtgcgcatgctgaggtttatccaggaggtcaatacgaccacccgcagctgcgccctgtgggatctggaagaggacaccgagtacattgtccacgtgcaggctatcagcatccagggacagtcccctgcctcggagcctgtgctgttcaaaactccccgcgaggccgaaaagatggcctcgaagaataaggatgaggtcaccatgaaggagatgggccggaaccagcagctgagaaccggagaagtgcttatcatcgtggtggtcctgttcatgtgggcaggagtgatcgctctgttctgtcggcaatacgacatcatcaaagacaacgagcccaacaacaataaggagaaaaccaagagcgcatccgagacgtcaacgccggaacatcagggagggggtttgcttcgctccaaaatt

SEQ ID NO: 11570 - DNA, 588 bp, Artificial Sequence
  Description of Artificial Sequence: Synthetic coding sequence
atgaggcggtggctcggttgtgtctgttttgcgcttgttcaggcggactcgccgtccgcaccagtgaacgtgactgtgcgacatcttaaggcgaacagcgcagttgtgagctgggatgtgctcgaggacgaggtcgttataggatttgcgatttcacaacagaagaaagatgtgagaatgcttaggtttatccaggaagtgaataccaccacgcgttcctgcgcactgtgggatctggaggaagatactgaatacattgtgcacgtgcaagcgatttcaatccaaggacaatcccccgcaagcgaacctgtgttgttcaaaactcctcgtgaagcagagaaaatggccagcaaaaacaaagatgaggtgactatgaaagaaatggggagaaatcaacagctcagaaccggcgaggtgctgattattgtcgtggtccttttcatgtgggccggcgtgattgccctgttttgtcgccagtacgacattatcaaggacaatgagcctaacaataacaaggaaaaaactaagtcagcaagcgaaaccagcaccccagaacatcagggtggtggactgcttcggtcgaagatt

SEQ ID NO: 11571 - DNA, 588 bp, Artificial Sequence
  Description of Artificial Sequence: Synthetic coding sequence
atgcgtcgctggttagggtgcgtctgcttcgcacttgtgcaggctgactcacccagcgcccctgtgaacgtgactgtgcgccacctcaaggcaaactccgccgtggtgtcttgggacgttctggaagatgaggttgtgattggttttgccataagtcagcagaaaaaagatgtccgaatgctccggttcatacaggaagtgaatacgacaacacggagttgtgctctttgggacctagaggaagatactgagtacattgtgcatgtccaggctatctcaatccagggccagagccctgccagcgagcctgttttgtttaagaccccacgcgaggcagagaagatggcttccaagaataaagatgaggtcacaatgaaggaaatgggaaggaaccaacagttgcgcaccggtgaggtgctgattatagtcgtggtactgttcatgtgggcgggagttatcgctctgttctgcaggcaatacgacatcatcaaggataacgaaccaaataataataaggaaaagaccaagagtgcatctgagacatccactcctgagcaccaggggggagggttgctgcgatcaaagatc

SEQ ID NO: 11572 - DNA, 588 bp, Artificial Sequence
  Description of Artificial Sequence: Synthetic coding sequence
atgaggcgatggcttggatgtgtgtgctttgccctggtccaggcagatagcccttccgcgcctgtcaatgtgaccgttagacacctgaaagcgaacagcgcggtggtgagctgggatgtgcttgaggatgaagtggtgatcggattcgcaatctcccaacaaaagaaggatgtgcgaatgctgaggtttatccaagaggtgaacaccaccactagatcctgcgcgctttgggatctcgaggaggatactgaatacatcgtgcacgtccaagctatatccattcaaggccaatcgcccgcgtcggaaccagttctgtttaagaccccaagagaagccgaaaagatggcttccaaaaacaaagacgaggtgactatgaaggagatgggacgcaaccagcagctgcgcaccggtgaggtgcttatcattgtggtggtgcttttcatgtgggccggagtcatagccctgttttgccgtcaatacgacatcattaaggataatgaacctaataacaataaagagaaaactaagtccgcaagcgaaacctcaactccagaacatcaggggggtggactgctgagaagcaagatt

SEQ ID NO: 11573 - DNA, 588 bp, Artificial Sequence
  Description of Artificial Sequence: Synthetic coding sequence
atgagaagatggctcggctgcgtctgttttgcactggtgcaggcggattctccgagcgctccagtgaacgtaactgttaggcacctgaaagccaactcggccgtcgtcagttgggacgttcttgaagatgaagtggtaatcggttttgccatttcccagcagaagaaagatgtgaggatgctgaggtttatccaggaagtaaacacaaccaccaggagctgcgctctctgggaccttgaagaggacaccgagtacatcgttcatgttcaggccatctccatccagggccagtctcccgcttccgaacctgtcctcttcaaaactcctagagaggccgagaaaatggccagtaaaaataaagatgaggtgacaatgaaagagatgggcaggaatcagcagttaagaacaggtgaggttctcataattgtcgtggtactgttcatgtgggctggcgttattgcactgttttgccgtcaatatgacattatcaaagataacgaaccaaataacaataaggagaagaccaagtctgctagtgagacctcgacacccgaacaccaaggtggagggcttcttcgctcgaagatt

SEQ ID NO: 11574 - DNA, 588 bp, Artificial Sequence
  Description of Artificial Sequence: Synthetic coding sequence
atgcgcaggtggctgggatgcgtatgtttcgcgctggtacaggctgacagtccaagtgcccccgtcaacgttaccgtgagacacctcaaggcgaacagtgcagtggtttcttgggatgtgctagaggatgaggtcgtaatcggatttgccattagccagcagaagaaggacgtccggatgctgagatttatccaggaagtcaacacaaccactaggagctgcgcactgtgggacctcgaggaggatacagagtacatcgtgcatgttcaggcaatttccatccagggccagagcccggcctcggaaccagttctgtttaagacacccagggaagcagagaagatggccagcaagaacaaagatgaagtgactatgaaagagatgggacgcaaccagcagcttcgtacaggcgaagtgctgatcattgtagtggtactgtttatgtgggcaggcgtcatcgctctgttctgcagacagtacgatataatcaaagacaacgagcccaataataataaagagaaaacaaaaagtgcttctgaaaccagtacacccgaacatcaaggcggcgggttactaaggtctaagatc

SEQ ID NO: 11575 - DNA, 588 bp, Artificial Sequence
  Description of Artificial Sequence: Synthetic coding sequence
atgagacgctggttaggatgtgtttgctttgcactcgtgcaggccgattctcctagtgcccccgtaaatgtcacagttagacatcttaaagctaactcagcagtggtgtcctgggatgtgttggaagatgaagtggtcatcggatttgctatatcacagcagaagaaagatgtgagaatgctgagatttatccaggaagtgaacacaacaactagatcatgtgctctctgggacttggaggaagatacagaatatatcgtgcatgtccaggcgattagtatacagggacagtcgccagcctcagaaccagtccttttcaaaacacccagggaagccgaaaagatggcttcaaagaataaagatgaagtaacgatgaaggaaatggggcgaaaccagcagttaaggactggagaggtcctcatcatcgtggtggtgttatttatgtgggcaggagtgatagcccttttctgtagacagtatgacataataaaagataacgagcccaacaacaataaagagaagacaaaatctgcttcagaaacatccactcccgaacatcagggaggggggcttttaagatctaaaatc

SEQ ID NO: 11576 - DNA, 588 bp, Artificial Sequence
  Description of Artificial Sequence: Synthetic coding sequence
atgaggcgatggcttgggtgcgtgtgtttcgccctggttcaagccgactccccgagcgccccagtcaatgtgaccgtccggcacctgaaggctaatagcgcagtcgtgtcttgggacgtgctggaggatgaagtggttattgggtttgcaatctcacagcaaaagaaagatgtgcggatgttgagattcattcaggaagtgaataccactactcgaagttgtgcgctgtgggacctggaagaggataccgaatacatagtacacgtgcaggccatatctatccagggccagtcacccgctagtgagcccgtgctgtttaagactccacgggaggcagagaagatggcctctaagaataaggatgaagttactatgaaggaaatgggccgcaaccagcaactgaggacaggggaggttttgatcatcgtcgttgtcctgtttatgtgggccggcgtgattgccttattttgccgtcagtatgacatcatcaaagacaacgagccgaataacaacaaagaaaaaacaaaatctgcatcagagacaagtactccagagcaccaggggggcggcctactcagaagtaagatt

SEQ ID NO: 11577 - DNA, 588 bp, Artificial Sequence
  Description of Artificial Sequence: Synthetic coding sequence
atgaggcgatggctcggttgcgtttgttttgcactggtgcaggcggattcgccatcggcaccggtcaacgtgacggtgcggcaccttaaagccaattccgcagtcgtttcgtgggatgtcctggaagatgaggtggtgatagggttcgctatctcgcagcaaaagaaggacgtcaggatgctgcggttcattcaagaggtcaataccactactcgtagttgtgctctgtgggacctggaggaagataccgaatacattgtccatgtgcaagcgatctccattcagggtcagagccctgcatcagagcctgtgctctttaagacccccagagaggcagaaaagatggcctccaagaacaaggacgaagtgacgatgaaggagatgggtcgcaaccaacaactgcggactggagaagtcctgattatcgtggtcgtcctctttatgtgggcgggcgtgattgcactcttttgtcgccaatacgacataatcaaagacaacgaaccgaataacaacaaggaaaagaccaaatcagcatccgaaacgtccacgccggagcatcaaggaggcggcttgcttcgctccaagatt

SEQ ID NO: 11578 - DNA, 588 bp, Artificial Sequence
  Description of Artificial Sequence: Synthetic coding sequence
atgaggcgctggctgggatgtgtatgcttcgcgctcgtgcaggctgattctccaagtgcccccgtgaatgtgacagttcgccatttgaaagccaacagtgccgtggttagctgggacgtcctggaggacgaggtggtaattggatttgcgatcagccagcaaaagaaggacgtgcgcatgttacgctttattcaggaggtgaatacaactacacgcagttgtgccttatgggatctggaggaagataccgaatatatcgtccatgtccaggctatctctatccagggccagagtcccgcttctgaaccggtcctgttcaagacccctagagaggccgaaaagatggcatctaaaaataaagatgaagtcaccatgaaagagatgggccgcaatcaacagttgcggaccggcgaggtgctaataatcgtggtcgttctatttatgtgggctggagtgatcgctctcttctgtcggcagtacgacataatcaaagacaatgaacccaacaacaacaaggaaaaaaccaagagcgctagtgagacctcaacccctgagcaccaaggtggaggcctgctcagaagcaagatc

SEQ ID NO: 11579 - DNA, 588 bp, Artificial Sequence
  Description of Artificial Sequence: Synthetic coding sequence
atgcggcgctggctgggttgtgtgtgcttcgccctcgttcaggctgatagcccgtctgctccagtgaacgtgaccgtgaggcacctgaaggccaacagcgcggtcgtttcatgggacgtgctcgaagacgaagtcgtcatcggttttgccatttcccagcagaaaaaggatgtgaggatgctcagatttatacaggaagtgaatacgaccacccgttcctgcgccctgtgggatttagaggaggacactgaatatatcgttcacgtccaggcaatttccatacagggccagtctcctgcatctgagcctgttctcttcaagactccacgggaggcggagaaaatggcctcaaagaataaggatgaggtgaccatgaaggagatgggaagaaatcagcagcttagaactggggaagtcctgatcattgtcgtcgtgctgttcatgtgggcaggagtgatagcgcttttctgccggcagtatgatattataaaagataatgagccaaataacaacaaggaaaagacaaaatcggcatcagaaaccagtactccagagcaccaagggggcggcctcctccgctccaagatc

SEQ ID NO: 11580 - DNA, 588 bp, Artificial Sequence
  Description of Artificial Sequence: Synthetic coding sequence
atgagaagatggttggggtgtgtgtgtttcgctctggtgcaggctgacagtccctcagcccccgtgaacgtaaccgtgcgtcatctcaaagctaacagtgcagtggtatcatgggacgtgctcgaggacgaggttgtgattggctttgcaatttcacagcagaaaaaagacgtgcgcatgctacggtttattcaggaggtgaatacaaccacccgcagctgcgccctgtgggaccttgaggaggatacggaatacatcgtgcatgtacaagctatatcaatccagggccagagccctgctagtgagcctgtgctgttcaagacaccccgggaggcggaaaagatggcgtccaagaacaaagacgaggtgaccatgaaggagatgggacggaatcagcagttgcggactggggaagtgcttataatcgtggtagtgcttttcatgtgggccggggttatcgctctcttttgcaggcaatacgatatcatcaaggataacgagcccaataacaacaaagagaagactaaatccgcttcagagactagtaccccggagcaccagggaggtgggctgttgcgatcaaagatc

SEQ ID NO: 11581 - DNA, 588 bp, Artificial Sequence
  Description of Artificial Sequence: Synthetic coding sequence
atgagacgatggctcggatgcgtctgttttgctctggtgcaagccgacagtccaagtgcgcccgttaatgtgaccgttagacacctgaaggccaattccgctgtcgtctcctgggacgtcctggaggacgaagttgtcatcggctttgccatttcccagcagaaaaaggatgtgcgaatgttgcggttcatccaggaagtgaacacaaccacaagatcctgtgcactctgggacctggaggaggacacagagtatattgtacacgtccaggcaatttcaatccagggacagtcccccgcaagcgagcctgttctgttcaaaacaccaagggaagcagaaaaaatggcctccaagaacaaggacgaggtgacgatgaaggaaatgggccgcaatcagcagcttagaaccggcgaggtcctcatcatcgtagtggtgttatttatgtgggcaggtgtgatagcccttttctgccggcaatacgatattatcaaggataatgagcctaacaataataaggagaaaactaagtctgcttcagaaacttctaccccagagcatcaggggggaggattgcttaggagtaaaatt

SEQ ID NO: 11582 - DNA, 588 bp, Artificial Sequence
  Description of Artificial Sequence: Synthetic coding sequence
atgcggcgttggcttggttgtgtgtgcttcgccctcgttcaggctgattcaccttctgctcccgttaatgtaacagttcgtcacctaaaagcaaactcagccgttgtttcttgggatgtgctcgaagacgaggttgtaatcggattcgctatctctcaacaaaaaaaggatgtcagaatgcttcgtttcatacaggaggtgaacacaactacgaggagctgcgcactgtgggacttggaagaggacactgagtacatagtgcacgtgcaggctatatcaatccaaggacagagtccggctagtgaacctgtcctttttaaaaccccacgggaagctgagaaaatggcctctaaaaacaaggacgaggtcaccatgaaggaaatgggccgtaatcagcagcttcgaaccggcgaggtgcttattatcgttgtggtccttttcatgtgggccggggttatagcattgttttgtagacaatacgatatcattaaggataacgagcctaataacaacaaggaaaagactaagtcagcatccgagacaagtactcctgagcaccagggtggaggacttctacgatctaaaatc

SEQ ID NO: 11583 - DNA, 588 bp, Artificial Sequence
  Description of Artificial Sequence: Synthetic coding sequence
atgcgccggtggctcggatgcgtttgtttcgcattagtccaggctgactctccgtccgcgccagtcaatgtcactgtgaggcatctaaaagctaactccgcagttgtgagctgggatgtactcgaggacgaggtcgttattggcttcgctatctcccagcagaagaaagatgtgaggatgttgcgcttcatccaggaagtaaatactaccaccaggtcatgcgccctatgggacctcgaagaggacaccgagtacatcgtgcatgtccaagcgatttcaatccagggtcagagcccagcctccgagcctgtcctctttaaaactccacgagaagccgagaaaatggcctcaaaaaacaaggacgaggttacaatgaaagagatggggaggaaccagcagttgaggacgggcgaagtcttgattattgttgtggttctgttcatgtgggctggtgtcattgccctcttttgtcgtcagtacgacatcatcaaggacaacgaaccaaataataataaggagaagaccaaatctgcgagcgaaacctccacacctgaacaccaggggggtggactgctgcggtccaaaata

SEQ ID NO: 11584 - DNA, 588 bp, Artificial Sequence
  Description of Artificial Sequence: Synthetic coding sequence
atgcggcgatggctcggatgtgtgtgttttgcactcgtccaggcggatagcccttccgcacctgtgaatgtcaccgtccgacatcttaaggcgaactccgctgtcgtgtcatgggatgtcctggaggacgaggtcgtgataggctttgccatctcgcaacagaaaaaagatgtcagaatgttgcgtttcattcaagaagtgaacaccaccacccgttcctgtgcactgtgggacctcgaggaggacaccgaatacatagtgcacgttcaagcaatttcaattcaaggccagagccctgcatcggaaccagtgcttttcaagacccccagagaagctgaaaagatggcatccaagaacaaggatgaagtgaccatgaaggaaatggggagaaaccaacagcttcggactggggaagtgctgattatcgtcgtggtcctgttcatgtgggcaggtgtgatagcccttttttgccggcaatatgacattatcaaagataatgagcccaataacaacaaagagaaaactaagagcgcctccgaaacgagcacccctgagcatcagggcggcggactgctgagatcgaagatc

SEQ ID NO: 11585 - DNA, 588 bp, Artificial Sequence
  Description of Artificial Sequence: Synthetic coding sequence
atgaggcgctggctcggatgtgtctgcttcgcgctcgtacaagccgattcgcccagcgccccagtgaacgtcactgtgcgccacctgaaagccaattccgctgtagtcagctgggatgtgctcgaggatgaggttgtgattggattcgcgatctcacaacagaaaaaagacgttagaatgctccgtttcatccaagaagtcaatactacgacccgctcctgcgctctctgggacctggaagaggatactgaatacatcgtgcacgtgcaggcgatctcgattcaagggcagtcccctgcctctgaaccagtcctgttcaagaccccgcgggaggcagaaaagatggcctcgaagaacaaagacgaggtcaccatgaaggaaatgggcaggaaccagcaacttcggaccggagaagttctgatcattgtcgtggtgctcttcatgtgggcgggagtgatcgccctgttttgccgacagtacgacatcataaaggacaatgagccgaacaacaataaagagaagaccaagtccgcgtctgagacgagcactccggaacatcagggcgggggcttgttgcgctcaaagatc

SEQ ID NO: 11586 - DNA, 588 bp, Artificial Sequence
  Description of Artificial Sequence: Synthetic coding sequence
atgaggcggtggttggggtgcgtctgcttcgcgctcgtgcaggcagatagtccaagtgccccagtgaatgtgaccgttcgtcatttgaaagccaactccgcagttgtgagctgggacgtgctggaagacgaggtggtgattggattcgcaatatcccagcaaaagaaggatgtgagaatgcttcgcttcattcaggaggtcaacacaacgactcggtcttgcgctctctgggacctcgaagaggatacagagtacatagtgcatgtgcaggccatttccatccagggccagagccccgcctcagagccggtcctgtttaaaacaccgcgcgaagcagaaaagatggcctccaaaaataaggatgaggttaccatgaaggagatgggaaggaaccagcagcttcgcacaggggaggttctgataatcgtagttgttcttttcatgtgggctggggtgatagctctgttctgtaggcagtatgatatcatcaaggataatgaaccaaataataataaggagaaaaccaagagcgcttccgaaacctcgacgcctgagcaccagggggggggccttctcaggagcaaaatc

SEQ ID NO: 11587 - DNA, 588 bp, Artificial Sequence
  Description of Artificial Sequence: Synthetic coding sequence
atgagacgatggctgggctgtgtgtgcttcgcactggtgcaggccgactccccttccgctcccgtgaacgtgaccgtccgacacttgaaggcgaattcagccgtggtctcttgggatgttctcgaggacgaggtggttattggcttcgccataagtcagcaaaagaaggacgtcaggatgctccgttttatccaggaggtgaacactacaacaagatcttgtgctttgtgggaccttgaagaagacacagaatacatagtacacgtgcaggccataagcattcagggccagtccccagcctccgagcccgtcttgtttaaaacaccccgcgaggcggagaagatggccagcaaaaataaggatgaggtcaccatgaaggaaatgggccgaaatcagcaactgaggactggagaggtgctgataattgtggtggtactgtttatgtgggccggagtcatagcgctgttttgccggcagtatgatataatcaaggataatgagccaaacaataacaaagagaaaactaaaagtgcatccgaaactagcacgccagaacaccagggtggcggtctccttaggtcgaagatt

SEQ ID NO: 11588 - DNA, 588 bp, Artificial Sequence
  Description of Artificial Sequence: Synthetic coding sequence
atgcggcggtggcttggatgcgtctgttttgccctcgttcaggccgattccccctccgcaccagtgaacgtaacggtgaggcacctaaaagccaattctgcggtggtctcatgggatgtgctagaagatgaagtcgtcatcggattcgctatcagtcagcagaagaaagatgttaggatgctaagatttatacaggaggtaaatacgacaacaagatcttgtgccctgtgggatctcgaggaagatactgaatacatcgtccatgtccaggccatatcaatccagggacagtctccagcttcagagcctgtcctctttaaaacgccgcgggaagcagagaaaatggcctctaagaataaagatgaggtgacaatgaaagaaatggggcgaaaccagcagctacgaactggagaggtgcttatcatagtggtggtcttattcatgtgggcaggggttatcgctcttttctgtagacagtatgatattataaaagataacgagcccaacaataataaggaaaagacaaaatccgcctccgaaacaagtacacctgagcaccagggaggggggttgctgaggagtaagatc

SEQ ID NO: 11589 - DNA, 588 bp, Artificial Sequence
  Description of Artificial Sequence: Synthetic coding sequence
atgcgccgctggctcggctgtgtctgcttcgctctggtgcaggcagactcacctagtgccccagtcaatgtcactgtgagacacctgaaggcaaattccgctgttgtcagttgggatgtgcttgaggacgaggtggtgatcggttttgctatttcgcagcaaaagaaggatgtacgcatgctgcgctttatacaggaagtcaacacaacgactcgttcctgtgcgctgtgggacctggaggaagacactgaatatatcgtccacgttcaggctatttccatacagggccagagcccggcatctgaacctgtgttgttcaaaactcctagggaagcggagaaaatggcgtctaagaataaggatgaggtcactatgaaggagatggggaggaatcagcaactgagaaccggcgaagtgctgatcatcgtagtcgtgcttttcatgtgggctggggttattgccctcttctgtcgccagtatgacataatcaaagacaacgaacccaacaacaataaagaaaaaactaaaagcgcctctgaaacttcaacccccgaacatcaggggggcggcttactgagaagcaaaatt

SEQ ID NO: 11590 - DNA, 588 bp, Artificial Sequence
  Description of Artificial Sequence: Synthetic coding sequence
atgagaaggtggttgggctgcgtgtgtttcgccctggtgcaagcagattcaccatccgcccctgtgaacgtaactgtgagacatttgaaggcaaacagcgctgtcgtctcgtgggatgtgctggaggatgaagtcgtaattggttttgcaatttcgcagcagaaaaaggatgtccgcatgcttcgctttatccaagaagtcaacacgactacccggtcatgcgccctttgggaccttgaagaggacactgaatacatagtgcatgtgcaggcaatatccatccagggtcaaagccccgcctcagaaccggtcctgtttaagacccccagagaagcagagaaaatggcttccaagaataaagatgaggtcaccatgaaagaaatgggccggaaccaacagctccgaaccggagaggtgctgattatcgtggttgtgcttttcatgtgggcaggagtgatcgcgcttttttgtcggcaatacgacattatcaaggacaacgaaccaaataacaataaagaaaagaccaagtcagcatcggagactagcacgcctgaacaccaggggggagggctccttcgcagcaagatt

SEQ ID NO: 11591 - DNA, 588 bp, Artificial Sequence
  Description of Artificial Sequence: Synthetic coding sequence
atgcgacgttggctgggttgtgtgtgcttcgcactggtgcaggctgattcaccaagcgcacccgtgaacgtgacagtgagacacctgaaagcaaactcagcagtggtttcatgggatgtgttggaagacgaggtggtgatcggattcgcaatctctcagcaaaagaaagacgtacggatgctgcgctttatccaggaggtgaataccacgacaaggtcctgcgccctttgggacctggaggaggatactgaatatatagtccacgtacaggccatatccatccagggacagtcccccgcgagcgaacccgtactattcaagactcccagggaagctgagaagatggccagcaagaacaaagatgaagttactatgaaagagatggggaggaaccagcagctgcggacgggcgaggtcttgataatcgtggtggtgttgtttatgtgggctggcgttattgccctgttttgtcgccagtacgacatcatcaaagataacgagcccaataataacaaggaaaagacaaagtccgcgtcagagaccagcacccccgaacaccaaggagggggccttctaagatccaagatc

SEQ ID NO: 11592 - DNA, 588 bp, Artificial Sequence
  Description of Artificial Sequence: Synthetic coding sequence
atgaggcggtggctcggttgtgtgtgcttcgccctggtacaggctgactcaccgagcgcaccagtgaacgtaacagtcagacacctgaaagcaaatagtgccgtcgtgtcttgggatgttctggaggacgaggttgtaatcggattcgctataagtcagcagaagaaagatgtgcggatgctgaggttcattcaggaggttaatactactactcggagctgtgcactgtgggacctggaggaggacactgagtacatcgtacacgtgcaggcaatctcaatacagggacagtctccagcctctgagccagttctgtttaagactccaagggaggctgagaagatggcatccaagaataaggatgaagtcactatgaaagaaatgggaagaaaccagcagctccggacaggtgaggtgctgataattgtcgtggttttgttcatgtgggctggcgtgattgccctcttctgcaggcagtatgatattatcaaggataatgagcccaataacaacaaggagaaaaccaagagcgctagtgagacatccacccctgaacatcaaggcggcggcttgctgaggtctaaaatc

SEQ ID NO: 11593 - DNA, 588 bp, Artificial Sequence
  Description of Artificial Sequence: Synthetic coding sequence
atgaggcgctggctgggctgcgtttgcttcgcattggtccaggccgatagcccaagcgcacccgttaatgtcaccgtccgtcatctgaaggctaacagcgccgtggtgtcgtgggatgtcctggaagatgaggtcgtgattggctttgctatcagccagcagaagaaggacgttcgcatgttgcgcttcattcaggaagtgaataccaccacgcgctcctgcgctctatgggacctcgaggaggacaccgagtacatcgtacatgttcaggccatttcgatccaaggacagtcccctgcctctgagcccgtcctcttcaaaacgccgcgtgaagcagaaaagatggcaagcaagaataaagatgaggtcactatgaaggagatgggccgaaatcagcaattaaggaccggtgaggttctcattatcgtcgtcgtcttgttcatgtgggctggcgtgatagccttattttgtcgccagtacgacatcattaaagacaacgagccaaataacaataaagagaaaactaaaagcgcgagcgaaactagcactcctgagcatcaagggggcggcctgctgcgaagcaagatt

SEQ ID NO: 11594 - DNA, 588 bp, Artificial Sequence
  Description of Artificial Sequence: Synthetic coding sequence
atgagacggtggctgggctgcgtgtgctttgccttggtccaagcagatagcccctccgcccctgtgaacgttaccgtccgccacctcaaagcgaattcagctgtcgtgtcgtgggatgttcttgaagatgaggtggtgattggattcgcaataagccaacaaaagaaggacgttagaatgcttcgtttcatccaggaagtgaataccactactaggtcgtgtgccctgtgggacctcgaagaggatacggagtatatagtgcatgtgcaggcgatcagcattcagggtcagtcccctgcatctgagcctgtcctgtttaagactcctcgggaagcagagaagatggcgtcgaagaataaggacgaggtcaccatgaaagaaatggggcgaaaccagcaactccggaccggagaggtgctcatcatagtcgtagtgcttttcatgtgggccggagtcattgcacttttttgtagacagtatgacatcataaaagacaatgaaccgaacaacaacaaggaaaagactaagtccgcatccgaaacctcaactccagagcatcaaggcggaggtctgctgcgatccaagatc

SEQ ID NO: 11595 - DNA, 588 bp, Artificial Sequence
  Description of Artificial Sequence: Synthetic coding sequence
atgaggcgttggctaggatgtgtgtgttttgcccttgtgcaggcagatagcccgagcgctcccgtcaatgtaactgttagacacttaaaagccaactcagccgttgtcagttgggatgtacttgaggacgaggtagttatcgggtttgccattagccagcagaaaaaagatgtgcggatgctaaggtttatacaagaggttaacacaacaacccggtcttgtgccctttgggacctggaggaagacactgagtatatagtgcacgttcaggccatatctatccagggacagtcacccgcgagcgagcctgtgctctttaagacacccagagaagctgagaaaatggcttctaaaaataaagatgaagtgaccatgaaggaaatgggacgcaaccaacagctaagaactggcgaggtattgataattgtggttgtgctcttcatgtgggcaggcgtaatcgccctcttttgccgccaatacgacattatcaaggacaacgagcctaacaacaataaggagaagaccaaatctgctagcgagactagcacgccagagcaccagggaggcggcttactcagatcaaagata

SEQ ID NO: 11596 - DNA, 588 bp, Artificial Sequence
  Description of Artificial Sequence: Synthetic coding sequence
atgaggcgctggctcggctgtgtgtgctttgccctggtgcaggcggacagcccgagcgccccggtcaacgtgacggttcggcatcttaaggccaacagcgccgtcgtgtcgtgggatgtgctcgaggacgaagtcgtcatcggattcgccatctcgcaacagaagaaggacgtccggatgctccgcttcatccaagaggtcaacacgaccactcggtcctgcgcactctgggatttggaggaggacactgaatacatcgtccatgtgcaggcgatatccattcaggggcagtcgcccgcgtcggaacctgtcctgtttaagaccccacgcgaagccgaaaagatggcctcaaagaacaaagacgaagtgaccatgaaggagatgggaagaaatcagcagctcaggactggagaagtgctgatcatcgtcgtggtgcttttcatgtgggccggagtcattgcgctgttttgtcggcagtacgatatcatcaaggataatgagccgaataacaacaaagaaaagactaaatcggcctcggagacttccactccggagcatcaggggggaggactgctgcgctccaagatt

SEQ ID NO: 11597 - DNA, 588 bp, Artificial Sequence
  Description of Artificial Sequence: Synthetic coding sequence
atgcggcgctggttgggatgcgtgtgcttcgccctcgtgcaggccgattcgccatccgcgccggtgaacgtcaccgtgaggcacctgaaggctaattccgcagtggtcagctgggatgtgctggaagatgaagtcgtaatcggatttgccatttcgcaacaaaagaaagacgtccgcatgttgcgctttatccaggaagtgaacactaccacccgttcatgtgccctttgggacttggaagaggacaccgaatacatcgtgcatgtgcaggcaatatccatccaggggcagagccctgcgagtgaaccggtgctgttcaagactcctcgggaagcagaaaagatggccagcaagaacaaagacgaggtcacgatgaaggagatgggacggaaccagcaactgagaactggtgaagtgctgatcattgtggtagttctgttcatgtgggcgggagttatcgcgctgttctgcagacagtacgatatcatcaaggacaatgagcctaacaacaataaggagaaaaccaagtcggcttccgagactagcacgccagaacaccagggtgggggcctcctcagatcgaaaatc

SEQ ID NO: 11598 - DNA, 588 bp, Artificial Sequence
  Description of Artificial Sequence: Synthetic coding sequence
atgagacggtggcttgggtgtgtctgcttcgctctggtgcaggcggactcccctagcgctccagtgaacgtcacggtgcgtcacctgaaggcgaatagcgcagtggtgtcctgggacgtgctggaggacgaagtggtgatcggcttcgccatctcccaacagaagaaggatgtccggatgcttaggttcatccaagaggtcaacactactacccggtcgtgcgcgctgtgggatttggaagaagatactgagtacatcgtgcatgtgcaggcaatatcaatccaagggcagtcgccggcatcggaaccagtgctgttcaagacgccccgggaggcagaaaagatggcctccaaaaacaaagacgaggtcaccatgaaggaaatgggacggaaccagcagctcagaactggagaggtgctgatcattgtcgtggtgctcttcatgtgggcgggagtgatcgcactgttctgccggcaatacgacattatcaaggataacgagccaaacaacaacaaagaaaagaccaagtcggcgtcagaaacctccactcccgaacatcaaggaggaggcctcttgaggtcgaaaatc

SEQ ID NO: 11599 - DNA, 588 bp, Artificial Sequence
  Description of Artificial Sequence: Synthetic coding sequence
atgaggcgttggctaggctgcgtgtgcttcgctctggtgcaggcggacagcccatccgcccccgtcaacgtaacggtgaggcacttaaaagccaactctgcagtagtaagttgggacgtgttggaggacgaagtggtcatcggatttgcaatcagccagcaaaagaaagacgtgaggatgctgcgcttcatacaggaggttaataccacaacaagatcctgcgcgctttgggatcttgaagaagataccgagtatatcgtacatgtgcaggctatttcaatacaggggcagtcacccgcttccgagcctgtattgtttaaaactccgcgggaagcagaaaaaatggcgagcaaaaacaaagatgaagtgacaatgaaggagatgggacgcaaccagcagttgcgcacaggggaggtgttgatcattgtggtcgttctattcatgtgggctggggttattgctcttttttgccggcaatatgacattattaaggataatgaacccaataacaataaggagaaaaccaaatcggccagcgaaaccagcaccccagaacaccaggggggaggactgctacgatctaaaatt

SEQ ID NO: 11600 - DNA, 588 bp, Artificial Sequence
  Description of Artificial Sequence: Synthetic coding sequence
atgcgccggtggctcggatgtgtgtgttttgccctggtccaagcagattcccctagcgcacctgttaacgtcaccgtccgccatctgaaggcaaatagcgccgtggtgtcgtgggacgtgctggaagatgaagtcgtcattggttttgcaatttcgcaacagaagaaagatgttcgtatgctgagatttatccaggaagtcaacaccactactcgaagctgtgctctctgggatctggaagaggacaccgaatacatcgtccacgtgcaggccatctcaatacagggccaatcccctgcttccgagcctgtgctcttcaagactcctagagaagcagaaaagatggcgtcgaagaacaaagatgaagtgacgatgaaagagatgggtcgaaatcagcaacttaggaccggagaggtgctgattatagtggttgtgttgttcatgtgggctggggtgattgcactcttctgccggcaatatgatatcattaaagacaatgagccaaacaataacaaggagaaaactaaatcagcctccgaaaccagcaccccagaacatcaaggagggggccttcttcggtccaaaatt

SEQ ID NO: 11601 - DNA, 588 bp, Artificial Sequence
  Description of Artificial Sequence: Synthetic coding sequence
atgaggagatggcttggatgtgtgtgtttcgcgctggtgcaagcggactcaccatcggcccctgtgaatgtcacggtcagacatctgaaagccaactcggccgtagtctcgtgggacgtccttgaagatgaggtggtgattggcttcgcaatttcgcaacaaaagaaggatgtgcgaatgttgcggtttatacaggaggtgaacactaccacccggtcgtgcgcactgtgggatctggaagaggacaccgaatacatcgtgcatgtgcaagcaatcagcattcaaggtcagtcgcctgcaagtgagccagtgctgtttaagacgccaagagaagctgagaagatggcgtccaagaataaagatgaagtcactatgaaagaaatggggagaaaccaacagctgcgtactggtgaggtcctgataatcgtggtggtgctgttcatgtgggcaggtgtgattgcgctcttctgtcgccagtacgacatcattaaagataacgaacctaataacaataaggagaaaacgaaaagcgcctcggaaacttccacccccgagcaccagggtggaggacttctccgatccaagatt

SEQ ID NO: 11602 - DNA, 588 bp, Artificial Sequence
  Description of Artificial Sequence: Synthetic coding sequence
atgcgcagatggctggggtgtgtgtgctttgcactggtccaagcagactcaccgtcggcccccgtcaatgtgaccgtgagacatctcaaggccaactcggcagtcgtgtcgtgggacgtccttgaagatgaagtcgtgatcggattcgctatctcacaacagaaaaaggacgttaggatgcttcggttcatccaagaggtgaacaccactactcggtcgtgcgcactgtgggaccttgaggaagataccgaatacatcgtccacgttcaggcgatctcgatccaaggacaatccccggcgtccgagccggtgctgttcaagactccgcgggaagccgagaagatggcgagcaaaaacaaggacgaagttaccatgaaggaaatgggcaggaaccagcaactccgcacgggagaggtcttgattatcgtcgtcgtgctcttcatgtgggcaggggtgatcgcgctgttctgtcggcaatatgacatcatcaaggacaacgagccgaataacaacaaggagaaaacgaaatcagcctccgaaacttccacccctgaacaccaaggaggaggtctgctccgctcgaagatc

SEQ ID NO: 11603 - DNA, 588 bp, Artificial Sequence
  Description of Artificial Sequence: Synthetic coding sequence
atgcgacgatggctgggatgtgtttgtttcgcactcgtgcaggccgattcaccaagcgcaccagtgaatgttaccgttcgccatctaaaagctaactccgccgtcgtttcgtgggatgtccttgaggatgaagtagttatcggattcgctatctcccaacagaagaaagatgtacgtatgctccggtttatccaggaagttaatactactacgcgatcatgtgccttatgggatcttgaagaagatactgaatacattgtacatgtacaagccattagtattcagggacagtctccggcaagtgaaccagttttgttcaaaactcctagagaagctgagaaaatggcgtccaaaaataaggatgaggtcacaatgaaggaaatgggacgaaaccagcaattgcggaccggagaagtcctcataattgtggtggtactatttatgtgggctggcgttatcgcactgttctgtcgacagtatgacatcatcaaagataatgagccaaataacaacaaagagaagacgaagtctgcgtccgagacttcgaccccagaacaccaagggggcggcttactgagaagtaagatt

SEQ ID NO: 11604 - DNA, 588 bp, Artificial Sequence
  Description of Artificial Sequence: Synthetic coding sequence
atgcgccgatggctggggtgtgtctgcttcgcccttgtgcaagcggactccccgtcggcccctgtcaatgtcaccgttcggcaccttaaagccaacagcgccgttgttagctgggacgtgctcgaagatgaagtggtcatcggattcgccatctcgcaacagaagaaggacgtgcgcatgctgcggtttatccaagaggtgaacactacgaccagatcctgcgctctgtgggaccttgaagaagatactgagtacatcgtccacgttcaggcgatttcaatccagggacaatcgccggcttccgaaccagtgctgttcaagactcctcgggaggcagaaaagatggcgtccaagaacaaagacgaggtgacgatgaaagagatgggcagaaatcagcagctccgcaccggggaagtcttgattatcgtggtcgtgttgtttatgtgggccggcgtgatcgctctcttctgccgacagtacgacatcatcaaagataacgaaccaaataacaacaaggagaaaaccaagtcagcgtccgaaacctcgacccccgagcatcagggtggaggactgctgcgctcaaagata

SEQ ID NO: 11605 - DNA, 588 bp, Artificial Sequence
  Description of Artificial Sequence: Synthetic coding sequence
atgagacgctggctcggatgtgtgtgcttcgctctcgtccaggccgattcgccatcagcaccggttaatgtgaccgtgcgccatcttaaagccaactcggccgtcgtgtcgtgggacgtgctggaggacgaagtcgtgatcggctttgcgatctcacagcagaagaaggatgtgcggatgctgcggttcattcaagaggtgaacaccaccacccgctcatgcgcgctgtgggatctggaggaagataccgaatacattgtgcacgtccaggctatttcaatccaaggacagagcccggcgtccgagccggtgctgtttaagactccgagagaggcggagaagatggcttcgaaaaacaaggacgaagtgacgatgaaagagatggggcggaatcagcagctccggactggagaggtcctgatcatcgtggttgtgctgttcatgtgggcaggagtgattgcactgttctgccggcagtacgatatcattaaggacaacgaaccaaacaacaataaggaaaagaccaagtcggcctccgagacttcgaccccagaacaccaaggaggaggtctgctccgctcgaagatc

SEQ ID NO: 11606 - DNA, 588 bp, Artificial Sequence
  Description of Artificial Sequence: Synthetic coding sequence
atgcgacgctggctggggtgcgtctgcttcgcactggttcaagccgattccccgtctgctccagtgaacgttactgttcggcacttaaaagcaaatagcgctgtggtgtcctgggatgtgctggaggatgaagtagtgatcggatttgccatcagtcagcagaagaaggatgtgagaatgctgagatttattcaagaggtgaacaccaccaccaggtcatgtgctctgtgggatcttgaggaagataccgagtacatcgtacatgtacaggctataagcatccagggccagtccccagccagcgaacctgttttgtttaaaactcctcgggaggccgaaaagatggctagtaaaaataaggacgaggtaaccatgaaagaaatgggcaggaatcagcagctgcgcacaggagaggtgttgatcattgttgtcgttctctttatgtgggctggcgtcatcgccctattttgtcggcagtacgatatcattaaggataacgaaccgaacaataataaggaaaagactaaaagcgccagtgagacatctaccccggagcatcaaggtggcggtctgcttcgatccaaaatt

SEQ ID NO: 11607 - DNA, 588 bp, Artificial Sequence
  Description of Artificial Sequence: Synthetic coding sequence
atgcgtcgatggttaggttgtgtatgttttgcgctagtacaagcggattcgccgtcggcgccggtaaatgtaacggtacgacatctaaaagcgaattcggcggttgtttcgtgggatgtactagaagatgaagtagtaataggttttgcgatatcgcaacaaaaaaaagatgttcgtatgctacgttttatacaagaagttaatacgacgacgcgttcgtgtgcgttatgggatctagaagaagatacggaatatatagtacatgttcaagcgatatcgatacaaggtcaatcgccggcgtcggaaccggtattatttaaaacgccgcgagaagcggaaaaaatggcgtcgaaaaataaagatgaagtaacgatgaaagaaatgggtcgtaatcaacaattacgaacgggtgaagttctaataatagtagtagttttatttatgtgggcgggtgttatagcgttattttgtcgacaatatgatataataaaagataatgaaccgaataataataaagaaaaaacgaaatcggcgtcggaaacgtcgacgccggaacatcaaggtggtggtctactacgatcgaaaata

SEQ ID NO: 11608 - DNA, 588 bp, Artificial Sequence
  Description of Artificial Sequence: Synthetic coding sequence
atgcggaggtggctcgggtgtgtctgtttcgctttggtccaggccgactctcctagtgctcccgtaaatgtgactgtccgacatctgaaagctaactctgcagtggtgtcttgggatgttctcgaggatgaggtggtcattggttttgccattagccagcagaaaaaagatgtacggatgctgcgctttattcaagaggtgaataccactactcgatcatgtgcattatgggatctcgaagaggacacagagtacatagtccacgtccaggctatctcaattcagggtcagagtccagcttccgaacccgttctctttaagacaccccgggaggcggagaagatggcatcaaaaaataaggacgaggtgacaatgaaagaaatgggacgcaatcagcagctgcggaccggcgaggttcttatcatcgtggtcgtcctgtttatgtgggccggagtaatagccctgttctgcagacagtatgacataattaaagataatgagcctaataacaacaaagagaagactaagagcgcttctgagacaagcacccctgagcatcagggaggcggtctgctcaggtcgaaaatc

SEQ ID NO: 11609 - DNA, 588 bp, Artificial Sequence
  Description of Artificial Sequence: Synthetic coding sequence
atgcgcagatggcttgggtgtgtgtgcttcgctctcgtccaggctgattcacctagtgctccagtgaatgtgactgtgcgccacctgaaggctaattctgctgttgtctcctgggatgtgttggaggacgaagtcgtgatcggattcgcaattagccagcaaaagaaggacgtgcgaatgttgcgattcattcaggaggtgaacaccacaacacggtcctgcgccctgtgggacctggaagaggataccgaatacattgtgcacgtacaggccatctctatccagggccagagccccgcttctgagcctgtcctgttcaagaccccccgcgaggccgaaaaaatggcgagtaagaataaggacgaagtgaccatgaaagagatgggcaggaaccaacagctgcggaccggagaagtgctgataattgttgtggtcttgttcatgtgggcaggtgtgatcgcactgttctgccgacagtacgacattatcaaggacaatgagcccaacaataataaagagaaaactaagtctgcctccgaaaccagtacccccgagcatcaagggggcggcctgctcaggtctaagatt

SEQ ID NO: 11610 - DNA, 588 bp, Artificial Sequence
  Description of Artificial Sequence: Synthetic coding sequence
atgaggcgatggttgggctgcgtgtgtttcgccctagtgcaggctgattctcctagtgcaccagttaacgtcaccgtgcgtcacctcaaggctaactctgcagtggtctcctgggacgtgctagaggacgaagtggtaatcggctttgcgatttctcagcagaaaaaggatgtgcgaatgctgcgatttatccaggaggtcaatactacaaccagatcttgcgccctgtgggacttggaggaggacaccgagtacatagtccatgtgcaggcaatctccatccaggggcagtcccctgcttctgaacctgtgcttttcaagacaccacgagaagcggagaaaatggctagcaagaataaggatgaagttaccatgaaagaaatggggcgaaatcagcagctaaggactggtgaggtgttgataatcgtggtcgtgctattcatgtgggccggcgtcatcgccctattctgtaggcagtacgacatcatcaaagacaacgaacccaacaataacaaggaaaaaactaaatcagccagtgagacttccaccccggaacaccaggggggggggttattgaggagcaaaatc

SEQ ID NO: 11611 - DNA, 588 bp, Artificial Sequence
  Description of Artificial Sequence: Synthetic coding sequence
atgcgaaggtggttaggctgtgtgtgcttcgctctggtacaggctgactctcctagcgctcctgtcaacgtcacagtaaggcacttaaaagccaactcagcagtggtatcatgggacgtgttagaagatgaagttgtgattggatttgcaatcagccagcagaaaaaagacgtgcgcatgttgaggttcatacaggaggtcaatactaccacaaggagctgcgccctttgggatctggaagaggatacagagtacatcgtgcacgttcaggctatctcaattcagggtcagtcccccgcctccgaacccgtgctgtttaaaaccccaagggaggcggaaaagatggcctctaaaaataaagacgaggtgacaatgaaagagatgggacgcaaccaacaactgagaaccggcgaggtgttaattattgtggtggtgctgtttatgtgggcaggcgtaattgccctgttttgccgccagtatgatataataaaggataacgagcccaataataacaaagagaagaccaaaagcgctagtgaaacttcaacccccgagcaccagggagggggattgcttcggagcaagatc

SEQ ID NO: 11612 - DNA, 588 bp, Artificial Sequence
  Description of Artificial Sequence: Synthetic coding sequence
atgagaagatggcttggctgtgtatgttttgcccttgtgcaggctgactccccctctgcccctgttaatgtgaccgttcggcatttgaaggctaacagcgctgtcgtgtcctgggacgtgctagaggatgaggttgtaattggattcgccattagccagcagaagaaggatgtcagaatgctgcgcttcattcaggaagttaacaccacaactagatcttgcgccctgtgggacctcgaggaggacacagagtacatagtgcatgtacaggccatcagcattcaagggcagagtccagccagtgagcccgtgctgttcaaaacgcctcgtgaagccgaaaaaatggcatcaaagaacaaggatgaggtgaccatgaaggagatggggcggaaccaacagcttcgcaccggggaggtcctgattattgttgtagtactctttatgtgggccggggttatcgcgttgttttgccgccaatacgatatcataaaggataatgaaccgaacaacaacaaggagaaaacaaagtcagcatcagaaacttctacaccagagcatcaggggggcggcctgctgcgcagtaaaatc

SEQ ID NO: 11613 - DNA, 588 bp, Artificial Sequence
  Description of Artificial Sequence: Synthetic coding sequence
atgcggcgatggcttggctgtgtctgctttgcactcgtgcaagcagattcgccatcggctccagtgaacgtcactgtgagacatttgaaggcaaattccgcagtggtgtcctgggacgtacttgaagatgaagtcgtaattggtttcgctatctctcaacagaaaaaggacgtgcgtatgctcagattcattcaggaagtgaacaccaccacgcgttcgtgtgccctgtgggacctggaggaagataccgagtacatcgtgcatgtgcaggctatttccatacaaggacagtcccctgcaagcgaaccagtgctgtttaagactccgcgcgaagccgagaagatggcatcgaaaaacaaggacgaagtcacgatgaaggagatgggtcgaaaccagcaacttcgcaccggcgaggtgttgattattgtcgtcgttctctttatgtgggcaggagtgatcgcattgttttgtaggcagtacgatatcataaaggataatgaacctaacaataacaaagaaaagactaagtccgcatcggagacttcgacgcccgaacatcagggagggggactcctgcggagcaagatc

SEQ ID NO: 11614 - DNA, 588 bp, Artificial Sequence
  Description of Artificial Sequence: Synthetic coding sequence
atgaggcggtggttgggctgtgtatgttttgcgctcgtccaggccgacagtccaagtgcacccgtgaatgtcacggtcagacatctgaaggctaacagtgccgtcgttagttgggacgtgctggaagatgaggtggtgataggatttgccatttctcagcaaaagaaagatgtaaggatgctgaggttcatacaagaggtcaacactacaacaagaagctgcgcactgtgggacctcgaagaagataccgagtatatcgtgcacgtgcaagctattagcattcaggggcaatctccggcatctgagcctgttctgtttaagacaccacgtgaagcggaaaaaatggcgagcaaaaataaagacgaggtgaccatgaaggagatgggcagaaatcagcaactgcgcaccggtgaggtgcttataatcgtggtggtgctgtttatgtgggcaggtgtaatcgcacttttttgccgccagtacgacattattaaagacaatgaaccaaataacaacaaggaaaaaacgaagtcggcatcagagacttccactccggagcaccagggcggtgggctgctgcggagcaagatc

SEQ ID NO: 11615 - DNA, 588 bp, Artificial Sequence
  Description of Artificial Sequence: Synthetic coding sequence
atgcggcggtggctcgggtgtgtgtgttttgcccttgtgcaggcagatagccccagcgcaccagtgaacgtcaccgttcggcatttgaaggcaaacagcgcagtggtgtcctgggatgtgttggaagatgaagttgtcattgggttcgcaatctcccagcaaaagaaagatgtgcgcatgcttagatttatccaggaggtgaacacgaccacccggtcgtgtgccctgtgggatcttgaagaggatactgagtacattgtccatgtccaggccatttccatccaggggcagagccctgcgtcggaaccggttctgttcaaaactcctcgtgaagcagagaagatggcttcaaagaataaggacgaagtgacgatgaaagaaatgggacgcaaccaacaactgcgaaccggggaagtgctcataattgtggtggtgttgtttatgtgggcaggtgtcattgctttgttctgcagacaatacgacattatcaaggataacgagccaaacaacaataaggaaaagacgaaatccgcgtcagaaacttcgacccctgagcatcaagggggaggactgctcaggtcgaaaatc

SEQ ID NO: 11616 - DNA, 588 bp, Artificial Sequence
  Description of Artificial Sequence: Synthetic coding sequence
atgcggcgctggctgggatgcgtgtgctttgccctggtgcaagccgattccccttcggccccggtgaacgtcactgtgcgccacttgaaggccaactcggcagtggtgagctgggatgtgctcgaggacgaggtggtgattgggttcgccatttcccaacagaagaaggatgtcagaatgctgcgattcatccaggaggttaatactaccactaggtcgtgtgcgctgtgggacctggaagaggacacggaatacatcgtgcatgtgcaggccatcagcatccaggggcagtcccccgcttctgaaccagtgctgttcaagaccccgcgcgaggcggaaaaaatggcatcaaagaacaaagacgaagttactatgaaggagatgggaagaaaccaacaattgcgcaccggagaggtgctcatcatcgtcgtcgtcctcttcatgtgggcaggcgtcatcgctctcttttgccggcagtacgacattatcaaggataatgaaccgaacaacaataaagaaaaaaccaagtcagcgtccgaaactagcaccccagaacaccagggaggtggccttctgcggtcgaagatc

SEQ ID NO: 11617 - DNA, 588 bp, Artificial Sequence
  Description of Artificial Sequence: Synthetic coding sequence
atgagaagatggctgggatgtgtgtgtttcgcacttgtgcaggctgattcgccctcggcccctgtgaatgtcaccgtccggcaccttaaggcaaactcagcagtggtgagctgggacgtgctcgaagatgaagtggtgataggatttgctatttcacaacagaagaaggacgtgcgcatgctgcgattcattcaagaggttaacactactacgagatcctgtgcactgtgggatctggaagaagatactgagtatatagtgcatgtgcaagccatttcgatccaaggacaatcccccgcatcggagcccgtccttttcaagaccccgagagaagcagagaagatggcatccaaaaacaaagacgaagtgactatgaaagagatgggacggaaccaacagcttcgtaccggtgaagtcctcataatcgtggtggtccttttcatgtgggcgggtgttattgcactgttctgtaggcaatacgacataatcaaagataacgagcctaacaataacaaagaaaagaccaagagcgcctcggaaacttcgaccccagaacatcagggaggtggactgcttcgtagcaagata

SEQ ID NO: 11618 - DNA, 588 bp, Artificial Sequence
  Description of Artificial Sequence: Synthetic coding sequence
atgcggcggtggctaggctgtgtgtgtttcgccctagtccaggcagattccccaagcgcgccagttaatgtgaccgtccggcacctcaaagctaactctgcagtggtgagttgggatgtgctcgaggacgaagttgtgatcgggttcgccatttctcagcaaaaaaaggacgtccgtatgctgagattcatccaggaggtgaacacgactactcgcagctgcgcactatgggacctggaggaggacacagagtacatagtccacgtccaggccatcagcatccaagggcaaagcccggccagtgagcccgtgctgtttaagacacctagggaggccgagaaaatggcctctaaaaacaaggatgaagtcacaatgaaggaaatgggacggaaccagcaactcaggaccggggaggtcctgattatagtggtggttctgttcatgtgggccggagttattgctctcttttgccgtcagtatgacattattaaggacaatgagcccaataataacaaggagaagaccaagtcagcatccgagacttctacgcctgaacatcagggtggaggcttgcttcgttccaaaatt

SEQ ID NO: 11619 - DNA, 588 bp, Artificial Sequence
  Description of Artificial Sequence: Synthetic coding sequence
atgcgcagatggctaggttgtgtctgtttcgcactggttcaggccgattccccttcagctcccgttaacgttacagtgcgtcacctgaaggcgaacagtgcagtggtatcgtgggacgtcctcgaggatgaggtggtcattggtttcgccatctcacagcagaagaaggatgtccgtatgttgagattcatccaagaggtcaacacaaccacgcgttcatgcgctctctgggatctggaggaggacaccgagtacatcgtgcatgtgcaagccattagcatccagggccagtcgccagcttcggagccagtcctttttaagacgccacgggaggctgagaagatggcctccaagaacaaggatgaagtgaccatgaaggaaatgggtcggaaccagcagttacgtaccggcgaggtcttgatcattgtcgtcgttttgttcatgtgggcgggtgtcatcgccctgttttgccgccagtatgacatcattaaggataacgagcctaataacaacaaggagaagaccaaatctgcaagcgagacgtctacccctgagcatcagggtggcggactcctgcgctctaaaata

SEQ ID NO: 11620 - DNA, 588 bp, Artificial Sequence
  Description of Artificial Sequence: Synthetic coding sequence
atgcgacggtggctcggctgtgtctgctttgctcttgtgcaggctgattccccttccgctccagtcaacgtgaccgtgcggcatctgaaagcaaattcagcagtggttagctgggatgttctcgaggatgaagtggtgatcggattcgccatttctcagcaaaagaaagacgtgcggatgctgagattcattcaagaggtcaatactactactcggtcctgcgcactttgggatctggaggaggacaccgaatacattgtgcacgtgcaagcaataagtatccaaggtcaaagcccggccagcgaacccgtgttgtttaagaccccaagagaggcagaaaagatggcaagcaagaacaaagacgaggtgaccatgaaggaaatgggaagaaatcaacagttgcgtactggagaggtcctgattattgtggtggtcctgtttatgtgggctggagtgatagcactgttttgtaggcagtacgatatcattaaggataatgagcctaacaacaacaaggaaaagaccaagtcggcttcggaaacctcgactcccgaacaccagggtgggggacttctgcgctctaagatt

SEQ ID NO: 11621 - DNA, 588 bp, Artificial Sequence
  Description of Artificial Sequence: Synthetic coding sequence
atgcggcgctggctggggtgcgtctgcttcgccctcgtgcaagcagatagcccgagcgccccggtgaacgttaccgtgcgccacctgaaggcgaattcagcggtggtgtcctgggatgtgttggaggatgaggtcgtcatcggcttcgctatttcacagcaaaagaaggatgtccgcatgctccgcttcatccaggaagtgaatactaccacccgctcgtgcgcgctgtgggaccttgaagaggacaccgaatacatcgtgcacgtgcaggcaatttccatccagggccaaagccctgcatcggagcctgtcctgttcaaaactccgcgggaggccgaaaagatggcttcaaagaacaaggatgaggtcaccatgaaagaaatgggacggaatcagcagcttcgcaccggagaggtgctgatcatcgtggtggtgctgttcatgtgggccggggtgatcgccctgttctgtcggcagtacgatatcatcaaggataatgaaccaaataacaacaaggaaaagactaagagcgccagcgagactagcaccccggaacaccagggaggagggctgctccggtccaagatc

SEQ ID NO: 11622 - DNA, 588 bp, Artificial Sequence
  Description of Artificial Sequence: Synthetic coding sequence
atgagacgatggctgggctgcgtctgttttgctctggtccaggcagactcaccaagcgcaccagtgaacgtaaccgtgcgacacctgaaggccaattcagcagttgtttcttgggatgtgctggaagatgaggttgtgatcggctttgcaatctcacagcagaaaaaagatgtgagaatgcttaggttcattcaggaggtcaacacgactacaagatcttgtgctctctgggatctggaggaggacaccgagtatatcgtgcatgtccaagccatctcaattcaaggacaatctccggccagcgagcccgtgctgtttaagacccctcgagaggcggagaaaatggcctctaagaataaggacgaagtgacaatgaaggagatgggtagaaatcagcagctgagaacaggcgaggtgctgatcatcgtggtggtgctgtttatgtgggctggagtgatcgctctgttttgcaggcagtacgatataatcaaggataatgaacccaacaataataaagagaaaactaaatcagctagtgaaactagcacacctgagcaccaaggaggggggctcctcaggtctaagatc

SEQ ID NO: 11623 - DNA, 588 bp, Artificial Sequence
  Description of Artificial Sequence: Synthetic coding sequence
atgcgccgctggctgggctgtgtctgctttgccctggtccaggcagactccccctcagccccagtgaacgtgaccgttaggcacttgaaagccaactccgccgtggttagttgggacgtgcttgaggacgaagtcgtaatcggtttcgccatcagtcaacagaagaaagatgttagaatgttgcgttttatccaagaagtgaatactaccactcgcagctgcgctctctgggacttggaggaggatactgaatatattgtgcatgtccaggccattagcattcagggtcaatctccagctagcgaacctgtgctgttcaagacacctcgcgaggcagagaagatggcttctaaaaataaggacgaggtgaccatgaaggaaatgggccgcaaccagcagctgagaactggagaggtgctgatcatagttgtggtgctcttcatgtgggctggtgttatcgcacttttttgccgtcagtatgatatcatcaaggataatgagcccaacaacaataaggagaagaccaagtccgcttcagaaacttctacccccgagcaccagggaggaggattgttgagatccaagatt

SEQ ID NO: 11624 - DNA, 588 bp, Artificial Sequence
  Description of Artificial Sequence: Synthetic coding sequence
atgcgccgctggctgggctgcgtgtgtttcgccctggtccaggccgattcacctagcgcgcctgtgaacgtgaccgtccggcacctcaaggcaaattcagctgtggtttcttgggacgtgctcgaggacgaagtggtgatcgggtttgcgatttcgcagcagaaaaaggatgtgcggatgctgcgattcatccaagaagtcaacaccaccacccggtcgtgcgcgctgtgggacctggaggaggatactgagtacatcgttcacgtgcaggccatcagcatccagggccaatcgccggcatcggaaccggtgttgttcaagacccccagagaagcagagaagatggcctccaagaacaaggacgaagtgacgatgaaggaaatgggacgcaaccaacagctgcgcactggcgaagtgctgattatcgtcgttgtccttttcatgtgggccggagtcattgcactgttctgtcggcagtacgatatcatcaaggacaatgagcccaacaacaacaaggaaaagaccaagtcggccagcgaaacttcaacgccggagcatcaaggaggaggattgcttagaagcaaaatc

SEQ ID NO: 11625 - DNA, 588 bp, Artificial Sequence
  Description of Artificial Sequence: Synthetic coding sequence
atgaggcggtggctcggatgcgtgtgttttgctctggtccaggccgactcaccgtccgccccggtcaacgttaccgtgcggcatctgaaagcaaattctgccgtcgtgtcctgggatgtgctggaggacgaggtggtgatcggattcgccatctcgcagcaaaagaaagatgtgcggatgctgcgctttatccaagaagtcaataccaccacccgctcctgcgcactgtgggacttggaggaagataccgaatacattgtgcatgtgcaggctatctctatccaaggccagtcgccggcctccgaaccggtgctcttcaaaaccccgcgcgaggccgaaaagatggcaagcaagaacaaggatgaagtgacgatgaaagaaatgggacgcaatcagcaacttagaaccggagaggtcctcatcatcgtggtcgttctgtttatgtgggcgggagtgattgcgttgttctgccgacagtacgacatcattaaggacaatgagccgaacaacaataaagagaaaactaagtcagcgtccgagacgagcaccccagaacaccagggaggaggactcctcagatcgaagatc

SEQ ID NO: 11626 - DNA, 588 bp, Artificial Sequence
  Description of Artificial Sequence: Synthetic coding sequence
atgaggcgatggttggggtgcgtctgcttcgccctggtgcaagccgatagcccctccgcccctgtgaacgttaccgtgagacaccttaaggccaattctgccgtcgtaagctgggacgtactggaggatgaggtagtcattggcttcgctatctcgcagcaaaaaaaagacgtcagaatgttgcgtttcatccaagaagtcaacacgacaacacgctcctgcgccctctgggaccttgaggaagacacagagtacatcgtgcatgtccaggcaatctctattcagggccaaagtcccgcaagtgagccagttctgttcaaaactccgcgtgaagcggagaaaatggccagcaaaaacaaggatgaggtgactatgaaagagatgggtcgcaaccagcagcttaggacaggcgaagtcctcattattgtggtggtactttttatgtgggcaggagtgatagcattgttttgccgccagtacgacatcatcaaggataatgaacccaataacaataaggaaaagaccaagagtgcctctgagacctcgacccccgagcaccaggggggcggtctgcttagaagtaagatc

SEQ ID NO: 11627 - DNA, 588 bp, Artificial Sequence
  Description of Artificial Sequence: Synthetic coding sequence
atgcgccgctggctgggatgtgtgtgttttgctttggtccaagcggactcgccgtcggcacctgtgaatgtcacggtccgtcacctgaaagccaactccgcagtagtctcctgggatgtcttggaagatgaagtggttattggatttgcgatctcgcagcaaaagaaggatgtgcgcatgctgagattcatccaggaagtcaataccaccacccgctcctgcgctctttgggacctggaggaggacactgagtacatcgttcatgtgcaggcgatcagcatccagggacagagcccggcgtcggaacctgtgctgttcaaaactccaagagaggcggaaaagatggcctccaagaataaagacgaggtgaccatgaaagagatgggccgcaatcagcaacttagaaccggggaagtgctcatcatcgtggttgtccttttcatgtgggcaggagtcatcgctctgttctgccggcagtacgatatcataaaagacaatgagcccaacaacaacaaggaaaagactaagtctgcaagcgagacttcgactccagagcaccagggtggaggtctgctgagatccaaaatt

SEQ ID NO: 11628 - DNA, 588 bp, Artificial Sequence
  Description of Artificial Sequence: Synthetic coding sequence
atgaggagatggttggggtgcgtttgtttcgcgctggtccaggccgacagcccttccgctcctgtgaatgttactgttaggcacctgaaggctaactctgcggtcgtgtcatgggacgtgctggaggatgaggtcgttatcggctttgctattagtcagcagaagaaggatgtacgaatgctgcgcttcatccaagaggttaatacaaccacgcggagctgtgccctttgggacctggaggaagataccgaatacatagtgcatgttcaggccatatcaattcagggacaaagccccgcctccgaaccggtactcttcaagactccccgggaggcggagaagatggcgagcaagaacaaggacgaggttactatgaaagagatggggcggaaccagcagctccgaaccggggaggtgctcatcatcgtggtggttttgtttatgtgggccggcgtgatcgccctcttttgccggcagtatgacatcataaaagataacgaaccgaacaataataaagagaagacaaagtcagcctccgagactagcacacccgagcaccaagggggtggtctcttgcggtcaaaaatt

SEQ ID NO: 11629 - DNA, 588 bp, Artificial Sequence
  Description of Artificial Sequence: Synthetic coding sequence
atgcggagatggctcggatgcgtttgtttcgccctggtccaggcagactcaccatctgcccccgtgaatgtgactgtacgacatctgaaggccaattccgccgtcgtgtcatgggacgtgctggaggacgaagtggtgatcggcttcgcgatttctcagcagaaaaaggatgttaggatgttgcgctttatccaagaagtgaacaccacgactcgctcctgcgcgttgtgggatctggaagaggacactgaatacatcgtccacgtccaggctatcagcattcaaggccaaagccccgcttcggagccagtcctgtttaagaccccaagagaagcggaaaagatggcatcgaagaacaaggacgaggtgaccatgaaagaaatgggacggaaccaacagctccgaaccggagaagtgctgataattgtggtggtgctgttcatgtgggctggcgtgatcgcgctcttctgcagacagtacgatatcatcaaggataacgagcctaacaacaataaggagaaaaccaaatcagcctcagaaacttcgacgccggagcaccaaggtggtggactcctgcggtcgaagatc

SEQ ID NO: 11630 - DNA, 588 bp, Artificial Sequence
  Description of Artificial Sequence: Synthetic coding sequence
atgcggcgatggcttggatgcgtgtgtttcgcactggtgcaggcagattcgccttcggcaccggtgaacgtgactgtccgccatctgaaggcgaacagcgcagtcgtgtcgtgggatgttttggaggatgaagtcgtcatcggctttgcgattagccagcaaaagaaggacgtgcgtatgctccgtttcattcaggaagttaatactacgactaggtcctgtgcattgtgggatcttgaggaggacaccgaatacatcgtgcatgtgcaggcaatttcgattcaaggtcagagccctgcgtcggaaccagtccttttcaagactcctcgggaggcagagaaaatggcatcgaagaacaaagacgaggtgaccatgaaggaaatgggtagaaaccaacagctgaggacgggtgaggtgctgattattgtggtggtcctctttatgtgggccggagtcattgctcttttttgccggcagtacgacatcatcaaagataatgaaccgaacaacaataaggaaaagaccaagtcagcatccgaaacttctacccctgaacatcaaggtgggggtctgcttcgttcgaagatc

SEQ ID NO: 11631 - DNA, 588 bp, Artificial Sequence
  Description of Artificial Sequence: Synthetic coding sequence
atgaggagatggctggggtgcgtgtgttttgctctggttcaggccgatagcccgtcggcacccgtcaacgttacagtccgccacttgaaagctaatagcgcggtagtgagctgggatgttcttgaggatgaggtagtcattgggtttgccattagccagcagaagaaggatgttcggatgctgcggttcattcaagaagtaaatactaccaccagatcatgcgctctctgggatcttgaagaggacactgagtatattgttcacgtgcaagccatcagcatacagggtcaatcacccgccagcgaaccagttctcttcaaaacaccaagggaggccgaaaaaatggctagcaaaaataaggacgaggtcaccatgaaggagatgggcaggaatcaacagctgaggaccggcgaggtcctgatcatcgtggttgttcttttcatgtgggccggcgtgatagcactattttgtagacaatatgatatcattaaggacaacgagccaaataataacaaggagaagaccaaaagtgcttcagagacaagcacaccagagcatcagggcggcggtctgctgaggtctaaaatt

SEQ ID NO: 11632 - DNA, 588 bp, Artificial Sequence
  Description of Artificial Sequence: Synthetic coding sequence
atgcgccggtggctcggctgcgtttgttttgcgttagtgcaagcggattcgcctagcgcaccggtaaatgttacagtccgacaccttaaggcgaactctgcagtcgtaagttgggacgtattagaagacgaggtggtgataggtttcgccatctctcagcagaagaaagacgtgcgaatgttgcggtttattcaggaagtcaacacgaccacccgctcctgcgcattgtgggacttggaagaagatacggaatatatcgttcacgttcaagctatctctattcagggccagtctccagcttcagaacctgtgctttttaaaacgccgagagaagcggaaaagatggcttcgaagaataaagatgaagtgacgatgaaagaaatgggaaggaatcagcaattacggacgggcgaagtgttaataattgtggtagtcttgtttatgtgggcgggggtcattgcgctcttttgcagacaatatgacattattaaagataacgagccaaacaacaacaaagagaagactaaatcagcgagtgaaacatctacacctgaacatcagggcggaggtctattgagatctaaaatc

SEQ ID NO: 11633 - DNA, 588 bp, Artificial Sequence
  Description of Artificial Sequence: Synthetic coding sequence
atgagacggtggttggggtgcgtttgcttcgccctcgtacaagccgacagtccatccgcacccgtgaacgtgacagtacggcacttaaaggccaatagtgctgtagtcagctgggacgtccttgaagatgaggtggttatcggatttgctattagccagcaaaagaaggacgtgcgcatgctgcggttcatccaggaggtgaatactactacacgtagttgcgctctgtgggatctggaagaggatacagaatatatcgtgcacgtgcaagccatctcaatccagggtcaaagccctgcctccgaacccgttttgttcaaaaccccgcgagaagctgaaaaaatggcttccaagaacaaagatgaggtgaccatgaaagagatgggacgcaatcagcagctaaggaccggcgaggtgctgattatcgtggtcgtactcttcatgtgggcaggcgtgattgcactgttctgccggcagtatgacatcatcaaagacaatgagcccaacaacaataaggaaaagacaaagagcgcgagtgaaactagtacacctgagcatcaggggggcggtctactgaggtcgaagatt

SEQ ID NO: 11634 - DNA, 588 bp, Artificial Sequence
  Description of Artificial Sequence: Synthetic coding sequence
atgagaagatggttaggatgtgtttgttttgcattagttcaagctgattctccatcagctccagttaatgtcacagttagacatttaaaagcaaatagtgcagttgtttcatgggatgttcttgaagacgaagttgttattggatttgcaatttctcaacaaaagaaggatgttagaatgcttagatttattcaagaggtaaatactactactagaagttgtgcattatgggatttggaggaagacactgaatatattgtacatgttcaagctatttcaattcagggacaaagtccagcatcagagccagttctttttaaaactccaagagaagccgaaaaaatggcttcaaaaaataaagatgaagttactatgaaagaaatgggtagaaatcaacaattaagaactggagaagttcttataattgttgttgttttatttatgtgggctggagttatagcattattttgccgtcaatatgatattattaaagataatgaaccaaataataataaagaaaagactaaatctgcttcagaaacatcaacaccagagcatcaaggaggaggtttgttaagaagtaaaatt

SEQ ID NO: 11635 - DNA, 588 bp, Artificial Sequence
  Description of Artificial Sequence: Synthetic coding sequence
atgagaagatggctgggttgtgtgtgctttgcactggtgcaggcggactcgccgtccgcgccggtgaatgtcactgtccgccatctgaaagcaaacagcgcggtcgtttcgtgggatgtgctggaggacgaagtggttatcggcttcgctatctcgcaacagaagaaggatgtcagaatgcttcggttcatccaggaggtgaataccaccacccggagctgcgctctgtgggaccttgaagaagatactgaatacatcgtgcatgtgcaagcaatctccattcaaggacaatcgccggcctcggagccggtgctgttcaagactccacgcgaagcggaaaagatggcatcgaagaataaggatgaagtgactatgaaagagatgggcagaaaccagcaactgcggaccggcgaagtgctcattattgtcgtggtgctgttcatgtgggcaggagtgatcgccctgttctgtcggcagtacgacatcatcaaggacaatgagcccaacaacaacaaggaaaagacgaagtcagcatcggagacgtcaaccccagagcatcaaggaggaggcctcttgagatccaagatc

SEQ ID NO: 11636 - DNA, 588 bp, Artificial Sequence
  Description of Artificial Sequence: Synthetic coding sequence
atgcggcgatggctcggatgcgtgtgtttcgcactggtccaggcggatagcccgtctgccccggtgaatgtgactgttcgccatctgaaggccaactccgcggtggtgtcatgggatgtgctggaggacgaggtggtcattggattcgcgatcagccaacagaaaaaggatgtgcggatgctgcgcttcatccaggaagtcaacactactactaggagctgcgcgctctgggatctggaggaagatacggagtacatcgtccacgtccaggccatctccatccaagggcaatcccccgcatctgagccagtgctctttaagacccctcgcgaagctgagaagatggcatcgaagaacaaggacgaagtgacgatgaaagagatgggccggaaccagcagctgagaaccggcgaagtgcttatcattgtggtggtcctgttcatgtgggcaggcgtcatcgccttgttttgtaggcaatacgacatcatcaaggacaatgagccgaacaataacaaggaaaagaccaaatcggcgtcagaaacctctacgccagagcatcagggtggaggattgctccgctcgaagatc

SEQ ID NO: 11637 - DNA, 588 bp, Artificial Sequence
  Description of Artificial Sequence: Synthetic coding sequence
atgcgtcgctggcttggctgcgtatgcttcgccctggtccaggctgattcaccatccgccccggttaacgtcaccgtcagacatctgaaagcgaattcagccgtcgtgtcctgggatgtgctggaggacgaggtggttattggttttgctatttcccagcagaaaaaggatgtgcgaatgctgcgcttcatacaggaggtgaatacgacgactaggtcatgtgccttgtgggacctggaggaggataccgagtacattgttcatgttcaggcaatcagcatccaaggacagtcccctgctagcgaacctgtcctcttcaaaacccctcgcgaggctgagaagatggcttcaaagaacaaggacgaagttactatgaaagagatgggaagaaaccagcaacttcggaccggagaggtgctgattatcgttgtggtgctttttatgtgggccggagtcatagcacttttctgtcgccagtacgatataatcaaagacaatgaacctaataacaacaaagagaagactaaaagcgcctccgagacctccactcccgagcatcagggcggtggccttctgagatcaaaaatt

SEQ ID NO: 11638 - DNA, 588 bp, Artificial Sequence
  Description of Artificial Sequence: Synthetic coding sequence
atgcgacgctggctcggctgcgtgtgttttgcccttgtgcaagccgactccccatccgcaccggtgaacgtgaccgtgagacatctgaaggccaactctgccgtggtttcctgggatgtactggaggatgaagtggtgatcggttttgctatttcacaacagaagaaggatgtcagaatgcttcgattcattcaggaggtgaataccactacccgctcatgtgccctgtgggaccttgaagaggataccgagtacattgtccatgtccaagcaatctcgattcagggacaatcgcctgcctccgaacctgtcctgttcaaaacccctagagaagctgagaagatggcttcgaagaacaaggacgaagtgacgatgaaggaaatgggcaggaatcagcaactcagaactggggaagtcctgatcattgtggtggtgctgtttatgtgggctggtgtgatagcactcttctgccgccagtacgatatcattaaagacaacgagcccaataacaataaagaaaagacgaagtcggcatcagagacttcgacgccagaacatcaggggggtggtctgcttcgcagcaagatt

SEQ ID NO: 11639 - DNA, 588 bp, Artificial Sequence
  Description of Artificial Sequence: Synthetic coding sequence
atgcgcagatggctgggatgtgtgtgcttcgctttggtgcaggctgacagcccgtccgcgccggtgaatgtgaccgtgcgccacctgaaggccaactccgccgtcgtgtcgtgggatgtgctggaggatgaagtcgtgatcgggttcgccatcagccaacaaaagaaggatgtgaggatgctgcgcttcatccaagaagtgaataccactacccggtcatgtgcactctgggacctggaggaagataccgaatacatcgtgcacgtgcaagctatctcgatccagggacaatccccggcctcagaaccagtcctgttcaaaactccacgggaggcggagaagatggcctccaaaaacaaggatgaagtaaccatgaaagagatgggacgcaatcagcagctgcgcactggagaggtcctgatcatcgtcgtggtgctgttcatgtgggccggcgtgatcgctttgttctgccggcagtacgacatcatcaaagacaacgagccgaataacaacaaggaaaagactaagagcgcctcggaaacctcaactccggaacaccagggaggagggcttctgcggagcaagatc

SEQ ID NO: 11640 - DNA, 588 bp, Artificial Sequence
  Description of Artificial Sequence: Synthetic coding sequence
atgcgccggtggttaggctgtgtttgctttgcccttgttcaagccgattccccgtccgccccagtgaatgtgaccgtgcgccatctgaaggcgaacagcgcggtcgtgagctgggacgtactggaagacgaagtggtgatcgggttcgccatctcccagcagaaaaaggatgtgcggatgttgcggttcatccaagaagtgaatacgacaactcgcagctgcgcgctgtgggatttggaggaggatacagaatacattgtccatgttcaggccatctccatccagggccaatctccagctagcgagccggtgttattcaagaccccacgagaggcggaaaaaatggcgagcaagaataaggatgaggtgacgatgaaggagatgggccgtaaccaacagctgcgtaccggcgaagtgctgatcatcgtcgtcgtgttgtttatgtgggcaggagtcatagctctgttttgtcgacagtacgatatcattaaggataatgagccgaataacaataaagaaaagactaagagcgcttccgagaccagcaccccagagcaccagggagggggccttctccgctctaagata

SEQ ID NO: 11641 - DNA, 588 bp, Artificial Sequence
  Description of Artificial Sequence: Synthetic coding sequence
atgcggcggtggctgggatgcgtgtgcttcgccctggtgcaggcagattcgcccagcgccccggtgaatgtgaccgtgcgacacctcaaggctaacagcgccgtggtcagctgggacgtgctggaagatgaagtggtgatcggcttcgccatttcgcagcagaagaaggacgtgagaatgcttagatttatccaggaagttaacaccaccacccggtcatgcgccctgtgggatctggaagaagatactgaatacatcgtgcacgtgcaggcaatctcaatccaaggacagagccctgccagcgagccagtgcttttcaaaaccccacgcgaggctgaaaagatggcctccaagaataaggacgaagtgactatgaaagagatgggcagaaaccagcagctgcgcaccggggaagtcctgatcatcgtggtggtgctcttcatgtgggccggcgtgatcgcgctcttctgccgacaatacgacattatcaaagataatgaacctaataacaataaagaaaagacgaagtcggcctctgaaacttccactccggaacatcaggggggtggactcctgcgctccaaaatc

SEQ ID NO: 11642 - DNA, 588 bp, Artificial Sequence
  Description of Artificial Sequence: Synthetic coding sequence
atgcgccgttggctaggctgcgtctgcttcgcattagtacaggctgactccccttccgcccccgtcaacgtgactgtccgccacctcaaggccaacagcgctgtcgtttcctgggacgtgctcgaggatgaagtggttattgggtttgcaatttcacaacagaagaaagacgttcggatgctgcgctttatccaagaggtaaatacaaccaccaggtcttgtgcactgtgggacctggaagaggataccgaatacatagttcacgtacaggccatctctatccaggggcagagtcctgctagcgaacctgtcctgttcaaaacgccccgcgaggcagagaaaatggcatcaaagaataaggatgaagtgactatgaaagagatggggcgcaatcagcagctgagaaccggcgaggtgctcattattgttgtggttttgtttatgtgggcgggcgtgattgcattattttgcagacaatatgatatcattaaggacaatgaacccaacaacaataaagagaagactaagagcgcgtcagagacctcgacacccgaacatcagggaggtggccttctccgcagcaaaatc

SEQ ID NO: 11643 - DNA, 387 bp, Artificial Sequence
  Description of Artificial Sequence: Synthetic coding sequence
atgaagacactgcaatttttctttctcttttgctgttggaaagccatttgctgcaacagctgcgagttgacgaacatcactattgctattgagaaggaagagtgtcgattctgtatctcgatcaataccacatggtgcgctggctattgctacaccagggatctagtgtacaaggatccggcccgcccgaaaatccagaagacgtgcacctttaaagaattggtgtatgagaccgttcgtgtgcctggctgcgcccatcatgccgactcactgtacacttaccctgttgctactcagtgccattgtggtaaatgtgacagcgatagcacagattgcacagtgcgcggtctgggacccagctattgctcgtttggagagatgaaggaa

SEQ ID NO: 11644 - DNA, 387 bp, Artificial Sequence
  Description of Artificial Sequence: Synthetic coding sequence
atgaaaacactccagtttttctttctgttctgctgctggaaggccatctgttgtaactcgtgcgaactcaccaatatcacgattgctatcgagaaagaggagtgcaggttctgcatctcgatcaacactacatggtgcgctggatactgctatacccgcgaccttgtttacaaggatccagcacggcccaaaatccaaaaaacctgcacgttcaaggaactggtgtatgagacagtccgtgtacccggttgcgcccatcatgctgattcactttacacttatcctgtagcgacacagtgtcattgtgggaaatgtgactctgatagcacagactgtactgtccgtggccttggaccgtcttattgcagttttggcgagatgaaagag

SEQ ID NO: 11645 - DNA, 387 bp, Artificial Sequence
  Description of Artificial Sequence: Synthetic coding sequence
atgaaaactctgcagttctttttcctattctgctgctggaaggcaatctgctgcaactcctgcgaactgaccaatatcaccatcgccatcgaaaaggaggaatgtagattttgcatcagcatcaacactacttggtgcgccgggtactgctacactagagatttagtgtacaaggatcccgccaggccaaagatccaaaaaacgtgcactttcaaggagttggtatatgagactgttcgggttccaggctgcgcacaccacgcagattccctgtatacttaccccgtggcaactcagtgccattgcgggaaatgcgacagcgatagtacagattgcacagtgcgcggcctcggcccttcttactgctcttttggagagatgaaagaa

SEQ ID NO: 11646 - DNA, 387 bp, Artificial Sequence
  Description of Artificial Sequence: Synthetic coding sequence
atgaagacgctgcagttcttcttccttttctgttgctggaaggccatctgctgcaactcatgcgagctgaccaacattaccatcgcaatcgaaaaggaggagtgtcggttttgcatttctatcaataccacgtggtgcgctggctattgctatacgcgtgatctggtatacaaggatccggcccgtcctaagattcagaagacatgcaccttcaaggagctggtctatgagacagtgcgtgtccctggttgcgcgcaccatgcggatagtctctacacctaccccgtggctacgcaatgccactgtggcaagtgcgatagcgacagtaccgactgcaccgtccgcggccttggcccgtcgtactgttcctttggcgagatgaaagaa

SEQ ID NO: 11647 - DNA, 387 bp, Artificial Sequence
  Description of Artificial Sequence: Synthetic coding sequence
atgaagacgttgcagttctttttcttattctgctgttggaaggccatctgctgtaactcctgtgagttgaccaacatcacaatcgccatcgagaaggaggaatgccgattctgtattagcattaatactacctggtgtgcaggatattgttacactagagacctggtgtataaagatcctgctagacctaagattcagaagacttgcactttcaaagaattagtgtatgaaaccgtgagagtgcccgggtgcgcccaccacgccgatagtctgtatacataccccgtcgcgacacagtgtcattgtggcaaatgtgactcagattccacagactgtaccgtgagaggcctcggcccgtcttattgctccttcggagagatgaaagag

SEQ ID NO: 11648 - DNA, 387 bp, Artificial Sequence
  Description of Artificial Sequence: Synthetic coding sequence
atgaaaacgctccagtttttctttctgttttgttgttggaaagcaatttgctgtaacagctgtgagctgacgaatatcaccatcgccattgaaaaggaagaatgtcgcttctgtatctcaataaacactacctggtgtgcaggttactgctacaccagggaccttgtgtataaggacccggccagacccaagattcaaaagacctgcaccttcaaagaacttgtttacgaaacggtaagagtccctggctgtgctcatcacgcagattccctttacacctacccagtggcgacccaatgccattgtggcaagtgcgattcagacagtactgattgtactgtgcgtggactggggccttcgtactgcagctttggagagatgaaagag

SEQ ID NO: 11649 - DNA, 387 bp, Artificial Sequence
  Description of Artificial Sequence: Synthetic coding sequence
atgaagactcttcagttcttcttcttattctgctgttggaaggccatttgctgcaactcatgtgagctaactaacatcacaattgccatagagaaggaagaatgtaggttttgcatttccatcaacactacgtggtgcgcagggtactgctacacaagggaccttgtttataaagacccggctcgacctaagattcaaaaaacctgcacctttaaggagttggtttacgagacagtacgagttcctgggtgtgcacaccatgctgactcgctttatacatatcctgtcgccactcaatgtcactgcggtaaatgtgactcagactcaacagattgtactgttcgaggactaggtccttcatattgtagttttggcgaaatgaaggaa

SEQ ID NO: 11650 - DNA, 387 bp, Artificial Sequence
  Description of Artificial Sequence: Synthetic coding sequence
atgaaaactctgcagttcttcttcctcttttgctgctggaaggcgatctgttgtaattcgtgtgagctcaccaacatcaccatagccattgaaaaagaagaatgtcggttctgcatctcaatcaacaccacttggtgtgccggatactgttacactagagatctggtttacaaggatcccgcgcgcccgaagatccaaaagacgtgcactttcaaggaacttgtgtacgagacggtgcgcgtgccaggatgcgcacaccatgccgattcgctgtacacctacccggtggctactcagtgtcactgcgggaaatgtgacagcgactcgactgactgtaccgtgaggggattggggccgtcgtactgctctttcggagaaatgaaggag

SEQ ID NO: 11651 - DNA, 387 bp, Artificial Sequence
  Description of Artificial Sequence: Synthetic coding sequence
atgaaaaccttgcagttcttcttcctcttctgttgttggaaagcgatttgctgtaatagctgcgagctcaccaacatcaccatcgctatagaaaaagaggaatgccgcttttgcatcagcatcaacaccacctggtgcgcgggttactgctacactcgcgacctcgtctacaaggatcctgcccggccaaagatccaaaagacgtgcacgtttaaagaacttgtgtacgagacggtcagagtccctggatgcgcccaccatgctgactctctgtacacttacccggtggccactcagtgccactgcgggaagtgcgattcggattccacggactgtactgtgaggggcctgggaccatcgtattgctctttcggcgagatgaaagaa

SEQ ID NO: 11652 - DNA, 387 bp, Artificial Sequence
  Description of Artificial Sequence: Synthetic coding sequence
atgaaaactctgcaattcttctttttgttttgctgttggaaggccatctgttgcaattcatgcgaactcaccaatatcactattgctatcgaaaaggaggaatgcagattctgcatctccatcaacactacctggtgcgccggatattgctacacgagagatctcgtgtacaaagaccccgctagaccaaagatccaaaagacttgtacgttcaaagagctggtgtacgagactgtccgcgtgcctggctgcgctcaccatgcagacagcttgtacacctatccggtcgctacccagtgtcactgcggaaagtgcgattcggactcaaccgactgcaccgtgcgcggccttgggcctagctattgtagctttggagagatgaaggaa

SEQ ID NO: 11653 - DNA, 387 bp, Artificial Sequence
  Description of Artificial Sequence: Synthetic coding sequence
atgaagacgctgcagttcttcttcttgttctgttgttggaaagctatctgctgtaactcgtgcgaacttaccaatatcaccattgcaatcgagaaagaagagtgcagattttgtatatcaataaacactacatggtgtgcgggttattgttacactcgagatctggtttacaaagatccggcacggcctaagatccagaagacgtgcaccttcaaggaactggtgtatgaaacagtgagggtgcccggatgcgcccaccatgccgattcgttgtatacataccctgttgcaactcagtgtcactgcgggaagtgcgactctgactctactgattgcacagttcgtggcctcggacccagttactgttctttcggcgagatgaaagag

SEQ ID NO: 11654 - DNA, 387 bp, Artificial Sequence
  Description of Artificial Sequence: Synthetic coding sequence
atgaagaccctacagtttttcttcttattttgctgttggaaggctatctgttgcaatagctgtgagctcaccaatatcaccatagcgatcgagaaggaggaatgccggttctgtatttctattaacaccacctggtgcgctggttactgctatactagggacctggtttataaagatccagcccgccccaagatacaaaagacatgcactttcaaggagcttgtgtacgaaaccgtacgtgtccctggatgcgctcatcacgccgacagtctgtacacctatcccgtggccacccagtgccactgcggaaagtgtgatagtgattcaaccgactgcacggtgagaggacttggacccagttattgcagctttggtgagatgaaggaa

SEQ ID NO: 11655 - DNA, 387 bp, Artificial Sequence
  Description of Artificial Sequence: Synthetic coding sequence
atgaagacccttcagtttttttttctcttctgttgctggaaggccatctgctgtaatagctgcgagctgactaatatcaccatcgccatcgaaaaagaagagtgcaggttctgcatttccataaacactacatggtgtgccggctattgctacactcgcgatctggtgtataaggatccggccagacccaaaattcagaagacttgtacgttcaaagagctcgtgtacgaaaccgtgcgagtgcctggctgcgctcatcatgctgattctttgtatacctaccctgtagcgacccaatgtcactgtggcaaatgtgacagtgatagcaccgactgtaccgtgcgaggactgggtccgtcatactgttcattcggcgaaatgaaggag

SEQ ID NO: 11656 - DNA, 387 bp, Artificial Sequence
  Description of Artificial Sequence: Synthetic coding sequence
atgaagaccctgcaattcttcttcctcttctgctgttggaaagcaatctgctgtaattcatgcgaactgacaaacataacaattgcaatcgaaaaagaagagtgtcggttttgcatcagcatcaacacaacttggtgcgcaggctactgttacacacgggatctggtgtataaggaccctgcccggcccaagatccagaagacttgtacctttaaagaacttgtctacgagacagtgcgagtcccggggtgcgcacaccacgcggattccctttacacctatccggtggcgacccagtgtcactgtgggaagtgcgattccgatagcacagactgcacggttagaggcctcggtccaagctattgcagtttcggtgagatgaaggag

SEQ ID NO: 11657 - DNA, 387 bp, Artificial Sequence
  Description of Artificial Sequence: Synthetic coding sequence
atgaaaacgcttcagttcttttttctcttctgctgctggaaagccatctgctgcaactcctgcgagctgaccaatatcaccatcgccatcgagaaggaagaatgtagattctgcatctcgatcaacactacctggtgcgccggttactgttacacgcgcgacctggtgtacaaagacccggcaagaccgaagatccaaaagacctgcaccttcaaggagttggtctacgaaactgtgcgggtcccaggatgtgcccaccatgccgactcattgtacacctaccccgttgccacccagtgtcattgcggaaagtgcgactcggactccaccgattgtacggtgagaggactcgggccctcttactgctccttcggagagatgaaagaa

SEQ ID NO: 11658 - DNA, 387 bp, Artificial Sequence
  Description of Artificial Sequence: Synthetic coding sequence
atgaagactcttcagttttttttcctgttctgctgttggaaggccatctgttgcaactcttgcgaacttacaaatatcacgattgctattgagaaggaggagtgccgcttttgtatatcaatcaacacaacttggtgcgctggatattgctacacgcgggatctggtctacaaggaccctgcccgcccaaagatccagaagacttgtactttcaaggagctagtgtacgagacagtgcgtgtccccgggtgtgcccaccacgcagattctctgtatacgtatccagtcgcaacccagtgtcactgcggtaaatgcgatagcgacagtacggactgcacagtgcgcggccttggtccatcttattgctctttcggcgagatgaaggaa

SEQ ID NO: 11659 - DNA, 387 bp, Artificial Sequence
  Description of Artificial Sequence: Synthetic coding sequence
atgaagacactgcagttcttttttttattctgctgttggaaggcaatctgctgcaactcttgcgagttgacgaatatcaccatcgcaatcgagaaggaggagtgccgcttttgtatcagtattaacacaacctggtgcgccggatactgctataccagggatctcgtgtacaaggatccagcccgccccaaaattcagaagacctgtacgttcaaggagctggtgtacgaaaccgttagggtgcctggatgcgctcaccatgcggacagcttatacacttaccctgtggccacccaatgtcactgtggcaagtgtgatagtgactctacagattgcacggtcaggggtctggggccgagctactgcagtttcggagagatgaaagag

SEQ ID NO: 11660 - DNA, 387 bp, Artificial Sequence
  Description of Artificial Sequence: Synthetic coding sequence
atgaaaaccctgcaattctttttccttttctgttgctggaaggccatttgttgtaactcctgcgagctgaccaacatcaccatcgccattgagaaggaagaatgccgattttgcatttcgatcaacaccacttggtgtgcaggatactgttacactagagatctggtgtacaaggatcctgcacggcccaagattcaaaagacttgtacctttaaggaattggtctacgaaaccgtgcgggtgcctggctgtgcacaccacgccgattccctctacacctaccctgtcgcaactcagtgtcactgcggaaaatgtgactccgatagcaccgactgtaccgtgcgtggacttggaccctcctactgttcattcggggaaatgaaggag

SEQ ID NO: 11661 - DNA, 387 bp, Artificial Sequence
  Description of Artificial Sequence: Synthetic coding sequence
atgaagacactgcagtttttcttcctgttctgttgctggaaagctatttgttgcaattcttgtgaacttaccaacataactattgccatagagaaggaggagtgccgcttttgtatctcaattaatacaacctggtgtgccggctactgttatactagagatctagtttataaggaccccgcccgaccaaaaattcagaaaacttgcacctttaaggagctagtctatgaaacagtaagggtgcccggatgtgcccatcacgctgactctctctatacataccctgtggccacccaatgtcattgtggtaaatgtgattcggacagcaccgattgcactgtgagaggcctcgggcccagttactgttccttcggggaaatgaaggag

SEQ ID NO: 11662 - DNA, 387 bp, Artificial Sequence
  Description of Artificial Sequence: Synthetic coding sequence
atgaaaaccctgcagttctttttcttattctgctgttggaaagccatctgctgcaacagttgcgagcttaccaatattactatcgctattgagaaggaggagtgtcgattttgcattagcattaacactacatggtgtgcaggctattgctacacaagggatcttgtctataaagatccagcacgccctaagatccaaaagacctgtacattcaaggagctggtttatgaaaccgtgagggtgcctggctgtgctcaccacgcagattcgctttacacctaccccgtcgccacccagtgtcattgtggaaagtgcgacagtgattccacggattgcacagtacggggtcttggcccatcctattgcagcttcggagaaatgaaagaa

SEQ ID NO: 11663 - DNA, 387 bp, Artificial Sequence
  Description of Artificial Sequence: Synthetic coding sequence
atgaaaactcttcagttcttcttcctcttttgctgttggaaggcgatctgttgtaatagttgtgagcttaccaatatcactattgctattgaaaaagaagagtgtaggttttgcatctcgatcaacactacctggtgcgcaggttactgttacactcgtgacctggtgtacaaggatccagcacgaccgaaaattcagaaaacctgcacgttcaaggaactcgtgtacgaaactgtgcgcgtccctggttgcgcacatcacgccgatagcctgtacacctacccggtggcaacgcaatgtcactgtggaaagtgcgactcagattccactgactgtactgtgcgcggacttgggccatcgtactgtagctttggagaaatgaaggaa

SEQ ID NO: 11664 - DNA, 387 bp, Artificial Sequence
  Description of Artificial Sequence: Synthetic coding sequence
atgaaaacgctgcagttctttttcctgttctgttgctggaaggcaatctgttgcaatagctgcgaactgaccaatatcaccatcgctattgagaaggaagagtgtagattctgtatctcgatcaacactacttggtgtgccggatattgctacacccgagatctggtgtacaaagacccggcccgcccgaagatccagaaaacctgtaccttcaaggaactcgtttacgaaactgtgcgggtgcccggatgcgcacatcacgcggactcgctttacacctaccccgtggcgactcaatgccactgcggtaaatgcgacagcgactctaccgattgcacggtgcgcggcttgggaccatcatactgctcattcggagagatgaaggaa

SEQ ID NO: 11665 - DNA, 387 bp, Artificial Sequence
  Description of Artificial Sequence: Synthetic coding sequence
atgaagaccctacaatttttcttccttttctgctgttggaaagcgatctgctgcaattcctgcgaactgacaaatatcacaatcgcaatcgagaaggaagagtgtagattctgtatcagtataaacaccacatggtgcgccgggtactgctacacgagagacctggtttataaagatccagccagaccaaagatccaaaagacttgtacctttaaagagctggtgtacgagaccgtccgagtgcctggctgtgcccaccacgccgactctctctacacctatcccgtggcgactcagtgccactgtgggaagtgcgactctgacagcacagactgcactgttagaggtctgggaccctcttactgttcatttggagaaatgaaagag

SEQ ID NO: 11666 - DNA, 387 bp, Artificial Sequence
  Description of Artificial Sequence: Synthetic coding sequence
atgaaaactctgcagttcttttttcttttctgttgctggaaggcaatctgctgtaattcgtgcgagctgactaacatcaccatcgctattgagaaggaagaatgccgtttctgtatttcgatcaacactacctggtgtgcggggtactgttacacccgcgaccttgtctacaaggatccagcaagacccaaaatccaaaagacctgtacttttaaggaactggtgtatgaaactgtccgggtgcctggttgtgcacaccatgcggactcgctttacacttaccccgtggcaactcaatgccattgtgggaaatgcgatagcgattcgactgattgcacggtgcgtggactgggaccctcgtactgttcctttggcgagatgaaagaa

SEQ ID NO: 11667 - DNA, 387 bp, Artificial Sequence
  Description of Artificial Sequence: Synthetic coding sequence
atgaaaacccttcagtttttctttcttttctgttgttggaaggcgatttgctgtaatagctgcgaacttactaacatcactattgccatcgaaaaagaagagtgccgtttctgcatttcgattaacaccacctggtgtgcaggttactgttacaccagagatctggtgtacaaagaccccgcaagacctaagatacaaaagacttgtacttttaaggagctggtctacgaaacggtgcgggtcccaggttgcgcacatcatgccgactcgctgtacacttatccagtggccactcaatgtcattgtggaaagtgtgactcggattcgaccgactgcactgtgaggggactgggcccctcatactgttcattcggagaaatgaaagag

SEQ ID NO: 11668 - DNA, 387 bp, Artificial Sequence
  Description of Artificial Sequence: Synthetic coding sequence
atgaagacacttcagtttttcttcctattctgttgctggaaggctatttgttgtaactcttgtgaactgactaacataactattgccatcgaaaaagaagaatgcaggttctgtatctctatcaacactacatggtgtgctgggtactgttatacacgggatcttgtgtataaagatcctgccagaccgaaaatccagaaaacttgtacatttaaggaactcgtgtatgaaactgtgcgggtgcccggatgtgctcaccacgcggattctttatatacatatcccgtagcgacacagtgtcactgtgggaaatgtgattcagattcaactgattgcactgtcagggggctagggccttcttactgctctttcggagaaatgaaagaa

SEQ ID NO: 11669 - DNA, 387 bp, Artificial Sequence
  Description of Artificial Sequence: Synthetic coding sequence
atgaagacattgcagttcttcttcctgttctgctgctggaaagctatctgctgcaatagttgtgaattgactaatattactatcgccatcgagaaagaagaatgtagattctgcatatccatcaatactacttggtgcgcgggatattgttacactcgggatctcgtgtataaagatcctgccagacccaaaattcagaagacctgtacatttaaggaattagtgtacgagactgttcgcgtgcccggctgtgcacatcacgccgattcactgtacacatatcctgtagctacccagtgtcattgtggtaagtgcgactctgactcaactgattgtacagtgcgaggattgggcccttcttattgttccttcggtgaaatgaaggag

SEQ ID NO: 11670 - DNA, 387 bp, Artificial Sequence
  Description of Artificial Sequence: Synthetic coding sequence
atgaaaacgttgcagttcttctttctattttgctgttggaaagcaatctgctgcaactcctgcgagctgacaaacattacaatagcaatcgagaaggaggaatgtagattttgtatctccataaacaccacctggtgtgccggctattgctacacacgcgatcttgtgtacaaggatccagctaggcctaagatccagaagacctgcacatttaaagagctcgtatacgagactgtgcgcgtgcccggctgcgcacaccatgccgacagcctttatacctatcccgtcgccacacaatgtcactgcggaaagtgtgacagcgacagcaccgactgtactgttcgtggtctgggcccaagttattgctcttttggcgagatgaaagaa

SEQ ID NO: 11671 - DNA, 387 bp, Artificial Sequence
  Description of Artificial Sequence: Synthetic coding sequence
atgaaaaccctccagttctttttcctgttctgctgctggaaggctatctgctgtaattcttgcgagttgaccaacattacaatagctatagagaaagaggagtgcaggttctgtatcagcataaacacaacctggtgtgcggggtactgttatacacgggatttggtttacaaagacccagcacggcccaagattcagaagacatgtacgtttaaagaactggtgtacgagacagttagagttcctgggtgcgcccaccatgccgatagcttgtatacttacccagtggccactcagtgccactgtggcaagtgtgactcagattccaccgactgcacggtccgtggacttggaccgtcgtactgctccttcggcgaaatgaaggag

SEQ ID NO: 11672 - DNA, 387 bp, Artificial Sequence
  Description of Artificial Sequence: Synthetic coding sequence
atgaagactcttcagttcttcttcttgttctgttgttggaaagcaatttgttgtaattcttgtgaactcacgaacattactatcgcaattgagaaggaggaatgccggttctgcatctcgataaatacgacgtggtgcgccggttactgctatacgagggaccttgtgtacaaagatcccgcgaggcccaaaattcagaagacctgcacttttaaagaattggtgtacgagacggtgagagttcccggctgcgcccaccacgctgatagcctctacacatacccagtagcgacccagtgtcattgcggaaaatgcgattcagattcgacagactgcacagtcagaggtttggggccaagctattgttcgtttggcgagatgaaagag

SEQ ID NO: 11673 - DNA, 387 bp, Artificial Sequence
  Description of Artificial Sequence: Synthetic coding sequence
atgaaaactcttcaattcttcttccttttttgttgctggaaggctatatgttgcaattcgtgtgaactcaccaatatcaccatcgcaattgaaaaggaggagtgcagattttgtatttcaataaacaccacctggtgtgcgggatactgctatacccgcgatctcgtgtacaaggatccagcccgtcccaaaatccaaaagacgtgcacttttaaggagcttgtgtatgaaaccgtcagagtgccgggttgtgctcaccatgcagactccctctacacctaccccgtggcaacccagtgtcactgcggtaagtgtgattcagacagcactgactgtacggtgcgcggactggggccatcctattgctccttcggagagatgaaggaa

SEQ ID NO: 11674 - DNA, 387 bp, Artificial Sequence
  Description of Artificial Sequence: Synthetic coding sequence
atgaaaacgttgcaattcttttttctcttctgttgttggaaggccatctgttgcaatagctgcgagctgaccaatatcactattgccatcgaaaaggaagaatgccgcttctgcataagcatcaacacgacctggtgcgcgggctactgttatacccgcgacctggtctacaaggacccggcccgaccaaagatccagaaaacctgtactttcaaagaactggtctacgaaactgtccgggtgccgggttgcgcccaccacgcagacagcctctacacttatcccgttgccactcaatgccattgcggcaaatgtgactcggattccaccgattgcaccgtgaggggcttgggaccgtcgtactgctcattcggagaaatgaaggaa

SEQ ID NO: 11675 - DNA, 387 bp, Artificial Sequence
  Description of Artificial Sequence: Synthetic coding sequence
atgaaaacgctgcagttcttcttcttgttttgttgttggaaagccatctgttgcaattcttgtgagctgaccaacattacgatcgcaatcgaaaaggaggagtgcagattttgcatcagtatcaatacaacctggtgcgcaggatactgctacacacgtgatctggtatacaaagatcccgcccgtcccaagattcagaaaacttgcacctttaaggagctggtttatgagaccgtgcgcgtgccaggttgtgcgcatcatgcagacagcctgtacacctatcccgtggctactcagtgccactgcggaaagtgcgacagtgattcaactgactgcactgtccgggggttggggccctcatattgctcctttggagaaatgaaggag

SEQ ID NO: 11676 - DNA, 387 bp, Artificial Sequence
  Description of Artificial Sequence: Synthetic coding sequence
atgaaaaccctgcaattctttttccttttttgctgttggaaagcaatctgttgtaactcctgcgaactcactaatatcactattgcgatcgaaaaggaggaatgtcgcttttgcatttcaattaacacgacctggtgcgccggctactgttacacccgagatcttgtgtacaaggacccagcacgtccaaagatacagaaaacttgcacgtttaaggagctcgtgtacgaaacggttcgggtccctggatgtgctcatcacgccgacagtctctacacgtatcccgtcgcaacgcagtgtcattgtggaaagtgtgattccgattctaccgattgtaccgttagaggactggggccgagctactgcagcttcggtgaaatgaaggaa

SEQ ID NO: 11677 - DNA, 387 bp, Artificial Sequence
  Description of Artificial Sequence: Synthetic coding sequence
atgaagaccctgcagttctttttcctcttttgttgctggaaagcaatctgttgcaactcatgtgaactgacaaatatcaccatcgcaattgaaaaagaggaatgccgcttctgtatctctattaacaccacttggtgtgcgggatattgctatacccgcgatcttgtgtacaaggacccggcacgccccaaaatccagaaaacgtgtacgttcaaagaattggtttatgagacggtgcgcgtgcctggctgtgcacaccacgcagactcactctacacctaccctgtagctacacaatgccattgtggcaaatgcgattcagactctacagactgtaccgtgagaggcctcggtcccagctactgcagctttggagagatgaaggaa

SEQ ID NO: 11678 - DNA, 387 bp, Artificial Sequence
  Description of Artificial Sequence: Synthetic coding sequence
atgaagacccttcagtttttttttctcttctgctgttggaaggccatctgctgtaatagctgcgagctcaccaatattaccatcgccatagaaaaggaggagtgccgcttttgcatcagcatcaacaccacctggtgcgccggatactgctatacgcgggatctggtgtataaggatccagccaggcccaagatacaaaagacctgcacgttcaaagaactggtgtatgagaccgtcagagtacctggctgtgcccaccacgccgactctctttacacataccctgtagcgacgcaatgtcactgcggaaaatgcgactctgacagcactgattgtaccgtgagaggcctcggaccctcatactgctcattcggcgaaatgaaggaa

SEQ ID NO: 11679 - DNA, 387 bp, Artificial Sequence
  Description of Artificial Sequence: Synthetic coding sequence
atgaaaacgttacaatttttttttttattttgttgttggaaagcgatatgttgtaattcgtgtgaattaacgaatataacgatagcgatagaaaaagaagaatgtcgtttttgtatatcgataaatacgacgtggtgtgcgggttattgttatacgcgtgatttagtttataaagatccggcgcgtccgaaaatacaaaaaacgtgtacgtttaaagaattagtttatgaaacggtacgagtaccgggttgtgcgcatcatgcggattcgttatatacgtatccggtagcgacgcaatgtcattgtggtaaatgtgattcggattcgacggattgtacggtacgtggtttaggtccgtcgtattgttcgtttggtgaaatgaaagaa

SEQ ID NO: 11680 - DNA, 387 bp, Artificial Sequence
  Description of Artificial Sequence: Synthetic coding sequence
atgaaaacattgcagttttttttcctcttttgttgctggaaagccatatgctgcaattcctgcgaactgaccaacatcaccattgccatcgaaaaagaggagtgccgcttttgcatctctatcaataccacctggtgcgctggatactgttatacccgcgatttggtctacaaggacccagcgaggcccaagatccaaaagacctgtaccttcaaggagttggtgtatgaaaccgttcgcgtgcctggatgtgcgcatcatgcggactctctgtacacgtatcctgtcgccacgcagtgccactgcggtaagtgcgattctgattcaacggattgcacggtacgcgggctggggccaagctactgctctttcggcgagatgaaggag

SEQ ID NO: 11681 - DNA, 387 bp, Artificial Sequence
  Description of Artificial Sequence: Synthetic coding sequence
atgaaaaccctccaattcttttttctgttttgttgttggaaggcaatttgttgcaacagctgtgaactcactaacattactatagctatcgagaaggaagagtgccggttttgcatctcaataaacaccacctggtgcgcaggatactgttacacccgtgatctggtgtacaaggatccagcgcgacctaagattcagaaaacctgtacctttaaggagctggtgtatgagactgtgcgcgtgccaggatgcgctcaccatgccgattcgctctacacttaccctgtcgcaacccaatgccattgcggcaagtgtgactccgattcgaccgattgcactgtgcgcggtctgggaccatcatactgttcgtttggcgagatgaaggag

SEQ ID NO: 11682 - DNA, 387 bp, Artificial Sequence
  Description of Artificial Sequence: Synthetic coding sequence
atgaagaccctacagttctttttcctcttctgttgttggaaggcgatttgctgtaattcttgtgaactgactaatattacaatcgctatcgaaaaggaagagtgcagattttgtatctccatcaacactacctggtgtgccggctactgctacaccagagatcttgtgtataaagaccccgcaagacctaagatccaaaagacatgcacttttaaagagctggtatacgaaaccgtgcgggtaccaggctgcgcacatcacgccgattctttatacacataccctgtggctactcaatgtcattgtggaaagtgtgactcagactccaccgattgcactgtcagaggcttgggaccatcatattgtagcttcggcgagatgaaggag

SEQ ID NO: 11683 - DNA, 387 bp, Artificial Sequence
  Description of Artificial Sequence: Synthetic coding sequence
atgaagacacttcagttcttctttctcttttgctgctggaaggctatctgttgtaattcatgcgagctcacaaatatcactattgctattgaaaaggaggaatgtcgattttgcattagcataaacacaacctggtgcgcaggctactgctacactagggatttggtgtacaaggaccccgcgaggcccaaaatacagaagacatgcacctttaaggaattggtgtatgagacagtacgcgtgcccgggtgtgctcatcatgcagactccctgtacacatacccagtcgccacccagtgtcattgtggcaaatgtgactccgatagcaccgactgcactgtgcgtggtctgggtccttcctattgtagctttggagagatgaaggaa

SEQ ID NO: 11684 - DNA, 387 bp, Artificial Sequence
  Description of Artificial Sequence: Synthetic coding sequence
atgaaaactcttcaatttttttttcttttttgttgttggaaagctatttgttgtaatagttgtgaacttacaaatataacaattgctattgagaaggaagagtgtcgattttgtatttcaataaatacaacttggtgtgctgggtattgttatactagagatcttgtttataaagatccagcaagaccaaaaattcaaaagacttgtacttttaaagaattagtttatgaaactgttcgagtaccaggatgtgctcatcatgcagattctctttatacttatccagttgcaacacaatgtcattgtggaaagtgtgactcagattctacagattgtacagttcgtggattgggaccatcatattgtagtttcggagaaatgaaagaa

SEQ ID NO: 11685 - DNA, 387 bp, Artificial Sequence
  Description of Artificial Sequence: Synthetic coding sequence
atgaaaactctccagttctttttccttttctgttgttggaaggcaatttgttgtaactcatgcgaactgactaacattacgatcgcaattgaaaaggaagagtgtaggttttgcatttcaattaacaccacctggtgcgcaggatactgttacacccgggacctcgtctataaggatccggccagacctaagattcaaaagacttgtacctttaaggagcttgtgtacgaaaccgtgcgtgtccctggttgtgcacatcacgctgactcactttacacttaccctgtcgcgactcagtgtcattgtggaaagtgtgacagcgattccaccgactgtactgtcaggggactcggcccatcctactgctcgtttggagaaatgaaggaa

SEQ ID NO: 11686 - DNA, 387 bp, Artificial Sequence
  Description of Artificial Sequence: Synthetic coding sequence
atgaagactctccagtttttcttcctgttttgctgttggaaagcgatctgttgcaacagttgcgagctgactaatattaccatcgccatagaaaaggaggagtgcaggttctgtatcagtatcaacactacgtggtgtgctgggtattgttataccagagatctcgtgtacaaggaccccgcgcgcccaaagatacagaagacctgcacctttaaggagttggtgtacgagaccgtaagagtgcccggctgcgcccatcacgctgatagcctttatacgtaccctgtcgccacccagtgtcactgcggcaaatgcgactccgattccacagactgcaccgtacgaggtctagggccgtcttactgttctttcggcgagatgaaagaa

SEQ ID NO: 11687 - DNA, 387 bp, Artificial Sequence
  Description of Artificial Sequence: Synthetic coding sequence
atgaagaccctccagttcttcttcctgttttgttgctggaaagcaatttgctgcaattcctgtgaactgacaaacattaccattgctatcgagaaagaagagtgccgattttgtatcagcatcaatacaacctggtgcgccggctactgctatacccgcgaccttgtgtacaaggatcctgctcgccccaaaatccagaaaacgtgcacgttcaaagaactggtctatgaaacggtccgggtgcctggctgcgcacatcatgctgattctctttatacctatcctgtggcaacccagtgccactgtggaaaatgtgattctgactcaaccgactgtactgtgcgtgggctcggcccaagctactgcagcttcggcgagatgaaggag

SEQ ID NO: 11688 - DNA, 387 bp, Artificial Sequence
  Description of Artificial Sequence: Synthetic coding sequence
atgaaaaccctccagtttttttttctcttttgctgctggaaggccatttgttgtaacagctgtgagctcaccaatatcacaattgccatcgagaaagaggaatgcaggttttgtatcagcattaataccacatggtgtgccggctactgttatactagggatctcgtgtataaggaccccgcacggcccaaaatccagaagacttgtaccttcaaagaactggtatacgaaaccgtgcgggttcccggatgcgcacatcatgccgacagcctgtacacctaccctgtggccactcagtgtcactgcggcaaatgcgattcagactctacagactgcactgttcggggactaggacccagttactgtagtttcggcgaaatgaaggaa

SEQ ID NO: 11689 - DNA, 387 bp, Artificial Sequence
  Description of Artificial Sequence: Synthetic coding sequence
atgaagaccctgcagtttttcttcctcttttgttgttggaaagccatctgctgcaactcatgcgagctaacaaatattacaattgccattgaaaaggaagaatgtagattttgtatcagcatcaacaccacatggtgtgccggatattgttatactcgagacctcgtctacaaagaccctgcacgtcctaagatccagaagacatgtacatttaaagagctggtctatgaaaccgtgcgtgtccctgggtgtgcccaccatgccgacagtctgtacacatatccggtagctacccagtgccactgtggcaaatgcgatagcgactcgacagattgcaccgtgagaggcctggggccatcatactgctctttcggagagatgaaggag

SEQ ID NO: 11690 - DNA, 387 bp, Artificial Sequence
  Description of Artificial Sequence: Synthetic coding sequence
atgaaaacgctgcagttctttttcctgttctgttgctggaaggccatctgctgcaattcatgcgagctgaccaacataaccattgctatcgagaaagaggaatgcaggttttgcatctcgatcaacaccacctggtgcgcaggctactgttacacccgggacctggtgtacaaggacccggcgcggccgaagattcaaaagacctgcacctttaaggagctcgtctacgagactgtgagagtgcctggatgcgcccatcatgccgactcattgtatacctacccggtggcgacccagtgccactgcggaaaatgcgactcagatagcaccgactgcactgtgagaggactcggaccgagctactgctcgttcggagagatgaaggaa

SEQ ID NO: 11691 - DNA, 387 bp, Artificial Sequence
  Description of Artificial Sequence: Synthetic coding sequence
atgaaaaccctgcaattcttcttcctcttttgctgctggaaagcgatttgttgcaactcctgcgagttgactaatatcaccatcgcaatcgaaaaggaagaatgcagattttgcatctccatcaacactacttggtgcgccgggtactgttacacccgggacctggtctacaaggatcccgcccgccctaagatccagaaaacctgtactttcaaggagcttgtgtacgagacggtgagggtcccgggatgcgctcatcacgcggacagcctctacacgtatccagtggccacccagtgccactgcggtaagtgcgattcggacagcaccgactgtactgtgcgcggcctgggaccgtcatactgttcgttcggagagatgaaggaa

SEQ ID NO: 11692 - DNA, 387 bp, Artificial Sequence
  Description of Artificial Sequence: Synthetic coding sequence
atgaaaaccctccagtttttcttcctcttctgctgctggaaggcaatctgttgtaactcgtgcgaactcactaatatcacgattgctatcgaaaaagaggagtgccgcttctgtatctctatcaatactacctggtgtgccggatactgttacacccgtgatctggtgtacaaggatcccgctcggcctaagatccagaaaacctgcaccttcaaagaactcgtgtacgagactgtgcgggtcccggggtgcgcacaccatgccgactccctctacacctacccggtggccacccaatgccactgcggaaaatgcgactccgattccaccgactgtaccgtcagaggactgggcccctcgtactgctcgttcggcgagatgaaggaa

SEQ ID NO: 11693 - DNA, 387 bp, Artificial Sequence
  Description of Artificial Sequence: Synthetic coding sequence
atgaaaaccttgcaattcttctttcttttttgttgctggaaggccatctgttgcaactcttgcgaactcaccaacattacgattgccattgaaaaggaggaatgtaggttctgtatcagcataaacacaacctggtgtgccggctactgttatacccgagacctcgtttacaaagaccccgcgcgccctaagatccagaagacatgtaccttcaaagaactggtgtacgagacggtcagagtgcctggctgcgcccatcacgcagatagcctgtatacctatcccgtcgccactcagtgccattgcggcaaatgcgactccgactctacggactgtacagtccggggcctggggcccagctactgttcgttcggggagatgaaggaa

SEQ ID NO: 11694 - DNA, 387 bp, Artificial Sequence
  Description of Artificial Sequence: Synthetic coding sequence
atgaaaacgctgcagtttttttttctcttctgttgctggaaggccatctgttgtaacagctgtgagctaactaacatcaccattgcaattgaaaaagaagagtgtagattctgcattagtatcaatacaacatggtgcgccggttactgctatacacgcgatctggtatataaggacccggcccgtccaaagattcagaagacatgcaccttcaaggagctagtgtatgagaccgtgcgggtgccaggatgcgcacaccatgctgattctctgtacacatacccagtcgcaacccaatgccattgtggaaaatgcgatagcgattctaccgactgtactgtgagggggttgggcccctcctattgttcttttggtgagatgaaggaa

SEQ ID NO: 11695 - DNA, 387 bp, Artificial Sequence
  Description of Artificial Sequence: Synthetic coding sequence
atgaaaactttgcaattcttcttcctgttctgctgctggaaggcgatctgctgcaatagctgcgagctgactaacatcactattgctatcgaaaaggaggaatgccggttctgtatcagcatcaacactacttggtgcgcgggctactgctacacccgcgacctggtctataaggatccggctcggccaaagatccaaaagacttgcacgttcaaagaacttgtgtacgaaaccgtgcgcgtgcccgggtgtgcacatcacgcggactccctctacacctaccctgtggccacgcaatgccactgtggcaagtgcgacagcgactcaaccgactgcaccgtgcgggggcttggaccatcctactgctcgttcggagagatgaaagaa

SEQ ID NO: 11696 - DNA, 387 bp, Artificial Sequence
  Description of Artificial Sequence: Synthetic coding sequence
atgaaaactctgcagtttttcttcctgttttgctgttggaaagccatttgctgtaacagctgtgagctgacaaatattacgatcgctatcgaaaaagaggaatgtcgtttctgtatctcgatcaacacgacctggtgtgccggatactgttacacgagggacctggtctacaaagacccagccagaccaaagatccagaagacttgtaccttcaaagagctggtctacgaaaccgttagggtccctgggtgtgcacaccacgccgactctctatacacctatcccgttgccacccagtgccactgcggaaaatgtgactccgatagcactgattgtacggtgcgcggcctagggccctcgtactgttcctttggggaaatgaaagag

SEQ ID NO: 11697 - DNA, 387 bp, Artificial Sequence; identical to SEQ ID NO: 11670
  Description of Artificial Sequence: Synthetic coding sequence

SEQ ID NO: 11698 - DNA, 387 bp, Artificial Sequence
  Description of Artificial Sequence: Synthetic coding sequence
atgaaaacgctccagttctttttcctgttttgttgctggaaggccatttgttgtaacagctgcgagcttactaatatcaccatagccatagagaaggaggaatgccggttctgtatctcgatcaatactacctggtgcgctggctactgctacacgcgggatctagtgtataaggatcctgcacgcccgaaaatacagaaaacgtgcaccttcaaagagcttgtgtatgaaaccgttcgggtgcctggatgtgcccaccacgcagattccctctatacgtaccccgtggcaacccagtgtcactgtggaaaatgtgatagtgacagcaccgactgtacagtcagaggactgggtccatcgtattgtagttttggcgaaatgaaggag

SEQ ID NO: 11699 - DNA, 387 bp, Artificial Sequence
  Description of Artificial Sequence: Synthetic coding sequence
atgaaaacacttcagtttttttttctgttttgttgttggaaagcaatatgttgcaatagttgtgaactgactaacataactatagctatagaaaaagaagaatgcagattctgtatttctattaacactacatggtgtgcgggatattgttacactcgcgaccttgtgtacaaagatccagcaagacctaaaattcagaaaacttgcacttttaaagaactcgtctatgaaacagttagggtccccgggtgtgcacatcatgcggactcactatatacttatccagtcgctactcagtgccattgcgggaaatgcgattcagattcaactgattgcacagtaagaggactcgggccaagttattgttcttttggagagatgaaagag

SEQ ID NO: 11700 - DNA, 387 bp, Artificial Sequence
  Description of Artificial Sequence: Synthetic coding sequence
atgaaaactttgcagttcttctttcttttctgctgctggaaagccatctgctgtaactcgtgcgaactgaccaatatcaccatcgccattgaaaaggaagaatgcagattctgtatctcaattaacaccacctggtgcgcgggttactgttacacgcgtgacctggtctacaaggaccctgcacgacccaagatccaaaagacgtgcactttcaaggagctcgtgtacgagactgtgcgcgtcccagggtgcgctcaccacgcagattctctttatacctatccggtggccacccagtgccattgtggaaagtgtgactcggactcgactgattgtactgtgaggggcctgggaccaagctactgctccttcggggagatgaaagag

SEQ ID NO: 11701 - DNA, 387 bp, Artificial Sequence
  Description of Artificial Sequence: Synthetic coding sequence
atgaaaactctccagttctttttcctgttttgctgctggaaggcgatctgctgcaactcttgtgaattgactaatatcaccatagcaatcgaaaaggaagaatgtcggttttgtatttccattaacaccacctggtgcgcaggatattgctacacgcgtgacctggtgtacaaagatcccgcaaggccgaagattcaaaagacctgtacctttaaggagctcgtgtacgagacggtcagagtgccaggatgcgcccatcatgctgactccctgtacacctacccagtggctacgcaatgtcactgtggaaagtgtgactcagattctactgattgcactgtccgcggcctcgggccttcgtactgttcgtttggtgagatgaaagaa

SEQ ID NO: 11702 - DNA, 387 bp, Artificial Sequence
  Description of Artificial Sequence: Synthetic coding sequence
atgaaaacgctgcaattcttcttccttttctgctgctggaaggctatttgctgcaactcatgcgagctgactaatatcaccattgcaatcgaaaaggaagagtgtcggttctgcatctcgatcaatacgacttggtgtgcaggatactgttacacccgcgacttggtttacaaggatccggctagaccaaaaatccaaaagacttgcaccttcaaggaacttgtgtacgaaactgtgcgggtgcctgggtgtgcccatcatgccgattctctgtatacctacccggtggcgactcagtgccattgcggaaagtgcgactcggatagcaccgactgtaccgtgcgcgggttgggaccgagctactgctcgttcggcgaaatgaaagag

SEQ ID NO: 11703 - DNA, 387 bp, Artificial Sequence
  Description of Artificial Sequence: Synthetic coding sequence
atgaaaacgctgcaattcttctttctcttctgttgttggaaggcaatttgctgtaactcatgtgaacttaccaatatcactattgccattgaaaaggaagaatgcagattttgcattagcatcaacactacctggtgcgcagggtactgctacacccgggacctggtgtataaggaccctgctagacctaagatccaaaaaacgtgcaccttcaaggagctggtgtacgagactgtgagagtgccgggatgcgcacatcacgccgattccctctacacctacccagtcgcaactcagtgtcactgtggaaagtgtgactcagactccacggactgtactgtcagaggactgggcccttcgtactgtagctttggtgagatgaaagag

SEQ ID NO: 11704 - DNA, 387 bp, Artificial Sequence
  Description of Artificial Sequence: Synthetic coding sequence
atgaaaaccctgcaattcttcttcctcttctgctgttggaaggcgatctgctgcaactcctgtgagctcactaatatcaccatcgcgatcgaaaaggaagagtgccgcttctgcatcagcattaacactacctggtgcgccggatactgctacactcgggacctcgtgtacaaggacccggcccggcctaagatccagaaaacctgtacctttaaggaactggtctatgaaactgtgcgcgtccctggatgcgctcatcacgctgactcgctgtacacctacccagtggccacccagtgccattgcggtaaatgcgatagcgactccactgactgcaccgtgcgtgggctgggcccgtcgtactgctcgttcggggagatgaaggag

SEQ ID NO: 11705 - DNA, 387 bp, Artificial Sequence
  Description of Artificial Sequence: Synthetic coding sequence
atgaaaactctccagttcttttttctgttttgttgctggaaggctatctgctgcaacagctgcgagctgactaacatcactatcgcaatcgaaaaagaagaatgtcgcttctgcatctccatcaatactacctggtgcgcgggatactgctacacgagagatctcgtgtacaaggacccagcacggccaaagatccagaaaacttgcacgttcaaggagctggtgtacgaaaccgtccgggtgccgggatgcgctcaccacgctgattcgctgtacacttacccggtggccacgcaatgccattgtggcaagtgtgacagcgacagcactgattgcactgtccgtggcctggggccgtcctactgcagcttcggagaaatgaaagag

SEQ ID NO: 11706 - DNA, 387 bp, Artificial Sequence
  Description of Artificial Sequence: Synthetic coding sequence
atgaaaactttgcagtttttcttcttgttctgttgctggaaggccatctgctgtaacagctgtgagcttactaacattaccatcgcgatcgaaaaggaggaatgccggttctgcatctccatcaatacgacgtggtgcgcaggatactgctacacccgggacctcgtctacaaggatccggctcgcccaaagattcagaaaacttgtactttcaaagagctggtgtacgaaaccgtaagggttccgggttgcgcccaccacgccgactctctttacacctatcctgtggcgacccaatgtcattgcggcaagtgcgacagcgattcgaccgactgcactgtgcgcgggctgggcccttcgtactgttcttttggagaaatgaaggaa

SEQ ID NO: 11707 - DNA, 387 bp, Artificial Sequence
  Description of Artificial Sequence: Synthetic coding sequence
atgaaaacgctgcagttcttttttcttttttgttgttggaaagcaatatgttgtaacagctgcgaacttactaacattacgatagcgatcgaaaaggaagagtgccggttctgtatttccatcaacaccacttggtgcgctggctactgttacactcgcgatctggtctacaaggacccagcacggcccaaaattcagaaaacttgcacgtttaaagaacttgtgtatgagactgtgagagtccctggttgcgcacatcatgcagactccctttacacctacccagtggccacccaatgtcattgtggaaaatgcgatagcgattccaccgactgtacggtgaggggactgggtccttcctactgcagctttggagagatgaaggaa

SEQ ID NO: 11708 - DNA, 387 bp, Artificial Sequence
  Description of Artificial Sequence: Synthetic coding sequence
atgaaaacccttcagtttttcttcctgttctgctgttggaaggctatctgctgtaactcatgcgaactgaccaacattacgatcgccatcgaaaaggaggagtgccgcttttgtatttcgatcaatacgacatggtgcgccggttattgctatactcgggacctggtgtacaaggaccccgcaagaccgaaaattcagaaaacctgtacatttaaagagctggtgtatgagacagttagagtgcctggctgcgcccaccatgccgacagcctttacacatacccagtcgccacgcagtgccactgcgggaaatgtgatagcgactcaaccgactgtacagtgagggggcttggacctagttattgtagcttcggtgaaatgaaggaa

SEQ ID NO: 11709 - DNA, 387 bp, Artificial Sequence
  Description of Artificial Sequence: Synthetic coding sequence
atgaagacacttcaattcttttttctcttctgttgctggaaagctatttgttgcaactcctgtgagctgaccaacatcaccatcgccattgagaaggaggagtgccgtttctgcatctcaatcaatacaacatggtgtgctggatattgctacaccagggacttggtgtacaaggatcccgctaggccaaaaatccagaaaacttgcacttttaaggaactggtgtacgagaccgtgcgtgtgcctggttgtgcacatcacgcagatagtctgtacacctatccagtggctactcaatgtcactgcggcaaatgcgatagcgatagcacagattgcaccgtgaggggtctgggaccttcttactgctccttcggagaaatgaaggaa

SEQ ID NO: 11710 - DNA, 387 bp, Artificial Sequence
  Description of Artificial Sequence: Synthetic coding sequence
atgaaaaccctgcaatttttctttcttttttgctgctggaaggctatatgctgtaatagttgcgagctgacgaacatcactatcgcaatcgagaaagaggaatgcagattctgcatttcaatcaatactacatggtgcgccgggtattgctacacgcgagatctggtgtataaggatccagccagaccaaaaattcagaagacctgcacctttaaagagcttgtttatgaaacagtcagggtccctgggtgtgcacaccatgctgatagcttgtatacgtatcccgttgctacacaatgccactgcggtaagtgcgactcagacagcacagactgcactgtgcgaggccttggcccttcatattgcagttttggggagatgaaagaa

SEQ ID NO: 11711 - DNA, 387 bp, Artificial Sequence
  Description of Artificial Sequence: Synthetic coding sequence
atgaaaactctgcagtttttcttcctgttttgctgctggaaagccatttgctgtaactcctgtgagttgactaatatcaccatcgcgatagaaaaggaagaatgtaggttttgtatttcaattaacaccacttggtgtgcagggtactgttacactcgggacttggtctacaaggatcctgcacgaccaaagattcaaaagacttgtacctttaaggaactcgtctacgaaaccgtgcgggttccaggctgcgcgcatcatgcagatagcctgtacacttacccggtggccacccaatgtcattgtggtaagtgtgactctgattcgactgattgcaccgtgcgaggactcggaccgtcctactgtagctttggtgaaatgaaggaa

SEQ ID NO: 11712 - DNA, 387 bp, Artificial Sequence
  Description of Artificial Sequence: Synthetic coding sequence
atgaaaacgttacaattcttttttcttttttgttgttggaaagcgatctgttgtaattcttgcgaactaacaaatattacaatcgcaattgagaaagaggagtgtcgattttgcatttcaatcaacacgacgtggtgcgccggctattgctatacgcgtgatttagtttataaagaccctgcaagacctaaaattcaaaaaacctgtactttcaaagaacttgtatacgagacagtgcgcgtgcctggctgtgcccaccatgctgattccctgtatacttatcctgtcgcgacgcaatgtcattgtggaaagtgtgattccgacagcactgattgtacagtgagaggacttggcccatcctactgctcatttggcgagatgaaagag

SEQ ID NO: 11713 - DNA, 387 bp, Artificial Sequence
  Description of Artificial Sequence: Synthetic coding sequence
atgaagaccttacagttcttcttcctgttctgttgctggaaggccatctgttgcaactcttgcgagttgacaaatataacaatcgcaatcgagaaagaggagtgcagattctgtatttccattaacaccacctggtgcgccggctactgctacaccagagacttggtgtacaaggatccagcgaggcccaagattcagaagacctgtacttttaaggagctcgtgtatgaaactgttagagtgcccggatgcgcccatcacgctgactcactgtacacgtacccagttgccactcaatgtcattgtggcaagtgtgactccgattcaacagattgtacggtgcggggtctcggaccatcttattgttccttcggagagatgaaggag

SEQ ID NO: 11714 - DNA, 387 bp, Artificial Sequence
  Description of Artificial Sequence: Synthetic coding sequence
atgaaaacgctgcaattttttttcctcttctgttgttggaaagccatctgctgtaatagctgcgagctgacaaatatcactatcgcgatcgaaaaggaggagtgcaggttttgcatcagcatcaatacgacttggtgtgcaggatattgttacaccagagacctggtttacaaagaccccgcccgcccaaagattcagaagacatgcaccttcaaggagttggtatacgagacagtgcgagtcccaggctgtgcacatcacgcagatagcctctatacataccccgttgcgacccagtgccactgtggcaaatgcgacagcgattctacagactgtacagtgagaggcctggggccctcgtactgcagttttggtgagatgaaagaa

SEQ ID NO: 11715 - DNA, 387 bp, Artificial Sequence
  Description of Artificial Sequence: Synthetic coding sequence
atgaaaaccctccagtttttctttttgttttgttgttggaaagcaatttgttgtaacagctgcgaactgactaacattacgatagcaatcgagaaggaagaatgtagattctgcattagcataaacaccacttggtgtgctgggtactgttacactcgggatctcgtctataaggatccggcacgtccaaagatccaaaagacctgtactttcaaggagcttgtgtacgagactgtgcgcgtccctggttgcgcgcaccacgccgattcgctgtacacctacccagttgccacccagtgtcactgcggaaaatgcgactcagatagcacggactgcactgtgcggggactcggaccttcgtattgctcttttggcgagatgaaagaa

SEQ ID NO: 11716 - DNA, 387 bp, Artificial Sequence
  Description of Artificial Sequence: Synthetic coding sequence
atgaaaaccttgcagttcttttttctgttctgttgctggaaggccatctgttgcaacagttgcgagctgaccaatattacaattgccatcgagaaggaggagtgtcggttctgcattagcattaatacaacatggtgtgcaggctactgttacacacgggatctggtctataaagaccccgcccggcccaaaatccagaaaacttgtacttttaaagagctggtgtacgagacagttagagtgccagggtgcgcgcaccatgcggactcattgtatacttatccagttgctacacaatgtcactgtgggaaatgcgacagcgactcaaccgactgtactgttagaggcttgggaccaagctactgcagctttggggaaatgaaagag

SEQ ID NO: 11717 - DNA, 387 bp, Artificial Sequence
  Description of Artificial Sequence: Synthetic coding sequence
atgaaaacactccagtttttcttcctgttctgctgctggaaggccatctgctgtaactcctgcgagcttacaaacattacaatcgccattgaaaaggaagagtgtcgattctgcattagcataaacaccacttggtgcgctggttactgttatactagggatctcgtgtacaaggatcctgcacggccaaaaatccagaagacctgtacttttaaagagctcgtgtacgagaccgttagggtgcctggctgcgcccatcacgccgattccctttacacttaccctgtggccacccagtgccactgtggaaaatgcgatagtgactccaccgactgtactgtgcgcgggctcggtccctcctactgcagctttggagagatgaaggag

SEQ ID NO: 11718 - DNA, 387 bp, Artificial Sequence
  Description of Artificial Sequence: Synthetic coding sequence
atgaaaacactacagttttttttcctgttctgctgttggaaggctatttgttgcaattcctgcgagctgactaatataacaatcgcaatcgaaaaggaagagtgcagattttgcatatccatcaacactacctggtgcgccgggtactgttatactagggacctggtctataaggatccagctcgacccaagatacagaaaacctgtactttcaaagaactggtctatgagaccgttagagttcctggctgcgctcaccatgccgactccctgtacacctatcccgttgccactcagtgccactgcggcaaatgcgatagcgacagcaccgactgcaccgtgcggggactaggcccatcttattgttctttcggggaaatgaaagaa

SEQ ID NO: 11719 - DNA, 387 bp, Artificial Sequence
  Description of Artificial Sequence: Synthetic coding sequence
atgaaaaccctgcagttctttttccttttttgctgctggaaggcgatttgttgtaacagctgtgagcttactaacattaccatcgcaattgagaaggaagagtgccgattttgtatttcgattaacactacctggtgtgcaggctattgttacactcgtgatctggtctacaaagatcctgccagaccaaagatccaaaagacttgcactttcaaagaactggtctacgaaaccgtcagagtgcctggttgtgcccaccacgcggatagcctgtacacgtaccctgtcgcaacgcaatgtcattgtggaaagtgtgacagcgatagcactgactgcaccgtgagaggactggggccttcttactgctcatttggtgagatgaaggaa

SEQ ID NO: 11720 - DNA, 387 bp, Artificial Sequence
  Description of Artificial Sequence: Synthetic coding sequence
atgaaaactctccagttcttttttctcttttgctgttggaaggctatttgttgtaactcgtgcgaacttaccaacattactatagccatcgaaaaggaagagtgcagattctgtatttccataaacactacgtggtgtgctgggtactgttacacccgtgacctcgtctacaaggatccagccagaccaaagatccagaaaacctgcacttttaaggagcttgtgtatgaaaccgtgagggtgccaggatgtgcccatcatgcagattcactctacacttaccctgtggccacgcaatgccactgtgggaaatgcgacagcgattcgaccgattgtactgtcagaggactgggaccaagctactgctcattcggcgaaatgaaggaa

SEQ ID NO: 11721 - DNA, 387 bp, Artificial Sequence
  Description of Artificial Sequence: Synthetic coding sequence
atgaagaccctgcaatttttctttctgttttgctgctggaaggctatctgctgcaattcctgcgaattgaccaacatcacgatcgcgattgaaaaggaggagtgtcgattctgtatctccattaacaccacctggtgcgcggggtactgctatacccgggacctggtctacaaggatccggccagaccaaagatccaaaagacttgtactttcaaagagctcgtgtacgaaaccgtcagagtgccgggatgtgcgcaccatgcggatagcctttacacctacccggttgcgacccagtgccattgcggcaagtgtgactcagattcaactgattgcaccgtcaggggactcggcccatcgtactgctccttcggagagatgaaggag

SEQ ID NO: 11722 - DNA, 387 bp, Artificial Sequence
  Description of Artificial Sequence: Synthetic coding sequence
atgaagacgcttcaattcttttttcttttttgttgctggaaggcaatttgctgtaactcttgtgaacttacgaatattactattgcaatagagaaagaagaatgcaggttttgtatctcaatcaatacgacttggtgtgcgggatattgctacacacgcgacctggtatataaagaccctgcacgaccgaaaattcaaaaaacgtgcacattcaaggagctcgtttatgaaacggtgcgggttccaggctgcgcacatcacgcggatagtttgtacacgtatcctgttgctactcaatgtcattgtggaaagtgtgactcagacagtaccgactgcactgtcagaggacttgggccatcttattgttcatttggcgaaatgaaggag

SEQ ID NO: 11723 - DNA, 387 bp, Artificial Sequence
  Description of Artificial Sequence: Synthetic coding sequence
atgaaaactctccaattcttcttcttgttctgctgttggaaggcaatctgctgtaattcgtgcgaactcaccaatatcaccattgcgattgaaaaggaggagtgccgcttttgcatctctatcaacaccacctggtgcgcaggttactgctacactcgggacctggtgtataaggatcccgctcggcctaaaatccagaaaacttgtactttcaaagagctggtgtacgaaaccgtgagagtgccaggctgcgcacaccatgcagattcgctgtatacctacccggtggcgacgcaatgtcattgcggtaagtgcgactccgattcaaccgactgcactgtccggggccttggtccttcctactgctcatttggggaaatgaaggaa

SEQ ID NO: 11724 - DNA, 387 bp, Artificial Sequence
  Description of Artificial Sequence: Synthetic coding sequence
atgaaaaccctccaatttttcttccttttttgctgctggaaggcgatttgttgtaattcttgtgaattaacaaacattacaatcgcaatcgaaaaggaagaatgcaggttttgcatcagcataaataccacctggtgcgccggatattgttacacaagagacctcgtctataaagatcccgcacgacctaaaattcagaaaacctgtacctttaaggagctcgtctatgaaacagtgcgggtgcctggatgcgctcatcatgccgatagtctttacacttaccctgttgccacccagtgccactgcgggaaatgtgatagcgacagtaccgactgtacggtgagggggcttgggccatcctactgttctttcggcgaaatgaaagag

SEQ ID NO: 11725 - DNA, 387 bp, Artificial Sequence
  Description of Artificial Sequence: Synthetic coding sequence
atgaaaaccctgcaattcttctttctgttctgttgctggaaagcaatctgctgcaactcatgcgaactcactaatatcactatcgctatcgaaaaggaggaatgccgcttctgtatctccatcaacactacttggtgtgctggatactgttacactcgcgatctggtgtacaaagacccagcaagaccgaagatccagaaaacttgtactttcaaggagctcgtgtacgaaactgttagggtcccaggatgcgcccatcacgccgactcgctgtatacttacccggtggccactcagtgtcattgtggaaaatgcgattcggacagcaccgattgcaccgtgcggggtttgggaccgagctactgctccttcggagaaatgaaggaa

SEQ ID NO: 11726 - DNA, 387 bp, Artificial Sequence
  Description of Artificial Sequence: Synthetic coding sequence
atgaaaactctccagttcttcttcctcttttgctgctggaaagcaatctgttgtaactcctgtgaactaaccaacatcaccatagctatcgagaaagaagagtgccgattttgcatcagtatcaacaccacttggtgtgccggctactgttataccagggatctggtgtacaaggaccccgcgcggcctaaaatacagaagacatgcacattcaaagaattggtctatgagacagttcgcgtgcctgggtgcgcccaccatgctgactccctgtacacgtatccagtcgctacgcagtgccattgcgggaaatgcgatagcgactcaactgattgtacagtgcgcgggcttggtcccagctactgcagctttggtgagatgaaagaa

SEQ ID NO: 11727 - DNA, 387 bp, Artificial Sequence
  Description of Artificial Sequence: Synthetic coding sequence
atgaaaactcttcaattcttttttctcttttgttgttggaaggccatatgttgtaactcgtgtgaactgactaatatcaccattgctattgagaaagaagaatgccgcttttgtatctcaataaacaccacttggtgcgcagggtactgctacactagggatcttgtgtacaaagaccctgcaaggcccaaaatacaaaagacctgtacctttaaagagctggtgtacgaaaccgtgagagtgcctggctgcgcccaccacgccgattccctttacacttaccctgtggcaacccagtgtcattgtggtaagtgcgactcagatagcactgattgcactgtgcggggtctgggcccatcgtactgttcgtttggagaaatgaaggaa

SEQ ID NO: 11728 - DNA, 387 bp, Artificial Sequence
  Description of Artificial Sequence: Synthetic coding sequence
atgaagacattgcagttcttttttctgttctgttgttggaaagccatatgctgtaatagttgcgagctcaccaatataacaattgcgatcgagaaggaagaatgtagattctgtataagcatcaatacgacctggtgcgcaggctactgttatacccgcgacttggtttataaggacccggccagacccaagatccaaaagacctgcactttcaaggaactggtatatgagaccgtgagggtaccggggtgcgcccaccatgctgatagcttgtatacataccccgtggctactcagtgccattgcgggaagtgtgactctgatagcactgactgcaccgttaggggacttggcccatcatactgttcattcggggaaatgaaggag

SEQ ID NO: 11729 - DNA, 387 bp, Artificial Sequence
  Description of Artificial Sequence: Synthetic coding sequence
atgaaaactctgcagtttttctttctgttctgctgttggaaggctatctgctgcaatagctgcgaattgacgaacataaccatcgcgatcgaaaaagaagaatgtcggttctgcatttcaatcaacactacctggtgcgccggctactgctacactagggatctggtttacaaggacccggcacgacctaagatccaaaagacttgcaccttcaaggagctcgtatacgaaaccgtgcgggtgcccggatgtgctcatcacgccgatagcctctacacctatccagtcgccactcaatgccactgcgggaagtgcgactctgactcgaccgactgtactgtgagaggactcggcccgagctattgttccttcggagaaatgaaggaa

SEQ ID NO: 11730 - DNA, 1257 bp, Artificial Sequence
  Description of Artificial Sequence: Synthetic coding sequence
atgtcctttattccagtggccgaggacagcgatttccccattcacaatcttccgtacggtgttttctctaccaggggcgatccacggcctagaattggggttgccattggcgatcagatcctggatttgagcatcatcaagcacctattcactggccctgtgctctcaaagcaccaagacgtttttaatcagcctaccctgaacagttttatggggctgggccaggccgcttggaaagaggccagggttttcctgcagaatctgcttagtgttagtcaggctaggttaagggacgatactgagctgcggaagtgcgcgttcatctcacaggccagcgccacgatgcacttgccagctaccatcggcgattacacagatttctattcgtctcgccagcatgctactaatgtggggattatgttccgtgacaaagaaaatgcgctgatgccaaactggcttcacctgccagtggggtatcacgggagagcgtcaagtgtggtagtttccggcactcctattagacgaccaatgggacaaatgaagcctgatgactccaaaccgcccgtgtacggcgcatgcaagctcctagacatggaactcgaaatggcattctttgtggggcctgggaacagactgggtgagccaatacctatttcaaaagcccacgaacacatctttggcatggtgttgatgaacgattggtctgctagagatatccagaaatgggagtacgtgccattggggccctttctgggtaagtcgttcggcaccaccgtgtcaccttgggtggtccctatggatgcactgatgcctttcgctgtacctaaccccaagcaagacccaagacccctaccatatctctgtcacgatgagccatacacattcgatattaacctgtccgtgaaccttaagggtgaagggatgtctcaagcagccaccatatgcaaaagtaactttaagtatatgtattggaccatgcttcagcagctgactcatcacagcgtgaatggttgtaatctgcgtcctggagacctccttgcaagtggtactatcagcggccctgagccagagaatttcggctccatgcttgagctctcctggaaagggacgaaacccatcgatctgggaaacggtcagaccaggaaatttttactggacggagacgaggttatcataaccggatactgtcagggcgatggctaccgaataggctttgggcagtgtgcaggtaaagtgttgcctgcgttacttccctca

SEQ ID NO: 11731 - DNA, 1257 bp, Artificial Sequence
  Description of Artificial Sequence: Synthetic coding sequence
atgtcatttatccccgtcgcagaggactccgactttcctatacataaccttccctatggtgtcttttcaaccagaggggatcctagaccacgaatcggggtggctataggcgatcaaattcttgatctgagcattatcaagcatctgttcactgggccagtcctgtcgaaacatcaagatgtgttcaatcagcctactctgaactcatttatgggtctgggtcaggctgcctggaaggaagcccgggtctttctgcagaatctgctgtcggtgagccaggctcgacttcgcgacgacaccgaattgagaaaatgtgcgttcataagccaggcgagcgcaaccatgcatcttcctgcaactattggagattacaccgacttttacagctccagacaacatgcaaccaacgtcggaatcatgttccgggacaaggagaacgctcttatgcctaactggctgcatttgcccgtcgggtaccacggtcgggcgtcgtccgtcgtggtgtcgggcacccccattagacgccctatgggacagatgaaacccgacgactccaagcccccagtctacggagcctgcaagctgttggatatggaacttgagatggcatttttcgtggggccagggaatagactcggggagccaattcccatttcgaaagcacatgaacacatatttggaatggtgcttatgaacgactggtccgctcgggacattcaaaagtgggagtacgtgccactgggaccttttttgggaaagtcgttcggtaccaccgtgtcgccttgggtggtgcccatggatgcactgatgccattcgccgtgcctaaccctaaacaagatccaagaccacttccttacttgtgccatgacgagccctatactttcgacataaacctgagcgtaaatctcaagggagaaggcatgtcccaggccgcaacgatatgtaagtccaacttcaagtacatgtattggactatgctgcagcagcttacccaccatagcgttaacggctgtaaccttcgtccaggagatcttttggcatctggtaccatttcgggaccagaaccggagaatttcggatccatgcttgagctttcttggaaaggcactaaaccaattgacctgggaaatggtcaaacgcgcaagtttctgcttgacggcgatgaagtgatcattactggatactgccaaggagatggttacagaatcggttttggacaatgtgcaggaaaggtgctgccagcacttctgcctagc

SEQ ID NO: 11732 - DNA, 1257 bp, Artificial Sequence
  Description of Artificial Sequence: Synthetic coding sequence
atgtcctttatacctgtagccgaggactccgatttccctatccacaatctgccctacggggtgttctccacgaggggagatccccgccccagaataggggtcgccattggggatcagatactagatctgagcatcatcaagcatctctttacagggcccgtcctcagtaaacatcaggacgtgtttaaccagcccacacttaacagctttatgggtctaggccaagccgcgtggaaagaagcacgcgttttccttcaaaacctcctgagcgtttcccaggccaggctacgagacgacactgaactgagaaagtgcgctttcatcagccaggcatctgccacaatgcatttgcccgccactattggagactataccgacttttacagtagtcgtcagcatgccactaatgtggggatcatgtttagagacaaggaaaatgctctgatgcccaactggctccatttgccggtgggttatcatggtcgcgcaagcagcgtagtggtatcaggcactcccatcaggcgacctatgggccagatgaaacctgatgactccaagcctccggtatatggggcctgtaagttgctggacatggaactggagatggccttcttcgtggggccaggtaatcggctgggagagccaattcccatttctaaggcgcacgagcacatctttggaatggtcctgatgaatgattggtccgcgcgcgatatacagaaatgggaatatgtccctctgggtccctttctcggcaaaagtttcggtacaactgtgtccccttgggtcgtgccgatggacgctcttatgcccttcgccgtccccaacccaaaacaggatccaaggccactgccttacctctgtcatgatgagccttatacattcgatataaatttgtctgtgaatttaaaaggagaaggcatgtcacaggccgcgacaatctgcaagtccaactttaagtacatgtattggacaatgttgcagcagctgacccatcacagcgtcaacggctgtaacttgcggccaggggatttactagctagtggcactatctccggccccgaacccgaaaactttggctcaatgctcgagctgtcatggaagggaactaagccaattgatctgggtaatggtcagacacggaagttccttttggacggggacgaggtgattatcaccgggtactgtcagggggatggctatagaattggttttgggcagtgcgccggcaaagtgctgccagcccttttgccatca

SEQ ID NO: 11733 - DNA, 1257 bp, Artificial Sequence
  Description of Artificial Sequence: Synthetic coding sequence
atgtcattcatccctgtggctgaagatagtgactttcccatccacaatctgccttacggagtcttcagcacccgcggtgatccgcggcccagaataggagtggcaatcggcgatcagattctcgacctgagcattatcaagcatctatttactgggcccgttctcagcaagcatcaggatgtttttaaccagccaacactgaattcttttatgggcctgggccaagctgcatggaaggaggctagggtgttcctgcaaaacctgctcagcgtttcccaggcccgactgcgcgatgatacagagctgcgcaagtgtgcttttatcagccaggccagcgcaacaatgcacttacccgccacaatcggcgactacaccgatttctattctagcagacagcacgccactaatgtcgggatcatgttccgggataaggagaacgcactgatgcccaattggctgcatctgccagtagggtaccacgggagggctagttccgtggttgtgtctggaacccctatccgcagacctatgggacagatgaagccagatgacagcaaacctccagtgtacggagcctgcaagctcctggatatggagctcgagatggccttttttgttggcccgggcaacagactgggagaacctataccaatcagtaaggcacacgagcacatctttggcatggtgctgatgaacgattggagtgcccgtgacatccagaaatgggagtacgtgcctttgggacctttcctgggaaagagctttggcacaacagttagcccgtgggtggtccccatggatgcgctaatgcccttcgcggttcctaatccaaagcaggacccccggcccttgccttatctctgccatgatgagccctatacctttgacatcaacttaagcgtgaacctcaagggcgaaggaatgtctcaagctgcaaccatctgtaaatcaaatttcaaatacatgtattggaccatgctgcagcaacttactcatcattctgttaacggctgcaacctgaggccaggcgatttgttggcgtcaggaactatcagcgggccggagcccgaaaactttgggtccatgttggagcttagttggaagggaactaaaccaattgaccttgggaatggacagacacgaaagtttttgttggacggagacgaagtcataatcaccggctactgtcaaggagacggttataggatcggtttcggtcagtgcgcaggcaaggtactgcccgcacttttgccaagt

SEQ ID NO: 11734 - DNA, 1257 bp, Artificial Sequence
  Description of Artificial Sequence: Synthetic coding sequence
atgtcatttattccagttgcagaagattctgattttcccattcacaatctcccctacggcgtcttttccacacgcggtgacccacggccgcggattggggtggctattggcgaccagatcctggatctgtccattatcaaacatttatttacaggccccgtactgtcaaagcaccaggacgtgtttaaccagccaacacttaacagttttatggggttgggtcaagctgcgtggaaggaagcgagggtgtttttgcaaaacctgctgtctgtgagtcaggcccgccttagagacgatactgagctccgtaaatgtgcctttattagtcaggcgagtgccacaatgcatctccctgccaccatcggtgattacacagacttttactctagtcggcagcacgcaacaaatgtgggcataatgttccgcgataaagagaatgccctcatgcccaactggctgcatctgccagtgggctatcacggtcgcgctagtagtgtggttgtctctggtaccccaattcggagaccaatggggcagatgaagcctgacgactcaaaaccacctgtctatggagcctgcaaattgctggatatggaactggaaatggcctttttcgtgggccccggcaatcggctgggagaacccatacctatctccaaagctcatgaacacatctttggtatggtcctcatgaacgattggagcgctcgagatattcagaagtgggaatatgttccactaggaccttttctcggaaagtctttcgggactaccgtgtccccgtgggtggtgcctatggacgcactgatgccttttgccgttcctaatcccaagcaggatcctcggcccttgccctatttatgtcatgatgaaccttacacgttcgatattaacctctccgtaaacttgaagggcgagggaatgtcccaggcggcaactatatgcaagtctaattttaagtatatgtattggacaatgttgcagcagcttacgcaccactcagtgaacgggtgtaatctacgccccggagatcttttagcttctggaactatttctggaccggagcccgaaaattttggctcgatgttggagctctcctggaagggcactaagcctatcgatctcggaaacggacagacaagaaaattcctcctggatggtgacgaagtaattattaccgggtattgtcagggggacggctatcggatcggatttggccagtgcgcgggcaaggtcctccccgccctgcttcccagc

SEQ ID NO: 11735 - DNA, 1257 bp, Artificial Sequence
  Description of Artificial Sequence: Synthetic coding sequence
atgtccttcatcccagtcgcagaggacagcgacttccccatccacaacctgccgtacggtgtgttctcaacgcgaggcgacccacggccacggatcggagtggccatcggcgaccaaatcctggacctcagcatcattaaacacctgttcacgggcccagtgctctcgaaacatcaggatgtgttcaaccagccgaccctcaactcgttcatgggactcggtcaggccgcgtggaaggaagcgagagtgttcctccaaaatctgctttcggtgtcgcaagcgcgcctgcgggacgacactgaactgcggaaatgtgcgttcatcagccaggccagcgctacgatgcatctgcccgcgaccatcggggactacaccgatttctactcttccagacaacatgctaccaacgtgggaatcatgttccgggataaagaaaacgcactgatgccaaactggcttcacctgcctgtggggtaccacggacgggcttcatccgtcgtcgtctcgggaacgccgattcgacggccgatgggtcaaatgaagcccgatgactccaagccgcccgtgtacggtgcatgcaagctgctggatatggaacttgagatggccttcttcgtgggcccggggaatcggctgggcgagccgatcccgatttccaaagctcatgagcatatcttcggaatggtgctgatgaatgattggtccgcacgggacatccaaaagtgggaatacgtccctctgggaccattccttggaaaatcgttcggaactactgtgagcccgtgggtggtcccgatggatgccctgatgcctttcgccgtgcctaaccctaaacaggaccccagaccgctgccgtacctctgccatgatgaaccatacactttcgacatcaatctctctgtgaacctgaagggagaaggcatgtcccaggcggcaaccatctgcaagagcaacttcaagtatatgtattggaccatgctccagcaattgactcaccactccgtgaatggatgcaacttgcgccctggagatctccttgcaagcggcactatctcgggacctgagccggagaatttcggctctatgctggaactctcgtggaagggaactaagccgatcgacctgggaaacggacagacccgcaaattcctgctggacggagacgaagtcatcatcactggatactgtcaaggcgatggataccgcatcggatttggccagtgcgcgggcaaggttctgcccgccctgcttccatcg

SEQ ID NO: 11736 - DNA, 1257 bp, Artificial Sequence
  Description of Artificial Sequence: Synthetic coding sequence
atgtcgttcatccctgtggcagaagatagcgattttccaatccataatctgccctacggggtgttttccacccgcggagatccccgcccccggattggggtggcaatcggtgaccaaattctggatctttcgattatcaagcacttgtttactggacctgtgctctcgaagcatcaagatgtctttaaccaacccaccttgaattcgttcatgggacttggacaggcagcatggaaggaagcacgtgtgtttctccagaatctgctcagcgtgtcacaagcaagattgagagacgataccgaactgaggaaatgtgcatttatctcacaagcaagcgcaactatgcatcttcctgcgactattggtgactacactgacttttactcgtcgagacaacatgccactaacgtgggaatcatgtttagagataaagagaacgcccttatgcctaactggttgcatctgccagtgggataccatggaagagcctcgagcgtcgtcgtatccggaacccccattaggcgaccaatggggcagatgaagccagacgattccaagccacccgtgtacggagcatgtaaactccttgacatggaactggaaatggcatttttcgtgggtccaggcaaccgactcggggaaccaatccctatttctaaggcacacgaacacatatttggcatggtgttgatgaatgactggtcagcccgcgatatccaaaaatgggagtacgtgcctctgggaccgttcctgggaaagtccttcggcaccaccgtgtcaccatgggttgttccgatggatgcacttatgccttttgcggtgccaaacccgaagcaagaccctagacctctcccctacctttgtcacgacgagccatacactttcgacattaacctgtccgtgaaccttaagggagaaggaatgagccaagccgcaactatttgtaagagcaacttcaagtacatgtattggaccatgcttcagcagctgactcatcactccgtcaatggctgcaacctcaggcctggtgatttgctggcttccggaactatttcgggaccagaaccagaaaacttcgggtcgatgctggaacttagctggaagggaaccaagcccattgatctgggtaacggacaaactaggaagttcctgttggatggcgatgaggtgatcatcaccggatactgtcagggggatggataccgcatcggatttggacagtgtgcggggaaagtcctgcctgcactccttccgtcg

SEQ ID NO: 11737 - DNA, 1257 bp, Artificial Sequence
  Description of Artificial Sequence: Synthetic coding sequence
atgagctttattccagtggcggaggatagtgactttcctattcataacctgccctacggtgtgttttccacgagaggcgacccaagacccagaattggggtagcaattggggatcaaattctggatctgtcgataatcaagcatctctttaccggaccagtgttgtcgaagcaccaagatgtattcaaccagcctaccctcaactcgtttatgggtctgggacaagcagcatggaaggaagcacgtgtgtttctccagaaccttctgtcagtctctcaagcgcgcctcagggacgataccgaactgcgcaaatgtgcattcatatcccaagcaagcgcaactatgcatttgcctgccaccattggggactacactgacttttacagctcacgccagcatgcgactaatgtgggcataatgtttcgggataaagagaatgcgctgatgcctaattggcttcatttgccagtgggctaccatggcagagcgtcctccgtcgtggtgtcggggactccaataaggcgtcccatgggccagatgaagccagatgattcgaaaccaccagtctacggagcctgcaaactgttggacatggaacttgaaatggcatttttcgttggccccggaaaccggctgggagagcccattcctatttctaaggcgcacgaacatatcttcggaatggtccttatgaatgactggtccgccagagatatccagaagtgggaatacgtgccacttggtccttttcttgggaagagcttcggtaccaccgtgtcgccttgggtggttcccatggacgcacttatgcctttcgcagtccctaatcctaaacaggaccctagaccactcccatacctttgccacgatgagccatacacctttgacattaacctttcagtgaacctgaaaggtgagggtatgtcccaagcggcaactatctgtaagtccaatttcaagtatatgtactggactatgcttcaacagctgactcaccattctgtcaacggttgtaacctgaggccgggagatcttctcgccagcggaactattagcggacccgagccagaaaacttcggatcgatgcttgaactgtcatggaagggtaccaagcccattgatctcggtaatggacaaacccgcaagtttcttcttgacggcgatgaggtgattatcaccggatactgccagggtgatggataccgtatcggttttggccaatgtgctgggaaggtcctgcctgccttgctgcctagc

SEQ ID NO: 11738 - DNA, 1257 bp, Artificial Sequence
  Description of Artificial Sequence: Synthetic coding sequence
atgagctttattcctgtcgctgaggatagtgacttccccatccataacttaccatatggcgtattcagcactcgcggggatccccgaccccggatcggcgtggccataggggatcagattctggacttgagcattattaagcacttatttacaggccctgtcctgtcaaagcatcaagacgtgttcaatcaacctacccttaacagctttatgggcctcggtcaggcagcttggaaagaagctcgggttttcctgcagaacctcctctccgtgtcgcaagccagactgagggacgacaccgaactaagaaagtgcgccttcatctcccaggcgtccgccactatgcacctgcctgcgactatcggagactatacagatttctattcctctcggcagcacgcaacaaacgttggcatcatgtttcgagacaaagaaaacgccctcatgccaaattggctccatttgcctgtcggataccatggtcgcgcgtctagtgtcgtggttagcggaactcccatacgccggcctatgggccagatgaagcctgacgactccaagcctcccgtctacggtgcttgcaagctgctcgatatggagctggagatggcttttttcgtggggcccgggaacagactgggagagcccatccctatctctaaagcacacgagcacatcttcggcatggtgctgatgaatgactggagtgccagagatattcagaaatgggaatacgtacccttaggcccattcctgggcaagtcgttcgggacaacagtgtcgccttgggtggtgcctatggacgctctgatgcctttcgccgtgccgaaccccaagcaagaccccaggcccttgccatacttatgccatgatgagccctacactttcgatatcaacctaagcgtaaacctgaagggcgaggggatgtcccaggcagcgacaatctgtaaatcaaactttaagtacatgtattggaccatgctgcagcaactgacacaccacagcgtcaatggctgcaatctgagacccggagatctcctggcatccggaactatttctggtccagaaccagagaacttcggcagcatgctggagctctcctggaaaggcaccaaaccaattgaccttggcaacggtcagaccaggaaatttctcctggacggcgatgaggtgatcatcacgggatactgtcagggagacggatacagaattgggtttgggcagtgtgctggcaaggtgctgcccgccttgttgccatcc

SEQ ID NO: 11739 - DNA, 1257 bp, Artificial Sequence
  Description of Artificial Sequence: Synthetic coding sequence
atgtcttttatccccgtagctgaagatagcgattttcccatccataatctgccatatggtgtcttttccacacgaggcgatcctagacctcgaatcggagtggctatcggtgaccagatactggatcttagcatcatcaagcaccttttcacaggacccgtgctgtccaaacatcaggacgtatttaatcagcctacactgaatagtttcatgggactcggccaggcagcctggaaggaggcgagggtattcttacagaacttgctgagcgtcagtcaggctcggctgcgcgacgacactgagctgcgaaaatgtgcatttattagtcaggccagtgccactatgcacctgccggcaaccataggtgattatacagatttttacagcagccgtcaacacgctactaacgtcgggattatgtttagagataaagaaaacgccctcatgcccaattggctacaccttcccgtgggctaccacggacgggccagctcagttgtggtgagtggaacacctataaggcgaccgatgggacagatgaaacctgacgactcaaagcctccggtctatggggcttgtaaactcctggatatggaattagagatggccttttttgttggaccaggcaaccggctgggtgagcccatcccgatatccaaagcccacgaacacatatttggcatggtgctgatgaatgactggagtgctcgggatattcagaagtgggaatacgtgcccttgggtccctttctaggaaaatccttcgggactactgtttccccgtgggttgtgcccatggacgcactcatgccttttgccgtccctaatcctaagcaagaccccagacctctcccgtatctctgccacgacgagccttatacttttgacatcaatctgtccgtgaatttgaagggcgagggcatgtcccaggctgctaccatatgtaaatccaactttaagtatatgtactggactatgctgcagcagctcacacatcacagcgtcaatggttgtaaccttcgacctggcgatctcctggccagtgggactatatccggtccggagcctgagaactttgggtccatgttggaactgagctggaaggggacaaagccaatcgacctgggtaatggacagacacgaaaattcctgctggacggggatgaagttattatcaccggctattgccagggggacggctaccgtatcggctttgggcagtgtgcggggaaggtattgcccgctctgctcccatct

SEQ ID NO: 11740 - DNA, 1257 bp, Artificial Sequence
  Description of Artificial Sequence: Synthetic coding sequence
atgtcgtttatccctgtggccgaagattcggactttcctatccacaatctcccttacggagtgttttcaacccgcggcgacccgcgccccagaatcggtgtggccatcggggatcaaatcttggatctgtccatcatcaagcacctgtttactgggccggtgctctcgaagcaccaagacgtctttaaccagccgactctgaattccttcatgggactgggacaagccgcctggaaggaggcccgggtctttctgcagaacctcctcagcgtgagccaggcgaggctgcgcgacgacaccgaacttcggaagtgcgccttcattagccaagcaagcgcaaccatgcacctgcctgccaccattggagactacactgacttctacagctcacgccaacatgcgactaatgtgggaatcatgttccgggataaggaaaacgcattgatgccgaactggctgcacctgccggtgggataccatggacgggcctcgtctgtggtggtgtccggaactccaattagacggccaatgggacaaatgaaaccagatgattcgaagccgcctgtctacggtgcctgcaagttgctcgacatggaactggagatggcattctttgtcggcccgggaaatcgcctgggtgaaccaatccccatctcaaaagctcatgaacatatcttcgggatggtcctcatgaatgactggagcgccagggacattcagaagtgggagtacgtgccgctcgggccgttcctcggaaagtctttcgggaccaccgtctcaccatgggtggtcccgatggacgccctgatgcctttcgccgtccctaacccaaagcaggacccgcggccactcccatacctgtgccatgatgaaccgtacaccttcgacatcaatctgtcagtgaacctcaaaggcgaaggcatgtcgcaagccgctacgatctgcaagagcaactttaagtatatgtattggacgatgcttcagcagctcacccatcactctgtgaacggatgcaatctgcgcccaggagacttgttggcctccggaaccatctcaggaccggagcctgaaaacttcggatcgatgctcgagctgtcctggaaggggaccaagccgattgacctcggaaacggccagactcggaaatttcttctggacggtgacgaggtgataatcaccggttactgccagggagacggatacagaatcggcttcggacaatgtgcgggaaaggtcctgccggcactgctccctagc

SEQ ID NO: 11741 - DNA, 1257 bp, Artificial Sequence
  Description of Artificial Sequence: Synthetic coding sequence
atgtcctttattcctgtggcagaggattcagattttccaatccacaatttgccttatggagtcttctccacccgcggagatccgagaccccgtatcggggttgctatcggcgaccagattctggaccttagtattattaagcacttgttcactggccctgtgctgtcgaaacatcaggatgtttttaatcagcctaccttgaatagttttatggggcttgggcaggcggcctggaaggaggctagagtctttctgcagaacttgctgtcggtgtctcaggcacgcctgcgggatgatacggaattgcgaaaatgcgctttcatcagccaggcttctgccaccatgcatcttcccgctacaataggggattataccgatttttatagttctcggcaacacgccaccaacgtcgggattatgtttcgcgacaaggagaatgcactgatgcccaactggttgcatctgccggtgggttatcatggtcgcgcctcctcggtggtggtgtcaggaacacctattcggaggcctatggggcagatgaaacccgatgactcgaaacccccagtgtacggcgcatgcaagttactggacatggagttggaaatggccttcttcgttgggcccggcaatcgcctgggagaaccaatccccatatccaaagctcacgagcatatattcgggatggtactcatgaatgattggagcgcacgggacatccagaaatgggaatatgtgcccttgggtccttttctcgggaagagctttgggactactgtgagcccctgggtggtcccaatggatgcactaatgcctttcgctgtgcccaacccaaagcaggatccaagacccctgccatacttatgtcacgatgaaccatacacatttgatataaacctctccgtgaacctgaaaggagagggcatgtcccaagctgccaccatatgcaagtctaatttcaagtacatgtattggacaatgttacagcagctgactcaccactccgtgaatggatgcaacctgagaccaggggacctgttagcgagtggaaccatctcagggcctgaaccggagaattttgggtcgatgctagagctgagctggaaggggaccaaaccaatcgatctgggaaacggacagacaagaaagttccttctggacggggacgaggtgataattactggatactgccaaggtgacggctatcgcatcggcttcggccagtgcgcaggaaaagtgctgcccgctcttctgcctagc

SEQ ID NO: 11742 - DNA, 1257 bp, Artificial Sequence
  Description of Artificial Sequence: Synthetic coding sequence
atgtccttcattcccgtggcggaggattcggattttccaatccacaatctcccctacggagtgttctcgacccgcggagatccacggccacgaattggtgtggcaatcggagatcaaattcttgatctgtcgatcattaagcatttgtttaccggacccgtcctcagcaaacatcaggacgtgtttaatcagccgaccctgaactcgttcatgggtctgggccaagctgcatggaaggaggcgagagtgtttctgcaaaatctgctttcagtttcgcaagcaagactgcgcgatgatactgaactcagaaaatgtgcattcatttcacaagcaagcgcaactatgcaccttcctgcaactattggtgactacacggacttttacagctccaggcagcacgcgaccaatgtgggtattatgtttagagacaaagagaatgctcttatgcctaactggcttcaccttccggtgggttatcatggtcgtgcatctagcgtggtggtgtcggggacgcctatacgccgacccatgggccagatgaaaccagatgactccaagccaccagtgtacggtgcatgcaaattgctggacatggagctggagatggcctttttcgtgggaccaggaaatagactgggtgaaccaatacctatttcaaaggcacatgaacacatttttggaatggtgcttatgaacgactggtcggcccgcgatatacagaagtgggaatacgtgccattgggtccttttctcgggaagtcgtttggcactactgtctcaccatgggtcgtccccatggacgcactgatgccgtttgccgtgcctaacccaaagcaagacccacgtcctttgccctacctttgtcatgatgagccctacacctttgacattaatcttagcgtgaatctcaagggtgaaggaatgtcgcaagcagccaccatttgcaagtcgaatttcaagtatatgtattggaccatgcttcagcagctgacccaccattccgtgaacggctgcaacctgcgaccaggtgatctccttgcttctggaaccatcagcggacccgaacctgagaacttcggatccatgctggaactgtcctggaaaggtaccaagcccattgatctgggaaatggacagactcggaagtttcttcttgacggcgatgaagtgatcattaccgggtactgtcagggagatggatacagaattggattcgggcaatgtgcgggaaaggtgctccctgcccttttgccctcg

SEQ ID NO: 11743 - DNA, 1257 bp, Artificial Sequence
  Description of Artificial Sequence: Synthetic coding sequence
atgtcattcattcccgtggctgaggacagcgatttccctatccataacctgccgtacggtgtgttttcaactcgaggggatcccaggcccaggataggggtcgctatcggggaccaaatccttgacctttccatcattaagcatctcttcacgggcccagtgctgtcaaagcaccaagatgtgtttaatcagcccaccctgaacagctttatgggactggggcaagcagcctggaaggaggcacgcgtctttcttcagaacctgctgtcggtgagccaggcccgcttgcgggatgatactgagctccgcaaatgtgcatttatctcacaggcaagcgcaaccatgcatcttccagcaactattggtgattacacggatttctactcgagcaggcaacatgccaccaacgttggaattatgtttagggataaagagaatgctctgatgccgaactggctgcatctccctgttggctaccacggtagagcatcctccgtcgtggtgtccggaactcctattcggcgtcctatgggccaaatgaaaccagatgatagcaagcctccagtgtacggcgcgtgcaaactccttgatatggaactggaaatggcattcttcgttggtcccgggaatcggttgggtgaaccaatcccaatttcgaaggcacacgagcacatatttggaatggtgcttatgaacgattggtcagcaagagatattcaaaaatgggaatacgtgcctttgggaccatttctgggaaagagctttggcaccactgtgtcgccctgggtagtgcctatggatgctcttatgccgttcgctgtcccaaaccctaagcaggaccccaggcccctgccctacctgtgtcatgacgaaccgtacacttttgacattaacctttccgtgaacctgaaaggtgaagggatgtcccaggccgcgaccatttgcaagagtaatttcaagtatatgtattggacgatgttgcagcaactgacccatcattcggtgaatggatgtaacctcaggccaggcgacttgcttgcctctgggactatcagtggacccgagcctgagaattttggctcgatgctggaactgtcgtggaagggaacgaagcctatcgacctggggaatggacaaaccagaaagttcctgctggacggtgacgaagtgattatcaccggttactgtcagggagacggttaccgcatcggattcggccaatgtgccggaaaggtgctgccagcactcctgcctagc

SEQ ID NO: 11744 - DNA, 1257 bp, Artificial Sequence
  Description of Artificial Sequence: Synthetic coding sequence
atgagcttcatcccagttgccgaagatagcgacttcccaatccacaacctgccctacggggtgttttccaccaggggggacccaagaccaaggatcggtgtcgctatcggcgatcagattctggatctgagcatcatcaagcacctgtttactggccctgtgctcagcaaacaccaggacgtctttaaccagcctaccctgaattcatttatgggcctgggacaagctgcctggaaggaggcccgcgttttcctgcagaacttgctgtcagtatctcaagctaggctgagagatgataccgagttgaggaagtgtgccttcatctctcaggccagcgccacaatgcaccttcctgcaacaatcggagactacaccgatttctatagttcacgtcagcatgctaccaacgtcggaatcatgtttcgcgataaggagaacgccctgatgcccaactggctgcatctgccagtgggctaccacggacgcgcatcttctgtcgtcgtctccggcacacccatcaggcggcctatggggcagatgaagcctgatgatagcaaaccccctgtttacggcgcctgcaagctccttgatatggagcttgagatggcatttttcgtggggccaggcaacaggctgggtgagccaatccccatatctaaggctcatgagcacatctttgggatggtcctgatgaacgactggtctgctagagacatccagaaatgggaatacgtacctctgggacctttcttgggaaaaagcttcggcacaaccgtcagcccttgggtggttcctatggacgcactgatgcccttcgccgtccctaacccaaagcaagatccacgccccctgccatatctctgtcacgacgagccatacacattcgatattaacctgagtgtcaacctgaagggggagggaatgtcccaggcggccactatttgcaaatccaacttcaaatacatgtactggacaatgctgcaacagctgacccaccactctgtgaatggctgtaacctacggcctggagatcttctggcctcgggcactatctctgggccagaaccggaaaatttcggcagtatgctcgaactctcatggaagggtaccaaaccaatcgacctcgggaacggacagaccaggaagttcctgctggacggcgacgaggtgatcatcactgggtactgtcaaggagacggctatcgcatcggttttggtcagtgtgctggaaaagtgcttcctgctctgctgcccagt

SEQ ID NO: 11745 - DNA, 1257 bp, Artificial Sequence
  Description of Artificial Sequence: Synthetic coding sequence
atgtccttcataccagtcgcagaggactctgacttcccaattcacaaccttccttatggcgtgttttccacgaggggcgatccccgcccccgcatcggagtcgctatcggggatcagatcttggatttaagcattataaagcacctgtttacaggcccagtactatccaagcatcaagacgtctttaaccaaccaacgttgaacagttttatgggtttgggacaggcagcttggaaggaagctagagttttcctgcagaaccttctctcggtgtctcaggcacgattgcgtgacgacactgaactgcggaaatgtgcattcatctcccaagcctctgcaactatgcacctgcccgcgacaattggtgattacacagatttttattccagcagacagcatgccactaacgtggggatcatgtttcgagacaaagagaatgccctgatgcccaattggctgcacctgcccgtgggatatcatggcagggcgtcaagtgtggttgtgtccggaacaccaattcggcgtcccatgggacagatgaagccggacgatagtaagcctccagtgtatggcgcttgtaagctacttgacatggagttggagatggcattttttgttggtccaggaaacagactgggcgagccaatccccataagcaaggcccacgaacacattttcgggatggtgctgatgaatgactggtccgcccgtgatatccagaagtgggagtacgtgcccttgggcccttttctgggcaaaagctttgggaccaccgtaagcccttgggtagtgccaatggacgcactcatgccttttgcggtgcccaatcccaagcaggaccctcgacctctgccttatctgtgccatgacgagccctacacatttgacatcaatcttagcgtgaatttgaagggtgagggaatgtctcaggccgccacgatttgcaaatctaattttaagtacatgtactggactatgctccaacagcttactcatcacagtgtgaacgggtgcaatctccgtcccggcgacctgctcgcgtcagggacgatatctggccccgagccagagaacttcggctcgatgctcgagctgtcatggaagggaactaaacccatcgacctcgggaacggccaaacacggaaattcctgttggacggcgacgaagtcatcattaccggatattgccagggggacgggtatcggatagggttcgggcaatgtgcagggaaggtgctgcctgccctgctgccaagc

SEQ ID NO: 11746 - DNA, 1257 bp, Artificial Sequence
  Description of Artificial Sequence: Synthetic coding sequence
atgtccttcatccctgtcgcggaggattcagacttcccgattcacaacctcccatacggagtgttttccactcggggcgacccacgtccaagaatcggcgtggcaatcggcgatcagatcctcgacctgtctatcatcaagcatctcttcaccggacctgtgctgagcaagcatcaggacgtgttcaaccagcccaccctgaactccttcatgggactgggccaggccgcttggaaggaggcacgggtttttctccagaacctcctttcggtgtctcaggcccgcctgcgggatgacaccgaactgcggaagtgcgccttcatctcacaagccagcgcgaccatgcaccttcccgccaccatcggagattacaccgacttctactcctcccgccaacacgccaccaatgtggggatcatgttccgggataaggaaaatgcactgatgccgaattggctccacctcccagtggggtaccatggtcgcgccagcagcgttgtcgtgtccggaacgccgatcaggcggccgatgggccagatgaaaccggacgactcgaaaccgcctgtctacggagcctgcaagctgctggacatggaattggagatggcattcttcgtcggaccaggaaatagactcggtgaacccattccgatctcgaaagcccacgaacacatcttcggtatggtgctcatgaacgactggtcagccagagacatccagaaatgggagtacgtgccactcggaccgtttcttggaaaatcgttcggaactactgtctccccatgggttgtgcctatggacgctctgatgcctttcgcggtgccaaacccaaagcaggatcctagaccgcttccctacctgtgtcacgatgaaccttacacttttgacataaatctgtcagtgaacctgaaaggagagggtatgtcacaggcagccactatctgtaagagcaacttcaagtatatgtattggaccatgcttcaacagctcactcaccatagcgtcaacggatgtaacctccggcctggagacttgctggcgtccgggactatctcgggcccggagccggagaacttcgggtcaatgctggaactgtcatggaagggaaccaaaccgattgacctcggcaatgggcagacgagaaaattcctgctggacggcgatgaggtgatcatcaccgggtactgccagggggacgggtaccggatcgggttcggacaatgcgccggtaaggtgctgcctgcacttctgccatcc

SEQ ID NO: 11747 - DNA, 1257 bp, Artificial Sequence
  Description of Artificial Sequence: Synthetic coding sequence
atgtcgtttatacctgtagccgaagatagcgacttcccgattcataaccttccttacggcgtgttttctacgagaggagatcccaggcctcgaatcggggttgctatcggtgatcagatccttgacctgtccataataaaacatctctttaccgggcctgtactctccaagcaccaagatgttttcaaccagcccaccctgaatagtttcatgggactggggcaagctgcttggaaagaagcaagggtgttcctccagaatttattgtctgtgagccaggcaaggcttcgagatgatacagagctgcgcaagtgcgcttttatctcccaagcatccgctacaatgcatctccctgccacaattggcgattacaccgatttttattcttccaggcaacacgcaacaaacgttggcatcatgtttagggacaaggagaacgcactgatgccgaactggctgcacctgccggtgggatatcatggtagagccagtagcgtcgtcgtgagtggaacgccaatcagaaggcccatgggtcagatgaagcccgatgatagtaaaccacccgtgtacggagcctgtaagctgctggacatggagcttgaaatggccttcttcgttgggccaggaaatcgcctgggcgagccaataccaatcagcaaagcccatgaacatatcttcggaatggtgttgatgaacgattggtctgcgagagatatacagaaatgggagtatgtcccgctgggtcccttccttggcaaatcatttggcactaccgtgtcgccatgggtggtgcctatggacgcacttatgccgttcgccgtcccaaaccctaaacaagaccctcggcccctgccttatctctgccatgatgagccttataccttcgatatcaatctgagcgtcaatttgaaaggtgagggcatgtctcaagctgcaaccatttgcaagagcaacttcaagtacatgtattggacaatgctgcagcagttgacacaccatagcgtcaacggatgcaacttgcggccaggcgatctgttagcgtctgggacaatctcgggacctgagccagagaattttggctctatgctcgaactatcttggaaagggaccaagcctattgacctcggcaacggtcaaacaagaaagttcctactggatggcgatgaagtgattatcaccgggtactgtcagggggacggctatagaattggatttgggcaatgcgcaggtaaagtgctgcccgccctgcttcctagt

SEQ ID NO: 11748 - DNA, 1257 bp, Artificial Sequence
  Description of Artificial Sequence: Synthetic coding sequence
atgagctttattccagtcgcagaagattcagattttcccattcacaacttaccgtatggagttttttcgacacgaggtgatccgcgacctcgaataggggtcgctataggcgatcagatcttggatcttagtataatcaagcatctatttactggtccagtcctctctaaacaccaggatgtcttcaatcaacctactctgaattcatttatgggattgggtcaagcagcctggaaagaggcgcgtgtctttttgcagaacctgctctcggttagtcaagcgcgattgagagacgatactgaattgcgcaaatgtgcctttattagtcaagcttctgctaccatgcatttgccggccaccattggggattacacagacttttattcatcgagacagcatgcaactaatgttggaataatgttccgtgataaggagaatgcactcatgcctaattggcttcacttgccggttggttatcatggccgtgcttcatcagtggtggtatcagggacaccgattcgcaggccaatgggacaaatgaagcccgacgattcgaaaccaccagtgtatggagcatgcaaactgctggacatggagctggagatggccttcttcgtaggaccaggcaaccgcttgggagagcctattcctatttctaaagctcacgagcacattttcggaatggtgcttatgaatgattggagcgctcgtgatatacaaaaatgggaatatgtaccgcttggcccctttcttggaaagtcatttggaacaacagtctcgccatgggttgtgccaatggatgctctaatgccgtttgccgtcccaaatccaaaacaagatccacgaccattgccatatttgtgtcatgatgaaccgtataccttcgatatcaatctttccgtaaatttaaaaggagaaggaatgtctcaagcagcgactatttgcaaatcaaatttcaagtatatgtattggactatgctccagcaattgactcaccactcggttaatggttgtaaccttcgaccaggagatctcttggcgtcaggaacgatttctggaccagagcccgaaaacttcggatccatgctcgagctttcttggaaaggtactaagcctatcgatctcggtaatggacaaactagaaaatttctactcgatggggatgaagtaattatcaccggctattgccagggagatggctatagaattggatttggacaatgcgccggaaaagtccttccggctcttctcccgtct

SEQ ID NO: 11749 - DNA, 1257 bp, Artificial Sequence
  Description of Artificial Sequence: Synthetic coding sequence
atgtcattcattcctgtggccgaagactctgacttcccaatccataacctcccttatggagtcttctcaacgaggggtgatccacgtcctcgcataggggtcgccatcggcgaccagatactggatctgtccatcattaagcacctgtttaccggaccggtcctgagtaagcatcaggatgtgttcaaccaaccaacgctgaatagcttcatgggtttggggcaagccgcttggaaagaagcccgtgtttttctccaaaacttgctgtccgtgtcccaagctcgtctacgtgacgatacggagctccggaagtgcgcatttatctcacaggctagtgctacaatgcatttgcccgccaccatcggggattataccgatttctactcttcccgtcaacatgcaactaatgttggtatcatgttcagagataaggagaacgctttgatgcccaactggcttcatttgcccgttggttaccatggtcgagcgtcctctgtggtggtttccggtactccaatccgccgaccgatgggtcaaatgaagccagacgattctaagcctcccgtctacggtgcttgcaagcttttggacatggaactagagatggctttttttgttggaccgggcaacaggctcggagagcctatcccaatctccaaagcacacgaacacattttcggtatggtgctcatgaacgattggagcgcgcgggacattcaaaaatgggagtatgtccctctcggacccttcttgggcaagtcctttggtacgaccgttagcccatgggttgttccgatggatgctttgatgcctttcgctgtgccaaaccccaagcaggatcctcggccactgccctacctttgtcacgatgagccttacacctttgacattaacttgtcggtgaatctgaagggggagggcatgtctcaggctgctacaatatgtaaatcgaactttaagtacatgtactggactatgcttcaacaacttacgcatcattcagttaacggctgcaacctacgtcccggcgatctgctcgcttctggaacaatatcgggtcccgaaccggagaacttcgggtccatgttggaactgagttggaaaggaacgaaaccaatcgatttggggaacggccagacgcgaaagttcctgctggatggcgatgaggtcatcatcactgggtattgtcaaggtgatgggtatagaatcggtttcggtcagtgcgccggaaaagttcttccggcactgttgccctct

SEQ ID NO: 11750 - DNA, 1257 bp, Artificial Sequence
  Description of Artificial Sequence: Synthetic coding sequence
atgtcttttattccagttgctgaagattctgattttccaatacataatcttccatatggtgttttttcaacaagaggagatcctcgtccacgaataggagtagctattggagatcaaattttagatttatctattattaaacatcttttcacaggaccagtattgtcaaagcatcaagacgttttcaatcaacctactttaaattcatttatggggcttggacaagctgcatggaaagaagctagagtttttttacaaaatttattgtcagtatctcaagctcgtcttagagatgatacagaattaagaaaatgtgcattcatttcacaagctagtgctactatgcacttaccagctacgataggagattatactgatttttattcatcaagacaacatgctactaatgtgggtattatgtttagagataaggagaatgctttaatgcctaattggttacatttaccagtaggatatcatggaagagcttcatctgttgtcgtatcaggaactccaattagaagaccaatgggacaaatgaaacctgatgactctaaacctccagtatatggagcttgtaaattacttgatatggaacttgaaatggcttttttcgttggaccaggtaaccgtttaggtgagccaatacctatttctaaagcccacgaacatatatttggtatggtgttaatgaatgattggtcagcaagagatatacaaaaatgggaatatgttccattaggaccatttttagggaaaagttttggtactacagttagtccatgggtagttccaatggatgctcttatgccatttgcagttcctaatccaaaacaagatccaagaccacttccatatctttgtcatgacgaaccatatacttttgatattaatttaagtgttaatctcaagggagagggtatgtcacaagcagcaactatttgtaaaagtaacttcaagtatatgtattggactatgttacaacaattaacacatcattcagtaaatggttgtaatcttcgacctggagatttattagcatctggaacaatttctggaccagaaccagaaaactttggatcaatgttagaattatcatggaaagggactaaacctattgatcttggaaatggacaaactcgaaagttccttttagacggagatgaggttattattacaggatattgtcaaggagacggatataggatcggatttggacaatgtgctggaaaggtattaccagcattattaccaagt

SEQ ID NO: 11751 - DNA, 1257 bp, Artificial Sequence
  Description of Artificial Sequence: Synthetic coding sequence
atgagcttcatcccggtggctgaggattctgatttccccatccataacctcccctacggagtgttctcaactagaggagatccgcggccacgcatcggagtggcgatcggcgaccagatcctggacctctcgatcatcaagcatctcttcaccggacctgtgctgtccaaacaccaagatgtgtttaaccagccgactcttaattccttcatgggcctgggccaggcggcgtggaaggaagcacgggtcttcctgcaaaatcttctcagtgtgtcccaggcgcggctgcgtgacgatactgagctccgcaaatgcgcttttatctcgcaagcctcagccacgatgcacctccccgccaccatcggtgactacactgatttctactcgtccagacagcacgccaccaacgtgggcatcatgttcagagacaaagagaatgcgcttatgcctaactggttgcaccttccggtcggataccacgggcgggcctcgtccgtggtggtgtccggaacccctatcagaaggccgatgggccagatgaagccagacgacagcaagccgccagtttacggggcctgcaagctgctggatatggagctggagatggcctttttcgtgggaccggggaatcgcctgggagaaccaatcccaatcagcaaagcacatgaacacatcttcggcatggtgttgatgaacgattggtcagcccgggacatccagaagtgggagtacgtgccactggggcctttcctgggcaaatcattcggtactactgtctcgccctgggtggtcccgatggacgctctcatgccgttcgcggtgccaaatcctaagcaggatccacgcccattgccgtacctgtgtcacgacgaaccgtataccttcgatattaacctgagcgtcaacttgaagggagaagggatgagccaggcggccactatctgcaagtccaatttcaagtatatgtattggactatgctgcaacaactgacccaccactccgtcaatggatgcaatctgcggccgggagatctccttgcctcgggaactatttcaggaccagaacccgaaaactttggatcgatgctggaacttagctggaagggaactaagcctatcgacctgggaaacggccagacccggaagttcctgctggacggcgacgaagtcatcatcaccggctactgtcaaggcgacggctacaggatcggatttgggcaatgcgccggaaaggtgttgccggcccttctgccgtcc

SEQ ID NO: 11752 - DNA, 1257 bp, Artificial Sequence
  Description of Artificial Sequence: Synthetic coding sequence
atgtccttcatccccgtcgcagaggactcggacttccctattcataatcttccctacggcgttttcagtacgcgcggtgacccccgacctcgcatcggagttgcaatcggggatcagatcctggatctaagcatcatcaagcatttgttcaccggacccgtcctcagtaagcaccaggatgtgttcaaccagcccacgcttaacagttttatgggactcggccaggccgcgtggaaggaggcgcgcgtcttcctgcagaatctacttagcgttagccaagcacggcttcgggacgacacagagttgcgtaaatgtgcgttcatttcacaggcttccgctacgatgcacctgcctgctaccattggcgactataccgatttctatagttcccgacaacacgccaccaacgttggcataatgttccgtgataaggaaaacgctctaatgccgaactggctacacttaccggtcggttatcacggccgcgcctcctcagttgtcgtatcgggcacacctatccgccgacctatgggtcagatgaagccggatgactctaagcctccagtctacggcgcttgcaagcttctggacatggagcttgagatggccttcttcgtcggtccgggtaaccgtctcggcgagccgatccccatctctaaggcacacgagcacatttttggcatggtcctgatgaacgactggtctgcgcgcgatattcagaagtgggaatacgttcccctcggtccctttcttggcaagtcttttggaaccacagtctccccttgggtcgtccctatggatgcactcatgccctttgctgtccccaaccccaagcaggacccccgcccccttccctacctgtgtcatgatgagccttacacgttcgacatcaacttgtccgtgaacctgaagggtgagggaatgtcgcaagccgcaactatctgtaagtctaatttcaagtacatgtactggacaatgctccaacagctcacacaccattccgttaacggttgcaacctacgccccggtgaccttctggcttcgggaacaatttccggcccggaacctgagaactttgggtctatgttggaactttcttggaagggcactaagcccatcgacctgggcaatggacagaccaggaaattcctgcttgacggcgatgaggtcattatcactggatactgccagggtgatgggtaccggattggttttggccagtgcgctggtaaggtgctccctgctctactcccgagc

SEQ ID NO: 11753 - DNA, 1257 bp, Artificial Sequence
  Description of Artificial Sequence: Synthetic coding sequence
atgtcattcatcccagtcgccgaagatagcgactttcctatccacaaccttccgtacggagtgttctcgacccggggcgacccgcggccgaggatcggagtggcgatcggggatcaaattctcgacctgagcatcatcaagcatctgtttactgggccggtgctgtccaaacatcaagacgttttcaaccaaccaactctgaacagctttatgggactggggcaggccgcttggaaagaagctcgggttttcttgcagaatctgttgtccgtcagccaagcccgccttcgggacgacactgagctccggaagtgcgccttcatcagccaagcatcggccaccatgcacctgcctgccaccatcggagattacaccgacttttactcgtcgagacaacacgctaccaacgtggggatcatgttccgggacaaggagaacgccctcatgcccaattggctccacctccctgtcggataccacggacgagcaagttccgtggtagtcagcggaacccctatacgaaggcccatggggcagatgaagccagatgactccaaaccgccggtgtatggcgcctgcaagctgctcgacatggagctcgaaatggcgttcttcgtgggaccaggaaatcggttgggtgagccgattccaatctccaaggctcacgaacacatctttggaatggtccttatgaacgattggagcgcgcgcgacattcagaagtgggaatacgtcccactgggaccattcttggggaagtcattcggcacgaccgtgtcgccgtgggtggtcccgatggatgctctgatgccgttcgccgtgccgaacccgaagcaagatccgcgacctctcccgtacctgtgccatgacgaaccatacactttcgatatcaacctgtcagtgaacctgaagggagaagggatgtcacaggccgcgactatctgcaaaagcaacttcaaatacatgtactggaccatgctccagcagctcactcaccattcagttaatggttgtaatctgcggccgggagatctgctcgcatcgggaaccatctccggaccggaacctgagaattttggatccatgctggaactgtcatggaaaggaactaagccgatcgatctgggcaatggacaaacccgcaagttcctgctggacggtgacgaggtcatcatcactggttactgccagggagatgggtaccgcatcggatttggacagtgcgccggaaaagttctgccagcactcctcccaagc

SEQ ID NO: 11754 - DNA, 1257 bp, Artificial Sequence
  Description of Artificial Sequence: Synthetic coding sequence
atgtcctttattcctgtggccgaggacagtgacttcccaattcacaatctgccatatggtgttttctctactagaggagatccacgcccgcgcataggcgtcgccatcggagatcagattctcgacctttcaataattaagcatctcttcacgggacccgtgctgtccaaacatcaggatgtattcaaccaacctacactgaattcatttatgggcctcggacaagcagcctggaaggaggcacgcgtcttcctccagaacctgctcagcgtgagccaggctagactcagagatgacacagaactgagaaaatgcgctttcatttcccaggcttctgcgaccatgcatctccctgccacaattggtgattataccgatttctactccagtagacagcacgccacgaacgtgggcattatgttcagagataaggaaaacgcccttatgccgaattggctgcaccttcctgttggctaccacggacgcgccagcagcgtggtcgtgtcaggcacgccgatcaggagacctatgggtcaaatgaagccagacgactcaaagccaccggtatacggcgcctgcaagctcttggacatggagttggaaatggcattttttgtcggccccggtaataggcttggtgaacctattccgatctcaaaggcccatgagcatatttttggcatggtgctgatgaacgattggagcgcgagggacattcagaaatgggaatacgttccactgggccctttcctgggaaaatccttcggtaccaccgtgtccccctgggttgttcccatggatgctctgatgccattcgctgtgcctaatccaaagcaagatccccgcccactgccttatttgtgccacgacgagccttacactttcgacataaatctgtctgtgaatctgaaaggagaaggaatgtctcaggcagcgaccatctgtaagagcaacttcaaatatatgtactggaccatgcttcagcaactgacacaccactccgtgaacggatgcaacttgagacccggagatctgctcgcctctggaaccatcagcggccccgagcccgagaactttggaagtatgctggaactgtcttggaagggcaccaagccaatagacctcggaaacggccagacccgcaagttcctgctggacggagatgaagtgatcatcaccggctattgtcagggcgacggatatcgcattggtttcggccagtgcgccggcaaagtgcttcctgctctgttgccatcc

SEQ ID NO: 11755 - DNA, 1257 bp, Artificial Sequence
  Description of Artificial Sequence: Synthetic coding sequence
atgtcattcatccctgtcgcggaagattccgacttccccatacataacctgccttacggcgtgtttagtacacggggcgatccccgcccccgaatcggagtggccattggagatcagatcctggacctgtcaatcataaagcacctctttaccggacccgttctgtcaaagcaccaggatgtgttcaatcagcccaccttgaacagctttatgggcctgggtcaagcagcatggaaagaagcccgtgtatttctgcagaatctgctgtctgtgtcacaagcaagacttcgtgacgatacagaactgaggaagtgtgcctttatttcgcaggcttcagctactatgcatcttcccgctacaatcggagactatacagacttttactcatccaggcaacacgccacaaacgtaggtataatgtttcgcgacaaagagaacgcacttatgcccaactggttgcaccttcctgtcgggtaccacgggagggcttcgagtgtggtagtttctggaacacctattcggaggccaatgggtcaaatgaagcccgacgactccaagccacctgtatacggagcctgtaaattacttgacatggagctcgagatggctttttttgtagggcctgggaaccggcttggtgaaccaatccctatctccaaggcccacgagcatatattcggaatggtactaatgaatgactggagtgctcgtgacatacagaaatgggagtacgtgcccttaggacctttcttggggaaatcctttggaacaacagtatccccatgggtggtccctatggatgcgctgatgccttttgcagtccctaatccaaagcaggatcccagacccctgccgtatttgtgtcatgatgagccatacaccttcgacataaatctgtctgtaaatttgaagggggagggcatgtcccaggccgccacaatatgtaagtccaattttaagtatatgtattggactatgttgcagcagcttacccatcacagcgtgaatgggtgtaatttacggcctggcgacctgctggccagcggaactattagcggaccggagcctgagaactttggatctatgttggaactcagctggaagggtaccaagccgattgacctaggcaacgggcagactaggaaattcctgctggatggcgatgaagtgatcattactggctactgccagggagacgggtatcgtataggctttgggcagtgtgctggtaaggtgctccctgccctactgccttcc

SEQ ID NO: 11756 - DNA, 1257 bp, Artificial Sequence
  Description of Artificial Sequence: Synthetic coding sequence
atgtcgtttatccctgtggccgaggactccgactttccgattcataacctgccgtacggagtgttctcgaccagaggcgaccctagaccgcggattggcgtcgccataggggaccagatcttggatctgtcgatcattaagcatctgtttacgggcccagtgttgagcaagcaccaggacgtgttcaaccaaccaaccctgaacagcttcatggggctcggccaggctgcttggaaagaggcgcgcgtgtttctccaaaatctcctgtcggtgtcccaggcccgccttcgagacgacaccgagctgaggaagtgcgcctttatctcccaagcctcagctaccatgcacctgcccgccactattggagattacaccgatttctactcctcccggcagcacgcaaccaacgtgggaatcatgttcagggacaaagaaaacgcgctgatgccaaattggctccatctgcccgtgggataccacgggcgggcatcgagcgtcgtggtcagcggaactccgatcaggcgcccaatggggcagatgaagccggacgattctaagccacctgtctacggtgcttgtaagctgttggacatggagcttgagatggccttttttgtcggaccgggaaacagactgggagaaccgatcccaatttccaaggcacatgaacacattttcggaatggtgctgatgaacgactggtcggcccgggacatccaaaagtgggaatacgtcccactggggccgttcctcggcaagtcgttcgggaccactgtgtcaccgtgggtggtgccaatggacgcccttatgcccttcgcagtgcctaatcctaagcaagacccccggccgctgccatacctctgccacgatgaaccgtacacctttgatatcaacttgtccgttaacttgaagggagaaggaatgtcgcaagcagccacgatctgcaaatcgaactttaagtacatgtattggactatgctccagcagctgactcatcactccgtcaatggatgtaatcttcggccgggagacttgttggcgagcggcaccatctcgggcccagaacccgagaatttcggttcaatgcttgaactgtcgtggaaagggactaaaccgatcgatctcggcaacgggcagacgagaaagttcctgctcgacggagacgaggtgatcattacgggctactgccaaggcgatggataccgcatcgggtttggccagtgcgcaggcaaagtgttgcctgccctcctgccgtcc

SEQ ID NO: 11757 - DNA, 1257 bp, Artificial Sequence
  Description of Artificial Sequence: Synthetic coding sequence
atgtcgtttatccccgtggccgaggactccgactttcccatccataatctcccttacggagttttctccactcggggagatcctcgcccacgcattggtgtggcaattggtgaccaaatcttggacctctcgatcatcaagcacctgttcaccggccctgtcctgtcgaaacaccaggacgtgttcaaccagccgactctgaacagcttcatggggctgggacaggccgcgtggaaggaagcaagggtgttcctgcagaatctcctgagcgtgtcccaggctagactgcgcgacgacactgaattgcgaaagtgtgcctttatctcgcaagcgagcgccaccatgcatctgccggctactatcggtgactacacggatttctactcgagcaggcagcacgccaccaacgtgggaatcatgtttcgcgacaaggaaaatgccctgatgcctaactggctccacctgcctgtgggataccacggaagagcctccagcgtggtcgtctcagggaccccaattcgcagaccaatgggtcagatgaagccggacgactcaaagcctccggtgtacggcgcctgcaagttgctcgacatggaactcgaaatggcattcttcgtcggaccgggtaaccggcttggagaaccgatcccgatcagcaaagcgcatgagcatatcttcggcatggttctgatgaacgattggtccgccagggacatccaaaaatgggagtacgtgcctctgggacccttcctcggcaagagcttcggcaccaccgtgtcaccatgggtggtgcctatggatgctctgatgccatttgccgtgccaaacccaaagcaggatccgcgtcctcttccgtacctttgtcacgacgagccatacacttttgatatcaacctgagcgtgaacctgaaaggagaagggatgtcacaagcggcgactatctgcaagagcaatttcaagtatatgtactggaccatgctgcagcaactgacccaccatagcgtgaacgggtgtaatcttcgaccaggcgacctgctggcctcgggcacgatctcgggaccggagcccgaaaacttcggatcgatgctcgagctgtcgtggaagggaaccaagcctatcgacctgggaaatggccagacccgcaagttcttgctcgacggagacgaagtcattatcaccggatactgccaaggcgatggctacaggatcggattcggacagtgtgctggcaaggtgctcccggctctgctcccttca

SEQ ID NO: 11758 - DNA, 1257 bp, Artificial Sequence
  Description of Artificial Sequence: Synthetic coding sequence
atgtccttcatcccagtcgctgaggactcggacttccctatacacaacctgccgtacggcgtgttctctacccgcggagatccacgcccacgaatcggagtggcgataggagatcagatcctggatcttagcatcatcaaacatttgttcacgggcccggtcctttcaaaacatcaggatgtgttcaaccaaccgaccctgaactcattcatgggactgggtcaggcagcctggaaggaagccagagtgttcctgcaaaacctgttgtcagtgtcgcaggcacggctgcgcgatgacaccgaacttaggaagtgcgctttcatctcgcaagcctcagcgaccatgcacctccctgcaactattggcgattacaccgacttttactcctcccgtcagcacgccacgaatgtcggaatcatgtttagagataaagagaacgccctgatgccgaactggctgcatctgccggtcgggtaccatggaagggcttcctccgtggtcgtgtcgggaactcccatccgccgccctatggggcaaatgaagccggacgactcaaaaccgccagtctacggagcgtgcaagctcctcgacatggagctggagatggcgttcttcgtgggaccgggtaatcgcctcggagaaccaatccctatctcaaaggctcatgagcacattttcggcatggtactgatgaatgactggtccgcacgcgatatccagaagtgggaatacgtgccgttgggcccgttcctgggaaagtccttcggtaccaccgtgtcaccgtgggtggtccctatggacgctctgatgccctttgcggtcccgaaccccaagcaagatcctaggccgttgccgtacctgtgccacgacgagccgtacaccttcgacatcaatttgagcgtgaacttgaagggtgagggtatgtcccaggctgccactatctgcaaaagcaatttcaaatacatgtactggaccatgctgcagcagctgactcaccactccgtgaacggctgtaacctgcgcccaggcgacttgctcgcatcgggcactatatcgggacccgagccagaaaactttggttcaatgctcgaactcagctggaagggaacgaagccaatcgatctgggtaatggacaaactcggaaatttctccttgacggtgacgaagtgattatcactgggtactgccagggcgacggatatcgcatcggattcgggcagtgtgccggaaaggtgcttccggccctcttgcctagc

SEQ ID NO: 11759 - DNA, 1257 bp, Artificial Sequence
  Description of Artificial Sequence: Synthetic coding sequence
atgagctttattccagtcgcagaagattccgatttcccaattcacaatctcccatacggtgttttttcaacccgtggcgacccaagaccacggatcggtgtggcgatcggcgaccagattctggatctttcgattatcaagcacctgtttaccggaccggtgctttccaagcatcaagatgttttcaaccaaccaactcttaactccttcatgggactgggtcaagcagcgtggaaggaagcgagagtgttccttcaaaatcttctgtccgtctcccaggcacgtctgagagatgatactgagctgcgcaagtgtgccttcattagccaagcctcagccacgatgcacctcccggcaaccatcggagattacaccgatttctacagctccagacaacatgcaactaacgtgggaattatgtttcgcgataaagaaaacgcacttatgccaaattggctgcacctccctgtgggatatcatggacgcgcatcgtccgtcgtcgtgtcgggcactcctatccgccgacccatgggacagatgaagcctgatgactcgaaaccccctgtgtacggtgcctgtaagttgctggacatggaactggagatggcatttttcgtgggcccggggaatcgtctgggggaacctattcctatttccaaagcacatgaacacatctttggaatggtgcttatgaacgattggtcggccagagatatccagaaatgggagtacgtccccctcgggccttttctcggtaaatcctttggaactacggtcagcccttgggtggtccctatggatgcactcatgccttttgcagtgcctaatccgaagcaggatccaaggcctctcccatatctctgccatgatgaaccatataccttcgacattaatctctcggtcaacctgaagggtgaaggtatgtcgcaggcagccactatttgtaagagcaatttcaaatacatgtactggaccatgcttcaacagcttacccatcacagcgtgaatggttgtaacctgcggcctggcgatcttcttgcgtcgggtaccatttctggcccagagcccgaaaacttcgggagcatgctggaactgtcatggaagggcactaaaccaatagatctgggcaatggacaaaccagaaagtttttgctcgatggagatgaagtcataatcaccggatactgtcagggtgatgggtacagaatcggttttgggcaatgcgcaggaaaagtcttgccagcactgctcccaagc

SEQ ID NO: 11760 - DNA, 1257 bp, Artificial Sequence
  Description of Artificial Sequence: Synthetic coding sequence
atgtccttcattcccgtcgccgaagattcggattttcctatacacaaccttccatacggtgtttttagcacgagaggtgatcctaggcccagaataggcgtcgccatcggcgatcagattcttgaccttagcattatcaaacaccttttcaccggtcctgtgctgtcgaaacatcaggatgtgttcaaccaacctactttgaactcgtttatgggtctgggacaggctgcctggaaggaggccagagttttcttgcagaacctgctttccgtctctcaagcaagactgcgtgacgataccgaactgcgcaaatgtgcctttatctcgcaggcatcggcaactatgcacctcccagcaactataggcgactacaccgacttttactcctccagacagcatgcaactaacgtgggaatcatgtttagagacaaggagaacgcacttatgccaaattggcttcatctgccggtgggataccatggtcgcgcgtcgtccgtggtcgtctcgggaactccaattagacgtcccatgggtcaaatgaagccagacgattccaaacctccagtgtacggtgcatgcaaacttctggatatggaactggagatggcattcttcgtcggaccggggaatcggttgggcgaacctatacccatttcaaaggcacatgagcatatcttcgggatggtgctgatgaacgactggtcagcacgtgacatccagaagtgggagtacgtgcctctgggaccttttttgggtaagtcgttcggaaccactgtgtccccatgggtggtcccaatggacgcactgatgcccttcgcggtcccaaatcctaagcaagaccctaggcccctgccatatttgtgtcatgatgaaccatacacgttcgacatcaatctttcggtgaacctcaagggggaaggaatgagccaagcggcaactatttgtaagagcaacttcaaatacatgtactggactatgctgcaacaacttacccatcattcagtgaatggttgcaacctgcggccaggtgatttgctcgctagcggaactattagcggtccagaaccagagaattttggttcgatgctggaactttcgtggaagggtaccaaacctatcgatcttggtaacgggcagactagaaagttcctgcttgacggcgacgaggtgatcattactggttactgtcagggtgatggttaccggattggatttggacagtgtgctggaaaggtccttccggcccttctgccttcc

SEQ ID NO: 11761 - DNA, 1257 bp, Artificial Sequence
  Description of Artificial Sequence: Synthetic coding sequence
atgagcttcattccagtcgctgaggactccgatttcccgatccacaacctcccatacggagtcttttcgactcgaggagatccgcgaccccgtatcggagtggcgatcggagatcagatactggatttgagcataatcaagcacctctttaccggcccggttctttccaagcatcaagacgtgttcaatcaacccaccctgaattctttcatgggtcttggccaagcggcatggaaagaggctagagtctttctgcaaaacctcttgtcagtgtcccaggcgcgcctccgcgacgataccgaattgcggaagtgcgcatttatctcgcaggcatcagcaaccatgcatcttcctgccaccatcggagactacactgacttctactcgtcgcggcagcacgccactaacgtcggaattatgttccgggacaaagagaacgctttgatgccaaactggcttcacttgccagtgggataccacggacgcgcgagctcagtcgtggtgtcaggcaccccaatcaggcgcccgatgggacaaatgaagcctgacgactcgaaaccccctgtctacggtgcctgtaaactgctggatatggagctggaaatggcctttttcgtcgggccgggaaaccggctgggcgaaccaatccccatcagtaaggcacatgagcacatctttggaatggtactgatgaatgactggtcagcccgggatattcagaaatgggagtacgtcccgctcggacctttcctcggaaagtccttcggcactacggtgtcgccctgggtggtgcccatggacgccctcatgccgttcgcggttcctaacccaaaacaggacccacggccgctgccatatctgtgtcatgacgaaccttacacgttcgacatcaatctctcagtgaatctgaagggtgaaggcatgtcacaagccgccactatctgcaagtcgaactttaagtatatgtactggaccatgctgcaacagctcacccaccattccgtgaacgggtgcaacctgcgcccgggagatcttctggcgagtggaacgatctcgggcccggaaccagagaattttggatccatgctcgaactgagctggaaggggactaagccgatcgatctcgggaacggacagactcgcaagttcctgctggacggtgatgaagtgattatcactggctactgccagggggacggataccgtattggattcgggcagtgcgctggaaaggtcctgcctgcgttgctgccgtcg

SEQ ID NO: 11762 - DNA, 1257 bp, Artificial Sequence
  Description of Artificial Sequence: Synthetic coding sequence
atgtcattcatccccgtggcagaggatagcgactttcctatccataatttgccttacggtgtattctccacccggggggatcctagacccaggatcggagttgccatcggggatcagattctggacctgagcatcatcaagcaccttttcaccggcccagtcctcagcaaacaccaagacgtctttaatcagccaacgctcaattctttcatgggcctcggccaagcggcctggaaggaggcacgagtctttttgcagaacctgctgtcagtgagccaggcacggctgagagacgataccgaactgaggaagtgcgctttcatcagccaggcctctgccaccatgcacctccctgcaacaatcggtgactacaccgacttttattcaagccgccagcatgccacgaatgtcggaatcatgttccgcgataaggagaacgcactcatgcccaattggctccatcttccagttggctatcacgggagagctagctcggtagtagtgtccggcacccctattagacgacccatggggcagatgaaacctgacgactctaagcctccagtctacggtgcgtgtaagttgttggatatggagctggagatggcattctttgtcggccccggtaataggttaggagaacctatacctatctccaaggcccacgaacacattttcgggatggtgctaatgaacgactggtctgccagggacattcagaaatgggaatacgttccactgggcccgttcctgggaaagtcattcggaactactgtttcgccctgggtcgtgcccatggatgcacttatgccattcgctgtccccaacccaaagcaagatcctagaccattgccatatctgtgtcacgatgagccctacacgtttgacatcaacctttccgtgaatctgaaaggcgaaggtatgtcccaggctgcaaccatatgcaagtcaaactttaagtatatgtactggaccatgctccagcagctgacccaccatagtgttaacggttgcaacctccgccccggtgatctgttagccagtggaaccatatccgggcctgagcccgaaaacttcggcagcatgttggagctgtcttggaagggaacaaagccaatagacctgggtaatggtcagactagaaaatttttattggatggagacgaggtgatcatcactggatattgccagggagacggataccgaattggttttgggcagtgtgcagggaaggtgctgcctgcactgcttcccagt

SEQ ID NO: 11763 - DNA, 1257 bp, Artificial Sequence
  Description of Artificial Sequence: Synthetic coding sequence
atgtcctttatcccggtcgctgaggactcggactttccaattcataatctgccttacggtgtgttctcaaccaggggcgatcctcgccctcggattggagtggctatcggggaccagattctggatctgtcgatcattaagcacctttttaccggcccagtgctctcgaaacatcaggatgtctttaatcagccaactctcaactcgtttatgggactcggacaggctgcatggaaggaagcccgcgtgtttctgcagaacctgctctcagtatcccaagctagactgcgggacgatactgaactgcgcaagtgtgccttcatttcccaggcatcggcaaccatgcacctgcctgccaccatcggggattacactgacttttactcatcgaggcaacatgctactaacgtgggaatcatgttcagagataaggaaaacgctcttatgcccaactggctgcatcttcccgttggatatcatggtagagcaagcagcgtggtggtcagtggaactccaatccgccgtccaatgggacagatgaaaccagacgattcgaagccccccgtctacggagcatgcaagctgctggatatggaactggagatggcattctttgtgggtccaggaaacagattgggagaaccgattcccatctccaaggcccatgaacacatattcggcatggtgctgatgaacgattggtccgcaagagatatccagaagtgggaatacgtcccgcttgggccgtttctcgggaaatcctttggtacgaccgtgagcccctgggtggtgccaatggacgcgctcatgccttttgcggtgcctaaccctaaacaagatcctcggcctcttccctacctgtgtcatgacgagccctacaccttcgacataaacctgtccgtgaatcttaagggtgagggaatgtcccaagcggcaaccatctgtaagtcgaactttaagtatatgtactggactatgctgcaacaactcactcaccatagcgtcaacggatgtaacctccgtccaggtgatctccttgcatccggcaccatcagcggacctgagcctgagaacttcgggtcgatgcttgagctgtcctggaagggaaccaagccaatcgatcttgggaatggacagacccgcaaattcctcctggatggcgatgaagtgataatcacgggatactgccaaggtgacggataccgaataggatttggacaatgtgcaggaaaggtccttcccgcactgttgccatcg

SEQ ID NO: 11764 - DNA, 1257 bp, Artificial Sequence
  Description of Artificial Sequence: Synthetic coding sequence
atgtcttttataccggtggccgaggatagtgatttcccgattcataatcttccgtatggagtattctcaacgcgtggggatcctcgaccacgcattggtgtcgctatcggagatcaaatcctggacctttctattattaagcatctgtttactgggccggtcctttctaaacatcaggatgtttttaaccaaccgacacttaactcatttatgggccttggtcaagcggcctggaaggaagcgagagtttttttacaaaatcttttatcagtgtcccaagctcgtttgcgagacgatacagaattaagaaaatgcgcttttattagccaagcttcagcgacgatgcacttacctgcgacaattggggattataccgatttttatagttcgagacagcatgcgacaaacgtgggtattatgttccgtgacaaagaaaatgcgctgatgccgaattggttacatttgccagttggttaccacgggcgtgcgtcatctgtggttgtgagtggcacacccatccgccgtcctatgggccaaatgaagcccgacgatagtaaaccgcctgtgtatggggcgtgcaagcttttggatatggagttagaaatggccttctttgttggacctggaaaccggttaggcgaacctatccctatttctaaagcacatgaacatattttcggcatggtgttaatgaatgattggtctgctagagacattcagaaatgggaatacgtccctctagggccttttttaggtaaaagcttcggcacaactgtctcaccttgggtcgtaccaatggatgcgctgatgccttttgcggtcccgaatccgaagcaggatcctcgacccctgccgtacttatgtcatgatgagccgtatacatttgatattaatttatccgttaatcttaaaggcgaaggaatgtcacaggcagctacgatttgcaaaagtaactttaagtatatgtattggacgatgctgcagcaattgactcatcattcagtgaatggctgcaacttgagaccgggcgatctgctggcgtcaggcacgataagcggccccgagcctgaaaattttggatcaatgctggagttaagctggaaaggcacgaaaccaattgatcttggtaatgggcagacccgaaaatttttgcttgacggcgatgaagtgataatcacgggatattgtcaaggagatggatacagaattggatttggccagtgtgcgggcaaagttcttcctgcattacttccgtcc

SEQ ID NO: 11765 - DNA, 1257 bp, Artificial Sequence
  Description of Artificial Sequence: Synthetic coding sequence
atgtcatttatcccggtggccgaagatagtgattttcctatacacaacttgccctacggggtgttctctaccaggggcgacccgaggccacggattggcgtggctataggggaccaaattctggatctctctattattaagcatctctttacgggacctgtgctctccaagcaccaagacgttttcaaccagcccacattgaacagtttcatgggattgggccaggcagcatggaaagaggcccgcgtatttttgcagaaccttctgagtgtctcacaggcacgactgcgggacgatacagagcttcggaagtgcgccttcatctctcaggcctccgccacgatgcacctgccggccacaataggagattacacagatttctacagcagccgacagcacgctacaaatgtgggaattatgttccgcgataaggagaatgcgctgatgcccaattggctccacctgcccgtgggataccatgggagggcaagttccgtggtggtgagcgggacacctattcggaggccaatggggcaaatgaagcccgacgattcaaaacctccagtgtacggggcctgtaagctgctagatatggaacttgaaatggccttctttgtgggacctggcaaccgactgggcgagccaattcctatcagcaaagcccatgagcacatcttcggaatggtattgatgaatgattggtcagccagggacattcagaaatgggaatatgtacctctcggtcccttcctcggcaaatcattcgggacgaccgtgtctccttgggtagtgcccatggatgccctgatgccgtttgccgttcctaaccccaagcaggacccacgtccactcccttacctgtgtcacgacgagccttatacttttgacatcaacttgagcgtcaacctcaagggcgagggaatgtcccaagcagccactatttgcaagtcaaacttcaaatacatgtattggacgatgctgcaacaactcacgcaccatagcgtcaatggctgtaatcttcggccaggcgacctgttggcttccgggaccatctctggccctgagccagaaaatttcggctctatgctcgaactcagctggaagggcacgaagcctattgatcttgggaacggccagaccagaaagttcctcctggatggtgacgaagtgattatcacgggttactgccagggtgacgggtatcgtattggattcggtcagtgtgctgggaaagtgttacccgccctcctgccatcc

SEQ ID NO: 11766 - DNA, 1257 bp, Artificial Sequence
  Description of Artificial Sequence: Synthetic coding sequence
atgtctttcattcccgttgccgaggattctgactttcctatacacaatctgccctacggagtgttttctacccgcggcgacccaaggcctagaatcggagtcgccattggtgaccagattcttgatctgtccataatcaagcacctgttcacaggaccagtgctgtctaaacatcaagatgttttcaaccagcctacgctgaacagtttcatgggcttggggcaggccgcctggaaagaagccagggtgtttttgcagaacctcctcagcgtgtctcaggccagactgagagatgacaccgagctgcggaaatgcgccttcatctcacaggcgagcgccactatgcacctgcccgcaacgataggggattatacggacttctattccagtcggcaacacgctaccaacgtagggattatgttcagagataaagagaacgcactcatgcccaactggctgcatctccccgtcggctaccacggccgggcttcttccgtggtggtttcaggtacacctatcaggcgcccgatgggacagatgaaacccgatgactccaagccccccgtgtatggagcctgcaagctgcttgacatggaacttgaaatggcattcttcgtggggccaggcaaccgactgggtgagccgatacccatcagcaaggcccacgaacatatcttcggcatggtgctcatgaacgattggtctgccagagacatacagaaatgggagtacgtaccactgggcccctttctggggaagtcattcggaacgactgtgagcccttgggtcgtgcccatggacgctctcatgccttttgccgtccctaacccaaagcaggaccctcggcctctgccctacctgtgtcatgacgagccctataccttcgatatcaacctctccgtgaatctgaaaggtgaggggatgtcccaggctgctactatttgcaagtccaactttaaatacatgtactggacaatgctccagcagctgacacaccacagcgtgaatggctgcaatctgaggcctggggacctcctcgcctccggaactatttctggccctgagcccgagaactttgggtctatgctcgagctgtcctggaagggtacaaaaccaattgacctgggaaacggacagaccagaaaatttctgctcgacggcgacgaggttattatcaccggttactgccagggcgatgggtaccgaattggctttggccagtgcgccggcaaggtgctccctgcactgctgcccagc

SEQ ID NO: 11767 - DNA, 1257 bp, Artificial Sequence
  Description of Artificial Sequence: Synthetic coding sequence
atgtctttcatccctgtggcggaagactcagattttcctatccacaacctcccctacggggttttcagtacacggggagatccacgcccccgaattggcgtcgcgatcggcgatcaaattttggatctgtcgataattaagcacctgtttactggtccggtgctgagcaaacaccaggatgtgttcaatcagcccacactgaactcgttcatgggtctcggacaggcggcgtggaaggaggcaagagtcttcctccagaatctgctcagcgtgtcccaggccagactgcgtgacgacactgagcttcgcaagtgcgctttcattagccaggcgtcagccactatgcacctgcccgcaaccatcggggactacactgacttttatagtagcagacagcatgctacaaacgtgggaataatgtttagagataaggagaacgctttaatgcctaactggctacatcttcccgtgggatatcacggacgtgccagttccgtcgttgtgtctggcactcccatcagacgacctatgggacagatgaaacccgacgatagcaaaccgcctgtgtacggcgcctgtaaactgctggacatggaattggaaatggccttcttcgtgggcccgggaaaccgccttggcgagcccatccccatttcaaaggcacacgaacatatctttggaatggtgctgatgaacgattggtctgcacgcgatattcaaaagtgggagtatgtgccactggggcctttccttggtaagtccttcggtaccaccgtctcgccgtgggtggtgccaatggacgcactgatgcctttcgccgtcccgaaccccaagcaggacccgcgacctcttccgtatctgtgtcacgatgaaccttacacttttgatataaatctctcagttaatcttaagggcgagggtatgagtcaggctgcaaccatctgcaaatcgaacttcaagtatatgtactggaccatgctacaacagcttacacaccacagcgtgaacgggtgcaacttacgtccaggcgatcttctggccagcggcactatttcgggtcctgagccagagaacttcggaagtatgctggagttgagctggaagggaaccaaacctatcgacttggggaatgggcagacacgaaaattcttactagacggggatgaagtcatcatcacggggtactgtcagggtgatgggtaccgcattgggttcggccagtgcgcgggaaaggtgctgcccgcactgctcccgagc

SEQ ID NO: 11768 - DNA, 1257 bp, Artificial Sequence
  Description of Artificial Sequence: Synthetic coding sequence
atgagttttatccctgtggctgaagattcggacttccctattcataatctaccatacggagtcttttccacacgaggagacccacgccctcgtatcggagtggccataggcgatcagatactagacctgtcaattattaagcatctattcacaggtcccgtcttatctaaacatcaggatgtctttaatcagccaacacttaattccttcatggggctcggacaagccgcctggaaggaggcccgggtcttcctgcagaacttgctttctgtaagtcaggctcgtttgcgagacgacacggaacttagaaagtgtgccttcatttcacaggcaagcgccactatgcatctcccagccactattggcgactacactgacttctattcaagccgccaacacgccaccaatgtcggtattatgtttagagacaaagagaatgcccttatgcccaactggctccatctgccagttggatatcacgggagagcctcctctgtggtggtcagtggcactcccataaggaggcccatggggcagatgaaaccggatgacagtaaacctcccgtatacggcgcctgtaagctgctggatatggagctcgagatggctttcttcgtcggcccaggaaatcgactcggcgagcctatccccatcagcaaagctcacgaacacatatttggtatggtcctcatgaacgattggtccgcgcgagacattcagaagtgggaatacgtcccattgggtcccttcctcggcaagtcctttggcaccaccgtgagcccttgggtggttccaatggacgcgttgatgccattcgccgtgcctaacccaaaacaggatcctaggcccttgccctacctctgtcatgacgagccatacacatttgacatcaacttatcagtcaacctgaagggcgaaggtatgagccaagccgcaactatctgtaagtcaaacttcaagtatatgtactggacaatgctgcagcagctgacccaccattctgtgaatgggtgcaatctgaggcctggagacctattagcatcgggtacaatatccgggcctgaacccgagaacttcggtagcatgctcgaactcagctggaagggcacaaagcctattgatctgggaaatggacagacgcggaagttcctgctcgatggagatgaggttattattacgggttactgtcagggggacggataccgaattggcttcggtcagtgcgccggcaaagtgctgccggctctcctcccatcc

SEQ ID NO: 11769 - DNA, 1257 bp, Artificial Sequence
  Description of Artificial Sequence: Synthetic coding sequence
atgtcatttatccccgtcgcggaggattcagatttcccgattcacaatctgccgtacggagtattctcgactcgcggcgatccccgtcctcgcattggcgtcgcgatcggtgatcagatcctggacctgtccatcatcaagcacctcttcacgggacccgttctgtcaaaacatcaggatgtgttcaaccaaccgactctcaactcgttcatgggtctgggacaggcggcttggaaggaggctagagtgttcctccagaacctcctgtccgtgtcacaggcaagactcagggatgacaccgaactgcggaaatgtgcgttcatctcgcaggcatcggccactatgcacctgccagccaccattggagactacacggacttttacagcagccgccagcatgccaccaacgtggggatcatgttcagggacaaggagaacgccctgatgcctaattggttgcacctccctgtggggtaccacggacgggctagcagcgtggtggtgtccgggactccaatacgccgccctatgggccagatgaaaccagacgattctaaacctccggtctacggcgcctgcaagctcctggacatggaattggaaatggcgttcttcgtgggaccgggtaacagacttggcgaaccgatcccgatctcgaaggcccacgagcatatcttcggaatggtgctcatgaacgactggtcggcgcgggatatccagaagtgggagtacgtgccactcggtccctttctgggaaaatcattcggaactaccgtctccccgtgggtcgtcccaatggacgctctcatgccattcgccgtgcctaacccgaagcaggacccgcgcccgctgccgtacctctgccacgacgagccgtataccttcgatatcaacctgagtgtgaacttgaagggtgagggaatgtcccaagcagccactatctgtaagtctaattttaaatacatgtactggaccatgctgcaacaactgacccatcattcggtgaatggatgcaatcttcgacctggggaccttctggccagcggcaccatctcgggcccagaaccagaaaattttgggtccatgctggaactgagctggaagggaaccaagccaattgacctgggcaacggacaaactcggaagtttctgttggacggcgacgaagtcatcatcactggatactgccaaggcgatggataccggatcggattcggacagtgcgcaggaaaggtgcttcccgcactcctgccgtcc

SEQ ID NO: 11770 - DNA, 1257 bp, Artificial Sequence
  Description of Artificial Sequence: Synthetic coding sequence
atgtcgttcatccctgtggctgaggactccgacttccctatccacaacctgccctacggagtgttttcaactcgcggagatccaagacctagaatcggcgtggccatcggtgatcaaatcctcgacttgagcatcatcaagcatctgtttactggccctgtgctgtcgaaacaccaggacgtctttaaccagcctactctgaactccttcatgggcctcgggcaggcggcctggaaggaagcgcgcgtctttctgcagaatctcctctcggtgagccaagcgagactccgcgacgacaccgagttgcggaagtgcgcctttatctcgcaagcctccgccactatgcatctccccgcaactatcggcgactacactgacttctactcatccaggcagcacgcgaccaacgtgggtatcatgttccgggacaaagaaaacgcactgatgccgaactggctccatctgccggtcggataccacgggcgagcgtcgtcagtggtggtgtccggcaccccgatccgccgcccgatgggacagatgaagcccgacgactccaagccgccggtctacggagcgtgcaagctcctggatatggagctggaaatggcgtttttcgtgggaccaggcaaccggctgggagaaccgatcccaatctcaaaggcacacgaacacatttttggaatggtgctcatgaatgactggagcgcccgtgacatccaaaagtgggaatacgtgccactgggccctttcctgggaaagagctttggaaccactgtgtcgccatgggtcgtgcctatggatgcgcttatgccatttgccgtgccgaacccgaagcaggatccgcgccccttgccttacctgtgccatgatgagccgtacacgttcgacattaatcttagcgttaatctgaaaggagagggaatgagccaagccgcgaccatctgcaaatccaatttcaagtatatgtattggaccatgctgcagcaactgactcaccactcggtcaatggatgtaacttgcgtccgggggatctcctcgcctcaggaaccatctctggcccggagccagaaaacttcggatcgatgttggaactgagctggaagggcacgaaacccatcgacctggggaacgggcaaaccagaaagttcctgctggacggagatgaggtgattatcacgggttactgccaaggagacggctacaggatcggattcggccaatgtgccggaaaggtgctgccggctcttctgccatcg

SEQ ID NO: 11771 - DNA, 1257 bp, Artificial Sequence
  Description of Artificial Sequence: Synthetic coding sequence
atgagcttcatcccagtcgcggaagattcggacttcccaattcacaacctgccatacggtgtgttttcaactcgcggcgatcctaggcctcggatcggcgtggccattggggaccaaatcctggatttgtccattatcaagcatctctttactggcccggtgttgtccaagcaccaggatgtgttcaaccaaccaaccctgaacagctttatgggcctgggacaggcagcgtggaaagaagcccgggtctttctccagaacctcctctccgtctcgcaagcgagactgagagacgacacggaacttagaaaatgcgctttcatctcccaggcttccgcgactatgcacctgcctgccaccatcggagactacaccgatttctacagcagccggcaacacgccaccaacgtggggatcatgttccgggataaggaaaatgcactgatgccgaactggctgcacctgccggtcggataccatggaagagcctctagcgtggtggtttcgggtactccaatcaggcgccctatgggccagatgaagccggatgactcaaagccgccggtgtacggagcctgcaagctgcttgatatggagctcgaaatggccttcttcgtgggaccgggaaacagactgggtgagccaatccccatcagcaaagcgcatgaacacatattcggaatggtgctcatgaacgactggtcggcccgcgacatccaaaagtgggaatacgtgccactgggaccattccttggaaagagctttggaaccaccgtctcgccgtgggttgtccccatggacgcactgatgccattcgccgtgccgaatcctaagcaagacccccgcccgctgccgtacctgtgccatgatgagccatacaccttcgacatcaatctgtcggtgaatctcaagggggaaggaatgagccaggctgctaccatctgtaaatcgaatttcaagtatatgtattggactatgttgcagcagcttactcatcactcggtgaacggatgtaatctccgcccaggggacctgctggcctctgggaccatttcaggaccggaaccggaaaacttcggctccatgctggaactctcgtggaaggggaccaagccgattgatctcggaaatgggcagacgagaaaattcctgctggacggtgacgaagtgatcatcaccggctactgccaaggtgacggatacaggatcggattcgggcaatgcgccggaaaggtcctgccagccctgctgccgtcc

SEQ ID NO: 11772 - DNA, 1257 bp, Artificial Sequence
  Description of Artificial Sequence: Synthetic coding sequence
atgtcgtttataccagtggcagaagattctgacttccctatccataatcttccttacggtgttttctcaacccgcggggatcctcgccctcggattggtgtggcgatcggtgaccaaatcctggatctgtcgattatcaagcatcttttcactggaccagtgctctccaaacaccaggacgtctttaaccagcccactctgaatagcttcatgggtttgggtcaagcagcatggaaggaggcaagagtctttctccaaaacctgctttcagtctcgcaagccagattgcgcgacgatactgaacttagaaaatgtgccttcatatcccaggcaagcgccactatgcatcttccggcaactattggtgactacacggatttctactcctcccggcaacatgccaccaacgtggggattatgttccgagataaggagaatgcgctgatgcccaattggcttcatcttcctgtcggataccacggaagagcttcgtccgtggttgtctccggaacccctattagaaggccaatgggacagatgaaaccagacgacagcaagcctcccgtgtacggagcatgtaagctcctcgatatggagcttgagatggcgttttttgtgggaccgggaaatagactgggagaacccatccctatttcgaaggcacacgaacacatcttcggcatggtgctgatgaacgactggtctgcgagagatatccagaaatgggagtatgtgcctcttgggccgtttctcggaaaatcgtttggtaccactgtctcaccttgggtcgtgcctatggacgcactcatgccattcgcagtgccaaaccctaagcaagacccgcggcccctgccctacctttgccacgacgaaccatacacctttgacatcaatctgtcagtgaatctgaaaggggaaggcatgtcccaagctgcaaccatttgtaaatcaaactttaagtatatgtactggaccatgctccagcagctgactcatcattcagtcaacggttgtaacctgcgtccaggggatctgctggcatccgggacgatcagcggcccagaaccggagaactttggctcaatgcttgagctttcttggaaaggaaccaaaccaatcgacctgggtaacggccaaactagaaagtttctgctggacggagatgaagtcatcattactgggtactgtcagggcgacggttaccgaatcgggtttggacaatgcgcaggtaaggtgttgcctgcactgctcccttcg

SEQ ID NO: 11773 - DNA, 1257 bp, Artificial Sequence
  Description of Artificial Sequence: Synthetic coding sequence
atgtccttcattcctgtagcagaggacagtgacttccctatacataacttgccatatggagttttctccacgagaggagatcctcggccccggatcggggtcgctattggcgatcagatcctggatctctctatcatcaaacacctgttcacggggcctgtactgtcaaaacaccaagacgtgttcaaccagccgacattgaatagctttatgggccttgggcaggctgcttggaaagaagctcgcgtgttcctgcaaaacctcctatcagtttcccaggcccgtctaagggatgacacagaacttaggaagtgtgcattcattagccaagcgtccgcaaccatgcatcttcccgccactataggagactacacagacttctatagtagcaggcagcacgccaccaacgtgggcattatgttccgagacaaagagaacgctctaatgccgaattggcttcaccttccagttggctatcacggacgagcttcaagcgtggtcgtttctggaactcctattcgccgaccaatgggacaaatgaagcccgatgactcaaagccacccgtgtacggtgcgtgtaagctgctagatatggaactcgagatggccttcttcgtggggcctggtaatcggctgggcgaacccatacccatttcgaaggctcacgaacacatctttggcatggtgctgatgaacgactggtcagcacgggatattcagaagtgggagtatgtgccactaggtccatttctgggcaaatctttcgggactacagtgagcccatgggtcgtcccgatggacgctctcatgccatttgctgtgcctaatcctaaacaggaccctcgtcccttgccctacctttgccatgatgagccatataccttcgatatcaatttgagcgtgaatctcaagggggaaggaatgtcccaagccgctacgatttgcaagtccaatttcaaatatatgtactggacgatgcttcagcaactcacccaccactcagtgaatgggtgtaacttgcgacccggcgatctcctggccagcggcactatttccggacctgagcctgagaatttcgggtcaatgctcgagttatcttggaagggcaccaagccaattgatcttgggaatggtcagactagaaagtttcttttggatggggacgaagtgatcattactggctactgtcaaggcgatggttaccgaattgggttcggccagtgtgcagggaaggtcctccctgctctgctcccatcc

SEQ ID NO: 11774 - DNA, 1257 bp, Artificial Sequence; identical to SEQ ID NO: 11762
  Description of Artificial Sequence: Synthetic coding sequence

SEQ ID NO: 11775 - DNA, 1257 bp, Artificial Sequence
  Description of Artificial Sequence: Synthetic coding sequence
atgagcttcattccagtggcagaggactctgattttcctatccataatcttccctacggggtgttctccactcggggtgatcctaggcctaggataggggtcgccattggggatcagattctggatctgagtatcattaagcaccttttcactggacctgtgctctcgaagcaccaggacgttttcaaccaacctaccctgaactccttcatggggctgggacaggccgcttggaaggaggccagagtttttttacaaaatctgttgtccgtctcacaggcaagactgagagatgataccgaactgcgcaagtgtgcgttcatttcccaagcatctgccaccatgcatcttccagctactatcggcgactacacagacttttactcaagtcgacagcacgcaactaacgtaggtatcatgtttcgagataaggaaaatgcgctgatgcccaactggctgcacctccccgtggggtaccatggcagagcctcatcagttgtggtctccggaacgcccatcaggcggcctatgggtcagatgaagcctgatgattccaagcctcctgtatacggtgcctgtaagttgttagacatggagcttgagatggccttctttgtgggtcccggaaatcgcctcggcgaaccaattcccatctccaaggcccatgagcacatttttggcatggtcctcatgaacgactggtccgcccgcgatattcagaagtgggagtatgtcccacttggaccgttcctgggcaagtcatttggcacgacagtgtctccttgggtggtgcccatggacgccctcatgccctttgccgtgcccaatcccaagcaagacccccggccactgccatacctgtgtcacgacgagccctatacgtttgacattaatctctccgtcaatctgaagggggagggaatgagccaggccgcaaccatttgtaagtccaactttaagtacatgtattggacaatgctgcagcagctgactcaccattcggtgaatggatgcaacctcagacctggcgacctcctagcatcaggaacgatttctggtccagagcctgaaaatttcggctcgatgctcgagcttagctggaaagggacgaagccaatcgatctgggcaatgggcagacgcgaaagtttttgcttgatggggacgaggtgatcatcaccggatactgtcagggggacggctatcgcattggtttcggtcagtgtgcggggaaagtccttcctgccctgctgccttct

SEQ ID NO: 11776 - DNA, 1257 bp, Artificial Sequence
  Description of Artificial Sequence: Synthetic coding sequence
atgtcatttatcccggttgctgaggactcggatttcccgattcacaacttgccgtacggcgtgttcagcaccagaggtgaccctcgcccacgtatcggtgtggcgattggcgatcaaattctggatttgagcatcattaagcacctgtttacggggccagtgctcagcaagcaccaggacgtttttaaccagccgaccttgaactcttttatgggcctgggccaagcggcgtggaaggaagctcgcgttttcctacagaacttgctgtcagtgagccaggctcgtctgcgcgatgacaccgaactgaggaaatgtgcattcatttcccaggctagcgcgacgatgcatctccctgcaactatcggtgactacaccgatttctattcaagccgccagcacgccacgaatgtgggcatcatgtttcgcgataaggaaaatgcactgatgccgaactggctgcacctacctgtcggctatcatggcagggcgagcagcgtggttgtcagcggtacgccgatcagacgccctatgggtcagatgaagcctgatgactcaaagccgcctgtttacggcgcatgcaaattactagatatggagttggagatggcgttttttgtcggaccgggtaatcgcttgggggaaccaatccccatcagcaaagctcacgaacacatcttcggtatggtactgatgaacgactggagcgccagagacattcaaaaatgggagtacgtccctctgggtccattcctgggcaaatccttcggtaccactgttagcccatgggtcgtccccatggatgctctgatgcctttcgccgtcccgaaccctaagcaagatccgcgcccgctgccatacctgtgtcatgacgagccgtatacgtttgacataaacctgtccgttaatctgaaaggagaaggtatgtctcaggcagcgaccatttgcaaatccaactttaagtacatgtattggaccatgctccagcagctgacccaccactccgtgaatggatgtaacctcaggcctggggacttgctcgcatctggcaccattagcggtccggagccggaaaactttgggtctatgctggagttgagctggaaggggaccaagccgatcgatctgggaaacgggcagaccaggaagttcctgctggacggagatgaagtgatcataaccgggtactgccaaggcgacggctatagaatcggtttcggtcagtgcgcgggcaaagtgttgccggccctgttgccgagc

SEQ ID NO: 11777 - DNA, 1257 bp, Artificial Sequence
  Description of Artificial Sequence: Synthetic coding sequence
atgagttttatcccagttgcagaggattcggattttcccatccataatctgccatacggcgtgtttagtaccagaggcgaccccagaccccggatcggcgtcgctattggagaccaaatactggatctttctatcatcaagcatctcttcactggcccggtactctctaagcaccaggacgtgtttaaccagcccacgttaaattcattcatgggtctgggtcaggccgcttggaaggaagcccgggtgtttctccagaatctgctgtccgtctctcaggccaggctgagggatgataccgaactgcggaagtgcgcctttataagccaggccagcgccactatgcatctgccagcgacaattggcgactataccgatttctactccagcagacagcacgccacaaatgtcggtataatgtttagggataaggaaaacgccttaatgcccaattggctacacttgccagtcgggtaccatggcagagcctcatctgtggtggttagcggtacacccatccggagacctatgggtcagatgaaacctgacgattcaaaacctcctgtgtacggcgcttgcaagctattggacatggagctggagatggcattcttcgttgggccgggtaacagactgggagagccaatccccatctccaaggcacatgagcatattttcggaatggtcctgatgaacgattggagcgcaagggacattcagaagtgggaatacgtgccacttggaccctttttggggaagagctttggaaccacagttagcccgtgggtggtgcctatggacgccctcatgccctttgcagtccctaaccctaagcaagatccccggcctctgccgtacctgtgtcacgatgagccatatacttttgatattaacctgtcggtgaacttaaaaggcgagggaatgtcccaagcggccaccatctgtaaatctaacttcaagtacatgtactggacaatgctccagcagcttacacatcactccgtgaatggatgcaacctacgacccggagacctgttggccagtggcaccattagcggccccgagccggagaattttggttcaatgctggaactgtcttggaaaggcacaaagccgatcgacctcggcaacgggcagacacggaagttcttgcttgacggggacgaggtcatcataaccgggtattgccagggggacggctaccggatcgggtttggccagtgcgctgggaaggtcctcccagctctcctccccagc

SEQ ID NO: 11778 - DNA, 1257 bp, Artificial Sequence
  Description of Artificial Sequence: Synthetic coding sequence
atgagcttcatcccagtggccgaggactccgatttccccattcacaacctgccatacggagtgttcagcactagaggagatccacgcccaaggatcggagtcgcaatcggggaccagatcctggacctgtcaattatcaaacacctgtttaccggacctgtgttgtcgaagcatcaggacgtgttcaatcaaccaactcttaattccttcatgggactcggtcaggctgcctggaaagaggctcgggtgtttctgcagaacctgctgtcggtttcccaggctcgcctgcgggacgacaccgagctgcgcaaatgcgccttcatctcacaggcctccgccaccatgcacctccctgcaaccatcggcgattacacggacttttactcaagccggcaacatgccactaatgtgggcattatgttcagggacaaagagaacgctctgatgccgaattggcttcacctcccggtggggtaccacggcagggcatcctcggtcgtggtgagtgggaccccaatcaggaggcccatggggcaaatgaaaccggatgactcgaagcctccggtgtatggagcgtgcaaactgctcgatatggaactggagatggcattcttcgtggggccgggaaaccgcctcggtgagccaatcccaatctcgaaagctcatgaacacatcttcggaatggtcctcatgaacgactggtcggcgagagacattcaaaagtgggaatacgtgccactgggcccttttctgggcaagagcttcggcactactgtgtccccatgggtggtccccatggatgccctgatgccattcgccgttcctaatccgaagcaggatcctcgcccgctgccgtacctctgccacgacgagccttacaccttcgatatcaatctctcggtgaacctgaaaggggagggaatgtcacaggccgcgactatctgcaaatcgaacttcaaatacatgtactggaccatgctccagcagctgactcaccactcagtgaacggatgcaacctgcgacccggagatcttctggcgtccgggaccatttcgggtccggagccggaaaactttggatcgatgctcgagctgagctggaagggaaccaaacctatcgacctgggaaacggacagactagaaaattcttgctcgacggggatgaagttatcattactggatactgccaaggagacggataccggatcggattcggccagtgcgccggcaaggtcctccccgccttgctcccgtcg

SEQ ID NO: 11779 - DNA, 1257 bp, Artificial Sequence
  Description of Artificial Sequence: Synthetic coding sequence
atgtcgtttatacctgtcgccgaggactctgattttcctattcacaatctgccgtatggcgtctttagcactcgtggagatccccggccacggatcggggtggctattggggatcagatcttggatttgtcgatcattaaacacctgtttaccggtcccgtgctttccaaacaccaggacgtgttcaaccaacctactctgaactcatttatggggctcggacaggcagcatggaaggaagcaagggtgtttctccagaacctcctgtccgtgtcccaagcacgtctgagagacgatactgaactgcgaaaatgcgcattcatctcacaagcatcggcaactatgcatctccctgcaaccattggggattacaccgacttctactcgtcccggcaacatgcgacgaatgtgggcattatgtttagagataaggagaatgctttgatgccaaattggttgcatctgcctgttggctaccacggtcgggcctccagcgtggtcgtgtcaggtacccctattagacgtccaatgggacagatgaagcctgacgattccaagccgcctgtctacggggcgtgcaaacttctcgacatggaattggaaatggcctttttcgtcgggccaggcaaccggttgggtgaacctataccaatcagcaaggcacatgagcacatatttggtatggtccttatgaacgattggtccgcaagagacattcaaaagtgggagtacgtgcctcttggaccttttcttggaaagagcttcgggaccaccgtgtcgccttgggtggtgcctatggatgccctcatgccgttcgccgtgccgaacccgaagcaagacccaagaccactgccctacctgtgtcatgatgaaccttatacgtttgacattaatctttctgtcaatcttaaaggagaaggaatgtctcaggctgcgaccatctgtaagagcaactttaagtatatgtactggacgatgctgcaacaactgacccatcattccgtgaatggatgcaaccttcgacccggtgatctgcttgcgtcgggaaccatttcaggaccagaacccgagaacttcggctccatgctggagttgtcgtggaagggaactaaacctattgatctcggaaacggtcaaacgaggaagtttctccttgacggggatgaagttatcattactggatactgtcaaggtgatgggtacaggataggattcggtcagtgtgctggtaaggtcctgcccgcacttctccctagc

SEQ ID NO: 11780 - DNA, 1257 bp, Artificial Sequence
  Description of Artificial Sequence: Synthetic coding sequence
atgagcttcattcctgttgcggaggatagcgatttcccaattcataatttgccttacggagtttttagcaccagaggagatccaagacctcgtattggtgtcgctataggtgatcaaatcctggatctctctatcataaaacacctgtttacaggccctgtactttctaagcaccaagatgtattcaatcaacccaccttgaattcattcatgggccttggccaagctgcatggaaggaagctcgggtgtttttgcagaatctcttgtccgtgtctcaggctagactcagggatgacaccgaactcaggaagtgtgcctttattagccaggcttcagcgactatgcatctgccagctaccatcggtgactacacagatttttactcatcccgacagcatgcaactaacgtggggattatgtttcgagataaggagaacgctctaatgcctaactggctgcaccttccagtgggttatcacggtagagcctcctctgttgtggtcagtggaacacctattaggagacccatgggtcagatgaagcctgatgacagcaagcctccggtgtatggagcgtgtaagttgctagacatggaacttgagatggcttttttcgtaggtcctgggaatcgtctaggtgagccgattccaatatctaaggctcatgaacatattttcggtatggtcttgatgaatgattggtcagcacgcgacattcagaaatgggagtatgtacctttgggaccttttctagggaaatccttcggaactactgtctcaccgtgggttgtcccgatggacgctctcatgcctttcgcagtgccaaaccctaaacaagatcctcgtcccctcccatacctgtgccacgatgagccctatacgtttgacattaacctgtcagttaaccttaaaggtgagggaatgtctcaagccgccacaatctgcaagtccaatttcaaatacatgtattggacaatgctacaacaattgactcaccatagtgttaacggttgtaacctgagaccaggagatctcttagcttctggcactatctcaggacctgagccagagaatttcgggagcatgcttgagctctcatggaagggcacaaaacctatcgaccttggtaatggacagacgcgtaaatttttgcttgatggggacgaggttattatcaccggatactgtcaaggtgatggttataggattggatttggacagtgcgccgggaaggtcttgcctgctcttctccctagt

SEQ ID NO: 11781 - DNA, 1257 bp, Artificial Sequence
  Description of Artificial Sequence: Synthetic coding sequence
atgtcctttattcctgtagcggaagattcagactttcctatacacaatctgccttacggtgtgttcagcactcggggagaccctcgcccccgcattggggttgcaatcggggatcagatccttgacctgtctatcatcaagcacctgttcacaggcccagtgttgagcaagcaccaagatgtgttcaaccagccaaccttgaattcatttatgggactcggccaagctgcttggaaagaagcccgggtgttcctacagaatcttctgagcgtgtcgcaggccaggctgcgggacgacaccgaattacgcaaatgtgctttcatttcgcaagcctctgctacgatgcatttgcccgccactatcggcgactacacggacttctatagttcccggcagcacgccactaatgtgggaattatgttccgcgataaagaaaatgccctgatgccgaactggctgcatctgccagtaggctatcatggtcgggctagctccgtagtcgtttctgggacaccaatacggagaccgatgggccaaatgaagcctgatgactccaaacccccagtctacggagcttgcaaactgctggacatggagctggagatggctttcttcgtggggccaggaaaccgtctgggggagccaatacctatctctaaggctcatgagcacatcttcgggatggtgcttatgaacgactggtccgcccgcgatatccagaaatgggagtatgtacctctcggcccgtttcttggtaagagctttgggaccactgtttctccttgggtggtgcctatggacgctctgatgccatttgcggtgcctaatcccaaacaagatccccgcccgctgccttatctctgccatgatgaaccatacacctttgacataaacctcagcgtgaacctgaaaggggagggcatgtcccaagccgccactatttgcaaatccaatttcaagtacatgtattggactatgctgcaacaactgacacaccattcggtcaacggctgtaacctgaggccaggcgatcttctggcttcggggacaatttccggcccagagcccgaaaacttcgggtccatgctcgagctatcttggaaggggacaaagcctatcgatctggggaatggtcagacccggaagttcctgcttgatggggacgaggtgatcataacaggttattgccagggggatggatataggatcggtttcggccagtgtgctggaaaggtgttaccagcactgctgccaagt

SEQ ID NO: 11782 - DNA, 1257 bp, Artificial Sequence
  Description of Artificial Sequence: Synthetic coding sequence
atgtcctttatccctgtcgcagaagatagtgatttcccaatacataacctgccttatggggtattttccaccaggggcgatcctaggccacgcattggtgtggcaattggcgaccagatcctcgatctttctattataaagcacctcttcaccggccccgtgctttccaagcaccaggacgtattcaatcaacccactctgaattcttttatgggtttgggccaggccgcttggaaggaggcgagggtgtttcttcaaaatcttctctctgtctctcaagccaggcttagagacgacacggagctgcggaaatgcgcatttatctctcaggccagcgccaccatgcacctccctgccactattggtgactatacggacttttatagttcacggcagcatgcaaccaacgtgggtataatgtttcgggacaaagaaaacgctctgatgccaaattggctgcatctgcccgttgggtaccacggcagagcctcctccgtggttgttagcggcacccctatccggagacccatgggacagatgaaaccggatgacagcaagcccccggtgtacggagcgtgcaaactgctcgatatggagctggagatggccttcttcgtgggtcccgggaatcggttgggggagcctatcccaatttcaaaggctcacgagcacatcttcgggatggttctcatgaatgactggagtgctagggatattcagaagtgggaatatgtgcccctgggcccttttctcggtaaaagctttgggaccactgtgagcccgtgggtggtacccatggacgctcttatgccgtttgctgttccaaacccgaaacaggatccccgccccttgccgtatctctgccatgacgaaccttatacgtttgacatcaatctgtcagtgaatttgaaaggagaaggaatgtctcaggccgcaactatttgtaaaagtaattttaagtatatgtactggactatgctccagcaactgacccaccactccgtgaacggttgtaatctgcgcccaggcgatctcctggcgagcgggacgatctcaggtcccgagcctgagaacttcggttctatgctggagctcagctggaaagggactaaaccaatagatttggggaacggacagacgagaaaatttctgctggatggtgacgaagtgatcatcaccggatactgtcagggtgacggatatcggatagggttcggccagtgcgccggaaaggtcctgcctgcgcttttgccgagt

SEQ ID NO: 11783 - DNA, 1257 bp, Artificial Sequence
  Description of Artificial Sequence: Synthetic coding sequence
atgagctttatcccggtggccgaggacagcgattttccaatccacaacctcccgtacggagtgttctcgacccgcggcgaccctagacccagaatcggggtcgcaatcggtgaccagatcctggacctgtccatcatcaaacatctcttcactggcccggtgctctcaaagcaccaggacgtgttcaaccagccgaccctgaactccttcatgggactgggacaggcagcatggaaagaagcgagggtgttcctgcagaacctgctgtccgtgtcgcaggcgcgcttgagagatgacaccgaactgaggaaatgcgccttcatctcccaggcaagcgcaaccatgcatctgccggccaccatcggtgattacaccgatttctactcgtcccgacaacacgcgactaatgtgggaatcatgttcagggataaggaaaacgccttgatgccaaattggctgcacctgccggtcggttaccacggaagggcttcttcggtcgtcgtgtccgggacgccgatccggcgccccatgggacagatgaagccagacgactcgaagcctccggtgtacggcgcctgcaagctgctggacatggagctggagatggcattctttgtgggaccgggaaatagactcggcgagcctatccctatcagcaaagcccatgaacacattttcgggatggtgctgatgaatgactggtcggctcgcgatatccagaagtgggaatacgtgcctctgggaccattcctgggaaagagcttcggcactactgtgtccccgtgggtggtgccaatggacgcactgatgccgtttgcagtgccgaaccctaagcaggacccccgcccgcttccatacctctgccacgatgagccttacactttcgatatcaatctgtcggtgaatctgaagggagagggaatgagccaggccgctactatttgcaagagcaatttcaaatacatgtactggactatgcttcagcagctgactcaccactcagtcaatgggtgcaaccttcgccccggcgatctcctggcctccggtactatctccggccctgaacctgaaaacttcggcagcatgctggagctgtcctggaagggcaccaagccaatcgatcttggaaatggacaaacccggaagtttctccttgatggggatgaagtgatcatcaccggctactgccagggcgacggataccggatcggatttgggcagtgcgcgggcaaggtcctgccggccctgctgcccagc

SEQ ID NO: 11784 - DNA, 1257 bp, Artificial Sequence
  Description of Artificial Sequence: Synthetic coding sequence
atgtcatttattccagtagctgaggatagcgattttcccatccataacctgccgtacggtgttttcagcacccgtggggaccctcgcccccgcataggggttgccattggcgaccagatcctggacttgagcatcataaagcatctgtttaccgggcccgtcctcagcaagcatcaggatgtgttcaatcaacccacgctcaactcgtttatggggctaggtcaggccgcttggaaggaggcccgtgtattcttgcagaacctactctctgtgtcacaggctcgactccgggacgataccgaacttcgtaagtgtgcgtttatatctcaggcttcagcaacaatgcacctgccagccacaatcggcgattataccgacttttatagcagtaggcagcatgccacaaatgttggcattatgtttagagacaaggagaatgccctgatgcccaactggctccaccttcccgtcgggtaccacggacgcgcgagctctgtggtcgtttctggcacccctattagacgtcccatgggtcagatgaagcctgatgatagcaaaccccccgtttatggagcctgtaaactgctagatatggaactggagatggcatttttcgtcggacctggaaaccgtcttggtgaacccattcccatatcaaaggcacatgagcatatcttcggcatggtgcttatgaacgattggtccgcgcgggacatacaaaagtgggagtatgtaccgctgggcccgtttctagggaaatcgtttggaactacagtgtctccctgggtggtgccaatggacgccctaatgccattcgcagtgcccaatccaaaacaagaccctaggcccttgccttatttgtgccatgatgaaccgtatacatttgatataaatttgtcagtgaatctgaaaggagaagggatgtcgcaagccgctacgatttgtaagtctaactttaagtacatgtattggaccatgctgcaacaactgacgcatcattccgtcaacggctgcaacctgaggccaggcgacctgctggcaagcgggactataagtggccctgaaccggaaaatttcggctccatgctcgagctcagctggaagggaactaagcccattgacttgggtaatgggcagaccagaaagtttcttctcgatggagacgaggtcatcattactggatattgccagggcgatgggtatcgcataggatttggacagtgtgcaggtaaagtcctgcctgccctcctcccttct

SEQ ID NO: 11785 - DNA, 1257 bp, Artificial Sequence
  Description of Artificial Sequence: Synthetic coding sequence
atgagcttcatcccagtcgcagaggattccgatttccctatccacaatctcccttacggcgtgtttagcacccgcggcgatccccgaccccggatcggcgtggctatcggtgaccagatcctggacctgtcaattataaagcacctatttacgggccctgtcctgtctaaacaccaggatgtatttaaccagcctactcttaactctttcatgggcctgggacaggccgcctggaaggaagcccgggtttttctccaaaatctgttgagcgtctcccaggcacgcttgcgtgatgacaccgaactgagaaagtgcgccttcatctcacaagcgtctgctacaatgcacctccccgctacaataggagactacactgacttctacagttctcgtcagcacgccactaatgtaggcattatgtttcgggacaaagagaatgccttgatgcccaactggcttcacctacccgtggggtatcacggcagggcgagttcagtggtcgtttccgggaccccaataaggagaccaatgggtcagatgaaacctgatgatagcaagccgccggtgtatggagcatgtaaactgttggatatggagctggagatggctttcttcgtgggtcccggaaaccgcttgggggagcccatacctatctctaaagcacacgagcacatcttcggcatggtcctcatgaacgattggagtgcccgagatattcagaagtgggaatatgtccccctggggcccttcctgggcaagtccttcggaacaactgtaagtccatgggtggttcctatggatgctctcatgccattcgccgttcctaatcccaaacaggacccccgacccctgccttacctctgccatgacgagccctacacattcgacatcaacctatcggtgaacctgaaaggcgagggaatgtcccaggcagctaccatatgtaaatccaatttcaagtacatgtactggactatgctgcagcaactcacccaccattctgtgaatggttgtaatttgagaccaggagatttactggcatccggaacaattagcggtcctgaacccgagaattttgggtcaatgctggaattaagctggaagggaaccaagcccatcgatctcggtaatggccaaacccggaaattcctgctggacggtgacgaagtcatcatcaccggttattgccagggcgacggatacaggatcggcttcggtcagtgtgctggcaaggtgcttcctgccctcttgcccagt

SEQ ID NO: 11786 - DNA, 1257 bp, Artificial Sequence
  Description of Artificial Sequence: Synthetic coding sequence
atgtcgtttataccggtagcggaagattcggattttccgatacataatttaccgtatggtgtattttcgacgcgaggtgatccgcgtccgcgaataggtgttgcgataggtgatcaaatactagatctatcgataataaaacatctatttacgggtccggttctatcgaaacatcaagatgtttttaatcaaccgacgctaaattcgtttatgggtttaggtcaagcggcgtggaaagaagcgcgagtatttctacaaaatttattatcggtttcgcaagcgcgtctacgagatgatacggaattacgtaaatgtgcgtttatatcgcaagcgtcggcgacgatgcatctaccggcgacgataggtgattatacggatttttattcgtcgcgacaacatgcgacgaatgttggtataatgtttcgtgataaagaaaatgcgttaatgccgaattggttacatctaccggttggttatcatggtcgagcgtcgtcggtagttgtatcgggtacgccgatacgtcgaccgatgggtcaaatgaaaccggatgattcgaaaccgccggtatatggtgcgtgtaaactactagatatggaactagaaatggcgttttttgttggtccgggtaatcgattaggtgaaccgataccgatatcgaaagcgcatgaacatatatttggtatggtattaatgaatgattggtcggcgcgtgatatacaaaaatgggaatatgttccgctaggtccgtttctaggtaaatcgtttggtacgacggtatcgccgtgggtagtaccgatggatgcgttaatgccgtttgcggttccgaatccgaaacaagatccgcgtccgctaccgtatttatgtcatgatgaaccgtatacgtttgatataaatctatcggttaatttaaaaggtgaaggtatgtcgcaagcggcgacgatatgtaaatcgaattttaaatatatgtattggacgatgttacaacaactaacgcatcattcggtaaatggttgtaatctacgaccgggtgatctactagcgtcgggtacgatatcgggtccggaaccggaaaattttggttcgatgctagaactatcgtggaaaggtacgaaaccgatagatctaggtaatggtcaaacgcgtaaatttttactagatggtgatgaagttataataacgggttattgtcaaggtgatggttatcgaataggttttggtcaatgtgcgggtaaagttttaccggcgttattaccgtcg

SEQ ID NO: 11787 - DNA, 1257 bp, Artificial Sequence
  Description of Artificial Sequence: Synthetic coding sequence
atgtcatttatcccagtggcggaagattccgactttcctatacacaacttgccttatggagtcttttccacgcggggggacccccgccctaggatcggtgtcgcgatcggcgaccagatcttggacctgtctattataaaacatctgtttacggggcctgttctcagtaaacaccaggatgtattcaaccagccaacccttaactcgttcatgggcctcggccaggccgcttggaaagaggcccgcgtttttctgcaaaacttgctgtctgtgagtcaagccaggctaagagatgacaccgaacttcgtaaatgcgcgtttataagccaagcgtcagctaccatgcatctgccagcaaccattggcgactatacagatttttacagctctcgccagcacgctactaatgttggcatcatgtttagggataaagagaatgcacttatgcctaattggctgcatctcccagtgggctaccacgggagagctagcagcgtggtggtgtcagggacgccaatccggcgccccatgggccagatgaaaccggatgactcaaagccccccgtgtacggagcctgcaaactgctggatatggagctggaaatggcgttcttcgtcgggcccggaaataggctaggggaacccattcctattagcaaagctcacgaacacatctttggcatggtgctgatgaacgactggagcgccagagacatacaaaaatgggagtatgtgccactcgggcctttcctgggtaagtctttcggaactactgtgtccccgtgggtggtcccaatggatgccctgatgcccttcgcagtcccgaatccaaaacaggatcccagacccttgccctacctgtgccatgatgagccatatacttttgacatcaaccttagcgtcaatctcaaaggcgagggtatgagccaagcggcgactatatgcaaaagtaacttcaagtacatgtattggacaatgttacagcagctgacacaccattcggtaaacgggtgcaatttgcggcccggcgatctgttagctagcggtacgatctcaggccccgaacctgagaatttcggttctatgctggaattaagttggaaagggaccaagccaatcgatctgggaaatgggcagacgagaaagttcctacttgatggggacgaagtcattattaccggctactgtcagggagatggctaccggattgggttcggacagtgcgctggcaaggtgcttcctgccctgctgccttca

SEQ ID NO: 11788 - DNA, 1257 bp, Artificial Sequence
  Description of Artificial Sequence: Synthetic coding sequence
atgtccttcattccagtggccgaggactctgatttccctattcataacctgccttatggggttttttcgaccaggggcgacccgagacctagaatcggggtggccattggtgatcagatcctcgacctaagcatcatcaaacacctgtttaccggaccagtgttgtctaaacaccaagatgtgtttaaccagccaactcttaattccttcatgggactcggccaggccgcctggaaagaggccagggtgtttcttcagaatctgctcagtgtcagccaagcccgactcagagatgataccgaactgagaaagtgcgcgttcatttctcaggcctccgctactatgcacttacccgcaacaattggcgactatactgatttctattcatctcgtcagcatgcaaccaacgtcggaattatgttcagagataaagaaaacgctctcatgccgaactggctgcacttgccagtgggctaccacggccgagcttcttctgtggtagttagcggaacaccgatccgaaggcctatgggacagatgaaacccgatgactccaaacccccagtgtatggtgcatgcaagctgctggatatggagctggagatggccttttttgtggggcctggaaacagattgggcgagccgatccctatctctaaggcacacgaacacatctttgggatggtgcttatgaatgactggtcggcccgggatatccagaagtgggaatatgtcccacttggaccctttctagggaagagctttggaacaacagtctctccttgggtagtcccaatggacgcgcttatgcctttcgctgtgccaaatcctaagcaggatcctaggccattgccatatctatgccatgatgaaccatatacatttgacattaacctgtccgtgaacctcaagggagaagggatgtcacaggctgcaacgatctgcaagtctaactttaagtacatgtattggactatgctacagcagctgacccaccactcagtaaatgggtgtaatctaagacccggggacctcctggcttccggcaccatttccggtcccgagccagaaaactttggctctatgctggagctcagttggaagggaacgaaacccatagatctggggaatggccaaactaggaaattcctgctggatggggatgaagtgatcattactggctattgccagggggatggctacagaataggcttcggccaatgtgcaggcaaagtacttcccgccctcttgccttcc

SEQ ID NO: 11789 - DNA, 1257 bp, Artificial Sequence
  Description of Artificial Sequence: Synthetic coding sequence
atgtccttcatcccagtggccgaggactctgactttccgatccataatctgccgtacggtgtcttttcaactcggggcgatccgcgcccaaggatcggagtcgctatcggcgatcagattttggacctctccatcatcaagcatctgttcaccggacccgtcttgtccaaacaccaggatgtgtttaaccagcctacgttgaactccttcatggggctcggacaagccgcttggaaagaagcaagagtgtttctgcagaacctcctgtcagtctcccaagcacggctgcgggatgacacggaactgaggaagtgcgccttcatctcgcaagcgtccgccaccatgcatctgccagcgactattggcgactatacggatttctactcatcgcggcagcacgctaccaacgtggggatcatgttccgggataaggaaaacgcgctgatgcccaactggctgcacctcccagtcgggtaccacggacgcgcctcgtcggtggtggtgtcgggaactccgatccgtcgaccgatgggacagatgaagcccgacgactcgaagccgccggtgtacggtgcttgcaaacttcttgacatggaactcgaaatggcattcttcgtgggacctggcaacaggctgggagaacctatcccaatcagcaaagcccatgagcacatattcggaatggttctgatgaatgattggtcagcccgagatatccagaagtgggaatacgtccctctgggaccattcttgggcaagtcattcgggaccactgtgtcgccgtgggtcgttccgatggacgctctgatgccttttgcggtcccgaatcctaagcaagacccgcgcccgctgccctacctctgccatgatgagccgtacaccttcgacattaacctctcagtgaaccttaagggcgaggggatgagccaggccgcgaccatctgcaagtctaatttcaagtatatgtactggaccatgctgcaacagctcacccaccacagcgtgaacgggtgtaatctccgccccggcgaccttctggcgtcgggaactatcagcggcccggagccagagaacttcggaagcatgctggaactctcttggaaaggaactaaaccaatagacctgggcaatggtcaaaccaggaagttcctgctcgacggagacgaggtgattatcactggctactgccagggggacgggtaccggattggctttgggcagtgtgccgggaaggtccttccagctctccttccctcg

SEQ ID NO: 11790 - DNA, 1257 bp, Artificial Sequence
  Description of Artificial Sequence: Synthetic coding sequence
atgagcttcataccggttgctgaggactccgattttcccatacataacctgccttacggtgtcttcagcactaggggagacccacgtccacggattggagtcgccatcggggatcagatcctggacctgagcatcatcaagcatctgtttactggacctgtgctcagtaagcaccaggatgtgttcaatcagccgaccctgaattcctttatgggcttggggcaggcagcatggaaagaggcaagggtgtttctacagaatctcctgagcgtttcacaggcacgtctccgcgatgacactgagctgcgaaagtgcgcatttattagccaagcctctgcgacaatgcacctgccagccacaataggtgactacacagatttttatagttctcgccagcacgccacaaacgtggggataatgttccgggacaaggagaatgccctcatgcccaactggttgcacctcccagtgggatatcacggacgagcatcaagtgttgtggtttcagggaccccaatccgcagaccaatgggccagatgaaaccggatgactctaagccccccgtctatggagcttgtaaactgctggatatggagttggagatggcctttttcgtgggtcccggaaaccgactcggggagccaatccccattagcaaggctcatgaacatatttttggcatggtacttatgaacgattggtctgctcgggatatccagaagtgggagtatgttccactggggcccttcctgggtaagtcttttggtactaccgtgtctccgtgggtggtgccaatggatgccctcatgcccttcgcagtccctaatccgaagcaggaccccaggcctctgccctatttgtgtcacgatgaaccatatacgtttgatattaatctgtccgtgaatttgaaaggcgaaggaatgtcacaggccgccacgatctgcaagagcaacttcaaatacatgtattggactatgctccagcagttgactcatcactcagtgaacgggtgcaacctccgaccgggcgacttactggcctccggaaccatcagtggccctgagcccgagaatttcgggtcaatgctcgagctttcatggaagggtaccaaaccaattgatctgggaaatgggcagacccgcaaattcctgctcgacggcgatgaggtcatcattacaggttactgtcagggggatggttacagaattggattcggccagtgcgccggaaaagtgctccccgctctgcttccatca

SEQ ID NO: 11791 - DNA, 1257 bp, Artificial Sequence
  Description of Artificial Sequence: Synthetic coding sequence
atgtcgtttattcctgtggcagaagattctgacttccctatccataatctcccatacggcgtgttcagcacccggggagatccccggccaaggattggagtcgcaattggtgatcagatccttgacctgtcgataatcaagcacctgtttaccggacccgtgctgtcaaagcaccaggacgtgttcaatcaaccgactcttaattccttcatgggtctgggacaggcagcatggaaagaagcacgggtgtttctgcaaaaccttctttcagtgtcacaggcccgattgcgagatgatactgaattgcggaaatgcgcattcatttcccaggccagcgcaaccatgcatctgcccgctaccattggagattacaccgacttctattcaagcaggcaacatgcgaccaacgtggggattatgtttagagataaggaaaacgccctgatgcccaattggctgcatcttcctgtgggctaccacggacgggcatcatcggtggtggtgtccggcactcccattcgcaggccaatggggcagatgaagcctgatgacagcaagccacctgtgtacggagcatgcaagctgctggatatggagctcgaaatggcatttttcgtggggccaggtaatcgccttggggagcctatcccaataagcaaggcacatgagcacatctttggtatggtgctgatgaatgattggtccgcgcgggatattcaaaagtgggagtacgtgccacttggcccttttcttggtaagagctttggtaccactgtgtcaccatgggtggtgccaatggatgcactgatgccattcgcagttccaaaccctaagcaggacccccgccccctgccttacctgtgccacgatgaaccctacacctttgacatcaacctttccgtcaatctcaagggagaagggatgtcccaagcagcgactatctgtaagtcgaacttcaaatacatgtactggacgatgcttcagcaactgactcatcattcagtgaatggttgcaatctcagacccggagacttgctcgcctccgggactatatcgggaccagagccagagaactttggaagcatgcttgaactttcttggaagggaacgaaacccattgatctcgggaatggacaaacccgcaaatttctcctggacggtgatgaggttatcataacgggttactgtcagggggatggatatcgaatcggatttggtcagtgtgcaggtaaggtgttgcctgcactcttgccctcg

SEQ ID NO: 11792 - DNA, 1257 bp, Artificial Sequence
  Description of Artificial Sequence: Synthetic coding sequence
atgtcttttatacctgttgccgaggattctgattttcctatacacaacttaccctatggggtattttccacacggggagacccccggcccagaataggggtagccatcggagatcagatcctggatctgtctatcatcaagcatctatttacaggacccgtcctatccaaacatcaagacgtgttcaatcagcccactcttaactcatttatggggttagggcaggcagcatggaaagaagcaagggtgtttcttcagaatctacttagtgtgtcccaggcacgattgcgagacgatacagaacttcgaaaatgtgccttcataagtcaggcctccgccactatgcatcttcctgccactatcggagactatacagatttttattcttccagacagcacgcaactaacgtggggataatgtttcgggacaaagaaaacgccctaatgcccaactggcttcacttacccgtggggtatcatggacgggcgagttctgtggtggtgtcagggacacctatcaggcgcccaatggggcagatgaaaccagatgatagtaagccaccagtttacggagcctgtaaactactagatatggaactcgaaatggccttttttgtgggacccggaaatcggttaggggagccaataccgatctccaaagcccatgaacacatatttggaatggttttaatgaacgattggtccgcaagggatatccagaaatgggagtatgtcccacttggaccatttttaggaaaaagtttcgggactactgtgtccccctgggtagtgcctatggatgcattaatgcccttcgctgtgccaaaccctaaacaggatcctagacctctcccttatctatgccacgatgaaccatatacttttgatattaatttatccgtaaatctcaaaggggaagggatgtcccaggccgccactatatgtaaatccaactttaaatacatgtattggactatgcttcagcagctcacacatcattctgtcaacgggtgcaatctaaggcctggagatctcctggcctcgggaacaatttccgggccagaacccgaaaattttggaagtatgctggaactctcctggaaagggacaaaacccatcgacctcggaaatgggcagacacggaaatttctattagatggagatgaagtgataataactggatattgtcagggggatggatatagaatcggattcggacagtgcgctggaaaagtgctgcccgcccttcttccatca

SEQ ID NO: 11793 - DNA, 1257 bp, Artificial Sequence
  Description of Artificial Sequence: Synthetic coding sequence
atgtccttcatcccggtggcggaggacagcgattttcccatccacaacttgccctacggcgtcttttcgacgcgcggagacccgcgaccgcgaattggagtcgccatcggtgaccagatcttggacttgtcaatcattaagcacttgtttacgggtcccgttcttagtaaacaccaggatgtttttaaccagccgaccttgaattctttcatgggactgggccaagccgcctggaaagaagcaagagttttcctccagaacttgctttccgtttcccaggcgcgtctcagggacgatacagagctgcgcaaatgcgcgtttatcagccaggcctccgccaccatgcacctgccggccaccattggagactacactgacttctactcctcgcgacagcatgccaccaatgtgggcatcatgttccgggataaggaaaacgccttgatgccgaattggttgcaccttcccgtgggataccacggacgcgcctcatctgtggtcgtatccggtacccccattcgccgacccatgggccagatgaaaccggacgattccaagcccccggtatacggcgcttgcaaactgttggacatggaactggagatggcgtttttcgttggacctggtaatcgcctgggcgagcccataccaattagcaaagcacacgagcacatattcggcatggtcctcatgaacgactggtcggcccgagatattcagaagtgggagtacgtacccctgggcccattcctgggcaagtcatttgggactactgtgtcaccctgggtcgtgccgatggatgccttgatgccctttgcagttccgaatcctaagcaggaccctagacccctaccatacctctgccacgatgagccatatacgtttgatattaacctgagcgtgaaccttaagggcgagggtatgtcacaggcggctacgatctgcaagagcaatttcaagtatatgtactggacgatgctgcagcagctgacccaccacagcgtgaatggctgcaacctccgcccgggagacctattagcctcgggcaccatttctgggcccgagccggaaaatttcgggtcaatgctggagctctcgtggaagggcacaaaaccgatagacctaggcaatggacagacacgaaagtttctcctggatggcgatgaggttatcattacgggctactgtcagggcgatggctaccgcattggcttcggccagtgcgccggaaaagtgctgccagctcttttgccatcg

SEQ ID NO: 11794 - DNA, 1257 bp, Artificial Sequence
  Description of Artificial Sequence: Synthetic coding sequence
atgagctttatccccgtggcagaggacagcgatttcccaatacataacctgccttacggcgtattttctacccgtggcgacccacggccacgcattggtgtcgctattggtgatcaaattttagacttgagtatcatcaaacatctcttcactggtcctgtgctctcaaaacatcaggatgtgttcaaccagcctacactcaactcattcatgggcctaggccaggctgcatggaaggaggccagggtcttcctacagaatcttctgagcgtgtcacaggccagactaagagacgacaccgagctgcggaagtgcgcctttatttcacaggcgtctgccaccatgcatttgcctgcgaccatcggcgattatacagacttctattctagcaggcagcacgcaacaaacgttggaatcatgtttcgcgataaggaaaacgcgctcatgcccaattggcttcacctccctgtgggctatcacgggagggcttctagtgtagtggtgtctggaacccctattcgcaggcccatggggcagatgaagcccgacgactctaagccacctgtttacggtgcctgcaaacttttagatatggaacttgagatggccttctttgttggccctggtaatagactgggggaaccgatcccaatctcaaaagcgcatgagcatatatttggcatggtactgatgaacgactggtcagcgagggacattcagaagtgggagtacgtgcccctgggaccttttctgggtaagtccttcggaaccaccgtgtcgccatgggttgtgcctatggatgccttaatgccttttgccgtcccgaatccgaaacaagatccaagaccattgccctacctttgccatgacgagccttataccttcgatatcaatctctcagtgaatctgaagggtgaagggatgagtcaggcggccacaatctgcaagtccaatttcaaatacatgtactggactatgttgcagcaactgacacatcactctgttaacggttgcaaccttaggcccggggacctcctcgctagcggcaccatctccgggcccgaacctgagaatttcggttccatgctggaactgagctggaagggcacaaagcctattgatctgggcaacggtcagactaggaagttcctcctagacggagacgaagtcattatcacggggtattgtcagggagatggctaccggataggctttgggcagtgtgccggaaaggttttgccagccctgttgcccagc

SEQ ID NO: 11795 - DNA, 1257 bp, Artificial Sequence
  Description of Artificial Sequence: Synthetic coding sequence
atgtcctttatccctgtggcggaagattcggattttccaatacacaatctcccatacggggtcttttcgacccggggggatccccgcccacggataggagtggcgattggcgatcaaattctggatctgagcatcattaagcacctgttcactgggcctgtcctgagcaaacatcaggacgtgtttaatcagccaacgcttaacagctttatgggactgggacaagcagcatggaaggaagccagagtgtttctgcagaacttgctgtccgtcagccaagcacggctgcgcgatgataccgaactgcggaagtgcgcttttatctcgcaggcatcagctactatgcatcttcccgccaccatcggagattacaccgacttttacagctcccgccagcacgcaactaatgtgggcattatgttcagggacaaagaaaatgcactgatgcccaactggctgcacctccctgtggggtaccacggtagagcgtcctcagtcgtggtcagcggtactcctattcgacgaccgatgggccaaatgaagccagacgactcgaagccccctgtctacggagcctgcaagttgctcgatatggagcttgagatggccttctttgtcggaccaggaaaccggctgggagaaccgatccctatctcgaaggcccatgaacacattttcggtatggtgctgatgaacgattggagcgcaagagacattcagaagtgggagtacgtccctctcggtccatttcttggaaaatcttttggtaccactgtgagcccttgggtggtgcctatggacgcgctcatgccttttgcagtgccgaatccgaaacaggacccaaggccgctgccttacctctgccacgacgagccatacacctttgacattaatctgtcggtgaatctcaaaggcgaaggcatgtcacaggctgcaactatttgtaaatccaacttcaagtatatgtattggacgatgcttcaacaactcacccaccattcggtgaacggatgcaatcttagacctggtgacctgttggcaagcggtactatttcgggacccgaaccagagaacttcgggtcgatgctcgaattgtcctggaaggggaccaaaccaatagatctcggaaacgggcagacccgcaaatttctgcttgacggggatgaggtgatcattaccggatactgccagggggatggataccggattggcttcggacaatgtgccggtaaggtgctgcccgcactgctcccatcc

SEQ ID NO: 11796 - DNA, 1257 bp, Artificial Sequence
  Description of Artificial Sequence: Synthetic coding sequence
atgagcttcattccggtcgctgaagattctgacttcccgatccataacctgccgtacggcgtgttttcgacccggggcgacccaaggccgcgcatcggagtggccatcggagatcagatcctggatctctcgatcatcaaacacctgttcactggaccagtcctgagcaagcaccaggatgtgttcaatcaaccgaccctgaattcgttcatgggactgggacaggccgcgtggaaggaggcccgggtattcctccaaaacctgttgagcgtgtcccaggcgagactgcgcgacgacaccgagctccggaaatgcgcgttcatttcgcaggcttcggcgaccatgcatctgcccgccacgatcggtgactatactgacttctattcgtcgcgccaacacgcaaccaacgtgggcatcatgttcagagacaaggagaatgccttgatgccgaattggcttcacttgcctgtgggctaccacggcagagcgtcatcggtcgttgtctccggcacgcctatacgtcgccctatggggcagatgaagccggatgactcgaagccgcccgtctatggcgcctgcaagctcctggacatggaacttgaaatggcctttttcgtggggccgggtaaccggctgggagaaccgatcccaatctcgaaggcacatgaacacatttttggaatggtgctgatgaacgactggtctgcaagagacattcagaagtgggagtacgtgccgctcggcccattcctgggcaaatcctttggaactactgtctcaccgtgggtcgtcccgatggatgcactgatgccgttcgcggtgccgaatccgaagcaggacccacgcccgctgccgtacctgtgtcacgatgagccgtacactttcgatatcaacctgtcagtgaaccttaagggggaaggaatgagccaagcggccactatctgcaaaagcaactttaagtatatgtactggaccatgctccagcagctgacccatcactctgtgaacggatgtaatctgcgaccgggagatctgctggcctccggaacgatctcgggtcccgagccggaaaacttcggtagcatgctcgaactgtcttggaaaggcactaagccgatcgacctcggcaatggccaaactcggaagttcctgctggacggtgatgaagtgattatcaccgggtactgccagggggatggataccgcatcggttttggacaatgcgcggggaaagtgctccccgcgctgttgccttca

SEQ ID NO: 11797 - DNA, 1257 bp, Artificial Sequence
  Description of Artificial Sequence: Synthetic coding sequence
atgagcttcatcccagtggctgaagactccgactttcccatccacaacctgccatatggagtgttctccactaggggagatcctagaccacgcataggcgtagctattggagaccaaattctcgacctttctatcatcaagcatttgttcaccggacctgtgctgtctaagcaccaagatgtgtttaatcagcccacactgaatagttttatgggcctgggtcaggccgcctggaaggaagcaagggtgttcctccagaacctccttagtgtctcccaggccagactcagagacgacactgagcttcgtaagtgcgcctttatctcccaagccagcgctactatgcacctccccgctactattggtgactacactgatttttactcctcaagacagcacgctactaacgtcggcatcatgttcagggacaaggagaacgctttgatgccaaactggctgcaccttcccgttggataccacggacgtgcaagctcagttgtcgtgagcggcacacccataaggagaccaatgggccagatgaaaccagacgactcaaagccacctgtgtacggcgcctgtaagctgctggatatggaactggagatggccttcttcgtaggacccggtaaccgtctgggagaacccatacctatctccaaagcacacgaacacattttcggtatggtccttatgaatgactggtctgctcgcgacatccagaaatgggaatatgtaccattgggccccttccttggaaaatcctttggcactacagtatcaccctgggtggtacccatggacgcccttatgccttttgccgtgcccaaccccaagcaagacccaaggccactcccctacctgtgtcacgatgaaccatacacatttgacatcaaccttagtgtcaacttgaagggcgagggtatgagccaggctgccaccatctgcaagagcaattttaagtatatgtactggacaatgctgcagcagctgacacaccacagtgtgaatggatgcaacctcagacccggtgatctgctcgcttcaggcaccatatcaggtcctgaacctgagaacttcggtagtatgttggaactctcatggaagggtacaaagcctatagacctgggcaatggccagactaggaagttcctgttggacggcgacgaggtaattatcaccggatactgccagggcgatggttacaggatcggcttcggccagtgtgctggaaaggtgttgccagctctcctgccaagc

SEQ ID NO: 11798 - DNA, 1257 bp, Artificial Sequence
  Description of Artificial Sequence: Synthetic coding sequence
atgagcttcatcccagtagcagaagactcagacttcccgatccataatctcccctacggggtatttagtacacgcggcgaccctcggccgcgcataggcgttgcaatcggggaccaaattcttgacctcagcatcattaaacatttattcaccgggccagtgctctccaagcaccaagatgtgtttaatcagcccaccctgaattcgtttatgggactaggccaggctgcttggaaggaagctagagtgttcctccagaatctgctttcagtgtcacaggctagattacgagacgacactgagctgcgaaaatgcgctttcattagtcaagcctccgccacgatgcatttacccgctaccatcggtgactacacagacttctactcgagtcggcagcacgccacaaatgtcggcattatgttcagagataaggaaaacgccctgatgcccaactggctgcacctccccgtgggatatcatgggcgggctagcagcgtggtcgtctctgggactcctattaggaggcctatgggccagatgaagcctgacgacagcaagccgcctgtttatggcgcctgcaagctgctggacatggagctggaaatggccttctttgtcggccctggaaaccgcctcggcgaaccaataccgatctctaaggctcatgaacacatttttgggatggtgctgatgaatgattggtccgcaagagatatacaaaaatgggaatacgtccctttaggccccttccttggcaagtcgttcggaacaacagtcagcccgtgggtggtgccaatggacgctctcatgccattcgccgtcccaaaccctaagcaggacccccgtccccttccttacctttgtcatgatgagccctacactttcgatattaacttgtcagttaaccttaagggcgaggggatgagtcaagcagccacaatctgcaaaagtaactttaagtatatgtactggaccatgctccagcagctgactcaccacagcgttaatggatgcaatcttcggccaggagatttactggcaagtggcactatttccggcccagagcctgaaaatttcgggagtatgcttgagctctcctggaagggcacaaaacccatagacctcggaaacggccagacaaggaagtttcttctggacggcgatgaagtaatcatcacaggctactgccagggagacgggtatagaatagggtttggccaatgtgccggcaaggtgttgccagctctgctgccatca

SEQ ID NO: 11799 - DNA, 1257 bp, Artificial Sequence
  Description of Artificial Sequence: Synthetic coding sequence
atgagcttcatccctgtggcggaggactcagattttcctatccacaacttgccctacggcgtgtttagtactcgaggtgatcccagacccaggatcggagtcgctataggagatcagatcctcgatctgtccattattaaacatctgtttaccggccctgtgctgtcaaaacatcaggacgtctttaatcagcctactctcaatagtttcatgggcctggggcaagcagcttggaaggaggccagggtattccttcagaacttgctgagtgtttctcaggcaaggctccgcgacgatacggaactcagaaaatgtgccttcatctcacaggcttccgcgaccatgcaccttcccgccaccatcggtgattacacggatttctattctagtcgccaacacgcaacaaacgtagggattatgtttagggacaaggaaaatgctttgatgcccaattggctgcaccttcctgtgggttaccatggacgggcgtcctccgttgttgtgtctgggacccctatcagaagaccaatgggtcaaatgaagccggatgattcaaaacctccggtgtacggagcctgtaaactcctggatatggagctggagatggccttctttgttgggcctgggaataggctcggtgagccaatccctatcagtaaggcacatgagcacattttcggaatggtcctgatgaatgattggtccgcacgcgatatccaaaagtgggaatacgtgccgctcgggccctttcttgggaagtcttttggtaccacagtgtcaccctgggtggtaccgatggatgctctgatgccttttgccgtacccaaccctaagcaagatccccggcctttgccttatctgtgccatgacgagccctatacctttgatatcaatctttctgtcaacctgaagggagagggcatgtcacaggccgctaccatctgcaagagtaattttaagtacatgtattggactatgctgcagcaattgacgcaccacagtgtgaacggctgcaaccttaggcccggggaccttctggctagtggcaccatcagcgggcccgagcctgaaaacttcggttcaatgctcgagctctcctggaaggggacaaagcctatcgatctcggcaatggacagaccaggaagtttctccttgatggtgacgaagtgatcatcactggatattgccagggcgatggttatagaatcgggttcggccagtgcgccggaaaggtcctgccagcccttctcccgtct

SEQ ID NO: 11800 - DNA, 1257 bp, Artificial Sequence
  Description of Artificial Sequence: Synthetic coding sequence
atgtcattcatacccgtggccgaggatagcgattttccaatccataacttgccttacggagtgttctcaactagaggtgatcctagaccgcggatcggagtggcaattggagatcagattctggatctgtcgattatcaaacatctttttaccggtccagtgctctccaagcatcaggatgtgtttaaccagccaactcttaactccttcatgggcttggggcaggcggcatggaaggaagctagagtctttctgcaaaaccttctctcagtgtcacaagccaggctgagggatgacactgaactccggaaatgtgcgttcattagccaggcatcggccacgatgcacctgccagcaactatcggtgactacaccgacttttactcgtcacgtcaacacgcgaccaacgtgggtataatgttccgagacaaagagaatgcgcttatgccaaactggctgcatcttcctgtgggataccacggccgggcatcaagcgttgtggtgagcggtacccctatcaggaggcctatgggccaaatgaagccggatgactccaagccccccgtctacggagcttgtaaacttctcgacatggaactggagatggcttttttcgtggggcctggaaaccgactgggcgagccaatacccatatcaaaggcacatgaacatatctttggcatggtgctcatgaacgactggtccgccagagatatccaaaagtgggagtacgtccctttgggaccatttctcggtaagtcgttcgggaccactgtctccccgtgggtggtgccgatggatgcactcatgccgtttgcggtgccaaaccctaagcaggatccgcgcccgctgccatacttgtgccatgacgaaccttacacctttgatatcaacctcagcgtgaacttgaagggagaggggatgtcccaagcagccacgatttgtaaaagcaatttcaagtatatgtattggaccatgctccagcaactcactcaccactcagtaaatggttgtaatcttcgacccggggatcttcttgcgtcgggcacgatttcgggacccgaaccggagaattttggctccatgcttgaattgagctggaagggcaccaagcctatcgatctgggtaatggtcaaacccggaagtttcttcttgacggcgatgaggtcatcattactggttactgccaaggagacggttatcgcattggttttggtcagtgcgcgggaaaggtcctccctgcactgttgccttca

SEQ ID NO: 11801 - DNA, 1257 bp, Artificial Sequence
  Description of Artificial Sequence: Synthetic coding sequence
atgtcattcatacctgtggcagaagattccgacttcccaatacacaatctcccatacggagtctttagcacccggggggatccacgcccaagaatcggcgtggcaataggtgatcaaattctcgacctttcaatcataaaacatctttttactggtccggttctttcaaagcatcaagatgtctttaatcagcctaccctgaattcgttcatgggacttggccaagcagcgtggaaggaagcacgggtgtttctccaaaatcttctctccgtatcccaggccaggctgcgagacgatacggaactgcggaaatgtgcattcataagtcaagcatccgcaaccatgcatctgccagcaactattggagattacaccgatttctactcctcgaggcaacacgccaccaacgtgggcattatgtttagagacaaggaaaacgctctgatgcctaattggcttcacctgcctgtggggtaccatggccgcgcctcgagcgtggtcgtgtcgggaactccaatccggcgcccaatggggcagatgaagccagatgatagcaagccaccggtgtatggtgcttgcaagctccttgatatggaactggagatggcattctttgtgggccctggaaatcggcttggagaacctattcctattagtaaggcacatgaacatatcttcggcatggtgctcatgaacgactggtcagccagggacattcagaagtgggagtacgtccctctgggtcctttcctggggaagagctttggtacgaccgtgtccccatgggtggtgccaatggacgctcttatgccatttgcggtgccaaacccaaaacaagatcctcgtccactgccttacctttgccacgacgagccctacacttttgacatcaacctttccgttaacctgaaaggggaaggtatgagccaagcagcaaccatctgcaagtcgaactttaagtatatgtactggactatgctgcagcagctgacccatcatagcgtcaacggatgcaacctgcgccccggtgatctgctggcgtccggaactatttcggggcctgaacctgaaaacttcggatccatgttggaactgtcctggaaagggaccaaacctatcgatctcggcaatggtcagacgcgaaagtttcttcttgatggagatgaagtcattatcaccggatactgtcagggggatgggtaccgcattggttttggacagtgtgcagggaaggtcttgcctgctttgctgcctagc

SEQ ID NO: 11802 - DNA, 1257 bp, Artificial Sequence
  Description of Artificial Sequence: Synthetic coding sequence
atgtccttcatccctgtcgcggaagatagcgattttccgattcacaaccttccgtacggggtgttcagcaccagaggggaccccaggccacgaatcggggtcgccattggcgaccaaatcctcgacctctcgatcattaaacatctctttaccggtccggttctgtccaaacaccaagacgtattcaaccagccaaccctgaactccttcatgggactcggacaggcggcctggaaggaagcgcgcgtctttctgcagaacctgctctcggtgtctcaggctcgcctgcgtgatgatactgaactccgcaagtgcgcctttatctcccaggcatcagctacgatgcatttgccggctacgatcggagattacaccgacttctactccagccggcagcacgccaccaatgtgggcatcatgtttcgcgacaaggaaaatgcgctgatgccaaattggctgcatctgccggttggataccacgggcgcgcaagctccgtggtggttagcggcacgcctattaggcggcccatgggacagatgaagcctgacgattccaaacctccggtgtacggggcttgcaagctcctggatatggaactggagatggctttctttgtcggacctggcaataggttgggcgagccgattccgatctcgaaagcccatgagcacatcttcggtatggtgttgatgaacgactggtcagcacgggacatccagaagtgggagtacgtgcctctcggcccattcctgggcaaatcattcggtaccaccgtctccccttgggtcgtgcctatggacgcattgatgccattcgccgtgcccaatccaaagcaggacccgcggccgttgccgtacctctgtcacgacgaaccatacaccttcgacatcaacctttctgtgaacctgaagggggagggaatgagccaggctgcaaccatctgcaagtctaacttcaagtacatgtattggaccatgcttcaacagctgacccaccacagcgtgaacggatgtaacctgcgccctggcgacctcctggcatcgggtactatttccggacctgagcctgaaaacttcggatcgatgcttgaactgtcctggaagggaaccaagccaatcgacctgggaaatggccagactcgcaaattcctcttggacggagacgaggtcatcataacggggtactgccaaggcgatggataccgcatcggctttggacaatgcgcgggaaaggtcctgccggcactgttgccctct

SEQ ID NO: 11803 - DNA, 1257 bp, Artificial Sequence
  Description of Artificial Sequence: Synthetic coding sequence
atgtcctttatcccagtggcagaggattccgattttccaatccacaacctcccttacggggtcttttccacgagaggtgatccaagaccgcgaatcggtgtggccattggagatcaaattctggacctctccatcattaagcacctctttactgggcctgtgctgtccaagcatcaagatgtctttaatcagccgaccctcaacagctttatgggtcttggacaggcagcctggaaagaagcgagagtgtttctccaaaacctgcttagcgtgtctcaagccaggcttcgtgatgacacggagctgcgcaagtgtgcctttatctcccaagcgtctgcgaccatgcatctgcctgctactattggtgattacaccgacttttactcgtcgagacaacacgcaaccaatgtgggtatcatgttcagggataaggaaaacgcacttatgcctaattggctgcatcttccagtcgggtaccatggaagggcatcatccgtcgtcgtgtcggggacccctattcggcgccccatgggccaaatgaagcctgatgactcaaagccccccgtctacggagcttgtaagttgcttgatatggagcttgaaatggcatttttcgtcggccctggtaacaggctgggcgaaccaattccaatttccaaggcccatgaacacattttcgggatggtgttgatgaatgattggtctgcaagagacatccaaaagtgggaatacgtcccccttggcccttttttggggaagagcttcggtaccaccgtgagcccttgggtggtgcctatggacgcactgatgcccttcgcagtgccaaacccaaagcaagatcctcgacccttgccatacctttgtcacgatgaaccgtacacgtttgacatcaaccttagcgtgaatctgaagggagagggaatgtcgcaagcagccaccatttgtaagtccaactttaagtatatgtattggaccatgctccaacagctgacccaccactcggtcaacgggtgtaaccttcgaccgggggacctgctcgcctcggggactatatcgggtccagagcccgaaaacttcggttcgatgcttgaactctcctggaaaggcactaagccaattgacctggggaacggacaaactcggaaatttctcctggatggcgacgaggttatcattaccggatattgccaaggtgatggataccgcatcggcttcggacaatgcgccggtaaagttctgccggccctgttgccatcg

SEQ ID NO: 11804 - DNA, 1257 bp, Artificial Sequence
  Description of Artificial Sequence: Synthetic coding sequence
atgtctttcataccggtggccgaagattcggacttccctatccataaccttccgtacggcgtcttctctacacgcggggacccgcggcccagaatcggtgtcgccatcggggaccagatactggatttgtccatcattaagcacctctttaccggcccagtactgtcaaagcatcaggatgtgttcaatcagcccacactaaatagctttatgggattaggccaggccgcttggaaagaggctcgagttttcctccaaaaccttctttccgtcagccaggcccgtctgcgcgatgataccgaacttagaaagtgcgcgtttatctctcaggcgagcgccactatgcacctccctgcaacaatcggagactataccgacttctactcctcccgccaacatgccactaacgtcgggatcatgttccgggataaggagaacgccctgatgcccaactggctgcatttgcccgtgggctatcatggccgcgccagcagtgtcgtcgtctccgggacccccattagacgaccaatgggccagatgaagcccgacgatagtaagccaccggtttatggagcatgcaaactactggacatggaactagaaatggccttctttgtgggcccagggaaccggctcggcgaacctatccctatcagcaaagcccatgagcatatattcggaatggttctgatgaatgactggagcgctcgggacattcagaaatgggagtacgttcccctaggcccttttttgggaaagtccttcggaaccactgtgagtccctgggttgtgccgatggacgcgctgatgccatttgccgttccgaatccaaaacaggatccgcgcccactgccgtacctgtgtcacgacgagccttacacattcgatataaatttgtccgtaaatcttaagggggaaggaatgagtcaagccgccaccatctgtaagtccaatttcaagtacatgtattggacgatgctccagcagctgacccaccactctgttaatggatgtaaccttcggccaggtgaccttctagcttccggcactatttcgggtccagagcctgaaaattttggtagtatgttagagctgagttggaagggcactaaacctattgaccttggaaatgggcagacacggaaattcttgttagacggcgacgaggtcatcataactggttactgtcagggggatggctatagaataggatttggacagtgtgctggaaaagtgctcccggcgttactgccttct

SEQ ID NO: 11805 - DNA, 1257 bp, Artificial Sequence
  Description of Artificial Sequence: Synthetic coding sequence
atgtccttcattcctgttgcagaggacagcgactttcctatccacaatctgccctacggagtttttagtacccgtggcgacccacgacccaggattggagttgctattggcgaccagattctggatctgagcataatcaagcatttgttcacagggccagttctgtcaaagcaccaagacgtgtttaaccagcccactctgaactcattcatgggactgggtcaggcggcctggaaggaggcccgagtgtttctccagaacctgctgtctgtctctcaagcaagacttagggatgataccgagctgcggaaatgtgctttcataagtcaggcaagtgcaacaatgcatctgccagcaaccattggagactacactgacttttattcctcccggcaacacgcaacaaacgttggaatcatgttccgggataaggaaaacgcgttaatgcccaactggctgcacctccccgtagggtatcacggcagagcctcctcagtggttgtgtccggtaccccaatacggagacccatgggacagatgaaaccggacgatagcaaaccccccgtgtacggtgcctgcaagctgctggatatggagctagaaatggcttttttcgtgggtcctggaaacaggctaggagaaccaattcccatatccaaggcccatgagcacatcttcggtatggtgctgatgaacgattggtctgcacgggatatccaaaaatgggagtatgtacctttagggcctttcctcgggaagtccttcggcacgactgtatcaccttgggtggttccaatggatgcactgatgccttttgccgtgccaaatcccaagcaagatccccgtcctttgccttatctgtgtcacgatgagccatacacttttgacatcaacctgagcgtaaacctgaaaggtgaaggaatgtcccaggcggccaccatctgcaagtccaacttcaaatacatgtactggacaatgttgcagcagttgacacaccattctgtgaacgggtgtaatctgagacccggggatcttctggcatccggcacaatatccgggcccgagccggagaacttcggctcaatgttggagctcagctggaaaggaactaagcccatcgacctgggtaacggacagacacgcaaatttctgctggacggggacgaagtgattatcacggggtattgccagggcgacggctatcggattgggtttgggcaatgtgccgggaaagtgctcccagctctcctgcctagc

SEQ ID NO: 11806 - DNA, 1257 bp, Artificial Sequence
  Description of Artificial Sequence: Synthetic coding sequence
atgagttttataccagtggccgaagattctgacttccccatccataaccttccctacggggtttttagcactcgcggggaccctcgccctcggattggcgttgcaatcggggaccagatcctggacctgtccattatcaagcacctgtttaccggacctgtgctaagcaagcaccaggatgtgttcaaccagcccactctgaatagcttcatggggcttggccaggctgcctggaaggaggcccgggtttttctgcaaaatcttttaagcgtgtcacaagcacggctgcgggatgataccgagttaagaaaatgtgccttcataagtcaggctagcgccactatgcatctcccagccacaattggcgactatactgacttctactcaagtaggcaacacgctacaaacgtggggattatgttccgtgacaaggaaaacgccctgatgcctaactggctgcatctgcctgtggggtaccatgggagggcctctagcgtggtggtgtccggaacacctataagaagacctatgggccagatgaagccagacgattccaagccaccagtttacggcgcctgcaagttgctcgatatggagctagagatggcctttttcgtagggcctggcaatagactgggcgagcctattcctatcagcaaagcccatgagcacatcttcggtatggtgctaatgaacgactggtctgctagagatattcagaaatgggagtatgtccccctggggccatttctaggcaagtcattcgggacaaccgtcagtccttgggtggtgcccatggacgccctgatgccttttgccgtgcctaacccaaagcaagatcccagacctctgccttacttatgtcatgacgaaccttacaccttcgatattaacctcagcgtgaacctgaagggggaaggcatgagccaggccgcaacaatctgcaaatctaatttcaagtatatgtactggacaatgctgcaacagttgacacaccactctgtcaacgggtgcaatctgaggcctggggatctactagccagtggcaccatctccggccccgaacctgaaaatttcggcagcatgctcgaactctcttggaaagggaccaagccaattgacttaggcaatggccagaccagaaagttcctgctggacggcgatgaggttatcatcaccggctactgccagggggatggctacagaattggtttcggacagtgcgcaggcaaggtgctccctgccctgctcccatca

SEQ ID NO: 11807 - DNA, 1257 bp, Artificial Sequence
  Description of Artificial Sequence: Synthetic coding sequence
atgtcgttcattcccgtcgcagaggatagcgattttcctatccacaatctgccatacggtgtgttcagcaccaggggggatccacgcccgagaattggagtcgctataggggaccagatcctggatctttccatcataaagcatctgttcaccggcccagtgctgtcaaagcatcaagacgtgtttaatcaaccaactctcaatagcttcatggggttgggacaagcggcatggaaggaagcacgagtctttttgcaaaatcttctctcggtgtcgcaggcaaggctccgtgacgataccgagctgcggaagtgtgccttcatttcgcaggcgtcagcaactatgcatctgccagcgaccatcggagattatactgacttttacagctcccgccagcacgcaaccaatgtcgggattatgttcagagacaaggaaaacgcacttatgccaaattggctgcacctgcctgtgggataccatggaagagcatcgagcgtcgtcgtctctggaactccaatccgtagacctatgggacaaatgaagcctgacgattccaagcctccagtttacggagcatgtaagctgttggacatggagcttgagatggcgtttttcgtgggccctggaaataggcttggagaacctattcccatatccaaagcgcacgagcatatctttggaatggtgttgatgaacgactggagcgcgagagatattcagaagtgggagtacgtgcctcttggtccgttcctgggcaagtcatttggcaccacggtgagcccatgggtcgtgccaatggatgcgctgatgccgtttgctgtgccaaaccctaagcaagacccaagacctttgccttacctctgccacgatgaaccttacaccttcgatatcaacctttccgtgaatcttaaaggcgaaggtatgagccaagcagcaacgatctgtaaatcaaactttaagtatatgtattggaccatgctgcagcaactcacccatcattcggtcaacggatgtaaccttcggcctggcgatcttcttgcaagcggtaccatttcgggcccagagccagaaaacttcggctcaatgcttgagctctcatggaaaggaaccaagcctatcgatctggggaatggacagactagaaagtttcttctggacggagatgaagtgatcattactggttactgccaaggcgacgggtacaggattggcttcggccagtgtgcaggtaaggtgcttcctgccctgcttccttcg

SEQ ID NO: 11808 - DNA, 1257 bp, Artificial Sequence
  Description of Artificial Sequence: Synthetic coding sequence
atgagctttatccctgtagccgaggattcggactttcccatacacaaccttccttacggtgttttctccacccgcggcgaccctcgccccaggatcggagtggctatcggagatcaaatactggacctcagtatcatcaagcacctgttcacaggtcccgtgctgtcgaagcaccaagacgtctttaatcagcccaccctgaattcttttatgggccttgggcaggccgcgtggaaggaggcccgagttttcttgcagaatctgctgtctgtaagccaggcacgcctgagggacgatacggaactgaggaaatgtgcattcattagtcaggcctccgccaccatgcacctacctgctaccatcggcgattacacggatttttacagctctcggcagcatgcaactaatgtcgggatcatgtttagggataaagagaatgccctgatgcctaactggctgcacctgccagtggggtatcacggccgcgcctcatccgttgtggtttctggcacgccgattcgccgtcccatgggccagatgaaaccagacgactcgaagccaccagtgtacggcgcatgtaaactattggatatggagctcgagatggccttctttgtcggccccggtaatcgcctcggcgaacccatccccatctcgaaggctcacgaacacatctttgggatggtgttgatgaatgactggagcgcaagagacatccagaagtgggagtatgtgccactggggccctttctagggaaaagttttggcaccactgtctcgccctgggtagtgccaatggatgctctgatgcctttcgccgtgcctaacccgaaacaggacccccgccccctgccctatctatgccatgatgagccatacacattcgacatcaaccttagcgtcaatctgaagggtgaaggcatgtcacaggctgctacgatttgcaagtccaattttaagtatatgtattggacaatgcttcagcaactaacacatcattccgtgaacggatgcaacctacggcccggggatctgctggcttccgggacaatctccggccccgaacctgagaactttgggagcatgctagaactgtcatggaaagggaccaaaccaattgatctgggcaatggccaaaccaggaagttccttctggacggggacgaagtgattattaccggctattgccaaggagacggttaccgcattggtttcggccaatgtgccggcaaggtgctcccagcgctgctcccatct

SEQ ID NO: 11809 - DNA, 1257 bp, Artificial Sequence
  Description of Artificial Sequence: Synthetic coding sequence
atgagctttatccctgtggctgaggactccgacttccccatccataacctcccatatggggttttcagcaccaggggagaccccagaccaaggattggggtggctattggcgatcaaatccttgacctctctattatcaagcacctgtttaccggcccggtgctgtctaagcatcaggatgtatttaaccagcctaccctgaactccttcatgggcctcggccaagcagcatggaaggaggcgagggtgtttttacagaacctcctctccgtctcgcaggcccggctgcgggacgacaccgagctccgtaagtgcgccttcatcagtcaggcgagcgctaccatgcacctgcccgctacgattggagattacacagatttttactcttcccgccagcacgcgacgaacgtcggaatcatgttccgggacaaggaaaacgcccttatgccaaactggctccatttgcctgtggggtatcacgggcgtgcctcgagcgtcgttgtatccggaaccccaattaggaggcccatggggcagatgaagcccgacgactctaaacctccggtgtacggcgcttgtaaattgctggacatggagcttgaaatggctttcttcgtgggcccgggcaaccgactgggcgagcctataccaatatcaaaggcacacgagcacatcttcggtatggtcctgatgaacgactggagcgccagggacatccagaagtgggagtatgttccgctgggtcccttcttgggcaagagttttgggacgaccgtgagcccctgggtggtgccaatggatgccctgatgccctttgccgtgcctaaccccaagcaggaccccaggcctctgccgtacctgtgtcacgatgaaccttacaccttcgacatcaacctgtctgttaacctcaagggcgaaggtatgtcccaggcggcaacaatttgtaaatctaactttaagtacatgtattggaccatgttgcagcagttgacccaccatagcgtcaatgggtgtaacctccgcccaggagacctactagcatcaggaaccatctcggggccagaaccagagaacttcggaagcatgctggagctttcttggaaaggtacaaagcccattgacctggggaatggccagaccaggaagtttttacttgacggggacgaggtgatcatcacagggtactgccaaggggatggctacagaatcggctttggccaatgcgcgggcaaggtgcttcctgccctgctcccttct

SEQ ID NO: 11810 - DNA, 1257 bp, Artificial Sequence
  Description of Artificial Sequence: Synthetic coding sequence
atgtcctttatacctgtggctgaggatagcgactttcctattcacaacctgccttacggagttttttcaacacgaggcgatcctaggcctaggatcggagtggccattggtgatcagatattagacttaagcattatcaaacacctgtttaccgggccagtcctgagtaaacaccaggatgttttcaatcagccaactctgaactcattcatggggctggggcaggcagcttggaaagaggcacgcgtttttctccagaatttgctgtctgtcagccaggccagattgcgcgatgataccgagctccggaagtgcgcgttcatctctcaggccagtgccaccatgcacctgcccgcaacgatcggcgactatactgatttttactccagccggcagcacgccacaaacgtcgggatcatgtttagggataaagagaacgcacttatgccaaactggctacacctccctgttgggtaccatgggagagcctccagtgtggtggtgtcaggtacacccatcagacggcctatggggcagatgaagcctgacgattcaaagccacctgtgtacggggcctgtaaactgctggacatggagctggagatggccttcttcgtggggcccggaaacagacttggagaaccaatcccaattagtaaagcgcacgagcatattttcggtatggtactgatgaacgattggagtgctcgcgatatccagaagtgggaatatgttcctttgggccccttcctcgggaagtcattcggcacaacagtttccccatgggtcgtgcctatggacgcccttatgccgtttgccgtgcccaaccccaagcaggacccgcgacccctcccgtatctttgtcatgacgagccatataccttcgacatcaacctgagtgtgaatctaaagggtgagggcatgtcccaggccgccaccatatgcaagtctaactttaaatatatgtattggaccatgctccaacagctgacgcaccactcagtcaacgggtgcaacctccggcccggggatttactcgcgtctgggactataagcggccccgaacccgagaactttgggagcatgttagagttgtcgtggaaaggcactaagcccattgacctgggcaacggacagacacgtaagtttttgctcgatggagacgaggtaatcattaccggctactgtcagggcgacggctataggatcgggttcggacagtgtgcagggaaggtccttcccgccctgctgccatcc

SEQ ID NO: 11811 - DNA, 1257 bp, Artificial Sequence
  Description of Artificial Sequence: Synthetic coding sequence
atgtcctttattcctgttgcagaagattcggactttcctattcataatctgccgtacggagtgtttagcaccagaggtgatcctcgtcctaggataggagtggctatcggggatcagatcctggatctctcgatcataaagcatctgtttactggacccgtgctctcaaaacaccaagatgtgttcaatcaacccaccctgaatagcttcatggggctcggtcaagccgcatggaaggaggcacgagtgtttctgcagaaccttctgtccgtgtctcaagcacgcttgcgagatgataccgaattgcggaagtgcgcgttcattagccaggcttcggcaactatgcacctccctgctaccattggtgattacaccgatttctactcatcacgccaacatgcaactaatgtcggaattatgtttagggataaggagaatgcactcatgccaaactggctgcatctccccgtggggtaccacgggagagcctcctcggtggtggtttccggtactccgattaggcggcctatggggcagatgaagcccgacgactcgaagccacctgtctacggcgcttgtaaactgcttgacatggaactggaaatggccttttttgtcgggcctggtaatcgcctgggagaaccgatacccattagcaaggcacatgaacatatcttcggcatggtccttatgaacgactggtcggcacgtgatattcagaaatgggagtacgtcccgttgggaccttttctcgggaaatcgtttggaacgacggtttcgccttgggtggtcccaatggacgcattgatgccatttgctgtaccaaatcccaaacaagacccaagacctctgccctacctgtgtcatgatgagccttacacgttcgacattaacctgtccgtgaatcttaagggtgagggaatgtcgcaagcagccactatttgcaagtcgaatttcaagtatatgtactggactatgcttcagcaactgactcatcactcggtcaatgggtgtaacttgaggcccggtgaccttctggcatcgggcaccatcagcggtccagaaccagagaattttggatccatgcttgaactctcatggaaaggaactaagcccatcgatttgggtaacgggcagaccaggaagttccttctcgatggagatgaggtgattatcactggatactgtcagggtgatggttacagaatcgggtttgggcaatgtgccggcaaagtgttgcctgcgctgcttccatcc

SEQ ID NO: 11812 - DNA, 1257 bp, Artificial Sequence
  Description of Artificial Sequence: Synthetic coding sequence
atgtcctttatacctgtcgcagaagacagcgactttccaatccataaccttccatacggcgtgttcagcacgcggggagacccccggccccgaataggcgttgccatcggtgatcagattcttgatctctccataatcaagcatctctttacagggcctgtcctcagcaagcaccaagatgtgtttaatcagcctaccctgaactcttttatgggtttagggcaggcagcctggaaggaggcgcgcgtgtttctccagaacctgctttccgtcagtcaagcccgcctacgcgacgataccgagctgaggaaatgtgcctttatctcccaggcaagcgccaccatgcatttgccagcaacaataggtgactacaccgatttttatagctctcggcaacatgcaacaaacgtgggcatcatgttcagggacaaggaaaacgctttaatgcccaactggctccatctgccagtggggtatcatggacgcgcctcttctgttgtggtgtcaggcacacccatccggcggccaatgggccagatgaagcccgacgattctaagccccccgtttatggcgcttgcaagctgctcgatatggaactggaaatggccttttttgtggggcctggaaataggttgggagaacctatacccatctccaaggcccacgagcacattttcggaatggtcttaatgaacgactggtccgccagggatattcagaagtgggagtatgtgcctttaggaccattcttagggaagagctttggaactaccgtgagcccatgggtggtgcctatggatgccttgatgccattcgcagtcccaaaccccaaacaggacccacggcccctcccctatctatgccacgatgagccctatacttttgatatcaatctgtcggtgaacctaaaaggggaaggcatgtcgcaggctgccaccatctgcaagtccaatttcaaatacatgtactggaccatgcttcagcagttgacgcaccactcggttaatggatgcaacctaaggcccggagacctgctggcctccggcactatctccggacctgagcctgagaatttcggctcgatgctggagctgagctggaagggtactaagcctatagacctgggtaatggtcagacccgcaagtttttgctcgatggagacgaggtgattatcaccggttattgtcagggtgacggctaccggatcggattcggtcaatgcgccgggaaggtgcttcctgccttgctgccttct

SEQ ID NO: 11813 - DNA, 1257 bp, Artificial Sequence
  Description of Artificial Sequence: Synthetic coding sequence
atgagcttcatcccggtcgcggaggactccgacttccctatccacaacctgccttacggagtgttctcaacccggggtgacccgcgcccacgcatcggggtggcgatcggcgatcagatcctcgatctgtcgattatcaaacatctgttcacgggaccggtgctgagcaaacaccaagacgtgtttaatcagcctaccctcaactcgtttatgggacttgggcaagcggcttggaaggaagctcgggtctttctgcagaacctgctcagcgtctcacaggcccggctgagagacgacaccgagctgcgcaaatgcgccttcatctcccaggcatcggccacgatgcacctccctgctactatcggcgactacactgatttctacagctcccgccagcacgccactaatgtggggatcatgttcagagacaaggagaatgccctgatgccgaactggctgcatctgccggttggataccatggcagagcatccagcgtggttgtgtcgggcaccccaatccgccgcccgatggggcagatgaaaccggacgactcgaagccaccggtgtacggtgcctgcaagctgttggatatggaactcgaaatggcctttttcgtcggacccggaaatcgcctgggagaaccgatcccaatttcgaaagctcatgaacatatctttggcatggtgctgatgaacgactggagcgcacgcgatatccagaaatgggagtacgtgccactgggaccgttcctggggaaatccttcgggactactgtgtcaccgtgggtcgtgcccatggacgcgctgatgccgtttgcagtgccaaatccgaagcaagatccccgaccactcccgtacctgtgccacgatgagccgtacactttcgacatcaacctgtcggtcaaccttaagggcgagggaatgagccaagctgctactatctgcaagtcgaacttcaagtatatgtattggacgatgctccagcaactgacccaccacagcgtgaatggctgtaacctgcgaccgggtgatctgctcgcatctggaactatctccgggccggaaccagaaaacttcggctcgatgctggagctcagctggaagggaacgaagccaatcgatctggggaacggacaaacgcggaaattcctgttggatggagacgaggtgatcatcactggatactgtcaaggggatggctaccgaattggattcggacagtgcgcgggcaaggtgctcccggccttgctgccgagc

SEQ ID NO: 11814 - DNA, 1257 bp, Artificial Sequence
  Description of Artificial Sequence: Synthetic coding sequence
atgtccttcataccagtcgctgaggactctgattttcccatccataacctaccttatggggtgttttcaactagaggggatccacggcctagaataggagtggccataggagatcagatcttggatctgtctatcatcaagcatctgtttacagggccagtgctttcaaaacatcaggatgtgttcaaccagcccacactcaattcattcatggggcttgggcaggcagcttggaaggaagcccgggtgtttctccagaatctcctctctgtgtcacaagcacgcctgcgggatgatacagaactccggaaatgcgccttcatctcccaggcctcagccactatgcatttaccagctactatcggagattacactgatttctattcttcccgtcagcatgctactaatgtggggatcatgtttagagataaagaaaacgcccttatgccaaactggctccacttgcctgtagggtaccacgggcgagcctccagtgtggtagtttcagggacacccatccgcagacctatgggacagatgaaaccagatgattctaagcctcccgtgtacggggcctgcaaactgctagatatggaactcgaaatggccttctttgtggggccagggaacagacttggagagcctatccccatctctaaagctcacgaacacatctttggaatggtactaatgaacgattggagtgccagagatatccagaaatgggaatatgtacctttagggcctttcctgggaaaaagtttcgggactacagtcagtccatgggtagtacctatggacgcacttatgcctttcgccgttcccaacccaaaacaggacccaaggcctttaccctacttatgccacgatgaaccatatacatttgatataaacctatcggtgaacctaaagggggaagggatgtctcaggccgctactatctgtaaatctaatttcaaatacatgtattggactatgctgcagcagcttactcatcatagtgtgaacgggtgtaatctgagaccaggagatctccttgcctctggaacaatttccgggcctgaaccagagaattttgggtcaatgcttgagctgagttggaaagggactaaaccaatcgatttgggaaacgggcagactaggaaattcctgctagacggagacgaagtcatcatcacagggtattgccagggggatgggtatagaatagggtttggacaatgcgccggaaaagtgctgccagctctcctcccctca

SEQ ID NO: 11815 - DNA, 1257 bp, Artificial Sequence
  Description of Artificial Sequence: Synthetic coding sequence
atgtctttcatccctgtggcagaagattcggatttcccgattcacaatctcccttatggtgtgttttcaaccagaggcgaccctcgccccagaattggcgtagctatcggagatcaaatcttagatctttccatcattaagcatctctttacaggaccagtcctaagcaaacatcaggacgtgtttaaccagcctacactgaattctttcatgggccttgggcaggccgcatggaaggaggcgcgcgtttttttgcagaatcttctgtccgtgtcgcaggcccgattgagggatgatactgagctgcggaagtgcgccttcatttcacaggctagtgccactatgcacctccccgctaccattggtgactatactgatttctacagctctaggcagcacgcaaccaatgttggcataatgttccgtgacaaagagaacgcgcttatgcctaactggttgcacctgccggtaggctaccatggccgagcctcatcagttgtggtctctggcactcccatacgccggccaatgggacaaatgaaacctgacgactccaagcctcccgtctacggtgcctgcaaactgctggatatggagctggagatggcctttttcgtaggccctggaaacaggctgggggagccaatcccgataagcaaagcacatgagcatatattcgggatggttctcatgaacgactggagcgcgcgagacatccagaagtgggaatacgtaccgctcggaccttttttaggcaagagtttcggaaccaccgtgtcgccctgggtggtgccaatggatgccctcatgcccttcgccgtcccgaatccaaaacaagacccccggcctcttccctatctgtgtcatgacgaaccttatacattcgacatcaatctaagtgtgaatttaaagggcgagggaatgagtcaagccgctaccatttgcaaatcaaacttcaagtacatgtactggacgatgctccaacagctgactcatcactctgtgaatggatgtaatctgcggcctggagacctcctagcatcagggactatttctgggcccgagccagaaaacttcggatcaatgcttgagttgagctggaagggaacaaaacccatcgacctgggcaacggccagactaggaagttcctgctggatggggatgaggttatcattacaggttattgtcaaggggatggctataggataggatttggccaatgtgcagggaaagtgttgcctgcgctattgccctct

SEQ ID NO: 11816 - DNA, 1257 bp, Artificial Sequence
  Description of Artificial Sequence: Synthetic coding sequence
atgagcttcatcccggtcgctgaggactcggacttccccatccataatctgccctacggagtattctcgactcgcggtgatccacggccccgcattggagtggcgatcggagatcaaatcctcgatttgtcgatcatcaagcacctgttcactggccctgtgctgtcgaagcatcaggatgtgttcaaccagccaactctgaattcgttcatgggcctgggacaggctgcgtggaaagaagcccgcgttttcctgcagaatctcctgtcggtgtcgcaagcacggctgcgggacgacaccgagctgcggaaatgtgcctttatctcgcaggcctcggcgaccatgcacctgccggccacgatcggagattacactgatttctactcttccagacagcacgcgaccaatgtgggaatcatgttccgcgataaggagaacgccctcatgcctaactggctccacctgccggtgggttaccatggaagggccagctcggtcgtggtcagcgggaccccgatcagacgtccgatgggccagatgaaaccggatgacagcaaaccaccggtgtacggagcttgcaaactcctcgacatggaacttgaaatggcgttcttcgtggggccaggaaaccggctgggcgaacccatccctatcagcaaggcacatgagcatatctttggtatggtgctcatgaatgattggagcgcccgcgacatccaaaagtgggaatacgtcccgcttgggcctttcctcggcaagtccttcggcacgactgtgtcaccatgggtggtcccgatggacgcccttatgccattcgccgtcccgaacccgaagcaggatccgcgcccgctcccatacctgtgtcacgacgaaccttacacttttgacatcaacctctcggtgaacctgaagggggagggaatgagccaggcagccactatctgtaagtcaaacttcaaatacatgtactggaccatgttgcaacagctgacccaccacagcgtcaacggatgcaaccttagaccgggagatctgctggcctccggaaccatctcagggccagagcccgaaaactttggatcgatgctggaactttcctggaagggaaccaaaccgatcgacctgggaaacggacagacccgcaaattcttgctggacggtgatgaggtcatcatcactggctactgccagggagatgggtacaggattgggttcggacagtgtgcaggtaaagtgctcccggctctgctgccctca

SEQ ID NO: 11817 - DNA, 1257 bp, Artificial Sequence
  Description of Artificial Sequence: Synthetic coding sequence
atgagctttatccccgtggccgaggatagcgacttccccatccacaatttgccctacggagtatttagcactcgaggtgaccctcggccacgcataggggtggctatcggggaccagattcttgatctttctatcattaaacacctgttcacaggcccggttctcagcaaacatcaggatgtctttaaccagccaacactgaacagtttcatgggacttggacaggccgcttggaaagaagcgagggtctttctccaaaacttgctgagcgtttctcaggccagacttcgggacgacactgaattacgcaagtgcgctttcattagccaggcttccgctaccatgcacctgcctgcaactatcggggattatactgatttctactcaagccgtcaacatgctaccaacgtcggtataatgttcagagacaaagaaaatgctctgatgccaaactggctgcatctgcccgtcggctatcacggcagggccagttcggtggttgtgagcggcactccaatccggagaccaatggggcagatgaaacctgatgacagtaaaccaccagtatatggtgcttgcaagttgctggacatggaattggagatggcatttttcgttggccccggcaatcggctgggtgagcccatccctatcagtaaagcccacgagcacattttcgggatggtccttatgaacgactggagtgctcgtgacatccagaagtgggagtatgtccctttgggccctttccttggcaaaagcttcggcaccaccgtgtctccatgggtggttcctatggatgccctgatgccattcgctgtccccaacccgaagcaagacccacgcccactgccatacttgtgtcacgacgaaccttatacctttgatatcaacctctctgtgaacctcaaaggggaaggcatgtcccaagcagcgactatatgcaagagcaactttaaatacatgtattggactatgctgcagcagttaacccaccatagcgtcaatgggtgtaacctgaggcctggagacttgcttgcatcaggcactatctccggccctgaacctgagaattttggatcaatgctggagctgtcatggaagggaactaaacctattgacctcggaaacggacaaacaaggaaattcctcctggacggagatgaggtgatcataactggctattgccagggagatggatatagaataggttttggacagtgcgctggaaaagtgctccccgcgcttctcccctca

SEQ ID NO: 11818 - DNA, 1257 bp, Artificial Sequence
  Description of Artificial Sequence: Synthetic coding sequence
atgtcgtttataccggttgcggaagattcggattttccgatacataatctaccgtatggtgtattttcgacgcgtggtgatccgcgaccgcgtataggtgtagcgataggtgatcaaatactagatctatcgataataaaacatttatttacgggtccggtattatcgaaacatcaagatgtatttaatcaaccgacgctaaattcgtttatgggtctaggtcaagcggcgtggaaagaagcgcgtgtatttttacaaaatctattatcggtttcgcaagcgcgattacgtgatgatacggaattacgaaaatgtgcgtttatatcgcaagcgtcggcgacgatgcatttaccggcgacgataggtgattatacggatttttattcgtcgcgtcaacatgcgacgaatgttggtataatgtttcgtgataaagaaaatgcgttaatgccgaattggctacatttaccggttggttatcatggtcgtgcgtcgtcggttgtagtttcgggtacgccgatacgtcgtccgatgggtcaaatgaaaccggatgattcgaaaccgccggtatatggtgcgtgtaaattattagatatggaattagaaatggcgttttttgtaggtccgggtaatcgtttaggtgaaccgataccgatatcgaaagcgcatgaacatatatttggtatggttctaatgaatgattggtcggcgcgtgatatacaaaaatgggaatatgtaccgctaggtccgtttttaggtaaatcgtttggtacgacggtttcgccgtgggttgtaccgatggatgcgttaatgccgtttgcggttccgaatccgaaacaagatccgcgaccgctaccgtatttatgtcatgatgaaccgtatacgtttgatataaatttatcggtaaatctaaaaggtgaaggtatgtcgcaagcggcgacgatatgtaaatcgaattttaaatatatgtattggacgatgctacaacaattaacgcatcattcggtaaatggttgtaatttacgaccgggtgatttactagcgtcgggtacgatatcgggtccggaaccggaaaattttggttcgatgttagaattatcgtggaaaggtacgaaaccgatagatctaggtaatggtcaaacgcgtaaatttttattagatggtgatgaagttataataacgggttattgtcaaggtgatggttatcgaataggttttggtcaatgtgcgggtaaagttttaccggcgttattaccgtcg

SEQ ID NO: 11819 - DNA, 1257 bp, Artificial Sequence
  Description of Artificial Sequence: Synthetic coding sequence
atgagcttcattccggtggccgaggattctgacttccctatccacaatttgccctacggagtcttttctacccgcggtgaccctcgcccccgaattggggtagccatcggtgaccagattctagacctcagcattatcaaacacctttttacagggcccgtgctaagcaagcatcaggacgtgtttaatcagcccaccctgaacagtttcatgggcctgggacaggcagcatggaaagaggcccgagtgttcctgcagaatctgctgagcgtcagccaggcaaggttgcgggacgacacagagctgcgcaagtgcgccttcatttcccaggcaagtgcaaccatgcacctgccagccactattggcgactacacagatttttacagtagccggcagcacgcaaccaacgtgggaattatgttccgggataaggaaaatgcgctcatgcccaattggctgcacctgcccgtcgggtatcacgggcgggcctcgtccgttgttgtctccggaactcccatccggcgccccatggggcagatgaagccagacgactcaaagcctcctgtgtacggtgcctgcaaactgctcgatatggagctcgagatggcctttttcgtgggtcctggaaacagactcggagagcctataccaataagcaaggcacacgaacatatttttggtatggtccttatgaatgactggagcgcacgagacatccagaagtgggagtacgtccctctgggtccattcctcgggaagtccttcggtactactgtgtccccttgggtggtacctatggacgccctgatgcccttcgcagtccctaatccaaagcaggacccaaggcccctaccctacctttgccacgacgaaccatacacatttgatattaacttgtcagtgaatctcaagggggagggtatgtcacaggctgcaaccatatgcaaatcaaactttaagtatatgtattggacaatgctgcagcagctgactcaccatagcgttaatgggtgtaatctcagacctggcgatctgttggcaagtgggactatctctggacctgaaccagagaattttggctcaatgctggaactatcttggaaggggactaagccgatagacttgggcaacgggcagactcggaaattcttactggacggagacgaagtgatcattacagggtactgtcagggtgatggctatcgcataggttttgggcagtgtgccggaaaggtgctacccgctctcttaccatca

SEQ ID NO: 11820 - DNA, 1257 bp, Artificial Sequence
  Description of Artificial Sequence: Synthetic coding sequence
atgtctttcatccctgtggccgaggattcggatttcccgattcacaatctgccatacggcgtcttcagcaccagaggagatccaaggcccagaataggcgtggcgattggcgatcagattctcgacctcagtataattaagcatctttttactggtccggttctatctaagcatcaagatgttttcaaccagccgacactgaactctttcatgggtctgggccaggcggcgtggaaagaggcaagagtgttccttcagaacctactcagtgtgtcgcaggccagactgcgagacgataccgagctgcgtaagtgcgccttcatcagtcaggcatcagcaacgatgcatctgcctgccacaattggggattacaccgatttttactcttccaggcagcacgccaccaatgtgggtataatgtttcgcgacaaagagaatgctctgatgccaaactggctccatctgcctgtagggtaccatggcagggcctcatctgtcgtcgtgtcgggaacccctattcgccgacctatgggccaaatgaagcccgacgacagcaagccacccgtgtacggagcatgcaagttgctggatatggaacttgaaatggcattcttcgtaggcccggggaatagactcggcgagcctatcccgatcagcaaagcacatgagcatatttttggtatggtccttatgaatgactggagtgccagagatattcagaagtgggagtatgtgccactgggtccttttttgggaaaatctttcggcacaaccgtgtccccatgggttgtcccaatggacgctcttatgccatttgccgtgcctaacccgaagcaggatccaaggcccctgccatacttatgtcacgatgaaccgtacactttcgatattaacctgtccgtcaatctaaagggcgaggggatgtctcaggccgccacgatttgcaaatccaacttcaagtatatgtactggaccatgttgcagcaactgacacatcactctgtcaatgggtgtaacctcaggcccggcgatcttctcgcgtcgggcacgatttccgggcccgagccagaaaactttggcagcatgctcgagctatcttggaaggggactaaaccaattgatctcgggaacgggcagacgcggaaattcctacttgatggggatgaggtaattataacaggctactgtcagggcgatgggtaccgtattggcttcggacaatgtgctgggaaagtcttgcccgcgctgttgccttct

SEQ ID NO: 11821 - DNA, 1257 bp, Artificial Sequence
  Description of Artificial Sequence: Synthetic coding sequence
atgtctttcatacctgtggctgaagactccgacttccccatacacaatcttccctatggggtgttttcaacaagaggggatcctagacctcgcatcggagtagctatcggggatcagattcttgatctgtcaattatcaaacatctcttcacagggccagtgctcagtaaacatcaagatgtcttcaatcagcctactctaaactctttcatgggattaggacaggcagcttggaaagaagctcgggtgttcctccagaatctactttccgtgtctcaggccagactccgggatgatacagaattacggaaatgtgccttcatcagtcaggcctccgcgacaatgcatctccccgccacaataggggattatacagatttctattcatctagacagcacgccacaaatgtagggataatgttccgcgacaaggaaaacgctctaatgcctaactggttacatctgccagtggggtatcacgggcgggctagttctgttgtggtatcagggacaccaattagaaggcccatgggacagatgaaacctgacgattctaaaccccccgtatatggagcatgcaaactactagacatggagctggaaatggcattttttgttgggcctgggaatcgccttggagaacccattcccatcagtaaggcacacgaacacattttcgggatggtcctgatgaacgattggagtgctagggacatacagaaatgggaatatgtccctcttggaccctttctagggaaatcctttggaactacagtgtccccctgggtggtgcccatggatgctctaatgcccttcgctgtgccaaacccaaaacaggatccacggcctctcccctatctgtgccatgatgaaccttatacattcgacatcaacttgtctgtgaacctcaaaggggaagggatgtctcaagccgctactatatgcaaatccaacttcaaatatatgtattggactatgctacagcagctcacacaccattccgtcaacggatgtaacttacgccctggggatctgttagctagtggaacaatttccgggcccgaacctgaaaactttggatccatgcttgagctttcatggaaagggacaaaacccatagatctcgggaacgggcagactagaaaattcttgctggacggagatgaagtaatcataactgggtattgtcagggagacggataccggatagggtttgggcagtgtgctgggaaagtgttacccgctttgctaccttct

SEQ ID NO: 11822 - DNA, 1257 bp, Artificial Sequence
  Description of Artificial Sequence: Synthetic coding sequence
atgtccttcattcccgtcgccgaagattccgactttccaattcataacctgccttatggagtttttagcactcgaggtgacccgcggccccgcattggtgttgcgatcggcgatcagattttggatctcagcatcatcaagcacctcttcaccgggccagtcctctctaagcaccaggacgtgttcaaccagcccactctgaactctttcatgggactgggacaggccgcttggaaggaggccagggtgttcttgcagaatctgctttcagttagccaggccaggctgcgggatgataccgaacttagaaagtgtgccttcatttcccaggctagcgctacaatgcacctccctgctactataggtgactatacagatttctactcaagccgccaacacgccacgaacgtcggaatcatgtttcgcgataaggagaatgccctgatgcccaattggttgcacctccctgtcgggtaccatggcagagccagttctgtggtagtgagcgggacacccattcggaggcccatgggccagatgaagcctgacgattcaaagcctcccgtatacggggcctgcaaactgctggatatggagttggaaatggccttcttcgtgggcccaggcaacagactcggagaaccaattcccatatccaaagcgcatgagcatatttttggtatggtgcttatgaatgactggtctgcccgggacatacagaaatgggaatacgttccccttggaccgtttcttggaaaaagcttcgggacaactgtgagcccgtgggtcgttccaatggacgcccttatgccattcgcagttcctaacccaaagcaggatccccggccactaccctacctgtgccacgacgagccctacaccttcgatattaatttgagtgtgaacttgaaaggcgagggtatgagtcaggcagccactatttgcaagtccaacttcaaatacatgtactggactatgcttcaacagctcactcaccactccgtgaatggatgtaacttgcgccccggggatctacttgccagtggcacgatatcgggccctgaacccgagaactttggcagcatgctcgaattaagctggaagggcaccaagccgatagaccttggcaatgggcaaacccgcaagtttttgttggatggtgacgaggttataattacagggtattgtcagggtgacggatacaggatcggattcggtcaatgcgcaggtaaggttctccccgcgctgctaccatct

SEQ ID NO: 11823 - DNA, 1257 bp, Artificial Sequence
  Description of Artificial Sequence: Synthetic coding sequence
atgtcttttatcccggtcgccgaggactccgactttccgatccacaacctgccatacggcgtcttttccactaggggcgatcctcgcccccgcattggtgtagccatcggcgatcagatcctggacctttccattatcaagcaccttttcaccggccccgttctttctaagcatcaggatgtgttcaatcaacctactctgaactccttcatgggtttgggtcaggccgcctggaaggaggctagggtgtttttgcagaacctcctgtccgtttcccaggctcgcctccgcgacgacaccgagctccgtaaatgtgcgtttatctcgcaggcatctgcgaccatgcacctgcccgctaccatcggggactacaccgatttctactcttctcgccaacacgctactaacgtcggcatcatgttcagagacaaagagaacgccctgatgcccaactggcttcacctccctgtgggttaccacggacgcgcgagttccgtggtcgtgtccgggacccccattaggcgacccatgggtcagatgaagcctgatgactccaagccccccgtttacggagcttgtaagctccttgatatggaactggaaatggctttcttcgtgggtcccgggaatcgtctcggagaaccgatccctatctcaaaggcgcacgagcacattttcggcatggtactgatgaacgactggtccgctagggacattcaaaagtgggagtacgtgccgctcgggcccttcctgggtaaatcgttcggcacgaccgtctctccttgggtcgtccctatggacgctctcatgccttttgcagtgcctaaccccaagcaggatccacgtccgcttccctacctgtgccacgacgagccatatacatttgacatcaatctctcggtcaatttgaagggtgagggaatgagccaggcagccaccatttgcaagtctaacttcaaatatatgtattggactatgttgcagcagttgacccaccatagcgttaacggctgtaatctccgacccggcgacctcctcgcttctggcacaatttccggaccagagcccgagaatttcggctccatgttggagctttcatggaaaggcacgaagcccatcgacctgggaaacggtcagacccgcaagttcctactcgatggtgacgaggtgatcatcacgggctactgccagggtgacggctaccgtatcggttttggtcagtgcgccggcaaggtgctgcccgccctgttaccttcc

SEQ ID NO: 11824 - DNA, 1257 bp, Artificial Sequence
  Description of Artificial Sequence: Synthetic coding sequence
atgagttttatccctgtggctgaggactcagactttccaattcataacctcccctacggcgtgtttagtacaaggggagaccctcgaccacggattggagtggccatcggtgatcagattctggacctgtccatcatcaaacacctgtttacaggccctgtgttaagcaaacatcaggatgtgtttaatcaacccaccttgaactctttcatggggctaggtcaggccgcttggaaggaagcacgggtgtttctccagaacctcctctctgtaagtcaggccaggcttcgcgacgatacagaacttaggaagtgcgcattcattagccaggcctctgctacaatgcaccttccagcaacaataggtgactatacagatttctactcctccaggcaacatgcaacaaacgtcggtatcatgtttagggacaaagagaacgctctcatgcccaattggctgcacttgcctgtcggatatcatggccgggccagctccgtggtcgtgagcggaacccccatccgcaggccgatgggtcaaatgaagcccgacgattctaaacctccggtttatggcgcgtgcaagctccttgacatggagctagaaatggcttttttcgtgggaccgggtaatagattgggcgagcccatcccgatcagtaaggcccacgaacacatattcggaatggtactgatgaacgattggagtgcgcgagacattcaaaagtgggagtatgtgcctcttggccccttcctgggcaagtcctttggcactacagtcagtccctgggtggttcccatggatgcactcatgcctttcgctgtccctaacccaaagcaagatccccggcccctgccttatctgtgccatgatgagccatatacattcgatattaaccttagtgtaaatctcaaaggcgaggggatgtcgcaagctgcaaccatttgcaagagtaacttcaagtatatgtactggactatgttgcagcagctcacacaccactcagtcaatgggtgtaacctgaggccgggcgatctgctggctagtggaacaatctcaggcccagagcctgaaaacttcgggagcatgctggaacttagctggaaaggcactaaacccattgacctggggaatggccaaacaaggaaatttcttctcgacggagatgaagtgatcattactgggtattgccagggagacggctacaggatcggatttggccaatgcgccggcaaagtcctgcccgccttgctaccatct

SEQ ID NO: 11825 - DNA, 1257 bp, Artificial Sequence
  Description of Artificial Sequence: Synthetic coding sequence
atgtcttttatccccgtcgctgaggactctgatttcccgattcataacctcccatacggagtattcagcacaagaggcgatcccaggccaaggataggtgtcgctattggcgatcaaatcttggatctgagtatcatcaagcacctatttacaggccctgttttgtccaagcaccaagacgtgtttaaccagccgaccctgaatagtttcatgggcctggggcaggccgcatggaaggaggccagggtgttcctgcagaaccttctctctgtttcgcaggcacgactgcgtgatgatacagagttgcgaaaatgcgcctttatctcgcaggcctcagccacgatgcatcttcccgccactattggtgattacacggatttctattcatccagacaacatgcgactaacgtgggtataatgtttagagataaggagaacgccttaatgcctaactggctgcacctgcctgtagggtaccacggtcgcgcgtcctctgtcgtggtatcagggacaccgatccgaagacccatgggacagatgaagcctgacgatagtaaaccacctgtctatggggcctgcaaactcttggacatggaactggagatggccttttttgtcggacccggcaatcggctcggggaacccattcccatttccaaagctcatgagcacattttcggaatggtccttatgaacgactggagcgccagggatatccagaaatgggagtacgtgccacttggtcccttcctgggaaagagctttgggacaactgtcagtccttgggtcgtacccatggatgcattgatgcctttcgctgtccctaaccccaaacaggatcctcgaccactgccctatctttgtcatgacgagccatacactttcgatatcaatctcagcgttaaccttaaaggcgaggggatgtcccaagctgccactatttgtaaatccaactttaaatatatgtactggactatgctgcagcagctgacgcatcattctgtgaatggatgcaatcttcgcccaggcgatctcctggctagcggcaccatctcagggcctgagccagagaacttcggcagtatgcttgaactgagttggaaaggtaccaaaccaattgacctaggcaacggtcagacacgtaagtttcttcttgatggcgacgaggtgatcatcacaggctattgccagggagatggttataggatcggattcggccagtgtgctggaaaagtgctccctgcccttctaccgtcc

SEQ ID NO: 11826 - DNA, 1257 bp, Artificial Sequence
  Description of Artificial Sequence: Synthetic coding sequence
atgtcattcatccctgtggcagaggatagcgacttccccatccataatttgccttacggcgtgttctctacgcgcggggaccccaggcccagaattggtgtggccatcggcgaccagattttggacttgtccatcatcaagcatctgttcactggaccagtcttatcaaaacatcaggatgtattcaatcagccaacactgaatagtttcatggggctaggacaggcggcatggaaggaagcccgcgtgttccttcagaaccttctctctgtcagccaggctcgtcttcgggacgataccgagctacgaaaatgcgcctttatctctcaggcaagtgccactatgcatttgcccgccaccattggcgactatacagacttctacagcagcaggcagcatgcgaccaatgttgggatcatgttcagagacaaggaaaatgccctgatgccaaattggctgcatctgcctgtggggtatcatggtagggcctccagcgtggtggtgtcaggcacccccatcagacgacccatgggacagatgaagcccgacgacagcaaacccccagtgtatggagcttgcaagctgctcgatatggaactggagatggccttcttcgttggaccaggcaatcgcctgggtgaacccataccaatttccaaagcccatgagcacattttcggtatggtcctaatgaacgattggtctgcacgcgatattcaaaaatgggagtacgtgcctctgggcccctttctgggtaagagctttggtacaacagtcagtccatgggtggtccctatggatgccttgatgccttttgccgtccccaacccaaagcaggacccacgccccctgccctacttatgccatgatgagccatacacgtttgacatcaacctgtcagtaaacttgaaaggtgaaggcatgagtcaggctgcaacgatctgtaagagcaattttaaatacatgtactggaccatgctccagcagctcacccatcattctgtcaacggctgcaacctccgtcctggcgatctcctggctagcggcacaatctcaggccccgaacccgagaacttcggctcaatgctggagctatcctggaagggcaccaaacccatcgatctgggcaatgggcaaactaggaaattccttctcgatggggacgaggtgatcatcacgggatactgccaaggcgacggataccgcattgggtttggccagtgtgctggaaaggtgcttcccgccctcctgccgtcc

SEQ ID NO: 11827 - DNA, 1257 bp, Artificial Sequence
  Description of Artificial Sequence: Synthetic coding sequence
atgtcttttatcccggtggccgaagacagtgacttccctattcataatctgccctacggggtgttttccactcgcggcgatccccgcccaagaatcggagtggctatcggggaccaaatcctggatctctcaatcattaagcacctgttcactgggcccgtcctgtccaagcatcaggacgtgttcaaccagcccaccctcaacagcttcatgggtttgggccaggcggcttggaaggaagcccgcgtgttcctgcagaatctactcagtgtctctcaggctaggctgagggacgatactgagctgaggaaatgcgccttcatctcccaggcctccgccactatgcacctgccagccacaatcggcgactacacagatttttattccagccggcaacacgcaacaaatgtggggataatgtttcgggataaggaaaacgcacttatgccgaattggctgcacctgcccgtagggtatcatggcagggcatccagcgtggtggtcagcgggaccccgatcaggagacccatgggccagatgaagcctgatgactcaaaacccccagtttatggggcctgcaagctgctagacatggaactcgagatggcattcttcgtcgggccgggaaaccgtcttggtgagccaatacctatctctaaggctcacgagcatatattcggtatggtcttgatgaatgattggagcgcaagagacattcagaagtgggagtacgtgccccttgggccatttctgggcaagtcatttggaactacagtgtctccttgggtcgtgcctatggacgcactgatgccattcgcggtgcctaaccccaaacaagacccacgcccccttccttacctgtgtcacgacgagccttatacctttgatatcaatttgagtgtgaatctgaaaggagagggcatgtcacaggctgcgacgatctgcaagtcaaacttcaagtacatgtattggaccatgctccaacagctcacccaccatagtgtcaacggttgcaaccttaggccaggggacctccttgcgtctgggactatttccggacctgagccggagaattttggatcaatgctggaactgtcctggaagggcacaaagcctattgatctcggaaacggtcaaacacggaaattcttattggatggtgacgaagtcatcatcacagggtattgccaaggagatggttacagaattgggtttgggcaatgtgctggaaaggtcctgcccgcattactgcccagc

SEQ ID NO: 11828 - DNA, 1257 bp, Artificial Sequence
  Description of Artificial Sequence: Synthetic coding sequence
atgtcctttattccggtggctgaagatagcgacttccctattcataacctcccctatggcgtattctcaactcggggagatccccgcccccgcataggtgtagctataggcgaccagatactcgacctgtccattatcaaacatctgtttactggccctgtcctgagtaagcaccaggatgtatttaaccaacccacactcaattccttcatggggttagggcaggccgcctggaaagaggcacgggtttttctacagaacctgctgtccgtctctcaggccaggcttcgtgacgacacggaactccgcaagtgtgcatttattagccaagccagtgccaccatgcaccttccagccaccattggcgattacaccgacttctattcatcaagacagcacgctaccaacgtgggaatcatgtttagagacaaggagaacgctctaatgcccaactggctccatctccctgtcggctatcacggcagagctagctccgtggtagtgagtggcactccaatacggagacctatgggacagatgaaacccgatgactcgaaaccaccagtctacggagcctgcaagctgctagatatggaacttgagatggccttcttcgtggggcctggcaataggctgggggagccaatcccaatcagcaaagcccacgaacatatatttggaatggtgttgatgaacgattggagcgctcgagatatccagaagtgggaatatgtaccactcgggccttttctcggcaagtcatttggcacaaccgtctccccatgggtggtccccatggatgctcttatgccatttgctgttcccaaccccaaacaggatcctagaccacttccctatttatgccacgacgagccctacacattcgatattaacttaagcgtgaacctgaaaggtgaaggtatgtcccaggctgccacaatttgcaagtccaatttcaagtatatgtattggaccatgctgcagcagctgacccaccactctgtgaatgggtgtaacctgcgccccggggatctgctagcttccgggacgatctccggacctgagcctgaaaactttggatcaatgctggaactctcatggaagggaaccaagcccatagatctgggaaacggacagacgcgaaagttcctgttagacggcgatgaggtgattattacgggatattgtcagggagatgggtacagaataggtttcggccagtgtgccggcaaagtgctccccgccctgctgccaagt

SEQ ID NO: 11829 - DNA, 1257 bp, Artificial Sequence
  Description of Artificial Sequence: Synthetic coding sequence
atgagtttcatcccggtcgcggaggacagtgattttcccatccataacctcccttacggcgtattctccacgcgaggggatccgcgaccgcgaatcggagttgccatcggcgatcagatccttgacttgtctatcattaagcatctgttcactggacccgtcctgtccaagcaccaggatgtctttaaccaacctacactaaattcgttcatgggtctcggacaagcggcctggaaagaggcacgtgtattcctccaaaacctgctctccgtgtcccaggcccggctccgtgacgacactgagctgaggaagtgtgccttcatctcccaggcctctgccaccatgcatctgcctgctaccatcggtgattatactgacttttactcatctcgacaacacgcaaccaatgttggtataatgtttagagataaggagaacgccctgatgcctaactggttgcacttgcctgtggggtatcatggccgggctagcagtgtcgtcgttagcggaacgcctattcgcagaccaatgggtcaaatgaaacctgatgattctaagccgcctgtctacggtgcttgcaagttgttagatatggagttggagatggccttctttgttgggcctggaaaccgcctcggggagcctatccctatttcaaaggctcacgaacatatttttggtatggtacttatgaatgactggtccgcccgagacatccagaaatgggagtatgttcccttaggcccttttctaggcaaatcattcggtacaacggtctcaccctgggtcgtccctatggatgctcttatgccttttgcagtgccgaaccctaaacaagatccgcggccactcccgtacctctgtcatgacgaaccatacacgttcgatatcaacctctccgtcaacctcaaaggcgagggaatgtcgcaggcggccacgatctgtaaatccaactttaagtacatgtactggacgatgctccagcaactaacccaccatagcgtaaacggatgcaatcttcgtcccggcgatttgttggcgagcggtactatatcaggccccgaacctgaaaatttcggttcaatgttggagttgagctggaagggaactaaaccaatagatcttggtaacggccaaactcgcaagttcttgctagacggggatgaggtgatcattaccggatactgccaaggagatggatataggatcgggtttggacagtgtgccggcaaggtccttccagcccttttaccttct

SEQ ID NO: 11830 - DNA, 1257 bp, Artificial Sequence
  Description of Artificial Sequence: Synthetic coding sequence
atgagttttatacccgttgcagaagattcagatttccctattcataacttgccatacggtgtttttagtaccaggggggatccacgtccaaggattggggtggcaatcggcgaccagatcctcgatttgtctataattaaacatctttttaccggaccggtcttgtcaaagcaccaagatgtcttcaatcaacccactcttaacagcttcatgggcctcgggcaggctgcctggaaggaagcccgggtattcttacaaaaccttctctccgtctcccaggctcgtttacgtgatgatacggaactccgaaaatgtgcatttatcagtcaagcgtcagcaactatgcatctacctgctaccatcggtgactataccgacttctattcttcccgacaacacgcaacaaacgtgggaatcatgttccgggataaggaaaatgcattgatgccaaactggcttcatcttccagtgggttaccatggcagagctagttccgttgtggtgtcgggtactccgataaggaggccaatgggacagatgaagcctgacgacagtaaaccaccagtgtacggagcatgtaaactcctcgatatggaattggaaatggccttcttcgttggaccggggaatagattaggtgaaccaataccgatttctaaagcccacgagcatattttcggtatggtgttaatgaatgattggtccgcacgagacatccagaaatgggagtacgttccattgggtccgttccttggtaaatctttcggtactaccgtgtcgccatgggttgtccccatggatgcacttatgccattcgcggtccccaatccgaaacaagatcctcgtccgttgccatacttgtgtcatgacgaaccttatactttcgatattaatttgtcagtcaatctcaaaggtgagggaatgtctcaggctgctactatctgcaagtccaattttaagtacatgtattggactatgctccagcagctcactcatcactcagttaatggatgtaatttgaggcccggagatttgctcgctagtgggactatatcaggtcctgagcctgagaacttcgggagtatgttagagttgtcttggaagggcactaaacctattgatttgggaaatggacagactcggaaattcttgttggatggtgacgaggtcatcattactggttattgtcaaggcgatggttatagaataggattcggacaatgcgctggtaaagtcttgcctgcactccttccttcg

SEQ ID NO: 11831 - DNA, 1257 bp, Artificial Sequence
  Description of Artificial Sequence: Synthetic coding sequence
atgtcctttatccctgtggcggaggacagtgactttcccattcacaatctgccctacggagtgttctctactaggggcgatccaaggccacgaatcggggtggcgattggcgaccagatcctcgacctgtctatcatcaagcatttgttcacggggccggtgctgtctaagcaccaggatgtgttcaaccagcctactctgaatagtttcatggggctggggcaggccgcgtggaaggaggcacgcgtgttcctgcagaatctgctcagtgtttctcaggcccgcctgcgcgatgatacagagcttcgcaagtgtgcattcattagccaggcctctgcgaccatgcatctccctgcaactattggtgactacaccgacttttactcttctaggcaacacgccaccaacgttggtattatgtttcgggacaaggaaaatgctctgatgcctaattggttgcaccttccagtcggctaccacggcagagccagcagtgtggtagtatcaggaactccaattaggcgccctatgggtcagatgaaaccagacgactctaaaccgccagtgtatggggcttgcaaactgcttgacatggaattggagatggccttcttcgtgggacctgggaataggctgggcgagcctattcccatatccaaggctcatgagcacatctttggaatggtccttatgaacgattggagcgctagagacatccagaaatgggaatacgtccctttgggtccgttcttgggtaagtcatttggtacaaccgtcagcccgtgggtggttccaatggacgccctcatgccatttgctgtgcctaatcccaaacaggatcctcgccctctgccgtacctgtgtcacgacgagccatacacgttcgatatcaacctgagtgtaaacctcaagggagagggaatgtcccaggcagccacgatctgcaagtctaactttaaatacatgtactggacaatgcttcagcagttgactcaccatagtgtaaacggctgcaaccttagacctggagatctgctggcctccggcacaatcagcggtccggagccggagaacttcgggtcaatgctcgaactgtcttggaagggcacaaagcccatcgatttgggaaatggccaaacccgaaagttcttgctggacggagacgaggtgattatcaccggatactgccagggggacggataccggataggcttcggtcaatgtgccggcaaggtcctcccggcattgctgcccagc

SEQ ID NO: 11832 - DNA, 1257 bp, Artificial Sequence
  Description of Artificial Sequence: Synthetic coding sequence
atgtctttcattcccgttgccgaagactctgatttccccatccacaatttgccttacggcgtcttctcaaccaggggagacccccgtcctagaataggcgtggcaatcggtgaccagatccttgacctgtccattattaaacacttgtttactggtccagtgttgtcaaagcaccaagatgtttttaaccaacccaccctgaactctttcatgggtctgggacaggccgcctggaaggaagccagggtttttcttcaaaacctgctctccgtgtctcaggctcgtctgcgcgacgacacagaactcaggaagtgtgcattcatatcacaggcatctgctaccatgcacctgcccgccaccattggagattacacagacttttacagctcacgccagcacgctactaacgtaggcattatgttccgtgacaaggaaaatgctctcatgcctaactggttgcatttgcccgtgggctatcacggcagggcttctagcgtggtcgtgagcggtacacctataaggcgccctatgggacagatgaagcccgatgactccaagccccctgtgtatggtgcttgcaagctcctggatatggagctggagatggccttctttgtaggtccaggaaatcgcctgggagagccaatcccaatctctaaggctcacgagcatatcttcggtatggtgctgatgaacgattggtccgcacgtgacattcaaaagtgggagtacgtccctttgggccctttccttggcaagagctttggcaccaccgtctccccatgggtggttccaatggacgccctgatgccatttgctgtgcccaatcccaagcaggacccccgtcccctgccatatctgtgccatgacgagccatatactttcgatattaatttgtccgtgaacttgaaaggagagggtatgagccaagccgctactatctgcaagagcaatttcaagtacatgtattggacaatgctgcaacagctcactcatcacagtgtcaatggctgcaacctccgccccggagacctcctggcctctggtacaatctctggtcctgagccagagaactttggtagcatgctcgaattgtcttggaagggcaccaaaccaatcgatctgggcaacggccaaacaagaaaatttctgctggacggagatgaggttatcatcaccggctattgtcagggtgacggatataggataggatttggtcagtgcgccggcaaggtcctgcctgctctgcttccaagc

SEQ ID NO: 11833 - DNA, 1257 bp, Artificial Sequence
  Description of Artificial Sequence: Synthetic coding sequence
atgtcttttatccccgtcgctgaggattccgattttcctatacataatctaccatacggcgtcttctccactaggggcgatccgaggccacgtattggcgttgccatcggcgatcagatcctcgacctatcgatcatcaagcatctgttcaccggcccagttctctcgaagcaccaggatgtgtttaatcaaccgacgttgaattcatttatgggactgggccaggccgcctggaaggaggctagagtctttctgcagaatcttctgagcgtgagccaggctcgacttcgagacgatacggagcttcgaaaatgcgcttttatcagccaggcgtccgccacgatgcatctgccggcaaccatcggggactatacagatttctacagttctcgtcagcacgccaccaacgtaggcatcatgttccgggacaaagaaaacgcgctgatgcccaactggctgcacttaccggttggataccacggtagggcaagtagtgtcgtggtgtcaggcacgccaatacggcgccctatgggacaaatgaagcctgatgatagcaaaccgcccgtttatggcgcatgcaagctgctggatatggagcttgagatggccttcttcgtgggacccggtaatagactaggtgaacctatccctatcagtaaagcacatgaacacatcttcgggatggtactcatgaacgattggtccgccagagatatccagaagtgggaatatgtgcccctgggtccgttcctgggaaaaagcttcggcacgacagtgagtccctgggtggtgcctatggatgctcttatgccattcgccgttccaaaccctaagcaagatccacgaccgctgccgtacctctgccacgacgagccctacacgtttgatattaacctgtcggtgaatctgaagggagaaggtatgagtcaggctgctaccatatgtaaatccaacttcaaatatatgtattggacgatgctacaacaactcacgcaccactccgtcaatggttgtaatctgagacccggtgacctgctagcatcaggcactataagcggtcctgagcctgagaatttcggctccatgctggagttgagctggaaggggaccaagcctatagatctgggcaacggtcagaccaggaagttcttgctcgacggtgatgaggtcattattaccggctactgccagggcgacggttatcgtattggctttggtcagtgcgcaggcaaggtgctccccgctctgttgccatca

SEQ ID NO: 11834 - DNA, 1257 bp, Artificial Sequence
  Description of Artificial Sequence: Synthetic coding sequence
atgtctttcataccagtggccgaagattcagactttcctattcataatctgccatatggtgtgttctccactcgaggcgatcctagaccacgcattggtgtagctatcggtgatcaaatcctggacttgagcattatcaagcatctgttcaccgggcccgtcctcagcaaacatcaggatgttttcaaccaacccacactgaactcattcatggggctgggacaggccgcttggaaggaagcccgcgttttcctgcagaatttgctgtccgtttcacaggctcggctcagagacgacacagagctgaggaagtgcgcttttatcagccaagcaagcgcaaccatgcacctccctgccaccatcggggactacactgatttctactcgagtcgtcagcacgcaacaaacgttggaatcatgttccgggataaagaaaacgcccttatgccaaactggctacatttgcctgtgggatatcatggcagagccagttctgtggtagtttccgggacacctattcgacgacctatgggccagatgaagcctgatgattccaagcctccggtctatggcgcatgtaagctcttagatatggagctcgaaatggcctttttcgtggggccggggaaccgcctcggtgagccaatcccaatctcaaaggctcacgaacacatcttcgggatggtactgatgaacgactggtcagctagagatatccagaaatgggaatacgtacccttgggacccttcttaggcaagtcattcgggaccacagtgtccccttgggtggtgccaatggacgcactgatgcccttcgctgtgccaaatccaaaacaggaccctaggcctctgccctacctgtgtcacgacgagccctacaccttcgacattaatctcagtgtgaacctcaagggggaaggtatgtctcaggccgcaacaatctgtaaaagtaactttaaatacatgtactggactatgcttcaacaactgactcaccatagtgtaaacggatgcaacctgcgtccgggcgacctcctggcgtccggcactatttcagggcccgagccggaaaactttggaagtatgctggagctcagctggaagggaacaaaacccattgatctgggaaatgggcagaccagaaagttccttctcgatggggacgaagtcattattactggatactgccagggagacggatacaggatcggcttcgggcagtgcgcaggaaaggtcctccccgctctcctgccctcc

SEQ ID NO: 11835 - DNA, 1257 bp, Artificial Sequence
  Description of Artificial Sequence: Synthetic coding sequence
atgtccttcatccccgtggctgaggatagcgacttcccaattcataaccttccgtatggagtgttctctacccggggtgacccaaggccgcggattggggttgcaattggcgaccaaatcctagacctatccatcatcaaacatctttttactgggcccgtactgtctaagcatcaggatgtgttcaaccagcccacactcaactcatttatgggtctgggacaggctgcttggaaagaggctagggtattcttgcagaaccttctgtcagtttcacaggcccgattgcgagatgacactgaattgaggaagtgcgcattcatatctcaggcaagtgccacaatgcacctgccagctacaatcggtgattacaccgacttctatagctctcgccagcacgccacaaacgtgggcattatgttcagggacaaagagaatgccctaatgccaaactggctccatcttccggtgggttaccacggccgcgctagcagcgttgtggtctcagggacgccgatcaggagaccaatgggacaaatgaagcccgacgactccaaacctcccgtttatggcgcctgcaaactgctggatatggagcttgaaatggctttttttgtcggccctggtaatcgcctgggcgagcctatcccgatcagcaaagctcacgagcacatcttcggtatggtcctcatgaacgactggagtgccagagacattcagaagtgggagtatgtgccgctgggtccgtttcttgggaagagttttggaacaactgtcagcccctgggtcgtacccatggacgctttgatgcccttcgccgtccctaaccctaagcaggaccctagacccctcccttacctgtgtcatgacgagccttacaccttcgatataaacttgagtgtgaacctaaaaggcgagggaatgtcacaggcagcaactatttgcaaatcaaatttcaaatacatgtattggaccatgctgcagcagctgacacatcattctgtgaacgggtgtaatctgaggcctggcgatttgctggcaagcggcaccattagcggtccagagcctgaaaacttcgggtcaatgttggagttgtcctggaaaggtacaaagcccatcgatctgggtaacggccagactagaaagttcttgctcgatggtgatgaggtgattatcaccggttattgtcagggggacggctacaggatcggatttggtcagtgtgctggaaaggtgctgccagcactgctgccttct

SEQ ID NO: 11836 - DNA, 1257 bp, Artificial Sequence
  Description of Artificial Sequence: Synthetic coding sequence
atgagctttattcccgttgccgaagactccgatttcccaatccataacctgccctacggagttttctcaacaagaggagaccctaggcctagaatcggtgtcgctattggtgatcagattctcgatctgtccataatcaaacatctcttcactggaccggttctatcaaagcatcaggatgttttcaaccaacctaccttgaacagctttatgggtctgggtcaggcagcctggaaagaagccagagtgttcctccagaacctgctatctgtctcacaggcgcggctgagagatgacaccgaattaagaaagtgtgcattcataagccaagcctcagccacgatgcatctgcccgccacaatcggggattacactgacttctattcctcacgccagcacgccacaaacgtgggaatcatgttcagagacaaagagaatgccctgatgcccaattggctacatttgcccgtgggctaccacggcagagcctcaagtgtggttgtttccggaacccctatacgccgccccatgggccagatgaaaccggacgattctaaacctcctgtctacggggcttgtaagctcctcgacatggaactggagatggcattcttcgtcgggccaggcaatcggctgggagagcctatcccaatttctaaggcccacgaacatatcttcggaatggtgttgatgaacgactggagcgcccgagacatacagaaatgggagtacgtgcctttggggcccttcctgggaaagtctttcggaactaccgtctctccatgggtggtccctatggatgccctgatgcctttcgctgtaccaaacccaaagcaggaccctagacctctcccatatctctgtcatgatgaaccctataccttcgatatcaatctgtctgttaatcttaaaggtgagggtatgtcgcaggctgcaaccatttgcaaatctaattttaaatatatgtactggaccatgctgcagcagctcacacaccactcagtcaacggctgtaacctccggccgggagacctgctagctagcgggaccatctccggcccagaacccgaaaatttcggcagcatgctcgaattgtcatggaaaggcactaaacctattgacttaggcaatgggcagactagaaagttcctgctggatggcgatgaggttatcattacggggtactgtcagggagatggctatcgaattgggtttgggcagtgcgctgggaaggtcttgcccgctctcctcccttca

SEQ ID NO: 11837 - DNA, 1257 bp, Artificial Sequence
  Description of Artificial Sequence: Synthetic coding sequence
atgtcttttatacccgtggcagaagactccgatttcccgatccataatctcccatatggcgtctttagcacgcgtggcgacccccggccacgcataggagttgcgatcggagaccaaatcttagacttgagcattattaaacacctgttcaccgggcccgtgttgagtaagcaccaggacgtgtttaaccaacctaccctgaactcatttatgggccttgggcaggccgcttggaaggaagccagggtctttctgcaaaaccttctttccgttagccaggcccgcttacgtgacgacacagagctcaggaaatgtgcctttatttcccaggcatctgccaccatgcacctacctgcgacaattggcgactatacagacttttatagctctagacagcatgccacaaatgttggaatcatgtttcgggataaggagaacgctctgatgcccaattggttacaccttcctgttggataccatggtcgggcttcatcggtggtggtctctgggacgcctatccggaggcccatgggccagatgaagccagacgactccaagcccccggtgtatggggcttgcaagttactcgacatggaattggaaatggctttcttcgtgggtccaggcaatagattgggcgaaccaattcctatctcaaaagcacacgagcatatctttgggatggtcctgatgaatgactggtccgcgagggacattcaaaagtgggaatacgtgccactggggccttttcttggcaagtctttcggaaccaccgtgtccccctgggtggtccccatggacgcactgatgccttttgctgtacctaatccaaaacaggacccccgacccctcccctatctctgccatgacgagccatacaccttcgatataaatctgagcgtgaacttgaagggtgaaggaatgtcccaggccgccaccatctgtaaaagtaattttaagtatatgtattggacaatgctgcagcagttaacccatcatagcgttaacggatgcaacctccggccaggggatctgctggccagcgggaccatatctggtcctgagcctgagaattttggtagcatgcttgagttatcatggaagggtactaaaccaatagatctgggcaatgggcagacccggaagtttctactggatggggatgaggtcattatcaccgggtactgtcaaggcgatggttacaggatagggttcggccagtgcgcagggaaggtactaccagcactgctcccaagt

SEQ ID NO: 11838 - DNA, 1257 bp, Artificial Sequence
  Description of Artificial Sequence: Synthetic coding sequence
atgagctttatcccggtagcagaagactctgacttcccaatccataatctaccctatggagtcttttcaaccagaggagatcctaggcctcggatcggcgtcgccatcggagatcagattttggacctgtccataatcaaacacctcttcaccggcccggtactcagtaaacaccaagacgtctttaatcagccaaccctcaattcatttatgggcctcggccaggcagcttggaaagaggccagagtgttcctccagaatcttttgtctgtgtcccaggcccggctacgcgatgataccgaactgcggaagtgcgctttcatatctcaagcctccgccactatgcacttgccagcaacaattggtgactataccgacttctactcctccagacagcatgcaaccaacgtcggcatcatgtttagggataaagaaaatgccctgatgcccaattggttgcatttgccggttggctatcacgggagagcaagctccgtggtagtgagtggcaccccaatacggcggcccatgggacaaatgaaaccggacgattctaagcctcccgtctatggcgcatgtaagctgctcgacatggaactggagatggcattcttcgttggtcccgggaaccgacttggagagcccatccccatctcaaaggcccatgaacacatcttcggcatggtcctgatgaatgattggtccgcgcgggacatccagaaatgggaatacgtgccactgggaccttttctcggcaaaagcttcggtactactgtgtctccatgggtcgttccaatggacgcactcatgccattcgctgttccaaaccccaaacaggatccgcggccgctgccctacttatgccacgacgaaccatatacattcgatattaatctgagcgtaaacctcaaaggagaaggaatgagccaggcagccaccatctgtaaaagtaacttcaaatacatgtattggaccatgctgcaacagctgactcaccactccgtgaatggttgcaacttgcgtcctggcgacttactggctagcggcaccatctccgggccggaaccagagaatttcggcagtatgctggaactatcctggaaaggaaccaagcccatcgacttgggaaacggacagactcggaagttcctgttggacggggatgaggtgattattactggatactgtcagggagacggatacagaattggattcggacagtgtgccgggaaggtactgcccgcactgctaccctca

SEQ ID NO: 11839 - DNA, 1257 bp, Artificial Sequence
  Description of Artificial Sequence: Synthetic coding sequence
atgtcctttattcctgtggcagaggacagtgacttcccaatccacaatctgccctacggagtatttagcactagaggtgaccctcgcccaaggatcggagtggccatcggggatcagattctcgacctgagtattattaaacacttgttcacgggaccggtcctgtctaaacaccaagacgtgtttaaccagccgacgctgaacagctttatgggcctaggacaggcggcttggaaagaggctagggttttcctgcagaaccttctgtccgtgtcacaggcaagactcagggatgatacggaactgagaaaatgtgctttcatcagccaggccagcgcaacgatgcacctccctgccacaatcggcgattacaccgacttttatagtagtaggcaacacgctaccaacgtgggaataatgttcagggataaggagaatgcgctgatgcccaattggctgcatctccctgtgggttaccacgggagagcttcttccgtcgtcgtctccggaactcccattcggcggcccatggggcagatgaaacccgacgactctaaacctccggtgtatggagcatgcaagctgttggacatggaactagagatggctttttttgtgggccccggtaaccggcttggagaaccaattcctattagtaaggcacatgaacacatcttcgggatggttctaatgaacgattggtcagcacgggatattcagaagtgggagtacgtacctcttggccctttcttaggcaaatcgttcggcacaaccgtgtcaccttgggtagtccccatggacgccttgatgcccttcgccgtccccaatcccaagcaagaccccaggcccttaccctatttgtgccatgatgagccttatacctttgacatcaacctaagcgtgaacctcaaaggcgagggcatgagtcaagctgctaccatctgcaagtcaaacttcaagtatatgtattggacgatgctccagcagctcacccaccactcagtcaatggttgcaatttaagacctggcgacctgctcgccagcggaactatctccggcccagaacccgagaattttgggtccatgctggagctctcctggaaaggtacaaaacccatagatcttgggaacgggcagacaaggaagtttctgctggatggagatgaggtgatcattacaggatactgccaaggggacgggtaccggattggattcggccagtgtgcaggaaaggtcctgcctgccctcctcccgtcg

SEQ ID NO: 11840 - DNA, 1257 bp, Artificial Sequence
  Description of Artificial Sequence: Synthetic coding sequence
atgtcgtttattccagtggcagaggatagcgattttcccattcataatctgccttacggagtattttctacgcgcggggacccccggcccagaatcggggtggctattggcgatcagatactcgacctgtcaattataaaacacctctttaccggtccagtcctcagcaaacatcaggatgtgttcaaccagcccacgctgaactcctttatgggccttggtcaggcggcctggaaagaagcccgggtctttctgcagaacctattgagcgtgtcccaagcccgcctgagagatgataccgagcttcggaagtgcgcctttatctctcaagccagcgcaaccatgcatctgcctgcaacgataggcgattataccgacttctacagctcacgccaacatgcaaccaatgtcggaattatgtttcgcgacaaggaaaacgcattgatgcctaattggcttcacctgcccgtcggttaccacggccgcgcttccagcgtggtcgtgtccggaaccccgatcagaaggcccatgggccagatgaaaccagacgattcaaaaccgcccgtgtacggagcctgtaagctgctggatatggagcttgaaatggcctttttcgtaggcccggggaaccggctgggtgagcctatccccatcagtaaagcacacgaacacatatttggcatggttcttatgaatgactggtctgcccgtgatattcaaaagtgggagtatgtgccccttggaccctttttgggtaagtcgtttgggacaactgtcagcccgtgggttgtgcctatggacgccctgatgccattcgcggttcccaatcctaaacaggacccacgtccccttccgtatttgtgccatgatgagccatatactttcgatatcaacttgtctgtgaacctcaagggggaggggatgtcccaggccgcgactatatgcaagtccaattttaaatatatgtactggactatgcttcaacagctgacacatcacagcgtcaacggttgcaacttgcggcctggggatctcctggcctcgggaacgatctccggacccgagcctgaaaatttcggctcaatgctggaactgtcttggaaagggactaagcccattgacctggggaatgggcagacaaggaaatttttgctcgacggcgacgaggtcattattacgggctattgtcaaggggatggatatcgcattggcttcggacagtgcgccggcaaggtcctgccagccctcctcccctcg

SEQ ID NO: 11841 - DNA, 1257 bp, Artificial Sequence
  Description of Artificial Sequence: Synthetic coding sequence
atgagttttatccctgttgccgaggattctgatttccccatccataatctgccatacggggtgttctccacaagaggagatcccagaccacgcatcggcgtcgcaattggggatcagatcctggacctcagcatcatcaaacacctgttcactggcccggtcctgagtaaacatcaggatgtttttaaccaaccgacattgaactccttcatgggtctcggccaggccgcttggaaggaggctcgggtttttctgcagaatttgttgagtgtgtcccaagcgcgcctgcgagatgacaccgaactgcgcaagtgcgccttcatcagccaagcctctgccaccatgcaccttccagccacaatcggcgattataccgatttttatagttcacggcaacatgccactaacgttggtattatgttccgcgacaaggaaaatgctcttatgccaaactggctccaccttcctgttggctatcacggtcgcgcatcctctgtggtagtcagcgggacgcccatcaggcgacccatgggacagatgaaaccagacgatagcaagccccctgtttatggtgcatgcaaacttctggatatggagctggagatggctttcttcgtgggtcctggcaatcgactgggcgagcctattcctattagcaaggctcatgagcatatctttggcatggttttgatgaatgattggagtgcgcgcgatatccagaaatgggaatacgtgccactcggccctttcctcggaaagagctttggaaccaccgtgtccccatgggtggtccctatggacgccctcatgccctttgcggtgcctaacccaaagcaggacccgaggcccctgccttacctttgtcatgatgaaccatacactttcgacattaacctgagcgtgaatctgaagggtgagggcatgtcacaagccgccactatttgtaagtctaacttcaagtatatgtactggacgatgctccagcaactgacccaccactccgtaaacgggtgtaacctgcgccccggggacctcctcgcatccggaaccatttccggcccagaaccagaaaattttggttccatgctcgagctgtcttggaagggtactaaacctatcgatctcggaaatggacagactcgaaaattcttgttggacggagacgaagtaattatcacgggctattgtcagggtgacggctatagaattgggttcggacaatgtgccggcaaggttttgccagccctgctgcctagt

SEQ ID NO: 11842 - DNA, 1257 bp, Artificial Sequence
  Description of Artificial Sequence: Synthetic coding sequence
atgtcattcatcccggtagcagaggactccgacttcccaatccataacctgccctacggcgtgttttcaaccagaggcgatccaagaccacgcattggcgtggctatcggtgatcagatcctcgacctgtccatcatcaagcatctgttcaccggcccggtcctctccaaacaccaggacgtgttcaatcagccaaccctcaacagcttcatggggttgggacaggccgcgtggaaagaagcgcgggttttcctgcaaaatctgcttagcgtgagccaggcaaggctgcgggacgacactgaactcaggaagtgcgcgttcatctcgcaggcgtcggccaccatgcatctgccagccacgattggggactacactgacttttactcgtcaagacagcatgccaccaatgtgggcatcatgttccgagataaggaaaacgccctgatgccgaactggctgcaccttccggtgggataccacgggagagcttcctcggtggtggtgtccggaactccgatccgccggccaatgggccagatgaaacccgacgattcgaagccgcctgtctacggagcgtgcaagctcctggatatggagttggaaatggcatttttcgtgggaccggggaaccggctgggagagcctatcccgatttcgaaggcccacgagcacatcttcggaatggtgcttatgaacgactggagcgcccgcgacatccaaaagtgggagtatgtccctcttggaccttttctgggaaagagcttcggaaccactgtgtcaccgtgggtcgtccctatggatgcgctgatgccattcgctgtgccgaatcccaagcaagacccccgcccgctcccatacctgtgccacgatgagccgtacacctttgatataaatctgagtgtcaatctgaagggcgaaggaatgtcccaggccgcaacgatctgcaaatcgaactttaaatacatgtactggactatgctccagcaactgactcatcacagcgtcaacggctgcaacctccgccctggagatctcttggcatcaggtactatctcgggtcccgaacctgagaacttcgggtccatgctcgaactgtcttggaagggaaccaaaccaatcgacctcggaaacggacaaactcgcaagttcctgctggacggagacgaagtgatcatcaccggatactgtcagggtgatggataccggattggcttcgggcaatgtgctggtaaggtgttgccggccctcctgccgtcc

SEQ ID NO: 11843 - DNA, 1257 bp, Artificial Sequence
  Description of Artificial Sequence: Synthetic coding sequence
atgagttttatacccgttgccgaggactctgactttcctatacacaacctaccgtatggggtcttcagtacccggggcgatccaagaccaagaattggagtggcgatcggcgatcaaatcctggacttatcaataataaagcatcttttcaccggaccggtgctgagcaaacaccaggatgtcttcaatcagcccaccctcaactcgttcatggggctcgggcaggcagcttggaaagaagcccgcgtctttctccagaatctcttgtccgttagtcaggcgagactgcgcgatgatactgagctcagaaagtgcgcctttatctcccaagcttctgctacgatgcatttgcctgccacaataggggactatacggacttctactcttcccgtcagcacgccaccaatgtcggcatcatgttcagagataaagagaacgccctaatgcccaattggctgcatctcccagtcggctatcatgggagagcatcgagcgtggtagtcagcggaacccccatccggagacctatgggccagatgaaacccgacgatagcaagcctcccgtgtacggagcctgcaaattgttggacatggagctggaaatggcattcttcgtcggacctggtaaccgcctgggagaacccattcctatttcaaaggctcatgagcatatcttcggtatggtcctgatgaatgactggagcgctagggatattcaaaaatgggagtatgtgcccctggggccttttctgggaaagtccttcggaaccaccgtatctccttgggtagtgcctatggacgccctaatgccgttcgcagtgcccaatcctaaacaggatccccgacctctcccttatctgtgccacgacgagccttatactttcgacatcaacttaagcgttaacctcaaaggagagggaatgtcccaagcagcgacaatctgcaaatccaatttcaagtacatgtactggacgatgctgcagcaacttacccaccattcagtgaatggctgcaacctgcggccgggcgacctgctggctagcgggactatcagcggacccgaaccggaaaatttcgggagcatgctggaattgtcgtggaaggggaccaaaccgatcgatctaggcaatggccagaccaggaaattcctgctcgacggggacgaggtcattataactggatattgccagggtgacggctaccgaattggatttgggcagtgcgccggtaaggtcctgcccgctctgctgccatca

SEQ ID NO: 11844 - DNA, 1257 bp, Artificial Sequence
  Description of Artificial Sequence: Synthetic coding sequence
atgtcgtttattccagtggccgaggatagcgatttcccaattcacaatctgccttacggggttttctccacacgcggcgatccacgacccagaattggggtcgccattggcgaccagatcttggatttgtcaatcattaaacatctgttcactggacctgtgctgtcgaagcatcaagatgtgtttaaccagccgaccttgaactccttcatgggcctgggccaggccgcctggaaagaagcccgggtgtttctacagaatctactgagtgtctcgcaggcccggcttagagacgacactgaactgaggaagtgcgcttttatttctcaagcgtctgcaacgatgcacctgcctgccaccatcggagattacacggacttctatagttcccgtcagcacgcaacgaatgtagggattatgttccgcgataaagagaatgcactgatgccgaactggctgcatctcccggtgggataccatggccgggcctcttcggtggtcgtgtcaggtactccgattcgtcgcccgatgggtcagatgaagcctgacgacagcaaaccacccgtatacggagcttgcaaattactcgatatggaacttgaaatggcttttttcgtcggaccaggtaatcggctcggggaacctatccctatttctaaggcacatgagcacattttcgggatggtccttatgaatgactggtctgctcgggacattcaaaaatgggagtatgtccccctcggccctttcttaggaaaatcattcgggacaaccgtctctccctgggtagtgccaatggatgcccttatgccattcgcagtgcctaaccctaagcaagacccgaggcccctgccatacctttgtcacgatgagccatatacattcgacattaatctgtccgttaacctcaaaggagaggggatgagtcaggcagcaaccatttgcaagagcaactttaagtatatgtattggaccatgctccagcagctgacccaccacagcgtgaacggctgcaacttgcgccctggtgatctcctcgcatcggggacgatctctggccctgaacccgagaattttgggtcaatgctggagttgagctggaaggggaccaagcccattgacctgggcaacggacagacgagaaaatttttgctggacggcgatgaggtgattattacaggatactgtcagggagatggttataggatcggcttcggtcagtgcgccggcaaagtgctcccggcacttcttccatcg

SEQ ID NO: 11845 - DNA, 1257 bp, Artificial Sequence
  Description of Artificial Sequence: Synthetic coding sequence
atgagctttatacccgtcgccgaagatagcgattttcccatccacaacttaccgtacggggtgttttctactcgaggagatcccagaccgagaatcggcgtcgcaattggagaccagattctcgatctttcaattatcaagcatctgtttactggcccggttctgtccaaacatcaggatgtgtttaaccagccgacactgaacagtttcatgggcctaggccaagctgcctggaaggaagcaagagtttttctgcagaatctgcttagcgtttcccaggcccgattgcgggatgacactgagctgagaaagtgcgcttttatttctcaagccagtgccactatgcacttacccgccaccatcggggattacactgatttctacagttctcggcagcacgctacaaacgtcgggattatgttccgagataaggaaaacgctttgatgcctaattggcttcaccttccagtgggatatcatggccgcgcctctagcgtggtcgtgagcggcacgcccatacggcggccaatgggccagatgaagcccgatgacagcaagcccccagtttacggagcctgtaaattgcttgatatggaactcgagatggctttcttcgttggccccggaaaccgcctcggtgagcccatcccaatctcgaaggctcacgaacacatcttcgggatggtactgatgaatgactggtctgcccgagatatacagaaatgggaatatgtgcctctcggcccattcctgggaaagtcgttcgggactacagtgagcccatgggtggttcctatggatgccctgatgccatttgctgtgcctaatccgaagcaggatccccgcccactcccttatctgtgtcacgatgaaccctatacgttcgacattaatctgagcgttaatctgaaaggtgaaggcatgtcacaggctgccactatttgtaagtccaacttcaaatacatgtattggacaatgctccagcagctgacacaccacagtgtaaatggttgcaacctgcgtccaggtgacctgctggcatctggcacaattagcggacctgaaccagagaacttcggaagcatgttggagttatcttggaagggaactaaacctatcgatctgggcaacggacagactaggaagtttctcctggatggggacgaagttattatcacaggctattgccagggcgacggctatagaatcggctttggccagtgcgctggtaaggtactaccggctttacttcccagc

SEQ ID NO: 11846 - DNA, 1257 bp, Artificial Sequence
  Description of Artificial Sequence: Synthetic coding sequence
atgtcattcatccctgtggccgaggattccgattttcccatccacaatctgccatacggggtgttctcaacgcggggagatcctaggccacgaattggcgtggctattggcgatcagattcttgacctcagcataatcaaacatctatttacggggccagtgctgagcaaacatcaggacgtgtttaaccagcctactttgaactcatttatgggtcttggacaggccgcctggaaagaagctagagttttccttcaaaacttgctctccgtttcccaagctcggctacgcgacgacaccgaactgagaaagtgcgctttcataagccaggctagcgctaccatgcatctgccggcgactattggtgattatacggacttctatagctctcgccagcacgcgactaacgtgggaatcatgttcagggataaggaaaacgcgttgatgccaaattggctacacttgccggtaggttatcacggccgagccagctcagtcgtcgtgtctggaacccccatccgaaggcccatggggcagatgaaacccgatgatagcaagcctcccgtctatggcgcctgtaagttgctggatatggaattggaaatggccttctttgttgggcccgggaatcgacttggtgagcctatccctatcagtaaggcccacgagcacatattcggcatggtgctgatgaatgattggagtgccagggacattcagaagtgggagtacgtgccactgggcccattcctcgggaagtcgttcgggaccactgtgagcccctgggttgtcccaatggatgcactgatgcccttcgcggtacctaatccaaagcaggacccgcgccccctgccttacctttgtcacgacgagccctatactttcgatattaatctgtctgtcaacctcaagggcgagggtatgagccaagcggctactatctgtaaatcgaattttaaatacatgtattggaccatgctccaacagctgacacaccactcagttaatgggtgcaacctgagacccggggacctgctggcctctggcactatatccggccccgaaccggaaaattttggcagcatgttagagctgagctggaaggggaccaagcctatcgatcttggcaatggacagacaaggaagttcttgctggacggggatgaagtcataatcaccggctactgtcagggtgacggttatcgtatcggttttggacagtgcgcaggtaaagttttaccagcgctgctacccagc

SEQ ID NO: 11847 - DNA, 1257 bp, Artificial Sequence
  Description of Artificial Sequence: Synthetic coding sequence
atgtccttcattcccgtggcagaagactccgattttccaatccacaatttgccttatggcgttttcagcacgaggggtgaccctagacctagaattggcgtcgctatcggtgaccaaatcttggatttgagcatcattaaacacttgttcactggcccagtgctttccaagcaccaagatgttttcaatcagccgactctgaactcttttatgggcctgggacaggcggcgtggaaagaggccagggtatttcttcagaatctgctgagtgtatctcaggctaggctgcgcgatgacaccgaattgcgcaagtgtgcgttcatttcacaagccagcgctaccatgcaccttcctgccaccatcggcgactatactgatttttacagctccaggcaacacgctacgaatgtgggaatcatgtttagggacaaggaaaacgcccttatgccaaattggctccatcttccagtcggatatcatggcagagcctcttccgtagtggtatccggcactccaatccgcaggcctatgggccagatgaaacctgatgattccaagcccccggtatatggcgcctgcaagttgctggatatggaactcgaaatggcatttttcgtcggccccggtaataggctcggcgagcctatccctatttctaaggctcacgagcatatttttggcatggttctgatgaacgattggagtgcacgcgacatccagaagtgggaatacgtcccattgggcccctttcttggcaaaagtttcggtactaccgtgtcaccctgggtggtcccaatggacgctcttatgcccttcgctgtaccaaacccaaagcaggaccctagaccgttgccttacctctgccatgacgagccgtacaccttcgacattaatttgtctgtcaacctgaaaggagaaggaatgtcccaggcggctactatttgtaagagcaacttcaagtacatgtattggacaatgctgcagcaactgacacaccatagtgtcaacggttgtaatctgaggccaggcgatctcttggcttcaggcactatcagtggtccagaaccagagaactttggttctatgctggagctgtcttggaagggaactaagcctattgatctgggtaatggacaaacaaggaagtttctcttggatggtgacgaggtgataatcaccggctattgccaaggcgacggctacagaatcggtttcggtcaatgcgctggtaaggtgttgcccgcgctgctcccgagc

SEQ ID NO: 11848 - DNA, 1257 bp, Artificial Sequence
  Description of Artificial Sequence: Synthetic coding sequence
atgtccttcattcccgtcgccgaggactccgacttccccatccataatctaccttacggcgtgttcagtacaagaggcgacccaaggcccagaatcggggtggccataggcgaccaaatactggatctgagcattataaaacatttattcactggacctgtgctgtccaagcaccaggacgtcttcaaccaaccaaccctaaattcctttatgggtctgggacaggctgcatggaaagaagcacgcgtcttcctgcagaacctcctctcagtgagtcaggctcggctgcgtgatgacactgaattaagaaagtgtgcctttataagtcaagctagtgctaccatgcacctcccagccaccataggtgactataccgacttctattccagccggcagcacgctacaaacgtgggcattatgtttcgcgacaaggaaaacgctctgatgccaaattggctgcatcttcccgtgggctatcacggcagggcaagctctgtggttgtcagcgggacccccattcgcaggcctatgggccagatgaagcctgacgacagcaagccccccgtgtatggcgcatgcaaactactggatatggaactagagatggctttcttcgtcggcccagggaacagactgggtgaacctattcctattagtaaggctcacgagcacatcttcggcatggttctaatgaacgactggtctgcacgtgacattcaaaagtgggaatacgtccctctcggccccttccttggcaagtcattcggcacaactgtgtccccctgggttgtccccatggacgcactcatgccattcgccgtgcctaatcctaaacaggatccaaggccactgccttacctgtgtcacgacgaaccctatacttttgacataaacctctctgttaatctgaagggcgaggggatgtcccaggccgctaccatctgcaagtcaaatttcaaatatatgtattggacaatgctgcaacagctaacccatcattccgtgaacggctgcaacctaaggcccggcgatctgctggcctctggcacaatttccggaccagagcccgagaacttcggcagtatgctggaattgtcttggaaaggcactaaacctatagaccttggcaatgggcagaccaggaaatttctcctggatggggacgaagttataatcaccgggtattgccaaggggatgggtatcggatcgggtttgggcagtgtgcagggaaggtgctgcccgccctgctaccctca

SEQ ID NO: 11849 - DNA, 1257 bp, Artificial Sequence
  Description of Artificial Sequence: Synthetic coding sequence
atgtccttcatccccgtggcagaggacagcgatttcccgatccacaacctcccttacggagtgttcagcacacgaggggatccgaggcctagaattggggtggccatcggggaccaaatcctggatctgtccatcataaagcatctgttcactggcccagtgctgtccaaacatcaggacgttttcaatcagccaactttaaattccttcatgggcctgggtcaagcagcgtggaaggaggcaagggtgttcttacagaatttgctctctgtgtctcaggcccggcttcgagacgacacagagctacgtaagtgcgctttcatctcccaggccagcgctaccatgcacttgcctgcaactatcggcgattacactgacttctattcctcacgccagcacgccactaacgtgggcattatgtttcgggataaagagaacgcattgatgccgaactggctgcacctgccagtgggttatcatggccgagctagttccgtggttgtctcagggacgcctattagacgaccaatgggacagatgaaaccggacgactcaaagcccccagtgtatggagcctgcaaactcttggacatggaactggagatggcctttttcgtgggccccggcaatagactgggagaacccattcccatctccaaggctcacgaacatatattcggtatggttctgatgaatgactggagcgcccgggacattcagaagtgggagtatgtccccctcggaccctttttggggaaaagtttcgggaccacagtctctccttgggtggtccctatggacgctcttatgccattcgcagtgcccaacccgaagcaggatccgcggcccctgccctatctttgccacgacgagccttacacattcgacattaatctttcagttaatctcaaaggagagggtatgtcgcaggcagccaccatttgcaagtccaatttcaaatacatgtactggactatgcttcaacagctgacacaccacagtgtgaatggctgcaatctgcgcccaggagaccttcttgccagcggtactatctcaggacccgaaccagaaaacttcgggagtatgctagaattgagctggaagggcacaaagccaatcgatctcgggaatgggcaaacacgaaagtttcttctcgatggagacgaagtaattattactggttattgccagggggatggataccggattggattcggtcagtgtgctggaaaggtccttcctgccctgctcccttct

SEQ ID NO: 11850 - DNA, 1257 bp, Artificial Sequence
  Description of Artificial Sequence: Synthetic coding sequence
atgagctttataccagtggccgaagactctgattttccgatccataacctcccgtatggagtttttagtactcggggagatcccaggccgcgaataggagttgctatcggtgatcaaatcttggatttatcaattataaagcacctgtttaccggaccggttttaagtaaacatcaggatgttttcaatcagccaactctgaatagctttatgggattgggacaggcagcatggaaggaagctcgggttttccttcagaaccttttgtcagttagtcaagcccgacttagagatgatacagagctccgaaagtgtgcgtttatctcgcaagcatcagccaccatgcacctcccggctacgataggtgattatacggatttctatagttcgcgtcaacatgccactaatgtgggaatcatgtttcgagacaaggaaaacgctttgatgccaaattggttgcacctaccggtcggttaccatggacgagcttcatctgtggtggtgtccggcacaccaatcaggcgcccgatgggtcagatgaagccagacgactctaagccccctgtttatggagcatgtaagctcctagatatggaattggagatggcattctttgtcggaccaggaaatcggttgggcgaaccgattccaatttcaaaggcccatgagcatatttttggaatggttcttatgaacgattggtcagctcgtgatatccagaaatgggagtacgttcctctcggacctttcttgggaaagtcctttggaactacggtttcaccgtgggtggtaccaatggatgctctcatgccgtttgcagttcctaatccaaagcaagatccgagacctcttccttacttgtgtcacgatgagccatacacgttcgacattaatcttagtgtgaacttgaagggtgaagggatgtcccaagcggcaacaatttgcaaaagtaattttaaatatatgtactggacgatgctccaacagctgacccatcattcggttaacggttgtaatttacgccctggagatctgcttgcgtccggaactataagcggaccagaacctgagaactttggatcaatgcttgaactgagctggaaaggaaccaagccaattgatctgggaaatggacaaactcggaaatttttattagacggagatgaagttattataactggatattgccagggagatggctaccgtatcggatttggtcaatgtgccggaaaggtactaccggctctgttgccatcc

SEQ ID NO: 11851 - DNA, 1257 bp, Artificial Sequence
  Description of Artificial Sequence: Synthetic coding sequence
atgtctttcattccagtggcggaagactccgactttcctatccacaacctgccctacggagtgttctccaccagaggggaccccaggccccggatcggagtggctatcggcgaccagatccttgatctctctataatcaagcatctattcacaggacccgtgctgtccaagcatcaggatgtgttcaaccagcctaccttgaacagcttcatgggcctcggccaagctgcttggaaagaggcgcgggtgtttttgcagaatctcttgagcgtgtctcaagcacgacttagagacgataccgagttacgcaaatgcgcatttatcagtcaggcctccgcaaccatgcatctgcctgccacaatcggagactatactgatttctactcctccaggcagcatgctacaaacgttggaatcatgttccgcgataaagagaatgcgctcatgccgaattggctccaccttcctgtggggtatcatggacgggccagtagcgtcgtcgtgtcaggaaccccaattcggcgacctatggggcagatgaaaccggacgactccaagccccccgtatacggggcatgcaagctccttgacatggagcttgaaatggcattctttgttgggccgggcaatcgcctaggggagcccatcccaatcagcaaggcccacgagcacattttcggaatggtcctgatgaatgactggagcgctcgggacatccagaagtgggagtacgtgccccttggtccattcctggggaagagcttcggcaccacagtgagcccctgggttgtacccatggacgctctgatgcccttcgccgtccccaatcccaagcaggatcccagacctctcccctacctctgccacgatgagccttataccttcgacattaacctcagcgtcaatctcaagggggagggcatgtcacaggccgctaccatttgtaagagcaactttaagtacatgtactggacaatgcttcagcagctgacccaccacagcgtgaatggatgcaatctccggccaggcgacctgctcgcaagtggtacaatcagtggccctgagccagagaacttcgggtccatgctggaactgagctggaaaggaacaaagcctattgatcttgggaacggccagactcggaagttcctgctcgacggcgacgaagtgataatcaccgggtactgccaaggtgacgggtacaggattgggtttggacagtgcgctgggaaggttctacctgcgcttttaccttca

SEQ ID NO: 11852 - DNA, 1257 bp, Artificial Sequence
  Description of Artificial Sequence: Synthetic coding sequence
atgtcatttattccagtagccgaagattcagattttccaattcataatttaccatatggtgttttcagtacaaggggagatcctagaccaagaattggagttgcaattggagaccaaattttggacttatctattatcaaacatctttttacaggtccagttttatctaaacatcaagatgtatttaatcaacctacattaaattcatttatgggacttggacaagcagcatggaaagaagctagagtatttcttcaaaatttactttcagtatcccaagctagattaagagatgatactgaattaagaaagtgtgcatttatttctcaagcttccgcaacaatgcatttacctgctacaattggtgattatacagatttttattcatctcgtcaacacgctacaaatgttggaattatgtttagagataaagaaaatgcattaatgccaaattggcttcacttaccagttggatatcacgggagagcttcttctgtcgtagttagtggtacaccaattagaagaccaatgggacaaatgaaaccagatgatagtaaaccaccagtctatggagcttgtaaacttttagatatggaacttgaaatggccttttttgttggacctggtaatcgtctaggtgaaccaattccaattagtaaagcacatgaacatatttttggaatggttttaatgaatgattggtctgctagagatattcaaaaatgggaatatgttccacttgggccatttcttggaaaatcctttggaacaactgttagtccatgggttgttccaatggatgctcttatgccatttgctgttccaaaccctaaacaagatccaagaccacttccttatctttgtcatgacgaaccttatacgttcgatattaatttatcagttaaccttaaaggtgaaggaatgtcacaagcagctacaatatgtaagtcaaattttaaatatatgtattggacaatgcttcaacaattaactcaccacagcgttaatggatgtaaccttagaccaggagatcttttagcttctggaacgatttcaggacctgaaccagaaaattttggttccatgttagaactttcttggaaaggaactaagccaatagatttaggtaatggtcaaacaagaaaatttcttttagatggagatgaagttataataactggatattgtcaaggagacggatatagaattggatttggacaatgtgctggaaaggtacttcctgctcttttaccatca

SEQ ID NO: 11853 - DNA, 1257 bp, Artificial Sequence
  Description of Artificial Sequence: Synthetic coding sequence
atgtctttcattccagtagctgaggattctgacttccctatacataatctcccctacggtgtcttctctacacgaggcgatccaagaccccggatcggggttgccataggggatcagatcctggatcttagtatcataaagcacctttttacaggacccgtgctgtctaaacatcaggatgtctttaatcagcctacactgaacagttttatggggctcgggcaggccgcctggaaagaagcacgggtgttcctgcagaatctgctgtccgtcagccaggctaggctgagagacgacacagagttaaggaagtgtgcatttatctctcaggcctccgccaccatgcatcttcctgccactattggagactacactgatttctattcttctcgccagcacgctacgaatgtggggatcatgtttcgtgacaaggagaacgctttgatgcctaattggctgcacctccccgtgggctatcacggccgggcctcttcagtcgtagtctccggtaccccaatcagaaggccgatgggccaaatgaagccagacgacagtaagccgccggtgtacggggcttgtaagctcttagatatggagctggaaatggccttttttgtcggacccggaaatcgactgggggaacccattcccattagcaaggcccacgaacacattttcgggatggttctgatgaatgattggtccgctcgagacattcagaagtgggagtacgtgccactcggacctttcttgggtaaatcgttcggcactacagtgtccccttgggtggtccctatggatgccctcatgccattcgcggtgcccaaccccaaacaggatcccagacctctgccctatctctgccacgacgagccttacactttcgacattaatctctctgtgaacttaaaaggagaaggaatgagccaggctgccactatttgcaaatcaaactttaagtacatgtattggaccatgctgcagcagctgactcatcatagtgtgaacgggtgcaatctgcgaccaggggacctcctggcgtccggcaccatctccgggcccgaacccgaaaatttcggttcaatgctggaactctcgtggaagggtacaaagcctattgacttgggaaatggacagactcgcaagttcctgctggacggagacgaagttataataacagggtattgccagggtgatggctaccggatcgggttcggacaatgtgcgggcaaggtgctgcctgctctgctgccttcc

SEQ ID NO: 11854 - DNA, 1257 bp, Artificial Sequence
  Description of Artificial Sequence: Synthetic coding sequence
atgtctttcattcccgtggccgaagactctgattttccaatccacaatctgccttatggcgtattcagtacaaggggtgatcccagaccacggattggggtcgctatcggggaccagattttggacctttcaattattaagcacctcttcacgggccctgtcctgtctaagcatcaggatgtcttcaaccagcctactttgaattcctttatgggactggggcaggcagcatggaaggaagctcgcgtctttctgcaaaacctcctgtctgtgtcccaggcgaggctgagagacgataccgaactgaggaaatgtgctttcataagtcaggcctccgcaacgatgcatcttcctgccaccattggagactataccgatttttactctagtcgacaacacgctaccaatgtgggcataatgttccgagacaaagaaaatgcccttatgccaaattggctgcacctccccgtggggtaccacggccgagcctcttctgtcgtggtttcaggcactccgattcgccgcccaatggggcagatgaagcccgacgattccaaaccccctgtgtatggtgcctgtaagctgttggacatggagctggagatggcctttttcgtgggccctggcaatcggctcggggagcctatccccatctcaaaagcccacgaacatatttttggaatggtgctgatgaacgactggtccgctagagacattcagaaatgggagtatgttccacttgggccctttttggggaagtccttcggaaccacggtcagtccctgggtggtccccatggatgcgctgatgccctttgccgtgcccaaccccaagcaggacccaagaccgctcccctacctgtgccacgacgaaccctacacatttgacattaatctgagcgtgaacttgaaaggggaaggcatgagtcaggctgctacgatttgcaagtccaattttaagtacatgtactggacaatgctgcagcagctgacccaccatagtgtgaacggatgcaatttgcggccaggcgacttgttggcgagcgggacaatttctggcccagagccagagaatttcggctctatgctggagctgtcttggaaaggaacaaaacctatcgatctggggaacggccagactcgaaagttcctgttggacggggatgaggtgattatcacgggctattgccagggcgacggctatagaatcggcttcggccagtgtgccggaaaagtacttcccgcactcctcccatct

SEQ ID NO: 11855 - DNA, 1257 bp, Artificial Sequence
  Description of Artificial Sequence: Synthetic coding sequence
atgtctttcatccccgtagctgaggacagcgacttccccatacacaatctgccgtatggggtgttctccactcgtggcgacccccggccgagaattggcgttgccattggcgaccagatcctggacctcagcatcattaagcacctgttcacagggccagtgttgagtaaacaccaagatgtgttcaatcagcctacgctcaactctttcatggggctcggccaggccgcctggaaggaagcccgtgtgttcctccaaaaccttctcagtgttagccaggcccgtcttcgagacgatactgagttgcggaagtgcgcttttatttctcaggcctctgcgacgatgcacttgcccgctaccatcggggactatactgacttttatagctctagacagcacgcgactaacgtcggaattatgttccgcgacaaggagaacgccctcatgccaaactggctacacttacccgttgggtatcacggaagggcatcgtctgttgtggtaagcgggactccaatcaggcgccctatgggacaaatgaagcctgacgactctaagcctcctgtatatggtgcttgtaaattgctcgatatggaacttgagatggccttctttgtcggccctggcaataggctgggtgagccgataccgatcagtaaagcccatgaacatatattcgggatggtgctaatgaacgactggtccgcacgcgatatccagaagtgggagtatgtccccctcgggcccttcttgggaaaatcctttggtactaccgtctcaccatgggttgtgcctatggatgccctcatgccattcgcagtgcccaatcccaagcaagatccgcgcccattgccatacctttgccacgatgagccgtacacatttgatattaacctatcagtcaatctgaagggcgaaggcatgagccaggcggctacaatctgcaaatctaattttaaatatatgtactggactatgctgcagcagctcactcaccattccgtgaatgggtgcaatttacgacctggagacctccttgcatccggcactattagcggacccgaaccagaaaactttggaagtatgttggagttgtcatggaagggtacaaagccgatcgacctgggtaacggacagactcgcaaattcctgctcgacggggacgaggtgataataacgggttactgccagggcgatgggtacaggattggattcggacaatgtgcaggaaaagttttacctgccctgttgccgtct

SEQ ID NO: 11856 - DNA, 1257 bp, Artificial Sequence
  Description of Artificial Sequence: Synthetic coding sequence
atgtcctttatacctgttgccgaagattctgacttcccaatccataacctcccatatggggtgttctctacaagaggtgatccaaggccaaggatcggtgtagcaattggggaccagatactggatctctcaattattaagcacttgttcaccggaccagtcctgtctaagcaccaggatgtattcaaccagccaaccttgaactctttcatggggctgggacaggccgcttggaaagaggccagagtcttccttcagaacctgctgagtgtgtcacaagctcggctccgagatgatacagagcttaggaagtgtgcctttattagccaggcatccgcaaccatgcacctgccagcaactattggcgattatacggatttctactcatctcgccaacatgcaacaaacgttggcattatgttcagggataaagagaatgcattaatgcccaattggttgcacttacccgtgggctatcacggccgcgcctccagcgtggttgtgagcggtacaccaattcgccggcccatgggccaaatgaaaccagacgactcaaagccgccggtgtacggcgcctgtaaactgctggatatggaactggagatggctttttttgtgggccccggcaatcgcttaggcgagccaatacccattagcaaggcccacgagcacatcttcggaatggtcctgatgaatgactggagtgcaagggacatccagaagtgggaatatgtgcccttagggcctttcttagggaagtccttcggcacaaccgtgtccccttgggtggttcctatggatgccctcatgccattcgccgtgcccaaccccaaacaggatccacggcccttgccctacctctgccatgacgaaccctatacgtttgatatcaacctgtcggttaacctgaaaggcgaaggcatgagtcaggctgccaccatctgtaaaagtaattttaagtacatgtactggaccatgctgcagcagctgacccaccactccgttaatggttgcaatctccgccccggggatcttcttgccagcggcaccatcagcggaccggagcccgaaaactttggttctatgttagagctcagctggaagggcacaaaacctattgatctcggaaacggccaaacacggaagtttttgctggacggtgatgaagtgataataacagggtactgccagggggacggctataggatcgggttcgggcagtgtgccggaaaagtgttaccggcccttctgccgtcc

SEQ ID NO: 11857 - DNA, 1257 bp, Artificial Sequence
  Description of Artificial Sequence: Synthetic coding sequence
atgagcttcatcccggttgcggaggattctgacttcccaatccataatctgccttatggcgttttcagcacgaggggcgatccaaggcccaggattggtgttgctatcggagaccagatcctggatctcagtataattaaacacctgttcacgggtccggtcctcagcaaacaccaagatgtgtttaaccagccgacactcaactcgttcatgggactgggtcaagcggcatggaaggaggcgcgcgttttcttgcagaatctccttagcgtatcacaggcccgcttgcgggatgacactgaactccgcaaatgtgctttcataagccaggcatccgcaacaatgcatcttccggcgacaattggagactatacagatttttatagctcacgtcaacacgcaacgaatgtgggcatcatgtttcgagacaaggaaaatgccctgatgcctaattggcttcacctgcccgtgggctaccacggcagagcgagcagtgtggtggtctccgggacccccattcgaaggcctatggggcagatgaagcctgatgattcaaagccccccgtctatggagcatgcaaactcctggatatggagttagaaatggccttcttcgtcggtcccggaaatcgcctcggcgaacccatacctatttcgaaggcccacgaacacatattcggcatggtattgatgaatgactggtcggcccgcgacatccagaagtgggagtatgtcccactggggccttttctaggaaaatccttcggaaccacggtttcaccctgggtggtccctatggacgctctcatgccattcgccgtaccaaatcccaagcaggatccccgacctctcccatacctttgtcatgacgaaccctataccttcgatattaacctttctgtaaatctaaagggtgagggcatgtcgcaagccgccacaatttgcaagtccaattttaagtatatgtactggaccatgttacagcaactcactcatcattccgtgaatggatgcaatttacggccaggggacctcctggcatccggaacaattagtggacctgagcctgagaactttggtagtatgctcgagctgtcatggaaaggcactaagcctatcgatcttggtaacggtcagacccggaaatttctgctcgacggggacgaagtcattatcactggatactgccagggcgacggatatcgcattgggttcggtcagtgcgcaggaaaggtattgccagctcttttaccaagc

SEQ ID NO: 11858 - DNA, 1257 bp, Artificial Sequence
  Description of Artificial Sequence: Synthetic coding sequence
atgagcttcatccctgtggccgaggactctgactttccgatccataacctgccctacggggtgttctctacacgcggggatccgcgccctcggattggggtggcaattggtgatcagatcctggatcttagcatcatcaagcacttgttcactggccccgtgctatctaagcaccaggatgtcttcaatcagccaacactcaattccttcatgggattaggacaggccgcgtggaaagaggccagagtttttctgcagaatctcctgagtgtctcgcaggctagattaagagacgacacagagctgagaaagtgtgctttcatctctcaggcctctgcaaccatgcatcttccagcaacaatcggagactacacggacttttactcaagtagacaacatgccacaaatgttggaattatgttccgggacaaggagaacgctcttatgcctaactggctgcacctgccagttggttatcacgggagagcctctagtgttgtcgtctccggcacaccaatcagacgtcctatgggccagatgaaacccgacgactctaagcctccggtgtacggggcctgcaaactcctggacatggagctggagatggccttctttgtcggccccggcaaccggctcggtgaacctatccccatcagtaaagctcacgagcacatcttcggtatggtcctcatgaatgactggtcagcccgcgacattcagaaatgggagtatgttccgctgggacctttcctaggtaagtcttttggtactaccgttagtccgtgggtcgtgccgatggatgccctaatgccattcgctgtgcccaacccaaagcaggacccacgcccgctcccgtatctgtgccatgacgaaccatacacattcgacattaatttatccgttaatctcaagggtgaggggatgtcacaggcggcaacaatctgcaaaagcaattttaaatatatgtattggaccatgctccagcagctgacacaccattctgttaatggttgcaatctaaggcctggtgacctgctcgcgtctggcacaattagcggacctgagcccgagaatttcgggtctatgctagaactgtcctggaagggcacaaagccaatcgacttggggaatgggcagacacggaagtttctgctggacggagatgaagtgatcattaccggctactgtcaaggagacggctaccggatcggatttgggcagtgcgcagggaaggtcctgccagcactgttgccctca

SEQ ID NO: 11859 - DNA, 1257 bp, Artificial Sequence
  Description of Artificial Sequence: Synthetic coding sequence
atgtcatttatacccgtggctgaagactccgactttcctatccataatctgccgtacggggtcttctctactcgtggagatcctcgcccccgcattggggtggcaatcggcgaccagatacttgatctgagtattattaaacatctcttcacaggccctgtcctttctaaacaccaggacgttttcaaccagccaacactcaacagcttcatgggtttagggcaggctgcttggaaagaagcccgtgtgttcttgcaaaacctcctgagtgtatcccaggcgagactgagggatgatactgaacttagaaaatgtgcattcatcagccaggcctctgccaccatgcacctgccggcgacaattggcgattataccgatttttactcatctagacaacacgccacgaatgtggggatcatgttccgggacaaggaaaatgccctgatgcccaattggctgcatctgccggttgggtaccatggtcgggcttcgagcgtggtagtgtcaggcacgccgatccgacggcctatggggcaaatgaaaccagatgattctaaaccgccggtctatggggcttgcaaactgctggacatggaactagagatggccttcttcgtaggcccagggaatagattaggagagcctatcccaataagcaaggcacacgagcacatttttggcatggtactgatgaacgactggtccgccagagacatacagaagtgggaatatgtacccttagggccctttctcggaaaatcctttgggactacggtgtctccttgggtggtacctatggacgccctcatgccgtttgcagtgccaaaccctaagcaggatcccagacccctcccatacttatgccatgatgaaccctacaccttcgacatcaacctgtccgtaaacttgaaaggagaaggcatgtctcaggcagctacaatttgcaaaagtaacttcaagtatatgtattggacaatgcttcagcagttgacacatcactcagtcaatgggtgtaatctccgccctggagacctacttgcgtcaggcacaatttcagggcctgagcccgagaatttcggctctatgctggaactgtcttggaagggcacaaaaccgatagacctggggaatggccaaacaagaaagttccttctggacggggatgaagttattattaccggctattgtcaaggagatggctaccgtattggatttggccaatgcgccggcaaggtgctgcctgcactactgccctca

SEQ ID NO: 11860 - DNA, 1257 bp, Artificial Sequence; identical to SEQ ID NO: 11858
  Description of Artificial Sequence: Synthetic coding sequence

SEQ ID NO: 11861 - DNA, 1257 bp, Artificial Sequence
  Description of Artificial Sequence: Synthetic coding sequence
atgtcttttatcccggtcgctgaggatagcgacttcccaatccataatttgccatatggcgtattttctacacgtggcgacccgcgcccaaggatcggcgtcgccataggggaccagattttggatctttcaattattaagcacctctttacgggcccggttctgtcgaagcatcaagatgtattcaatcagcctacactgaatagtttcatgggactcggtcaggctgcatggaaagaagcccgcgtttttttacagaatctgctgagcgtttctcaggcgaggttacgtgatgacacggagctgcggaaatgcgcattcattagtcaggcgtcagcgactatgcacctcccggcaactatcggagattacacagacttttattcttcacgtcagcatgctacgaatgttggtatcatgtttagagataaggaaaatgcgttaatgccgaactggcttcatctaccggttgggtatcatgggagggcatctagcgtcgtagttagcggtactcctatacgccggcctatggggcaaatgaagcccgatgattctaaaccgccggtctatggcgcttgcaaattacttgatatggaactggagatggcattttttgttggtccaggcaaccgcctgggcgaaccgatccctatatccaaagcgcacgagcatatttttggcatggttctaatgaatgactggtctgctcgggacattcaaaaatgggaatacgtgccgctcggcccttttttaggaaagagctttggcacaaccgtctcgccatgggttgtgcccatggatgctcttatgccgttcgccgtgccgaatccgaaacaagaccctaggccgttaccgtatttatgccatgacgaaccttatacgtttgacatcaatcttagcgttaatctaaaaggagaagggatgtcacaggcagcgacaatctgcaaaagcaattttaagtatatgtattggacaatgcttcagcagttgacacatcactcggtgaatggatgcaatcttcgtcctggggatctcctagcatcaggtacaatttcaggcccggagcctgaaaacttcgggagcatgctggaactttcttggaaaggcaccaaaccaattgacttaggcaacggtcaaacacgtaaatttctgttagatggcgatgaagttattattactggttattgccagggtgatggatataggattggctttgggcaatgtgcaggaaaagttctgccggcgctgttaccgtca

SEQ ID NO: 11862 - DNA, 1257 bp, Artificial Sequence
  Description of Artificial Sequence: Synthetic coding sequence
atgtctttcatccctgtagccgaagattccgatttcccaatccataatctgccttatggggttttcagtacacgcggggatccccggcctcgcattggggtggctataggggaccagattctcgatttgtcaattataaaacatctctttactggaccagtcctaagtaaacaccaggatgtatttaaccagcccactctcaactctttcatggggctaggacaggccgcctggaaagaggcaagggtgttcctccagaatctccttagtgtgtcccaggcaaggctccgagatgatacagaactgcgaaaatgtgcattcatatcccaggcctctgcgactatgcaccttccagccactatcggagattatacagatttctatagttcacgacagcacgctactaatgtgggaatcatgttcagggacaaagaaaatgctctcatgccaaactggttacacctacccgtcgggtatcatgggcgggccagttctgtggtggtttctgggactcctataaggaggccaatggggcagatgaaacctgatgattctaaacctcccgtttatggagcctgcaagctgctggatatggaacttgaaatggcttttttcgtcggacccgggaacagacttggagaacctattccaatctctaaagctcacgaacacattttcggaatggtacttatgaacgactggtcagctcgggatattcagaagtgggaatacgtcccacttggaccttttctaggaaagtctttcgggacaacagtgtctccttgggtagtgcccatggatgcattaatgcctttcgcggtacctaaccctaaacaggatccccgccccttgccatacctttgccacgatgaaccttatactttcgatatcaatctctctgttaacctcaaaggagaagggatgagtcaagctgctacaatctgtaaatcaaatttcaaatatatgtattggactatgctccagcagttaactcaccactctgtgaatgggtgtaatttgcggcctggggatctgcttgcatctggaactatctcaggacccgaacctgaaaattttggatctatgctggaactttcctggaaagggacaaaacctatcgatcttgggaacgggcagactagaaaattccttctagacggagatgaagtcataatcacaggatattgccagggggatgggtatagaattggattcggacagtgcgccggaaaggtgctccccgcccttctgccatcc

SEQ ID NO: 11863 - DNA, 1257 bp, Artificial Sequence
  Description of Artificial Sequence: Synthetic coding sequence
atgtcttttattccagttgctgaagattccgacttcccaatccataatcttccgtacggggtgttttccacccggggcgatccccgcccccggatcggcgtggctatcggagaccagatcctggacctctccattatcaaacatctgttcacaggacccgtcttaagcaagcatcaagatgtgttcaatcagccgacattgaacagtttcatggggctcggtcaggcagcttggaaggaggcaagagtatttctgcagaaccttctgtccgtgtcacaagctagactgcgggatgatacagagctcagaaaatgtgcattcatcagtcaagccagtgccacgatgcacctcccagccacaatcggagattataccgatttctacagttcacgacaacacgcgactaacgtcggcatcatgttcagggataaggagaatgccctaatgcccaactggctgcacttgcccgttgggtatcacggtagggcgtcgtcagtggtcgtatctgggactcctattagacggcccatgggtcagatgaaacctgacgactctaagccacccgtgtacggagcgtgcaaactgctggacatggagctcgaaatggcatttttcgttggacctggaaatcgactgggtgaacctatcccaatctccaaagctcatgaacatattttcggaatggtcttaatgaatgattggtccgcgcgtgatattcaaaagtgggaatatgttccactcggaccctttcttggcaaaagcttcgggacaaccgtgagtccgtgggtagtgcctatggacgccctgatgccgtttgcggtaccaaacccaaaacaggaccccaggcctctcccctatctctgtcacgacgagccatacacctttgacattaacctgtctgtgaacctgaaaggagagggaatgtcgcaggccgccactatttgcaaaagcaactttaaatacatgtattggacaatgcttcagcagctcacgcaccattcggttaatggatgtaatcttcggccaggcgacctccttgccagcggcaccatatcaggacctgagccagaaaatttcgggtcaatgctggagctgtcctggaaaggtaccaagccaattgatttggggaacgggcagacacgaaagttcctgcttgatggcgacgaagtaatcatcacagggtactgtcaaggggacgggtacagaatcggctttggacagtgcgcgggaaaagtcctgccagccctcctccctagt

SEQ ID NO: 11864 - DNA, 1257 bp, Artificial Sequence
  Description of Artificial Sequence: Synthetic coding sequence
atgagttttataccggtggccgaggactccgactttcctatccataaccttccatatggcgtgttctcaaccagaggggatccacgacctcgaatcggcgtggccatcggtgaccagatcctggacctgtccatcattaagcatctgttcacaggccctgtgctcagtaagcaccaggacgtttttaatcagccaacactcaactcgtttatgggtctaggccaggcagcctggaaggaggcccgagtctttctccagaacctgttgagcgtgtcccaagccagactcagagatgacaccgagctgaggaagtgtgcctttatatcccaggcatcagctaccatgcacctccctgcaacaattggggactacaccgacttttactcttctcgccagcatgccactaatgtgggcatcatgtttagagataaggagaatgctctgatgcctaattggctccacctccctgtgggatatcatgggcgggcctcttccgtcgtcgtcagcggcacccctatcagaagacctatgggacagatgaagccagacgattcgaaaccccccgtgtacggcgcctgtaagctacttgacatggagttagagatggccttcttcgtcggacccgggaacagactgggagaacccattccgatttccaaggcccatgagcatatttttggaatggtgctgatgaacgactggagtgccagggatatccagaagtgggagtatgtccccctgggaccctttctgggcaaaagtttcgggacaacggtgagcccctgggtggttcccatggacgctctcatgcctttcgccgtgcctaaccccaaacaggacccgcgcccactcccgtatttgtgccatgacgagccttacaccttcgacatcaatctgtcagtgaatttgaagggcgaaggaatgtcccaggccgctaccatttgcaaatctaactttaagtacatgtattggactatgctccaacagctgacacaccacagtgtgaacgggtgcaacctgcgccctggtgacctgctcgcgagcggtaccataagcggccctgagcctgagaatttcgggtcgatgctggagctttcgtggaaaggcaccaaaccaatcgatcttggcaacgggcagacgcgcaagtttctgctcgacggcgacgaagtgatcattaccgggtattgtcagggcgacggatatcgcatcgggttcggacagtgcgcaggaaaagtgttgccagctctgcttccgtca

SEQ ID NO: 11865 - DNA, 1257 bp, Artificial Sequence
  Description of Artificial Sequence: Synthetic coding sequence
atgtcctttattccagtggccgaggatagtgatttccctattcacaacctgccctacggggtcttttctacaagaggtgatcctcggccacgaataggcgtcgcaatcggtgaccagattctggacctgagcatcatcaaacacctatttacaggtcctgtgctttccaagcaccaggatgtatttaaccaacctaccctgaactcttttatgggtctggggcaagcagcgtggaaggaggctcgggtgtttctgcagaacctcctttcagtttcacaggctcggctgcgcgacgatacagagctccgaaaatgcgccttcatctcacaggcatccgcaaccatgcacctcccagcaaccattggcgactacacagacttttattcatccagacagcatgctaccaatgtgggaatcatgttcagagacaaagagaatgctctcatgccgaactggctgcaccttcctgtgggttaccacggacgcgcttccagcgtagtggtgtcaggaactccaattcgacggcccatgggccagatgaaacctgatgactctaaaccgccagtgtacggagcctgcaaactgctggatatggagctcgagatggcctttttcgtggggccggggaataggttgggcgagccgatccccatatctaaggcccacgaacatattttcggcatggtgttaatgaacgattggtccgcccgggatatacaaaaatgggagtatgtacccctcgggcctttccttgggaaatcgtttggcacgaccgtatctccctgggtggtgccaatggatgccctgatgccgttcgctgtccctaaccctaagcaggacccccggcccctaccatatctttgtcatgacgaaccttacaccttcgacattaaccttagtgtcaatctgaagggggaggggatgagccaggctgccactatttgcaagtccaattttaaatacatgtattggaccatgttgcagcaactgacacaccattccgtcaacgggtgcaacctgcgccctggagaccttttggcatctggaaccatctctggccctgaacctgaaaatttcggctcaatgctcgaactctcatggaaagggactaagcctatcgacctgggcaacggacagacaagaaaattcctgttggatggagatgaggtcattataacgggctactgccagggggatggctatcgaatcggcttcggccagtgtgctggtaaagtactgccagctttactgccctct

SEQ ID NO: 11866 - DNA, 1257 bp, Artificial Sequence
  Description of Artificial Sequence: Synthetic coding sequence
atgtcattcatacctgtcgcagaggattcggattttcccatccataacctgccttacggggttttttcaacaagaggcgatcccagaccaaggattggagtcgccattggagatcagatccttgacctgtctatcatcaagcatctgttcactggcccggtcctgagcaagcatcaggacgtgtttaaccaaccaacactgaattctttcatgggactgggccaagcagcgtggaaggaggcccgggttttcttgcagaatctactgagcgtgtcccaggccagactcagagatgacacggaactacgaaagtgtgccttcatatcacaggcttccgcaaccatgcacttgccagctacaatcggggactatacggacttttactcttcccgccagcacgctacaaacgttgggattatgttccgtgataaagagaatgcactgatgcctaactggctgcatctaccagtcggctaccatggccgggcatcgtctgtcgtagtgagtggcaccccaatccgacgcccaatgggccaaatgaagcccgacgactcaaaacccccagtatatggggcttgcaaactgctggacatggaacttgaaatggcgtttttcgtcggcccaggtaaccggctcggggagccgatcccaatctctaaagctcatgagcacatttttggcatggttctcatgaatgattggtcggctagagatatccagaaatgggaatatgtgcccttaggacccttcctaggcaaatctttcgggaccaccgtgagcccatgggtagtgccaatggacgcactcatgccattcgctgtgcctaacccaaaacaggacccgcggccgttgccctatctgtgccacgacgagccatacacattcgacattaacctctccgttaatctcaagggagaagggatgtctcaggcagccacaatttgcaaatcgaacttcaaatatatgtactggaccatgctgcagcagctaacccaccattccgtgaacggctgtaacctgcgccccggagacctgctcgcttctggtacgattagcgggcccgaacccgagaactttggttcaatgcttgagctgtcctggaagggtaccaagcctattgaccttggaaacggccaaactcgcaagtttcttctcgacggagatgaggttattatcacaggttactgtcagggagatgggtaccgcataggctttgggcagtgcgccggcaaggtcctgcccgcacttcttcccagc

SEQ ID NO: 11867 - DNA, 1257 bp, Artificial Sequence
  Description of Artificial Sequence: Synthetic coding sequence
atgtcctttatccctgtcgctgaggactctgattttccaatccataacctgccatacggggtcttctcaacccgcggtgaccctcgtcctagaataggcgtggcaatcggcgaccaaatcttggacctgagcattatcaaacatttgttcactggccccgttctgtccaaacatcaagacgtgttcaatcaacccacgctgaattcgtttatgggattaggccaggctgcgtggaaagaagcgcgcgtttttctgcaaaacctgctgtcagtttcacaagcgcgccttcgcgacgataccgaattgcggaagtgcgcgtttatcagccaggcatccgccacgatgcacctgccagcaaccattggggattacaccgacttctattctagccgccaacacgcaacgaatgtcggtattatgtttcgcgataaggaaaatgcacttatgccaaattggctgcacctgccggtgggttatcatgggcgggcgtcgagcgtggtggttagtggtaccccaatccgccgcccaatgggtcaaatgaagccggatgattcgaagccaccagtgtatggcgcatgtaagcttttggacatggaattggagatggcttttttcgtgggtcctggtaatcgtctgggtgagccgatccctattagcaaggcacacgagcatatctttggtatggtcctgatgaacgattggagcgcccgcgacattcaaaaatgggaatatgtgcctttgggaccttttttgggcaagagcttcgggactaccgtgtcaccgtgggttgttccgatggacgctctgatgcctttcgcagtgccgaacccaaaacaggatccgagaccactgccttatctgtgtcacgacgaaccctatactttcgatatcaatctgtcagtcaacctgaagggagaaggcatgagccaagctgcaacgatctgtaagagcaactttaagtacatgtattggactatgctccagcaactgacccaccatagcgtcaatgggtgcaaccttagaccgggtgacctgctggctagcgggactatctccgggccagagccagagaatttcggcagcatgctagaactgagttggaagggcaccaaaccgatcgatctgggcaacggtcagacgagaaaattcctgttagacggtgacgaggttatcattactggctattgtcaaggtgacggttatagaatcgggtttgggcagtgtgccggcaaggttctcccagctcttctcccgtca

SEQ ID NO: 11868 - DNA, 1257 bp, Artificial Sequence
  Description of Artificial Sequence: Synthetic coding sequence
atgtcatttattcccgtagccgaagattcagattttcctatccataatcttccttatggcgtgttcagcaccagaggagatccaagacctcggataggggttgcaattggggatcaaatccttgacctctctattatcaagcacctgtttacgggccccgtgctaagtaaacatcaggacgtgttcaatcagccaaccctaaattcgtttatgggcctgggccaagccgcgtggaaggaggcacgggtatttctacagaatctgctgtcagtgtctcaggctcggttgcgagacgacacagagctccgcaagtgcgcctttatcagtcaggcgtccgccacgatgcatttaccggctaccattggcgactataccgacttctatagttcgcggcagcacgctacaaatgttggcatcatgtttcgcgataaggagaatgcgctcatgcccaattggctccatcttccagtcggctaccatggccgcgctagcagtgttgtggtgtctggcacacccatccgacgccccatgggacagatgaagccagatgatagcaaaccaccggtttacggcgcttgcaaactgctagacatggagttagagatggcattcttcgtgggcccaggaaaccgcttgggtgagccaattccgatcagcaaggcacacgagcatatatttggcatggtactgatgaacgattggtctgctcgggacatccagaagtgggagtatgtcccattgggcccctttcttggcaaatccttcggaacaaccgtctcgccttgggtcgtccccatggatgccctcatgcccttcgccgtgccaaacccaaagcaggacccccggcctttaccttacctttgtcatgatgaaccctatacctttgatataaacttgagtgtgaacctcaagggggaaggtatgtcacaggccgccaccatctgcaaatctaactttaagtatatgtactggaccatgcttcagcagctgacacatcattcagtcaatggatgcaacctgcgtcctggcgacctgcttgcatcgggtaccatttcaggccccgagccggagaattttggaagcatgctggaattgagctggaagggtaccaagccaatagacctcggcaacggccaaacaaggaaattcctactggatggggacgaggtcattataacaggctattgtcagggggatggctatagaatcggttttggccagtgcgctgggaaagtgctccctgctttgctcccttca

SEQ ID NO: 11869 - DNA, 1176 bp, Artificial Sequence
  Description of Artificial Sequence: Synthetic coding sequence
atggcagccctccggcaacctcaagtagccgagcttctggcagaagcacgcagggcatttagagaagaattcggggcagaacctgagcttgccgtgtcagcaccaggaagagtgaacctgatcggcgaacataccgactacaaccaggggcttgtccttcccatggctcttgaattgatgactgtgcttgtcggctcgccaaggaaagatggactcgtttctcttctgactacctccgagggggctgacgagccacaacgtctgcagtttcctcttcctactgcccaaaggtcgctggaaccaggaacgcccagatgggctaattacgtgaagggagtgatccaatactaccctgcagctcctcttccaggattttccgcagtcgtggtttcttccgtgccgctgggcggaggactctccagctccgcaagcctcgaagtcgcaacttacactttccttcaacaattgtgccctgattccggaaccattgcagctcgggcacaggtctgccaacaagcagaacactccttcgcaggcatgccgtgtggtattatggaccagtttatctcccttatggggcagaagggtcatgcgcttctcattgactgccgctcgcttgagacttcgctggttccactgagcgatcccaaactcgccgtgttgattactaatagtaacgtgagacattcacttgcatcctcggagtaccctgtcaggcgcaggcagtgtgaagaggtggcacgtgccctcggaaaggagtcactcagggaagtgcagctcgaagaacttgaggcggcgcgtgacctggtgtccaaggagggatttcgccgggctaggcacgtcgtcggggaaataagaaggactgcacaagcagcggctgcgcttcgcaggggtgattaccgggcctttggaagattgatggtggagtcacatcgaagcctccgagatgattacgaagtgtcgtgtcctgaactggaccagttggtggaggcggctctcgccgtgcccggagtgtacggatcgaggatgactggtggaggatttggcgggtgtacggtgactctcctggaggccagcgcagcaccacatgcaatgcgccacatacaagaacattacggagggacggctactttctacctgagccaggccgcggatggtgccaaagttctctgcctg

SEQ ID NO: 11870 - DNA, 1176 bp, Artificial Sequence
  Description of Artificial Sequence: Synthetic coding sequence
atggccgcgctgcggcagccacaggtagcagagctcctggccgaggcacggcgggcgtttcgggaagagttcggtgccgaacctgagttagctgtctctgccccaggaagagtgaacctgatcggagagcacacagactataatcagggacttgtgcttccgatggcactggaactgatgactgtgttagttggctccccccggaaagacggcctggtcagtctgctcacgacctccgagggcgcagatgagcctcagcgactgcagtttcccctgccaacagcacaacgctcattggagccaggcactcctcgctgggcgaattacgtcaaaggcgtgatacagtactatcccgcagcaccgttgccaggcttttcggccgttgtcgtgtcttctgttccactcggtggtggactgtcctcctcagcctcgctggaggtggctacatatacctttcttcagcaactgtgcccagacagcggtacgatcgccgcaagggcacaagtctgtcagcaagctgaacacagtttcgccggaatgccttgtggaataatggaccaatttatcagtttgatgggtcagaagggacatgcactgctgattgattgtcgctccctagaaacttctctggtgcccctgagcgatcccaagctcgccgtcctgatcaccaatagtaacgttaggcatagtttagcgtcttctgaatatccggttaggaggcgtcagtgtgaagaagtggcgcgggctctgggcaaagagtccctcagagaagtgcagctcgaagaactagaagcagcaagggatctagtttcaaaggaggggtttcgtagagcacggcacgttgtgggcgagattcggaggaccgcgcaggccgctgccgctctccgcaggggggattatcgggccttcggaagactgatggtagagagtcatcggtcgttgcgcgacgactatgaggtgagttgccccgagctcgaccagctcgtagaggcggcattggctgtacctggcgtgtacggttcgcgtatgacaggtggtgggttcggaggctgtaccgtgacactactggaagcctcagctgctcctcatgcaatgaggcacattcaagaacattatggaggcaccgccactttttatttgagtcaggccgctgacggcgccaaggtactgtgcctc

SEQ ID NO: 11871 - DNA, 1176 bp, Artificial Sequence
  Description of Artificial Sequence: Synthetic coding sequence
atggccgcccttcgtcaaccacaagtagctgagttattggctgaagctcgtagggcttttcgtgaagagtttggtgctgaacctgaattggccgtctcagcaccagggcgtgtgaacttaattggagagcacactgattataatcagggtcttgtcttgcctatggcactggaattgatgactgtacttgtggggagtccacgtaaggacggacttgtgtcgttgttgacaacctctgaaggtgctgatgagccacaacgccttcagtttccattgccaaccgcgcaacgtagtctagagcctggaacacctcggtgggccaattatgttaagggggtgatccagtactatccggctgctcctttgccagggttttccgctgtcgtcgtgtcctctgtgcccctcggaggaggactttcttcatcggcatccttggaggttgccacttacactttcctccaacagctgtgcccggattctggaactattgcagctagggctcaagtgtgtcagcaggctgagcacagtttcgcgggaatgccctgtgggataatggatcagtttatctccctcatgggtcagaagggccacgcccttctgattgattgtagaagcctggagacctcccttgtaccgcttagtgatccgaaactggctgttttaattactaacagcaacgtgagacactctctggctagttcagagtacccagtgagaagacgccaatgcgaagaagtcgcgagggcgctcgggaaggaatctttacgtgaggtacagctagaagaactagaagcagcaagagatctagtgagtaaggaaggtttccggcgtgcacgtcacgttgtaggtgagatcagaagaactgctcaggctgctgcggcactgaggaggggtgattatagggctttcggaaggctcatggtcgaatcgcataggagcttgagggacgactatgaggtttcttgcccggagctggatcagctcgtcgaggccgccttggccgtccctggggtttacggatcacgcatgaccggggggggcttcggtggctgcactgtgaccttacttgaggctagcgcagctccacatgctatgagacacattcaggagcattatgggggtaccgctacattctacctctcccaggccgctgacggagccaaagttctctgcctt

SEQ ID NO: 11872 - DNA, 1176 bp, Artificial Sequence
  Description of Artificial Sequence: Synthetic coding sequence
atggctgcccttcgccagcctcaagtggccgaactactggccgaggcccgacgggcgtttcgagaagagttcggagccgaacccgaactcgctgtgtctgcccctggaagagttaatcttatcggggaacatactgattacaaccaggggttagtgctccctatggcactagaattaatgactgtactggtggggtctcccaggaaggacgggttagttagtctcctaacaacttcagagggagcagatgaaccccagcggctccagtttcctcttccaacagcccagaggtcactggaaccagggactcctaggtgggcaaactatgtcaaaggagttatacagtattatcctgctgctcccctcccagggttctccgcagtggtggttagttctgtgcccctaggaggaggattgagttcttctgcaagtctcgaagtcgccacttatacattcctgcagcagctatgtcctgatagtggaactatagccgccagagctcaggtgtgccaacaggccgaacattcgttcgctggaatgccttgtggaataatggaccagtttataagtcttatgggacagaaagggcacgctctactcatagactgtaggtctctagaaacatcactagtgcctctgtctgatcctaaattagcagtgcttataactaattctaatgtccgccactctctcgcctcctctgaatatcctgtcaggcggagacagtgtgaagaggtggctcgagcactcggaaaagaatccctgcgagaagtgcagctagaagaactagaagctgccagagacctggtgtctaaagaagggttcagacgggctaggcatgtggtgggggaaattaggcgaacagctcaggctgcagcagcgttacggcggggggattatcgagcatttggacggctgatggtggaaagtcacaggtctctgcgggatgactatgaagtgtcctgccccgaacttgatcaacttgtagaagccgcactcgctgtgcccggagtgtatgggagtcggatgacaggaggaggatttggaggatgtacagtgacactcttagaagcttccgccgccccacacgccatgcggcacatccaggaacactatggaggaactgccacgttctatctatctcaggccgctgatggggcaaaagtcctgtgtctt

SEQ ID NO: 11873 - DNA, 1176 bp, Artificial Sequence
  Description of Artificial Sequence: Synthetic coding sequence
atggcggcactgcgtcaaccccaggtggcggaactgttggcggaagcgcgcagggcctttcgggaagaattcggcgcggaacccgaactcgccgtgagcgctcctgggcgcgtcaacttgatcggtgagcataccgactacaaccagggactggtgttgccgatggctctggaattgatgaccgtgcttgttggcagcccgagaaaggatggactggtgtccctgttgaccacttcggaaggggcagacgagcctcaaagattgcaatttccactgccgaccgcgcaacgctctttggaaccaggcactccacgctgggcgaactacgtgaagggagtcatccagtactaccctgccgccccgcttccaggattctcggctgtggttgtctcatccgtgccgctcggtggcggactgtcgtcgagcgcctccctcgaagtcgccacttatacttttctgcaacagctgtgccccgactcaggaactatcgcagcacgggcacaggtgtgccaacaagccgagcactcgttcgcaggaatgccgtgtggaatcatggaccaattcatctccctcatgggacagaaaggtcacgcgttgctcattgattgtaggagcctggaaacctcactggtgcccctctccgacccgaaactcgccgtgctcatcacgaactcaaacgtccggcacagcctggctagctcggagtacccggtgcggcgccggcagtgcgaggaggtggcccgcgccctgggaaaggagtcccttcgggaagtacaactcgaggagttggaagctgccagggacctcgtcagcaaggaagggttcaggagagcgcggcacgtggtgggagaaataaggcggaccgcacaagcggcggctgctctccgcagaggagactaccgcgcttttggacggctcatggtggaatcccatagaagccttagggacgactacgaggtgtcgtgcccagagctggaccaactggtcgaggcggcgctggcggtcccaggagtgtacggctcgcgaatgacggggggtggcttcggcgggtgcaccgtgactctgctggaagcctcagcggccccgcacgctatgcggcacatccaggagcactacggtggcacggccaccttctacctgtcacaggccgccgacggagcaaaggtgctctgtttg

SEQ ID NO: 11874 - DNA, 1176 bp, Artificial Sequence
  Description of Artificial Sequence: Synthetic coding sequence
atggccgccctgaggcaaccccaggtcgctgagctattagcagaggcccggagggccttccgagaggaatttggggcagagcccgagcttgccgtttccgctcctggccgtgtgaacctgattggagaacacacggactacaatcaaggtctggtcttacctatggccttggaactcatgacagtactagttgggagtccccggaaagacggcctcgtgtcactgctcacgacaagcgagggcgctgacgaaccccagaggctgcaatttccactgccaaccgcacagagatcactagaacccggcacccctcgctgggccaattatgtgaagggtgtgatccagtattacccagcagctccactccctggcttcagcgctgtggtagtatccagcgtgcccctgggtggggggcttagttcgtccgcctcactggaggtagcaacttacacctttctgcagcagttgtgcccagactcaggcactatcgcagcgagagcacaggtatgtcagcaagctgagcactcattcgctgggatgccatgtggaatcatggaccagttcatctcgctgatgggacagaaaggccacgctctgctgatcgactgtcgcagcctcgagacatccctcgtgccactgtccgacccgaagctggcagtgctcattaccaattctaatgtacggcatagtctggcgtcttcagaataccccgttcgccggcgtcagtgtgaggaagtagcccgcgctctgggtaaagagtcactgagggaggtgcagctggaggagctggaagccgcaagggacctcgtatcgaaagagggattccgcagagcccggcacgtggtgggagagatccggaggacagcgcaggccgccgctgcccttcggcgaggcgattaccgtgcgtttgggaggctgatggtagagtcacacaggtcactgcgggatgattacgaagtgtcctgcccagaactggatcagcttgttgaggccgctttggcagttcctggtgtgtatgggtctcggatgacgggtggtggtttcggtgggtgcaccgtaacactgttggaggctagcgccgcaccccacgctatgagacacatccaagagcattatggaggcactgctactttctatctgtcccaggccgccgatggggctaaggttctgtgcttg

SEQ ID NO: 11875 - DNA, 1176 bp, Artificial Sequence
  Description of Artificial Sequence: Synthetic coding sequence
atggccgccctgagacaaccgcaggtggccgaacttctcgctgaagccagacgggccttcagagaggagttcggggcggaacccgagctggccgtgtcggcgcctggtagggtgaacctcatcggagagcataccgactacaaccagggcctcgtgctgcctatggcactcgagctgatgaccgtgctcgtcgggtcgccacgcaaagatggtttggtgagcctgctcactacctccgagggagcggacgaacctcagcggctgcagtttccactgccaaccgctcagcggtcacttgagccgggaaccccaaggtgggcgaactacgtcaaaggggtgatccagtactatccggcggcgccactgcctggcttctcagccgtggtggtgtcgtctgtgccgctgggagggggattgtcgtcaagcgcttcgctggaagtggcgacttacactttcttgcaacagctgtgcccagatagcggcaccatagcggcgcgggctcaagtgtgtcaacaggccgagcatagctttgcaggaatgccttgtgggatcatggaccagtttatctcgctgatgggccaaaaaggccacgctctgctcatcgactgccggtccctcgagacttcgctggtcccactgtccgaccccaaactcgccgttctcatcactaactccaatgtgcgccactcactcgcttcctcagagtacccggtgcgccgccggcagtgcgaggaagtggcacgcgcattgggaaaggaaagccttcgggaggtgcagcttgaggaactggaagcggcccgcgacctcgtctcaaaagagggattccgccgcgctcggcatgtggtcggagagattcggcgaactgctcaggccgcggcggcgctgcgcagaggagattacagggcgttcggcagactgatggtggagtcacataggtcccttcgggacgactacgaggtttcgtgcccagagctggatcagcttgtcgaagctgccctcgcagtgccaggtgtgtacggatcaagaatgactggaggaggcttcggagggtgcactgtcacgctgctcgaggccagcgctgccccacacgctatgcggcacatccaagagcactacggcggaaccgccaccttttacctctcgcaagctgccgacggggcaaaggtgctgtgcttg

SEQ ID NO: 11876 - DNA, 1176 bp, Artificial Sequence
  Description of Artificial Sequence: Synthetic coding sequence
atggctgccctgagacaaccccaagtggcagagctgcttgcagaggccagacgggccttcagggaggagtttggcgctgaacctgaactggctgtgtccgcacccggcagggtcaacctcatcggcgagcacacagattataaccagggccttgtactgcctatggcactcgaactgatgactgtgttggtaggtagcccacgcaaggacggcctggtctccttgctgaccaccagcgaaggcgctgatgagcctcagagacttcagtttcctctgccgaccgcccagcgctccctggagcccgggacccccagatgggccaactatgtcaagggagttattcagtactatcccgccgctccgctgcccggattctctgctgttgtcgttagcagtgttcctctcggcgggggactcagcagttcagccagtctcgaagtcgctacttatacctttctccagcagttgtgccctgacagcgggactatcgccgccagagcgcaggtgtgtcagcaggccgagcacagcttcgcaggcatgccatgcggcattatggatcagtttatctctctcatggggcaaaagggccatgctctgcttattgattgccggtctcttgaaacaagcttggtgccactgtccgatcccaaactggccgttcttatcacaaattccaatgttcggcatagtttggcatcttcagagtacccggtgcggagaagacagtgcgaagaggttgcaagagctttgggcaaggaatctttgagggaggtacaactggaggagctcgaagccgccagagacttggtgagtaaagagggcttccggcgggcaaggcacgtggtgggtgagattagacggacagcacaagctgctgctgctttgcggcgcggagattaccgggccttcgggagactgatggtcgaatcccatagatccctgagggacgactacgaagtgagctgcccggagctggaccagcttgtcgaggccgccctggcagtacccggcgtgtacggcagcaggatgacggggggaggattcggcggctgcaccgtgaccctccttgaagcaagcgctgcaccacacgcgatgcgccacatacaggagcattatggtgggacagcaactttctatctgtcccaggccgcggacggcgcaaaggtgctgtgcctg

SEQ ID NO: 11877 - DNA, 1176 bp, Artificial Sequence
  Description of Artificial Sequence: Synthetic coding sequence
atggcggctctgagacaacctcaggtcgcagaactgctcgccgaggctaggcgtgccttccgcgaggaattcggagcagaaccggagctggccgtcagcgccccgggccgggtgaacctgatcggagagcacaccgattacaaccagggattggtgctcccaatggccctcgaacttatgaccgtcttggtcggttcaccgagaaaggatggcctcgtgtccctgctgacgactagcgagggggccgacgaaccgcaacgcctccagttcccactgccgactgctcagcgctcgctcgagcccggaacccctagatgggcaaactacgtgaagggggtgatccagtactaccccgcggccccactcccaggattttccgccgtggtcgtgtcatccgtcccgttgggtgggggtctgtcctcatcggcatccctcgaagtggccacctacacctttctccagcaactctgccccgactcgggcacgatcgcggccagggcgcaggtctgccaacaggcggagcattcgtttgctggcatgccgtgtggaatcatggaccaattcatcagccttatggggcagaaagggcacgccctgcttatcgactgccgcagcctggagacttcgcttgtgccgctgagcgacccgaaactggcggtgctgataactaatagcaacgtgaggcactccctggcatcatcagaatacccggtccggagaaggcaatgcgaagaagtggctcgcgctctgggcaaggagagcctcagggaggtccagctggaagagctggaagccgctcgcgacctggtgtccaaagaaggattccggcgcgcaagacacgtggtgggagagattaggagaaccgcgcaagctgcggcagctttgcggaggggtgactaccgggcgttcggacgcctcatggtcgaatcgcaccggagcctgcgcgacgactacgaagtctcgtgtcctgagttggaccagcttgtggaggccgctctggcggtgcctggggtgtacgggtccaggatgactggaggagggttcggagggtgtactgtgactttgctggaagcgtcagccgctccgcacgccatgcgccacatccaggaacactacggaggaaccgcgaccttctacttgtcacaggcagcagacggtgctaaggtgctctgcctg

SEQ ID NO: 11878 - DNA, 1176 bp, Artificial Sequence
  Description of Artificial Sequence: Synthetic coding sequence
atggcagcactgcggcaaccacaagtcgcggagcttctcgcagaagcgcgacgtgcgtttcgtgaggaatttggtgccgaacctgaacttgcagtgagcgccccaggaagggtgaaccttataggagaacataccgattacaatcaaggactggtgcttcccatggcactcgaactgatgaccgtgctcgtcgggagcccgcggaaggacggtcttgtatccctgcttactactagcgagggggctgatgaacctcaaagactccaatttccccttccaaccgcacaaaggtccctggaacctggtactccccgctgggccaattacgtgaaaggcgtgatccagtactaccctgccgccccgcttccaggattttccgcagtcgtggtgtcatctgtgcctcttggaggtggcctgtcctcctcggcctcccttgaggtagccacttacactttcttgcagcaactctgtcctgactccggtacgattgccgcacgcgcacaggtctgtcagcaggcggagcacagcttcgccggcatgccttgtggtatcatggatcagttcataagtcttatggggcagaagggtcacgcgcttctcattgattgccggagcttggagacgtcgcttgtgcctctctcggaccctaagctggcggtgctcatcaccaactccaacgtgagacactcactcgcatcaagcgaataccctgtgcgacgacggcaatgtgaggaagtcgcgcgggcactcggcaaggaatcactccgggaagtgcaacttgaggagcttgaggcagctagagacttggtgagcaaggaaggatttcgcagggcccgacatgtcgtgggtgaaattcgtagaacggcacaagcggcagcagcgctcagacgaggagactaccgcgcctttggacggcttatggtggaatcccatcgcagcctgagagatgactacgaagtctcgtgtcctgagcttgatcagcttgtcgaagcagcacttgcagtcccgggagtctatggttcgcgtatgactggaggcggcttcgggggatgtactgtgacccttcttgaggcgtcggccgcaccacatgcgatgaggcacattcaagaacactatggcggtaccgcaaccttctacctgagccaggccgctgatggagcaaaagtcttgtgcctg

SEQ ID NO: 11879 - DNA, 1176 bp, Artificial Sequence
  Description of Artificial Sequence: Synthetic coding sequence
atggctgcactcaggcagccgcaggtcgccgaattgctggctgaggcccgccgtgccttcagagaagagtttggcgctgagcctgagctcgccgttagtgctcccggccgggttaacctcattggggagcacaccgactacaatcagggcctggtcctgccaatggccctggagctcatgactgtcctggtcgggtcccccaggaaagacgggctcgtttccctactcacaacatctgagggcgccgacgagcctcagcgtctgcagtttcctttacccacagcccagagatcgctagaaccgggaactcctcgatgggcgaactatgtcaaaggagtcatccagtactatcctgctgctcctttgcctggattcagtgccgtggttgtgtcttccgtcccattgggtggaggtctttcttccagtgcgagtctcgaggtggccacttatacgttcctgcagcagctctgtcccgatagcgggactatcgcggctagggcacaggtctgccagcaggcagagcacagcttcgcgggcatgccttgcggcataatggaccaatttatcagtctgatgggccagaaaggccacgcgcttctcatcgattgtcgctctttggagacttccctcgttcccctgtctgatcccaagctggctgtcctgattaccaactcaaacgtgcggcattctctggcaagtagcgaatatcccgtgcgccgccgccaatgcgaggaggtagctcgcgcgttgggcaaggaatctctccgagaggtgcaactcgaggagctcgaagctgctcgcgatcttgtgtcaaaggaagggtttaggagggcccgccatgtcgtaggtgagataaggcggaccgcgcaggcagccgctgcgttgagacgcggcgactacagggctttcggaagacttatggtcgagagccatcgctcactgagggatgattatgaggtgtcctgccctgagctggatcagcttgtcgaggcggccctggccgtgccaggggtctatggtagtagaatgacaggaggcgggttcggtggttgcaccgtcaccttgctggaggcctccgctgctccacacgcaatgagacacatccaggagcactacggagggactgccactttctacttgtcacaggcagcagacggggccaaagtgctctgcctt

SEQ ID NO: 11880 - DNA, 1176 bp, Artificial Sequence
  Description of Artificial Sequence: Synthetic coding sequence
atggctgccctcagacaacctcaggtcgccgagctgttagcggaagctagacgggctttcagagaagagttcggtgcggaaccagaattggcagtcagcgctcccgggcgcgtaaacctgattggcgagcacaccgactacaatcaggggctggtcttaccaatggccctggagctgatgaccgtgctcgtcggttccccacgaaaggacggattggtcagccttcttacaacttcagagggggccgacgaaccacaaaggctgcaattccctctgcctacagctcagagaagtctggaaccaggcacaccacgatgggcgaactatgtaaaaggtgtcatccagtattaccctgccgccccactaccaggatttagtgctgtggtggtctcctccgtccctctaggcgggggcctgagttcatccgcaagcttagaagtggcaacttatacatttctgcagcagctgtgccctgattccggcacgattgctgcccgggcgcaagtttgccagcaggctgaacatagcttcgccggcatgccatgcggaatcatggaccagtttataagcctgatgggccagaagggccatgccctcctaattgactgccggagcctggaaacatccttagtgccactctccgaccctaagctcgccgtgctaattactaattcaaatgtgagacactctctagcgtcaagtgaataccctgttagaagacggcaatgcgaggaggtggctagagcgctcggcaaggaaagtctccgagaagtacagttggaggaacttgaagcggccagggaccttgtgtcaaaagagggttttaggcgcgctagacatgtcgtcggggagatccgtagaaccgctcaggcggcggctgcactgaggaggggcgattacagagcttttggacgcctgatggtggagtcacatcgcagcctgcgggatgattacgaggtgtcctgtcccgagctcgaccaactggtcgaagccgcattagccgtgcctggggtctatggtagccggatgacagggggcggatttggcggatgcactgtgactctcctagaagcatcggccgccccgcatgcgatgaggcatatccaggagcactatggtggtaccgctacgttctatctatcccaggcagctgacggcgcaaaggtgctctgcctg

SEQ ID NO: 11881 - DNA, 1176 bp, Artificial Sequence
  Description of Artificial Sequence: Synthetic coding sequence
atggcagctcttcggcagccgcaagtggccgaactgctggccgaggcgagaagagcatttcgcgaagaatttggtgcggaaccagaactcgcagtgtccgcacctggacgagtgaacctgattggtgagcatactgattacaaccaaggccttgtgcttcctatggcccttgaactcatgacggtccttgtcggaagcccgcgtaaggatggattggtgtccctgcttaccacctcagagggagcagatgaaccgcaacgcctccaattcccactcccaaccgcccagaggagcctcgagccaggtacgcctcggtgggcaaattacgtcaaaggcgtgatccaatactaccctgccgcgccactgccaggtttttcggcagtggtggtcagctccgtgccactcgggggtggcttgtcatcgagcgcatcccttgaagtggcaacctataccttcctgcaacaactgtgccccgattcgggtaccattgcagcaagggcacaagtgtgtcaacaagcagaacattcgtttgcggggatgccatgcggcatcatggatcagttcatttcgcttatgggtcaaaaagggcacgcacttctgattgattgcagatccctcgaaacttcactggtgcctctttccgacccaaaactcgccgtcctgattacgaactcgaatgtccgccactcgctggcatcgtcagaataccctgttcggcggcgtcaatgtgaagaagttgcacgcgctcttggtaaggaatccctgcgggaggtgcagttggaagagcttgaagcagcaagggatctggtgtccaaggaagggttcagacgagcacgacatgtggtgggggagattcgccgtactgcacaagcagccgcagccttgcgccgcggtgattaccgggcatttggacggcttatggtggagtcccaccgctcactgcgagacgattacgaagtctcatgtcccgaactggatcaacttgtggaagcagcactggcagtgccgggtgtctacggttcccggatgacgggagggggctttggtggatgcaccgtcacccttttggaggcatccgccgctccacacgcaatgagacatattcaagaacattacggaggaaccgccaccttttacctgtcccaggcagcagacggagccaaggtgctttgtctc

SEQ ID NO: 11882 - DNA, 1176 bp, Artificial Sequence
  Description of Artificial Sequence: Synthetic coding sequence
atggccgctttgaggcagccacaggtggctgaactgctcgcagaggcccgccgggcattccgcgaagaattcggagcagagcccgaactggcggtgtctgcgccagggcgcgtaaatctcataggcgagcatacggattataaccaggggcttgttctgccaatggccctggagttgatgacagtacttgtgggcagcccgaggaaggatggattggtgtccttgctcaccacctctgaaggagccgacgagccccagcgtctgcaattcccactccccactgcccagcgatcacttgaacctggtacccctcggtgggctaactacgttaaaggggtgatccagtactaccctgcagccccactgcccggtttttccgcggtcgtggtcagctctgtgcctctgggcggaggtctcagcagtagcgcaagcctggaggtggccacttataccttcttgcagcagctgtgtcctgattctggaaccatagctgcgagggcccaagtgtgtcagcaagctgaacatagctttgccggcatgccctgcggcatcatggaccaattcatctccctgatgggacaaaaagggcacgccctgctcatcgactgccggagcctggagacctcacttgtgcccctgtccgatcccaaactggccgtgcttatcaccaactcaaatgtgcggcactctctagcgtcctccgaatatcctgtgcgccgtagacagtgcgaggaggtggccagggccctgggcaaggagtctctgcgggaggtccagttggaagagctcgaggcggcgcgcgatctcgtatccaaagaaggcttccggcgagctcgacatgtggtgggcgagatcaggagaactgcccaggctgcagccgctctgcgcagaggggattacagggcattcggtagattgatggtggagtctcatcgcagtctgagggacgactacgaggtttcatgtcccgagttagaccagctcgtcgaagctgctcttgccgtgcccggagtgtatggctctcggatgactggcggcgggttcgggggatgcacagtgactctcctagaagctagcgctgccccacatgccatgagacatattcaggaacattatggcggtacagctacgttctacctatctcaggctgcagatggtgccaaggtactgtgtctg

SEQ ID NO: 11883 - DNA, 1176 bp, Artificial Sequence
  Description of Artificial Sequence: Synthetic coding sequence
atggccgcccttcggcagccacaagtggccgaactgcttgcggaggcacgtcgggcattccgcgaagagtttggagcggaaccagaacttgcagtgtcggccccagggcgagtgaacctcatcggtgaacacactgactacaaccaaggacttgtgctgcccatggcactcgaactcatgaccgtcctcgtgggttccccaaggaaggacggactggtgagccttctcactacctccgaaggtgcggacgaaccccaacggcttcagttcccacttcctactgcacagcgaagcctggaaccaggaactcctcgttgggcgaattacgtcaaaggagtgatacaatactaccctgcagcaccccttcccggattctcggcagtggtggtgtcatcagtgcctctgggtggaggacttagcagctccgcatcgcttgaggtcgccacgtacacgttcctccaacaattgtgtcctgactcaggaactatcgctgccagagctcaggtgtgtcaacaggcagagcattcctttgcaggaatgccctgtggaatcatggatcagttcatatctttgatgggtcagaaaggccacgccctcttgatcgactgtcgaagccttgagacttcccttgttccactctcagatcctaaactggcggtgctcattactaattccaatgtccgccattcacttgcatcatctgaatacccagtcaggcggagacaatgtgaagaggtggccagggcattgggcaaagaatccctccgagaagtgcaactggaagaactcgaagcagcgagggatctcgtgtcgaaggagggatttcgtcgagcacgccatgtcgtcggcgaaattcgcagaactgcacaggcagccgcagcactgcgccggggtgattaccgagctttcggacggctcatggtggagtcccatcggtcgctcagagatgactacgaagtctcttgtcccgaactggaccagcttgtggaggcggcactggcagtgcctggagtgtacggaagcagaatgactggaggagggtttggagggtgcaccgtgaccctgctcgaagccagcgcagccccacacgcaatgcggcatatccaggagcactacggcggtactgcaaccttttatctttcccaagctgccgatggcgcaaaggtgctgtgcttg

SEQ ID NO: 11884 - DNA, 1176 bp, Artificial Sequence
  Description of Artificial Sequence: Synthetic coding sequence
atggccgcactcaggcaaccacaggtagccgagcttctggccgaagctcgccgcgctttccgagaagaattcggagccgagccggagttggctgtttccgcgccaggacgagtcaacctcatcggggaacataccgactacaaccagggccttgtgctcccgatggccttagagttaatgacggtgttggtaggatccccgagaaaagacggtcttgtttccctactgacgacaagcgagggagcggacgaacctcaacggttacaatttcccctcccaacagctcaacgcagcttggagcctggcacgccacgttgggccaattatgttaagggtgtcatccagtattatccggctgcaccactgcccggattcagcgccgtggtcgtttcatcagttcccctcggcggcggactgtcctccagtgcctcgttggaggttgcaacatacacgttcttgcaacagctatgtccggattctggcaccattgcagcccgagcgcaagtgtgccagcaagcagagcacagcttcgccggcatgccctgcggaatcatggaccagttcatcagcctaatggggcagaagggtcatgctctgctgattgactgtcggagtctagaaacatcattagtcccactgagcgatccgaagttagctgttttgataacgaacagcaatgtgaggcacagcttggcgagctccgaatatcctgttcgcagacggcagtgtgaggaagtcgcacgtgctctgggtaaagaaagcctgcgagaggttcaattggaggaactagaggcggctagagatttggtctccaaggagggcttccgccgggccagacatgttgtcggcgaaattcgccgtacagctcaggccgcagccgcacttcgtaggggcgattaccgggctttcggtcgtctgatggtggaatcgcaccggtccctccgagatgactacgaagtgtcttgccctgagctagaccagctcgtcgaggcggccctcgcggttcccggcgtctacggaagtcgcatgactggtgggggcttcggggggtgcactgtgacactgttagaagctagtgccgcacctcatgcaatgcggcatattcaagaacattacggcggtaccgccacgttttatctgtctcaggccgctgatggggccaaagtactttgtttg

SEQ ID NO: 11885 - DNA, 1176 bp, Artificial Sequence
  Description of Artificial Sequence: Synthetic coding sequence
atggctgctttgaggcaaccacaggtggccgaactgctggccgaggccagaagagcgtttagagaggagtttggggctgagcccgagctggctgtttctgcgcctggcagggtgaatctgattggagaacataccgactacaaccagggactggttctgcccatggctcttgagctcatgacagtcctcgtcgggagccctagaaaggatggcctggtcagtcttctgaccacgtctgagggggctgacgagcctcagcgcctacagttcccactgcccactgcccagagaagcctggagccaggcacaccaagatgggccaactacgttaagggagtgattcagtattaccccgccgcccccctgcctgggttttctgccgtggtggtctcgtccgtcccgttgggcggagggctgtcatcctccgcaagtctcgaggtggcgacatatactttcttacagcagctctgcccggattctggcacaatcgccgccagagctcaggtctgtcagcaggccgagcattcatttgcgggcatgccatgcggtatcatggaccagtttatttctctcatgggtcagaagggtcatgctttgctaattgattgtcgatctcttgagaccagcctcgtgccactcagcgatcctaaattggccgtccttattaccaactccaacgtcaggcactctctggcaagtagtgaataccccgtgaggaggaggcaatgtgaagaggtcgcacgggccctgggtaaagaaagcctgagggaggtccagcttgaagagctggaggccgcaagagatctggtgagcaaggagggattcaggcgagccagacatgtggtgggggagataagaaggacggcccaggccgctgccgctcttaggcgtggcgactaccgggcatttggtaggttgatggtggagtcacataggtcattgcgggatgactacgaggtgtcctgcccggagctcgaccagcttgtggaggcggccctggccgtgccgggggtctacggctcaagaatgactggcggcggatttggaggatgcaccgtgaccttacttgaggcctctgccgcgccccatgctatgcggcacattcaagaacactacgggggcacggcgacattttatctgagccaggccgcagatggggcaaaggttttgtgcctg

SEQ ID NO: 11886 - DNA, 1176 bp, Artificial Sequence
  Description of Artificial Sequence: Synthetic coding sequence
atggcagccctgcgtcagccacaagtagctgagctcttggcagaggccagacgagcgttccgggaggaattcggagctgaaccggagctcgcagtttccgcccccggccgtgttaatttgatcggcgagcacacggactacaatcaaggtttagtactccccatggctttggaactgatgaccgtactggtgggtagcccgcggaaggacggcctggtgtccttactcactacctccgagggggctgatgagccgcaacggctgcaattccctcttcccaccgcccagcgatctctcgaacccggtacccctcgctgggcgaactatgttaagggcgtcatccagtactaccctgccgctccacttccaggcttctcggccgtcgtagtatctagtgtccccctgggaggaggactgtcgtccagcgcgagcctcgaggtggctacgtacaccttcctgcagcagctttgccccgactccggcaccatcgcggcccgtgcacaggtctgccagcaggcggagcactcgttcgctggcatgccttgcgggataatggaccagttcatctccttgatgggccagaagggacatgccttgctgattgactgccgtagtctggagacgtcactggtgcctttgagtgatcctaagctagccgtcctcattaccaactcaaacgtccggcacagtctcgcaagctcggagtaccccgttcgccgcaggcagtgcgaggaagtggcccgtgcactgggtaaggaatccctgcgtgaggtccagctcgaggagttggaagccgctagggacttagttagcaaggagggttttaggcgggctcgccacgtcgtcggcgagatccggcgcaccgcgcaagccgcagccgcgctaagacgtggcgattaccgggcgttcggccgcctcatggtggagagccatcgttccctgagagacgattacgaggtcagctgcccagaattggaccaattagtggaggccgccctggccgtccccggcgtgtacggaagccgtatgacgggaggcggcttcggaggatgcactgtaacccttctcgaggcaagcgcagctccgcacgcgatgcgccacatccaagagcattacggcggtaccgccaccttctacttatcccaggcggctgacggcgctaaagtcttgtgcctc

SEQ ID NO: 11887 - DNA, 1176 bp, Artificial Sequence
  Description of Artificial Sequence: Synthetic coding sequence
atggcggcgctacgtcaaccgcaagtagcggaattattagcggaagcgcgacgagcgtttcgagaagaatttggtgcggaaccggaattagcggtatcggcgccgggtcgagtaaatttaataggtgaacatacggattataatcaaggtctagttttaccgatggcgctagaattaatgacggttctagttggttcgccgcgaaaagatggtttagtttcgttattaacgacgtcggaaggtgcggatgaaccgcaacgtttacaatttccgttaccgacggcgcaacgatcgttagaaccgggtacgccgcgttgggcgaattatgtaaaaggtgtaatacaatattatccggcggcgccgctaccgggtttttcggcggttgtagtttcgtcggtaccgctaggtggtggtttatcgtcgtcggcgtcgctagaagtagcgacgtatacgtttctacaacaattatgtccggattcgggtacgatagcggcgcgtgcgcaagtttgtcaacaagcggaacattcgtttgcgggtatgccgtgtggtataatggatcaatttatatcgttaatgggtcaaaaaggtcatgcgttattaatagattgtcgttcgttagaaacgtcgctagttccgttatcggatccgaaattagcggtactaataacgaattcgaatgttcgtcattcgttagcgtcgtcggaatatccggttcgtcgtcgacaatgtgaagaagtagcgcgtgcgctaggtaaagaatcgttacgagaagttcaattagaagaactagaagcggcgcgagatctagtatcgaaagaaggttttcgtcgtgcgcgacatgtagttggtgaaatacgtcgaacggcgcaagcggcggcggcgctacgtcgaggtgattatcgtgcgtttggtcgtctaatggtagaatcgcatcgatcgctacgagatgattatgaagtttcgtgtccggaattagatcaactagtagaagcggcgttagcggttccgggtgtttatggttcgcgaatgacgggtggtggttttggtggttgtacggtaacgctactagaagcgtcggcggcgccgcatgcgatgcgtcatatacaagaacattatggtggtacggcgacgttttatttatcgcaagcggcggatggtgcgaaagtattatgttta

SEQ ID NO: 11888 - DNA, 1176 bp, Artificial Sequence
  Description of Artificial Sequence: Synthetic coding sequence
atggcagcgctccgccagccacaggtggcagagctgctggcggaagcacgcagagcgtttcgtgaggagtttggagccgaaccggaactggccgtgtccgcgcctggccgagtcaatcttataggggaacataccgactataaccagggactcgtgcttcccatggccctcgagctcatgacggtgctggtgggcagcccaagaaaggacgggctggtcagccttctgactacgtcggaaggagccgacgaacctcagcgactccagtttccactgcccaccgcacaaagatcacttgagccgggaacgccccggtgggcaaactacgtgaagggagttattcaatactaccctgcagcacccctgccagggttcagcgcagttgtggtgtcctctgttccactgggtggcggccttagcagctcggcgagccttgaggtggcaacctacacctttctgcaacaactctgcccagatagcggcactatcgctgcacgggcacaagtgtgtcaacaagcagaacacagcttcgcaggaatgccttgcggtatcatggatcagtttatctctttgatgggacaaaagggtcacgccctcctcatagattgtagaagtctcgaaacctctttggtaccccttagcgacccgaaacttgctgtgcttattactaactcgaacgtccgtcattcgctggcgtcctcagaataccccgtgagacgccgacagtgcgaagaagtggcacgtgcgcttggaaaggaatcccttagggaagtccagctggaagagcttgaggctgctcgggacctggtcagcaaagagggattcaggcgggcccggcacgtggtgggtgagatcagaagaaccgcccaagctgccgccgcccttagacggggagattaccgggcttttggtcgccttatggtggaatcacatcgctctctgcgcgatgattacgaagtgtcgtgtcccgaactcgatcaattggtggaagccgcactcgccgtccctggtgtctacggatcacgcatgactggtggaggtttcggcggttgcactgtgactttgctggaggcgtcggcggccccacatgcaatgcggcatatccaagaacactacggtggaactgctaccttttatctgtcgcaagctgccgatggggcaaaggtcctctgcctg

SEQ ID NO: 11889 - DNA, 1176 bp, Artificial Sequence
  Description of Artificial Sequence: Synthetic coding sequence
atggccgcactccggcagcctcaggtggcagaactgcttgcagaggctaggcgtgcctttagagaggaattcggagcagaacctgagcttgccgtctccgcacctggaagagtgaatcttataggcgaacataccgattacaaccagggtcttgtgcttcccatggctttggaacttatgaccgtgctggtggggagcccgcggaaggatggactggtgtcgcttctgaccacttcagaaggtgcggacgagccacaaaggctccagtttcccctgcccaccgcgcagcgcagcttggagccgggaacccctaggtgggcaaattacgtcaagggagtgatacagtactatcctgcagccccactgccagggttcagcgctgtggtcgtgtcgagcgtgccactgggcggagggctctcaagctccgcatcccttgaggtggcaacctacacttttctccagcagctgtgtccagattcgggaacgatcgccgctcgtgcccaggtgtgtcaacaagcagaacactcctttgcgggaatgccctgcggaatcatggaccaattcatttccctgatgggtcaaaaggggcatgcacttctcatcgactgccggtcgctggaaacttctctggtccctcttagcgatcctaagttggcagttctgataactaattccaacgtgcgtcactcgcttgcgtcctcagaataccccgtgcgccgtaggcagtgtgaagaagtagctcgtgccttgggtaaggagagcctgagggaagtccagctggaggagcttgaggcagcacgcgatctggtgtccaaggagggattcagacgagcaagacatgtggtgggagagatccgtagaaccgcacaagcagccgccgctttgcgacgcggagactacagagcattcggacggctgatggtggagtcgcatcgaagccttagagatgattacgaagtttcatgccccgagcttgatcagctggtcgaggctgcactggccgttcccggtgtgtacgggtcgcggatgaccgggggaggattcggtgggtgtactgtgactttgctcgaagcctccgcagcgcctcatgcaatgcgccatattcaggagcactacggcggtaccgcgactttctacctctcccaggcggcagatggagcaaaagtgctctgtctt

SEQ ID NO: 11890 - DNA, 1176 bp, Artificial Sequence
  Description of Artificial Sequence: Synthetic coding sequence
atggccgcactgcggcagcctcaggttgcagaactccttgcagaggcgcggagagcttttcgagaagagtttggagcagaaccagaacttgccgtgtcggcccctggacgtgtcaacctgataggagagcatactgattacaaccaggggctggtgcttcctatggcacttgagctcatgactgtgctcgtgggctctccgcgcaaagatgggcttgtttcactccttactacttcggaaggagccgatgagccccaaaggcttcagtttccactgccaaccgctcagcggagcctggagcccggaaccccaagatgggcaaactacgtgaaaggtgtcattcaatactaccctgcggctcccctgccgggattttcagcagtggtggtgtcctccgtcccactcggaggcgggctgtcctctagcgcatctctggaagtggctacttacaccttccttcaacagctttgtcccgactccggcaccatagctgccagagcccaagtgtgtcaacaggcagaacactccttcgctggtatgccatgcggtataatggatcaattcatctcactcatgggacaaaagggacatgcactgcttattgattgcaggagccttgaaacttccctggtgcctctgtccgaccctaagctggcagttcttattaccaacagcaacgtgcggcactcactggccagctcagagtacccggtgaggaggcgccagtgtgaggaggtcgctagggcattgggtaaggaatcgctcagagaggtgcaacttgaagaactggaggcagcacgggacctcgtcagcaaggaaggctttagaagagcacgacacgtcgtgggcgaaattcgccgaacggcccaagcggccgccgcgttgcggagaggggattacagagcatttggtcgcctgatggtggaatcgcataggtcactgagagacgattatgaggtgagctgccctgaacttgatcaacttgtcgaggcagcacttgcagtccccggagtgtacggatccagaatgaccggtggtggcttcggcggctgtactgtgacgcttcttgaagcatcagctgctcctcatgcgatgcgtcatatccaggagcattacgggggtaccgcaactttctatctttcccaagcagcagatggggcgaaggtcctctgcctc

SEQ ID NO: 11891 - DNA, 1176 bp, Artificial Sequence
  Description of Artificial Sequence: Synthetic coding sequence
atggccgcacttcggcaaccacaagtagcagagctgctggcagaagcacgaagggcatttcgggaggaatttggggctgagcctgagctggccgtgtcagcgccagggcgggtgaatctcatcggagaacacactgattacaatcagggcctcgtccttcctatggcgctggaacttatgactgtcttggtcggatcaccaaggaaggatgggttggtgtcgcttcttactacttcagaaggagccgacgagccacaaagactccaattccctcttcctaccgcgcagagatcgctggaaccagggacccccagatgggctaactacgtgaaaggtgtgattcagtactacccagcagcaccccttccaggattttcggcagtcgtggtcagcagcgttcccctcggcggcgggctgtcgtctagtgcatccctcgaagtggccacctacacgttcttgcagcaactgtgtccggattccggtactattgcagcacgcgcccaggtctgtcaacaagcagaacattcatttgcaggtatgccatgtggtattatggatcaattcatctccctgatgggtcagaagggacatgcacttctgatcgattgcagaagccttgaaacctcattggtgcctctgtcagaccctaagctggccgtgctgattaccaacagcaacgtgcggcattccctggcgagctctgagtaccctgtgagacgtcggcagtgcgaggaagtggcgcgagctcttggtaaggaatcgctgcgcgaggtgcagctggaagaactcgaggcggcacgggacttggtgtcgaaagagggttttcggagggccaggcacgtggtgggtgagatcagaagaaccgcacaggcagctgccgccctgcggcgtggagattacagggcatttggccgcttgatggtggagtcacaccgctcccttcgcgatgattacgaagttagctgtccggaactggatcagctggtcgaagcagcacttgcagtgccaggagtgtacggttcgaggatgaccggtggagggtttggagggtgtaccgtgacgcttttggaggcgtccgcggcgccccatgcaatgaggcacattcaagaacactacggaggaaccgcaaccttctacctgtctcaagcagcagatggagccaaagtgctctgtctg

SEQ ID NO: 11892 - DNA, 1176 bp, Artificial Sequence
  Description of Artificial Sequence: Synthetic coding sequence
atggctgcgttgagacaaccacaagtagctgagctactcgcggaggcaagacgagcctttagggaggagttcggcgcagaacccgaactggccgtgtccgcaccaggacgagtgaacctcattggtgaacacactgactacaatcaggggctagtgctgcccatggcattggaattgatgaccgtgctggtcggaagcccgagaaaggacggcctcgtcagcctgttgaccacgagcgaaggcgcggacgaaccccagaggctccagtttccactgcctaccgctcagcggtcactcgaacctggcaccccccgatgggctaattacgtgaagggcgtaatccaatattatcctgcggcaccccttcccggcttctccgctgtagtggtgagcagtgtcccattgggcggggggctttcaagcagcgcgagtctggaggtggctacttatacatttctgcagcaactgtgcccagatagcgggaccattgctgccagggcgcaagtatgccagcaggccgagcattcattcgcgggaatgccttgtggtataatggaccagtttataagcctgatgggtcagaagggacacgcattgctgatcgactgccggagtctggagacatcattggtccccctctccgatcccaaacttgcagtcctgattactaattcgaacgtccgtcactccttggcatcgagcgagtatcccgtgcgcagaaggcagtgtgaagaagtcgcacgtgccctcggaaaggaaagtcttcgggaagttcagctagaggagcttgaagccgccagggacctggttagcaaagaggggtttagacgtgcacgccacgtcgtaggagagattcgtcggaccgcacaggcagccgcagcactccggagaggcgattaccgagcattcggccggctgatggtggaaagccaccgaagtctgcgagatgattacgaggtcagctgtcccgaacttgatcagctagtcgaagccgctctggccgtccccggggtgtatggatccaggatgacaggaggaggcttcgggggctgtactgtgacactcttggaggcctcagctgctccccacgctatgagacacatccaggaacactacggaggcacagctactttctacctatctcaggccgcagatggagccaaggtactgtgcctg

SEQ ID NO: 11893 - DNA, 1176 bp, Artificial Sequence
  Description of Artificial Sequence: Synthetic coding sequence
atggccgccctgcgacagcctcaagttgccgaacttctggccgaggccaggagggcatttagggaagaatttggagccgaacctgagctcgctgtaagcgcaccaggacgcgtgaatctgattggggaacacacggattataaccagggcttggtgctgccaatggcacttgaactcatgaccgtcctggtgggatctcctcgaaaagatggcctggtatccttgctgacaaccagcgaaggagctgacgagccccagaggttgcaattcccgctgcctacagctcagaggagcctggagccgggaaccccaagatgggccaattatgtgaaaggggtaattcagtattacccagccgctcctctcccgggattttctgctgtggtcgtatcttcagtaccattggggggcggtctgagcagtagcgcctcattggaagtagcaacatataccttcctccagcaactgtgcccggattccggcacgattgcagctcgagcacaagtgtgtcagcaagcagagcattctttcgcggggatgccctgtggtattatggatcaatttatttctctgatgggacagaaaggacacgctctgctcatcgactgtagatctctcgaaacaagcctcgtgccactttctgatccgaagcttgccgtgctgatcacaaattctaacgtgcgacatagtctcgcttcctcagaatacccagtgcggcgacggcagtgcgaggaagtcgcccgggcactcggcaaagaatcattgcgcgaagtgcagctggaagagcttgaggcggcccgcgatctcgtgagtaaggaaggtttcagaagggcgcggcacgttgtgggcgaaatcagacgcacagcacaggccgctgcagccctgagacgcggtgattatcgcgctttcgggcgcttgatggtcgaaagccacagatctctgcgagacgactacgaggtgagttgccccgaactggaccagctcgttgaggccgccctcgccgtccctggggtctacggatcaagaatgacaggaggcggatttggtggctgcactgtgactctgctggaggctagcgcagccccacacgcgatgaggcacattcaggagcactacggggggactgccacgttttatctcagtcaagcggcagatggcgccaaggtgctctgtttg

SEQ ID NO: 11894 - DNA, 1176 bp, Artificial Sequence
  Description of Artificial Sequence: Synthetic coding sequence
atggcagctttgcggcagccacaggtcgccgaactgctcgctgaagctcgtcgcgctttccgggaagagttcggtgctgaaccagagctggccgtcagtgcgcctggcagggtgaacctgataggggagcatactgattataatcaaggacttgtgctgccaatggcgcttgaactgatgactgtgttggtcggaagccccagaaaggatggactcgtttctctgttgacaacctccgagggggcagatgagccacagaggttgcaattcccgctcccaactgctcagaggagtctggaaccggggactccccgctgggccaactacgtgaaaggtgttatacaatactacccagctgccccgctgcctggcttcagtgccgtagtcgttagctctgtccctctgggcgggggacttagcagctccgcttccctggaagttgccacttacactttcttacagcagctctgccccgactctggcaccattgccgctagggcccaagtgtgtcagcaagcagagcattcgttcgctggtatgccttgcggcatcatggaccagtttattagcctgatgggtcaaaaaggccacgcactgctcatcgactgccgcagcctggagactagcctggttcctctttcagatcctaaacttgctgtgttgatcactaacagcaatgtcaggcacagcctcgccagcagcgaatatcccgttaggaggcggcagtgcgaagaggtggcgcgcgctttgggcaaagaaagcctcagggaggtgcagctcgaggagttagaggctgcgcgcgatcttgtgtcaaaggagggcttccgtagggcaagacatgtggttggagagattcgtagaactgcacaggccgccgctgcgctgaggagaggtgactatcgggcttttggccgcctgatggtcgagagccacaggagtcttcgcgacgattacgaagtaagctgtccagagttggaccaactagtggaagcggcactggcggttcctggtgtatacggatcccggatgaccggtggtggctttggaggttgcacagttactctgttggaagcctcagctgctccgcatgctatgcgccatatccaagagcattatggaggaacagctactttttacctcagccaggctgcggatggcgctaaggttctctgtttg

SEQ ID NO: 11895 - DNA, 1176 bp, Artificial Sequence
  Description of Artificial Sequence: Synthetic coding sequence
atggccgctctgaggcagcctcaggtagctgagctcctggctgaagcccggagagcgttcagagaagaatttggtgccgagccggagttggcagtctctgcgcccggcagagtaaatcttatcggggagcatactgattataaccagggcctggtccttcctatggctctcgagctgatgactgtcctggtaggatcaccacgaaaagacggactcgtttccctacttaccacatcagagggtgcagacgagcctcagcgtctgcagttccctctacccaccgctcagagaagtctggagccaggcactccccgctgggccaactatgtgaaaggtgtcatccagtactacccagccgcccctttacccgggtttagcgccgtggtcgtgtcaagcgtgccgctcggtggcgggcttagctcgtccgcaagtctggaggtcgctacatatacgttcctgcagcagctgtgccccgattctggcactatagccgctagggcacaggtgtgccaacaggcagagcattcttttgccgggatgccctgtggaataatggaccagttcataagcctcatggggcagaaggggcacgcgctgttaattgactgtaggtccctggaaacttccctcgttccactgtctgacccgaagcttgcagttcttatcacaaacagcaacgtcagacactctcttgcatcttccgagtaccccgtgaggcgcagacagtgtgaagaagttgctagggcactgggcaaagagtctctccgcgaggtgcagcttgaggagcttgaagcggcaagagatcttgtttccaaggaaggcttccggcgagcgcgccacgttgtcggcgagatcagacggactgcacaggccgctgccgcgctcagaaggggagattatcgggcttttgggcgtctgatggtggaatctcacagatcactccgtgacgactacgaggtgtcatgcccggaactagaccagttggttgaggcagccctggccgtccccggcgtgtacggatccaggatgaccggaggcggcttcgggggctgtactgtgacactacttgaggcaagcgctgccccgcatgctatgcgccatatccaagagcactacgggggcacagctactttctatctgtctcaagccgctgacggtgcaaaggtcttgtgtctg

SEQ ID NO: 11896 - DNA, 1176 bp, Artificial Sequence
  Description of Artificial Sequence: Synthetic coding sequence
atggcggccctgcggcagccacaggtggccgaattgttggccgaggcacgacgtgcgtttagggaggagtttggggccgagccagaactcgccgtgtctgcccccggccgggttaatttgatcggtgagcatacggactacaaccaaggcctagtgcttccaatggctctggagctgatgacggtgttggtgggcagccctcgtaaggacggcttggtgtcactccttactacatcagaaggtgctgacgagccgcaaaggctccagtttcctctgcccaccgcacagaggtcactggagccaggcactccacggtgggcaaattatgttaagggagtgatccagtattatcccgccgcccccctgcccgggttttctgcagtggtggtctcctctgtgccactgggggggggcctttcgtcctccgccagtttagaggttgccacctacactttcctacagcaactctgccccgactcaggcaccattgcagctcgagcccaggtgtgtcagcaagcagagcactcctttgcaggcatgccttgtggcattatggatcaattcattagtctcatggggcagaaaggccatgccctgctgatcgactgtaggtccctggaaacatctttggtccccctcagcgaccctaaactggccgttctgatcaccaatagcaacgtgcgccactccctcgcaagctcagagtatcctgtgcgacggaggcagtgtgaagaagttgcaagagctcttggcaaggagtctctgcgcgaggtacaacttgaagagctggaggcggcccgagatctggtctctaaggagggcttccgacgggctagacatgtcgttggagagatccggaggacggcccaggcagcggccgccctacgacgaggcgactatcgagcgtttggtagactgatggttgagtctcaccgatccctgagagacgattatgaggtctcctgcccagagttggaccagctggtggaggccgctctggctgtgcccggagtgtatggcagtaggatgacgggcgggggcttcggcggctgcaccgtgactctactcgaggccagcgcggcgccgcacgcaatgaggcatatccaggaacattacggtggcaccgcaacattctacctaagccaggccgctgatggcgccaaggtgctctgtctg

SEQ ID NO: 11897 - DNA, 1176 bp, Artificial Sequence
  Description of Artificial Sequence: Synthetic coding sequence
atggccgctctgcgccaacctcaggtggccgaactcttggcggaggctagacgggctttccgggaagaattcggagcagaaccagagctcgctgtgtccgcgccgggtagggttaacctgatcggagagcatactgattacaatcagggccttgtgctccctatggccctggaattgatgactgtgctggtgggatccccgcgcaaggacggactcgtctccctgctcactacgtccgagggtgcggatgaaccgcaacggctgcagttcccgcttccaaccgcccagagaagcctggaaccagggacccctagatgggccaactacgtgaaaggggtgatccaatactatcccgcggcaccactgccaggtttttctgccgtggtggtgtcctcggtccctctggggggaggcctgtcaagctcggcgtcgctggaggtggccacgtacaccttcctgcaacagctctgcccggacagcggcaccattgccgcgagggcccaggtgtgccaacaggccgagcactcgtttgccggaatgccctgcggaatcatggaccaattcatcagtctgatgggccagaagggacatgccctgttgatcgattgtaggtcactggagacttcattggtccccctgtcagacccgaaacttgcggtcctgattaccaactccaatgtccgccatagcctggcgtcgtccgagtacccagtgcgccgacgccagtgcgaggaggtcgcaagagcactcgggaaggaatccctgagagaagtgcagcttgaagaactggaagctgcacgggatttggtgtcgaaggaaggattccgtcgggcccggcatgtggtaggagaaatccgccgcactgcacaggcagccgctgctctcagacggggggactaccgggcctttggccgcctgatggtggaaagccaccgatcgctgcgcgacgattacgaggtgagctgcccggagctcgaccaactcgtcgaagccgccctggcggtcccgggcgtctacggctcacggatgaccggaggaggtttcggaggctgcaccgttaccctcctggaagcatcggctgcgccgcacgcgatgcgccacatccaggagcactacggaggaactgcaactttctacctttcacaggctgccgacggagcaaaggtgctctgtctc

SEQ ID NO: 11898 - DNA, 1176 bp, Artificial Sequence
  Description of Artificial Sequence: Synthetic coding sequence
atggcagcactgcgtcagccccaggtcgctgaactgctggcagaagcccgcagggccttccgcgaggaattcggcgcagaacctgaactggcagtgagcgctcctggacgcgtgaacctgatcggggagcatacagactataaccagggcttagtgctacccatggcattagagcttatgaccgtgctagtgggaagccctagaaaggacggactcgtgtccctgctaacaacctccgaaggcgccgatgaaccacaaaggctgcagtttccccttccaaccgctcagagaagtctggaacctggcacaccaaggtgggcaaattacgtgaagggcgtgatccagtactatccagccgcccctctgcctgggtttagtgccgttgtggtttcaagcgttcccctgggtggcgggctgtcaagtagcgccagcctggaggttgccacatatacattcctgcagcaactatgtcctgattctggtaccatcgcagcccgggcccaggtctgtcagcaggccgagcacagcttcgctggaatgccatgtgggattatggatcagtttatttccctgatgggacagaagggacacgccctgctgattgactgtcgtagtctggaaacctctctggtgccattaagtgaccccaaattggctgttttgattactaacagtaatgtgaggcactcattggcctcctccgagtaccctgttagaaggcggcagtgcgaagaagttgccagagccctgggtaaggagtcccttagagaagtgcaattggaagagttagaagccgcccgcgatctggtgagcaaggaaggatttcgacgagcccggcatgtcgttggggagattcgaagaaccgctcaggctgcagccgcactgaggagaggagattatagggcattcggcagactcatggttgagtcacataggagccttcgagatgactatgaagtcagttgtccagaattagatcagctggtcgaggcagctctggcagtgcccggggtctacggcagccggatgacaggggggggcttcggcggttgtaccgtgactcttctggaggcctccgccgcccctcacgccatgagacatattcaggagcattacgggggcactgccaccttttatctatctcaagctgccgatggtgcaaaagttttgtgtttg

SEQ ID NO: 11899 - DNA, 1176 bp, Artificial Sequence
  Description of Artificial Sequence: Synthetic coding sequence
atggctgcactgcgacagccacaggtggccgaactcctcgcagaagcacgacgggcgttccgggaagaatttggggcagagcctgagctggcagtctcggctcctggaagagtcaaccttatcggggagcacaccgattacaaccaaggactggttcttcccatggcattggagctcatgactgtgctggtgggatcgccaagaaaggacggacttgtgagccttctgaccacttcagaaggcgcagacgaaccccaacggcttcagttcccacttcctactgcacagcgcagcctggagcctggcaccccaagatgggcaaactatgtcaaaggtgtgatacagtactacccagccgcacctctgcctgggttctcagcagtggtcgtgtcgtccgtacctcttggaggcggactttcaagctccgcctcccttgaagtggcaacgtacacctttcttcagcaactgtgtccagacagcggtaccatcgccgcaagagcccaggtgtgccagcaagccgaacattcatttgccggtatgccatgcggcatcatggatcagttcatatcactgatgggccaaaaaggtcatgccttgttgattgattgtcgaagccttgaaacttcgctggtgcccctttccgaccctaagttggccgtcctgattaccaactcgaacgtgcggcattcgctcgcatcttccgaataccccgtcagacgccggcagtgtgaggaagtggcaagggcactgggaaaggaaagccttagggaagtgcaactcgaagaactggaggcagcgagagatctggttagcaaggaaggattccgtcgcgcccgccacgtggtcggtgagattagacggaccgcgcaagcggcagcagcacttcggagaggcgattaccgcgccttcggacgtctcatggtggagtcccaccgctctctccgagacgattacgaagtctcttgcccagaattggaccagctggtggaagcagcgcttgccgtacctggagtgtacggttcccggatgaccggtggtggtttcggtggttgcactgtgacccttctggaagcctcagcggcgccgcacgccatgcggcacatccaggaacattacggaggcacggctactttttacctttcacaagctgccgatggagcgaaagtgctgtgtctt

SEQ ID NO: 11900 - DNA, 1176 bp, Artificial Sequence
  Description of Artificial Sequence: Synthetic coding sequence
atggccgccctgagacaaccacaggtggcggaactcctcgcggaggcacggcgcgccttccgggaggagtttggcgctgagcctgagctggcggtgtccgcccctggacgcgtgaaccttattggagaacatactgattacaatcaggggctcgttctccccatggcactcgagctgatgaccgttctggtcggctccccacgcaaggacggactggtgtcgttgcttaccacctcggagggagccgatgagccgcaaaggcttcagtttcccttgcctaccgcccaaagaagcctggagccggggactccacggtgggctaactacgtgaagggggtgattcagtattacccagcggcgccactgccgggcttctccgccgtcgtggtgtcatcagtgccactcggtggaggtttgagcagttccgcctcactcgaggtggcaacttacacttttctgcagcagctctgcccagattctggtactatcgcggccagggcccaggtatgccaacaagctgaacactcgttcgcaggaatgccttgcggcataatggaccagttcatcagcctcatggggcagaagggccacgctctgttgatcgactgtcgctccctggaaacgtcactcgtgcccctgagcgaccctaaactggcggtgctgatcactaattccaacgtgcggcatagcctggcgtcaagcgagtacccggtcaggagaagacaatgcgaagaagtggcccgcgcgctcggtaaagaatcactgagagaagtccagctggaagaactggaggcagcgagggacctcgtcagcaaggaagggttccggcgcgcaagacatgtggtgggtgaaattcgcagaaccgcccaggccgcggccgctctccgcaggggagattatagagcgttcggacgcctgatggtcgaatcacatcggtccctgcgcgacgactacgaggtgtcgtgcccagagttggaccaactggtggaggccgctttggccgtcccgggggtttacgggagccgtatgaccggcggtggattcggaggatgtactgtgactctgctcgaggcttcggcagccccacacgctatgcggcacatccaagagcactacggaggaaccgcgacgttctacctgagccaggcagcagacggtgcaaaagttctctgcctc

SEQ ID NO: 11901 - DNA, 1176 bp, Artificial Sequence
  Description of Artificial Sequence: Synthetic coding sequence
atggccgcactgaggcagccgcaggtagcggagctgctcgctgaagcacggagggcctttagggaggagttcggcgccgagccggaactagcagtctcagcccccgggagagtgaatctaattggagagcatacagattacaatcagggattagtgttgcccatggctctcgagcttatgacggtgctggtggggagtcctcgcaaagacggattggtctccctcctgacaaccagcgaaggggctgatgagccccaacgactgcaattccccttgcccactgcccaacggagcctcgagccgggaacgccccggtgggcaaactacgtaaagggtgtcatccaatactatcctgccgccccattgcccggtttcagcgctgtcgtagtcagctcagtgccccttggaggcgggctgagcagctcggcatcgctagaggtggccacttacacattcctccagcagttatgtccagattccggaaccattgcagcgcgcgcacaggtttgccagcaggcagaacacagcttcgctgggatgccatgtggcatcatggatcagttcataagcttaatggggcagaaaggacacgcgctgctaatagactgccgctctttagaaacatccctcgtgcccctctccgaccccaaattggccgtgctaatcaccaactcaaacgttcgccactccttagcttcttcagaataccccgttcgccggaggcagtgcgaggaagtggcacgggccctcgggaaggaatcactgcgtgaggtacaattggaggagctggaagcggccagagatctggtgagtaaagagggcttccgccgcgcgagacatgtggttggcgaaattagacggacagcccaggcagccgccgccttgagacggggggattatcgagccttcggccggcttatggtggagagccataggtccctcagagacgattacgaggtctcatgcccagaactggatcaactagtcgaggcagctctggccgtccccggtgtgtatggctccagaatgactggcggggggtttggtggctgcactgtgaccctgctcgaggcctctgcagcgccccacgccatgcggcatatccaggaacattatggtgggactgcaactttttatctcagccaggccgctgacggtgccaaggttctgtgctta

SEQ ID NO: 11902 - DNA, 1176 bp, Artificial Sequence
  Description of Artificial Sequence: Synthetic coding sequence
atggcagccctccggcagccccaagtcgcagaattgctcgccgaagctcggagggcctttcgtgaggagttcggcgccgaacctgaattagccgtgtctgcccccggccgcgtgaacctaataggtgagcatacggactacaatcagggtctcgtcttaccgatggccctggagttaatgacggtgctggttggcagcccgaggaaggacggcctggtatccctgctgacaactagtgagggagccgacgagccgcaacgtctgcagtttcctcttcccacggcacagcgcagcttagagcccggtacaccgcggtgggccaattacgtgaagggagtcatacagtactatccggccgcgccactgcctggattttccgccgtggtcgtgtcgtccgtccccttgggtggcggattgagttcgtcggctagcctggaagtcgcgacgtacaccttcttgcagcaactgtgtcccgacagcggcacgatcgctgcccgagcacaagtctgccaacaggcggagcattcatttgccggaatgccgtgcggcattatggaccagttcatttcccttatgggtcagaaaggacacgccttactgattgactgccgctctctagagaccagtctggttccattatccgatccaaagctggccgtgttaatcacgaattccaatgtgcggcactccctagcgtcgtcggagtacccggtgcgccgacgtcagtgtgaagaggtagccagagccttgggcaaggagtctctgagagaggtgcagttggaggagctagaggccgctcgcgacctggtctcgaaggaaggattccgcagggcccgtcacgtggtcggcgaaattcgccgcacagcgcaggcagcagcggctttgcggcggggagattatcgtgcgttcggccgtctgatggtcgaatcccataggagtttaagggacgactacgaggtgagctgccctgagttggatcagctggtagaggccgcgctggctgtgccgggtgtttatggttcccgcatgacgggtggaggctttggaggttgcactgtgaccttgttggaagccagcgctgccccccacgcgatgagacatatccaagagcactacggagggacagcgaccttctacctgtcccaagccgctgatggcgccaaggtgctgtgtctc

SEQ ID NO: 11903 - DNA, 1176 bp, Artificial Sequence
  Description of Artificial Sequence: Synthetic coding sequence
atggccgccctacggcagccccaggttgccgaactcctggcagaagcgcggagagcgttcagagaagagttcggtgcagagccagagctcgcggtctcggcccccggtcgggtaaatctgattggcgagcacacggactataaccagggtctggtgctgccaatggccttggaactgatgacagtgctggtgggctcaccacgcaaagacggactggtgtcgttgcttaccactagcgagggggctgacgaaccccagagactgcagttccccttgcctaccgcccaaagatccctagaacctggcacacctaggtgggcgaattatgtgaagggggtcattcaatactatccggccgcaccgctgcctggattcagcgccgtcgtagtgagcagtgttccactgggcggggggcttagttcatctgcgtctttagaggtcgctacctacaccttcctccagcagttgtgccccgattccggtaccattgctgctagagctcaggtctgccagcaggcagaacatagcttcgccggcatgccttgcggaatcatggatcagtttatcagcttaatggggcagaaagggcatgccctactgatagactgtagaagtctcgagacatcattggtgcccctgagcgatccaaagctcgctgttctcatcacaaacagtaatgtgaggcactcactggcttcctcagagtaccccgtcagaagacgccagtgcgaagaagtggcccgagccctaggcaaagagtccctgcgcgaggtgcaactggaggagctcgaggccgcacgcgacctcgtcagtaaggagggatttcgccgtgcacgacacgtggtgggcgagattcgaaggacagcccaggccgccgctgctttgcgccgcggcgactatagggctttcgggcgactgatggtggaatctcatcggagcctgcgggacgactatgaagtgtcttgcccagagctagatcagctagttgaggcagccctggctgtgcctggcgtgtacgggtccagaatgacgggcggtggcttcgggggttgcactgtgactttacttgaggctagtgccgcgccccacgccatgaggcacattcaggagcattacggcgggacggccaccttttacctgagccaggccgccgatggagctaaggtgctatgcctc

SEQ ID NO: 11904 - DNA, 1176 bp, Artificial Sequence
  Description of Artificial Sequence: Synthetic coding sequence
atggcagctttgagacaaccccaggttgcggagctgctggccgaagcaaggagagccttccgcgaggagtttggtgcagagcctgaattggctgttagtgctccaggaagagtgaacttgataggtgagcatacagactataaccagggactggtcctgcctatggccctggagctgatgaccgtcttggtgggtagccccaggaaggacggcttggttagtctgcttacaaccagtgagggtgcagatgagccacaacgcctgcaattccccctgccgaccgctcagaggagcctggaaccgggcactcccagatgggctaactacgtaaagggtgttatccagtactaccccgcggcccccctcccgggcttcagcgctgtggtcgtgagctcagtgccgctgggaggcggccttagcagctcagccagcctggaggtggcaacgtataccttcctgcagcagctgtgccctgacagcggtaccatagccgctagggctcaagtgtgtcagcaggctgaacacagcttcgctggaatgccttgtggcatcatggaccagttcatctccctgatgggacaaaaaggccatgctttgctcattgattgcaggtccttggaaacgtcactggtgcccctgtccgatcccaagctcgcagttttgatcaccaactctaacgtcaggcatagtctcgcaagttcagagtatccagtgcgcaggagacaatgcgaagaagtggccagagccctgggcaaggagagtctgagagaagtccagctggaagaactggaggccgccagggacctggtttccaaggagggcttcaggagagctaggcatgtggtgggagagattcgcagaactgcccaggccgctgccgcactcaggcgcggtgattaccgcgcctttggtagactgatggtggagagccacagatctcttagggacgattacgaggtgtcatgccctgagctggaccaactggtagaggcggccttggctgtgccaggtgtgtacggttcccgcatgactggcggaggattcggtggttgcacagtcacgctgctggaggcaagcgccgcaccacatgccatgaggcacatccaggagcattacggtggaacggctacattctacctgagccaagcagccgatggcgccaaagttctgtgtctt

SEQ ID NO: 11905 - DNA, 1176 bp, Artificial Sequence
  Description of Artificial Sequence: Synthetic coding sequence
atggctgcactccggcagccccaggtggctgagctgttggccgaggcaagaagggcatttagggaggagtttggagcagagccagagctcgccgtatctgcgccagggcgggtgaacttgatcggagagcacacagattataatcaaggcctagtactgcctatggccttggagctaatgacagtcctcgtgggaagtcctcggaaagacgggctcgtgtccttattaacgacatctgaaggcgctgacgaaccccagagacttcagtttccactgcccactgctcagagaagtctcgaacctggtacccctaggtgggcaaattacgtgaagggtgttattcaatactacccagccgcgcccttacctggcttttcggctgttgttgtgagctcggtgcccctgggtggcggcctgtcatcttccgcaagcttagaagttgctacgtacacctttctccagcagttgtgcccagactctggcactatcgccgcacgcgcacaagtgtgtcagcaggccgaacacagctttgccggtatgccctgcgggattatggatcagttcatctccctcatggggcagaaaggacatgccttgctaattgattgcaggtccctggagacttccctcgtgccactttctgacccgaaactcgccgttttgattactaattcaaatgtaagacatagtctggcaagctctgaataccccgtgcggcgcaggcagtgtgaagaggtggcccgggcccttggaaaggagtctttacgagaggtccagttggaagagctcgaagcagcaagggatctggtctccaaggagggctttagacgagctcgacacgttgtcggcgaaattaggaggacagcccaggctgctgcggcacttcgtcggggcgactatagggctttcggtcgcctgatggtcgaatcccataggtcgcttagggatgattacgaagtctcctgtccagaactcgatcagctcgttgaggcggcgctagctgtccccggggtttatggctccagaatgacagggggcggatttggcgggtgtaccgtcacattgctcgaagcttccgccgctccgcatgccatgagacatatccaagaacactatggtgggactgccactttttacctatctcaggctgccgatggcgcaaaagttttgtgcctg

SEQ ID NO: 11906 - DNA, 1176 bp, Artificial Sequence
  Description of Artificial Sequence: Synthetic coding sequence
atggccgcactccggcagcctcaagtcgccgagctcctggcggaagcgcgcagagccttccgggaagagtttggagccgaaccggaacttgcggtgtcagcccctggccgcgtgaatctcatcggtgagcacaccgactacaatcaagggctggtcctgcccatggcccttgagctgatgaccgtgctcgtcggatcgccacgcaaagacggcctggtttcgctgttgaccacctcggagggcgctgacgagccccagcgcctccagtttccactgccgacggcccagcgctcgttggaaccgggaactccgaggtgggctaattacgtgaagggagtgatccagtactacccagccgctcccctccctggattttcagcagttgtagtctcatcggtgccactcggtggcggactgagctcctcggcctcactggaagtggcaacgtacactttcctccaacagctgtgcccagattccggcaccatcgccgcgcgcgcccaggtctgtcagcaggctgagcattcgttcgccggcatgccatgcggaatcatggaccagtttatcagcctgatgggacaaaaagggcacgcgctgctcatcgattgccggtcgttggagacgtcgctggtcccgctgtcagatccgaagttggcggtgctgatcacgaactcaaacgttagacactcccttgcgagctcagagtaccccgtgaggcgaaggcaatgcgaagaagtggcccgcgccctgggaaaggagtccttgcgcgaagtgcaactcgaagaactggaggcagcccgggacctggtgtcgaaagagggattccgcagggcaaggcacgtggttggcgagatccgccggacggcccaggccgctgcggctctgagacgcggagactaccgagccttcggaagattgatggtggagtcccaccgctcactgagagacgactacgaggtgagctgcccagaactggatcaactggtggaggcggcgctggcggtgccgggagtgtacggatcgaggatgactggcggagggttcggcggatgtactgtcaccctgctcgaagcctctgctgctcctcacgccatgcgccacatccaagaacattacggcggaaccgcgaccttctatctttcgcaagctgcagacggagccaaggtgctgtgcctc

SEQ ID NO: 11907 - DNA, 1176 bp, Artificial Sequence
  Description of Artificial Sequence: Synthetic coding sequence
atggcagcgcttcgacagcctcaggtggctgagctactggcagaggcccgaagagccttcagggaggagttcggagccgaacctgagcttgctgtctccgccccaggccgagtcaatctgattggcgagcacaccgattacaaccagggattggtgctgccaatggccctggaactcatgacagtgctggtgggctccccccgcaaggacggcttagtgtctctcctcacgacatctgagggggccgatgagcctcaaaggctccagttcccactacccactgcccagaggtcactggagcccgggactcctcgatgggcaaactacgtcaaaggcgtgattcagtactacccggctgcccctctccctggcttttccgcagtggttgtgtcctcagtccctctgggggggggcctgtcatcctcagcaagcctggaggttgccacttacaccttcttgcagcaactgtgccccgatagtggcactatcgccgctcgagcacaggtttgtcagcaagccgagcattctttcgctggaatgccctgtggtattatggaccagttcatttctttgatgggtcagaaagggcatgccctgctgatagactgtagatctctggagaccagcctcgtaccactgagtgatcccaaactggcggttcttataaccaattctaacgtgcgacattcgcttgcaagctcagaatatcctgtgcgacgtaggcagtgcgaggaagtggctagggcactggggaaggagtctcttagggaagtccaactggaagaactggaggctgccagagacctggtgtcaaaggaggggttcagaagagccaggcacgtggtcggtgagattcggaggacagcacaggccgcagcagctcttcgtcggggcgactacagagcttttggccgtctgatggtggagagtcaccgatccctccgggacgactatgaagtgtcttgcccggaactagatcaactggtggaggcggctctcgcggtgcccggagtgtacggttcccgcatgaccggcggcgggttcgggggctgcactgtgaccctgctagaagccagcgccgcgccccacgctatgcgacatatacaagaacactacgggggaactgccacattttatttgagtcaagccgcagatggcgccaaagtcctttgtctc

SEQ ID NO: 11908 - DNA, 1176 bp, Artificial Sequence
  Description of Artificial Sequence: Synthetic coding sequence
atggctgccctcaggcagccccaggtagcagaactgttggcagaagcacggcgcgccttccgagaggagttcggcgccgaacccgagctggccgtgtccgcccccggacgagtgaacctgatcggcgaacatacagattataatcagggattggtcctgcctatggcactggagctcatgactgtcttggtgggctctccgcgcaaggatgggcttgtcagcttgctgactacctccgaaggagctgatgaacctcagagactgcagttccccctccccactgcgcagcgctcccttgagccgggcactccaagatgggcgaactatgtcaagggcgtaatccagtactaccccgcagcgcctctgcctggcttttccgccgtggtagtgtcctctgtccctcttggtggtggcctgagttcaagcgcgtccttggaagtcgcgacttacacctttctgcagcagctctgcccggacagcggcacgatcgctgctagggctcaggtgtgtcagcaggctgaacatagtttcgcgggcatgccatgcggtataatggaccaatttattagcctcatgggccagaaaggccacgcccttcttatcgactgccggtccttggagacttctctggtgccgcttagcgaccccaaacttgccgttcttataactaattcaaacgtgagacactcactcgcctcttccgagtaccccgtccggaggagacagtgcgaggaagtggccagggcccttggcaaggagtcactgcgggaggttcagctggaggagcttgaagcagctagggacctggtgtctaaggagggattcagacgcgcccgccatgtggtgggggaaatccggaggacagcccaagccgcagctgccctgaggagaggggattaccgggcgttcggtaggcttatggtggaaagccacagaagccttcgagatgactacgaggttagctgcccagagctggatcaactggttgaggcggcactggcagtccctggagtttacggaagtagaatgaccgggggaggttttggcggttgtaccgtgaccctgctcgaggcgtccgccgcacctcacgccatgcgccacatccaggagcattacggtggaaccgctactttctatctctctcaggcagccgacggtgccaaggtgctgtgtctg

SEQ ID NO: 11909 - DNA, 1176 bp, Artificial Sequence
  Description of Artificial Sequence: Synthetic coding sequence
atggccgcactgcggcagccacaagtggctgaactgctggcggaggccagacgggcgtttcgagaggagtttggagctgagcctgagttggctgtttccgcgccgggtagagtgaatctcatcggagaacacaccgactacaaccaaggccttgtcttacccatggcactggaactgatgactgtgctggttgggtctccgagaaaagacggcttagttagccttcttaccacttccgagggcgcagatgagccgcagcggctgcagttcccattgcctacagcccagcgcagcttggaaccaggcacaccaaggtgggccaattacgtgaaaggggttattcagtactatcctgcagcaccactgccaggattctccgccgtcgttgtctccagcgtccccctggggggggggctgagctcgagcgcctctctggaagtggccacatacacctttcttcaacagctctgtccagattcaggaacgatcgccgcgcgggcccaggtgtgccagcaagcggagcatagtttcgccggtatgccatgcgggatcatggatcaattcatctccctgatgggccagaagggccacgctttgctgattgattgcaggagccttgaaacctccctggtgccgttgtcagaccctaaactggccgtcctgattactaatagcaacgttcgccacagcctcgctagcagtgaatatcctgtaagacggagacagtgtgaagaggttgccagggccctgggaaaagagagtctgcgggaagtgcaactggaagagttagaggccgctcgggatctcgtaagtaaagaaggctttcgccgagccaggcatgttgttggagagatccggcgtacggcccaggctgccgcagctctgaggcgcggcgactatagggcttttggacggctgatggtggaatcccatcgaagcctgagggatgattatgaagtgtcttgtccagaattggaccaactggttgaggccgccctggctgtccctggagtttatggaagtcgtatgactggcggaggtttcggcggctgtaccgtgaccctccttgaagctagtgccgccccacatgctatgcgccacatacaggaacattacggtggcacagccacgttctatctgtctcaagctgctgacggagccaaagtcctgtgtctg

SEQ ID NO: 11910 - DNA, 1176 bp, Artificial Sequence
  Description of Artificial Sequence: Synthetic coding sequence
atggccgcactgcgccagccgcaggttgctgagctcctcgccgaggcccgcagagcctttcgggaggagtttggcgctgaaccggaacttgcggtgtcagcccccgggcgtgtgaatctcatcggggagcacacagattacaatcagggcctggttctgccaatggcactagagctcatgacagttttggtcgggtcaccgagaaaagacgggctggtgagcctgctgacaactagtgaaggtgcagatgaaccgcagcggctacagttccccttgcccacagcacagagaagcctggaacccggcacaccccggtgggccaactacgtcaaaggggtcattcagtattatcctgccgccccactccccggtttctcagccgttgttgtttccagcgtaccacttggcggaggcctttcttcatccgctagtcttgaggtggccacatacactttcttgcaacagttgtgcccagactccggaacaatcgcggccagggctcaggtatgtcagcaggcagaacactcattcgccggtatgccctgtggtattatggaccagttcatcagtttgatgggtcagaagggccacgcgctgctcatcgactgtcgttctcttgaaacatcactggtgcctttgagcgacccgaagctagctgtgcttattacgaattctaacgtccgccactccctggcatcgagcgaataccccgtccggagacggcagtgcgaagaggtggcccgcgccctggggaaggaatcgctgcgcgaagtgcagctcgaggagttagaagcagctagagatttggtctccaaggagggttttcgtcgcgctcggcacgtcgtgggggaaattaggcggacagcgcaagccgctgccgcattgcggcgaggtgattatcgagcatttgggcgattgatggtagagtctcatagatcactcagagacgattatgaagtgagttgtcctgagcttgaccagctggtagaagctgcccttgcagtccccggagtgtacgggtccaggatgactggaggggggtttggaggctgcacagtgaccctcctggaggcaagcgcagccccacatgctatgcgacacatacaggagcactatggaggtaccgccaccttttacctgagtcaggccgccgatggcgccaaagtcctgtgtctg

SEQ ID NO: 11911 - DNA, 1176 bp, Artificial Sequence
  Description of Artificial Sequence: Synthetic coding sequence
atggcagcactgcggcagccacaagtcgccgagctccttgcggaggcgaggcgtgccttcagagaagagtttggtgcagaaccggaacttgccgtgtcggctcctggcagggtgaacttgattggagaacacaccgactacaatcagggtcttgtgctccccatggccctggagttgatgactgtgttggtcggtagcccaaggaaagacggtctggtgagcctgctcaccactagtgagggtgcagatgaaccacagaggctgcaattcccgcttcctaccgcacagcgaagcctcgaacccggcacgccaaggtgggctaactacgttaagggagtgattcaatactatcctgcagcccctctgcctggtttttcagcggtcgttgtctcctcagtgccacttggtggaggcctgtcgtcctcggcatcgctggaagtggcaacttacacctttttgcaacagctgtgccccgatagcggcaccatcgcagcgcgggcacaggtctgccaacaagcagagcattcgttcgcgggtatgccatgcggaattatggatcaattcatttcactgatgggccagaagggacacgctcttcttattgactgtcgatcccttgaaacctcccttgtgcctctgtccgatccaaaactggcggtccttattactaacagcaacgtgcgccattcactggcatccagcgaatatccagtgcgtcgacgccagtgtgaagaagtggcccgcgcattgggaaaggaatccttgcgagaggtccaactggaggaacttgaagctgcaagggatctcgtgtctaaagagggctttagaagggcacggcatgttgtgggagaaatccgccgcacggcacaagcagcagcagccctcagacggggagattatcgagccttcggacgtcttatggtggagtcgcatagatcactcagagacgattatgaagtgagctgtccagaactcgaccaactggtggaggcagccctggcagttccgggggtctacggatcccgaatgaccggtggaggattcggtggatgcaccgtgactctgctggaagcatcggcagcgccgcatgcaatgaggcacattcaagagcactacggtggaactgcaaccttttacctgagccaggctgcggacggtgcaaaggtgctgtgtctg

SEQ ID NO: 11912 - DNA, 1176 bp, Artificial Sequence
  Description of Artificial Sequence: Synthetic coding sequence
atggctgcactgcggcagccacaggtggcagagctcctcgctgaggccagaagagcattccgggaggaattcggagcggaaccggaactcgccgtctccgcgcctgggagagtcaacttgatcggtgagcacaccgactataaccagggactggtgctgccgatggcacttgagctgatgactgtgttggtcggctcaccaaggaaagacggactcgtgtcactcctgactacttcagaaggagcagacgaaccacaacggctgcaattcccactccccaccgcccagcggtcactggagcctggtacgccacggtgggcaaactacgtcaagggtgtgatccaatactaccctgccgcgccattgccggggttctcggccgtcgtggtgtcatccgtgccgctgggaggcggactctcgagctccgcctccctggaagtggcgacctacactttccttcaacaactctgtccggattcaggaaccatcgcggcccgggcacaggtgtgccaacaggccgagcactcgtttgcgggaatgccttgtggaatcatggatcagttcatctcactgatgggacagaagggccacgcgttgctcatcgattgccgctcgctcgagacttccctggtgcctctgagcgacccgaagctggcagtgctgatcaccaacagcaatgtccggcactcgctcgcatcaagcgagtaccctgttcgccgccggcagtgcgaggaagttgcccgggcgctggggaaggaatcgcttcgcgaagtgcaactggaagagctggaagccgcccgcgatctggtcagcaaagagggcttccgtcgcgcgcggcacgtcgtgggagaaattaggcgcaccgctcaggctgctgctgccctcaggcggggagactacagagccttcggccggcttatggtggaaagccacaggtcgctgcgggatgattacgaggtgtcgtgcccagagctggaccagctggtggaagccgcacttgccgtcccgggagtctacggatcccggatgacgggaggcggatttggaggatgtactgtcactctgctcgaagcgtcggctgcaccgcatgctatgaggcatatccaggaacactacggaggcactgcaactttctacctctcccaagcagcagacggggcaaaagtgctgtgtctg

SEQ ID NO: 11913 - DNA, 1176 bp, Artificial Sequence
  Description of Artificial Sequence: Synthetic coding sequence
atggctgccctgaggcaaccgcaggtggccgaactgctggccgaagctcgtcgcgcgttcagggaagagttcggggcagagccggaactggcggtgagtgcgcctggacgggtgaacctgatcggcgagcacaccgattacaaccaggggttggtcctgcccatggccctcgaactgatgactgtcctggtgggaagcccgcggaaagacggactcgtgagccttctcaccacttccgaaggcgccgatgagcctcagcgccttcagttcccgttgccaaccgcgcaacgcagcctcgaacctggaaccccgcggtgggcaaactacgtgaagggagtgattcagtactatccggcggcgccgctcccaggatttagcgccgtcgttgtaagctcggtgccactcggaggcggcctcagcagcagcgcgtcactggaagtggctacgtacactttcctgcagcagctttgccccgactccggtaccatcgccgccagggcccaagtgtgccaacaggcggaacactcatttgctggtatgccgtgtgggatcatggaccagtttatctcgctcatgggacagaaaggccacgcactgctcatcgactgccgttcactcgaaaccagcctggtgccactcagcgatcccaagctcgcggtgctgattactaactcgaatgtgcgccactcgctggcatccagcgaatacccggtgcgccgccgccaatgcgaggaagtcgcgagagcactcggaaaagaatcactgcgcgaggtgcagcttgaggagctggaagcggccagagatttggtcagcaaggaaggattcagaagggctcggcacgtggtgggagaaatcagacgcacggcgcaagccgcggccgcactgaggcgcggcgattaccgggccttcggacgcctcatggtggagtcccacaggtccctgagagacgactacgaggtgtcctgtcctgaactcgatcagctggtggaagccgcactcgcggtgccgggagtgtacggttcgaggatgaccggaggtggattcggaggatgcaccgtgactcttttggaagctagtgctgctccgcatgccatgcgccatattcaggagcattacggtggaactgcaaccttttacttgtcgcaagctgccgatggagctaaggtcctgtgcttg

SEQ ID NO: 11914 - DNA, 1176 bp, Artificial Sequence
  Description of Artificial Sequence: Synthetic coding sequence
atggccgccttgaggcagccacaggtggctgaactgctcgccgaagcgcggcgcgcctttcgggaggagttcggagccgagccggagctggcagtgtcagcgccgggaagggtgaatctgattggagaacacaccgattacaaccagggactcgtgctcccgatggcgctggagctcatgactgtcctcgttggatcgccgcgaaaagatggattggtgtcgctgcttaccacttcagaaggagcggatgaaccacaacgcctgcagtttccgcttccaaccgcacaacggtccctggaacccggcacccctcgctgggccaactacgtcaaaggcgtcatacagtattacccagcggcccccctgcccgggttctccgccgtggtggtttcgagcgttccactgggaggaggactctcttcgtccgcatccttggaggtcgccacctacactttccttcagcagctgtgccctgactcaggcaccattgctgctagagcccaagtgtgtcagcaggccgaacattcgttcgcgggcatgccgtgcggcatcatggaccagttcatctcactgatggggcaaaaagggcatgcacttttgatcgactgcagaagccttgagacgtctctggtcccgctgtcggaccctaagttggcggtcttgatcactaattcgaacgtgagacactccctcgcatcctcagaatatcctgtccgtaggcggcaatgcgaagaggtcgctcgggcgttgggaaaggagagcctccgggaagtgcagctggaggaactcgaagcagccagagatctcgtttcgaaggagggattccgtagagcacgccacgtcgtgggtgaaatccggcggactgctcaagcggccgccgccctccggagaggtgactacagagcctttgggcgccttatggtggaaagccaccggtcactgagagacgactacgaagtctcgtgtccggagctggatcagctggtcgaagcggccctggcagtgccgggagtgtacggctcgcggatgactggagggggtttcggcggatgcacggtcacgctcctcgaggcatccgccgcgcctcatgctatgcggcacatccaggaacattacggcggcaccgccacgttttacctcagccaggctgcagacggtgctaaggtcctgtgcctc

SEQ ID NO: 11915 - DNA, 1176 bp, Artificial Sequence
  Description of Artificial Sequence: Synthetic coding sequence
atggcagcgctccgccagcctcaagtggcggagctgctcgccgaagcacgccgggcgtttcgagaagaatttggggcagaacccgaactggccgtgtcggctccaggacgcgtaaacctgattggggagcataccgattacaatcaaggactcgttcttcccatggcccttgagctgatgaccgtgctggtgggcagcccaaggaaggacgggcttgtgagcctgcttaccacctcagagggagcagatgagcctcaacggctccagttccctcttcctacggcacaacgctcgctggaaccaggcaccccacgctgggcaaactacgtgaagggtgtcattcaatactaccctgcagcaccacttcctggcttctcggcagtcgtggtgtcaagcgtgccacttggcggaggactgtcatcaagcgccagtttggaagtggccacctacacctttctccaacagctgtgtcccgactccggcactattgcagcccgggcacaggtgtgtcaacaagcagaacatagcttcgctggtatgccctgcggtataatggaccagtttatctccttgatggggcaaaaggggcatgcactgttgattgactgtagaagcctcgaaacttcgcttgtgcctctttccgatccgaagctcgctgtgctcattaccaactccaatgtgcggcattcgctggcaagctccgaataccctgtccggagacgccagtgtgaggaagtcgctagagcgctgggaaaggaaagccttcgggaagtgcagctcgaagaactggaggcagcacgtgatctggtgagcaaagagggttttcgcagagcaagacatgtggtgggcgagattcgtcgtacggcccaggcagccgcagcccttcgacgcggggattaccgcgcctttggacggctgatggtcgaaagccatagaagccttcgagatgactacgaggtgtcatgtcctgagcttgatcagctcgtggaagcagcccttgcggtgcccggcgtgtacggctccaggatgactggaggaggttttggaggttgtactgtgactctgctggaagcgtcggcggcacctcatgcgatgagacacatccaggaacattacggaggcaccgccacgttttacctcagccaggccgcggatggagcaaaggtgctctgcctt

SEQ ID NO: 11916 - DNA, 1176 bp, Artificial Sequence
  Description of Artificial Sequence: Synthetic coding sequence
atggctgccctgaggcaaccgcaagtggcagagctcttggccgaggcgagacgggccttcagagaggagttcggcgctgaacccgagctcgcagtgtcggccccgggtcgcgtcaatctgataggcgagcatactgactacaaccaaggattggtgcttccgatggccttggaacttatgactgtacttgtggggtccccgaggaaagacggactcgtgtccctgcttactaccagcgaaggggcagacgaaccgcagagactccaatttccgctcccaaccgctcaacgatcactggagcccggcacgcctagatgggcaaactatgtgaaaggagtcatccagtactacccggcggcaccgctgccaggattttccgccgttgtcgtgtcatctgtgcccctgggtggcgggctgtcgagctccgcatccctggaagtagccacctataccttcctgcaacagctctgccccgactcaggcaccatcgccgcccgcgctcaggtctgccagcaggcggagcactctttcgcaggaatgccatgcggcattatggatcagttcatctcactgatgggtcaaaagggccatgccctgctgatcgactgccgctcgctggaaacttcactcgttccgttgtctgaccccaagttggctgtgctcatcaccaattccaacgttagacacagcctggcaagcagtgaatacccagtgagacggaggcagtgcgaagaagtcgcccgggctttgggaaaggaatccctcagagaagtgcagctcgaagagctggaagccgcccgcgatctggtgtccaaggaaggttttcggagagcgcggcacgtggtcggagagattcgcaggactgctcaggccgcggccgcgctgcgcagaggagattaccgagcgttcggtcgcctgatggtggaatcacatagatcactcagggatgattacgaagtttcgtgtccagaactggatcaactggtggaggccgccctggcagtgccaggcgtctacggatcgaggatgactggcggagggtttggagggtgtaccgtgacgctgctggaggcctcggctgcacctcacgccatgcgccacatccaagagcattacggaggaacggcaaccttctacctctcccaggcagcggacggagccaaagtgctgtgtctc

SEQ ID NO: 11917 - DNA, 1176 bp, Artificial Sequence
  Description of Artificial Sequence: Synthetic coding sequence
atggcagcgctgcgtcaaccgcaagtggctgaactgcttgccgaggcccggagggcctttagagaagaatttggtgcggaaccagagctcgcagtgtcagcacctggtagggtcaacctgataggggagcacactgactacaaccaaggtttggtgctgccaatggcactcgaattgatgaccgtccttgtgggatccccacgtaaagacggacttgtctcccttctgacgaccagcgaaggagcggatgagccccagaggctccagtttcccttgcccaccgcacagcggtcacttgaaccgggaacccccagatgggcaaactacgtcaagggagtcatacaatactacccggcagcacccctgccaggatttagcgcggtggtcgtgtcgagcgtccctctgggcggcgggctttcgtcctcagcatctctcgaagtggccacctacacgttcctgcagcagctttgtcctgactcaggaacgattgcagcgagggcacaggtgtgccaacaagcagaacactcattcgcagggatgccttgtggaattatggatcaattcatctccctgatggggcagaagggccatgctcttctgattgattgtagatcgctggagacttcgctcgtgccgctctcggaccctaagctggcggtgctcatcaccaattccaacgtgcggcatagccttgcctcctcggaatacccggtgagacgccgccagtgcgaagaagtggcaagagcactgggtaaagagtcactgcgcgaggtccagctcgaagaactcgaagccgctcgcgacctcgtctcaaaggagggttttcggcgagcgcgccatgtcgtgggtgagattcggaggacggcacaagccgcagccgcgttgagacgtggagactatcgggcctttggacgtctcatggtcgagtcacatcggagcctgagagacgattacgaggtgtcgtgcccagagctcgatcagcttgttgaagcagcactcgccgtcccgggcgtgtacggtagccggatgacgggtgggggctttggaggctgtaccgttactctgctcgaagcatccgcagctccacacgccatgaggcatatccaggaacattatgggggtactgccactttctacctctctcaggcagcggacggcgccaaagtgctgtgcctt

SEQ ID NO: 11918 - DNA, 1176 bp, Artificial Sequence
  Description of Artificial Sequence: Synthetic coding sequence
atggcagctctgagacaacctcaggtggcagaactgcttgctgaggcccggagagccttccgcgaggaattcggagcagaaccggagctggctgtgtctgcaccgggacgcgtaaatctgatcggcgagcacaccgactacaatcaaggcctcgtgctcccgatggccctcgaactcatgactgtgttggtcggttcccccaggaaagacggcctggtgagcctgctgaccacgagcgaaggagcggatgaaccgcaaagacttcagttcccgctgccaaccgcccaacggtccctcgaaccaggaacgccgcgctgggcgaactacgtgaagggagtgattcaatactaccctgcagcacctctcccgggcttctccgcagtggtggtttcgtcggtccctctgggcggtggactgtcgtccagcgcctcactcgaggtcgcaacttacacgttcctgcagcagctctgcccagatagcggcactatcgcagcgcgcgcccaggtttgccagcaggccgaacattcgttcgcaggcatgccgtgcggtataatggaccagtttatcagcctgatgggacaaaaggggcatgccttgcttatcgactgccggtccctggaaaccagtctggtgcccctctcagatcccaaacttgccgtcttgatcactaactccaacgtgcggcactcgttggcatcgtccgagtaccccgtgcgaaggaggcagtgtgaggaagttgctagggccttgggaaaggagtcactgcgcgaggtacaactggaggaactggaagcggcccgcgacctcgtgtcaaaggagggctttagaagagcacggcacgtggtaggggaaatcagacgtactgctcaggcggcagccgcccttcgccgtggcgactacagagcatttggacgactcatggtggagtcccatcggtcgctccgcgatgactacgaagtgtcgtgtccggaactggatcaattggtggaggccgccctcgccgtcccaggggtgtatggatcgcggatgaccggaggcggcttcggcggatgcactgtcaccctgctggaagcatctgctgccccacatgcgatgcgccacatccaggaacactacggaggtactgccactttctacctgtctcaggcagcggatggagccaaggtcctgtgcctt

SEQ ID NO: 11919 - DNA, 1176 bp, Artificial Sequence
  Description of Artificial Sequence: Synthetic coding sequence
atggctgccttgagacagcctcaggtggccgaactcttagcagaagcccgtcgagcctttagggaagaatttggggctgagcccgaactggccgtcagtgcacctggacgggtgaatttaatcggggaacacaccgactacaaccagggtctggtgcttcccatggcactagaattgatgacggtgctggtggggagtccaaggaaggacggcctggtttcactgttgaccactagcgaaggagcagatgagcctcagaggttacagtttccgctccctactgcgcagagatctctcgaacctggcactcccagatgggcaaactacgtaaagggagtgattcagtattatcccgccgctcccctgcccggctttagtgctgtggttgtttctagcgtgcccctgggtggaggattatccagtagtgcatccttggaggtcgcgacatacacttttctgcaacagctctgcccagatagcgggacgattgcggctagggctcaagtgtgtcagcaggccgagcactcctttgccgggatgccctgtggaattatggatcagtttatttccctgatggggcagaagggtcacgccctgctgattgattgccgatccctggagacatccctggtgcctctttctgatccaaagctcgcagtgctgatcactaattctaatgtccgtcatagcctggcctccagcgaataccctgtgcgaaggagacagtgtgaggaggtcgcgcgagccctcgggaaagagtctctccgggaagtgcagctggaggaactagaggctgcaagagatctggtgtccaaggagggttttcgtcgagcccgccacgtggtgggagagatccgcaggacagcacaagcagccgccgccctgaggcgaggagattatagagcttttggccggctcatggttgagtctcatcgctctctgcgggatgattacgaagtttcatgtcccgagctggaccagctcgtggaggcggctctggccgtgccgggcgtctacggatcacggatgaccggaggtggctttggcggctgtaccgtcacactgcttgaggccagcgcagcccctcatgccatgagacatattcaggaacactatggtggtactgcaactttttacctgagtcaagctgcggacggcgctaaagtgttgtgccta

SEQ ID NO: 11920 - DNA, 1176 bp, Artificial Sequence
  Description of Artificial Sequence: Synthetic coding sequence
atggctgcgctgcgccagccacaggtggccgaactccttgcagaagcccgcagagccttccgggaagaatttggagctgagcccgagctggcagtgtcagcgccgggacgcgttaatctcattggagagcacaccgactataatcagggactggtgctgccgatggccctcgaactcatgaccgtcctggtgggttcgccacgcaaggacggacttgtgtctctcctgactacttcggagggagcagacgagccacaacgcctgcagttccccttgcctaccgcccaaaggtccttggaacctgggaccccgcggtgggcaaactacgtcaagggcgtgatccaatactacccggctgcacctctgccgggattctcggctgtggtggtgtcgagcgtcccgcttggcggtggactcagctcctcggcgagcttggaggtggccacttacactttcctccagcagctctgcccagactcaggcaccattgccgcgcgcgcccaggtgtgtcagcaggccgaacacagctttgcggggatgccgtgcgggatcatggaccagttcatctccctgatgggtcagaagggccatgcgctgctgattgattgcaggtcgctcgaaacttcacttgtgccgctcagcgacccaaaacttgcggtgctgatcaccaacagcaacgttaggcattccctcgcatcgtcggaatacccggtgcggcggcgtcaatgtgaagaggttgcccgcgccctcggaaaggagtccctgcgtgaggtccagcttgaagaattggaagcggcccgcgatttggtgtctaaggaaggattccgtagagcccggcatgtggtgggggaaatccggagaaccgcgcaggccgcggcagccctgcgacgaggggactaccgcgccttcggccggcttatggtcgagtcccataggagcttgcgggatgactacgaggtgtcatgccccgagctggatcaacttgtggaagcagctctggcggtccctggggtctacgggtcacggatgacgggaggaggatttggtggctgcacggtcactctgttggaggcatcagccgctccccacgccatgagacacattcaagaacactacgggggcaccgcgacgttctatctgtcccaagcggcagatggagccaaagtcctgtgcctg

SEQ ID NO: 11921 - DNA, 1176 bp, Artificial Sequence
  Description of Artificial Sequence: Synthetic coding sequence
atggcagcattgcggcagccacaggtggcagagctgttggccgaggccaggcgggccttccgtgaggagttcggtgcagagcctgagctggctgtttccgctcctggtagggttaatctcattggggagcatactgactataatcaggggctcgtgcttcccatggccctggagctgatgactgtgttagtaggctccccccgcaaagacgggttggtgagcctcctgaccacctccgagggcgccgatgaaccgcagcgccttcagttcccactccctactgcccagcgcagcctagagcctggtaccccccgctgggccaactatgtaaagggcgttatccagtattacccagccgcgcccctgcccggtttctcagcagttgtggtctccagcgtgcccttgggggggggcctctccagctcagcctccctcgaagtagccacttacacctttctccaacaactgtgtcccgatagcggaaccatagccgctagagctcaggtgtgccaacaagccgagcatagtttcgccgggatgccatgcggtatcatggatcaatttatctctctgatggggcagaagggccacgcgttgctaattgattgccgtagtctcgaaacgtcactcgtcccactgtcggatcccaagctggccgtgctcatcacaaatagcaatgtcaggcattccttggctagttccgagtacccagtacgcagaaggcagtgcgaggaggtggccagggccttggggaaagagagtctgcgggaagtgcagctggaagagttagaagccgcacgagatttggtgtccaaagagggctttagaagggcccgacatgttgtgggggagatccgcaggactgcacaggctgcagccgctttgaggcgcggcgattacagagcatttggcaggctcatggtagagagccaccgcagccttcgagacgactacgaagtgtcctgccccgagttggaccagctggtggaagccgccctggcggtcccaggcgtttatggctcacgtatgacgggtggtggatttgggggctgcaccgtcacacttttggaagcctctgctgctcctcatgcgatgcgccacattcaggagcattatggagggaccgccacattctatttgagtcaggcggctgatggggccaaggtcctgtgctta

SEQ ID NO: 11922 - DNA, 1176 bp, Artificial Sequence
  Description of Artificial Sequence: Synthetic coding sequence
atggctgctctaagacagccacaggtagccgagcttttggcggaggccaggcgggcttttcgggaggagtttggcgcggaacctgagctcgcggtgtccgcgcctggccgcgtgaatcttattggtgagcacactgactacaatcagggcctggttttgccaatggctttagaactgatgacagtgttagttggctcaccacgaaaggatggacttgtgtctctgctgactacgtccgagggcgctgatgagcctcagcgcttgcagttccctctacctaccgctcagagatcattagaacctggcactccgcgttgggctaactatgtgaagggggtcattcaatattacccggctgcacccctccccggattctcggcagtggtggtgtcttctgtgcccctcgggggtggattgtcatcatctgctagtttggaagtcgccacctacacttttttgcaacagctgtgccccgacagcggaacaatagctgcccgagctcaggtatgtcaacaggccgagcactccttcgcaggcatgccgtgcgggatcatggaccaatttatctcgcttatgggccagaagggacatgccctactgatcgactgccgctctctcgagacatccttagttcccttatctgacccaaagcttgctgtgctcattaccaacagtaatgtccggcactcactggcttcctcagagtaccccgtgcgccgccgtcagtgtgaagaagtggctcgtgccttgggaaaggagagcttacgcgaggtgcagctggaggagttggaggctgcacgagatctggtgagtaaggagggcttcaggcgggctcgccatgttgtgggtgagattagacggacagcgcaggccgcagcagccctcagaaggggagattacagagccttcgggagactgatggtggaaagccaccggtcacttagagacgattacgaggtctcttgcccggagctcgatcagctggtggaggcggcgctagctgtgcctggagtctacggctctcggatgaccggggggggcttcggtggctgcaccgtgacgctcctggaagccagtgcggccccccacgctatgagacacatccaggagcactatggcggaaccgccacattttaccttagccaggcagccgatggagccaaggtgctctgcctg

SEQ ID NO: 11923 - DNA, 1176 bp, Artificial Sequence
  Description of Artificial Sequence: Synthetic coding sequence
atggctgctttacgacaaccacaagttgcagaacttcttgctgaagcaagaagagctttcagagaagaattcggagctgaacctgaacttgctgttagtgcaccaggaagagtaaatttaataggtgaacatacagattataatcaaggtttggttttaccaatggctttagaacttatgacagttttagttggaagtccaagaaaagatggacttgtttcactattaactacttcagaaggtgctgatgaaccacaaagacttcaatttccattaccaactgctcaaagatctcttgaacctggaactccacgttgggccaattacgttaaaggtgttattcaatattacccagctgcacctcttccaggatttagtgctgttgttgtatcaagtgttccattaggaggaggtttaagttcgagtgcatctttagaagttgcaacttatacatttcttcaacaattgtgtccagattcaggaactattgccgctagagctcaagtttgtcaacaagcagaacatagttttgcaggaatgccatgtggaattatggatcaatttattagtttaatgggacaaaaaggacatgcattattgatagattgtagaagtcttgaaacatcattagtcccactttctgatccaaagttagcagttttaataactaattccaatgtaaggcattcattagcatcatctgaatacccagttagaagaagacaatgtgaagaagttgctcgagcattgggaaaagaaagtttacgagaagttcaacttgaagaattagaagcagctagagatttagtttcaaaagaaggatttagacgagctagacatgttgttggagaaatacgtagaacagcacaagcagcagctgcattaagacgaggagattatcgagcatttgggagacttatggtcgaatcacatagaagtcttagagatgattatgaagttagttgtccagaattagatcaattagttgaagctgctcttgccgttccaggagtctatggatcaagaatgactggtggagggtttggaggttgtactgttacccttttagaagcttcagctgcaccacatgcaatgaggcacattcaagaacattatggaggaacagctaccttctatttaagtcaagcagcagatggagcaaaagtattatgtctt

SEQ ID NO: 11924 - DNA, 1176 bp, Artificial Sequence
  Description of Artificial Sequence: Synthetic coding sequence
atggccgcactccgccaaccgcaggtcgccgagctcctggcagaggcacgaagggccttccgcgaggagttcggtgcagaaccggagctggcggtgtcagctcccggaagagtcaacctcatcggggaacataccgattacaaccagggcttggtgttgccaatggctctggagttgatgaccgtgctcgtcggatcaccgcggaaagatggacttgtgagcctcctgaccacgtcggagggtgccgacgaaccgcaacgtctgcagttcccactcccaactgcccaacggtccctggagcctggaacgccacggtgggccaactacgtcaagggagtgatccagtactaccctgcagcccccctcccgggattttcggcagtggtggtgtcgtcggtcccgttgggcggcgggctttcgtcctccgcatcgctggaggtggcaacgtacactttcctccagcagctctgcccggactcgggtaccatcgcggcgagagcacaggtgtgccaacaagccgagcactcgtttgcgggaatgccgtgtggtattatggaccaattcatttcactcatgggacagaagggacatgcattgctgatcgactgcaggtcgctggaaacttcacttgtgcctttgtcggacccgaagttggcggtcctgatcaccaactccaacgtgaggcactccctcgctagcagcgaatacccggtgcggagacgccagtgcgaagaagtcgcgcgggccctgggcaaggaatcactgcgcgaagttcaacttgaagagcttgaggcagcacgcgatcttgtgtcgaaggagggattcagacgcgcgagacacgtggtgggcgaaatccggcggactgctcaggccgcggccgcgctgcggcgcggggattaccgggcattcggtagactcatggtcgaatcgcatcgatctctcagagacgattatgaagtgtcatgccctgaactcgatcagctcgtggaggccgcgttggccgtcccgggagtgtacggttcgaggatgaccggcggtggattcggaggatgcactgtcaccctgctggaagcctcggcagccccgcatgccatgcggcatatccaggaacattacggcggaaccgctactttctacctctcacaagcagcggacggagcaaaggtcctgtgcctg

SEQ ID NO: 11925 - DNA, 1176 bp, Artificial Sequence
  Description of Artificial Sequence: Synthetic coding sequence
atggcagcccttaggcagccccaggtggcagagctgctggcagaagcccggcgcgcatttagggaagaatttggcgcagaacccgagctggctgtgtccgcaccaggtcgtgtgaatttgatcggggaacatactgattacaaccaagggctggtgctgccgatggcactcgaacttatgaccgtccttgtgggatcacctcggaaggacggccttgtgtcactgcttactaccagcgaaggcgcagatgaaccacaacggctgcagttccctcttccaaccgcacaacggagccttgagcctgggacccctaggtgggcaaactacgtgaagggtgtgattcagtattatcccgcagcacctctgcctgggtttagcgcagtggttgtgtcatccgtccccctgggcgggggactttcgagctcggcctcgctggaagtggccacctatacctttctccaacaattgtgccctgattccggtactatagcagcgagagcacaagtgtgtcaacaagccgaacatagctttgcggggatgccttgcggcatcatggaccagtttatctcgctcatgggacaaaaaggtcatgcgctccttattgattgtaggtcccttgaaacctcgctggtgccattgagcgatccaaaacttgcagtcctcataaccaactcaaatgtgcgccatagccttgcctcctcggagtaccctgtccgtagacgccaatgtgaagaagtcgcaagagcactcggtaaggagtcgcttcgcgaggtgcaactggaagaactcgaagccgcgagggatctcgtctctaaggaggggtttcgccgggccagacacgtggtgggtgaaattagacgcaccgcacaagcggccgcggcacttagaagaggcgactacagggcatttggaaggctgatggtggaatcacacagatctctgagggacgattacgaagtgtcgtgtcctgagctggaccagcttgtcgaggcagcccttgcagtcccaggcgtgtacggatcgagaatgaccggaggaggttttggcggctgcactgtgacccttcttgaagcctccgcagcaccccatgcaatgagacacattcaagagcattacggaggaaccgccactttctacctttcccaagccgctgatggagcaaaggtgctttgtctt

SEQ ID NO: 11926 - DNA, 1176 bp, Artificial Sequence
  Description of Artificial Sequence: Synthetic coding sequence
atggccgcacttcggcaaccgcaagtcgccgagcttctggccgaagcgcggcgggcttttcgcgaagagttcggagctgagcctgaactcgcggtgtcggctccgggccgcgtgaacctgatcggagaacatactgactacaatcaggggctcgtgcttccgatggccctggaactcatgaccgtgctggtgggctcaccgagaaaggacgggctggtgtccctcctgactacctctgagggagcggacgagccgcagaggctgcaatttcctctgccgacggcccaacgctcactggaacctgggactccgagatgggctaactacgtcaagggtgtgatccagtactaccccgcagcaccactcccgggcttctccgcggtggtcgtgtcctcggtgccgctcgggggcgggctgtcgtcgtcagccagcctcgaagtggctacttatactttcctccagcagctgtgtcctgattcaggaaccatcgcagctcgggcgcaagtgtgccagcaggcagaacattcatttgccggtatgccttgcgggatcatggaccagttcatcagcctgatgggacagaaagggcacgcgctgttgatcgactgtagaagtcttgagacttcgctcgtgcctctctccgacccgaagttggccgtgttgatcaccaatagcaacgtccgccacagccttgcttcgtcagagtacccagtccgacgccgccaatgcgaagaggtggcaagggcactcggtaaagaaagtttgcgagaggtccagctcgaagaactcgaagccgctcgcgacctcgtgtcgaaagaaggcttcaggagagcccggcatgtggtgggagagattcggcgcaccgcccaggcggccgcggcgctgcggcgaggagactaccgtgcgttcggacggctcatggtggaatcgcatcgctcgctgagggacgattacgaagtgtcatgcccagaacttgaccaactggtggaagccgcactcgccgtgcccggagtctacggctcccggatgaccggtggcggcttcggaggctgcactgtgacgttgctcgaagcgtcagcagcacctcacgcgatgcgccatatccaagagcactacgggggaactgccaccttctacctgtcgcaagcggctgatggcgcgaaagtcctgtgcctc

SEQ ID NO: 11927 - DNA, 1176 bp, Artificial Sequence
  Description of Artificial Sequence: Synthetic coding sequence
atggctgccctgaggcagccacaggttgccgagctgctcgccgaggctcgcagggcattcagggaggaatttggagcagaacccgagcttgcggtatccgccccaggcagggtaaaccttattggcgaacacacagactacaatcagggccttgtcctacccatggcactggagctgatgactgttctcgtgggttcgccccggaaggatggtttggtctccctactgaccactagcgagggcgcagatgaaccacaaagattgcagttcccactgcccacagcccagcgatcactcgaaccaggcacgccccggtgggccaattatgtgaagggcgtgatccagtactaccctgccgcaccgctccctggcttttccgcagttgtcgttagctctgttcccctgggaggggggctgtcctcctctgcatcactcgaagttgccacctatactttcctccagcagctctgtcctgactctggcacaatcgctgcccgtgcccaggtatgccagcaagccgagcactccttcgcgggaatgccttgtgggataatggaccagttcatttcgttaatgggtcagaaaggacacgctctcctgatcgactgccgctccctggaaacttctctcgtgcctctgagcgatcccaagctcgccgtgttgataacgaactcgaacgtacgtcactcgctcgcatcttctgagtatcccgtacgccgtaggcagtgtgaggaagtggcacgggccttgggcaaggagagtttacgagaggtccagcttgaggagctggaggctgccagggatctggtcagcaaggaaggatttaggagggcccggcatgtggtgggcgaaatccggaggactgctcaagccgctgcagccttacgcaggggcgactaccgtgccttcggccggctgatggtagagagtcaccgctctttacgtgacgattatgaggtctcctgccctgagctggatcagctggtggaagcagcgcttgcagtcccaggggtctacggcagcaggatgaccggtggcgggttcggcggttgtacagtcactctgctggaagcttcagccgcaccccacgccatgcgacatatccaagagcattacggcggaacagcgaccttctacctttctcaggctgctgatggagcaaaagttctatgttta

SEQ ID NO: 11928 - DNA, 1176 bp, Artificial Sequence
  Description of Artificial Sequence: Synthetic coding sequence
atggcggccctgcgccagccacaagtggccgagctcctcgccgaggcccgccgcgctttcagagaggagttcggcgcggagccggagctggccgtgtcagcccctggacgcgttaatctgatcggcgagcataccgactacaatcaaggacttgtcctgcctatggccctggagctgatgactgtactggtgggatcaccacgcaaggatggcctggtgtcgttgctgactactagcgagggagccgacgaaccacagagactccagtttcctctgccaactgcccaacgctcgctcgagcctggcaccccgcgctgggccaattatgttaagggcgtgatccagtactacccagccgcgcccctccctggattctccgcggtggtggtgtccagcgtcccgctgggcggtggactgtcgtcctccgcatcactggaagtcgccacgtacacctttctgcaacaattgtgcccggactcaggcaccatcgctgccagagcacaggtgtgccaacaggcggaacacagcttcgccggaatgccttgtggaattatggatcaattcatcagcctgatgggacagaagggccacgccctccttattgactgccgctcgctcgaaactagcctggtgcccctgtccgatcccaagttggcagtgctgatcacgaactccaacgttcgccattctctcgctagctcggagtacccggtgaggcgcaggcagtgcgaggaggtggccagggcactgggcaaggaatcgttgcgggaagtgcagctggaagaactcgaggcagccagagatctcgtgtcaaaggagggattccggcgcgcacgccacgtcgtcggagaaatccggcggactgcgcaggcggcagctgcgctgaggcgtggtgactaccgcgcattcggaaggctgatggtcgaatcccacaggagtctgcgggatgattacgaggtgtcgtgtccggaactggatcagctggtcgaggccgctctggccgtgcctggcgtctacggttcccgcatgacgggaggaggcttcggaggttgcaccgtcaccctcctggaggcttccgcggccccgcatgccatgcgccacatccaagaacactacggcggtactgcgactttctacttgagtcaagctgctgacggtgccaaggtcctttgcctt

SEQ ID NO: 11929 - DNA, 1176 bp, Artificial Sequence
  Description of Artificial Sequence: Synthetic coding sequence
atggccgctcttcgccagcctcaggtcgctgaactcttggccgaggctcgcagggcttttcgtgaggaattcggcgctgagccagagctcgccgtaagtgccccaggccgtgtaaacctgattggagaacatacagattataaccagggcctcgtcctgccaatggcactggaactcatgactgtactggtcggctctcctaggaaagatggactggtcagtctcctgacaacaagtgaaggagctgacgagccacagagactccagtttccactgcccaccgctcagaggagtctcgagccaggcactcctcgctgggccaactatgtcaaaggtgtcatacaatactatcctgctgcccccctgccaggcttcagcgcagtagtcgtgtcaagcgttcccctcggcggaggcctcagttctagcgcaagcctggaggttgctacctacacatttctccaacagctgtgccccgactccggaaccattgctgcaagagcccaggtgtgccagcaagcagagcatagcttcgccggaatgccttgcggcatcatggaccagttcatctccctgatgggccagaaaggccacgccctccttatcgattgccgctcccttgagacctctctggtcccactgtctgaccctaagctcgccgtgctgattacaaactccaacgtgagacactctctggcctccagcgagtatccagtgcgccgccgccagtgcgaggaagtggctcgtgctttgggcaaggaatctttgcgcgaagtacagctcgaggaactggaggccgctcgcgacctggtatccaaggagggtttcagaagggccaggcatgttgtcggcgaaattagaagaaccgcccaggcagcagccgccttgagacgtggtgactacagggcttttggaaggttgatggtggagtcccacagaagtctcagggacgactacgaggtttcttgccccgaattggaccagctcgtggaagcagccctcgccgttccaggtgtttatggatcccgcatgaccggcggtggtttcggaggatgtactgtgacattgctggaggcctccgctgctcctcacgccatgcgtcacatacaggaacactacggcggaaccgcaaccttctatttgtcacaggccgcagatggtgcaaaggttctttgcctc

SEQ ID NO: 11930 - DNA, 1176 bp, Artificial Sequence
  Description of Artificial Sequence: Synthetic coding sequence
atggctgctcttagacaaccgcaggtggccgagctgcttgccgaagcgcgacgcgcgtttagagaggagttcggagccgaaccggagcttgcagtgagcgcccccgggcgggtgaaccttattggagagcacaccgactacaatcaaggcttggtgctgcctatggcacttgagcttatgaccgtgcttgtcggatcacccagaaaagatgggctcgtgagcctgctgactacctccgaaggagcggatgaaccacaaaggcttcaatttcccctgcctacggcgcagcgatctctcgaaccgggcactcctagatgggcgaactacgtgaaaggcgtgattcaatactacccagcagcaccgctccctggattctccgcagtggtcgtgtcgtcggtccctctgggaggaggtctttcttcgtccgcttcacttgaagtggcaacttacaccttcctgcagcaactctgtcctgactctggaactatcgcagcacgggctcaggtgtgccagcaagctgaacactccttcgcggggatgccctgtggtataatggaccaattcatctccctgatgggacaaaaggggcatgcactgctgattgactgtaggagcctcgagacgtcgttggtgcccctctccgatcccaagctggccgtcctcatcaccaatagcaacgtgcgccactcattggcaagctcggaatacccagtgcgaaggcgacaatgcgaagaagtcgcccgtgctcttgggaaggagtccctccgcgaagtgcagctggaagagcttgaagcagcacgcgatctcgtttcgaaggagggttttcgccgtgcgaggcatgtcgtgggtgagatcagaaggacggctcaggcagccgcagcacttaggagaggtgattatagggcgtttggtcgcctgatggtcgaatcacaccgttcccttagagacgactacgaagtcagctgccctgagctggatcagctcgtggaagcagcgcttgcagtgcctggcgtctacggctcgcgtatgactggtggaggctttggcggttgtactgtcacccttcttgaggctagcgcagcccctcatgccatgagacatattcaggaacattacggcggtacggcaaccttttacctttcgcaagcagcagatggtgcgaaggtcttgtgcttg

SEQ ID NO: 11931 - DNA, 1176 bp, Artificial Sequence
  Description of Artificial Sequence: Synthetic coding sequence
atggcagcactacggcagccccaggtcgcggaacttttggcggaagctaggcgcgcctttagagaagaatttggagccgagcctgagttagctgtctccgccccaggacgtgtgaacctcattggggagcatacagactacaatcagggactagtcctacccatggccctggagctgatgaccgtactggttgggtctcctagaaaagacgggctggtgagtcttctgacgactagcgaaggggcggacgaaccgcaaaggttgcagtttcccctcccaacggcacagaggagtttagagccaggtacccccaggtgggcaaactatgtgaaaggcgtgatccagtattaccccgcggcacctttgccgggtttctcagcagttgtcgtgtcctcagtaccgctcggcggcgggctttcatctagtgcatcacttgaagtggcaacatacacattcctgcagcagctctgccctgacagtggaacaattgcagctagagctcaggtgtgccagcaggcagaacattcgtttgctggcatgccctgcggaattatggatcagtttatctctctgatgggacagaaggggcatgccctgcttattgactgccgctctctggagacaagcttggtcccgctttccgatcccaagctggccgtcctgatcactaattctaacgtgaggcattcgctggcctctagcgagtaccccgtccgcagaagacagtgtgaagaggtcgcacgggcactcggcaaggagtccctgcgtgaggttcaactggaggaacttgaagcagctcgagacttagtgtctaaagaaggcttccgcagggccaggcatgtggtgggcgagatcaggagaactgcccaggccgcagcagcactgcgcaggggcgattatcgcgcatttggtcgtctgatggtggaaagccatcgaagtctgcgcgatgactatgaggttagttgcccagagttggatcaactagtggaggctgcgctggccgtgcccggcgtgtatggctctcgcatgacggggggcgggttcggtgggtgcacagtaacgctacttgaagcatctgcggcccctcatgccatgagacatattcaggagcactatggagggacagctacattctacctctcacaggcagccgacggggcaaaagttctatgtctg

SEQ ID NO: 11932 - DNA, 1176 bp, Artificial Sequence
  Description of Artificial Sequence: Synthetic coding sequence
atggctgctcttcggcagccacaggtggctgaacttcttgcagaagcaagaagggccttccgagaggagtttggggccgaacccgaactcgctgtaagtgcccccggaagagtaaacctcataggagaacacactgattataaccaggggctcgtgctgcctatggctctagaactcatgacagtactggtcgggagtcccagaaaggatgggctcgtatctcttctgacaacttctgaaggagccgatgaacctcagaggctgcagttcccactacccactgctcagcgctcgcttgaacctggaacacccaggtgggccaattacgtcaaaggggtgatacagtattaccctgcagccccacttcctgggttctctgcagtggttgtaagttcagtgcccctcggaggaggactgtcctcgagtgccagtcttgaagtcgctacatatacttttcttcagcagctatgtcccgatagtggaactatcgcagcaagagcccaggtctgtcagcaggccgaacattcatttgccgggatgccatgtggaatcatggatcagtttatcagtctgatgggacagaaagggcacgccctccttattgattgtagatccttggaaacttctcttgtccccctcagtgaccccaagctggctgtgttgataacaaatagtaatgtgcgccactctctcgcttcctcggaatatccggtgcgcaggcgccagtgcgaagaggtcgcccgcgccctcgggaaggaatcccttagagaagtgcagctagaggagttggaagctgctcgagatcttgtatcaaaagagggatttaggcgtgctagacacgttgttggggagattagacgaacagctcaggcagccgcagcgcttagaagaggggattatcgagcgttcgggagattgatggtggaatcacaccgctcacttcgcgatgattatgaagttagttgtccggaactcgaccagctcgtagaagccgccctcgcagtgcctggagtctatggatcacggatgactggaggggggttcgggggatgtactgtcacactcctggaggccagtgcagctccacatgctatgagacatatccaggaacattatggggggactgccactttctatctgtcccaggcagccgatggagccaaggtgctatgcctg

SEQ ID NO: 11933 - DNA, 1176 bp, Artificial Sequence
  Description of Artificial Sequence: Synthetic coding sequence
atggcagctctgcggcaaccacaggtcgcggagctgctcgccgaagcccgccgcgccttcagggaagagtttggggccgagccagaactcgcggtctcagcacctgggagagtcaacctgatcggcgaacacacagactacaaccaggggctcgttcttcccatggctctggagctgatgactgtgctggtgggcagtccgcgaaaagatgggttagtctctctgcttacaacatcagagggcgccgacgagccacagaggctgcagttcccgttaccaactgcccagcgatccctcgaacccggcaccccccgctgggctaactatgtgaaaggtgtcatacagtactacccggccgccccactgccagggttttccgccgtggtcgtctcatccgttccattaggggggggtctgtctagcagcgcctcactcgaagtggctacctataccttcctacagcaactctgtcctgacagtggaaccattgccgccagagcgcaggtttgccagcaggccgagcactcctttgctgggatgccatgcgggatcatggatcagttcatctccctgatgggacagaaggggcacgcactcctcatagactgcaggagcctcgagacaagtctggtccccctgtcagatccaaagctagccgtcctgattacaaattcaaacgtgcgccactctcttgcctcttccgaataccccgttagacgcaggcagtgcgaggaggtggctagggcgctcggtaaagaatccctgcgggaggtgcagctggaggaactcgaagccgcccgggatctcgtttctaaagaaggctttagacgcgcccgccatgtggtgggagaaatacgccggacggcacaggctgcagcagcacttcggcggggcgattatcgcgcattcgggcgattgatggtggagtcacatcggtccctgcgggacgactacgaggtatcctgcccggagctcgatcaacttgtggaggctgcattagcggtccccggggtgtacggctcccgcatgaccggtggcgggttcggggggtgtactgtaacattattggaggctagcgcagcgccgcacgcgatgcgacatatccaggagcattacggaggaacagcaacattctatttgtcccaggcggctgacggagcgaaggtgctgtgcctg

SEQ ID NO: 11934 - DNA, 1176 bp, Artificial Sequence
  Description of Artificial Sequence: Synthetic coding sequence
atggcagctctgcggcagccgcaagtggctgagttgctggccgaagcgagacgggcgtttcgtgaagagtttggtgcggaacctgaactagcggtgagtgccccaggaagagtgaacctcatcggggagcacacagactataaccaaggactagtccttcccatggcccttgaattgatgacggtccttgtcggctctcctagaaaagatggcttagttagcctgctgacgacaagcgaaggtgccgacgaaccccaaagactccagtttcctttgccaacagcacagcgctccctggagccgggtacgcctcgatgggcaaattacgttaagggagtgattcagtactatcctgcggcgcccttaccgggcttcagcgcagtggtagtgtcatccgtcccgctgggtggcggactgtcttcatctgcaagcttggaggttgcgacgtatacgtttctgcagcaattatgccctgacagcggtacaattgcggctagggcacaagtatgccagcaagccgaacattcctttgccggtatgccttgcggcattatggatcagtttatttcattgatgggacagaaaggacatgcacttctgattgattgtagatcactggaaacatctctggtgccgctcagcgacccaaaattggctgtgctgatcaccaattctaacgttcgtcattcattggcgtcttctgagtatcctgtcagaagaagacaatgcgaagaggtggcacgtgcactagggaaagaaagcttgcgggaggtacaacttgaagagcttgaagcggctcgggatctggtctcgaaagaaggtttccgacgtgcccgtcacgtcgtcggggaaattaggaggacagcccaggccgctgcggcgcttcgccgcggcgattaccgcgcttttggtagactcatggtggagagccatcgaagcctacgtgacgattacgaagtatcatgtccggaactggatcaactggttgaggcggctttggcggtgccaggtgtatacggcagcaggatgaccgggggcggatttggcggttgtactgtgaccttacttgaggcctcggcggcaccacacgcgatgaggcatatccaggaacattacggcggcacagctactttttacttaagccaggccgcagatggggccaaagtactctgcctt

SEQ ID NO: 11935 - DNA, 1176 bp, Artificial Sequence
  Description of Artificial Sequence: Synthetic coding sequence
atggccgcacttcgccaaccacaggtcgcagaactcttggcagaagcaagacgggcatttagggaagaattcggtgcagaaccagaactcgcagtctcggcccccggaagagtcaatctcattggtgagcacactgattacaaccaaggactggtgctgcctatggcacttgaactgatgaccgtgcttgtgggatccccacgcaaggacggactcgtgtccctcttgactacttccgaaggtgccgatgaacctcagcggctgcaatttccacttcccaccgcacagagatccctggaaccaggtactcctcggtgggcaaactacgtgaaaggagtcatccaatactaccctgcagcgcctcttcctggtttttcggcagtggtggtgtcgtccgtccctcttggaggaggtctttcgtcgtccgcatcgctggaagtggcaacttacacctttcttcagcaactgtgccctgacagcggcaccattgccgcgagggcgcaagtgtgtcagcaagcggagcacagctttgctgggatgccttgcggtattatggatcagtttatctcgctcatgggacagaaaggccacgcactcctgatcgactgtcgtagcctcgaaacctcccttgtgccactgtccgatccaaaactggccgtgcttattacgaattcaaatgtgagacattcgctggcctcttcggagtaccctgtgcgaaggcgacaatgtgaggaagtggcaagagctctgggaaaagagtcgctccgagaagtccagctggaggaactggaagctgcaagagatctcgtgtccaaggaaggattccgcagggcacgacacgtcgtcggtgagatacgcagaactgcacaagccgcagcagccttgagacggggagactaccgagcatttggtcgacttatggtggagagccatagaagccttagagatgactatgaagtgtcttgcccagaacttgatcagctggtggaagcagcgctcgcagtccctggagtgtatgggtcaaggatgaccggaggcggatttgggggatgtaccgtgaccctccttgaagcctccgcagctccgcatgcaatgaggcatattcaggaacattacggggggactgcaaccttttacctttcccaggcagccgacggagcaaaagttctgtgtctg

SEQ ID NO: 11936 - DNA, 1176 bp, Artificial Sequence
  Description of Artificial Sequence: Synthetic coding sequence
atggcggctctgcgacaaccacaggttgctgagctgcttgcggaagcccgcagagctttccgggaggaatttggtgccgagccggaactggctgtcagcgccccgggcagagtgaacctgatcggcgaacacaccgactacaaccaaggactggttctgccgatggcgctggaactgatgaccgtgctggttgggtctccgcgcaaagatgggctggtcagccttctgacgacctccgagggggcagacgaaccgcagcggctccaattcccgttgccgacggcgcagcgttcactggaaccaggcactcctcggtgggccaattacgtcaaaggtgtcatccaatactacccggccgcacctctgccaggttttagcgccgttgttgttagctcagtgccactgggcggcggattatcctccagcgcttcattagaagtcgcaacttatacgtttctgcagcagctgtgtccggactctggcactatcgctgctcgcgcacaggtctgtcaacaggcggagcatagcttcgcaggcatgccttgtgggatcatggaccaatttatttctctgatgggacaaaagggtcatgccttgctgatagactgtcgttcattggaaacttctctggtccccctgtctgacccaaagttggcggttctaatcactaattctaacgtccgccattctctagcgagctctgagtacccggtacgccgtcgccagtgtgaggaggtggcgcgcgcactgggcaaggaaagcctgagagaggttcagctagaggagctggaggcagcgcgagacctcgtaagcaaagaaggcttcagacgcgcccgccacgtcgtaggcgaaatccgccgcaccgcgcaggcagctgcggccttacgccggggggactatcgcgccttcggtcgcctgatggtagaaagccatcgttccctgcgcgacgattacgaagttagctgtccagagctcgaccagctagtagaagcagccctggctgttcctggtgtctacgggtccagaatgactggcggaggtttcggcggttgtacagtcacgttgctcgaggcctcggccgcccctcatgcaatgagacacattcaagagcattatggcggtacggcaaccttctacctgagccaggcagccgacggagctaaggtcctctgcctg

SEQ ID NO: 11937 - DNA, 1176 bp, Artificial Sequence
  Description of Artificial Sequence: Synthetic coding sequence
atggcagccttgcgacagccacaggtggctgagcttctagcagaagcccgacgcgcattccgggaggagttcggcgcggagcctgagctcgccgtcagtgcccccggccgagttaacctgattggcgagcataccgattacaatcaggggctggtcctgccgatggcgctggaacttatgactgtgctggtgggatccccaaggaaggatggcctcgtgtcccttctaacgacaagcgaaggggcagacgagcctcagcgtcttcagtttccgctccccacagcccagaggtctctcgagcctggcacgcctagatgggcgaactatgtaaagggcgtgatccaatactatccggcagcccccctgccaggctttagtgctgtggtagtgtcttcggtaccattaggcgggggtctctcaagctcggccagtctggaagtggctacatacaccttccttcagcagctgtgtcctgatagcggcactatagcagcacgcgctcaggtttgccagcaggccgaacatagttttgccgggatgccttgtggaatcatggatcagtttatcagcctcatggggcagaaaggacatgccctcttgattgactgcagaagcctcgagaccagtctggtccccctgagtgaccctaagctcgccgtactcatcactaatagcaacgttagacactctctcgcgtcctccgagtaccccgttcggcgccgacagtgcgaagaagtggcacgggccctcgggaaggagtctctgcgggaagtccagctggaggagctggaggccgccagggacctggtttcaaaagagggatttaggcgggcaagacacgtggtgggcgaaataagaagaactgcccaggccgcggcagccttacgacgaggggactatagagcgttcggccgcctaatggttgagtctcatcggagcttaagggatgattacgaggtctcgtgccctgaactggaccagctggtcgaggccgcgttggcagtgccgggggtttatggcagccgtatgacaggtggtgggtttggcgggtgcacagtgacgctcctggaggcctcagctgccccacatgcaatgcgacatattcaggagcattatggagggactgcgactttttatctctcgcaggccgccgacggtgccaaagtcttatgcctc

SEQ ID NO: 11938 - DNA, 1176 bp, Artificial Sequence
  Description of Artificial Sequence: Synthetic coding sequence
atggccgccctccggcagccccaggtagcagagcttctggccgaggccaggcgtgcttttagggaggagttcggtgccgaacctgagctggcagtatcagcgcccggccgtgtcaatctcatcggtgagcataccgactacaaccagggcttggtgcttccgatggctctggagcttatgaccgttttggtgggctcgccaagaaaagacggcctcgtctctttgctgaccaccagtgagggagcagacgaaccacagcgactccagttccctctgcctacagcgcagcgaagtctggagccgggtaccccaagatgggccaattatgtcaagggagtgatccagtattatcccgctgcacctttgcctggattcagtgctgtggtggtgtcttcagtacccttaggtggaggactcagcagttccgcttccctggaggtggcgacctatactttcctccaacagctctgtccagatagtggcacaatcgccgcccgcgcccaggtgtgccaacaggccgagcattcgttcgcgggaatgccgtgcggcatcatggatcagttcatttccctgatgggacagaaaggccatgctctcctgatcgactgtcgatccctggaaacaagtctggtgccactgtctgaccctaaacttgccgtactgatcactaactccaatgtgcggcattcactggcctcaagcgaataccccgtcaggaggcggcagtgcgaggaagtggctcgcgccctgggcaaggagtctcttcgcgaagttcagctggaggaactcgaagctgctcgggatctggtctccaaagagggattccgtcgtgcacgtcacgtcgtgggggagatacggcgcactgcacaggccgctgccgctctccgccgtggcgactatcgagcattcggccgactcatggtagagtcacatcgctctctcagagatgattatgaggtcagctgcccagaactggatcaactggttgaggcagccttggctgtgcccggcgtctacggtagccgaatgaccggggggggttttggagggtgtaccgtgaccctgctcgaggcaagtgctgccccccacgctatgcgacatatccaagagcactatggagggaccgccaccttttacctgagccaagcagccgacggcgccaaggttctgtgtctc

SEQ ID NO: 11939 - DNA, 1176 bp, Artificial Sequence
  Description of Artificial Sequence: Synthetic coding sequence
atggcagccctgcggcagcctcaggtcgcagagctccttgcagaggcgcggagggcatttcgcgaagagtttggcgccgagccggagcttgccgtgtcagccccaggtagagtgaatctgatcggtgaacacaccgactataatcaaggactagtactaccgatggccctggaactaatgacagtcctggtgggaagcccgcggaaagatggcctcgtgagcctgctcaccacaagcgaaggtgccgacgaaccccagcgcttgcagtttcccttaccaactgcccagcgaagcctcgagccgggcacgccccgctgggctaactatgtgaagggagtgatccagtattaccccgcagcaccgttgcctggcttctccgcggtggttgtgtccagcgtcccgctcggtggggggctgtcctctagcgcatcactagaggtcgcaacatatacttttctgcagcagctgtgtccagatagcgggaccatagctgcccgtgcccaggtctgtcagcaggcagaacactccttcgctggtatgccatgcggaatcatggaccagtttatatccttaatgggccagaagggccacgcgctgctgatagattgtcggagtctcgaaacttcactggtgccgctcagcgatcctaagctggctgttctcataactaacagcaatgttcgccacagtttggcgtcctccgaatacccggtgcggcgcagacagtgtgaggaggtggcccgcgccttgggcaaagagtctctccgcgaagttcagcttgaggagctggaggctgcccgcgacctggtttccaaggagggttttcgtagagccaggcacgtcgtcggcgagattagaaggaccgcccaggcggctgcggctttgagaagaggggactacagggcctttgggcgcctgatggtggaatctcacaggagcctgagggatgattatgaagtgtcatgtccggaactagatcaattagtggaggctgcacttgctgttccgggagtgtatggaagccggatgactgggggaggattcggtggctgcacagtaacccttttggaagcatccgccgctccccacgctatgcggcacatccaggaacactatggtggcactgctacgttttatctaagccaggccgctgacggcgcaaaggtgctgtgcctg

SEQ ID NO: 11940 - DNA, 1176 bp, Artificial Sequence
  Description of Artificial Sequence: Synthetic coding sequence
atggccgctttaagacagcctcaagtagctgaactgttggctgaagccagaagggcatttagagaggagttcggagctgaacctgaattggcagttagcgctccaggaagagtgaatctcatcggcgaacacactgactacaatcagggcctggttctgcctatggccctggagctgatgaccgtgctggtaggttctccccgcaaggacggtcttgtcagcctgttgaccacctccgagggagctgatgagccccaacgcctgcagtttcccctaccaacggctcagcgcagcctggaaccagggacccccaggtgggctaactacgtgaagggagtcatccagtactacccagcagcccctttacctggattctcagcagtggtcgtaagcagtgtccccttaggcggaggcctgagcagctccgcgagtctggaggttgccacctacacctttctgcagcagctgtgtccagacagcgggacaatagcagctagagcccaggtctgccagcaagctgaacactcattcgctggcatgccttgtggaattatggatcaattcatctcattgatggggcaaaagggacacgccctcttgattgactgtcggagtcttgaaacctcactcgtcccactgagcgatcccaagctcgctgtcctgatcactaacagcaacgtccgccacagtcttgcctcatcagagtaccctgtgagacgcagacagtgcgaagaagtcgcccgtgctcttgggaaagaaagtttgagggaggtgcaactggaggaattagaggcagctagggacctggttagcaaagagggattcaggcgcgcccgtcatgtcgtcggagagatccgcagaacagctcaggcggcagctgctctgagacgcggggactaccgggcattcggtagactgatggtcgaatcacatagaagtctccgtgatgattacgaggtgtcgtgccccgagctggaccagctcgtagaggctgccctggctgtgcctggagtttatggctccagaatgaccggcggcggtttcggaggatgcactgtgaccctcctcgaggctagcgctgcacctcacgctatgcgacatatccaggagcactatgggggtactgccaccttttatctgtcccaagcagccgatggagctaaggtcttgtgcctg

SEQ ID NO: 11941 - DNA, 1176 bp, Artificial Sequence
  Description of Artificial Sequence: Synthetic coding sequence
atggccgccctgcgccagcctcaggtggcggaactcctggcagaagcgcggcgcgcattccgggaggaatttggtgccgaaccagaattggcggttagcgcacctgggcgcgtgaatctgattggcgaacacaccgactataaccaggggctggtgctgccaatggcactggaactgatgacggtgcttgtcgggtccccgagaaaggatggactggtgtcgctcctcaccacttcggaaggagccgatgaaccgcagcggctgcagtttccgctccctactgcccaaagatcgctggaacccgggactccgagatgggccaactacgtgaagggtgtcatccaatactatccggccgcaccgctgccgggattttcagccgttgttgtgtcgagcgtcccgctgggtggtggactctcgtcctcagccagcctcgaagttgctacctacacctttctgcaacagctgtgcccagactccggcactatcgcagctagagctcaggtgtgtcagcaagctgaacactctttcgccggcatgccttgtggaattatggaccagttcatctcactcatgggacagaaaggccacgcccttctcatcgactgtcggtcgcttgaaacctcattggtgccactgtcggatccgaagctcgccgtgctgatcaccaatagcaatgtaagacactccctcgcgtcatcagaatacccagtgcgcaggcggcaatgcgaagaagtggcgcgcgccctgggaaaggagtcgctccgggaagtgcagctcgaggaactggaagccgcgcgggacctcgtgtcgaaggagggcttccgccgggctaggcatgtcgtcggagaaatccggcgcacggcccaagcagccgcagcactgcgccggggtgactaccgagcgttcggacggctgatggttgaatcccaccggtcgcttcgggatgactacgaagtctcgtgcccagagttggaccagttggtggaagctgcattggccgtcccaggagtgtacggatcgagaatgaccggtggcggatttggcgggtgcacggtgactctgctggaggcgtccgccgccccgcacgcgatgaggcacatccaggaacactacggcggaaccgcgactttctacctctcacaagccgctgacggcgccaaagtcctgtgcctc

SEQ ID NO: 11942 - DNA, 1176 bp, Artificial Sequence
  Description of Artificial Sequence: Synthetic coding sequence
atggccgcattgcgacaacctcaagtcgctgaattgcttgctgaggctagaagggccttcagagaagaatttggagcagaaccagaacttgccgtttctgcaccaggccgagtaaatctgatcggagagcatactgactataatcaaggactggtcctgccgatggcattggaactgatgaccgtactggtgggatcacctagaaaagatggacttgtatctttgttgaccacttcggaaggagcagacgaacctcaaaggttgcagtttcctcttcctacagcgcaacgctctttggagccgggcactccacgttgggcgaattacgtaaaaggagttattcaatattatcctgcagccccattgccaggattcagtgccgtggttgtcagctctgtgccgctaggaggcggcttaagttcgtctgcttcattagaagtagccacatatactttcttacaacaattgtgtccagattcaggaacaattgccgccagagctcaggtttgccaacaagctgaacattcatttgcgggcatgccatgtggaatcatggatcaattcatttcgttaatgggtcagaaaggacacgccctgctcattgattgtcgctctcttgagacatctctggttcctctaagtgacccaaagctcgcagttcttattactaactcgaacgtgcgacattcacttgctagctcagaatatccggttcgacgtcgacagtgcgaagaagtcgcacgggcccttggtaaagaatcactgcgagaagttcaactggaagagctcgaagcagcccgagatttggtctcaaaagagggcttccggagagcacgccacgttgtcggagaaatccgtagaacagcacaggccgctgctgctcttcgtaggggagactacagagcctttggacgtttgatggtcgaatctcatcggtctctccgggatgactacgaagtctcttgtccagagcttgaccaattggtggaggccgcacttgccgtcccgggagtttatggctctcgcatgactggtggaggattcggcggatgtacagtaacgttgttggaagcttcagcagctccgcatgctatgcgacatatccaagagcactacggaggtacggcaaccttttatctaagtcaagctgcagatggagcaaaagtgttgtgtctt

SEQ ID NO: 11943 - DNA, 1176 bp, Artificial Sequence
  Description of Artificial Sequence: Synthetic coding sequence
atggccgcacttcgccagccccaggtggccgaattactagctgaagctcggagagccttccgcgaagagttcggagctgaacctgagttggcagtctccgcccccgggagagtgaatctgataggcgaacatactgattataatcaaggcctcgttcttcctatggctcttgagctcatgaccgtgctggtaggctctccccgcaaggatggactggtgtcattgctgacaacctccgagggagccgatgagccccagcgcttgcaattcccacttcctacagcccagagaagtcttgaaccagggactccccggtgggccaattatgttaaaggagtcatccagtattatcctgcagccccattaccgggattcagtgcagtggtcgtgtcttcagtcccattaggaggcggacttagcagctccgcatccttggaagtcgcaacctacacttttctgcagcaactctgcccagactcagggaccatagccgctcgggctcaggtgtgccagcaggctgagcacagcttcgctgggatgccttgtggcatcatggaccagtttatcagcctgatgggtcagaaaggtcacgctcttctaatcgattgccgctcattagaaacaagcctggtcccgctgtcagaccctaaactcgcagtactcatcaccaatagcaacgtgcgccatagcctggcttctagcgagtacccagtccggcgaagacagtgtgaggaagtagcaagagctctaggtaaggaatccttaagagaggtgcagcttgaggagctcgaagctgctcgggatctggtttctaaggaagggtttcgccgagcacgacatgtggttggcgagatacgcaggacggcccaggccgccgctgctctgcgtcgcggggactaccgtgcattcggccgcctcatggtggagtcccataggtcacttcgggacgattacgaggtgtcttgcccagagttggaccagctcgttgaggccgccctggcagttccaggcgtgtacggctcacgcatgactggaggaggtttcggcgggtgcactgttactctgctcgaagcaagcgctgcccctcatgccatgaggcacatccaggagcactacgggggcaccgctaccttttacctgagtcaggcagcggacggcgctaaggtactgtgcctg

SEQ ID NO: 11944 - DNA, 1176 bp, Artificial Sequence
  Description of Artificial Sequence: Synthetic coding sequence
atggcggctctgaggcaaccacaagtcgcggagctgcttgccgaggcccggagggctttccgcgaagaattcggagcagagcctgaactcgccgtgtccgcgccaggtcgggttaatctcattggggaacacacagattacaaccaaggactcgtgctcccaatggctctggagctgatgactgtcctagtgggtagcccccgtaaggatggcctggtgtcactcctgacaacctcagaaggcgctgacgaaccacaaaggctccagttccccttgccgactgcgcagcgctcgctggagccaggaacgccacgctgggcgaactatgtaaaaggggtgatccagtactacccggcagctccactacccgggttctctgcagtagtagtttcttccgtgcccctcggcggcggtctaagttcttcagcctctctggaggttgccacttacacattccttcagcagttgtgtccggactccggcactatagcggctagggcacaggtgtgccaacaggcagagcacagctttgctggtatgccttgtggcataatggaccagtttatcagccttatggggcagaaaggacacgccctgctgatcgattgcaggtccttggagacatctctggttccgctcagtgatcctaaactggccgtgcttatcactaactccaatgtgagacactcacttgcctccagcgaataccccgtccgccgaagacagtgtgaggaggtggcccgtgcgttagggaaggagtcgttgcgtgaggtgcagctggaggaattggaagcagccagagacttggtgagcaaggaaggttttcggcgcgcccggcacgttgtgggggaaatacgcagaactgcgcaggctgctgcagccttgaggcgtggggattatcgggcatttggcagactgatggtggaatcgcaccgctccctccgggacgattacgaagtgtcatgtcccgagttggatcagctggttgaggcagctctagcagtgcctggggtgtatggcagccggatgacagggggtggttttggcggctgtactgtgacgttgctcgaggctagcgctgcgcctcatgcaatgcgtcatatccaggagcactacggagggacagccactttttacctctcgcaagccgccgatggggcaaaggtcctgtgcctg

SEQ ID NO: 11945 - DNA, 1176 bp, Artificial Sequence; identical to SEQ ID NO: 11931
  Description of Artificial Sequence: Synthetic coding sequence

SEQ ID NO: 11946 - DNA, 1176 bp, Artificial Sequence
  Description of Artificial Sequence: Synthetic coding sequence
atggccgccctccgtcaaccccaagtggccgagttgctggccgaggcccgaagagccttccgcgaggaattcggcgctgagcctgagcttgctgtgtccgcaccaggaagggttaaccttattggcgagcatacagattacaatcagggactcgtgttgcccatggcccttgagctgatgacagtgttagtgggtagcccacggaaggatggcctggtctcactcctgactaccagcgaaggtgccgatgaaccccagagactccagttccccctgccaaccgctcagcgatccttagaacctggcacccccaggtgggccaactacgtcaagggcgtcattcagtactatcccgcagctccattgccgggattttcagcagtggtcgtctcgagtgtcccccttggaggtggactcagcagtagcgcgtcactagaagttgctacatatacctttctgcagcagctgtgcccagactctggcacaattgccgcccgggcacaggtgtgtcagcaagcagagcactcctttgctggcatgccttgtgggattatggatcagttcatctccctcatgggtcagaagggtcacgcgctgctcatagactgtaggtctcttgagacctccctcgtcccactgagcgatcctaaactggcggtgctcatcacaaactctaacgtgcgccactcactggcctccagcgagtaccccgtacggcgccgccagtgtgaggaggtcgctagggccttagggaaagaatccctcagggaagtccaactggaagagctagaagcggccagagatttggtgagtaaagaaggctttcggagggccaggcacgtagtgggagagatccggcgaaccgcgcaagccgctgccgccctgagacgaggtgactaccgtgcattcggccgtcttatggtggaaagccatcggtctctgcgcgacgattatgaagtgtcttgtccagagctagatcagcttgtggaggcagctctggccgtgcctggagtgtacgggagcaggatgactggtggcggtttcggcgggtgcactgttaccctcctcgaggctagtgcggctccacatgctatgaggcatattcaggagcactacggaggcacggctacattctacctgagccaggctgctgacggggctaaagtgctatgtctt

SEQ ID NO: 11947 - DNA, 1176 bp, Artificial Sequence
  Description of Artificial Sequence: Synthetic coding sequence
atggcggccctgcggcaaccgcaagtggctgagctgctggcagaagctcggagagcgttcagggaggaatttggcgcggaacccgagttggcagtgagtgcaccgggacgcgtgaatctcatcggtgagcacaccgattacaatcaaggccttgtgctgccgatggcgctggaactcatgactgtcttggtggggtcgcccaggaaggacggactggtgtccctcctgaccacttccgagggagccgacgaacctcaaaggctgcagttcccgttgccaaccgctcaaagatcgctggaacctggcactcctaggtgggcgaactacgtgaagggagtgatccagtactacccagcagcgccactgcccggattctcagccgtcgtagtctccagcgtaccgcttggaggaggactttcgtcgtcagccagcctggaagtcgcaacctacaccttcttgcagcagctgtgcccagatagcggaaccattgccgcgagagcccaggtctgtcaacaagccgagcactcctttgcgggtatgccgtgtggaatcatggatcagttcatctccttgatggggcagaaagggcacgcgttgctgatcgactgtagatcccttgaaaccagccttgtgccgctgtcggacccgaagctcgcagtgcttataaccaactcaaacgtccggcatagcctggcttcctcggaataccctgtccgccggcgccagtgcgaggaggtcgcccgtgccctcgggaaggaatcgctccgggaggttcagctcgaagaacttgaagccgcccgggacctcgtgtcgaaggaaggctttcgcagggccagacatgtggtgggtgaaatccgcagaactgcccaagcagctgccgctttgcggagaggagattaccgagccttcggcaggttgatggttgagagccaccggtccctccgggacgactacgaggtgtcgtgccccgagctcgatcagctcgttgaagcagcactggcggtgccgggcgtgtacggatcacggatgactggaggcggttttgggggctgcactgtcacgttgctcgaggcgtccgctgcacctcatgcgatgcgacacattcaggagcattatggaggaactgccactttctacctgtcgcaggcagccgacggagcaaaggtgttgtgtctt

SEQ ID NO: 11948 - DNA, 1176 bp, Artificial Sequence
  Description of Artificial Sequence: Synthetic coding sequence
atggcggccctcaggcagccccaggtcgccgaacttctggcggaggcccggcgagcttttcgcgaggagtttggagctgagccggaactcgccgtttctgcccctggacgcgtcaacctcatcggagaacatacggattacaaccagggccttgtgctgccaatggcactcgaactcatgactgtgctcgtaggaagccccagaaaagatggcctcgtgtcgctgttgaccactagcgagggagccgacgaaccgcaacggctccaattcccgctgccgactgcacagcgctcgctcgagccaggaacgccccgctgggccaactacgtcaagggcgtgatccagtactaccctgccgcaccgctgcccggattttcagccgtcgtggtgtcgtcagtcccactcggaggaggcctctccagttcggcaagcctggaagtcgcaacctatacgttcctgcaacagctctgcccagacagcggaactattgccgcacgggcccaggtctgccaacaggcagagcactcgtttgctggaatgccttgtgggatcatggaccagttcatctccttgatgggccagaaaggtcacgccctcctcatcgactgcagatcgttggaaacctcactggtgccgctgtccgatcctaaactggctgtgctgattacgaattccaatgtccgccacagcctggcctccagcgaatacccggtccggcgcaggcagtgcgaggaagtggcaagagccctgggcaaagagtcactcagggaggtgcagcttgaagagctggaagcagcccgggacctggtgtccaaggagggcttccggcgggcccggcacgtggtcggcgaaattcgccggactgcccaggctgcggcggcacttcggagaggagactacagggccttcggtagactgatggtggaaagccatcggtcgctgagagacgactacgaagtgtcgtgcccggaactcgaccagctggtggaggctgcgctcgccgtgccaggggtctacggctcgcgcatgactggaggcgggttcgggggatgcaccgtgactctgctggaagcatccgcagccccacacgccatgcgccatatccaggaacactacggagggactgccaccttctacctgtcacaggccgccgacggagccaaggtgctgtgcctg

SEQ ID NO: 11949 - DNA, 1176 bp, Artificial Sequence
  Description of Artificial Sequence: Synthetic coding sequence
atggcggcacttagacaaccccaagtggccgagctgttggccgaggcccgccgcgctttccgggaggagttcggcgcggagcctgaactcgccgtaagcgcccccggcagggtgaatctgatcggagagcacactgattacaatcagggactcgttctgccaatggcgctggaactaatgacggtgctcgtaggttccccaaggaaggacggcctagtgtctctgttgaccacttcagaaggggctgacgagcctcagaggctgcagtttcctctcccaaccgcgcaacggagtctggagcctggcacaccacggtgggccaattatgttaaaggcgtgatccagtactatcccgcagcacctctgccagggttctccgccgtagtcgtttccagtgtacccctgggcggcgggttgagcagctctgcatccttagaggtggccacttatacatttcttcagcagctctgccccgactcaggcaccattgcagcccgggctcaggtgtgccagcaggccgaacacagtttcgctggaatgccatgcggcattatggaccaattcatcagtctaatgggccagaagggacatgctctattaattgactgtaggtcgctcgagacttcccttgttcccctaagcgatcccaaattggccgtactgattacaaacagtaatgtgcggcactccctggcaagttcagagtatccagtccgccgcaggcaatgtgaagaggtcgcacgggcccttgggaaggagtccctgagggaagttcagctagaagagctggaggcggcccgggacctcgtcagcaaggaaggatttaggagggccagacacgtggtgggagaaatccgtaggaccgcgcaagctgcagcagccctgaggaggggtgactatagagctttcggaaggctgatggtcgagagtcatagatcactgcgcgacgattatgaagtgagctgccccgagctggaccagctggtcgaagccgcattggcagtgcctggggtgtacgggagtcggatgacgggtggagggttcggcgggtgtactgtcaccttactcgaagcatctgctgctcctcacgcaatgcggcacatccaggaacattatgggggtaccgctacgttctacttatcgcaggcagcagatggagcaaaggtgctgtgtttg

SEQ ID NO: 11950 - DNA, 1176 bp, Artificial Sequence
  Description of Artificial Sequence: Synthetic coding sequence
atggcagcccttagacagcctcaggtggctgaactactcgccgaagctcggcgagcgtttcgtgaggaattcggcgctgaacctgagctggccgtatcagcacccgggagggtgaatctaatcggagagcatacagactacaatcagggcctggtcctgccaatggctctggaactcatgaccgtgctcgttggttctccccggaaggacggcctggtgtcactgctgaccactagcgagggagcggacgaaccccaaaggctgcagttcccattaccaactgctcaacgttcactggaacctggtactccaaggtgggccaattacgtaaagggcgttattcagtactaccctgccgctcccctgccagggtttagcgccgtggttgtctcttcggtgccactgggcgggggcctgagctcatctgcaagcctcgaagttgcaacttacacgttcctccaacagctgtgtcctgacagtggcacgatcgcggcccgggcacaggtgtgccaacaagcggagcattccttcgcagggatgccctgtggaatcatggaccaatttatctccctcatgggccagaaaggccacgccctgctgattgactgccggagtctggagacctcactggtgcccctttctgatccaaagctggccgtccttattaccaacagcaacgtaagacactcccttgcctcatcagagtatccggttcgccggagacagtgtgaagaagtagcccgggccttggggaaggaatcattgagagaagtccagctcgaagaactggaagccgcaagggacctggtgtccaaggaaggattcagacgggccaggcatgtggtcggtgagattagacggactgctcaggcggcagcagctctaagaaggggtgactacagagccttcgggcgactcatggtggaatcccaccgttccctgcgggatgactatgaggtcagctgccccgagctggatcagctcgttgaagcggccctggcagtcccaggggtgtatggtagcaggatgactggcggaggattcggcgggtgtaccgtgaccctgctggaagcgtccgcggccccacatgctatgaggcacattcaggaacactacggggggaccgcaacattctatctaagccaggcagccgacggggcaaaggtgttgtgtctc

SEQ ID NO: 11951 - DNA, 1176 bp, Artificial Sequence
  Description of Artificial Sequence: Synthetic coding sequence
atggcagcgcttcgacaaccacaggtggccgaactgctcgcagaagcacggagagcttttagggaagagtttggcgcggaaccagaactcgccgtgtccgcgccaggaagagtgaacctgattggggaacacactgattacaaccaagggctcgtcctccctatggcactcgaacttatgacggtgctggtgggaagcccccggaaggatggacttgtgtcgctgctgaccactagcgaaggagcagatgaacctcaacgcctccagttccctttgcccaccgcacaacgctccctggagcccggaacccctcggtgggcaaactacgtgaagggcgtgattcaatactaccctgccgcaccactccccggattttcagcggtggtcgtgagctccgtgccacttgggggcggcctttcgtcctcggcatcgctggaagtggcaacttacaccttcctgcagcagctttgtccagattcggggactatcgcagcaagggcacaggtgtgtcaacaggcggaacacagctttgccgggatgccatgtggaataatggatcaattcatttcgctcatgggtcagaagggtcatgcactgcttatcgactgtcggagtcttgaaacctcgctggtccctctgtcagatccaaagttggccgtgctcatcacgaattccaacgtgcggcattcgcttgcctcatcggaataccccgtcagacgcagacaatgtgaagaagtggctagagcccttggtaaggaatcacttagagaagtccaactcgaagaactggaagcagcaagggatctggtgtctaaggaaggttttaggcgcgctaggcatgtcgtcggtgagattagacgcactgcacaagcagcagcggcactgagacgaggagattatagggcatttggccgcctgatggtggaaagccacaggtcgcttagagacgattacgaagtgtcatgcccggaacttgatcaacttgttgaggcagcactggcagtcccgggagtgtacggttccagaatgaccggtggaggttttggaggctgtactgtgactcttctggaagcatcagcagcaccgcatgcaatgcgacacattcaagagcattacggtggaaccgcaactttttacctgtcacaagctgcagatggggcaaaggtgctgtgtctc

SEQ ID NO: 11952 - DNA, 1176 bp, Artificial Sequence
  Description of Artificial Sequence: Synthetic coding sequence
atggccgcacttaggcagccccaggtcgccgaactgctcgctgaggctcgtagggcattccgtgaagaatttggcgccgagcctgagcttgccgtgtcggcgcccgggcgcgtcaatctgatcggtgaacatactgattataaccaaggtctggttctgccaatggctctggaacttatgacagtgcttgttggctctcctcggaaagacggactggtgagtctgttgaccacgtccgaaggtgctgacgaacctcagaggctccagttccctcttccaacagcccaaagatccctagagccaggcactccaaggtgggccaactacgttaagggcgttattcagtattatcctgccgcccccctgcccggattttcggctgtcgtggtgagctccgtaccactggggggggggctcagctcctccgccagcctggaagtggccacctatacattcctgcagcaattgtgtcctgattctggaaccattgctgccagggctcaggtttgccagcaggcagaacatagctttgctggaatgccctgtggcataatggaccaattcatatccctgatgggtcagaaagggcacgcccttctgatcgattgccgatctttggagacatcattagttcccctgagtgatccgaagttagcggtactgattacaaacagtaatgtgcgacactcattggcctcgagcgagtacccagtcagaagaagacaatgtgaagaggtggcccgcgcactcggaaaagaatccttgagagaagtacaacttgaagaactcgaagcggcccgggatctggtgagcaaggaggggttcaggcgagcaaggcacgtggtgggcgagatcagaagaactgcacaggcggccgccgctctccgaagaggggattacagggccttcggaagactgatggttgagtctcataggtcgctcagggatgactatgaagtatcatgtcccgaactggatcagctggtcgaagctgcactggctgtcccaggagtgtacggttccagaatgaccggaggggggttcggcggctgtacggttactttgctggaagcgagcgccgccccccatgccatgagacacattcaggagcactacgggggcactgcaacattctacttatctcaggctgccgatggcgcaaaggtcttgtgtctg

SEQ ID NO: 11953 - DNA, 1176 bp, Artificial Sequence
  Description of Artificial Sequence: Synthetic coding sequence
atggccgctcttagacagccacaagtcgcagaattgctggcggaggcaagacgagccttccgcgaagaatttggtgccgagcctgaactggcggtgtcggccccgggcagagttaacctcatcggggaacacaccgattacaaccaaggattggtgctgccaatggccctcgaactgatgacggtcttggtggggtcccctcggaaggacggactcgtgtccctcctcactacttcggaaggagcggacgaaccgcagagactccaattccccctgccaaccgctcaaagatcgcttgagccggggacgccaaggtgggccaactacgtgaaaggagtcatccagtactacccggctgcgccattgccggggttttcagcagtggtggtttcgtccgttccgctgggtggaggcctgtcctcctctgcgtccctcgaggtggcgacttacactttcctccagcagctgtgcccggatagcggaactattgcggcacgggcacaggtctgccaacaggctgaacacagcttcgctggcatgccctgcggcatcatggatcagttcattagcctgatggggcaaaaagggcatgcgctgctgatagactgtaggtcgcttgaaaccagtctcgtgcctctgagcgatcccaagctggcagttcttatcacgaattcgaatgtgcgccactcgctggccagctctgaatacccggtgagacggcggcagtgtgaagaggtagcgcgggcgctggggaaagaatccctgcgggaagtgcagctggaggaactggaggcggcacgcgacctcgtgtccaaagagggatttcgccgcgcccggcatgtggtgggggagatcagacggaccgcacaggccgcagccgcgctgcgacggggtgactacagagctttcggaaggttgatggtggagtcacatcggtcactgcgtgatgactacgaggtcagctgcccagagctcgaccaactggtggaggcagcactggccgtccccggagtttacgggtcccgcatgacgggaggaggcttcggtggatgcaccgtgactctcctggaagcctcggcggccccgcacgccatgaggcacattcaggaacattatgggggaactgcaaccttctacctgtcgcaggctgctgacggagcaaaggtgctctgcctg

SEQ ID NO: 11954 - DNA, 1176 bp, Artificial Sequence
  Description of Artificial Sequence: Synthetic coding sequence
atggcagcactccgacagccgcaggtggcggagctcctggcggaagcaagaagagcatttcgggaagaattcggtgcagagccagaacttgccgtgtcggcccctggaagagtgaatttgattggtgaacatacggattacaatcaaggcctggttctgccaatggcactggaactgatgactgtgctggtgggatccccgagaaaggatggtcttgtgtccctgctgaccacctccgagggggcagatgaacctcagcgtctgcaattccctctgcccaccgcacagcggtcactggagcctggcacccctagatgggcaaattacgtgaagggagtgattcagtactacccagcagcccctctcccgggattctcggcagtcgtcgtgtcgtccgtccccctcggcggaggactgtcatcatcggcctcgcttgaagtggcaacctacacctttctgcaacaactctgtccagattcgggaaccattgctgctcgcgcacaagtgtgtcaacaggcagaacactcattcgcaggaatgccatgcgggattatggaccagtttatctccctgatgggacaaaagggtcacgcgcttcttattgattgtcggtccctcgagacttcactcgtgccactctccgacccgaaacttgcggtgcttattactaatagcaatgtgaggcattcattggcgtcgtccgaatacccagtccggaggagacagtgtgaggaagtcgccagagcactcggaaaggaaagccttagagaagtgcaactggaggaactggaagccgcaagggacctggtgtctaaggaaggattcagaagagccaggcacgtcgtgggcgaaattagacgtaccgcccaggcagctgcagcgctccgacgaggagattatagagcatttggacgtctcatggtcgagtcgcatcgcagcctgcgcgacgactacgaggtcagctgtcctgagctggaccaactggtggaagcagcgttggccgtgcctggggtttacgggagcaggatgaccggcggaggttttggaggatgcactgttaccctccttgaagcctccgccgctccacacgcaatgaggcacatacaagaacattacggcggaactgctacgttctacttgagccaggcggcagatggagcaaaggtcctttgtctg

SEQ ID NO: 11955 - DNA, 1176 bp, Artificial Sequence
  Description of Artificial Sequence: Synthetic coding sequence
atggccgcccttcggcagccacaggtagccgagcttctggccgaagctagacgagcatttagggaggaattcggggctgaacctgagctggccgtgtccgctccagggcgggtgaacttgataggagagcacaccgactacaaccaagggttagtgttgcccatggccctggagctcatgaccgtgctggtggggtctccacgcaaagacggactggtgtccctcctaacaacgtcggagggagctgatgagccacagcgacttcagttcccattgcctacagctcagcgctctctagaaccaggaacaccccgttgggccaattacgtgaagggcgtgattcagtattatccagctgccccactccctgggttttccgctgtggtagtgtcctctgtgccattggggggaggcctgagcagttcagcttctctggaagtggcgacatacacctttttgcagcagctttgtccagacagtggaacaattgcagctagggctcaggtgtgtcagcaggctgagcactctttcgccggcatgccttgtggcataatggatcaattcatttcactgatggggcagaagggacatgcccttctgattgactgtcgttccctggaaactagcctggtgccactttctgatcccaaacttgccgtattaatcacgaattctaacgtgaggcattctctggcctctagtgaatacccagtccgacgccgacagtgtgaggaggtggcaagagctctcggtaaggagagtctccgggaagtgcagctggaagagctcgaggcggctcgtgatcttgtctccaaagaggggttccgaagagcccgacacgttgttggcgagattcgaagaaccgcccaggccgccgcagcactccgcaggggtgactaccgtgccttcggacgcctcatggtggagagccaccggtccctaagagacgattatgaagtgtcgtgcccagagttggatcagctggtagaggccgctctggctgtacctggagtttacggctccagaatgaccggtggtggcttcggtggttgtacggtgacactgttggaggctagcgctgcgccccatgccatgcggcatattcaggagcactatggcggtaccgcaaccttctacctgagtcaggcagcggacggagcaaaggttctgtgtctc

SEQ ID NO: 11956 - DNA, 1566 bp, Artificial Sequence
  Description of Artificial Sequence: Synthetic coding sequence
atggcagcggtggtggcagcgacgcggtggtggcagttgcttttagtcctttctgcggctgggatgggagccagcggcgcgcctcagcctccgaatattttactactgcttatggatgacatgggatggggggatttaggagtctatggtgaaccttctcgggagactccgaaccttgaccgcatggcggctgaagggcttctgtttccgaacttttacagtgcaaatccgctttgctccccctctcgtgcggctctcttaactggaagattgcctatacggaatggcttttacacgacaaacgctcatgcaagaaatgcatacacgccgcaggaaattgttggagggatcccagactcagaacaactgcttcctgaattacttaaaaaagcagggtatgtttcgaagatagtgggaaaatggcatctgggccatcggccgcaatttcacccactgaagcatggattcgatgaatggtttggatccccaaattgtcactttggaccgtacgataataaagcccggccaaatattccggtatatcgcgactgggaaatggtaggaaggtattatgaagagtttccaatcaatctcaaaacgggcgaagctaatttaacgcaaatatatttacaagaggcgttagattttattaagagacaagcgaggcatcacccgttttttttgtattgggctgttgatgcgacgcacgcgccagtctatgcaagcaaaccgtttcttggcacgtcacagcgtggccgctacggcgatgctgtgagagaaattgatgattcaattggaaagatattggaattattgcaggatcttcatgtcgctgataacacatttgtcttttttacgtcggataacggagctgctctgattagcgcaccggaacagggaggatcaaacggaccatttttatgtggcaagcagacaacctttgagggcggtatgcgcgaacctgccttagcgtggtggccgggtcatgtaacggcaggccaagtatctcatcaattaggttccatcatggatttgtttactacctcactggccctggctggtttgactccgccgagtgatcgtgcaattgacggccttaatttgctgccaaccttactacaaggccggctgatggatcgtccgattttctactacagaggcgacacacttatggcagccacgcttggccaacataaggcccatttttggacatggaccaactcatgggaaaattttagacaaggcattgatttctgccctggccagaatgtttctggagtaacgacgcataacttagaagaccataccaaacttccgttaattttccatttaggtcgggaccctggagaaagattcccactgagttttgctagtgcagagtatcaggaagcgctcagtcgcattacatccgtggtccaacagcatcaggaggcactggtgcccgcgcaacctcagttgaatgtgtgcaattgggcggtcatgaactgggccccaccaggttgtgagaagctgggaaaatgtcttacgcctcctgagagtattcctaaaaagtgtctatggagccac

SEQ ID NO: 11957 - DNA, 1566 bp, Artificial Sequence
  Description of Artificial Sequence: Synthetic coding sequence
atggccgcggtcgtggcagcgacccgttggtggcagctgctgctcgtcctttccgccgcaggaatgggcgcttcgggcgccccccagccccctaatatcctccttcttctgatggatgacatgggatggggagatctcggagtgtacggagaaccttcgagagaaacccctaacctggatcgtatggccgccgagggacttctgtttcctaacttctactcggcaaacccactttgttctccatcacgggcggcactgcttaccggtaggctccctatcaggaatggattttacaccactaatgcacatgctagaaacgcatacacccctcaggaaattgtgggtgggatcccagattcggagcagctgctgccggagttgcttaagaaagcaggatatgtgtccaagattgtgggtaagtggcatttgggacatcgacctcaatttcatccgctgaagcatggatttgatgaatggtttggtagcccgaactgccactttggaccctacgacaacaaggcccgccctaacattccggtctaccgcgattgggaaatggtgggacgatactacgaagagttcccgattaacctgaaaacgggagaagcaaaccttactcaaatctacctccaggaggcactggatttcatcaagagacaggcaagacaccatccatttttcctttattgggcagtggatgcgacgcacgccccagtgtacgcatcgaagccatttcttgggacttcgcagcgcggtcgctacggtgatgccgtccgggaaattgacgactcgattggtaagattcttgaactgctccaggatcttcacgtggcagataataccttcgtgtttttcaccagcgataatggtgcggcgcttattagcgcaccagaacaaggtggttccaacggccctttcctttgtgggaagcagactacttttgaagggggaatgagagaaccagcccttgcctggtggcccgggcacgtgacggcaggacaggtgtcgcatcaacttggttcaatcatggatctctttaccacttcgttggcactggctggtcttacgccacccagcgatcgggccattgacgggcttaatcttctgcctaccctgctccagggacgccttatggaccgtcctatcttttactatcgcggcgatactctcatggccgcaacgcttggtcagcataaggcgcatttttggacctggactaactcgtgggagaactttcggcaaggcattgacttttgtcccgggcaaaacgtgtctggcgtgaccactcacaatttggaagatcacaccaagttgcccctcattttccatcttggacgggatcccggtgagcgatttccgctctcgttcgcaagcgcagagtaccaagaagccttgtcgcgaatcacctcggtcgtgcaacagcatcaggaagcactcgtgcctgctcaaccccagcttaacgtctgcaattgggccgtgatgaactgggcacctcctggatgcgaaaaactcggtaaatgcctgacgccccctgaatcaattccaaagaagtgtctttggagccat

SEQ ID NO: 11958 - DNA, 1566 bp, Artificial Sequence
  Description of Artificial Sequence: Synthetic coding sequence
atggccgcagtcgtggccgccacccggtggtggcaacttctgcttgtgctgtcagcagccggtatgggtgcgtcgggggccccgcagccccccaatatccttctcctgctgatggacgacatgggttggggcgacctcggtgtctacggcgaaccctcccgtgaaacccccaacctggatcgcatggcggcagaaggtttgttgtttcctaatttctactcggcaaacccactgtgctctcctagccgcgcagctctgctcacgggaaggctgcctatacgcaatggattctataccactaatgcccatgcccggaacgcatacaccccccaggaaatcgtggggggaattccagattccgaacaattgctccccgaactgctcaaaaaagccggctacgtctccaagattgtgggaaaatggcacctggggcataggccacagtttcatccacttaagcatggttttgatgaatggtttggatcccccaattgccattttggtccttacgataacaaggcacgacctaacatccctgtctaccgagactgggagatggtcggaagatactacgaagagtttcccataaacttgaaaaccggcgaagcaaaccttacccaaatctacctgcaggaagcgctcgatttcatcaagagacaggcaagacaccacccattcttcctgtactgggctgtggacgcaacgcatgcgccagtgtacgcatccaagccatttctgggtacgagccagagaggtcgctacggcgatgcagtgcgcgaaattgacgatagcatcggcaaaattctcgaactcctgcaagaccttcatgtggccgacaacaccttcgtctttttcacttccgataacggtgcagcgttgatttccgctccggaacagggtggatccaatgggccattcctgtgcgggaagcaaactacctttgaaggcggaatgcgcgaaccagcacttgcatggtggcctggtcacgtgactgcaggccaagtctcacatcaactggggagcattatggacctttttacgacttcacttgcccttgccggactcactccaccctccgatagagcaattgatggacttaaccttcttcccaccctcctgcaaggcaggctcatggataggcccattttctactaccggggagatactctcatggcagctaccctgggtcagcataaagctcatttttggacgtggactaactcatgggaaaactttaggcaggggatcgatttctgccccggacagaacgtgtcgggagtgaccacccataacctcgaggatcatactaagctgcctcttatctttcatcttggcagggatccaggggaacggttcccactgtcgttcgcctccgcagagtaccaagaggcgctgagccgcattacctctgtggtgcaacaacaccaggaagcgcttgtgccagcacagccccagctgaatgtgtgcaattgggcagtgatgaattgggcacctccaggctgtgaaaagctgggaaagtgtctgaccccgccagagagcatccctaagaagtgtctttggagccac

SEQ ID NO: 11959 - DNA, 1566 bp, Artificial Sequence
  Description of Artificial Sequence: Synthetic coding sequence
atggcagctgtcgtggcagctaccagatggtggcagctccttctggtgctcagcgcagcaggtatgggagcttcaggagcaccacaacccccaaacatccttctcttgctgatggatgatatgggctggggcgacctgggtgtgtacggtgagcccagccgtgaaacccctaaccttgatcggatggccgcagaaggactgttgtttccaaacttttactcggcaaaccccctttgtagcccatcacgggctgcacttctcaccgggcgcctgccaattagaaatggcttttacactactaacgcacatgcacgcaacgcttacactccgcaagagattgttggaggtatcccagactccgaacaacttttgccagaacttttgaagaaggccggctacgtgagcaagatcgtgggtaaatggcatctgggccatcgtcctcagtttcatccccttaagcatggtttcgatgaatggttcggatcaccaaattgtcactttggaccttacgacaataaggcaagacctaacattccagtgtatcgtgattgggagatggtgggtcgctactatgaagagttcccgattaatctgaaaaccggagaagccaacctgacccagatttacctccaagaagcacttgactttatcaagcgccaagccagacatcatccatttttcctttactgggctgtcgatgcaacccacgcccctgtgtacgcatcgaaacctttcctgggtacctcgcaacggggccgctatggagacgccgtgcgggagatcgatgactcaattggaaagatactcgaactccttcaagatcttcatgtcgctgacaacacttttgtgttcttcacctcagacaacggggctgcactcatctctgctcctgagcagggaggctccaacggaccctttctttgcggaaagcaaaccacctttgaaggcggaatgagggagcctgccttggcctggtggcctggtcatgtgactgcagggcaagtctcgcatcagttgggatcgatcatggatctgtttaccacttccctggcattggcagggcttacccctcccagcgatagggcaatagacgggcttaacttgctgcccacgctcctccaaggacggctgatggatcgaccgattttctactaccggggtgatactcttatggcggcgaccctgggtcagcacaaggcacacttttggacttggacgaactcatgggagaattttcgacagggaattgacttttgcccaggacaaaacgtctcgggagtcactactcacaacttggaggatcatactaaacttccgctgatttttcaccttggtcgggatcccggtgaaaggttccctctcagctttgcctccgctgaataccaggaagcactgtccagaatcacttccgtggttcagcaacaccaggaagccctcgtgcctgcacaacctcaactcaatgtgtgtaactgggccgtcatgaactgggccccacctggctgtgaaaagctcggaaagtgtctgacgccgccagaatccataccaaaaaagtgcttgtggtcccat

SEQ ID NO: 11960 - DNA, 1566 bp, Artificial Sequence
  Description of Artificial Sequence: Synthetic coding sequence
atggccgccgtggttgccgcaacccgctggtggcagctgttgctggtgctctcggctgccggcatgggagcgtccggagcgcctcaaccacccaatattctgcttctgctgatggacgatatgggatggggagatctgggcgtgtacggagaaccatcaagagagacgcccaacctcgacagaatggcagctgaagggctgctgttcccaaatttctactccgccaacccactgtgttcaccttcgcgagctgccctgctgaccggtagactcccaattcggaacggattctacaccaccaatgcccacgcccgcaatgcatatacccctcaggagatagtgggaggaattccagattcggaacagctcttgccggagctcctgaagaaggcgggatacgtgtcaaaaatcgtgggtaagtggcatctggggcacaggccgcagttccacccactcaaacacggtttcgacgaatggttcggttcaccaaactgccacttcgggccctacgacaataaggcccggcccaacatccctgtgtaccgcgattgggaaatggtcggaagatactacgaggaatttcctatcaacctgaaaactggagaagccaatctgacccagatctatcttcaggaggccttggatttcattaaacgccaggcgagacatcacccgtttttcttgtactgggcagtcgatgcaacccacgcacctgtgtatgcctccaaaccgttcctgggaacttcccagagaggtcgctacggagatgccgtccgggagatcgacgactccatcggaaagatcctggaattgctgcaagatctgcacgttgccgacaatacgttcgtctttttcacctccgacaacggtgcggcactcatctcggcgccggaacagggaggatccaacggaccatttctttgcggaaagcagactacctttgagggcggaatgcgcgaaccagccctcgcttggtggcctggccacgtgaccgcgggccaggtgtcgcaccaactggggtcgatcatggacctgttcactacttccctggctctcgccggtttgacgccaccctccgatcgggccatcgatggactcaatctgctgccgacgctgctccaaggacgcctgatggaccgccccattttctactaccgcggcgacactctcatggccgcaaccctcggacaacataaagcgcacttctggacttggacgaattcgtgggagaactttcgccagggcatcgatttctgcccgggacagaacgtctcaggagtcaccacgcacaacctggaggatcataccaaactcccgctgatcttccacctgggtcgggaccctggagaacgctttccgctgagctttgcgtcagcggagtaccaggaagccctgagtcgcatcacgtcggtggtgcaacagcatcaagaagcgctggtgcccgcccagccgcagctgaatgtgtgcaactgggccgtgatgaattgggcgccgccgggatgtgagaagctggggaagtgcctcaccccgccagagtcaatcccgaagaagtgtctttggtcacat

SEQ ID NO: 11961 - DNA, 1566 bp, Artificial Sequence
  Description of Artificial Sequence: Synthetic coding sequence
atggccgccgtggtcgctgcaactcgctggtggcagctcttactggtgctaagtgccgcaggcatgggcgccagtggagccccccaacctcccaacatcctgctgctgctgatggacgacatggggtggggggacttgggcgtatacggtgaaccctccagagaaacccccaatctggatagaatggcggccgagggtcttctcttcccaaatttctacagtgctaatcctttgtgcagcccaagtagggcggccctgctgaccggtagactgcccattcgcaatggcttctacactaccaacgcgcacgcccgtaacgcctacactccccaggaaattgtgggggggattccagactccgaacagctgctgcccgagctcctgaaaaaggccgggtacgtcagtaaaattgtgggcaaatggcatctcggacaccgaccccagttccaccctctgaaacatggattcgatgaatggttcgggtcacctaattgccactttggcccctacgacaacaaagcaagacccaacattccggtatatcgcgattgggagatggtaggccgctattacgaagaatttcccataaatttgaaaaccggtgaggcaaatctgacccagatttacctgcaagaggcactggatttcataaaacgtcaggccaggcaccacccttttttcctatattgggcagtcgacgcgacccatgccccagtctatgcgtctaagccattcctgggaacctctcagaggggacgctacggagacgccgttcgtgagattgatgattccattggaaaaatcctggaactactgcaggatctgcacgttgcggacaatactttcgtttttttcacctccgacaatggggctgcgttgatatcagcccccgagcaggggggatcgaacggaccttttctctgcgggaagcagacaaccttcgaaggaggtatgagggaaccagcattagcctggtggccggggcacgtaacggctggccaagtttcccaccagctgggatctattatggatttatttaccacatctcttgcactcgctggactgacgcccccgagtgatagggctatagatggtctgaacttattgcctacactgcttcaggggagacttatggatagacctattttctactacaggggcgatacattgatggccgctacccttggccaacataaggcacacttctggacatggaccaatagctgggaaaatttcaggcagggcatcgacttttgccccggccagaacgtaagtggggttaccacccacaatttagaagatcacactaaactccctttgatctttcaccttggaagagaccccggtgagcgatttcctcttagttttgccagcgcggaataccaagaagctctgtccagaatcacgtcagtcgttcaacagcaccaggaggcattagttccagcacagccacagttgaatgtgtgcaactgggcagtcatgaactgggccccaccaggctgtgagaaattgggaaagtgtttgacaccgccggagtccatacctaagaagtgtctgtggagtcat

SEQ ID NO: 11962 - DNA, 1566 bp, Artificial Sequence
  Description of Artificial Sequence: Synthetic coding sequence
atggccgccgtcgtggcagccaccagatggtggcaactcctgctggtgctcagcgccgctggaatgggtgcgagcggagcaccgcaacctcctaacatcctcctcctgctcatggatgacatgggatggggcgacctgggggtgtacggagaaccgtcaagagagactccaaacctggatcggatggccgcggaaggactgctcttcccaaacttctacagtgctaatccactctgctcgccgtcgcgcgccgccctgctcaccggacgcctgccgatccggaacgggttctatactaccaacgcccacgcccggaatgcatacactccacaggagattgtcggaggtatcccggattcggaacaactgctgcctgagcttctcaagaaggcagggtacgtctcaaagatcgttggaaagtggcatctggggcatcgtccacagttccacccactgaaacatggatttgacgaatggttcggatcgccgaattgccacttcggaccgtacgacaataaagcccgcccaaacatcccggtgtaccgggattgggaaatggtggggcggtattacgaagagttcccgattaacctgaaaaccggagaagccaacctcacgcagatctatctgcaagaagctcttgacttcatcaagagacaggcgcgccatcaccccttcttcctctactgggcggtagacgcaacccacgcccctgtgtacgcatctaagccgttcctgggaacgtcccaaaggggacggtacggggatgcagtccgggagatcgatgactcgatcggcaagatcctggagctgctgcaggatctccacgtcgccgataacaccttcgtgttctttaccagcgacaatggagcagccctcatctccgcacctgaacaaggaggatcgaatggcccgttcctctgcggaaaacaaaccacctttgaagggggaatgagagagccggcgctcgcgtggtggccgggccacgtgacggcgggacaagtgtcgcaccaactgggatcaattatggatctgttcaccactagcctcgcactggccggactcactccgccctcggatcgggccatcgatggactgaatttgctcccaaccttgctgcaaggaaggcttatggaccggccgatcttctactacagaggagacactctgatggccgccaccctcggacaacataaggctcacttctggacctggactaatagctgggaaaactttcgccagggcatcgacttctgcccgggacagaacgtgtcaggcgtgactacccacaacctcgaggaccatactaagctcccgcttatcttccatttgggacgggatccgggtgagcgctttccgctctcctttgcgtcagctgaataccaagaagctctctccagaattacctccgttgtgcaacagcatcaagaagcgttggtgcccgcccagccgcagcttaacgtctgcaactgggccgtgatgaattgggctcctcccggctgcgaaaagctgggaaagtgcctgaccccaccagagtccatccctaagaaatgcctctggagccat

SEQ ID NO: 11963 - DNA, 1566 bp, Artificial Sequence
  Description of Artificial Sequence: Synthetic coding sequence
atggctgccgtcgtcgcggcaacccgatggtggcaactactcctcgtgctatccgcggccggcatgggggcatcaggcgccccacagcctcctaacattctcctgctgcttatggacgacatgggctggggcgatctgggcgtctatggcgagccaagtcgggaaaccccaaacttggacagaatggcagccgagggtctcttatttcccaacttttattccgccaaccctttgtgctctcccagccgcgccgcattgctcacaggtaggctgcccatcaggaacgggttctacactaccaacgctcatgctcgcaacgcttatacacctcaagaaatcgtgggcggcattcctgactctgagcagctgctgcccgaactactgaaaaaagcggggtatgttagcaaaatcgtagggaaatggcacctagggcatcgacctcagttccatcccctcaagcatggattcgatgagtggtttggctcacccaactgccatttcggcccttatgataacaaggcacgccccaacatccccgtttatagagactgggagatggtgggacggtattacgaagagttccccattaaccttaagaccggagaagcaaatctcactcaaatttacttacaggaggcacttgactttattaaacgacaagctcggcatcatccattctttctgtattgggctgtggatgcgactcacgctcctgtatatgccagtaagccttttctgggcacctcccagcggggccgctatggtgatgcagttcgcgagatcgacgactcaatcggaaaaattttagaactcctccaggacctccacgtggccgacaacactttcgtcttttttacctccgataatggggctgccctcatttcagcgccagaacaagggggctccaatggaccgtttctgtgtggcaaacagaccacttttgaggggggtatgcgcgagccagccctggcttggtggcctggacatgtcacagcaggccaagtcagccatcagctgggtagcatcatggatttgtttaccacttcgctcgccctggctgggctgacacccccctccgatcgggctatcgacggattaaacctactccctacactgctccagggcaggcttatggatcggcccattttctattatagaggtgatacactgatggcggcaacccttggacagcacaaagctcacttctggacttggacaaattcttgggaaaattttcggcagggcatcgatttttgtccaggccagaacgtgtctggcgtcaccacacataatcttgaggatcacacgaagctccctctcatttttcacctgggccgtgacccaggcgaacgattccctctgagctttgcatcagctgaataccaggaagctctgtcccgaatcaccagcgttgtgcagcagcaccaagaggctttagttcccgctcaaccccagctgaatgtttgtaattgggctgtgatgaactgggccccacccggttgtgagaagttaggtaaatgcttgaccccacccgaatccataccaaagaagtgcctttggagccac

SEQ ID NO: 11964 - DNA, 1566 bp, Artificial Sequence
  Description of Artificial Sequence: Synthetic coding sequence
atggcggcggtagtagcggcgacgcgttggtggcaattactattagttctatcggcggcgggtatgggtgcgtcgggtgcgccgcaaccgccgaatatactattactactaatggatgatatgggttggggtgatctaggtgtttatggtgaaccgtcgcgtgaaacgccgaatctagatcgaatggcggcggaaggtctattatttccgaatttttattcggcgaatccgttatgttcgccgtcgcgtgcggcgctactaacgggtcgattaccgatacgtaatggtttttatacgacgaatgcgcatgcgcgtaatgcgtatacgccgcaagaaatagttggtggtataccggattcggaacaactattaccggaactattaaaaaaagcgggttatgtatcgaaaatagttggtaaatggcatttaggtcatcgtccgcaatttcatccgttaaaacatggttttgatgaatggtttggttcgccgaattgtcattttggtccgtatgataataaagcgcgtccgaatataccggtatatcgtgattgggaaatggtaggtcgatattatgaagaatttccgataaatctaaaaacgggtgaagcgaatttaacgcaaatatatttacaagaagcgctagattttataaaacgacaagcgcgtcatcatccgttttttctatattgggcggtagatgcgacgcatgcgccggtttatgcgtcgaaaccgtttctaggtacgtcgcaacgtggtcgttatggtgatgcggtacgagaaatagatgattcgataggtaaaatactagaattattacaagatctacatgttgcggataatacgtttgtattttttacgtcggataatggtgcggcgttaatatcggcgccggaacaaggtggttcgaatggtccgtttctatgtggtaaacaaacgacgtttgaaggtggtatgcgagaaccggcgctagcgtggtggccgggtcatgtaacggcgggtcaagtttcgcatcaactaggttcgataatggatctatttacgacgtcgttagcgttagcgggtctaacgccgccgtcggatcgagcgatagatggtctaaatttactaccgacgttactacaaggtcgattaatggatcgaccgatattttattatcgaggtgatacgctaatggcggcgacgttaggtcaacataaagcgcatttttggacgtggacgaattcgtgggaaaattttcgacaaggtatagatttttgtccgggtcaaaatgtttcgggtgtaacgacgcataatttagaagatcatacgaaactaccgctaatatttcatctaggtcgagatccgggtgaacgttttccgttatcgtttgcgtcggcggaatatcaagaagcgctatcgcgtataacgtcggtagtacaacaacatcaagaagcgttagttccggcgcaaccgcaattaaatgtttgtaattgggcggttatgaattgggcgccgccgggttgtgaaaaactaggtaaatgtttaacgccgccggaatcgataccgaaaaaatgtctatggtcgcat

SEQ ID NO: 11965 - DNA, 1566 bp, Artificial Sequence
  Description of Artificial Sequence: Synthetic coding sequence
atggccgcggtcgtcgcagccacacgctggtggcagctgctgcttgtcctgtctgcagcaggcatgggcgcttctggagcgccacagcctcctaacattctgctcctgctcatggatgacatgggatggggcgacctgggcgtttacggcgagccatcaagggagacgcctaacctggatcgcatggcggccgagggcctactgttcccaaacttctatagtgctaatcctctgtgtagtccgtctagggccgccctgctgactggcaggcttccgattaggaatgggttctacacaacaaatgctcacgcacggaacgcctacacgcctcaggaaatcgtgggcggaattcccgacagcgaacaattgttgcctgagctcttgaagaaggctgggtatgtgagtaaaattgtgggcaagtggcatctgggtcatcgcccccagttccatccactgaaacacggtttcgacgagtggtttggctcgcccaactgccattttggcccctacgacaataaagctcgccctaatatcccagtctaccgcgactgggagatggtaggccgatattatgaggaatttcccattaacctgaaaacaggagaagcaaacctgacacagatatacttacaagaggctctcgatttcatcaagcgccaggcgagacatcacccattttttctctactgggcggtggatgctacccatgcgcccgtgtatgcctccaagccattcctgggcacaagccagagggggcggtatggagacgcagttagggaaatcgatgacagcatcggtaagatcctggagttgctgcaggatctccatgtagccgacaatacgtttgtcttcttcacatctgacaatggagccgcactcatctctgccccggagcagggaggtagcaatggccccttcctctgcggcaaacagacaactttcgagggtggaatgcgagagcctgccttggcctggtggccaggccatgtcactgccggacaagtaagtcatcagctgggatcaatcatggatttgtttacgacgagtctcgcattagctggcctgactccaccatcagacagagccattgacggacttaatctgctgcccactttgctccagggacgccttatggacagacccattttttattaccggggcgatacccttatggccgcaacactgggccaacataaggcccatttctggacttggacaaactcttgggaaaatttcaggcaaggcatagacttctgtcccggccaaaacgtctccggggtaaccacacacaacctggaggaccatactaaactgcctttaattttccatcttggaagggatccaggcgagcgcttcccactgtcattcgccagcgccgagtaccaggaagctctgagtagaattacatctgttgtgcaacagcaccaggaagcactggtcccggctcaaccccagttgaacgtgtgtaactgggctgtgatgaactgggctccacccggctgcgaaaaactgggtaagtgtcttacgccacccgagagcatcccgaaaaagtgcttgtggtcacac

SEQ ID NO: 11966 - DNA, 1566 bp, Artificial Sequence
  Description of Artificial Sequence: Synthetic coding sequence
atggccgctgtggtggccgctacccggtggtggcagctgctgctcgtcctctctgcggccggaatgggagcatccggtgcgccgcagccccccaatatcctcctcctcttgatggacgacatgggatggggggacctgggcgtgtatggagaaccttcacgggagacgccgaatctggatcgcatggctgcagagggactgctctttcctaacttctactcggcgaatccgctgtgctcgccgtctcgtgccgcgcttcttactggtaggctcccgatacggaacggcttctacaccactaacgcccacgctagaaatgcctacacgccccaagaaatcgtcggaggtatcccagactccgagcaactcctgccagaactgttgaagaaagctggatacgtctcgaagatcgtcggaaagtggcatctcggccacaggcctcaattccatccactcaagcatggattcgacgagtggttcggttctcccaactgccatttcggtccttacgacaacaaagcccgcccgaacattcctgtgtaccgggattgggaaatggtcggacgatactacgaggaatttccaatcaatcttaagaccggcgaagcgaatctgacccagatttatctccaagaagcactcgacttcatcaagcgccaggccaggcaccacccgttctttctctactgggccgtcgacgctactcatgcgccagtgtacgcttcaaagcccttcctgggcacctcgcaaagaggacgatacggggacgccgtgcgggaaattgacgattccatcggaaaaatcctggaattgctgcaagatctgcacgtggcggataacacttttgttttcttcacttcagacaacggcgcagcattgatttccgcaccggaacagggcggctcgaacggtccttttctctgtggcaagcagaccacgtttgagggtggtatgcgcgagccggcgctggcctggtggcctggacacgtgactgcaggacaggtgtcccaccagttgggctccatcatggatctgtttaccacgtcgctcgcccttgcgggactgaccccaccgagcgaccgggcgatcgacggcctgaatctgctgccgaccctgctgcaaggacggctgatggacagacctatcttctactaccgcggagatactctcatggcagccaccctgggacagcataaagcgcatttctggacttggaccaactcgtgggagaacttccgacaggggatcgatttctgtccaggacagaatgtgtcaggcgtcactacccacaacttggaggatcatactaagttgcctctcatattccacctcggacgcgatccgggagaaaggttcccgctgagcttcgccagcgccgaataccaggaggcattgagcaggatcacgtcggttgtgcaacagcaccaggaggccctcgtcccagcccaaccccagcttaacgtgtgcaattgggccgtgatgaactgggcgcctccgggctgcgagaagctgggaaagtgccttaccccacccgaatcgatcccaaaaaagtgcctttggtcacac

SEQ ID NO: 11967 - DNA, 1566 bp, Artificial Sequence
  Description of Artificial Sequence: Synthetic coding sequence
atggcagcagtggtcgcggcaacgcgctggtggcaactccttcttgtcctgagcgcggcaggaatgggtgctagcggggcaccacaacctcctaacattcttcttctgctgatggatgatatgggctggggcgaccttggggtgtacggcgagccatcaagagaaaccccgaacctcgaccggatggcagcagaaggactcctgtttcctaatttctactcagcgaaccctctttgttcgccatcacgggcagcacttctgactggccggctgccaatacggaacgggttttacaccactaacgcacacgcaagaaacgcctacactcctcaagaaatcgtgggcggaattcctgattccgaacaactgcttccagaacttcttaagaaagcaggctacgtgtccaagatcgttggaaagtggcatctgggacacagacctcaatttcatcctctgaagcatggatttgacgaatggttcggatctcccaattgtcattttggtccgtacgacaacaaagcaagaccaaatatcccggtttatcgggattgggagatggtgggaagatactacgaagaatttcctatcaatcttaaaactggggaggcaaaccttactcaaatctacctgcaggaggcactggatttcatcaaaagacaggcccgccaccatcccttttttctctactgggctgtcgatgcaacccatgcacctgtgtacgcatctaagccttttctgggaacgagccaacgcggtagatatggagatgcagttcgggaaattgatgactccattggaaagatacttgaacttcttcaggacctgcatgtggcagataacactttcgtctttttcacgtcggacaatggagcagcgcttatctcggcgccagagcagggcggctccaatggaccctttctttgcggaaaacagaccacctttgaaggagggatgagagagcctgcattggcgtggtggcccggccatgtcactgcgggacaagtgtcccaccaactcggatcgataatggatctgtttacgacctcgctcgcacttgccgggcttacgcccccatcggatcgggcaattgatggtttgaacctgctcccaactcttcttcagggtcgattgatggatcgtcccatcttctattacagaggcgacaccctgatggcagcaaccctcggacagcataaggcgcatttctggacctggactaactcgtgggaaaacttcaggcaggggattgatttttgtcccgggcaaaacgtctccggagtgaccacgcacaacctggaagatcatactaaactgcccttgattttccatcttggaagagatccaggagaacgcttcccactctcctttgcaagcgccgaatatcaggaggctctgagtaggattacctcggtggtacagcaacatcaagaagccctggtgcctgctcaacctcagcttaacgtgtgcaattgggcagtcatgaattgggcccctcctgggtgcgaaaaactgggcaaatgtcttactcccccagagagcattcctaagaagtgtctttggtcgcat

SEQ ID NO: 11968 - DNA, 1566 bp, Artificial Sequence
  Description of Artificial Sequence: Synthetic coding sequence
atggcggcagtggtcgctgccacccgctggtggcagctcctgcttgtcctgtcggctgcgggcatgggcgccagcggagccccacagccaccgaatatcttgcttcttttgatggacgacatgggctggggcgacctcggggtgtatggggagccaagcagggagactcccaacctggaccggatggcagcagaagggcttcttttccccaacttctacagcgcaaatccactgtgcagcccgtcgcgcgccgcgctgctgaccggaaggcttccgatccgcaacggattctatacgactaacgcgcacgcacgcaacgcgtacactcctcaggaaattgtcggtggaatcccagattcagagcagctgcttccagagctgctcaaaaaagctgggtacgtgagtaaaatcgtcggcaagtggcacctgggacacagaccgcaattccatccgctgaagcatgggttcgacgaatggttcgggtcgccgaactgccatttcggtccgtacgacaacaaggctcggccgaacattccggtgtaccgcgactgggagatggtgggacgatactacgaagaattcccgatcaatctcaaaactggcgaagcaaacctcactcagatttacttgcaggaagcactggactttatcaagcgccaggcccggcatcacccgttttttctctactgggcggttgatgccactcacgccccggtgtacgcctcaaaacctttcctgggaacctcccagcgcggcaggtacggcgacgccgtgagagagatcgatgactccatcggaaagatccttgagctgctgcaggacttgcatgtggccgataacacttttgtgtttttcacctcggacaacggggcagcactgatttctgccccggagcagggaggcagcaatggtcctttcctttgcggcaagcagactaccttcgagggaggcatgagagagccggccctggcctggtggccgggacatgttactgcaggacaggtgtcacatcagctgggctcgatcatggatctgttcaccacctcacttgctctggcaggtctgactccgccatccgaccgcgcgattgacggtctgaacctccttcctaccctgctgcaggggcgcctgatggacagaccgatcttctattaccggggagataccctcatggccgccaccctgggccaacacaaggcccacttctggacctggactaattcctgggaaaactttcggcaagggatcgatttttgccctggacaaaacgtgtcgggagtcaccacccataacctcgaggatcacactaaactgcctctgattttccacctgggacgggatccgggtgaaaggttcccgctctcattcgcgtccgcagaataccaagaagccctttcgcgcattacttctgtggtgcagcaacaccaggaagcgctcgtgccagcccaaccacagcttaatgtctgcaactgggccgtgatgaactgggcaccaccgggatgcgagaagctgggaaagtgcctgactcctccagagtcaatcccaaagaagtgcctctggtcccac

SEQ ID NO: 11969 - DNA, 1566 bp, Artificial Sequence
  Description of Artificial Sequence: Synthetic coding sequence
atggccgcagtggtggcagcgacccggtggtggcaactgctgctggtgctttcggcggccggtatgggagcgtccggagcacctcagcctcctaacattctgctgctgttgatggatgatatggggtggggtgaccttggagtgtacggcgaaccaagccgcgaaaccccaaacctggatcgcatggccgcagagggtttgcttttcccaaacttttactcagccaaccccctttgttcgccatcgcgcgccgcactcctcaccggtagactgccgatcagaaacggcttttacaccaccaacgctcatgcccggaatgcatacacccctcaagagatcgtgggtgggattccggattcagaacaacttttgcccgaactcttgaagaaagccggatacgtgtccaaaattgtcgggaaatggcatctgggacatagacctcaattccatccgcttaagcacgggtttgacgaatggtttgggtcaccaaactgccatttcggcccatacgacaataaggcaaggcctaacattccagtgtaccgcgattgggagatggtcgggaggtactacgaggaatttccgatcaatctgaaaactggcgaagcaaacctcacccaaatctacctccaggaggcactcgacttcattaagcggcaagccagacaccacccatttttcctgtactgggcagtagacgcaacccatgcaccagtgtacgccagcaagccttttcttggtacgtcacagcggggaagatacggagacgcagtgcgtgagatcgatgattccatcggtaagatccttgaactgcttcaagaccttcatgtggcagacaacacctttgtgttcttcacctctgataatggcgcagcgcttatttccgcacccgaacagggaggctcgaacgggccttttctgtgtggaaaacagaccacctttgaaggagggatgcgcgaacctgcacttgcgtggtggccaggacacgtgactgccggacaagtctcccatcaattgggttcaatcatggacctctttaccacgtccctcgcccttgcaggattgaccccaccttccgacagggcgattgatgggctgaacctcctgcctactcttcttcaaggccggctcatggatcgacctattttctactacagaggggatactctcatggcagcaaccctgggacaacacaaggcgcatttttggacctggaccaactcgtgggagaactttagacaagggatcgatttttgtcctggacagaatgtgtcgggtgtgacgacgcacaatttggaggaccatactaagctccctctgatttttcatctgggtcgtgaccccggtgagcgcttccctcttagctttgcatcagccgagtaccaggaagctctgtctcggattacctcagtggttcagcaacaccaagaagcactcgtgcctgcgcaaccacagctgaatgtctgcaattgggcagtgatgaactgggcaccccccggatgcgaaaaacttggaaagtgtctgacgcctcccgaatcgatccctaaaaagtgtctctggtcccac

SEQ ID NO: 11970 - DNA, 1566 bp, Artificial Sequence
  Description of Artificial Sequence: Synthetic coding sequence
atggccgctgtcgtggccgctactcgctggtggcagctcctgctggtgctgagtgctgccgggatgggggcttctggggcacctcagccaccaaatattctgctgctgttaatggacgatatgggctggggcgacttgggcgtgtacggcgagccttctcgcgaaacccctaacctggatcggatggctgccgaaggtctgttgttccctaatttctatagtgccaaccccttgtgctctccttcacgagcagccttactaacaggaagacttccaatccgtaatggattctacaccaccaacgcccacgcacggaacgcctacacccctcaagagatagtaggcgggattccagacagtgaacaactcttgcccgagctcttaaagaaggcaggctatgttagcaaaatagtcggaaaatggcatcttggacacagaccacagttccacccactgaagcacggattcgatgagtggttcggctcccctaattgtcattttggaccatatgataacaaggctcgtcccaatatccccgtttatagggactgggagatggtcgggcgttactacgaggaatttcccatcaatctcaagactggcgaggcaaatctaacccagatatacctgcaagaagctctggattttataaagcgccaggctagacatcacccctttttcctatattgggccgtggatgccactcacgcccccgtgtatgccagcaagccattcctggggacaagccaaagagggcgctacggcgatgccgtgcgagaaatcgatgatagcatcggtaaaatcctagagctgctgcaagatttacacgtcgctgacaacacttttgtattcttcaccagtgataatggcgccgcccttatctctgccccagaacaaggaggctctaatggcccctttctgtgtggaaaacagactaccttcgagggcggaatgcgcgaaccagcattggcctggtggcccgggcacgttactgcagggcaagtttctcatcagctggggagcataatggatttattcactacctctttagccctggctgggctgactcctccttccgatcgggccatagacggcctcaacttactgcccactctcctgcagggcaggctgatggatcggcctatcttttactatagaggggacactttaatggcagctaccttaggacagcataaagcccacttttggacctggacaaactcctgggagaactttcgtcaaggaatcgatttttgccctggccaaaacgtcagcggggtgaccactcataacctcgaagatcacacaaaactgcctctgattttccacctgggacgggacccaggcgagcggttccctctgtcttttgcttccgcagagtatcaggaggccctgtctcgaatcacctccgtagtgcaacagcatcaggaggctctagtgcccgcccagccccaactgaacgtgtgcaattgggcagtgatgaactgggctcctcccggctgcgaaaaacttggaaagtgtttaacaccacccgaatctatccccaagaagtgtttgtggtctcac

SEQ ID NO: 11971 - DNA, 1566 bp, Artificial Sequence
  Description of Artificial Sequence: Synthetic coding sequence
atggcagccgtggtggcagcaaccagatggtggcaactgcttctcgttctctccgcagctgggatgggcgcatcaggagcgcctcaaccaccgaatatactgctgcttctcatggacgatatgggatggggtgacctgggcgtgtacggcgagccttcgcgggagactccaaatcttgataggatggcagcagaaggtcttttgtttcctaatttctactcggctaacccactctgctcaccgtcaagggcagcactcctgactggtagactcccaatccggaacggattttacaccacgaatgcacatgccagaaacgcatataccccgcaggagattgtgggtggaatccctgactcggaacagcttctgcccgaactgctcaagaaggcaggttacgtgtcaaagattgtcggcaagtggcacctgggccaccggcctcaatttcatcctctgaagcatggatttgatgagtggtttggatcacctaactgccatttcggaccatacgataacaaagcacgccccaatatcccggtctacagggattgggagatggttggtaggtactacgaggagtttccgatcaacttgaaaaccggtgaagcaaacctcacgcagatctaccttcaggaagcactcgacttcattaaacggcaagcccgtcaccatccgttttttctctactgggcggtggacgcgacgcatgcccccgtgtacgcatcgaagccatttctcgggaccagccagcgggggaggtacggtgatgcagtgagagaaatagatgattcaattgggaaaatcctggaacttcttcaagaccttcatgtggcggataacaccttcgttttctttacttcagataacggggcagcccttattagcgcaccagaacagggtggctccaatggtccttttctgtgcggaaaacaaactacgttcgagggaggtatgcgtgaacctgcacttgcatggtggccaggccatgtcaccgccggtcaggtgtcccaccaattgggctcgatcatggacttgttcacgacttcccttgcacttgccgggctcactccgccttcggaccgcgccatagatgggttgaatttgcttcctactctgttgcaaggtcgcctcatggacagaccgatattctactaccgaggcgataccttgatggccgcgactctcgggcaacacaaggctcatttttggacctggaccaactcctgggaaaacttccgccaaggcattgatttttgtcccgggcaaaacgtgtccggtgttacgacccataacctggaagatcataccaagttgcccctcatttttcacctgggcagggaccctggagaacgtttcccacttagctttgcatcggcagaataccaggaagcactgtcgagaatcactagcgtggtccagcaacatcaggaggcccttgtgcccgcacaaccccaactgaatgtgtgtaactgggccgtgatgaattgggcccctccgggttgtgaaaagctgggaaagtgtctcacgccacctgagtctattccgaaaaagtgtctgtggtcccac

SEQ ID NO: 11972 - DNA, 1566 bp, Artificial Sequence
  Description of Artificial Sequence: Synthetic coding sequence
atggctgcagtggttgcagcgacccggtggtggcagctgcttttggtccttagcgccgccggtatgggggcttccggagccccacagccacccaatatcttgctcctgctgatggatgatatgggctggggtgaccttggggtgtacggagaacccagccgagaaacgcccaatctagaccgcatggctgccgagggcttactttttccgaacttctattcagcaaatccattgtgttccccttcccgcgcagccttgctgaccggacggctgcccatacggaacggcttttacactactaacgcacacgctcgtaatgcttacactccgcaggagatcgtcggcggtattcccgacagcgagcagctgctcccagaattattgaaaaaagctggctacgtgtcaaaaattgtgggaaaatggcatttgggccacagacctcaatttcacccactgaagcacggcttcgatgagtggtttgggagtcccaactgccatttcggaccatacgacaataaggcccgtccgaatataccagtgtacagagattgggagatggtgggaagatattacgaagagtttcccatcaacctgaaaaccggcgaggccaacttgactcaaatctatctgcaggaggctctcgactttattaagcgccaagccagacaccatccattcttcctgtactgggctgtggatgccactcacgctccagtttatgcatcaaaaccctttctaggcacctcccagcgcggtagatacggggatgctgtgagggaaatagacgactccatcggcaagatccttgagttgcttcaagatctgcacgtagctgacaacacattcgtattctttacttccgacaatggcgccgctctgatttctgcgccagagcagggcggctccaatgggccgttcctctgcggaaagcaaacaacatttgagggaggtatgcgagaacctgcacttgcctggtggccaggacatgtaacggcaggccaggtctctcaccagcttggttctataatggacctgttcactactagcctagctctggcaggtctaactccaccgagcgacagggctattgacggactgaatctgttgccaaccttactgcagggccgtttgatggacaggccaatattctactatcggggagatacgctcatggctgcaaccctcggccaacacaaagctcatttttggacctggaccaactcctgggagaactttcggcaaggaatcgatttttgtcctggtcaaaacgtgtccggagtaactactcataacttggaggaccacacaaaactgcctctgatctttcacctgggccgcgatccaggtgaacgatttcctctaagctttgcctctgctgagtaccaggaggcacttagtcgcatcaccagcgtggtgcaacagcatcaagaagccttggtgcccgcacagccgcagttgaacgtgtgcaattgggccgtgatgaactgggcccctccagggtgtgagaagcttggaaaatgcctaacaccacccgaatctatacctaagaagtgtctgtggagtcac

SEQ ID NO: 11973 - DNA, 1566 bp, Artificial Sequence
  Description of Artificial Sequence: Synthetic coding sequence
atggcggccgtggtagccgccacaaggtggtggcagctgttactggtcctcagcgctgctggaatgggagccagcggcgccccccaacccccaaatatactgcttctcctcatggacgatatggggtggggggacctgggcgtatacggtgagccttccagagagacaccaaatttggatcgtatggccgcagagggattgctgttccccaacttttatagcgctaaccctctgtgcagcccctccagagccgctcttctcacgggtcgactgccaattcgaaatgggttttatactacaaatgcccacgccagaaatgcctataccccacaggagatagtgggaggtatacctgatagcgaacagctgctgcctgaactgctcaaaaaagcaggttacgtgagcaagattgtgggcaaatggcacttgggccatcgccctcagttccatccactgaaacacgggtttgatgaatggttcggatcccccaattgccatttcgggccgtatgataataaggcacgcccgaatataccggtgtaccgtgactgggaaatggtgggcaggtattacgaagaattccccatcaacctaaaaactggggaggcgaatttgacacagatctaccttcaggaagcactggactttatcaagagacaggcgcgacaccatcctttcttcctctactgggctgtcgacgcgactcatgctccagtatacgcctccaaaccatttttgggcacatcccagaggggtagatatggagacgccgtcagggagatcgacgactctataggaaagatcctcgagcttctgcaagatctacacgtcgccgacaatacttttgtctttttcacatcagacaatggagccgcactgatatcagcccctgagcaggggggatcaaatgggccatttttatgtggaaagcagaccaccttcgagggaggaatgcgcgaaccagctcttgcatggtggcccgggcacgttactgccggacaggtgagtcatcagctcggctcaataatggatctgttcacaacctccctggctctggctggtctgacgcctccaagcgaccgcgccatcgatggtctgaacctgctgcccaccctcttgcagggtaggcttatggaccgacctatcttttactacagaggagacaccttgatggcagccactctgggacaacataaggcccacttctggacctggacaaattcctgggagaattttagacagggcattgacttttgtccaggccagaacgtgtccggtgtgacaacccataatctcgaagatcacactaagctgcccctgatcttccacttgggtcgcgacccaggcgagcgtttcccactttcttttgcctcagccgagtaccaggaggccctgtcccgcattacctccgtcgtgcagcagcaccaggaagccctcgtccctgcgcagcctcagttgaacgtctgcaattgggcagtgatgaactgggcacctcccggatgcgaaaagttaggtaagtgccttactccccccgaaagcattcccaagaaatgtctctggtctcac

SEQ ID NO: 11974 - DNA, 1566 bp, Artificial Sequence
  Description of Artificial Sequence: Synthetic coding sequence
atggcagccgtcgtcgccgccacccgatggtggcaactactgcttgttctgagcgccgctgggatgggagccagtggtgctccccagcccccaaatatcttgctgctgttgatggatgatatgggatggggagatctcggcgtttatggagaaccttctcgcgaaacacctaacctggaccgcatggcagctgaaggtctcctctttccaaatttctactctgctaatccattgtgcagtccatcgcgggctgcactgctcaccggaaggcttcccatcaggaacggcttctacaccacgaacgcgcacgcgagaaacgcatatactcctcaggagatcgtggggggcatccctgattccgaacaacttcttcccgagctcctgaaaaaagctgggtatgtgagcaaaatcgttggtaagtggcacctgggacaccgcccccagtttcaccccctgaaacacggcttcgacgagtggttcggaagcccaaactgtcattttggcccctatgataacaaggcgcggcccaacataccagtgtatcgggactgggagatggtggggcggtattatgaggaattccccatcaacctgaaaacaggcgaagctaaccttacacagatctatcttcaggaagctctcgattttattaaaagacaggctcggcatcatccgttctttctttattgggctgtggatgccacacacgccccagtctacgcttccaaaccctttctcggcacctcacagcgtggccggtatggcgatgccgtcagagagatcgacgactcaattgggaaaattttggagctgctgcaagatctccacgtggccgacaacacatttgtgttctttacatctgataatggggcagccctgatcagcgcccccgagcaaggcggctcgaatggcccattcctgtgtgggaagcagaccaccttcgaaggtggaatgagggagcccgctctggcttggtggcccggtcatgttaccgctggacaggtgtctcaccagctgggtagcattatggatctgttcactacttctctggctcttgccggtcttacacctcctagcgaccgggcgatagatgggctgaatctgctccctactctccttcaggggagattgatggaccgaccaatcttttactatcgaggggatacgctgatggccgccactttggggcagcataaggcacatttctggacttggactaactcttgggaaaatttccgtcagggcattgacttctgccctgggcaaaatgtaagtggagtgactacccataacctggaggaccatacaaaactaccgctcattttccatttaggtagggatcccggcgagcgtttcccgttgtctttcgcttcagccgaataccaagaggccctttccaggatcacgtctgttgtgcagcagcaccaggaggctctagtccccgcgcagcctcaactcaacgtctgtaattgggccgtgatgaattgggcccccccaggctgcgagaagctcggcaaatgcctgacacctcccgaaagtatcccgaagaagtgtctgtggagtcac

SEQ ID NO: 11975 - DNA, 1566 bp, Artificial Sequence
  Description of Artificial Sequence: Synthetic coding sequence
atggcagcagtggtggccgctacaaggtggtggcagctgctgttggtgctcagtgccgccggaatgggtgcttctggagccccccaacctcctaatatactgcttttgctcatggatgacatgggctggggagacctgggcgtgtatggcgagccctctcgcgagacccctaacctcgatagaatggcagctgaaggtctgctcttcccaaatttctattcagcaaacccattgtgctctccatccagggccgctctccttaccggaagactccccatcaggaacggcttctataccactaatgctcacgcacgtaacgcatacacaccccaggagattgtgggaggcatccccgatagcgaacagttgctcccagaactgctcaagaaggccggctacgtctcaaaaatcgtgggaaagtggcatcttggtcatcgcccacaattccacccactgaagcatggtttcgacgagtggtttggatcacctaattgccacttcggaccttacgacaacaaggcccgccctaatattcccgtatacagggattgggagatggtgggcaggtattacgaagagttccctatcaacctcaagacaggtgaagccaacctgacccaaatttaccttcaggaagcactcgacttcattaagagacaggccaggcatcacccattctttctgtactgggcagtggatgcaacccatgctcctgtgtatgccagtaagcctttcttgggtacatcacagaggggaaggtacggcgatgccgttagagagatcgacgacagtatcggtaaaatcctggaactgctccaagatctgcacgtggctgataacaccttcgtgttcttcacaagtgacaacggagcagccctgatcagcgcaccagagcagggtggatctaacggccctttcctgtgcggaaagcaaacaactttcgaaggcggcatgagagaacccgccctggcctggtggccaggacacgtcacagcaggccaggtgtctcaccaactgggatcaatcatggacctgtttaccacatccctggcactggctggtcttaccccaccctccgatagggcaatcgatggactgaacctgctccccacccttctccaaggtagacttatggataggccaattttctactaccgtggagatacattgatggctgctacactgggccagcataaagcccacttctggacatggaccaactcctgggaaaatttcagacagggtatcgacttctgcccaggacaaaacgtgagcggagtaaccactcacaacctggaagaccacacaaaacttcctttgatttttcatctgggccgcgaccccggcgaacgtttccctctctccttcgctagcgccgagtaccaggaggccctttctaggattacttcagttgtgcagcagcatcaggaagccctggtgcccgctcagccccagttgaacgtgtgcaactgggctgtcatgaattgggccccccccggctgcgagaaacttggtaaatgcctcacacctcctgagtccatccctaaaaagtgtctgtggtcacat

SEQ ID NO: 11976 - DNA, 1566 bp, Artificial Sequence
  Description of Artificial Sequence: Synthetic coding sequence
atggccgcggtggtggctgccacaagatggtggcagctgcttttagttctgtctgctgcgggaatgggcgcttcaggagctccacagcctccaaatattcttctattgctcatggacgacatgggatggggtgatctgggcgtttacggggagccatcaagggaaacaccaaacttggataggatggctgccgaggggctcttgtttcctaacttttatagcgccaaccctctgtgttctcctagtagagctgccctgctgacgggccgacttcctatcagaaacggcttctacactactaatgctcacgcacgcaatgcttatacaccgcaagaaatcgtgggaggtatccctgactctgagcagctgctcccagaactgctgaagaaagccggttacgtcagcaaaattgtcggcaaatggcacctcggccacaggccccaattccatcctctgaaacacggatttgacgagtggttcggatccccaaactgccacttcggcccgtacgacaacaaggcccggccaaacatacctgtgtaccgggattgggagatggtcggtcgttattacgaagagtttcctattaaccttaaaacaggagaagccaatctgacgcagatctacctccaggaggcacttgatttcataaaacggcaagcacgccaccatcctttcttcttatattgggccgtggacgccacccacgcacccgtgtatgcctccaaaccctttttgggtacttctcagcgaggccggtacggcgatgcggtaagggaaattgatgactcaatcggcaaaatactggagctcttgcaggatctccatgtggctgacaacacgttcgtgttttttacatcagataatggagccgccctgatcagcgcgcccgaacagggcggttccaacgggcccttcctgtgcggaaaacagaccaccttcgaaggcggtatgagggagcccgctctggcgtggtggcccggccatgtgaccgcggggcaagtgtcgcatcagctcgggagcataatggatcttttcaccacatccctggcactcgctggactgacaccaccctcggacagggccattgatggactgaacctcctgccaactttactccaagggagactgatggatagacctattttttactaccggggagacacgctaatggcagcaactctggggcagcataaagcccatttttggacctggactaattcttgggagaatttcagacagggcattgatttctgccccgggcagaatgtctccggggtaacgacacacaatcttgaagatcatactaaactgcctctgatcttccatctgggtagagacccaggagagaggttcccactgtcttttgccagcgctgagtatcaggaggcactgtcccgcattacttcagtcgttcagcaacaccaagaggcgctagtccctgcccagcctcagttgaacgtgtgcaattgggcagtgatgaattgggcaccacctggctgtgaaaaactgggaaagtgcctgactcctccagaaagtattcccaagaaatgcctgtggtcacat

SEQ ID NO: 11977 - DNA, 1566 bp, Artificial Sequence
  Description of Artificial Sequence: Synthetic coding sequence
atggctgccgtggtcgctgctactcgatggtggcagctactccttgttttgtctgcagcaggaatgggagcttctggcgccccacaacctccgaatatacttctcttactaatggatgacatgggatggggtgatctcggagtatatggagaacctagtcgcgagactccaaatttggatcgaatggctgctgaaggcctgttgttcccaaacttttattcggccaatccgttatgcagcccaagtcgagctgcgcttctgacgggacgcttgccaattcggaacggattctatactaccaatgcacatgctcgtaacgcttatactccacaagaaatagttggaggaattccagattcagaacaactgctaccagaattgttgaaaaaagctggatatgtttcaaaaatagtgggtaaatggcacttgggacatcgtccacagtttcatccacttaaacatggttttgatgagtggtttggatccccaaattgccacttcggaccatatgacaacaaagcgaggccgaacataccagtttatcgagactgggagatggttggaagatattatgaagagttccccattaatcttaaaacaggggaggccaatctcacacaaatatatcttcaagaagctctcgatttcataaagagacaggctcgtcatcatccattcttcctttattgggccgtcgatgcaacccatgcgcccgtttatgcttctaaaccatttttgggtacttcccagcggggcagatatggagacgccgtacgtgaaatcgatgattcaattggaaaaatacttgaactcctccaggatttgcatgtggctgataatacttttgtcttcttcacatctgataatggagccgctttaataagcgctccagaacagggaggcagtaacggtcctttcttgtgtggtaagcagacgacttttgaaggaggaatgagagaaccggcactggcatggtggccgggtcacgtcacggcaggtcaagtgtctcatcaactaggttccattatggatttgtttacaacttcattggctctagcaggactcacgccaccatcagatcgagctattgatggacttaacctgcttccaacattgctgcaaggacgtttgatggaccgcccaatcttttactatcgaggagatacacttatggccgcaactcttgggcaacacaaagcacatttctggacttggactaattcatgggagaacttcagacaaggcatagacttctgtccaggacagaacgtttcaggggtcactacgcacaatttggaggatcacaccaaattgccgctgatattccatcttggaagagatccaggcgagcgctttccactatcgttcgcctctgctgagtaccaagaagcactctctagaatcacatccgttgttcagcaacatcaagaagcactcgtgcctgcacaaccacaactgaatgtgtgcaattgggcagtcatgaactgggctccaccaggatgcgaaaaattgggaaagtgccttacaccaccggaatcaattccaaaaaaatgcctttggtcgcac

SEQ ID NO: 11978 - DNA, 1566 bp, Artificial Sequence
  Description of Artificial Sequence: Synthetic coding sequence
atggctgccgtggtagcagctacacggtggtggcagttactattggtgctgtccgccgcagggatgggagcttcaggggcacctcaacctcccaatatccttctgctgcttatggatgatatgggatggggcgatcttggcgtttacggggagccaagccgtgagacccccaatctggacagaatggctgcagagggtttgttgtttcctaatttttattctgcgaaccccctgtgctcgccctctcgagcagctctgcttaccgggcgcctccctattagaaatggtttttacacgaccaatgctcacgcacgtaacgcttacacaccgcaggaaatagttgggggtatccccgatagcgagcagctactgcctgaactattgaagaaagcggggtacgtgtcaaagattgttggtaagtggcatcttggccacaggccccagttccacccactgaaacatggattcgatgaatggtttggatcgccgaactgccatttcgggccttacgataacaaagcccgccccaacatccccgtataccgggactgggagatggtgggcagatactatgaagaattccccataaatctaaagacaggcgaggcaaacttaacccagatctacctgcaggaggcgctggacttcatcaagcgtcaggccaggcaccacccatttttcctgtactgggcggtggatgccacgcatgcacctgtctacgcgagtaagccttttctgggaacctcccagcggggtcggtacggggacgcggtcagggagatagatgatagcataggcaagatccttgaactattgcaggacttgcatgtggccgataatacattcgtgttcttcactagcgacaatggagccgccttgatttctgccccagagcaggggggaagtaatgggccattcttgtgcgggaaacagacaacctttgagggagggatgcgggagcctgccctggcatggtggcccgggcacgtaaccgcggggcaggtgagtcatcagttgggctccattatggacttgttcacaacaagcctagcactcgcaggtttgactccaccttcagatcgcgccatcgatggactgaatctactgccaacactgctgcaggggcgcttgatggatcgtccaattttttactatcgcggggacacactcatggccgcgactctgggacagcacaaagcccatttctggacatggactaactcttgggaaaattttagacagggtatagatttttgtcccggtcagaatgtgagcggggtcaccacccacaatctggaggatcataccaagctgcccctgatattccatctgggcagggatcctggcgaaagattccccctatcatttgcgagcgccgagtaccaagaagccttaagcaggatcaccagcgttgtccagcagcaccaagaggccttggtccccgcccagccacagctgaatgtctgtaactgggccgtgatgaactgggccccaccaggctgtgaaaaactcggaaaatgcctgacgccacccgagagtattcccaaaaagtgcttgtggagccac

SEQ ID NO: 11979 - DNA, 1566 bp, Artificial Sequence
  Description of Artificial Sequence: Synthetic coding sequence
atggcggccgtggtggccgccacccgctggtggcaactgctcctggtgttgagcgcggcaggaatgggggcgagcggcgccccgcagcctccgaatatccttctgctcctcatggacgatatgggctggggagacttgggagtgtacggcgagcccagccgggaaaccccaaacctggacaggatggcagcggaaggactgctcttcccaaacttctattcggcaaatccgctctgttcaccgtcgcgcgccgcactcctgactggacgccttccgatccggaacggcttctacactaccaatgcccatgccaggaacgcctacacccctcaagaaatcgtgggcggaatcccggactcagagcagctgttgccggagctcctgaagaaagccggatacgtctcgaagatcgtgggaaagtggcatctgggacatcgcccgcaatttcatccactgaaacacgggttcgacgaatggttcggaagcccaaactgtcactttggcccgtacgataacaaggcacggccaaatatcccagtgtacagggactgggagatggtcggccggtactacgaagaattcccgatcaaccttaagactggagaggcaaatctgactcagatctacctccaagaggcgctcgatttcatcaaaaggcaagcccggcatcacccgtttttcctgtactgggcggtggatgccacccatgcaccagtctacgcgagcaagcccttcctcgggacctcacaacgcggccgctacggagacgcggtgcgggagatcgacgacagcatcggtaagattctggaactgctgcaggatctccatgtggcggacaacactttcgtgtttttcacttcagacaacggcgccgcgctgatctcagctccggaacagggtggttcgaatggaccctttctgtgtggaaaacaaactaccttcgaaggaggcatgcgggagcccgcccttgcatggtggccggggcacgtgactgcaggacaggtgtcccatcagctgggatcgatcatggaccttttcactaccagcctggcgctggcgggtctgacccctccttctgacagggcgatcgatggccttaacctcctcccaacgctgctccaaggcaggctgatggaccgcccaatcttctactatagaggagataccctcatggctgcgaccctgggccagcacaaggcgcatttttggacttggacgaactcgtgggaaaacttccggcagggaatcgatttctgcccgggtcaaaacgtctccggcgtgacgacccacaatctcgaggatcacaccaaacttccgctgatcttccatcttggacgcgatccaggtgagcgctttccactctcgtttgcctcggctgaataccaagaagccctctcacgcattacttcagtggtgcagcagcatcaagaagcgttggtgcccgcccagccccaactgaacgtctgcaactgggccgtcatgaactgggcgccgcccggctgtgagaaactggggaagtgcctgacgccccccgagtccatccctaagaagtgcctctggtcccac

SEQ ID NO: 11980 - DNA, 1566 bp, Artificial Sequence
  Description of Artificial Sequence: Synthetic coding sequence
atggctgcggtggtggccgcaacacgctggtggcagttgcttcttgtgctatctgctgccggaatgggagcttcaggcgccccacagcccccaaacattttactgttgttaatggacgatatgggttggggtgatcttggcgtttatggagaaccttcgcgtgagacaccaaatcttgatagaatggctgcggagggattgctttttcccaacttttattcagccaatcctctctgttcaccaagccgagccgctcttctaacaggacgacttcctatcaggaacggattttatactacaaatgcacacgctcgtaatgcctatacaccacaagaaatcgtgggtgggatcccagacagtgaacagcttctgcctgagttactcaaaaaggcagggtacgtgagcaaaatagtgggaaagtggcatctgggtcataggccacaatttcaccccctcaagcatgggttcgatgaatggttcggttccccgaattgtcactttggaccttatgacaataaagcccgtcccaatattcctgtttatcgcgattgggaaatggtcgggcgttactatgaagagttccctatcaatctcaagaccggtgaagctaatctgacacaaatctaccttcaggaagctctagattttatcaagagacaagcgagacatcacccgttctttttatattgggccgtggacgcaacacacgctcctgtgtatgcctcaaaacctttcttgggaacctcccaacgggggcggtatggcgatgctgttagggagattgatgattccattggcaagattcttgaattgctgcaggatttacacgtcgccgacaatacttttgtcttcttcacatctgataatggtgctgcacttataagcgcccctgaacaggggggctcaaatggacctttcctctgcggtaagcaaactacgtttgaggggggaatgagagaaccagctttagcttggtggcccggacacgtaaccgccggacaggttagtcatcagttaggctccattatggatcttttcactaccagcttggcattggcgggtctaactccaccgtcggatcgagccatcgatggtcttaacctcctacccacattacttcaagggaggttgatggaccgaccaattttctattataggggagacacgcttatggccgccactttgggtcaacacaaggctcacttctggacttggaccaactcttgggaaaactttaggcaaggtattgacttttgtcctggtcaaaacgtctccggagtgacgactcataacctcgaagatcacacaaaattgcctctcatattccatcttggacgcgatccaggtgaaagatttcctttatcgttcgcttccgctgaataccaagaggccttatcaagaatcacgagcgttgtgcaacagcatcaggaggctttggttcctgcccaacctcagctgaacgtttgtaactgggccgttatgaattgggctcctccaggctgtgaaaagcttggaaaatgcctgactcctcctgagtcaatcccaaaaaagtgcctctggagccat

SEQ ID NO: 11981 - DNA, 1566 bp, Artificial Sequence; identical to SEQ ID NO: 11961
  Description of Artificial Sequence: Synthetic coding sequence

SEQ ID NO: 11982 - DNA, 1566 bp, Artificial Sequence
  Description of Artificial Sequence: Synthetic coding sequence
atggctgcggtggtggcagccactcggtggtggcagctccttctagtactctccgcagccggtatgggagcttccggagctccccagccccctaatatccttttgctgctaatggatgatatgggttggggcgacctcggtgtgtatggcgagcctagtagagagacacccaaccttgaccgtatggctgctgagggtcttcttttccccaatttttattctgccaacccgttgtgcagtccgagtagggccgcactcttgactggtagactcccgataagaaacggcttctacactactaacgcccatgccagaaacgcctataccccacaagagattgtagggggaattcctgactccgagcagttacttcccgagctgctgaaaaaggctggttacgtcagcaagatcgttggcaagtggcacctaggccaccggccccagtttcatccgctgaaacatggattcgacgagtggttcggttctccaaactgtcatttcgggccatatgataacaaagcaaggcctaatattcccgtttaccgcgattgggagatggtcggccgctattatgaggaattcccgatcaacctgaagacaggcgaggccaacttgacccaaatctacctgcaagaagcgttggatttcatcaagaggcaggcgcgccaccatcctttcttcctgtactgggcagtcgacgctacacacgctcccgtctatgcctcgaaaccctttctggggacttcccaacgaggtcgctacggggacgccgtgagggagatcgacgattcaattggtaagatcctggaattgctgcaggatctgcatgtggccgacaatacttttgtgttcttcacctccgataacggagctgccctcattagcgctcctgaacaggggggctcaaatggtcccttcctctgcggaaaacagaccaccttcgaaggcggtatgcgcgagcctgcactggcttggtggcccggccatgtgacggcgggacaagtctcacaccaactgggtagtattatggatctgtttacaactagtttggcactggccggattgactccgccctctgatcgggcaattgatggcctcaatctcctgcccacactactacagggaaggcttatggacaggccgattttttactaccgaggcgacaccctgatggccgccactctggggcagcataaggcccacttttggacttggacaaattcatgggaaaatttcaggcagggaatcgatttttgtccgggccagaatgtgtccggagtgaccacgcacaatttggaggatcacacgaaactgccacttatcttccacctcggacgcgatcccggtgagcggttccccctttcttttgcttcggcagagtaccaagaagcattaagtcgcatcacctctgtggttcagcagcatcaggaagccctagtgccggcgcaacctcaactgaatgtatgcaattgggccgtcatgaactgggctcctcctgggtgtgaaaaactcgggaaatgcctgactccacccgagagcataccaaaaaaatgtctctggtcccac

SEQ ID NO: 11983 - DNA, 1566 bp, Artificial Sequence
  Description of Artificial Sequence: Synthetic coding sequence
atggctgcagtggtcgccgcgacaagatggtggcaactgcttctcgtcctcagcgcagctgggatgggcgctagtggtgcccctcagcccccaaatattctgttactgcttatggatgatatgggatggggcgacctgggcgtttatggggaacccagccgtgagactcccaatttggaccgcatggcagcggagggactcttgttccccaacttctactcggcaaatccactgtgttctccttccagggcggctctgctgaccggaagactaccaattcgcaatggattctacaccaccaacgctcacgcacgtaacgcctatacaccacaggaaatcgtgggcggcatacctgacagtgagcagctacttcccgaactcctgaaaaaagcaggatacgtaagtaaaatcgtggggaagtggcacctgggacatcgcccccagttccacccacttaagcatggatttgacgaatggttcggcagtccaaattgccacttcggcccctacgataataaggcacgcccaaacatacctgtatatcgggactgggagatggttggtcgttattatgaagagttccctatcaacctcaagaccggagaagcaaacctgacgcaaatctacctgcaggaggcgctggactttatcaagcggcaggcccgtcaccacccatttttcttgtattgggctgtggacgctacgcatgccccagtgtacgcatcaaagcctttcctgggcaccagccagagaggccggtacggggacgcagtgcgcgagatcgacgattctatcggtaagatcctggagctcctgcaggacctccatgtggccgataacaccttcgtgttcttcacctccgacaacggcgccgctcttatatcagcgccagagcaggggggatcgaatggtccgttcctgtgcgggaagcagacaacctttgaggggggaatgcgtgagccagccctcgcttggtggcccggacatgtgacagctggccaggtgagccatcagttgggttctatcatggacctcttcacaaccagcttggccctcgcaggcctcactccccctagtgatcgcgctatcgacggcctcaacctgctccctaccttgctccaaggtagacttatggaccggcctatattttattacaggggggacacgctgatggctgccacactaggtcaacataaggctcacttttggacctggacgaattcttgggagaactttcggcagggcatagacttttgtcctgggcagaatgtgagcggcgtgactacccataatctggaagatcacaccaagttgcctcttatctttcacttaggccgcgaccccggcgaaagatttccgcttagcttcgcttccgccgaataccaggaggccctctctcggatcacatctgttgtacagcaacatcaagaggcccttgtgccagcgcagccacaactgaacgtttgcaattgggcagtaatgaactgggcccctccgggctgtgaaaagctgggaaagtgcttaactccacctgaatcaattccgaagaaatgcctgtggagtcat

SEQ ID NO: 11984 - DNA, 1566 bp, Artificial Sequence
  Description of Artificial Sequence: Synthetic coding sequence
atggcagcggtagtggcggcaactaggtggtggcaactcctgctcgtgctcagcgccgcaggtatgggagcttcaggcgctccgcaaccgcccaatatccttcttcttctcatggatgacatgggttggggtgatttgggtgtttacggagaaccaagccgcgaaaccccgaacctggaccgtatggctgcagagggcctgcttttcccgaacttctactccgcaaaccctctctgctcgccttcccgggcagcacttcttaccggtagactccccattagaaacgggttttacacgaccaacgcccatgcaaggaacgcgtacacgcctcaggaaattgttggtggaattccagattcagaacaactgcttccagagcttctgaaaaaggccggatacgtgtcgaagatcgtcggtaagtggcaccttgggcatcgccctcagtttcatcctctgaaacatggatttgacgagtggttcgggtcccctaactgtcatttcggtccatacgacaataaggcaagacccaacattcctgtgtaccgcgattgggagatggtgggcagatactacgaagaatttccaattaacctcaaaaccggtgaagccaatcttacccaaatctatctgcaagaggcactcgactttatcaagcggcaagcacggcatcatccatttttcctgtactgggccgtcgatgcaacccatgcgccagtctacgcgtcaaagccatttcttggcactagccaaagaggacgttacggggacgccgtgagagaaattgatgattcaattggaaagattcttgagctcctgcaagaccttcatgtggctgacaacacttttgtgttctttacctcagacaacggagcggcccttatctccgcgcccgaacaaggtggatctaacggtcctttcctctgtgggaagcagaccactttcgaaggagggatgagggaacccgcactggcatggtggccaggacatgtgaccgccggacaagtctcccatcagctcggctcgattatggatttgttcactacttccttggcactcgcaggcctcactcctccctcggaccgcgcgatcgatgggctgaacctgctgcctaccctccttcaaggcagactgatggacagacctatattctactaccggggagacacccttatggcggcaactctggggcagcacaaggcccatttttggacctggaccaactcctgggagaatttccgtcagggtatcgacttttgtccgggacagaatgtctccggtgtgacgactcataacctcgaggatcacactaaacttcctctcatttttcaccttggaagggatcctggcgaaagatttcctctgtcgtttgcgtcagcagaataccaagaagctctttcacggattacgtcggtcgtgcagcaacatcaagaagccctcgtgcctgcacaaccccaactgaatgtgtgcaactgggccgtgatgaattgggcacctccgggctgtgaaaaacttgggaaatgtctgaccccacccgaatccattcctaaaaagtgtctctggtcccat

SEQ ID NO: 11985 - DNA, 1566 bp, Artificial Sequence
  Description of Artificial Sequence: Synthetic coding sequence
atggctgcagtcgtggcagcaacccggtggtggcagctcctgcttgtcctgtcggccgccggaatgggtgcgagcggagcaccccagccgccaaacattttgcttttgctcatggatgacatggggtggggtgacctcggagtgtacggcgagccctccagagagactcctaacttggacagaatggcagcagaagggctgctctttccaaacttctattcggcaaatcccctgtgttcaccatccagggctgcactcctcaccggcagactgcctattcgcaacggattctacactactaatgcccatgcacgtaatgcttacacgcctcaagaaatcgtcggcggtatccccgactcggagcagcttctgcctgagcttctgaagaaagccggctacgtctccaagatagtcggcaagtggcaccttggtcatcggcctcaatttcacccactgaaacatggatttgatgaatggttcgggtccccaaattgccactttggtccctacgataacaaagcaaggccgaatatccctgtgtacagggactgggaaatggtgggacgctactacgaggagtttcctatcaacttgaaaacgggagaagcaaaccttacccagatttaccttcaggaggccctggacttcataaagagacaggcacgtcaccacccatttttcctgtactgggccgtggatgccactcacgccccggtctacgcatcgaagccatttctgggaacctctcaaagaggccgatacggagatgcagttagagaaattgatgacagcatcggaaagatcctcgagctgctgcaggacctgcatgtcgcagataataccttcgtgttctttactagcgataatggagcagctctgatctccgcacccgagcaggggggatcgaatggcccttttctgtgtggcaaacaaaccacctttgagggcggtatgagggaacccgcactggcatggtggcctggtcatgtgaccgcaggacaggtgtcccatcaacttggttccataatggatctcttcaccacctcgctggcgctggcaggactcactccaccgtcagaccgggcaatagatggcctcaatctgcttcctactctgctgcaaggcagactcatggatcgtccgatcttttactatcgcggtgataccctcatggcagcaactttgggtcaacacaaagcacacttttggacctggaccaactcgtgggagaactttagacaagggattgacttctgccctggacagaacgtgtcaggggtgactacgcataatctcgaggatcatacgaagctccctctgattttccaccttggacgcgatcctggagagcggtttccactctccttcgcgtccgcagaataccaggaagcactctcaagaattacttccgtggtgcagcagcatcaagaggcattggtgccagcacaacctcagcttaacgtctgtaattgggcagtgatgaactgggcaccgcctggttgtgaaaagttgggcaagtgcctgactcctcctgagtccattcctaagaaatgtctgtggtcccat

SEQ ID NO: 11986 - DNA, 1566 bp, Artificial Sequence
  Description of Artificial Sequence: Synthetic coding sequence
atggcagctgtggttgcagccacacggtggtggcaactgctgcttgtgctgtcagctgcaggtatgggagcctctggggcaccgcagccgcctaatattctgctgttgcttatggatgatatggggtggggggatctaggcgtgtatggcgagccctcacgagaaacaccaaacctcgatagaatggccgctgagggattattgtttccgaacttttactcagcaaaccccctgtgtagcccctcacgagccgccctgcttaccggccgtctgccaatccggaatggcttctataccactaatgctcacgcccggaacgcgtatacaccgcaggagatagtgggcggtatacccgactctgagcagttactcccagaactgttgaagaaggcaggatacgtttcaaaaatcgtaggcaaatggcatctgggccatcggcctcagtttcatcctctgaagcacggatttgacgaatggttcggatcaccaaactgccacttcggtccatacgacaataaggcccgacctaacatacctgtttacagggactgggagatggtcggccgctactacgaggaattccccatcaaccttaagaccggtgaggctaacctgacgcagatttacctgcaggaggccctggatttcatcaaaagacaggcccgacaccatcccttcttcctatattgggcagtcgacgcgacccacgcgcccgtctatgcctccaagcccttcctgggtacatcccagcggggtcgctatggcgacgccgtaagggaaatcgacgacagtattggcaaaattctggaattgctccaggatctgcatgtggctgacaacacattcgtgttttttacaagcgataacggcgctgccctcatctccgccccggagcaaggcggcagcaatggcccttttttatgcggaaaacaaactactttcgaaggtggaatgcgagagcccgctctagcctggtggcccggccacgtgaccgccggccaggtgtctcatcagctagggtccattatggatctatttactaccagcctcgctctcgctggtctcactcctccttccgaccgggccattgacggactgaacctgttgccaactctgctccaggggagactcatggacagaccaatcttctattatcgaggcgatactttaatggcggctactttgggccagcacaaggcacacttttggacttggaccaacagttgggagaatttccggcagggcattgatttttgcccgggccagaacgtgtccggagtgactacccataatctcgaagaccacaccaagcttccgcttatctttcacctggggcgcgacccaggcgaaaggttccctctgtcctttgcgtctgcagaataccaggaggctctctccaggattaccagtgtggtgcaacagcaccaggaggcactggtcccagcgcagcctcagttaaacgtatgcaactgggccgttatgaattgggcaccacctggctgcgagaagcttggtaaatgtctgacccctcctgaaagcattcccaagaagtgcctgtggtcacac

SEQ ID NO: 11987 - DNA, 1566 bp, Artificial Sequence
  Description of Artificial Sequence: Synthetic coding sequence
atggcagcagttgtagccgctacccgatggtggcagctcttgctggtactgtcagctgctggaatgggggcaagcggagccccacagcctcccaatattctgttgctgttaatggacgacatggggtggggggacctgggcgtgtatggtgagccttctcgggagacccctaatctcgacaggatggcagctgagggcctcctgttccccaatttctactctgccaatcccctctgctctcctagccgggcagccctcctcaccgggcggttacctatccgcaatgggttttatactactaatgcccacgccagaaacgcatatacccctcaggagatcgtgggagggatcccagattccgagcagctgctcccggagctgctgaagaaagctggttacgtgtctaaaattgtaggaaagtggcatctgggccacagaccgcaatttcaccccctgaaacacggatttgatgaatggtttggaagccctaactgccacttcggaccttatgacaacaaagcgcggccaaatatccctgtgtatagagattgggagatggtggggcggtactacgaagagttcccaatcaacctaaagaccggggaagctaacctcacacagatctacctacaagaggctttggactttataaaaagacaagctcgccatcacccatttttcctgtactgggcagtggatgcgacccacgccccagtgtatgcttctaaacccttcctggggacaagtcagcgaggtcgatatggcgatgctgtgagggagattgacgactctattggcaagattcttgaactgctgcaggatcttcacgtggccgacaacaccttcgtgttcttcacgagcgataatggagctgcccttatatccgctccagagcaggggggctcaaacggaccctttctgtgcggcaagcagaccacctttgaagggggtatgcgtgagcccgctctggcttggtggccaggccacgtgaccgcggggcaggtatcccaccaacttggttccatcatggacctgtttaccacctcgttggctctcgccggacttacccccccctctgaccgggccatagatggcctcaatctccttccgaccctgctccaaggacggctaatggatcggccaattttttactaccgcggcgatacactcatggctgctaccttaggacagcacaaagctcatttctggacatggactaattcatgggagaacttccgccagggcatcgacttttgtcctggacagaatgtttctggagtgactactcacaatctggaagatcatacgaaattaccactgatcttccatctggggagagaccccggagagcggttccccctttccttcgccagcgcagagtaccaggaagccctgtcgaggatcacaagcgtagtgcagcagcaccaggaggccctggttccggcccaacctcaactaaacgtttgcaattgggccgtgatgaattgggcgcctcccggctgcgaaaagctggggaagtgcctgactcctcccgaaagcatccctaaaaagtgcctctggagccat

SEQ ID NO: 11988 - DNA, 1566 bp, Artificial Sequence
  Description of Artificial Sequence: Synthetic coding sequence
atggcggcagtggttgctgcaacacgctggtggcagctcctgctagtgctgagtgcggccgggatgggagcctccggcgcaccccagcctcccaatattttgctcctgctgatggatgacatgggctggggagatctgggcgtgtacggagaaccctcacgggagacacctaatctggaccggatggcggcagaaggtctgctgttcccgaatttctactctgcgaatccactatgtagcccttctagggcagcactgctgaccgggcggctgcctatcagaaacggtttttatacaactaacgcccacgctagaaatgcctacacgccccaggagattgttggtggcattcccgattcggagcagctccttccagagctcctgaaaaaagccgggtatgtaagtaagatcgtggggaaatggcacctcgggcatcgaccccagtttcacccactgaagcacgggttcgatgagtggttcgggtcacccaactgccattttgggccctatgacaacaaagcccgcccgaatatacccgtttatagagactgggaaatggttggacgatactacgaggagtttcctatcaatcttaaaaccggtgaagccaatttgacccaaatctacttgcaggaagctcttgattttattaagcggcaggctaggcaccatccattctttctgtattgggccgttgatgcaacccatgcgcctgtgtacgcatctaagcccttcttgggcacaagtcagcgcgggaggtatggcgatgcagtccgcgaaattgacgattcgatcggcaagatactggagctgctgcaggacctgcatgtggcggacaacactttcgtgtttttcacttctgacaatggagcagctctgatctctgctcctgagcaggggggtagtaatggcccttttctgtgcggtaagcagaccactttcgagggaggcatgcgggagccagctctcgcctggtggccaggacatgtcacagctggccaggtatcgcaccagctcgggtctatcatggatctttttacgacgtctctcgctctagccggtttaacgcctccctcagacagagctatagacggcttgaatctcttgcccacgctgctgcagggccgtctcatggacagaccaattttttattaccgcggcgataccctgatggctgccaccttagggcagcacaaggcccatttctggacatggacaaactcctgggagaattttcggcagggaattgacttctgccccggacagaacgtgtcaggagtgacgacacacaacttggaggaccataccaagcttcccctcatttttcacttggggagggatccaggagaacgctttccactgagttttgcttctgccgagtatcaggaggccttaagcagaattacctctgttgtacagcaacatcaagaagcgctggttccagcgcagccacaattgaatgtctgtaattgggctgtcatgaactgggccccacccggttgtgagaagctcggaaagtgcctgactcctcctgaatccattcccaagaaatgcctgtggtctcat

SEQ ID NO: 11989 - DNA, 1566 bp, Artificial Sequence
  Description of Artificial Sequence: Synthetic coding sequence
atggcagcggttgtcgccgccaccaggtggtggcagctgctgcttgtgttaagtgcagcgggtatgggagcaagcggcgctcctcagccccccaatattctccttcttctgatggatgacatgggctggggagatctcggagtctacggagagccatcaagggagacccctaatctggaccgtatggcggctgaagggctcttgttcccgaatttctattcagccaacccactgtgctcaccatcacgcgctgctctcctgacagggcggctgcctataagaaacggtttttataccactaacgcgcacgcccgcaatgcttacacacctcaggagatcgtgggtgggatacccgacagcgaacagctgttacccgaattgctcaagaaggctggctacgtcagtaaaattgtgggaaagtggcatttgggccacaggcctcaattccatccgctgaagcacggctttgacgagtggttcggaagcccaaactgccatttcgggccttacgacaataaggccagaccaaatatccccgtgtaccgagactgggagatggtgggacgatactacgaggagttcccaatcaatctcaaaaccggggaagcaaacttgactcagatttatttacaagaggcactcgacttcattaaaaggcaggcacggcaccaccccttttttttgtactgggctgttgatgcaacacacgcaccagtgtatgcctcaaagcccttcctcggaacgagtcagcgaggccgatacggcgacgctgtgagggaaatcgatgactcaattggaaagatccttgaacttttgcaggatctccacgttgcagacaatacatttgttttcttcacttcggacaacggggccgcccttatctccgcacctgagcagggaggttctaatgggcccttcctgtgcggaaagcaaaccacctttgaaggcggcatgagggagccagctctcgcctggtggccgggccacgtgactgctggacaggtctcccatcagctgggcagcatcatggacctgtttacaacaagcctggcgctcgccggacttacccctccatctgatagggctatagatggactcaacctattgccgactttgctgcagggtaggctgatggacagaccaatcttctattaccgtggggataccttgatggcggccacacttggccagcataaagcgcacttctggacatggacaaatagctgggagaattttagacagggtatcgacttctgcccgggccagaatgtgtctggtgtgaccacgcacaatctcgaggaccataccaagctgcctctgatattccatctcgggcgcgaccctggggagcgcttccctttgagtttcgcatcagcagaatatcaggaggcccttagtcggatcacctctgtggtgcagcaacaccaggaggctttagtgccggcccaaccgcagttaaatgtgtgtaactgggcagtcatgaattgggcacctccgggttgtgagaagctaggtaagtgtctgactcctcctgagtccatccctaagaaatgtctatggagccat

SEQ ID NO: 11990 - DNA, 1566 bp, Artificial Sequence
  Description of Artificial Sequence: Synthetic coding sequence
atggccgcagtggtagctgctacgagatggtggcagcttttgctggtcttgtccgcagctgggatgggagcttctggggccccccagccccctaacatcctccttcttcttatggatgatatggggtggggggatcttggagtctacggggaacccagtcgggagactccaaacctcgataggatggccgctgaagggctactcttccctaacttctattcggcaaaccctctctgttccccctctcgggccgcactgctcacaggaagactgccaatcagaaatggattctatactacaaatgcccacgctagaaatgcctatactcctcaggaaatcgtgggaggaatacctgattctgaacagctgctacccgaacttcttaaaaaggctggatatgtgtccaaaatcgtagggaagtggcacttgggacacaggccacagttccatccactaaaacacgggttcgatgagtggtttggatctcccaattgtcattttgggccttatgataacaaagcacgacctaacatccccgtgtatagagattgggaaatggtcggacggtattatgaagaattcccaataaacttaaaaacaggggaggccaatctgactcaaatatatctacaggaagctttggattttataaaaaggcaggcgcggcaccatcctttctttctctattgggccgtagatgcaacacacgcacctgtctatgcctctaaacctttcttaggaacatctcagcgggggcgatatggagatgccgttcgggaaatagatgattccatcggaaaaatactcgaactgctgcaggaccttcacgtggctgacaatacattcgtattctttacatccgataacggggctgccctcatttctgcccctgaacaagggggatccaacgggcctttcctgtgtgggaaacagacaacttttgaaggaggaatgcgggaaccagccctcgcatggtggcccggacatgttactgcgggacaggtgtctcatcagctcggatccatcatggatctatttactacgagtcttgccttagccgggctgactccaccatctgatagagccatcgatggactgaatctccttcccactctccttcagggaaggctgatggatcgccccatattctattaccgcggagatacactcatggccgctacactggggcagcacaaggcccatttttggacttggacaaactcttgggaaaatttccgccagggaatagatttctgccccggacagaacgtatctggggtgacaacacacaatcttgaagatcacacaaaactacccctcatctttcacctagggagggatcctggggagaggttccccctgtccttcgctagtgcagaataccaggaagccctaagtcggattacatctgtggtccagcaacatcaggaagctctcgttcccgcccagcctcaattaaacgtgtgtaattgggctgtaatgaactgggctcctcccgggtgtgaaaaacttgggaaatgtcttactcctccagaatccatccccaagaagtgtttatggtctcac

SEQ ID NO: 11991 - DNA, 1566 bp, Artificial Sequence
  Description of Artificial Sequence: Synthetic coding sequence
atggccgctgtcgtggccgccactcgctggtggcagctgctccttgtgctgagcgccgctggaatgggagcgtccggagcccctcagccgccgaacatcctgcttcttcttatggacgacatgggttggggcgacctgggggtctacggcgagccgtcaagggagactccgaatctggaccgcatggccgcggaaggacttctgttcccaaacttctactctgccaacccattgtgctcgccctccagggcggcactcctgactggccggctcccgatccggaatggtttctataccaccaatgcccacgcccgcaacgcgtacaccccacaagaaatcgtgggtggtattcccgattccgaacagctgctcccggaacttctgaagaaggccggctacgtgtcgaagatcgtgggaaagtggcacctcggacatcgcccgcagttccatccgctgaagcacggattcgacgaatggtttggaagcccaaattgtcattttggtccatatgacaataaggctagacctaatatcccggtgtaccgcgactgggaaatggtgggacggtactacgaggaattccctatcaacttgaaaacgggagaggccaatctgacccagatttacctgcaggaggcactcgactttatcaagcggcaggccaggcaccacccatttttcctgtactgggcggtcgacgctacccacgccccagtgtacgcgtcgaaaccgttccttggaaccagccaacgcgggcggtatggggacgccgtcagagaaatcgatgacagtattggtaagatcctcgaactgcttcaggacctgcacgttgcggataataccttcgtgttcttcacttcagacaacggagctgcactgatctcggccccggagcagggaggatccaacgggcctttcctctgcggtaagcaaaccactttcgaaggcggaatgcgcgaaccggcactggcctggtggccaggacatgtcactgccggccaagtctcgcatcagctgggctcgatcatggaccttttcaccaccagcctggccctggccggactcactccgccgtcggaccgcgctatcgacggcttgaatttgttgcctaccctgctccaaggccgcctcatggacaggccgattttctactacaggggcgacaccttgatggctgccactcttggccaacacaaggcccatttctggacctggaccaactcatgggagaatttcagacaggggatagacttttgcccggggcaaaacgtgtccggggtcactacccacaatttggaggatcacaccaagctgcccctgatcttccatctgggcagagatcctggtgagaggttcccgctctcattcgcttccgcggaataccaggaagcattgtcgagaatcacctcggtggtacaacagcaccaggaggccttggtcccggcccaaccccagctgaacgtctgcaactgggccgtgatgaattgggcaccgcctggctgcgagaagctgggaaaatgcctgactccgccagaatcaatccccaagaagtgtctctggtcccac

SEQ ID NO: 11992 - DNA, 1566 bp, Artificial Sequence
  Description of Artificial Sequence: Synthetic coding sequence
atggccgcagtcgtggcggcgactaggtggtggcaactcctgctcgtgttgtcagcagcaggtatgggggcatccggagcacctcagccacctaatatccttctcctcctcatggacgacatgggttggggtgatctcggtgtctacggtgagccttcccgtgaaaccccaaacctggatcggatggcagccgaggggctgctgttcccgaacttctattcagcaaaccctctttgctctccctcccgcgcagcactgcttactggacgactgcctatccgcaatggattttacactaccaacgcgcatgctcgtaacgcatatacgcctcaggagatcgtcggtggaatacccgactcagaacagcttctgccggaactgttgaaaaaggcagggtacgtttcgaagatagtgggaaaatggcatctgggtcacaggccacaattccaccctctgaagcatgggtttgacgagtggttcggatcgcctaactgtcattttgggccatacgacaacaaggctagaccgaatattcctgtctaccgtgattgggagatggtgggccgatactacgaggaatttcctattaaccttaaaaccggagaagcaaatctcacccagatctaccttcaggaggcgctggatttcatcaaaaggcaggcaagacatcacccattctttctttactgggcggtcgacgcaactcatgcacccgtgtatgcatccaagccatttctgggtactagccaacgtgggcgctacggtgacgcagtccgcgaaatagatgattccatcggaaagatactcgaactgctgcaggaccttcatgtcgccgataacaccttcgtgttctttacctccgataacggggccgcccttatctcggcgccagagcagggtgggtccaacggtcctttcctctgcggtaagcagaccaccttcgagggtgggatgagagaacccgccctggcatggtggccaggccacgtgaccgcaggacaggtatcgcatcagctgggatcgatcatggatctctttactacttcccttgctcttgccggcctgacccctccttccgatcgggcaattgatggtttgaatctgctgcccactctgcttcaaggcagactgatggatagacctattttctactaccgaggtgataccctcatggccgcgactctgggacagcacaaggcacacttctggacttggaccaactcgtgggagaactttcgccaagggatcgacttttgtcctggccaaaacgtgtccggcgtgactacccataacctggaagatcataccaagctccctctgattttccatttgggtcgcgatccaggcgaacgattcccactgtcgtttgcatccgcggaataccaggaggcactttcgaggattactagcgttgtgcaacaacatcaagaggcccttgtcccagctcagccccagctcaatgtgtgcaattgggctgtgatgaattgggcccctccaggctgcgagaagctgggaaagtgtctgactcctccggagagcattcccaaaaagtgtctgtggtcgcac

SEQ ID NO: 11993 - DNA, 1566 bp, Artificial Sequence
  Description of Artificial Sequence: Synthetic coding sequence
atggccgccgtggtggcagctacccggtggtggcagctcctactggtcctcagcgccgcaggtatgggggcttccggtgcaccacaaccgccaaatattctgcttctgctcatggacgacatgggatggggcgacctgggcgtgtacggtgaaccctcccgcgagactcccaatttagaccgtatggccgccgagggactcctgttccctaatttctattcagcaaatcccctttgttcccctagtagagctgctttgctcacaggacgccttccaattaggaatgggttctacactaccaatgctcacgccagaaacgcctacactcctcaggagatagttggtggtatccccgactcggagcaattactgcctgaactgctgaaaaaagctgggtacgtaagcaaaatcgtcgggaaatggcacctggggcaccgcccccagtttcaccccctgaaacacggttttgacgagtggtttggtagtcctaattgccactttggcccgtacgacaataaggctagacctaatattccggtttatagagattgggaaatggtgggcaggtattacgaagagtttcctataaacctgaagactggtgaggcgaatctcactcagatctatctccaggaggctctagactttataaagcggcaagctaggcatcacccctttttcctctactgggcagtagacgccactcatgctcccgtctatgctagcaaacccttcctggggacttctcagcggggtcggtacggtgacgccgtgcgcgaaatcgacgacagtatcggtaagatcctggagcttctgcaggatttgcatgttgccgacaatacctttgttttcttcacctccgacaatggggctgccctaatcagcgcgcccgaacagggagggagcaatggtccatttttgtgcggaaagcagacaacgttcgagggaggaatgcgggagcccgccttagcttggtggcctggccatgtaactgcaggacaagtctctcaccaactggggagcattatggaccttttcacaacaagcctggccctagccggactcaccccacctagtgatcgcgccattgatggccttaatctcctgccaacactgctgcagggtcgcctaatggacaggcccatcttctattatcgaggagacacccttatggccgccacgcttggccaacataaagcacatttctggacttggactaactcttgggaaaatttccggcagggaattgatttttgtccgggccagaacgtgtctggcgtgacaacccataacctggaggatcacacaaagctccctctgatcttccaccttggcagagaccccggtgagaggtttcctctgtcttttgcctctgctgaataccaggaggccctctccagaataacaagcgtcgttcagcagcatcaagaggccctcgtgccagcccaacctcaattgaatgtctgtaactgggctgtcatgaattgggcccctcctggctgcgaaaaactgggaaagtgtctcacaccacccgaaagtattccaaaaaagtgcctgtggtcccat

SEQ ID NO: 11994 - DNA, 1566 bp, Artificial Sequence
  Description of Artificial Sequence: Synthetic coding sequence
atggctgctgtggtggctgccaccaggtggtggcaactccttcttgtattaagtgcagccgggatgggtgcctcaggcgctccacagcctcctaacatcctactactactgatggacgatatgggatggggggatttgggagtgtacggagagccatcccgggaaacaccaaaccttgatcgaatggcagccgaggggctgctatttccaaacttttactcggccaatcccctctgttcacccagtagggcggcactgctaaccggtcggctgccaattcggaacggcttttatacaacaaacgcacacgccagaaatgcgtacacgccccaggaaatcgtcggagggattccagacagcgagcagctgctcccggagctgcttaagaaggctggctacgttagtaagattgtcgggaaatggcacctgggacataggccacagttccacccattgaaacacgggtttgatgagtggttcggatctcctaactgtcattttgggccatatgacaataaagctaggccgaatatcccagtttatagagactgggaaatggtggggcgctactatgaggaatttcccatcaaccttaaaactggcgaggcaaacctgactcagatctacctgcaggaggccttggattttatcaagaggcaggctcgtcaccaccccttttttctgtactgggctgtggatgcaactcatgcaccagtttacgctagcaagccgtttctgggaacgagtcagcgcgggcggtacggggacgcggtgagggagatcgacgattcaatcgggaagatcctagaactacttcaagacctgcacgtggccgacaacacgttcgtctttttcacatcagataatggagctgcattgatctcggcccctgaacagggcggctccaacgggcccttcctgtgtgggaaacagaccaccttcgaaggaggaatgcgagagcccgcactggcctggtggccaggacacgtgactgctggccaggtttcgcatcaactgggctccataatggatttgttcactacctctctcgccttggccggactcacaccaccttctgaccgcgcgattgacggcctgaatctgctcccaacattactgcagggccggctaatggatcgccctatcttttattacagaggggacacactcatggccgcaaccctgggccagcataaggcgcacttctggacttggactaactcatgggagaatttcagacaagggattgacttctgcccaggacagaatgtgtcaggcgtgacaactcacaatcttgaagatcacaccaaattgcccttgattttccatctcggcagagaccctggagagcgttttccccttagtttcgcttccgccgaatatcaggaagccctgagtcgaatcacatccgtagttcaacagcatcaggaggcactggtacctgcccaacctcagttgaacgtgtgtaattgggccgtcatgaactgggctcctccgggttgtgaaaaattaggcaaatgtcttacccccccggagagtattcccaaaaagtgcctgtggagtcat

SEQ ID NO: 11995 - DNA, 1566 bp, Artificial Sequence
  Description of Artificial Sequence: Synthetic coding sequence
atggccgccgtggtggcagcgacgcgatggtggcaactgcttctggtcttgtccgctgcgggcatgggcgccagcggcgcaccccagccaccaaacatccttcttctccttatggacgacatgggttggggcgacctgggtgtctatggcgagccgtctagggaaaccccgaacctggatagaatggccgcggagggactgctgtttcccaatttctacagcgccaaccctctgtgctccccgtctcgtgccgcccttctcaccggacgcttgcccatccgcaacggattttacaccaccaacgctcatgcgcgcaacgcttatactccccaagaaattgtcggaggcatccctgactccgagcagctattgccggaactgctaaagaaagcaggttacgtctcgaagatcgttggtaagtggcaccttggtcatcggccgcagttccacccgcttaagcatggatttgatgagtggtttggctcccccaattgccacttcggcccctacgataacaaggccagaccgaacatccctgtttaccgtgactgggagatggtcggacgttactacgaagaatttcctatcaacctgaagaccggcgaggcaaacttgacccagatctatttgcaggaggctttggatttcattaaacgccaggcccgtcatcacccttttttcttgtactgggccgtcgacgccacccacgcaccggtctatgcctccaagcccttcttgggtactagtcaacggggtcgttatggggacgcagtacgggagatcgatgacagtataggtaagatcctagagctcctgcaggatctccacgtcgctgataacactttcgtcttctttacgtccgacaacggcgctgctctgatctcggcacccgagcagggaggctcgaatggaccgttcttgtgtggaaagcagacaactttcgagggcgggatgcgcgagcctgccctcgcgtggtggccaggccatgtgacagccggccaagtgtcgcatcagttggggtcgattatggatctgttcactacgtccttggcgctggcaggcctcactccaccttccgatcgggctatcgacggtttgaaccttcttccgaccttgctgcaggggcgccttatggacagaccgatcttctactatcgtggcgacacgcttatggctgctacgttgggccagcataaggcccacttttggacctggacgaacagttgggagaacttccgccagggaatcgacttctgccccggtcagaacgtatctggagttaccacccacaacctcgaagaccacacaaaactgccattgatcttccatctcggccgggaccccggagaacgcttcccactgtccttcgcttctgctgaataccaggaggctctgagccgcataacctcggtggtccagcagcaccaggaggctctagtgcctgcccaacctcaactcaacgtgtgcaattgggcagtgatgaactgggccccccccggctgtgagaagttaggcaaatgtctgacaccgcctgagtctattcctaagaagtgcttgtggtcccat

SEQ ID NO: 11996 - DNA, 1566 bp, Artificial Sequence
  Description of Artificial Sequence: Synthetic coding sequence
atggccgcagtggtcgccgcaacacgctggtggcagttgttgctggtcctcagtgccgccgggatgggcgccagtggtgcacctcaacctcctaatattcttctgctgctaatggatgatatgggatggggggatctaggggtctacggggaaccctcaagagaaacgccgaatctcgacagaatggccgccgaggggcttctctttccgaatttttactcagcaaacccattgtgctcgcccagccgggcggccttactaaccggtaggctgcctatcaggaatgggttttataccacaaatgctcacgcgagaaatgcgtatactcctcaggaaatagtgggcggcatccctgatagtgaacagcttttgcctgagctgctcaagaaggccgggtatgtgtccaagatcgtaggaaaatggcatttaggacacagaccccagttccatccactgaaacacggattcgacgagtggtttggctcgcccaactgccacttcggcccgtatgataataaggcacggcctaacataccagtttacagagactgggagatggttgggaggtactacgaggagtttcctatcaacctcaagacgggggaggcgaacttaacccagatatatctccaagaggcgctggactttataaaaagacaagctcgccaccacccttttttcctctattgggctgtggatgccacacacgctccagtatatgcctccaagccatttttggggaccagtcagcggggccgatatggagatgcagttcgtgagattgatgacagcatcggaaaaatcttagaactgctccaagacttgcatgtggccgataatacgtttgtcttcttcacaagcgataacggtgccgcactaatttcagcccctgagcaaggggggtccaacggcccgtttctgtgcggaaagcagactactttcgaaggcggtatgcgcgagcctgcacttgcctggtggcccggtcatgtgacagcagggcaggtgtctcatcagctcggcagcataatggatctgtttactacatctttggcgctggccggccttactccgccttccgaccgcgccatagatggcctcaacctgctgcctacactgctccagggccgactgatggatcgccccatcttttattacaggggagatacgcttatggccgccactctgggacagcacaaggctcatttctggacttggacaaatagctgggagaactttagacaggggatcgatttttgtccaggacagaatgtttcaggagtgaccactcacaatttggaggatcatacaaagttaccactgatctttcacctcgggcgggacccaggagagcggttccctctgagcttcgcttccgcagagtaccaagaggccctttccaggatcacctctgtggtgcagcagcatcaggaagcactggtgccggcgcaaccacagctgaacgtgtgcaattgggccgtcatgaattgggcccctcctggctgtgagaagctgggaaaatgcctgacccctccagagagcatccccaaaaaatgtttgtggagtcac

SEQ ID NO: 11997 - DNA, 1566 bp, Artificial Sequence
  Description of Artificial Sequence: Synthetic coding sequence
atggccgccgtggtcgcggcgaccaggtggtggcaacttttgctggtgctgagtgcagccggcatgggagcgtccggcgctccgcaaccaccgaacatcctgctgctcctgatggatgacatgggatggggagatctcggcgtgtacggggagccatcgagggaaaccccgaacctcgaccgcatggcggcagaaggcctgctctttcccaacttctactcggccaaccctctctgctcgccatcgcgggccgcactcctgactggacggcttccgatcaggaatgggttctacactactaatgcccatgccagaaacgcctacaccccgcaggaaatcgtgggtggcatcccagattccgaacagctgctcccggagctgttgaagaaagcaggctacgtgtcgaagatcgtgggaaagtggcaccttggtcaccgcccgcaattccacccactgaaacacggattcgatgaatggtttgggtcacccaattgccacttcggaccctatgacaataaggctcgccctaatatccccgtttatcgggactgggagatggtgggacggtactacgaggaattcccgatcaaccttaagaccggcgaggcaaatctgacccagatttatcttcaagaggcccttgatttcatcaagcgccaagcgcgccaccatccatttttcctttactgggccgttgatgctacccatgctcctgtgtacgcatctaaacccttcctgggcacgtcgcagcggggccgttacggcgacgcagtccgcgaaatcgacgattccatcggaaagatcctggaactgctccaggatctgcatgtcgccgataacacgttcgtattctttacgtcggataatggagctgccctcatcagcgcgccggaacagggcggaagcaacggaccgttcctgtgcggaaaacagactactttcgaaggtgggatgagggagccagccctcgcatggtggcccggccacgtgactgcaggacaagtgagccatcagcttggctcaattatggacctcttcactaccagcctggcactcgccgggctcacgccaccatctgacagggcgattgacggattgaacctgcttcccaccctcctccaaggtcggctcatggaccgtccaatcttctattacaggggagacactttgatggcggccaccctcggacagcacaaggcccatttctggacttggactaatagctgggagaacttcagacagggaattgacttttgccctggccaaaacgtctccggggtcaccactcataacctcgaggaccacaccaagctgccgcttatcttccacctgggacgcgaccctggcgagcggtttcccctgtccttcgcttcggccgaataccaggaggctctctcgcgcatcacttccgtggtgcagcagcaccaggaagccttggtcccggcgcaaccacagctcaacgtctgcaattgggctgtgatgaactgggcccctccgggatgcgagaaactgggaaaatgtctcactcctccggaaagcatccccaagaagtgcctgtggagccac

SEQ ID NO: 11998 - DNA, 1566 bp, Artificial Sequence
  Description of Artificial Sequence: Synthetic coding sequence
atggcggccgtcgtggcagctacaaggtggtggcagctcctcttggttcttagcgcagcgggcatgggtgcttccggagcaccccagcctcccaacatcctgctccttcttatggacgacatgggctggggagatctgggggtttatggcgagccctctcgcgaaacacccaatttggacaggatggctgccgagggcctgttgttcccaaacttttattccgcaaatcccctttgctcccccagtagggctgccctgctgactggccgactccctatacgaaacggattttatacgacaaacgctcacgctaggaatgcatataccccacaggaaatagtgggcgggattcccgactccgaacagctgctgcctgagcttctcaagaaagcagggtacgtttctaagattgttggcaagtggcaccttgggcaccggccccagtttcatccactgaaacatgggtttgatgagtggtttggatctcccaactgtcacttcggcccttacgacaacaaggccagacccaatattcccgtgtatagagactgggagatggttgggcggtactatgaggagttccctatcaacttgaaaacgggtgaggccaatcttacacagatctacctccaggaggctctggatttcataaagagacaggcccgccatcacccctttttcctctactgggccgtggacgccactcacgccccagtgtacgcatctaagccattcttgggaacttcccaacgcgggcgctacggggacgcggtaagagaaattgacgactctatcggaaagattctcgaactgctgcaggacctgcacgtcgctgacaatactttcgtctttttcactagcgacaatggggctgccctgatcagcgcccccgagcaagggggcagtaatggacctttcctctgcggtaagcagacgacattcgaaggaggtatgagagagccagcattggcatggtggcctggccacgtcacagccggccaggtttcacaccagcttggatctatcatggatctcttcacaacctcccttgccctggctggacttaccccgccgtccgatagggcaatcgatgggctgaacctgcttcccactttgctccaaggaagactgatggatcgccccatcttctactacaggggggacacgctgatggccgcgaccctgggtcaacacaaggctcacttttggacctggacaaattcatgggagaacttcaggcaaggtatcgatttttgcccaggccagaatgtcagtggcgtgaccacacataatctggaagaccatacaaaactgccacttatttttcatctgggtagggaccctggggagcggtttcctcttagcttcgcatctgctgagtatcaggaggcactctcacgaatcacttctgtggtccaacaacaccaggaagcgctggtgccagcacagccacaactgaatgtatgcaactgggcagtgatgaactgggcccctccaggctgtgaaaaacttggtaaatgcctgacgcctcctgagagtattcccaaaaagtgtttgtggagtcac

SEQ ID NO: 11999 - DNA, 1566 bp, Artificial Sequence
  Description of Artificial Sequence: Synthetic coding sequence
atggctgcagtggtcgcagctaccagatggtggcagcttcttcttgtgctgtccgcagcaggaatgggagcttccggcgcgccccagccccccaacattctgttgcttcttatggatgatatgggttggggggatcttggagtgtacggtgagccatcgcgagagacgcctaatctcgataggatggcagcagaagggctgctcttccctaacttttacagcgcgaacccactgtgtagccctagcagggcagcattgctcaccggccgcctgcctattcgcaatggtttttacactactaatgcacatgccagaaacgcctacactcctcaggaaatcgtgggaggtattccagattccgaacaactccttcctgaactgctgaagaaagccggatacgtcagcaagatcgtgggaaaatggcatcttggacatcgcccacaatttcaccctctcaagcacggatttgatgagtggttcggaagccctaactgtcattttgggccttacgacaacaaggcacgcccgaacatacctgtctaccgagactgggaaatggtcggccgttactacgaagaatttccaatcaatctgaaaactggagaagcaaacctgacccagatttaccttcaagaagcacttgactttatcaaacgtcaggctcggcatcacccgtttttcctttattgggctgtggatgctacccatgctccagtgtacgcatcgaaacccttcctgggtacttcacaaaggggtcgatacggagatgcagtgcgtgaaatcgacgattcgattggaaagattctcgaactgcttcaagaccttcatgtggcagataatacctttgtgttcttcacttcggataacggagcggcactgatctccgctcccgaacagggcggcagcaacggaccctttctttgtggcaaacaaactacctttgagggtggaatgcgggaacccgcgcttgcgtggtggccgggacacgtgactgcaggacaggtgtcacaccaacttggctcgattatggacctctttactaccagcctggcactcgcaggcctgaccccaccctctgatcgcgccatagatgggctgaacctgcttccaactctgctgcaaggcagacttatggaccgcccgattttctactatcgaggggatactctgatggcagccaccctcgggcagcataaagctcacttctggacttggaccaacagctgggaaaacttcagacagggaatcgatttttgtcccggtcagaatgtgagcggagtgactacgcacaacttggaggaccacaccaaactgcccctgatctttcatcttgggagagatcccggagagcgcttcccactttcattcgcatccgcagaataccaagaggcactctccagaataacctccgtggtgcaacaacatcaggaagccctcgtgccagcacaacctcagttgaacgtgtgtaactgggcagtgatgaattgggcacccccagggtgtgaaaagctgggcaagtgtctcaccccaccagaatcgattcctaaaaagtgtctctggtcgcac

SEQ ID NO: 12000 - DNA, 1566 bp, Artificial Sequence
  Description of Artificial Sequence: Synthetic coding sequence
atggccgctgtcgtcgccgcgaccaggtggtggcaactgcttttggtgttgtcggccgccggaatgggcgcctcgggtgccccacaaccacctaacatcctccttctgttgatggatgatatggggtggggcgaccttggagtctacggcgaaccatcccgagaaactcccaacctggaccgcatggcggctgaaggcctgctgttcccgaacttttactcagccaatcccctgtgcagcccatcgagagccgcgctgctcactggtagactgccgatccgaaatggtttctacaccaccaatgctcacgctcgaaacgcttacacgccacaggaaatcgtgggaggcattcctgattctgagcaactgctccccgagctgctgaagaaggccggatacgtgagcaaaatcgtgggaaagtggcacctcggtcaccggcctcagttccacccgctgaagcacggttttgacgagtggtttggatcccctaactgtcactttggcccgtacgataacaaagcgaggccgaatatacctgtgtaccgcgactgggagatggtgggacggtactacgaggaattcccgatcaatcttaaaactggagaggcaaacttgacgcaaatctaccttcaagaggcattggacttcatcaaacggcaggcgcgccaccatcccttcttcttgtactgggcagtggacgcaacccatgcaccggtgtacgcgtcaaagcctttccttgggacttcccaacgcgggcgctatggagacgctgtccgggaaatcgatgactccattggaaagattcttgaactgctgcaggatctccatgtggcagataacaccttcgttttctttacttcagataacggagcggccttgattagcgctccggaacagggaggctccaacggaccattcctgtgtggtaagcagactacgttcgaagggggaatgagggaaccagcactggcgtggtggcctggccacgtgaccgccggccaggtgtcccatcagctgggatctattatggatctgttcactacctcactcgccctggctggactgaccccgccttccgaccgcgccatcgacgggctgaacctgttgccgaccctgttgcagggaaggcttatggaccgaccaatcttctactaccggggagacactttgatggccgccaccctcggccaacataaggcgcacttttggacttggaccaattcatgggaaaactttcgccagggtatcgacttctgcccaggacagaacgtgtccggcgtcactacccataatctggaagatcacactaaactgccccttatcttccacctggggcgggacccgggcgagagattcccgctcagcttcgcgtcggcggagtatcaagaggcactgtcacgcatcacttccgttgtccagcagcatcaagaagcccttgtgcctgcacagccccagctcaacgtttgcaattgggcagtcatgaattgggccccacctggatgcgagaaactgggaaagtgcctgactccgccagagagcatcccgaagaagtgcctttggagccat

SEQ ID NO: 12001 - DNA, 1566 bp, Artificial Sequence
  Description of Artificial Sequence: Synthetic coding sequence
atggctgctgttgtggccgccacccggtggtggcagctcctgctggtgctgagcgcagctggtatgggagcgagtggagccccacagccaccaaatattctgttacttctcatggacgacatggggtggggagatcttggagtgtatggggagccttcccgagaaacgcccaatctggaccgaatggctgccgagggcttactgttccccaacttctattctgccaacccactatgctctccctcgagagccgccttgttaactgggcgactgcctatccgtaatggtttttacacaaccaatgcccatgcgagaaacgcctatacacctcaggagatcgtgggggggatcccagattccgaacagctactcccggagctactcaagaaggctggctacgtctctaagatagtcggaaagtggcacttggggcacagacctcaattccatccgcttaaacacggcttcgacgagtggtttggatctcctaactgtcattttgggccatacgacaataaggctcgacctaatatcccagtttatagagattgggaaatggtagggcgatattacgaagaatttcccatcaacctgaagaccggtgaagctaatctgactcagatctatttacaagaagcgttggattttatcaaaagacaggccagacaccatcctttttttctctattgggcagttgatgccacccacgctccagtttatgccagcaaaccattcctcggaaccagtcagcgaggccgatacggcgatgccgtgagagaaatcgatgactcaatcggaaagattctcgaactcctgcaggatctccacgtggccgacaacacatttgtcttttttacctctgacaacggggccgccttaataagcgctcctgagcaaggggggtctaacggcccatttctctgcggcaaacaaaccacctttgagggtggaatgcgagaaccagccctcgcctggtggcctggtcacgttacagcaggacaagtcagtcaccagctgggttccataatggatttgttcaccacttcattagcacttgcaggtctgacccccccgtctgatagggcaatagacggccttaacttactgcctacactgctgcaggggagattaatggacagaccgatcttttattatagaggagatacgctcatggctgccactttgggacagcataaagcccacttctggacctggactaactcttgggagaacttcagacaggggatcgatttttgcccgggccagaacgtctccggagtgactacgcataacctggaagatcacacaaaactacccttgattttccatctgggaagagaccccggcgagcgattccctctgtcatttgctagcgctgagtatcaggaggcccttagtcgtattacatcagtcgtgcagcaacatcaagaagcattggtgcctgcgcaaccacagctgaatgtttgtaactgggccgttatgaactgggctcctccaggatgtgagaaactggggaaatgtctgacaccccccgaaagtattcctaagaaatgtctctggagccac

SEQ ID NO: 12002 - DNA, 1566 bp, Artificial Sequence
  Description of Artificial Sequence: Synthetic coding sequence
atggcagcggtcgtcgcagcgacccgctggtggcagctccttctggtgctgtcagccgcaggaatgggagcgtcgggcgcaccacagccacccaacatccttctgctccttatggatgatatgggttggggcgacctgggcgtctatggggagccttccagagaaacccctaacttggacagaatggcagccgagggacttctgtttccaaacttctacagcgcgaacccactgtgctcgccttcccgggccgcgctcctgaccggtcgactgcctattcgcaatggcttctacactacgaacgcacatgctaggaacgcatacaccccccaagaaatcgtggggggtatccctgactccgaacagctgcttcctgaactgctgaagaaagcaggatacgtgtcgaaaattgtcgggaagtggcatcttggtcatcggccccagtttcatccacttaagcatgggtttgatgagtggtttggttcgcccaattgtcattttggtccttatgacaacaaggcacggccaaacattccggtgtatagagactgggaaatggtgggaagatactacgaagaatttcccattaatcttaagacgggtgaggccaatctcactcaaatctacctccaggaggcactcgatttcattaagcgccaggcccggcatcatcccttctttctttattgggccgtcgatgcaacgcacgcccccgtgtatgcgtcgaagccatttctgggaaccagccagagaggacgatacggagatgccgtgagggaaatagatgattccattggaaagattctggagttgctccaagatcttcatgtggctgacaatacctttgttttcttcacgtccgataacggagcggcactgatttcggccccggaacagggtggttccaacggtccctttctttgtggaaagcagactacctttgagggaggaatgcgggaacccgctctggcgtggtggccagggcatgtgaccgcaggacaagtgagccatcaactcggatccattatggatctctttaccacctcccttgcactcgcaggacttactccaccaagtgaccgtgcaatcgacggactgaatctgctccccaccctgcttcaagggcggctcatggacaggccgatattctactaccgcggagatactctcatggccgcaaccctcgggcaacataaggcgcatttttggacttggaccaacagctgggagaacttccggcagggaattgacttctgccctggtcaaaacgtgagcggggtgacgacccacaatctggaggaccacaccaaactgcctttgatatttcatcttggtagagatcccggtgagcgttttccgctgtcctttgcaagcgccgagtaccaagaagccctgtccagaatcaccagcgtggtccaacaacatcaggaagcactggtgcctgcacagccacaactcaacgtgtgtaattgggcagtcatgaattgggctcctcctggatgtgaaaagctcggaaaatgccttaccccaccggaatccataccaaagaagtgcctgtggtcccac

SEQ ID NO: 12003 - DNA, 1566 bp, Artificial Sequence
  Description of Artificial Sequence: Synthetic coding sequence
atggccgcagtcgttgctgctacgagatggtggcagctccttcttgttctcagtgcggccggtatgggcgctagtggtgctcctcagccaccaaacatcctattactgctcatggacgacatgggctggggtgatctaggtgtttatggtgagccatcgagggagacaccgaacctagacaggatggctgccgaaggacttctcttccccaatttctactcagccaatcccttgtgttccccttctagagcggcgctgcttaccggtcgccttccaattcgtaacggcttttacacgactaacgcccatgctcgcaacgcttacacacctcaggagatcgtaggtgggatccccgattcggagcaactgttgcctgaacttctgaagaaggcgggttatgtcagcaaaatagtagggaagtggcacttaggacatcggcctcaattccatcctctcaagcacgggttcgacgagtggttcggctcgccaaactgccactttggcccgtacgataacaaggcgaggcctaatatccctgtgtacagggattgggagatggtcggacgatactatgaagagtttcccataaacttgaaaacgggtgaggcgaacttaacccagatttacttgcaggaggccctggacttcatcaaacgacaggcccgacatcatccgttctttttgtactgggctgtcgatgcgacccatgcgccggtatacgcttccaagcccttcttaggcacatcgcaacgcggccgatacggcgatgccgtgcgggagattgatgactcaataggaaagatccttgagttgcttcaagatcttcacgtggccgataataccttcgtattttttacctctgacaacggcgcggccctcatatccgctccagaacaaggcggctcgaatggaccattcctttgcggcaagcagacaactttcgaagggggtatgcgggagcccgctctggcatggtggccagggcatgtcacagcgggtcaggtctcacaccagctaggatccatcatggaccttttcactacctcgctcgctcttgcgggtctgacgccaccaagtgacagagcgatcgatggtctgaatcttctgcctactctgctgcagggacgactaatggatcggccaatattctactatcggggagacaccctgatggctgctactcttggccagcataaggcgcatttttggacatggaccaattcgtgggagaacttccgtcagggaatcgacttttgcccgggtcagaatgttagtggtgttacgacacacaaccttgaggaccacaccaagctgccgctgatttttcatcttgggagggacccaggcgagagattccccctttccttcgctagcgcggaatatcaggaagctcttagcagaatcacctcagtcgtgcagcaacatcaagaggctctggttccggcgcagcctcagttgaacgtgtgcaactgggcagtcatgaattgggccccacccggatgtgaaaaattggggaaatgcctaaccccacccgagtctatccctaaaaagtgtttgtggtcacat

SEQ ID NO: 12004 - DNA, 1566 bp, Artificial Sequence
  Description of Artificial Sequence: Synthetic coding sequence
atggcggcagtggtggccgctacacggtggtggcagctgttgttggtcctgtctgccgcgggaatgggcgcaagtggtgcaccacagcctccgaatatattactgctcctgatggacgacatgggttggggggatctcggggtctacggtgagccttctagagagacccccaacctggacaggatggcagcggaaggtctcttattccctaatttctacagcgccaatcctctatgctctccttctagagccgctctgctgacggggcgcctgccaattcgcaacggtttttacacaactaatgcacatgctagaaatgcttatacccctcaggagatcgtcgggggcatacctgacagtgagcagctgttgcccgagctgttgaagaaagcaggttacgtgagcaagatcgtcgggaagtggcacctcggccaccggccccagtttcatccactcaaacacggattcgacgagtggttcgggagcccaaattgccattttggcccatacgacaataaagcccgtccaaatatcccagtctaccgggactgggaaatggtcggccgttattacgaggagttccccatcaatctgaagacaggcgaggccaacctgactcagatttatctgcaggaagctcttgactttatcaaaaggcaggccaggcaccaccccttttttttgtattgggccgtggacgcaacccatgcccccgtttatgcctctaagccattcttgggaacgagtcagaggggaaggtacggcgacgcagtgagggagatcgacgacagcatcggtaagatcctagagcttctccaggatcttcatgtcgccgataacactttcgtcttcttcacctctgacaatggagctgctctgatctccgcacccgagcagggcggatcgaacggcccattcctgtgtggaaaacagacaacatttgagggagggatgagggagccggctctagcctggtggcctggccacgtgaccgcaggacaagtttctcaccagctgggcagcattatggatctgtttaccacatctctagctctggcagggctcacacccccaagcgatagggcaatcgatggattgaacctccttccgactctgttacaaggtcggctgatggaccggcccattttttactatcggggcgacacgcttatggctgctaccctcggacagcacaaggcccacttctggacatggacgaatagctgggagaacttcagacagggcattgatttttgccccgggcagaatgttagtggtgtcaccacccacaatctggaggaccacaccaaactcccacttattttccaccttgggagagatccgggagagaggtttcctctgagctttgcttccgccgaataccaggaggctctgtctaggatcactagtgtagttcagcagcaccaggaggccctcgtgcctgcccagccacagctgaacgtgtgcaactgggccgtgatgaactgggctcctcccgggtgtgagaagttgggaaagtgcttgacccccccagagagtatcccgaagaagtgcttatggagccat

SEQ ID NO: 12005 - DNA, 1566 bp, Artificial Sequence
  Description of Artificial Sequence: Synthetic coding sequence
atggcggccgtggttgcggcgactcgctggtggcaactgttgctggtcctgtccgccgctggaatgggcgcatccggagccccacaaccgccgaacatactcctgcttctgatggacgacatgggttggggggatcttggagtctatggggagccgagcagagaaacgcccaacctcgatcggatggcagcagaggggctgctgtttccaaacttttactccgccaaccctctgtgctcgccgagcagagcggcactgctcacggggaggctgccgatacgcaacggattctacacgacgaacgctcacgcgcggaacgcgtacaccccacaggaaatcgtcggaggaatcccagattccgaacagttgcttccggaactcctcaagaaggccggctacgtttcgaagattgtcggaaaatggcatctgggtcaccgcccccaattccaccccctgaaacatgggtttgatgaatggttcggcagccccaactgccattttggcccttatgacaataaagctcggcccaatatcccagtgtacagagattgggaaatggtgggacgatactatgaggaattcccgatcaacttgaaaacgggggaagcaaatttgactcaaatctacctgcaagaagctctggatttcatcaagcgccaggcgcggcatcatccatttttcctgtactgggctgtggatgccacccacgcccccgtgtacgcatcgaagcctttcctgggaactagccagcgtggcagatacggcgatgcagtcagagagatcgacgacagcatcggtaagatcctggagctgctgcaggatctccacgtagcggacaataccttcgtgttcttcacctccgacaatggcgctgccctgatctcggccccagagcaaggcggatccaatggaccattcctttgcggaaagcagaccacgttcgaaggcggtatgagagaacccgcgctcgcgtggtggccgggacacgtcactgcaggacaggtgtcgcaccagcttggatccattatggacctgtttactacctcactcgccctggccggtctgacgccaccgtcggatagagcgatcgacggactcaacctgctgcccaccctgctgcaagggcggctcatggaccggccaatcttttactaccggggagacactctgatggcggccactctcgggcagcataaggctcacttctggacctggaccaattcgtgggagaacttcagacagggtattgatttctgcccagggcagaacgtgagtggagtgactactcacaacctggaggaccacaccaagctgcctctcatctttcatctgggtcgggaccccggcgaacggttcccgctctcattcgccagcgctgagtaccaggaggcactgtcacgcatcacctccgtcgtgcaacagcaccaggaggcgctcgtgccggcgcaaccacagctcaacgtgtgcaactgggccgtgatgaattgggctccgccgggatgtgaaaagctcggaaagtgtttgaccccgccagaatcgattccgaagaaatgtctgtggtcgcat

SEQ ID NO: 12006 - DNA, 1566 bp, Artificial Sequence
  Description of Artificial Sequence: Synthetic coding sequence
atggcagccgtcgtggccgctacccgatggtggcaactcctactggtcctctctgccgccgggatgggagcatccggcgcgccccagccaccgaacatcctgctgctgctgatggatgacatggggtggggtgatttaggggtatacggagaacccagcagggagacacccaaccttgaccggatggcagcagagggcctgctcttcccaaacttctatagcgcaaatcccctctgcagtccctctcgcgctgccctgttaacggggcggctgccaataaggaacggtttttataccaccaacgcacacgcccggaacgcctatacaccccaggagatcgtgggtgggataccagactccgagcagttactccctgaattactgaagaaagctggttacgtgtcaaaaatcgttggaaagtggcacctcggtcatcgaccacagtttcacccccttaagcatgggttcgacgagtggtttggcagtcctaattgtcactttggtccctacgataataaggccagaccgaacatccctgtatacagggattgggagatggtcggccgatactacgaggagttcccaatcaacttaaagacaggtgaagccaatttaactcaaatttacctgcaggaagcattggacttcattaaacgccaggcacgccaccacccattttttctgtattgggccgtcgacgccacacacgccccagtgtatgcctccaaacctttcttgggcacctcccagcgcggaagatatggtgatgctgtacgagagatcgatgacagcatcggaaaaattttggaactgctgcaggacctgcacgtggctgataatactttcgtcttttttaccagtgacaacggggccgcattaatcagtgcgccagagcaaggcgggagtaacggccccttcttgtgcgggaagcagacaacttttgaggggggtatgcgggagcccgcactcgcttggtggcccggacacgtgacggcagggcaagtgtctcatcagctcgggtcaattatggacctttttactacttcgctagcactcgccggcttaacacctccgtcggaccgggccatcgatggtctgaatttgctgcctacgctattgcaaggacgcctaatggaccgaccaatattttactatagaggtgacactttaatggcagccaccttggggcaacacaaagctcatttctggacctggactaactcttgggagaatttccggcagggcatcgacttctgccctggccagaacgtcagtggtgtgaccacgcataatttagaggatcacactaagcttcccctgatttttcatctcggtcgcgacccaggggagcggtttccgctgagctttgcctcagccgaataccaggaagcactgtcccggattaccagtgtcgtccagcagcaccaggaggcactcgtgccagcacaaccgcagctgaacgtctgcaactgggccgtgatgaattgggcaccgcctggctgtgagaagcttggtaaatgcttgaccccccccgagtcaatccctaagaagtgcctgtggtcgcac

SEQ ID NO: 12007 - DNA, 1566 bp, Artificial Sequence
  Description of Artificial Sequence: Synthetic coding sequence
atggccgcggtggtggcagcgactcggtggtggcaacttctgctggtgctgtcggcagcagggatgggagcatctggagcaccgcaaccccccaacatcctgctgctccttatggacgacatgggttggggagacttgggcgtctacggagaacctagcagggaaactcccaacctggacagaatggcggcagaaggcctgttgtttcccaacttttactcagccaaccccctctgctccccttccagagcagcattgcttaccggccgcttgcctattagaaatggcttttacaccaccaacgctcacgcaagaaacgcgtacactccacaagaaatcgtgggcggcatccccgatagcgaacagctgctgcccgaactgttgaaaaaagccggatatgtgtcgaagatagtgggaaagtggcaccttggacacagaccacagtttcatccgcttaagcatggttttgacgagtggtttggatcaccaaactgccactttggtccatacgataacaaggctagaccaaacatcccggtgtacagggattgggaaatggtcggaagatattacgaggaattccctatcaacctcaagaccggggaagcaaacctgacccagatatacctccaggaggcactggatttcatcaaacggcaagcaagacatcatcccttctttctgtactgggccgtggatgcgacgcatgcaccagtgtacgcatcgaagccattcctcggaacgtcccaacggggacgctatggagatgcagtgcgagaaatagacgacagcatcggaaagattctggaactgctgcaagatcttcatgtcgccgataacacctttgtgtttttcacttcagataatggagcagcactgatatcggccccagaacagggagggtcaaatggccccttcttgtgcggtaaacagaccacctttgaaggaggaatgcgagagcctgctctcgcctggtggccgggacatgtcactgccgggcaggtgtcccaccaactcggttcaattatggatctctttactacttcgctcgcacttgccgggcttactccaccgtctgaccgcgcaattgatgggctgaacctccttccaactttgctgcaggggcggctgatggatcggcctattttctactaccggggagataccctgatggcagcaaccttgggacagcataaggcccatttttggacttggactaacagctgggagaattttcgtcagggcatcgacttttgtcccgggcagaacgtgtcgggtgtgactacccataaccttgaggatcataccaagctgccactcatcttccatctcggcagagatccaggtgagaggtttcccctttcgttcgcgtcagccgaataccaagaagccctgtcacggattacctccgtcgtccagcagcatcaagaagcattggtgccggcgcagccccaacttaacgtgtgtaattgggccgtgatgaactgggccccacctgggtgtgaaaagctgggcaaatgtctgacgcctcctgaatcgattccgaagaagtgtctgtggagccac

SEQ ID NO: 12008 - DNA, 1566 bp, Artificial Sequence
  Description of Artificial Sequence: Synthetic coding sequence
atggcggcagtcgttgccgccaccaggtggtggcaactgctgctggtgcttagcgccgctggcatgggtgcctccggcgccccacaaccacccaatatactgctcctgttgatggacgatatgggctggggcgacctcggggtctacggagagccaagccgcgaaactccgaaccttgaccgcatggctgccgagggcctcctgttcccgaacttctactcggcaaatccactgtgcagcccttcgcgggccgctctgctgactgggcggctccctatccggaacggattctacaccacgaacgcccatgccagaaacgcgtacactccgcaggaaatcgtgggaggcatcccggattccgagcagctgctgccagaactgcttaagaaggcaggatacgtgtcaaaaatcgtgggaaagtggcatcttggacacaggccgcaattccatcctctcaaacatggttttgacgaatggttcggctcgccaaactgtcatttcggcccctacgataacaaggccagaccgaatatccccgtgtaccgggactgggaaatggtcggcaggtactacgaagaattcccgattaatctgaaaactggcgaggcaaacctgactcagatttacctgcaagaggcgctcgacttcatcaaaagacaagcaagacaccaccccttcttcctgtactgggccgtggacgcgactcacgcaccggtgtacgcctcaaagccatttctgggcacttcgcaacggggacgatacggcgatgcagtccgggagattgatgattcgatcgggaaaatcctggaacttcttcaggacctccatgtcgcggataataccttcgtgttctttaccagcgataatggagccgccctgatctccgccccagagcagggaggctccaatggtcctttcctgtgcggaaagcaaaccaccttcgaaggcggaatgcgggagccagcccttgcatggtggccgggccacgtgaccgccggacaagtgagccatcagttgggcagcatcatggacctgtttactaccagcctggcgctcgcgggactgactccgccttcagatagagcgatcgatggtctgaatctcctgcccaccttgctgcaggggcgcctgatggaccggccaatcttctactatagaggtgatacgctgatggcggctactcttggccagcataaggcgcatttttggacctggaccaacagctgggaaaacttccgtcaaggaatcgacttctgccctggccagaacgtgtcaggagtcactacccataatctcgaggaccataccaaactccctttgatcttccatctcggtcgggacccgggggagcggtttccactgagtttcgcgagcgcggaataccaggaagcgctgagccgcatcacctccgtcgttcaacaacaccaggaggctctggtcccggcacagcctcaattgaacgtctgtaactgggccgtgatgaactgggccccaccaggatgtgagaagctgggaaagtgcctgaccccgcctgaatcaatcccgaagaagtgcctgtggagccac

SEQ ID NO: 12009 - DNA, 1566 bp, Artificial Sequence
  Description of Artificial Sequence: Synthetic coding sequence
atggcggcagtggtcgccgctactaggtggtggcagctcctcctggtgctgagcgccgccggcatgggtgcgtcaggggctccgcaaccgccgaacatcctgctcctgctcatggacgacatgggatggggcgatctgggcgtctatggtgaaccatcgcgtgagactccaaacctggaccggatggcagcagaggggttgctgttcccgaatttctactcggctaatcccctgtgctcaccgagccgcgctgctttgctcactggtcgactccctattagaaacgggttctacactaccaacgcacatgcgcgcaatgcttacaccccgcaagagatcgtgggagggattccggactcagaacagctgctgccggagctcttgaagaaagcaggttacgtgtcgaaaatcgtgggcaaatggcatcttggccatagacctcagttccatccactgaagcacggattcgatgaatggttcggttcgccaaattgtcatttcggcccttacgacaataaggcgcgccctaacatccctgtgtacagagattgggagatggtgggacggtattacgaagaattcccgattaacctgaaaaccggagaggcaaacctgactcaaatctacctgcaggaagcgctggatttcataaagaggcaagcccgccaccacccctttttcctctactgggcagtcgacgcaacccatgccccagtgtacgcttccaagcctttccttggaactagccagcgcggtagatacggagacgcagttcgggaaattgacgactccatcggcaagatcctggagctcctccaagacctgcatgtcgcagataatacgtttgttttctttacctccgataacggcgccgccctcattagcgcccctgagcaaggtgggagcaacggaccattcctctgtggcaagcagactactttcgagggcggcatgcgagaaccggcgcttgcgtggtggccggggcacgtgactgctggccaggtgtcgcaccagctggggtcgatcatggacctttttactacgagcttggcgcttgccggactgactccaccgtcggaccgcgcgatcgatggtctgaacctcttgcccaccctcctgcagggacgactgatggacaggccaatcttttactaccggggagacactctcatggcggccactctcggacagcacaaggcccatttctggacctggactaactcctgggaaaactttaggcaaggcatcgatttctgccccggccagaacgtcagcggagtcactacgcacaatctggaagatcacaccaagctgcccctcatcttccatctcggccgcgacccgggagaacggtttccgctgtcatttgcctccgccgaataccaagaggccctgtctcgcattacgagcgtggtgcagcagcaccaggaagctctcgtcccagcacagcctcaactgaacgtctgcaattgggccgtgatgaattgggcccctccgggatgtgagaagctgggaaaatgccttactccgccagagtcaatcccaaagaagtgcctgtggagccac

SEQ ID NO: 12010 - DNA, 1566 bp, Artificial Sequence
  Description of Artificial Sequence: Synthetic coding sequence
atggctgctgtggttgccgcgactcgctggtggcaactgctgctcgtcctgagcgccgccggtatgggagcctccggggccccacagccgcctaatatcctgctgctgcttatggacgatatgggatggggtgatctgggggtgtacggagaaccttcacgagaaacgccgaacttggatcggatggccgccgaggggctcctttttcctaatttctacagcgccaatccgctttgctcgccctcaagggcggccctcctcacgggacggctgccaattagaaacggcttctatactaccaacgcgcacgcaagaaatgcctacaccccgcaggagatcgtcggcggaatccctgacagcgaacaacttctccctgaactgcttaagaaagccgggtacgtgtcgaagatcgtgggaaaatggcatctgggtcaccgcccacagttccatccactgaaacacggattcgacgaatggtttgggtcacctaactgtcacttcggaccgtacgacaataaggctaggcccaacatcccggtgtaccgggactgggaaatggtcggccgttactacgaagagtttccgatcaacctcaagacgggagaggccaacctgacccagatttacctccaggaggcactcgactttatcaagagacaagcccgccaccacccgttcttcctgtactgggccgtggacgccacccatgccccagtctatgcatcaaagccgttccttggcacttcccaacggggaagatacggagacgccgtgcgcgaaatcgatgactccatcggtaagatcctggaactgttgcaggacttgcatgttgctgacaacaccttcgtattcttcaccagcgataacggagctgcgctgatttcagccccggagcaaggaggatcgaatggaccattcctctgcggtaaacagaccactttcgagggtggaatgagagaacctgctctcgcctggtggccaggacatgtgactgctggacaggtgtcacaccaactcggatcgatcatggatcttttcaccacgtcgctggcactcgccgggttgaccccaccgtcggaccgtgccatcgacggactcaaccttctgccgaccctcctgcagggtaggctgatggacaggccgatcttttactacagaggagacacgctgatggcggctactctcggacagcataaagcgcacttctggacctggactaacagctgggaaaacttccgccaaggcatcgacttctgccccgggcagaatgtgtccggagtaaccacccacaacctggaggaccacactaagttgccgctgatttttcatttgggacgggacccaggagaaaggttcccgctgtccttcgcgtcggcagagtaccaggaagctctgtcaagaatcacttcggtagtccagcagcaccaagaagccctggtgccggcgcaacctcagctgaacgtgtgcaattgggccgtgatgaactgggcgcctccgggatgcgagaagctcggcaagtgcctgaccccacccgagtccatcccaaagaaatgtctgtggtcccat

SEQ ID NO: 12011 - DNA, 1566 bp, Artificial Sequence
  Description of Artificial Sequence: Synthetic coding sequence
atggcagcagttgttgctgcaactcgatggtggcaattattactagtattaagtgcagctggaatgggtgcttctggagctccacaaccaccaaacattttattattattaatggatgatatgggttggggagatcttggagtttatggagaacctagtagagaaactccaaatttagatagaatggcagctgaaggattattattcccaaatttttattcagctaatccactttgtagtccaagcagagcagcattattaactggaagattaccaattagaaatggattttatactacaaatgcacatgcaagaaacgcatatactccacaagaaattgttggaggaattcctgattcagaacaattattacctgaacttttaaaaaaagctggttatgttagtaaaattgttggtaaatggcatttaggtcatagacctcaattccatcctcttaagcatggatttgatgaatggtttggatcaccaaattgccattttggaccatatgacaataaagctagaccaaatatacctgtatatagagattgggaaatggtaggacgatattatgaagaatttccaataaatcttaaaactggtgaagcaaacctcactcaaatatatttacaagaagctcttgactttattaagagacaagcaagacatcatccattttttttgtattgggctgtagatgcaactcatgccccagtttacgctagtaagccttttttaggaactagtcaaagagggcgttatggagatgctgttcgtgaaattgatgattcaattggtaaaattttagaacttcttcaagatcttcatgttgctgataatacatttgtattctttacttcagataatggtgcagctttaatttcagcaccagaacaaggagggtctaatggaccatttctttgtggaaaacaaactacttttgaaggtggaatgagagagccagcacttgcttggtggcctggacatgttacagctggtcaagtatctcatcaacttggaagtattatggatcttttcactacatcattagctttggccggactaactccaccatctgatcgagctattgacggtcttaatcttttaccaactttacttcaaggtcgattaatggataggcctatattttattatagaggagatactcttatggcagcaacacttggacaacataaagctcatttttggacttggacaaattcttgggaaaattttagacaaggaattgatttttgtcctggtcaaaatgtaagtggagttactacgcataatcttgaagatcatacaaaattacctttaatttttcatcttggtagagaccctggggaaagatttccattgtcttttgctagtgctgaatatcaagaagctctttcaagaattacttcagtagtacaacaacatcaagaagctcttgttccagctcaaccacaattaaatgtatgtaattgggctgtgatgaattgggcacctcctggatgtgaaaaattaggtaaatgtttaacaccaccagaatcaattccaaagaagtgcttgtggtcacat

SEQ ID NO: 12012 - DNA, 1566 bp, Artificial Sequence
  Description of Artificial Sequence: Synthetic coding sequence
atggccgcagtggtggccgctacacggtggtggcagctgcttctggtgctgtccgctgccggcatgggcgcttccggggccccccagccaccgaatatcttgctgctactaatggatgatatggggtggggcgatctcggcgtgtacggcgagccgtcaagggagacacctaatctggacaggatggcagcggagggcctgctgtttcctaatttctatagcgctaaccccctgtgtagccctagtagggctgctcttctgactggacgactcccgatccggaatggattctatactactaacgcccatgctaggaacgcttacacccctcaggagatagtcggaggcataccggatagtgaacaactgctgccggaactgctgaagaaagccggatacgtatcaaagattgtcggtaaatggcacctggggcacaggcctcagtttcatccactaaagcatgggttcgatgaatggttcggatctcccaattgccacttcgggccttacgataataaagctagaccgaacattccggtgtacagggactgggaaatggtggggagatattacgaagaattcccaattaatctgaagactggagaggctaacctgacccagatctatctccaggaagctctcgatttcattaagcgtcaggccagacatcacccattcttcttgtactgggctgtcgacgcaacccacgcaccggtttatgcatccaaaccattcttaggtacgtcccagcggggccgttacggagatgcggtaagagaaatcgacgatagcataggaaaaatcctggaacttctccaggacctccacgtggcagataatacttttgttttctttacctccgacaacggtgcagccctgatcagcgcacctgagcagggcggcagtaacggccccttcctatgcggcaagcagaccacgttcgaaggtggcatgagggaacccgccctggcgtggtggcccggccacgtaacggccgggcaggtgtctcaccagcttggaagcatcatggatcttttcacaacatctctcgccctggctgggctgacaccaccaagcgatagggcgatcgacggtcttaacctgctcccaaccctgctccagggaaggttgatggatcgccctatcttttattaccggggtgatacacttatggcggctacgctgggacaacataaggcacacttttggacatggacaaattcttgggaaaatttccggcagggtattgatttctgccccggtcagaacgtatcaggcgttactactcacaatctggaagatcataccaaattgcccttgatttttcatcttggacgagacccgggcgaacggttccctctgtcgttcgccagtgccgaataccaggaagccttatcgagaatcacttcagtggttcagcagcaccaagaagctctggtgcccgctcagccgcagctaaacgtgtgcaattgggccgtgatgaactgggcacctcccgggtgtgaaaagcttggcaagtgcttgactccccctgaaagcattccaaagaagtgcctctggtctcat

SEQ ID NO: 12013 - DNA, 1566 bp, Artificial Sequence
  Description of Artificial Sequence: Synthetic coding sequence
atggctgcagtggtggctgcgaccagatggtggcaactgctgctcgtgctgagcgcggctggaatgggagcctcaggcgccccacaacccccgaatatcctgctcctcctcatggacgacatgggatggggggacctgggtgtgtacggcgaaccttcgcgggagactccgaatcttgaccgcatggctgcggagggactgctcttcccaaacttttactcagcaaatccactgtgctcaccctccagagcagcgctccttaccgggcggctcccgatccgcaacggtttctacaccaccaacgcgcacgctcggaacgcctacactccgcaggaaatcgtcggaggaattccagactcagagcaactgctgcccgagctcctgaagaaggccggatacgtgtcaaagatcgtcggcaagtggcacctcggtcacagaccgcagttccacccgctcaagcacgggttcgatgaatggttcggttcaccaaactgtcatttcggaccatacgacaacaaagcccggccgaatatcccagtctatcgcgactgggagatggtgggacgctactatgaggaattccctatcaacctgaaaactggagaggcaaacctcacccagatctacctgcaagaagccttggacttcatcaagcggcaagcccgccaccacccctttttcctctactgggcagtggacgccactcacgccccagtctacgcctcgaaaccttttctgggcacttcccagaggggccggtacggggatgcggtgcgggagatcgacgactcaatcggcaaaatcttggaactgttgcaggatttgcacgtggcggataatactttcgtctttttcacctcggacaacggcgccgcgttgatctcggcgccagaacaggggggatcgaatggcccgtttctgtgtggaaagcagactacctttgagggaggaatgagagaacccgccctggcctggtggccaggacatgtgactgccggccaggtgtcacatcagctcggttccattatggacctttttaccacttccctcgcactggccggactcactcccccgtccgatcgggctattgacggactgaacctgctgcccacgctcttgcaaggaaggctgatggatcgcccgatcttctactaccgcggcgatacgctcatggcggcgactctgggccagcacaaggcacatttctggacctggaccaattcatgggagaactttcgccaagggatcgatttctgcccagggcaaaatgtttccggagtgaccactcataatctggaggaccacactaagttgccgctgatctttcatctgggacgggatccaggggagcgcttcccgttgtcctttgcgtcggcggagtaccaggaggcgctgagccgcatcacctccgtggttcaacagcaccaagaagctctggtgccggcccaaccgcagctgaacgtgtgcaactgggctgtgatgaattgggccccgccgggatgcgaaaagctgggaaaatgcctgacgccccccgaatcaatcccgaagaagtgcctctggtcgcac

SEQ ID NO: 12014 - DNA, 1566 bp, Artificial Sequence
  Description of Artificial Sequence: Synthetic coding sequence
atggccgcagtggtggccgctacccggtggtggcaactcctgctggtgctcagcgccgccgggatgggagcatcaggagcaccgcagccgccaaatatcctgctcctgctgatggatgatatggggtggggagacttgggtgtctacggagaaccgtcgcgggaaacccctaacctggaccggatggctgccgagggactgcttttccccaacttctactccgcgaatccgctgtgttcaccaagccgagccgcgcttctgactggccgcctgccgatcagaaacggattctacactactaacgctcacgcgcgcaatgcatacactccacaagaaatcgtgggaggtatcccggactcggagcaactgcttccggagctgctgaagaaggccgggtacgtgagcaagattgtcgggaagtggcacctgggacacagaccacaatttcacccgctcaaacacggattcgacgagtggttcggttcgccgaactgccactttggcccctacgacaacaaggcgcggccgaatatcccggtgtacagagattgggagatggtggggcggtactacgaggagttcccgatcaatcttaagaccggagaggcaaacctcacccagatttacctgcaggaggcgctggacttcattaagagacaggcgcggcaccatccgtttttcctctactgggctgtggatgctacccatgccccggtgtatgcatcgaagccgtttttgggcacttcccagcgcggtcgctacggagatgcagtccgcgaaatcgacgactcaatcggcaagatcctggagctcctgcaagacctgcacgtggcggataacacgtttgtgttcttcacttcagacaatggcgcagccctcatctcggcgcctgaacagggaggttccaatggaccgttcctgtgcgggaaacaaaccaccttcgaagggggtatgcgcgaaccggcgttggcatggtggccaggacatgtgactgccggacaggtaagccaccagctcgggtccatcatggatttgtttaccacttcgctggctctggcaggcctcactcccccaagcgaccgggccattgacggactgaatctcctgcctaccctgctgcaaggacggttgatggatcgccccatcttctactatcgcggggatactcttatggctgccaccctgggacagcataaggctcacttctggacctggactaatagctgggagaactttcgccaggggatcgatttctgcccgggacagaatgtctcaggcgttaccacccacaacctggaagatcatactaagctgccgctgatcttccatctcgggagggacccaggtgagagatttccactgtcgtttgcttccgccgaataccaagaagcactctcacggattacttcagtcgtccagcaacatcaagaggcactcgtccctgctcaaccccagctgaacgtgtgcaattgggctgtgatgaattgggccccgccgggatgtgagaaactgggaaagtgtctgacgccgccggagtcgatccccaagaaatgcctttggtcgcat

SEQ ID NO: 12015 - DNA, 1566 bp, Artificial Sequence
  Description of Artificial Sequence: Synthetic coding sequence
atggcagctgtcgtcgcagcaactagatggtggcagcttctccttgtgctgtccgcagcaggaatgggcgcttcaggggccccccaacctcccaatatactgcttttgcttatggatgacatgggctggggtgatctgggtgtctacggagaaccatcaagggagactcctaatctcgaccgaatggctgcagagggcctcctttttcctaacttttacagcgcaaaccctctttgttccccttcgagagcagccctcctgaccggtagactccccattaggaacgggttctacacgactaatgcccatgcacggaatgcatacacccctcaagaaattgtcgggggaattcccgattcggaacaacttctgccagagctcctgaaaaaggctggctacgtgagcaagattgtgggcaagtggcatttggggcacaggccacagtttcaccctctgaaacacggatttgatgaatggttcggttcccctaactgtcatttcggaccatacgataacaaggcacggcctaacataccggtttacagagactgggagatggtggggagatactacgaagagttccctattaacctcaagactggtgaagcaaacctgactcagatttatctccaggaagctctcgatttcatcaagcgacaggctagacaccacccattctttctctactgggcagtcgacgcaactcacgcccccgtgtacgcatcgaaacccttcttgggaaccagccagagggggagatacggtgatgccgtgagagagattgatgatagcatcggtaagatcctcgaacttctccaggacctgcatgtcgcagataacacctttgtgttctttactagcgataacggggcagccctgatctccgcaccggaacagggaggatcgaacggcccctttctttgtggtaaacagactacctttgagggcggaatgagagaaccagcacttgcatggtggccaggtcatgtgaccgccggccaagtctcgcatcaacttgggagcattatggatcttttcaccaccagcctcgcacttgcagggctgactcctcctagcgatagggcgatcgacggacttaacctgcttcctactctccttcaaggtcgtcttatggacagacctatattctactaccgaggagatactctgatggcagcaactctgggacagcataaagcgcatttttggacgtggactaactcgtgggagaacttcaggcaaggaattgatttttgtcctggacaaaacgtcagtggagtgaccacccataatcttgaagatcataccaaactcccactgattttccatcttggacgcgatccaggggaacgctttcccctctcatttgcatccgcagaataccaagaagcactgagcagaatcacgtcggtggtgcagcagcaccaggaagccctggtcccagcacagccccaacttaacgtgtgtaactgggcagtgatgaactgggcgccacctggatgtgagaagctcggaaagtgcctgacccctcccgaatccatccccaagaagtgtctttggtcccat

SEQ ID NO: 12016 - DNA, 1566 bp, Artificial Sequence
  Description of Artificial Sequence: Synthetic coding sequence
atggccgctgtggtagcagctacaaggtggtggcagctactgctggtcctctctgccgccggaatgggggcctccggagctccccagccccctaacattttactgttacttatggacgatatgggatggggggatctcggagtttacggagaaccctctcgggagactcccaacctagataggatggcagctgaaggattgctttttccaaatttctactctgctaaccctttatgttctccctccagggcagcactcttaactgggcggttgcctatcaggaatggattctacacaactaatgcacacgcccggaatgcttatacaccacaggaaatcgtgggggggattccagattctgagcagttgttgcccgaattattgaaaaaggcaggatacgtttccaagatagtgggaaagtggcaccttgggcaccggccccagtttcaccctctcaaacacgggttcgacgagtggtttgggtcgcctaattgtcatttcgggccttatgataacaaagcacgacctaatatcccagtgtatcgagactgggaaatggtcggaaggtactatgaggaatttcctataaacttaaaaactggggaagccaacttaactcagatttatttgcaggaagccctagacttcatcaagcggcaggcccggcaccaccctttctttctgtattgggccgtggatgccactcatgctcctgtgtacgcatcgaaacccttcttaggaacatcccagcggggacggtatggggatgctgttagagaaatagatgattccatcggaaagattctagaattgctacaggatttacacgtagccgataatacattcgtgttcttcacatccgacaacggggccgcccttatctctgctcctgaacaggggggatctaatggaccatttctctgtggaaagcagacgacattcgaaggaggaatgagggaacctgcactggcttggtggcctggacatgtcacagcagggcaggtctctcatcagcttggatctatcatggatttatttacaacttcccttgccctcgccggactaactccgccatcagatcgtgcaatagatggactcaatctgcttcccactttactgcaggggcggttaatggatcggcccatcttttattatagaggggatactctcatggcagctacgctggggcagcataaagcccatttctggacttggacaaacagttgggaaaacttcagacaggggattgatttttgtccagggcagaatgtgagtggggttacaacacacaaccttgaggatcatacaaaacttcctctaatattccatctggggcgcgatcccggggaacgcttcccattgtccttcgcaagtgccgaatatcaggaagccctgtcgaggataacttcagtggtacagcagcatcaggaagcacttgtgccagcccagccccagctaaatgtgtgtaattgggccgtgatgaactgggccccccctgggtgtgagaaactcggaaagtgccttacaccccctgagtctatacccaaaaaatgtctgtggtctcat

SEQ ID NO: 12017 - DNA, 1566 bp, Artificial Sequence
  Description of Artificial Sequence: Synthetic coding sequence
atggcagccgtggtggcagcaacccgctggtggcaacttctgcttgtgctgtccgcagcgggaatgggggcatcaggcgcaccacagccccccaatatactccttttgctcatggatgacatgggatggggcgacctgggagtgtacggcgagccatcgagagaaactccaaatcttgatcggatggcagccgaagggctgctcttccccaatttctactcggctaacccactgtgttcgccttcccgcgcagccctgcttaccggtaggctgcccattagaaacggattctacaccactaatgcccacgcacggaacgcatacacccctcaagaaattgtgggagggatccctgactcggagcagctgctgcccgaacttctcaagaaggcaggatacgtgagcaaaatcgtcggtaagtggcatctgggtcaccgtccacaatttcatcctctgaagcatggctttgatgagtggttcggttcgcccaactgccacttcggcccatacgacaataaggcccggccaaacatacccgtctacagggactgggagatggtgggcagatactacgaagaatttccaattaaccttaagactggggaggccaaccttacgcaaatctacctgcaggaagcgctcgactttatcaaaaggcaggccaggcaccatccatttttcctttactgggcagtggacgcaactcacgccccggtctacgcatcgaagccatttctcggaacctcacagcgcggtcgctatggtgatgcagtgcgggaaatcgatgactcaatcgggaagatcctggaactcctgcaggatttgcacgttgcagataacacttttgtgttctttaccagcgataacggcgcagccctgatctccgccccagaacaaggcggcagcaacggcccttttctctgtggtaaacaaacgaccttcgaagggggcatgcgtgaacctgcactggcatggtggcctggtcacgtgactgctggacaggtgtcccaccagctcggctctattatggatctttttaccacttcccttgcactggccggacttaccccaccttccgatcgtgcaattgatggtctgaacttgctgcctactctgttgcaagggcgcctgatggatagacctattttctactacaggggagacaccctgatggctgccaccctcggacaacataaggcacacttttggacttggaccaacagctgggaaaactttagacaaggaatcgatttctgtccaggtcagaatgtgtcaggtgtcaccacgcataatctcgaagatcataccaaactgcccctgatttttcatcttggtcgggatcctggagagaggtttcccctgagcttcgcatctgctgagtaccaagaggccctgtctcgaataactagcgtcgtgcaacagcatcaagaagctctcgtgccggcacagccgcagctcaatgtctgcaattgggcagtcatgaactgggcacctccgggttgtgaaaaactcggcaaatgtctcactccaccagagtccatcccgaagaaatgtctctggtcacat

SEQ ID NO: 12018 - DNA, 1566 bp, Artificial Sequence
  Description of Artificial Sequence: Synthetic coding sequence
atggcggcagtggtcgcagccactaggtggtggcaactgctgcttgtcctttcggcagcgggaatgggggcgtcaggggcgcctcagccccctaacatacttttgcttctgatggatgatatgggctggggcgatctgggagtctatggggaaccttcgagggaaaccccaaaccttgatagaatggcggccgaagggcttctgtttcctaacttttacagcgcgaatccactttgcagcccttcccgtgctgccctgttgacgggacggctgccgatacgaaacggcttctacaccactaatgcacacgcaagaaacgcttacactcctcaggaaattgtgggcggtatcccagattcggaacaactccttcccgagctcctgaagaaggcggggtacgtctccaaaattgtgggaaagtggcatcttggtcatcgacctcaatttcaccccctgaaacacgggtttgacgaatggtttggatcgccgaattgccactttggaccatacgataacaaggcacgcccaaacattcctgtgtacagagattgggagatggtcggtagatactacgaagagttcccaattaaccttaagaccggcgaagctaacctcacccagatatatctccaggaagctcttgatttcatcaaacgccaagcgcggcaccatcctttctttctgtactgggcagtggacgcgacccatgctccagtgtacgcgtcaaagccatttctggggacctcgcagcggggtcgctacggtgacgcggtgagagagattgacgattctattggtaagatccttgaactcctccaggaccttcatgtggcagataacacctttgtgttcttcacttccgataatggagcagcacttatttccgcacctgaacagggtgggagtaatggaccatttctttgtggtaagcagaccacctttgaggggggaatgagggaaccagccctggcctggtggcctgggcatgtgaccgcaggccaggtgtcccatcaactgggctccatcatggatctctttaccacgtcacttgcattggcggggttgaccccacccagcgatagagccattgacggcttgaatcttcttccaactctcctccaaggccgccttatggacaggcctatcttttactaccgaggagatacgctcatggccgcaaccttgggacaacataaagcccatttctggacttggactaattcgtgggaaaactttagacaaggaatcgatttttgtccgggacagaacgtgtctggcgtgactacgcataacctcgaggatcacaccaaactgcccttgattttccatctggggcgggaccctggcgagcggttccctctgtcctttgcctccgccgagtaccaagaagctctgtcccgaatcacgtccgtcgtgcaacagcaccaagaggccctggtgccagcgcaaccacagctgaatgtctgtaattgggccgtgatgaactgggcgcctcccggatgtgaaaaacttggaaagtgccttactccacctgaatctattcccaagaagtgcctctggagccat

SEQ ID NO: 12019 - DNA, 1566 bp, Artificial Sequence
  Description of Artificial Sequence: Synthetic coding sequence
atggccgccgtggtggccgccacacgctggtggcagttgctgctagtcttgagcgcagcgggcatgggcgcgtcaggagcaccgcagccacctaatatcctgctcctgctgatggatgacatgggctggggcgacctgggggtctatggggaacccagtcgggagacacctaacctagatagaatggctgccgagggtcttctttttcccaacttttattcggcaaaccccctgtgctcgccatccagggctgcccttcttaccggaaggctgcctattaggaatggattctacaccacaaacgcccacgccaggaacgcgtataccccccaggaaatcgttggcggaatccccgactctgagcagcttctgcccgaactgcttaaaaaggccggctatgtatccaaaatagtcgggaagtggcacctcggccacaggccccagttccatcccctgaaacacggattcgacgagtggttcggcagcccaaactgtcactttggcccctatgataataaggctagacctaacattccggtctacagagactgggaaatggtggggaggtattacgaggaatttccaatcaacctgaaaacaggagaggctaacctgacccaaatctacttacaggaggccttagatttcataaaacgtcaggctcgacaccatcccttctttctgtactgggcggtcgacgctacacatgcaccagtatatgccagcaaaccctttctgggcacatctcaaagaggtaggtacggagatgccgtgcgtgagattgacgattcgataggcaagattctagaactcctgcaggatctgcacgtagctgataatacatttgtgtttttcacttctgataacggcgctgccctgatcagtgccccagagcaggggggctcaaacggcccctttctgtgtggcaagcagaccacctttgaaggaggtatgcgcgagccagccctggcttggtggccgggacatgtaacggccggtcaagtgtcccatcagttggggtctataatggacttattcactacctccctggccctcgctggcctgacacccccatctgatagggccatagatggcctgaacttgctcccaaccttactgcagggtcggctgatggataggcccattttctattaccgaggtgacacactaatggctgcaactctgggtcagcacaaggctcacttttggacctggacaaactcttgggaaaacttcaggcagggcatcgatttttgtcccgggcaaaacgtgtctggggtgacaacccacaatttggaagatcataccaagctcccgctcatctttcatctgggtcgagacccaggggaacgattcccactgagcttcgcttcagccgaataccaggaagctctgtccaggattacttcggtcgtacaacagcaccaggaagcgctggttcccgcccagccacagcttaacgtgtgcaattgggcggtcatgaactgggctcctcccggatgcgaaaaattaggaaagtgtttaacaccccccgagtctattcctaagaaatgtctgtggtcacat

SEQ ID NO: 12020 - DNA, 1566 bp, Artificial Sequence
  Description of Artificial Sequence: Synthetic coding sequence
atggcggctgttgtggccgccacccgctggtggcagctgttgttggtgttgtccgccgctggcatgggcgcaagcggcgcaccacagccgcctaatatcttgttgctgttgatggatgatatgggctggggagacctaggcgtctacggcgaaccgagccgcgagacgccaaacctcgatcgaatggccgcggaaggtctgctgttcccgaacttctactcagccaacccactttgtagcccctcccgagcggcgcttctgaccggccgcttgcccattcgaaacggattttacacgaccaacgcgcacgccaggaatgcgtacacgccgcaggagattgtggggggaataccggattcggagcagctactaccagagctgctgaagaaggctggctacgtatcaaagattgtgggcaagtggcatctgggacaccgtccccagttccatccccttaagcatgggtttgacgagtggtttggatccccgaactgccacttcggcccttacgataacaaggcacgcccaaatatcccggtgtaccgcgactgggagatggtcggacgttattatgaggagttccccataaatctaaagaccggcgaggcaaacctcactcagatttatttgcaggaagccctggacttcatcaagaggcaagcacgacaccaccccttcttcctgtactgggccgtggacgccacacacgccccggtctatgctagcaagccgttcctgggcaccagccagaggggtcgctacggtgatgcggtgcgcgaaatcgatgattccattggcaagatcctggagctgcttcaagacctgcacgtggccgataatacctttgtattcttcacaagtgataatggtgctgccttgatttccgcaccggagcagggtggctcgaatggaccgtttctgtgcggcaagcagaccacgttcgaagggggcatgagagagcctgcccttgcgtggtggcctggtcacgtgacggcgggccaggtaagccaccagctgggatcgattatggacctgttcacgacatctctggcgctcgccggcctgacccccccaagtgaccgagccatcgacggcctgaatttgttgccgacacttctgcaaggtaggctgatggatagaccaatattttactaccggggcgatacgcttatggccgccactctgggccagcataaggcccatttctggacatggacaaattcttgggagaacttccggcagggcatagatttttgccccggccaaaacgtttccggcgttactacacacaacctagaggaccatacaaagttgcccctcattttccatctgggccgcgaccccggtgaaagattccccctgagtttcgcgtctgccgaatatcaagaggcgctgtccaggattacgagtgtagtgcagcaacatcaggaagccttggtaccggcacaaccgcagctaaacgtgtgtaactgggcagttatgaattgggccccacccggttgtgagaagttgggcaaatgcctgacgccgcctgaaagcatacccaagaagtgcctgtggtcgcac

SEQ ID NO: 12021 - DNA, 1566 bp, Artificial Sequence
  Description of Artificial Sequence: Synthetic coding sequence
atggctgcggtggtggctgccactaggtggtggcagctcctattagtgctctctgccgctggcatgggggcttctggcgcaccacagccccccaatatcctgctgctactcatggatgatatggggtggggtgacctgggtgtgtacggcgagccttcaagagagacacccaacttggatcgcatggctgctgagggcttattgtttccaaatttttattcagcgaatccgctgtgttctccctctagagctgcattactgaccggcagattgcctataaggaacggcttttacactacgaacgctcacgccaggaatgcctatacaccacaggagattgtgggaggtatccccgattcagagcagctgctgcctgagctgctgaagaaggcgggttatgtctcaaaaatcgtcgggaaatggcatctcgggcaccggccacagtttcacccactgaagcacggcttcgatgagtggttcggcagccctaactgccacttcggcccttacgacaataaggcacgcccgaacatcccggtgtatcgggactgggagatggtgggccgttattatgaagagttccccattaacctgaaaaccggggaggccaatctgacccagatctaccttcaggaagccttggattttataaagaggcaggcccgacaccatccttttttcctgtactgggcagtggacgcaacacatgccccagtttacgcgtcaaagccctttttgggaacatctcaaaggggtaggtatggagatgccgtaagagagatagacgattcgattggcaaaattcttgaactccttcaggatctgcacgttgcggacaacacctttgtgtttttcacatccgataatggagctgccctaatcagcgcccctgagcagggaggaagcaatgggcccttcctgtgtggaaaacagacgaccttcgagggggggatgagagagccggcgctggcatggtggcccggccatgtgactgctggccaggtgtctcatcaactggggtcaataatggatctgttcacgacttctctggctctggccggattaaccccaccaagcgatagagcaatcgacggtttaaacttgctgccaacgctactacagggaagactcatggaccggccaattttttactaccgtggagacaccctgatggcagcaacactcggacagcacaaggcccacttttggacttggacaaatagctgggagaacttcaggcagggaatcgatttctgtcccggccagaacgtgagcggagtcacaacccacaatttggaagatcacacaaaactgcctctcatctttcacctagggcgcgacccgggagaaaggttccccttgagcttcgccagcgcggagtatcaggaagcactgtctcgcatcacctctgtggtgcaacagcatcaagaagcactcgtgcctgcgcaaccccaactgaacgtctgcaattgggctgtaatgaactgggcccctcctggatgcgagaaactcggcaagtgcttgacccctcctgagtcaatcccaaaaaagtgcttgtggtcacat

SEQ ID NO: 12022 - DNA, 1566 bp, Artificial Sequence
  Description of Artificial Sequence: Synthetic coding sequence
atggccgccgtagtcgccgcgacgcgctggtggcagcttctcttggttctttccgcggctggtatgggagcctcaggcgcccctcagcctcccaacattttgctgctgctgatggacgacatgggctggggagatctgggtgtatacggtgagccttctcgcgagacccccaatttggataggatggccgctgaaggtttgcttttccccaacttctattctgcaaacccgttgtgctcaccctcaagagccgctctgctgactggaaggctgccgattaggaatggcttctacaccacaaatgcccacgccagaaacgcctatacccctcaggagatagtaggtggaatcccagatagtgaacagctgctccccgagttgctgaaaaaagccggttatgtcagtaagattgtgggcaagtggcaccttggccacagaccgcagtttcatcctctgaaacatggcttcgacgagtggttcggcagtcccaattgccacttcggcccttacgacaacaaagcacgccctaatatcccagtataccgcgattgggagatggttggacgctattatgaagaattccctattaatcttaagacgggagaagccaatttgactcagatctacttgcaggaagctctggactttatcaaaagacaggctcgccaccaccctttcttcctgtattgggcagtagacgcaacccacgctccagtgtacgcttcaaagcctttcctgggtacttctcagcgcggtaggtacggagacgctgtgagagagatcgacgatagcatcggtaaaattctcgaactgctgcaggacctgcacgtggccgataatacttttgtttttttcacttcagataacggtgctgctctgatcagcgcgccagaacagggaggctcaaatggtcccttcctgtgtggaaaacagaccacttttgagggaggtatgcgcgaacccgctctggcatggtggcccggccatgtcactgccggacaggtatcccaccagctcggttctatcatggatttgttcaccacatcattggctctcgcgggattgactccccccagtgatcgcgcaatcgatggtcttaaccttttgccgacgctcctccagggtagacttatggacagacccatcttctactaccgcggtgacactcttatggcagcgaccctgggacagcacaaggctcacttttggacgtggactaactcttgggagaatttccgccaaggaattgacttctgcccgggccagaatgtaagcggcgtgacaacgcacaatttggaggatcacactaagcttcctctgatctttcatctgggaagggacccgggagagcgcttccccctctccttcgcctccgctgaatatcaggaagctctgtctagaattacgagcgttgtgcagcaacatcaggaggccctggtcccagctcagcctcagctgaacgtgtgtaactgggcggtcatgaattgggcgccgcccggctgtgaaaagttgggtaagtgtcttaccccaccggagtctatccctaagaagtgcctgtggagtcac

SEQ ID NO: 12023 - DNA, 1566 bp, Artificial Sequence
  Description of Artificial Sequence: Synthetic coding sequence
atggcagcggtggttgccgcaacccgttggtggcagctgcttctcgtgctgtccgccgcaggaatgggagcttcgggggcaccacagccaccaaacattctccttctcctcatggacgacatgggctggggggatctgggagtgtatggcgagccgtcaagggaaacccccaacctggataggatggcggccgaaggcctactctttcccaacttttattccgctaacccgctctgttcccccagcagggcagccctcctgaccgggcgcctccccattcgtaacggcttttacactacaaacgcccatgcgcgaaatgcgtatacgcctcaagagatagtgggcggcattcctgacagtgagcagctcctcccagagctcttaaaaaaagctgggtatgtgtccaagatagttggaaaatggcatttgggccacaggccccagtttcatccgctgaagcacggtttcgacgaatggttcgggtctccaaattgccatttcggcccatatgacaacaaggcccgccccaacatcccagtttacagagattgggaaatggtaggtagatattatgaggagtttcccattaatctgaaaactggggaggcaaatctgacacaaatatatctgcaggaagcattagatttcattaaacggcaagcccggcaccaccccttttttctttattgggcagtggatgcaacccatgcgcccgtgtatgcctccaaaccttttttggggacatcccagcggggacgatacggggatgcagtccgcgagattgatgattctatcggcaagattctcgagctcctgcaggatctccacgttgctgacaatacattcgtctttttcactagtgacaacggagccgccctgatctccgccccagaacaggggggcagcaatggacctttcctatgcggaaagcaaactaccttcgaaggcggtatgcgagagccagctctcgcctggtggcctggccatgtgacagcagggcaggtaagccaccagctcggctcaatcatggacctctttactacctccttggcccttgccgggctgactcccccctctgaccgagctatcgatggtcttaacttactgcctaccctattacagggtcggctcatggacaggcccatcttctattacagaggtgacactcttatggcagcaaccctcggccagcataaggcacatttttggacgtggactaattcctgggagaatttccgccaaggcatcgatttctgccccggacagaatgtgtcaggagtaacaacgcacaatttggaggaccacaccaaactacccctcatctttcacttgggtagagacccaggcgagcggtttccactttctttcgctagtgcggagtatcaggaggccctgtcaagaattacctcagtcgttcagcaacaccaagaggctctggtgcctgcccagccgcaactgaacgtatgtaactgggcagtgatgaactgggctcctcccgggtgtgaaaaactgggcaaatgtctgactccacccgaaagcatccctaaaaagtgcctgtggagccac

SEQ ID NO: 12024 - DNA, 1566 bp, Artificial Sequence
  Description of Artificial Sequence: Synthetic coding sequence
atggccgcggtggtggcagcaacgaggtggtggcaactcctgctggtactgtctgcagcgggaatgggggccagcggagctccccaaccccccaacatactccttctgctgatggacgacatggggtggggtgatttgggcgtgtatggtgagccgagccgcgagacaccgaacttggacaggatggccgccgaaggccttctgttccccaacttttatagtgcaaacccactttgtagcccgtcaagagccgctctcctcacaggccggcttcctatccgcaatgggttttatacaaccaatgctcacgctaggaatgcttacaccccgcaggaaatcgtggggggcattcccgacagtgagcagctgctgcctgaactgctgaaaaaggcaggctacgtgtctaagatagtgggaaagtggcatctcggacatagacctcagtttcatcccctgaagcacggctttgatgaatggtttggatcccccaattgtcatttcggcccctacgataacaaggctaggccaaatattccagtgtatagagactgggaaatggtgggccgctactatgaggagtttccaattaacttgaaaacgggtgaagctaacctgacccagatttacctgcaggaagcactcgatttcatcaagcggcaggcccggcatcacccattcttcttgtattgggcagtggatgctactcatgctcccgtgtatgcctcaaaaccttttctcggcactagtcagcgcgggagatacggtgacgccgttcgcgaaatcgatgatagcatcggaaagatcctggagcttttgcaagacctccacgtggcagataacacctttgtgttctttacttccgataacggtgccgcactgatctctgctcccgagcaagggggctccaatggtccattcttgtgtggcaaacagacgacattcgagggcggtatgagggaacctgctctggcgtggtggcctggtcacgtgactgccggacaggtatcccaccaactcggcagcataatggacttgtttacgaccagcctggcattggccggactgacccccccttctgaccgcgcaatagatggccttaacctcctgcctaccttgctccaggggcggctgatggaccggcccattttttattaccggggagacactctgatggcagcaacactcggacagcacaaggcccacttctggacctggacaaactcttgggagaacttcagacagggcatcgatttctgcccagggcaaaatgtgtccggcgtcacaacacacaacctggaggatcacactaaactgccactgatatttcatcttggaagagatccgggggagaggttccctttgtcatttgcttccgccgaataccaggaggccctctctagaatcacctccgtggtgcagcagcaccaggaagctttggtgccagctcagccgcaactgaacgtgtgcaactgggccgtgatgaattgggcccctccaggttgtgaaaagctgggaaaatgcctcacacccccagaaagcattccaaaaaagtgcctctggagccac

SEQ ID NO: 12025 - DNA, 1566 bp, Artificial Sequence
  Description of Artificial Sequence: Synthetic coding sequence
atggccgccgtagtggccgctacgcgctggtggcaattactcctcgtgcttagtgccgccggcatgggagcctcaggtgcgccacaaccaccaaatattttgctactgttaatggacgacatgggctggggcgacctcggggtgtatggtgaacccagtcgcgagactccgaacttggatcggatggcagcggaggggctcctgttcccaaacttttattctgccaacccactgtgtagtccgtctagggcggctcttctcacaggacgcctaccaattcggaacggattctacaccaccaacgcacatgcccgcaacgcatacactccacaagagatcgtgggaggtatccccgactctgagcagctcttgccggagttattgaaaaaggccggatatgtgtcaaagatcgttggcaaatggcatttgggacacaggccccaattccatccgttgaagcatggctttgacgagtggtttgggtccccaaactgtcatttcggtccttacgataataaggcccgccctaacatacccgtttacagggattgggagatggtaggcagatattatgaggagttccccataaacctcaaaacaggagaggctaaccttacacagatttacctgcaagaagccctggacttcatcaagcggcaagccaggcatcaccccttttttttgtactgggcggtcgacgccacgcatgcacccgtctatgcttccaagcctttcctgggaacctcccagcgcggacgctatggagacgcggtcagagaaatcgacgacagcattggaaaaatcttggagctgctccaagaccttcatgtcgccgataatacgttcgtatttttcacctccgacaatggcgccgcattgatcagcgctcctgagcaagggggtagtaacggtccttttctctgcggcaaacagacaactttcgagggaggcatgagagaaccagctctggcatggtggccaggccacgtgacagccggtcaggtgagtcaccagttgggcagcatcatggacctatttaccacctcacttgcacttgcgggcctgacccctccaagcgaccgggccatcgatggcctgaacctactgccaactctccttcagggcaggttgatggaccgaccaatcttttattacaggggcgatactcttatggccgccactctgggccaacataaggctcacttttggacctggactaatagctgggagaattttagacaaggaatcgacttctgccctgggcagaatgtctccggggttacaacacacaacctggaagatcacaccaagctgccattaattttccacctggggcgcgatcccggagagaggtttcccctctcattcgcatcagctgaataccaggaagcactgtcgaggatcacgagtgtggtacagcagcaccaggaggcactcgtgccggctcagccccagctgaatgtgtgtaactgggccgtgatgaattgggcgccacccggatgcgagaaactgggcaagtgcttgacaccccccgaaagcatccctaaaaaatgcctgtggtcccac

SEQ ID NO: 12026 - DNA, 1566 bp, Artificial Sequence
  Description of Artificial Sequence: Synthetic coding sequence
atggcagccgtggtggccgctactcgctggtggcagcttttgctcgtgttgtctgctgctgggatgggagcaagcggtgcaccacagcctcccaacatcctgctccttctcatggacgatatgggatggggtgaccttggtgtatacggtgagcccagccgagaaaccccaaatctggatagaatggcggctgaaggactactgtttccaaacttttacagtgccaaccccttatgctctccaagtcgcgccgcattgctcacaggtcgtctcccgattcgcaacggtttctacacaactaatgcacatgcaagaaatgcatacacacctcaggaaatcgtgggcgggatccccgacagcgagcagcttctgcctgagctgctgaaaaaggcgggctatgtgtctaaaattgtcggcaaatggcacttgggccatagaccacaattccaccctctgaagcatggcttcgatgagtggttcggctcaccaaattgccactttggaccatacgataataaggccagacccaatatccccgtctaccgcgactgggaaatggttggccgctactacgaggaatttcccatcaatctgaaaacaggcgaagcaaacctgacccagatatatttgcaggaggctttggattttatcaagcggcaggcaaggcatcaccctttcttcttgtactgggccgtagacgccacacacgctcctgtatacgcttcaaaacctttcttggggacgagccagcgggggcggtatggggatgccgtccgcgagatagacgattccattggcaagattttggaacttctgcaggacctccatgttgcagataatacttttgtgtttttcacttccgataacggtgctgcattgatttccgcgccagaacagggcggatctaacggcccatttctttgcgggaagcagacaacattcgaaggcgggatgcgggagcctgccctagcctggtggcccggccacgtgaccgcgggtcaagtttctcatcagctgggttcgataatggacctgtttacaacgagtctggccctcgccgggcttaccccaccgtccgatcgagccatagatggtcttaatctcttgcctaccctcctgcagggtcggctgatggatagaccgatattttattaccgcggggacaccttaatggccgcgaccctcggacagcataaggcccacttctggacttggacgaattcctgggagaactttagacagggtattgacttctgccccggacagaacgtgagtggtgtgaccacccacaatctggaagatcacactaagctcccacttatatttcacttgggccgggatcccggagagcgctttcctctgtcatttgcttctgcggagtaccaggaagccctctccagaattacgtccgtggttcagcagcaccaggaagcgctggtccccgcacaaccacaacttaacgtatgcaactgggccgtgatgaactgggcgcccccaggctgtgaaaagcttggcaagtgtttgacaccacctgagagtatcccgaaaaaatgcctctggagccat

SEQ ID NO: 12027 - DNA, 1566 bp, Artificial Sequence
  Description of Artificial Sequence: Synthetic coding sequence
atggccgccgtggtggcggccactcggtggtggcagctgctgctcgtactgagcgcagccggaatgggagcgtcgggcgctccgcagccacccaacatcttgctgttgctgatggatgacatgggatggggcgatctcggggtgtacggagaaccatcccgggaaaccccgaacctggaccgtatggcagccgagggcttgctgtttccgaacttttattcagccaacccactgtgttctccttcccgcgccgccctgctcaccggtcggcttccaatccgcaacggattctacaccaccaacgcccatgctcgcaacgcatacaccccacaggagatcgttggaggtattccggacagcgaacaattgctgccggagctcctgaagaaggcaggctacgtctcgaagatagtgggaaaatggcaccttgggcaccgcccccagtttcacccccttaaacatggcttcgacgagtggtttggcagccctaactgccacttcgggccgtacgacaacaaggcgaggccaaatatcccggtttacagggactgggaaatggtcggacggtactacgaagaattcccaatcaaccttaagacgggggaagcgaacctgacccagatctacctccaagaggccctggacttcatcaaacggcaggcacgccatcacccattcttcctgtactgggccgttgacgcgactcacgcgccagtctacgcctccaagcccttcctgggcacgtcgcaacggggccgctacggggatgccgttagagagatcgacgacagcatcgggaagatcctggagctcctgcaggacctccacgtggccgataatacgttcgtgttcttcacttcagacaatggagcggctctgatctccgccccggaacaaggtggatcgaacggaccattcctgtgcggaaagcaaactacttttgaaggaggaatgcgagagcctgccctcgcttggtggccgggtcatgtgactgcaggacaggtcagccatcaattgggtagcatcatggatctgttcacgacctcgcttgccctggcggggctgaccccgccctcggaccgtgccatcgatgggctcaacctgcttccaactttgctccagggccggctgatggataggcctatattctactatcgcggcgacaccctgatggcggccaccctgggacaacataaggcacacttttggacttggaccaattcttgggagaatttcagacagggaattgatttctgcccgggccagaatgtctcgggagtcactactcataatctcgaggatcacaccaaactgccactgatttttcacttgggccgggaccctggcgaacggttcccgctttcgtttgcatcagccgaataccaggaagccctcagtaggatcacctctgtggtgcagcaacatcaagaggcgttggtcccggcacagccacagctgaatgtctgcaattgggctgtcatgaactgggcgccgccgggatgtgaaaagctcggaaaatgccttacccctccagagtccatcccgaagaagtgcctgtggagccac

SEQ ID NO: 12028 - DNA, 1566 bp, Artificial Sequence
  Description of Artificial Sequence: Synthetic coding sequence
atggctgccgtggtggcagccacccggtggtggcagctcctgctggtgctgagcgcagcgggtatgggggcgtcaggcgccccgcaaccgccgaatatactcctgttgctcatggatgacatgggttggggagatctcggtgtatacggcgaacctagcagggaaaccccaaacctggatagaatggccgccgaaggtctgctcttcccgaacttctattcggctaacccactgtgtagcccgtccagggccgcgctgctgacgggacgtctccccatccgcaacggattctacaccactaacgcacacgctaggaatgcttacactccccaagagatcgtcggtggcatcccagactcggagcagttgctgcccgagctgctgaagaaagcagggtacgtgagcaagatcgtgggcaagtggcatctcggccaccgccctcagtttcatccgttgaaacacggattcgacgagtggtttgggtcaccaaattgtcactttggtccttacgacaataaagctagaccgaacatcccggtgtacagagactgggagatggtcgggcggtactatgaggaattcccgattaacctgaaaacgggcgaggcgaatctgacccaaatctacctgcaggaagcactggacttcattaagcgccaggcccgccatcacccctttttcctgtactgggcggtcgacgctactcacgcgccagtgtacgcttccaagccattcctgggaacctcgcaacgcggacgatacggagatgctgttcgcgaaatcgacgatagcatcgggaagatactggagctgctgcaagatctccatgtggcagataacaccttcgtgttcttcaccagcgacaacggagcagccctcatctccgcgccggaacagggaggaagcaacggacctttcctttgcgggaagcagactacttttgaaggggggatgcgggaacctgccctcgcgtggtggcccggccacgtgaccgccggacaagtgtcgcaccagcttggatctatcatggacttgttcactaccagcctggcgctggccggacttactccaccctctgaccgcgccatcgatggtcttaacctgcttccgaccttgcttcaaggtcggctgatggatcggcccattttctattacaggggagacaccctcatggctgctacgctgggccaacataaagctcatttctggacctggacgaactcgtgggagaacttccgccagggaatcgacttctgccctggccagaatgtgtcaggtgtaaccactcacaacttggaagatcatactaagctgccgctgatctttcacttgggaagagatccgggagaaagatttcctctgtccttcgcctccgcggagtaccaggaggcactgtcaaggatcacctccgtggtgcagcagcatcaggaagccctggtcccggcccagccgcagcttaacgtgtgcaattgggccgtgatgaattgggcacctcccggatgcgaaaaacttggcaagtgtctcactccacctgaaagcatcccaaaaaagtgcctgtggtcccac

SEQ ID NO: 12029 - DNA, 1566 bp, Artificial Sequence
  Description of Artificial Sequence: Synthetic coding sequence
atggccgccgtcgtcgcagctacacggtggtggcaactcctactggtactttccgctgctgggatgggcgcctctggcgccccacagccaccaaacatcctcctccttctgatggacgacatgggctggggcgatctcggcgtctacggagaaccctctagagagaccccaaatctcgaccgcatggctgcagagggcttgctgtttccaaacttctactcagctaatccactctgttcaccatctagggcggctctcctcactggcaggcttcctatcagaaatggcttctacacaactaacgcacacgcgagaaacgcttacacaccacaggagattgtcggaggaattcccgactccgaacaactgctgcctgagttgctgaaaaaagccggctatgtcagcaagatcgtcgggaagtggcacttgggacaccgcccacaattccaccctctcaagcatggattcgacgagtggttcgggagccctaactgccactttggcccctacgataacaaggcaaggccaaatataccagtctacagagactgggagatggttggcaggtactacgaggagtttccaatcaacttgaaaacaggagaagccaacctgacccagatatacctccaggaagctctggatttcattaagaggcaggctaggcaccatccatttttcctttattgggctgtcgatgcaacccacgctccagtgtacgctagtaaaccctttctgggaacgagccagaggggtcggtatggcgatgctgtgagggagatcgacgactccattggcaagatattagagctgcttcaagacctgcacgtcgcagacaacacattcgtgttttttacaagcgataacggcgccgctcttatatcggctcccgaacagggcgggtcaaacggaccattcttgtgtggcaagcagactacgttcgaggggggaatgagggagcctgcactggcatggtggcctggccatgttactgcaggccaagtttcccatcagctggggtctatcatggatttgtttacaacgagtcttgcactcgcaggcctgactcctccctctgaccgagctatcgacggcctgaacctcctcccaacactgctgcaaggacgcctcatggatcgccctatcttctactatagaggggacacacttatggccgccaccctggggcagcacaaggcacacttttggacatggactaattcgtgggagaacttccgccagggtatcgacttctgccctggccaaaacgtcagcggtgtcactacacacaacttagaagatcataccaagctgcctctcatctttcatctcggacgcgatcccggagaaagatttccattgagcttcgcatctgctgaataccaagaggcattgagccgtataactagcgtggttcagcagcaccaggaggcgctggtccccgctcaacctcaactcaacgtttgcaattgggcagtaatgaactgggctccacccggatgtgagaagctgggaaagtgcctgacccctcctgagagcatccctaaaaaatgcttgtggtcgcac

SEQ ID NO: 12030 - DNA, 1566 bp, Artificial Sequence
  Description of Artificial Sequence: Synthetic coding sequence
atggccgccgtcgtggctgccacaaggtggtggcagctactccttgtgctatctgcagcagggatgggcgctagtggagctccacagcctcctaatattctgctcttgctgatggatgacatgggatggggcgatcttggtgtttatggcgaaccttcccgggaaactcctaacctcgatcgcatggctgccgagggcctcctgtttcccaacttttattcggccaatcccctctgcagtccctcccgcgccgcactcttgaccggcagacttccaatccgcaatggtttttataccaccaatgctcatgcgcggaatgcatatacaccccaggagattgtgggaggcattccggatagcgaacagttgctccctgagttactaaaaaaggctggctatgtgtcaaaaattgtagggaaatggcacctcggtcaccggccgcagttccatccacttaaacacggcttcgacgagtggtttggctctcccaactgtcatttcgggccctacgacaacaaagcccgcccaaacattccagtgtacagggactgggaaatggtgggaagatactatgaggagtttcccatcaatctaaaaaccggcgaggccaacctcacacagatctatctgcaagaggcattggattttataaaaagacaggctcgccaccatccatttttcctgtattgggcggtggatgccacgcacgcacctgtctacgcctctaaacctttcctgggcacatcgcagagagggaggtacggagacgccgttcgcgagatcgatgacagcattggtaagatactcgagttgctccaggacctgcatgtggcagacaatactttcgtgttttttacatccgacaatggcgcagccttgatcagtgctcctgagcagggggggtcaaacggcccattcctatgcgggaaacaaaccaccttcgaaggcggcatgcgcgaacctgccttggcctggtggccgggtcacgtcaccgcgggtcaggtatcccatcagctggggtcaatcatggacctttttacgacctccctggcactggccgggctgacgccaccgtccgaccgggccattgacggactcaacctgctgcccactcttcttcagggacgcctgatggatcggccgatcttttactacagaggggacacgctcatggccgctacacttggacagcacaaggcgcatttttggacctggacaaactcctgggagaatttcagacaaggcattgacttctgtcccggccagaatgtatccggggtgactacacacaatctggaggaccatacaaagctgccactgatttttcacctcggtagagatccaggagagcggttccccctgagcttcgccagtgcggagtatcaggaggccctgtctcgaatcacttcagttgtacagcagcaccaggaggctttagtgcccgcgcagccgcaattgaacgtgtgtaactgggccgttatgaactgggcccctcccggatgcgaaaaactcggtaagtgcctgacccctccagaaagcataccgaagaaatgcctgtggagccac

SEQ ID NO: 12031 - DNA, 1566 bp, Artificial Sequence
  Description of Artificial Sequence: Synthetic coding sequence
atggcagccgtggtcgccgcgaccaggtggtggcaacttctgctggttctgtccgcggcgggcatgggtgcgtccggcgccccacagcctccgaacatcttgctcctgctgatggatgatatgggttggggggacctcggcgtatatggagaaccctccagggaaactccaaacctggacaggatggccgcggagggcctcctcttccccaacttctattcagcgaatcccctgtgctctccttctagggcagctttgctcaccggtcggctgcctatacgaaatggcttctatacaacaaacgcgcatgctaggaatgcctacaccccacaggagatagtcggcggcatacctgattcagagcagctgctgcccgagctcctgaaaaaagcaggatacgtctccaagatcgtgggaaaatggcatctcgggcaccggcctcagtttcatcctctcaagcacggattcgacgagtggttcgggagtcccaattgtcacttcggtccgtacgataacaaggctagaccgaatattccagtttacagagactgggagatggttggaagatactacgaggagttccctattaacctgaaaacaggagaagccaatctcacccagatctaccttcaggaggccctggacttcattaagcggcaagccaggcatcacccgtttttcctgtactgggctgtcgacgccacccacgctcccgtttacgcctccaaaccattcctgggaacgtcccagagaggcaggtacggcgacgccgtccgggagattgatgacagtataggcaagatcctggagctgctccaagacttgcacgtagctgataacacgttcgtgttttttaccagtgacaacggcgccgctctgatctccgcgccagagcagggaggaagcaatgggccgtttctctgcggcaaacaaacaacattcgaaggaggtatgcgcgagcctgccctggcttggtggcccggccatgtgactgcgggtcaagtaagccatcaacttggctccataatggatcttttcaccacttccctggctctggctggccttacacctccctccgatagagctatcgacggcctgaacctcctcccgactcttttgcagggccgcctgatggacagacctatattctactatcgaggagacacactcatggccgccacacttggtcagcataaggcccacttttggacctggacaaactcttgggagaattttagacagggtatcgacttttgtcccggacagaatgtttctggggtcaccacccataacctggaagaccacacaaagctgccgctgatattccaccttggcagggatccaggtgaaagattccccctcagttttgcaagtgcagaatatcaggaggctctttctaggatcacctctgtggtgcagcagcaccaggaggccctcgtccctgcacagccccaactgaatgtctgtaattgggccgtgatgaattgggcacctccaggctgtgagaaactggggaaatgccttactccacccgagtctatacctaagaaatgcctttggagccat

SEQ ID NO: 12032 - DNA, 1566 bp, Artificial Sequence
  Description of Artificial Sequence: Synthetic coding sequence
atggctgctgtggtcgccgccacacggtggtggcagttgctgctcgtactctccgctgctggcatgggagcctctggcgccccacaaccccctaatattctcctcctcttaatggacgacatgggctggggagacttaggcgtttatggagaaccaagcagggagactcccaacctggaccgtatggcagccgagggattgctttttccaaacttctatagcgcaaaccccctctgctccccatcccgggctgctctcttaactggtcgccttcccataagaaatggcttttatactaccaatgctcacgcgcgcaacgcctatacaccccaagaaatcgtgggtggcatcccagattcggagcagcttcttccagaactcctgaagaaggcagggtatgtctcaaagatcgtgggtaagtggcatctgggccataggccacagtttcatccactgaagcatggattcgatgaatggttcggcagccccaattgtcactttggtccatatgataataaagcccgccccaatataccagtctatcgtgactgggagatggtcggaaggtactacgaggaatttcctataaatctcaagactggcgaagccaatttgactcagatatacctgcaagaagccttagatttcatcaagaggcaggcgagacaccaccccttcttcctgtactgggcggtcgatgctacccatgcacctgtttacgcctcaaagcccttcctgggaacctcacagcgcggcaggtacggggacgcggttcgagaaatcgatgattcaattgggaagatcctcgaactcctccaagacctccatgttgccgacaatacattcgtctttttcacaagtgacaatggagccgctttaattagtgcccccgaacagggggggtccaacggaccattcctgtgcggaaagcagaccacattcgaaggtggaatgcgcgagcccgccttggcctggtggcccggccacgttaccgcaggccaggtgagccaccagttggggtccataatggatttattcactacatctcttgcgctggccggcctaactcctccgagtgacagagccatcgatggtctgaatctactccccacactcctgcaaggccgcctgatggacaggcccattttctattaccgcggggacacattgatggctgccaccctgggccagcataaggcccatttctggacatggaccaactcgtgggagaactttcggcaggggattgatttttgcccgggtcagaatgtcagtggcgtgacgactcacaatctggaggatcacacaaaattgccattgatttttcatctgggccgggatcccggcgaacgatttccactctctttcgcaagcgctgagtatcaggaggcactgagtcggatcacctcggtggtgcaacagcatcaagaagcactagtgcccgcacagccccaattgaatgtgtgtaactgggctgtgatgaactgggctcccccgggctgtgagaagctgggaaagtgtctaacccctccagagtcgattcccaagaagtgtctttggagccac

SEQ ID NO: 12033 - DNA, 1566 bp, Artificial Sequence
  Description of Artificial Sequence: Synthetic coding sequence
atggcagcagtggttgcagctactcgctggtggcaactgcttcttgttttgtctgcggccggaatgggagcaagcggagccccacagccgccgaatattttgctgttgctaatggatgacatgggctggggtgaccttggagtctacggtgaaccatctagagagactcctaacctggatagaatggcggccgaaggattacttttcccaaacttctatagcgcgaatcccctgtgctctcctagcagggctgctttactgacaggccgcctgcccatccgtaacgggttctataccactaacgcgcatgcgcgaaacgcatataccccccaggaaatcgtgggcggaatccctgactctgagcaactgctgcccgagctgctgaagaaggccgggtacgttagtaagatagtgggaaaatggcatttgggacacaggccgcagtttcaccctctgaaacacgggtttgatgaatggtttgggtcccctaactgtcatttcgggccgtacgacaacaaggcccgccccaacatccctgtctacagagactgggagatggtcggcagatactacgaagaattcccaatcaatctgaaaactggagaagctaacctgacccaaatttacctccaggaggccttggattttattaaaaggcaagccaggcaccaccccttcttcttgtactgggctgtcgacgctactcatgctcccgtttacgccagcaaaccattcctcggaacaagccagcgcgggcggtacggtgacgccgtgagggaaatcgatgatagcatcggaaagattttggagctccttcaggatcttcacgttgcggacaatactttcgtcttctttacctctgataatggagccgcacttataagcgcccccgagcagggaggttcaaacggaccttttttatgcggcaagcagacaacattcgagggcggcatgagggaacctgccctggcctggtggccaggacacgtcactgctggccaagtgtcacatcagctggggagcatcatggacctctttaccactagtctggcactcgcagggttgacccccccaagcgaccgcgcaatcgatggccttaatctgctgccaacactgttgcaggggaggttgatggatcgcccaatcttttactacagaggtgatacattgatggccgctacgctgggccaacacaaagcccacttttggacctggacaaactcatgggagaattttaggcaaggaattgacttttgcccgggacaaaacgtcagcggtgtgaccacccataatctcgaggaccacaccaaacttcctctgatctttcatcttggacgcgaccctggcgagcggttcccactgagttttgcatctgccgagtatcaagaggcactgagtcgcataacgagtgtggtgcagcaacatcaagaggctctggtaccagcccaacctcagcttaacgtgtgcaattgggcagtgatgaactgggccccacctggctgtgagaaacttggtaaatgcctgacaccccctgaaagcatccctaagaaatgcctgtggtctcac

SEQ ID NO: 12034 - DNA, 1566 bp, Artificial Sequence
  Description of Artificial Sequence: Synthetic coding sequence
atggccgcagtcgtggcagcaacccgatggtggcaactccttttggttctgtccgcagcagggatgggagcgtctggagccccgcagcctcccaatatcctgctcctgttgatggatgacatgggttggggggatctgggggtgtacggagagccgtcgagagaaacgcctaaccttgaccgcatggcggccgaaggactcctttttcctaatttctactccgctaacccgctgtgttcgccttcccgggcggccctgcttactggtaggcttccaattcgtaacgggttctacaccactaacgctcacgcaaggaatgcatacacgccacaagaaattgtgggcggtatacctgatagcgaacagctgttgcctgaactgctcaagaaggcaggatacgttagcaagattgtgggaaagtggcatctgggtcacagaccacaatttcatcccctgaaacacgggttcgacgaatggtttggctcaccaaattgccactttggcccgtacgataacaaggccagacctaatatcccagtgtacagagactgggaaatggtgggacgctactacgaggaatttcctatcaatcttaagaccggggaagctaatcttacgcaaatctaccttcaagaagccctggatttcatcaaacgccaagcacggcaccacccattctttctctattgggccgtggacgcaacccatgcacctgtctacgcctcaaaaccattccttggcaccagccagagaggtcgctacggtgacgcagtgcgtgaaattgacgattccataggaaagattctggagctgctgcaggatctccatgtcgctgataatacttttgtgttctttacttccgataacggcgccgctctgatttccgctcctgagcaggggggcagcaacgggcctttcctgtgtggaaagcaaactacctttgaaggaggtatgcgcgaacccgcactggcatggtggcccggacacgtgactgcgggtcaagtgtcacaccaacttgggtcaattatggatctctttacgacgtcgttggcactggcaggccttaccccaccgtctgatcgcgcaatagatgggcttaaccttcttcctactcttctgcaaggtagacttatggatagacccatcttttactataggggagatacgctcatggcagcaactcttggtcagcataaggcgcatttttggacctggactaacagctgggaaaacttcaggcagggcattgacttttgcccaggtcagaacgtctcgggagtgaccacccataaccttgaggatcataccaaacttccactcattttccatttggggcgggaccctggcgaacgtttcccattgtccttcgcatcggctgaataccaagaggccttgagcaggataacttccgtggtgcaacaacatcaggaggcacttgtcccggctcagccacagctcaatgtctgtaattgggcagttatgaattgggcaccaccaggttgtgagaagctgggcaagtgtcttaccccgccagagtcgatccctaagaagtgtctgtggtcccac

SEQ ID NO: 12035 - DNA, 1566 bp, Artificial Sequence
  Description of Artificial Sequence: Synthetic coding sequence
atggcagccgtggtggcagctacgcgctggtggcagctgcttctggtgctgagcgccgccggcatgggagcatctggggcgccccagcccccgaatatcctgctgctgctgatggatgacatggggtggggcgacctgggggtatatggcgagcccagccgtgagacgcccaacttggatcgcatggccgccgaagggcttctgttcccgaatttctattctgcaaatccactttgctcaccgagccgggcagctttactgacagggcgtctgccgatcaggaatgggttctatactacaaatgcccacgccaggaatgcatatactccacaagagatcgtgggtggcatccctgatagcgagcagctcctgcccgagctgttgaagaaggccggatacgtttccaagattgttggcaaatggcatctgggccaccggccacagtttcatccgctgaaacacgggttcgacgaatggtttggaagtcccaattgccacttcggcccatatgataataaggcccggccaaacatccccgtgtatcgagattgggagatggtgggtaggtattacgaggagttccctattaatcttaaaaccggggaggccaacctgacccagatctacctgcaggaagcactcgattttattaagaggcaggctaggcaccaccctttcttcctctattgggcagtcgacgcaacccatgctccggtgtatgcctcaaaaccattcctgggtacaagccagagaggaaggtatggggacgcggtcagagagattgatgattctataggaaaaatcctggagttgcttcaggacctgcatgtggcagataacacgtttgtgttctttaccagcgataacggagcggccttgatcagcgcgcctgaacaggggggtagtaatgggcctttcctgtgcggcaaacagacgaccttcgagggaggcatgagggaaccagcactggcctggtggccaggacatgtcaccgccgggcaggtttcccaccagcttggaagcattatggatctattcactaccagcttggccttggccggcctgacaccccccagcgatagggccattgacggactcaatctgctccccacacttctgcagggaagattgatggaccgtcccatattctactaccgaggagacactttgatggctgccaccctgggccagcataaggctcacttctggacgtggaccaattcatgggagaactttaggcagggtattgacttctgtccaggtcagaacgttagcggtgtcactacccataacctggaagaccacactaaactccctctgatttttcacttggggcgcgatcccggagagcgcttcccgctttcgttcgcttcggctgaataccaggaggccttaagccggatcaccagtgttgtccagcagcaccaggaggccttggttcctgcccagccccaattgaacgtctgtaactgggccgtgatgaactgggcgccgccagggtgcgagaagctaggcaaatgtctgaccccccctgagtctataccgaaaaagtgcctatggagccat

SEQ ID NO: 12036 - DNA, 1566 bp, Artificial Sequence
  Description of Artificial Sequence: Synthetic coding sequence
atggcagcagtcgtggccgccacccgctggtggcagctcctcctcgtgctttctgcggcgggaatgggcgcgtccggagccccccaacccccaaacattctcctgcttctgatggatgatatgggttggggcgacctgggcgtctacggtgaaccatccagagaaaccccaaacctggatcggatggcggcagagggactcttgtttcctaacttttactccgcaaatcctctgtgctccccctcacgggcagccctgctgaccgggagacttcccatacgtaacggcttttacactactaacgcacatgcacgaaacgcttacaccccccaagaaattgttggtggtataccggattccgaacaacttcttccagaactgctcaagaaagccggatacgtcagcaagattgtcgggaagtggcatctggggcatcgaccacaatttcatcctctcaagcacggattcgatgaatggtttggatcgccaaattgtcattttgggccctacgacaataaggcgaggccaaacattccagtgtacagagactgggagatggtcggaagatactacgaggagttccctatcaaccttaagaccggtgaagcaaacctcacgcagatctacctccaagaggcactcgatttcattaagcgtcaagccagacatcatccattctttctctactgggcagtggacgcaacccacgcaccagtgtacgcatcgaaacctttccttggcacttcacaaagaggacgctacggagatgccgtgcgagagatagatgactcaattggaaagattctggagcttcttcaagacctccacgtcgccgataacaccttcgtgttcttcacgtcggataacggggcggcacttataagcgcacccgaacaaggtggtagcaacggtccctttttgtgcggaaaacagactacctttgaaggggggatgagggaaccagcacttgcatggtggccaggccatgtcacggcaggccaggtgagccatcaactgggttccattatggatctctttactacgtcgctggcactggcaggtcttaccccgccttctgaccgagccatcgacggactgaaccttctcccaaccctgctgcagggaaggctgatggatagacctatcttttactaccgtggagacaccttgatggcagctacgctgggacaacataaggcacacttttggacctggacgaacagctgggaaaacttccgccagggaattgatttttgtcccggacagaatgtgagcggagtcaccacccataacctggaagatcatacgaagttgccattgatcttccatctcggacgcgatcccggggaaagatttcctcttagctttgcgagcgcagaataccaggaagcgctctcgagaatcacctcggtggtgcagcaacatcaagaggctctggtcccagcacagccgcagctgaatgtctgtaattgggcagtcatgaattgggcaccgccaggctgcgagaagctgggaaagtgcctgactcctcccgagtccataccaaagaagtgcctttggtcgcac

SEQ ID NO: 12037 - DNA, 1566 bp, Artificial Sequence
  Description of Artificial Sequence: Synthetic coding sequence
atggcggcggtcgtcgcagccactcgctggtggcagctccttctcgtcttgtccgccgcaggaatgggagcgtcgggagccccgcaacccccgaacatccttctccttctgatggatgatatgggatggggggacctcggagtgtacggggaaccatcaagggaaacccccaacctcgatcgcatggccgccgaaggactgctgttcccgaatttctacagcgcgaacccgctctgctccccctcccgcgcagccctgctgactggacgcctgccaatccggaatggattctacaccactaacgcgcatgctcgaaatgcatacaccccacaggaaatcgtgggaggaatcccagattcagagcaacttctgccagaacttctcaagaaagccggatacgtgtcaaagatcgtggggaagtggcatctgggtcaccggccgcagttccacccgctcaagcacggattcgatgagtggttcggaagcccaaattgccactttggaccgtacgataacaaggcgcgcccgaacatcccggtctatcgggactgggagatggtcggacgctactacgaggagttcccgattaatcttaagactggggaagccaacctcactcagatctatctgcaagaagcgctggatttcataaagagacaagctcgccaccacccgttcttcctttattgggcggtggacgccactcacgcaccagtctacgcctctaagccattcctgggaacttctcagcgaggacggtacggcgacgctgtgagggaaatcgacgactcaatcggaaaaatcctggagctgttgcaagacctgcacgtggccgataatactttcgtgttctttacctccgataatggagctgcattgatctcggctccggaacaaggaggatcgaatggaccgtttctgtgtggtaagcagactacttttgaaggcggaatgcgcgagcctgccctggcgtggtggcccggccacgtcactgccggacaagtctcccatcaactgggcagcatcatggacttgttcactactagcctcgctctggcgggcctgacccctccatcagacagagccatcgatgggctcaacctcctgcccaccctcctccagggacgactgatggaccggcctattttctactaccgcggagacacccttatggccgccaccctgggacagcacaaggcccatttttggacctggaccaattcctgggagaatttccggcagggcattgacttttgcccaggacagaacgtctccggagtgacgactcataatctggaggatcacactaaactcccactgatcttccatctcggccgggaccccggcgagcggttcccgctgagctttgcctccgctgaataccaggaggccctgagccgcatcaccagcgtggtccaacaacaccaggaagccctggtgccagcgcaaccccagctgaacgtgtgcaactgggcagtcatgaactgggctccgcccggatgcgagaagctgggcaagtgcctgactccgcctgaatcgatcccaaaaaagtgtctgtggagccat

SEQ ID NO: 12038 - DNA, 1566 bp, Artificial Sequence
  Description of Artificial Sequence: Synthetic coding sequence
atggccgccgtcgtcgctgccacccgctggtggcagctcttgcttgtcctgtcggcggcagggatgggtgcgtccggcgccccgcagcctccgaacatcctcctgcttctgatggatgatatgggctggggtgatctgggagtctacggggagccgtcacgcgaaactcccaacctggacagaatggccgcggaagggctgctgttcccgaacttctacagcgccaatcccctctgctccccttcgcgcgcagccctcctgaccggacgcctccctatcagaaacggattctacactactaacgcacatgcaagaaacgcttatactccgcaggaaatcgtgggaggcatccctgacagcgagcagcttctcccggaacttctgaagaaagcgggctacgttagcaaaattgtgggtaagtggcacctgggtcataggccacagtttcacccgctgaagcatggatttgacgagtggttcgggagcccaaattgtcatttcggcccgtacgacaacaaggcccgccccaatattccagtgtaccgcgactgggaaatggtgggacggtattacgaagaattcccaattaatctcaagaccggagaagccaatctgacccaaatctacttgcaagaagctctggacttcatcaagcggcaggcgcgccaccaccccttcttcctctactgggcggttgacgccacccatgcgccggtgtacgcttctaagccgttcctgggcacctcacagcggggccgatacggcgacgcggtgcgggagatcgacgactcaatagggaaaattctggagctgctccaagacctgcatgtcgccgacaacacctttgtgttcttcacttcagataacggagcggccctcatctcggcccctgaacaaggaggatccaacggtcctttcctctgcgggaaacaaacgacctttgaaggcggaatgagggagccagcgttggcatggtggccgggacacgtgactgcaggacaagtgtcgcaccagctgggaagtatcatggatctgtttactacttcgctggctctggcaggactgacgcccccgagcgatagagcaatcgacggacttaacctgctgccgactctcttgcagggaagattgatggataggccgatcttttactaccggggagataccctgatggccgccaccttgggccagcacaaggctcacttctggacctggactaattcgtgggagaattttcggcaaggaatcgatttctgcccaggtcaaaacgtgagcggcgtgactacccacaaccttgaggatcacaccaagctgccactcatcttccatctcggacgtgacccgggagaacgcttcccactgtccttcgcttccgccgagtaccaggaagcgctctcgcggatcacctccgtcgtgcagcagcaccaagaggcactggtcccagcccagccccagctgaatgtgtgcaactgggctgtgatgaattgggcccctcctggatgcgaaaagctcgggaagtgtctcacgccgccagagtccatcccgaagaaatgcctgtggtcacat

SEQ ID NO: 12039 - DNA, 1566 bp, Artificial Sequence
  Description of Artificial Sequence: Synthetic coding sequence
atggcagccgtggtggccgctacccgctggtggcaactgctccttgtgctctccgctgcgggaatgggagcgtcaggagctccgcagcctcccaacatcctgctgttgctgatggacgatatgggatggggcgatctgggcgtgtacggtgagccgtcgcgcgaaacgccaaacctggacaggatggccgccgaaggcctgctgtttcctaatttctactccgccaacccgctgtgcagcccctcgcgggccgcacttctgaccggacgcctgccgatcagaaacgggttctacactaccaatgcacacgcccggaatgcttatacgccacaagagatagtgggaggaatcccggactccgaacaactgttgccggaactgctcaagaaggcgggatacgtgtcgaagatcgtgggcaaatggcatttgggacataggccgcaatttcaccccctgaagcacgggttcgatgagtggttcggatcaccgaactgccatttcggaccctacgacaacaaggctcgccccaacatcccggtctaccgggactgggagatggttggacgctactacgaggaattcccgatcaacctgaaaaccggcgaagccaatctcactcagatttacctgcaagaagcgctggacttcataaaacgccaggcacggcaccatcccttcttcctttactgggctgtggacgctacccacgctcccgtgtacgccagcaagccattcctggggacctcccaacggggaaggtacggagatgccgtccgcgaaatcgacgattcgattggaaagatcctggagcttcttcaggacctgcatgtggcggataacacttttgtgttctttacttctgacaacggagccgccctcatctctgcccccgaacagggaggatcaaacggaccgttcttgtgcggcaagcagactactttcgagggaggcatgcgggaacccgccttggcatggtggccggggcatgtcacggcgggacaagtgtcgcaccagctcggctcaattatggacctttttactacttccctcgccctggcaggcctgaccccaccctccgatagagccattgatggcctgaatctcctcccgactctgctgcaggggcggctgatggacagacccatcttttactaccgcggggataccctgatggcggcaactcttggccagcataaagcgcatttctggacgtggaccaactcgtgggagaacttccggcagggaatcgacttctgtccgggccagaacgtgagcggagttactacccacaatctggaggaccacacgaaactgccactgatcttccacctgggaagggatccgggggagcggtttccactctcattcgccagcgccgagtaccaggaagctctgagtcgcatcacctccgtggtgcagcagcaccaggaggctcttgtgccagcccagcctcagctgaatgtctgtaactgggcagtcatgaactgggcgccgccagggtgtgagaagctcggaaaatgtctcacgccgccggaatcgatcccaaaaaagtgcctctggtcgcac

SEQ ID NO: 12040 - DNA, 1566 bp, Artificial Sequence
  Description of Artificial Sequence: Synthetic coding sequence
atggcggcggttgtggccgccacacgttggtggcagctactcctggtgctcagcgccgcagggatgggagcatctggggcaccccagccgcccaacatcctcttgctgttgatggatgatatgggttggggagacctgggcgtgtatggcgagccaagtcgggagactccaaatctcgatcgcatggctgcggaaggactgctgttccccaatttttatagtgctaacccattgtgcagcccatctcgggcagcactccttacaggacgtttacccattagaaatgggttctacactaccaatgcccacgcccggaacgcctacacaccacaagaaatcgtcggcgggattcctgatagtgaacagctgctgccagagttactcaaaaaagctggctatgtgagcaagattgtggggaaatggcatttagggcaccgccctcagttccatcccctcaaacatggcttcgatgagtggttcggcagcccgaattgccacttcggtccctatgataataaagcccgcccgaacattccagtatatcgcgactgggagatggtgggtcgctattatgaagaatttcctattaacttgaagactggggaagccaatcttacccaaatttatctgcaagaggctctggactttataaagcggcaggcgcggcatcaccctttcttcctttactgggctgtagacgcgacccacgctcctgtttacgctagcaagccgttcctgggaacatcccaacggggtcgttacggagatgccgtacgcgaaatagacgattctatagggaagatccttgagctcctccaagatctacatgtggccgataacacctttgtgttttttacctcggacaacggcgccgcactcatatctgccccagagcagggcggttcaaatggaccatttctatgtggtaaacaaactacttttgagggcggaatgagagagcctgctctcgcatggtggcccgggcacgtgacagcaggtcaggtcagccaccagctcggctcaattatggatctgttcacaacttctttggcattggcgggcctgacgcctccatccgacagggctatagacgggctcaacctcctgcctaccctcctgcaaggccggttaatggacaggcctattttttactatagaggggatactttgatggctgcgactttaggacagcataaggctcatttctggacgtggacaaatagttgggaaaatttcaggcagggcatcgacttctgtccaggccagaatgtcagcggggtgaccacccacaacctggaggatcacactaaactgccactgatattccatctcggccgagaccctggggagcgcttcccactgtctttcgccagtgccgagtatcaggaggccctgtccaggatcaccagtgtcgttcagcagcaccaggaagcactggtaccagcacagcctcagctgaacgtatgtaactgggccgtgatgaattgggccccccctggatgcgaaaagttgggcaaatgcctcaccccgcctgagagcattccaaagaagtgtctgtggagccac

SEQ ID NO: 12041 - DNA, 1566 bp, Artificial Sequence
  Description of Artificial Sequence: Synthetic coding sequence
atggccgccgtcgtcgctgcaacgcgatggtggcaactcttgcttgtgctgtctgcagcaggtatgggggctagtggggccccccagccaccaaacattctcctccttctgatggacgatatgggttggggcgacctgggggtctatggggaaccctctcgagagactccaaacctggatcgcatggccgctgaaggactgctctttccaaatttttacagcgcaaacccactgtgtagcccttcacgcgctgccctcctgactgggcgcctcccaataagaaacggcttttacactacgaacgcccacgctcgcaacgcctatacaccacaggagattgtgggcggtatccctgatagcgagcagctgctgcccgagctgctcaagaaagccggctacgtgtccaaaatagtgggcaaatggcatctcggacaccgccctcaattccacccactcaagcatggctttgatgagtggtttggatctcccaattgccacttcggtccttatgacaacaaagcgagacccaacattcctgtgtatagggactgggaaatggtaggacggtattacgaagagttcccaataaatctgaagacaggagaagcaaatctgacacagatctacctgcaagaggcattagattttatcaagcggcaggctaggcatcacccattcttcctgtactgggccgttgacgctacacacgctcccgtctatgcaagtaagcctttcttggggacctcccagcgcggccgttatggggacgccgttcgagaaattgatgattccattggtaaaattctcgagttgctacaggacctgcacgtggccgacaatacattcgtcttctttactagcgataacggggctgctctgatcagcgcaccagagcagggtggctccaacggtccatttctgtgtggcaaacagactacctttgaggggggtatgcgggaaccagccttggcttggtggcccggtcatgttaccgccgggcaggtgagccaccaacttgggtccatcatggatctgttcacaacctcactggctttggccgggttaaccccgccctccgaccgtgcgattgacgggctgaacctgctccctaccctcctacagggccgattgatggaccggccaattttctattaccggggagacaccctgatggccgctaccttgggccagcataaggcacacttctggacctggacaaattcctgggagaatttcagacagggcatcgacttttgccctggccagaatgtatccggcgtaacaacacataacctggaagaccatacgaagctacctctgatcttccatcttggacgcgacccaggcgagcggttcccactgtcttttgcttccgcagaatatcaggaggccctgtcacgtataactagcgtggtgcagcagcaccaggaggctctggtcccagcccagccacagcttaacgtttgcaattgggccgttatgaactgggccccacccgggtgcgaaaaactcgggaagtgcctcaccccacccgaaagcattcctaagaagtgtctgtggtctcac

SEQ ID NO: 12042 - DNA, 1566 bp, Artificial Sequence
  Description of Artificial Sequence: Synthetic coding sequence
atggcggcggttgttgcggcaacccgctggtggcaactgctgctggttctgagcgcggcaggaatgggcgcgtccggcgcgccacaaccgcctaacatcctgctactcctcatggatgacatgggctggggtgatttgggcgtatacggcgagccgtcccgcgagacccctaatctggatcggatggccgcggagggcttgctcttccctaatttttacagcgcaaacccactgtgtagcccgagccgcgcagcgctgctgactggccgcctgccaatccgcaatggtttctacactacgaatgcacacgcgcggaacgcctacaccccacaagaaattgtcggtggtataccagattccgaacaactgctgccggagttgctgaaaaaagccggctacgtcagtaagattgttggtaagtggcacctaggccaccgcccgcagtttcatcctctgaagcacggtttcgacgagtggttcggctcccctaactgtcacttcggcccatacgataacaaggccaggccgaatatcccggtctaccgcgactgggaaatggttggtcgctattatgaggagtttccgattaacctgaaaaccggtgaggcaaacctgacccaaatttacctgcaggaagcccttgacttcataaaacgacaagctcggcaccaccctttcttcctgtactgggccgtagatgcaactcacgccccagtctatgcctccaagccgtttctaggtacgagtcaacgcggcaggtatggcgatgctgtccgcgaaatcgatgactcaatcggtaagattctcgaactgctgcaggatctgcatgtcgccgacaacaccttcgttttctttacctcagacaatggagctgccttaatctccgcccctgaacagggtggaagcaacggtccttttctctgtggcaagcagaccacgttcgaaggtggcatgcgggaaccagccctggcttggtggccaggccacgtcaccgcagggcaggtaagccatcagctgggcagcattatggacctgtttactaccagccttgcgcttgcagggctcacgccaccttccgaccgcgccatcgatggtctgaatctgctgccaacgttgctgcagggacgcttgatggataggcctatcttctattatcgaggggatacactgatggcagccacccttggccagcataaagctcacttttggacctggaccaactcgtgggagaacttccggcagggaatcgatttttgccctggccagaacgtctccggcgttactacccacaatttggaagaccacactaaactacctcttatcttccacctgggtcgggatcctggcgagcgtttcccattgtcattcgcatctgctgagtatcaggaggctctctcccgtattactagcgttgtccagcaacaccaagaagcactggtcccggctcagcctcagctgaacgtgtgtaactgggccgttatgaactgggctccgccgggctgcgagaagctgggcaaatgcttaacccctccagagagcatccctaaaaagtgtctgtggagccat

SEQ ID NO: 12043 - DNA, 1137 bp, Artificial Sequence
  Description of Artificial Sequence: Synthetic coding sequence
atgtcacgctccggtaccgacccccagcaaaggcagcaagcaagtgaggctgacgcagcagcggctacatttcgagcaaacgaccatcagcatatcagatataacccactgcaagacgagtgggtcctcgtgtccgctcatagaatgaaaaggccttggcagggccaggtagagccacaactgctgaagaccgtcccaaggcatgacccccttaatcctctctgcccgggggctatccgagcaaacggagaggtgaaccctcagtacgattcaaccttcctgttcgacaatgactttcctgccctgcagccggacgcccctagtcctggaccatctgaccaccccctttttcaggccaagagcgctagaggagtttgtaaagtgatgtgctttcacccttggagcgatgtgaccctccctctcatgagcgtgccggagattcgtgctgtggtggatgcttgggctagcgtgaccgaggagctgggcgcgcagtacccttgggtgcagattttcgagaacaagggtgccatgatgggatgcagcaacccacacccacattgccaggtctgggcgtcatctttccttccagatatcgcccagagagaagagcggagccagcaagcctacaagagtcagcatggtgaaccactgcttatggaatactcaaggcaggaactgctgaggaaggaaaggcttgtcctgacttccgaacattggctggtgctagtgcctttttgggccacttggccctaccagactctgctgcttccccgcaggcacgtcaggcgattgccggagcttacaccagcagaacgggatgatttagcatcgatcatgaagaaactgctgacaaagtacgataacctgttcgaaacttcttttccttacagtatgggttggcacggcgccccaacaggttccgaggccggggccaactggaatcattggcaactgcatgctcactattacccccccctcctgcgatcggcgacggtgcgaaagttcatggtgggctacgagatgttggcacaggcccaacgggacttaaccccagagcaagcagcggaaaggctgcgggccctgcctgaagtccattatcatcttggccagaaggatcgcgagaccgcgaccatagca

SEQ ID NO: 12044 - DNA, 1137 bp, Artificial Sequence
  Description of Artificial Sequence: Synthetic coding sequence
atgagtcggagtggtaccgaccctcagcagcggcagcaggcgagtgaagcagacgctgcagctgccacgttccgagccaacgatcaccaacatatcaggtataatcctctgcaggacgagtgggtgctggtgtcagcccatcgaatgaaaagaccttggcagggccaagtggagccacaactgctgaagactgtcccgcgacatgatccactcaatcctctctgtcctggcgctatccgagccaatggggaggtgaatccacagtatgacagcacatttctgttcgacaatgactttcccgcgttgcagccagatgcaccgagccccggcccctcggatcacccgttgttccaagctaaatcggcccgcggagtttgtaaggttatgtgctttcacccctggagcgacgtcacactgccacttatgtccgtgcccgaaatccgggcggtggtggacgcctgggcttctgttacagaggaactaggagcgcaatacccgtgggtacagatcttcgagaataaaggagctatgatgggctgcagcaatcctcaccctcattgccaggtatgggctagcagctttttgcccgatatagctcagcgcgaggaaagatcccagcaggcatacaaaagccaacacggtgagcctctcttaatggagtactcaaggcaggaacttcttcgaaaagagcggcttgtattgacaagtgagcactggctcgttctagttcccttctgggcaacctggccataccaaactctactgctgccgaggaggcacgttcggagactcccagaactgacccccgccgagcgagacgacctcgcctcaattatgaaaaaactgttgacaaaatacgacaacctgttcgaaacttcttttccatattctatgggatggcacggagcccccaccggcagcgaagcaggcgcaaactggaaccactggcagctgcacgcccattactatccccccctcctacgctctgcaactgtgagaaagttcatggtagggtacgagatgttggcccaagcgcagcgggatctgacgcccgaacaagcagcagagcggctcagagccctgcctgaggttcactatcatttgggtcagaaagatagagagacggccaccattgct

SEQ ID NO: 12045 - DNA, 1137 bp, Artificial Sequence
  Description of Artificial Sequence: Synthetic coding sequence
atgtcacgctccggcactgacccacaacagcgccagcaggcctcagaggctgacgcggccgccgccactttcagagcaaatgaccaccaacacatccgctacaacccgctgcaggatgagtgggtgctggtgtcggcacaccgcatgaaaagaccatggcaaggccaagtggagccgcagctgcttaaaactgtgccgaggcacgacccgctgaacccgctctgtccaggggctattcgggccaacggagaagtgaacccgcagtacgacagcacttttctgttcgacaatgacttcccggcgctgcaaccggacgcgccttctcccggcccgtcggatcatccgcttttccaggctaaatcggcaaggggagtctgtaaggtgatgtgctttcacccgtggtcggacgtgaccctcccacttatgtcagttccagagatccgcgccgtggtggatgcttgggcgagcgtgactgaagaactgggagcacaatacccttgggtccagatcttcgaaaacaagggcgccatgatgggatgttcgaaccctcatccgcattgccaagtgtgggcaagcagcttcctgccggatatcgcacaacgcgaagaaagatcccagcaggcttacaagtcacagcacggagaaccactcctgatggaatactcaagacaggaactgctgcgaaaagaacgccttgtgctcacttctgagcattggctcgtgctcgtcccgttttgggcaacttggccataccagacgctcttgcttcctcgccgccacgtgcggcgactgccagagctcactccggctgagcgggacgatctggcctcgattatgaagaagctcctgaccaagtacgataacttgttcgaaacctcattcccatactcgatgggatggcacggggccccaaccgggtcggaggcaggagccaactggaaccactggcagctccatgcccattactacccgccgctgttgaggtcagcgaccgtgcgcaagttcatggtcggctacgaaatgctggcgcaggcgcaacgcgacctcactccagagcaagccgccgagcgactgcgcgcattgcccgaggtccactaccacctgggacaaaaggatcgggagactgctaccatcgcc

SEQ ID NO: 12046 - DNA, 1137 bp, Artificial Sequence
  Description of Artificial Sequence: Synthetic coding sequence
atgtctcgctccggcactgatccgcagcagagacagcaagccagcgaggctgacgccgcggcggccacttttcgcgcgaacgaccaccaacatatccggtacaacccgctgcaagacgagtgggtccttgtgtctgcccaccgcatgaaaagaccgtggcaggggcaagtcgagccacagcttttgaaaaccgtgcccagacatgacccgctcaacccgctgtgtcctggagctattcgagccaacggagaagtgaatccgcagtatgattccactttcttgtttgataacgatttccctgcgctgcaacctgacgcgccatcccctggaccgtcagaccacccactgttccaggcaaaatcagcccgcggcgtgtgcaaagtgatgtgcttccatccctggtcagacgtcactctgccattgatgtcggttccagagattagagccgtggtggacgcttgggcgtccgtcactgaagaactcggagcacagtacccttgggtgcagatctttgagaacaaaggtgccatgatggggtgctctaatccacacccacattgccaggtgtgggcgtcgtcctttctcccagacatcgctcagagagaagaacggtcacagcaggcatacaaatcgcaacacggcgaacccctcttgatggagtatagccggcaagagctgctgcggaaagaaagactggtgctgacttccgagcactggcttgtcctggttccgttctgggcgacttggccctatcaaacgctgctcctccctagacgccacgtgcggcgccttccagagctcactccggccgaacgagatgatctggcatccatcatgaagaagctgctgaccaagtacgataatctgttcgaaacgagcttcccgtacagcatgggttggcatggagcgcccaccggctccgaggccggggcgaattggaaccactggcagctgcatgcacattactaccctccattgctgcgctcagctaccgtcaggaagttcatggtgggatacgaaatgctggcgcaagcccagagagatttgactccggaacaggcggctgaacggctcagggctctcccggaggtgcactaccacctgggacagaaggacagagaaaccgcaactatcgct

SEQ ID NO: 12047 - DNA, 1137 bp, Artificial Sequence
  Description of Artificial Sequence: Synthetic coding sequence
atgtccagaagcggaacggatccccagcagcgtcagcaggcatctgaagctgacgctgcagccgcgacctttcgcgccaatgatcaccaacacataaggtacaatcctctgcaggacgaatgggtgctcgtctctgcacaccggatgaaacgcccctggcaggggcaagtagagccgcagctcctgaagacagtgccccggcacgatcccctgaaccctctttgtcccggggcaatccgggcaaatggagaggttaatccccagtatgatagcacatttctatttgataacgatttccccgcgctacaacccgatgccccctcacccgggccatctgatcatccattatttcaggctaaatccgcccgaggggtgtgcaaagttatgtgtttccacccctggtcagacgtgacactgccactcatgagtgtgcctgagatcagggctgtcgtggacgcctgggcgagcgtcaccgaggagctcggcgcacagtatccatgggtccagatttttgagaataaaggggcgatgatgggctgcagcaatcctcatcctcattgccaggtctgggctagctctttcttgcccgatatcgctcagcgggaagaacgatcccagcaggcatacaaaagtcagcacggagagccacttctgatggagtatagtcgtcaggaactcctgcgcaaagagcgcctggtgctgacatccgagcattggctagtgttggtgccgttctgggcaacgtggccataccaaactcttcttctgcctcgacgccacgtccgtagactgccagagctgacacccgctgagcgcgacgacctcgccagcatcatgaaaaagttattgacaaagtatgataacctattcgagacttctttcccttactctatgggctggcacggcgcaccaacaggaagtgaggccggagcaaactggaaccattggcagcttcatgcgcattattaccctcctttgcttcgcagtgccactgtgagaaagttcatggtgggatatgaaatgctcgctcaggcccaacgggacctcacacccgagcaggccgcagagcgactgcgggcactgcccgaagtgcactatcatctggggcagaaagatagagagacagcgacgatcgcc

SEQ ID NO: 12048 - DNA, 1137 bp, Artificial Sequence
  Description of Artificial Sequence: Synthetic coding sequence
atgagccgcagcggaaccgatcctcagcagcgacagcaggcctctgaagctgatgccgctgcagctacctttagggcaaatgatcatcaacatatcaggtataatcccctgcaggatgagtgggttttggtctctgctcatcgaatgaaacggccatggcagggccaagtggaacctcagctgctaaagacagtgcccagacacgatccgctaaatcccctctgtcccggggccatccgagctaatggagaggtaaacccccagtatgattctaccttcttattcgataacgattttcctgccctccagcccgacgcgcctagtccaggcccaagcgaccatccactcttccaggctaagagcgccaggggagtgtgcaaggtgatgtgtttccatccctggagtgacgtgacattaccactgatgagcgtgcctgaaattagagcggtagtggatgcgtgggcgagcgtgactgaagaacttggtgctcagtatccatgggtacagattttcgagaataaaggcgccatgatgggttgcagcaatccccatccccattgtcaggtctgggccagttcatttctgcccgatattgctcagcgcgaggagagatcacagcaggcgtataaaagtcagcacggggaaccgctcctaatggaatacagcaggcaggagctactccgcaaagagcggctcgtgttgacctctgaacactggctagttttggtgccgttctgggcaacctggccttaccagacgcttttgctccctagaagacacgtgaggcggctgcccgaacttactcccgccgagagggacgaccttgcttctatcatgaagaaacttctgacgaagtacgataatctcttcgaaactagcttcccgtattctatgggctggcatggcgccccaaccgggagtgaggccggagcgaactggaaccattggcaattgcatgcccattattatccaccattactgagatccgccactgtccgcaagttcatggttggctacgagatgcttgctcaggctcagcgggacctcacgccagagcaagccgccgaacgactccgcgcattgccagaggtgcattaccacttagggcagaaggatagggagactgccactatcgct

SEQ ID NO: 12049 - DNA, 1137 bp, Artificial Sequence
  Description of Artificial Sequence: Synthetic coding sequence
atgtccagatcaggaaccgatcctcaacaaagacaacaagcgtccgaggctgatgctgctgccgcgacttttcgagccaatgatcatcaacacatccgctacaaccccctccaggatgaatgggtgctcgtctcggcacacagaatgaaacgcccttggcaaggacaagtggaaccacagctgctcaaaaccgtgccccgtcacgatccgctcaaccccttgtgcccaggggcgattagggccaacggagaggtcaatccgcagtacgactcgacgtttctgtttgacaatgattttccggctctgcagcctgacgcaccttcgccaggcccgtcagatcatcccctgtttcaggcaaagtcggcgcgaggagtgtgtaaggtaatgtgtttccatccgtggtctgacgtgactcttcctctcatgtcggtgcctgagattagggcagtggtggatgcatgggcgtccgtgaccgaagaactcggggcgcagtacccgtgggtccagattttcgagaacaagggtgcgatgatgggctgttcaaatccacatccacactgccaagtatgggcatcatcctttcttccagacattgcgcaacgggaagagcgtagtcagcaagcgtataagagccagcacggggaaccactcctgatggagtactcgcggcaggaactgcttagaaaggaacgcctcgtgttgactagcgaacactggcttgtcctggtgcccttttgggcaacctggccttaccaaactcttctgcttcctagacgtcatgtgcgccgcctgcctgaactgaccccagccgagagagacgatctggcctccatcatgaagaagctgttgactaaatacgataacctcttcgaaaccagcttcccatattcgatgggctggcatggtgcacctactggctcggaagccggagcgaactggaaccattggcagctgcatgcacactactacccacctcttttgcgttcggctaccgtccgtaaattcatggtgggatacgaaatgcttgcacaagcacaaagagatctcacgcctgagcaggcagccgagcggcttagggccctcccagaagtgcattaccatctgggtcaaaaggatcgagaaaccgcaacgatagca

SEQ ID NO: 12050 - DNA, 1137 bp, Artificial Sequence
  Description of Artificial Sequence: Synthetic coding sequence
atgtcgagatcgggcactgaccctcaacaacgtcagcaagcgagcgaagcagacgcggccgctgcgacttttcgggctaatgatcatcagcatattcggtacaacccgctgcaggacgaatgggtgcttgtgtcagcacataggatgaaacggccttggcaaggccaagtcgaacctcagcttctcaaaactgtgccaaggcacgatcctctgaacccactgtgtccaggagcaattcgcgcaaacggtgaggtgaatccacaatacgattccactttcctgtttgataacgactttccagcactccaacctgatgcaccatcgcctggccctagcgatcatcctctttttcaagcgaagtctgcccgtggggtgtgcaaggtgatgtgcttccatccttggtcggatgtgacccttccactgatgtccgtgcccgagatccgtgccgtcgtcgacgcctgggcgtcagtgaccgaggaactcggagcccaatacccctgggtgcagatcttcgagaacaagggagctatgatgggttgtagcaacccccacccgcactgtcaggtctgggcgtcgtcattcctccctgatattgcacaacgggaagaaaggtcccagcaggcatacaaaagccaacatggagaaccccttttgatggaatattcacgtcaggagttgcttcgcaaggagcggcttgtgctcacttccgagcattggctggtcttggtccctttctgggcgacttggccataccagactcttctcctcccacgacgccatgtcagacgccttcctgaactgaccccagccgaacgggatgacctggcgtcgatcatgaagaaacttctcaccaagtacgacaacctgtttgaaaccagctttccgtacagcatgggctggcacggggcccccaccggatccgaggccggggcaaactggaaccactggcaactgcatgcccattactacccaccactgcttcgctcagcaaccgtgaggaaattcatggtgggctacgaaatgctcgcccaggcacaaagggatctgactccggaacaagctgcagaacgccttcgcgcactgcctgaggtgcactaccacctgggacaaaaggaccgagaaaccgccaccattgct

SEQ ID NO: 12051 - DNA, 1137 bp, Artificial Sequence
  Description of Artificial Sequence: Synthetic coding sequence
atgtctaggtctgggacagaccctcagcagaggcagcaagcctccgaggcagatgcggccgctgccactttccgggcaaatgatcaccaacatataagatacaatcctctgcaagatgaatgggtattagtgtccgcgcataggatgaagcggccctggcaggggcaggtggaacctcagctcctgaagactgtgcctaggcacgatcctcttaatcctctctgtccaggagctatccgcgccaacggagaagttaatccccagtacgatagtacattcctgtttgataacgatttccctgctctccagcctgatgctccttcccctgggccctctgatcacccattgttccaggccaaatctgcaaggggggtatgtaaggtgatgtgttttcacccctggagtgatgttacgctgccactcatgagtgtgccagaaatccgagccgtagtggatgcctgggcttccgtgacagaagaactaggggcccagtatccgtgggtacagatttttgaaaataaaggggcaatgatgggatgcagtaatccccaccctcactgtcaggtgtgggcctcatcttttctaccagatatagctcaacgcgaggagaggtcccagcaagcatataaaagtcagcacggggaacctctcctgatggaatactctcggcaggagcttctgcggaaagaacggctcgtgctgacatccgaacactggttagttttggtacccttttgggccacatggccttaccagacattactgctgcctcgtcggcatgtgcgcagactgccagaactgactcctgctgaaagagatgacttagcctctatcatgaaaaaactgcttactaaatatgataacctatttgaaacaagttttccctattcaatgggatggcacggggctcccacaggaagtgaagctggggccaattggaatcattggcaattacatgctcattactatcctcccctccttcgatcagccacagtgcggaaattcatggtcgggtatgaaatgctcgctcaggctcagcgggacctcacaccagagcaggctgcagagagattgagagcacttcccgaagtgcattatcatctcgggcagaaagatcgcgagactgccactatagca

SEQ ID NO: 12052 - DNA, 1137 bp, Artificial Sequence
  Description of Artificial Sequence: Synthetic coding sequence
atgtcccgttccggcacagatcctcaacaaagacaacaagccagcgaggctgatgctgctgcagctacttttagggcaaatgatcaccaacacatccgttacaacccgttacaggatgagtgggtgctcgtgagcgcccacaggatgaagagaccgtggcagggccaggttgagccgcaattgctgaagaccgtgccacggcacgatcccctgaatcccctgtgccctggcgccatcagggctaacggcgaagtgaacccacaatatgactcaacattcttgtttgacaatgatttcccagccctacagccagacgcaccaagcccgggcccatccgatcatcccctgttccaagcaaaatccgcgcgaggagtgtgtaaggtgatgtgctttcatccgtggtccgatgtcacgctacccctaatgtcggtcccagagattagggctgtcgtcgatgcatgggcgagtgtgacagaggagctgggtgcccaatacccctgggtgcagatattcgagaacaaaggagcgatgatgggatgttccaacccccacccacactgccaggtgtgggcgtcatcattcctccccgatatcgctcaacgtgaggaacgttctcagcaggcctataaaagccagcatggcgagccacttcttatggagtactcacgccaggagctgcttaggaaggaacggctggtgcttacgagtgaacactggctggtgctggtacccttctgggctacttggccctatcagacgctgcttttgccacggcgtcatgtccggagactgcctgagctcacaccagccgagcgtgatgacctggcctcgattatgaagaaactgttaacaaagtatgataacctgttcgaaaccagttttccctatagcatggggtggcacggcgcaccgactggatccgaggctggcgccaattggaaccattggcagctgcatgcacattattatccgcctctgctccgatccgctacggtgcggaagttcatggtgggatacgagatgctggcccaggctcagcgggacctgacgcctgagcaggccgctgagcgcctgagggctttgcccgaggtccactaccatctaggacagaaagaccgcgaaacagctacaatagcc

SEQ ID NO: 12053 - DNA, 1137 bp, Artificial Sequence
  Description of Artificial Sequence: Synthetic coding sequence
atgagccggtccggcacggaccctcagcaacgccaacaggcaagcgaagcggacgcagcagccgcaaccttccgtgccaacgaccatcaacatattagatacaaccctctccaggacgaatgggtgctggtgtcggcacatagaatgaagcgcccgtggcagggacaggtggagccacaacttctgaaaactgttcccagacatgatccactcaaccctctctgtccgggtgcgatcagggcaaatggtgaagtcaatccccaatacgactcgacctttctcttcgataacgatttcccagctcttcaacccgatgcaccttcccctggcccatccgatcatccactgtttcaagcaaagtccgcgagaggggtgtgcaaggtgatgtgtttccatccatggtcagacgtgacccttccgctgatgtcagtgccggaaatacgagctgtggtggacgcctgggcttccgtcactgaagaacttggggcacagtatccatgggtgcagattttcgaaaacaagggggctatgatggggtgttcgaacccccacccacactgtcaggtctgggcatcgtcattcctccccgatattgcacagagagaagaaagaagccaacaagcatacaagagccaacacggggagccgcttctcatggaatattcccgccaggaactccttaggaaggaaagacttgtgctcacttccgaacattggctcgtccttgtccccttctgggcaacctggccttaccaaactctgcttctgcccaggagacatgtccgccgtctccctgaacttacccctgcagaacgggacgacctggcctccattatgaaaaaacttctgaccaagtatgataacctgttcgagacttcgtttccctactccatgggatggcacggagcacctaccggatcagaagctggtgctaactggaatcattggcaactgcatgcccactattacccccctttgcttaggagcgcgactgtgcgcaagtttatggtgggctacgaaatgctggcacaggcccaacgagatcttactcctgagcaagccgcagaaaggctgcgtgcactgcctgaagtgcattaccacctgggacagaaggatagggaaaccgctaccatcgca

SEQ ID NO: 12054 - DNA, 1137 bp, Artificial Sequence
  Description of Artificial Sequence: Synthetic coding sequence
atgtctcggtctggaaccgacccgcagcagagacaacaggcgtctgaagccgacgctgcagcggcaaccttccgcgcgaacgatcatcaacatattcggtacaacccgctgcaggacgaatgggtgctcgtctcggcccaccggatgaagcgcccttggcagggtcaagtggaacctcaactgctcaaaactgtccccagacacgaccccctcaatccactgtgcccaggggcaatcagggcaaacggagaggtcaacccgcaatacgactccacctttctcttcgataacgacttccctgctctccaaccggacgctccttcgcctggcccgagcgaccatccgctgttccaggcgaagtccgcacgaggggtatgcaaagttatgtgctttcacccgtggagtgatgtgacccttcctctcatgagcgtgccagagatccgggccgtcgtggatgcctgggcttcagtgactgaagaacttggcgcccagtacccgtgggtgcaaatctttgagaataagggagccatgatggggtgcagcaatccgcacccacactgtcaggtgtgggcgtcatcgttcctgcctgacatcgcccagcgggaagaaagaagtcagcaggcgtataagtcccaacatggcgagccactgttgatggaatactcgcgacaggagctgttgcgcaaggaaagacttgtactgacttcagaacactggctggttctggtgccattctgggcaacgtggccctaccagaccctcctcctgccacgcagacatgtccgcaggctcccggagctgactccggcggagcgcgacgatctcgcgtccatcatgaagaagctgctcaccaaatatgataacctgttcgaaacctcgttcccttactcaatgggttggcatggagcgcccactggatcggaagcaggcgctaattggaaccattggcagttgcacgcccactactacccgccgctcctgaggtcggccactgtgcgcaagttcatggtcggatacgagatgcttgcccaggcacaacgggacctcacccccgagcaagccgccgagaggttgagggccctgccggaagtgcactaccaccttggccagaaagatcgcgaaaccgcgactattgct

SEQ ID NO: 12055 - DNA, 1137 bp, Artificial Sequence
  Description of Artificial Sequence: Synthetic coding sequence
atgtcgcgctccgggaccgacccccagcagagacagcaagcctccgaggcagacgctgccgccgcaacttttagggcgaatgaccaccaacacatccgctacaacccgctgcaggacgaatgggtgctcgtctcggcgcatcgtatgaagaggccttggcagggacaggtcgagccgcagttgcttaagaccgtcccgagacacgacccgctcaacccactgtgccctggagccatccgcgccaacggagaagtcaacccacagtacgactccacgttccttttcgataatgacttcccggctctgcagcccgacgcgccgtcccctggaccgtccgaccatccgctgttccaagccaagtcagcccggggtgtgtgtaaggtgatgtgcttccatccttggagcgacgtgactctgcccttgatgtctgtgcctgagattcgcgcagtggtcgatgcgtgggcatccgtgactgaagagctgggagcgcaatacccctgggtccagatctttgaaaacaaaggggccatgatgggatgctcgaatccccacccgcactgccaagtctgggcctcctcatttctgccagatattgcgcagcgggaggagagatcccaacaggcatacaaatcccagcacggagagccattgctgatggaatactctcgacaggaactgctcagaaaggagcggctggtcttgacttcggagcactggctggtgctggtgcctttctgggccacctggccataccagactctcctgctccctcggagacatgtgcgccggctcccagaactgacccccgctgagagagatgacctggcatccatcatgaaaaaactgctcactaagtacgacaacctcttcgaaacctccttcccttacagcatgggatggcatggtgcccccaccgggagcgaagccggagcgaactggaatcattggcagctccacgcgcattactacccgccgttgctgcgctcggccacggtgagaaagttcatggtgggctatgaaatgctggcccaggctcaaagggatctcactccggagcaggcggctgaacggctgcgcgcgttgcctgaagtgcactaccatcttggacagaaggaccgcgaaaccgctactatcgct

SEQ ID NO: 12056 - DNA, 1137 bp, Artificial Sequence
  Description of Artificial Sequence: Synthetic coding sequence
atgtcccgctctggcaccgatcctcagcaacgacagcaagcttcggaagccgacgctgctgccgccactttcagggcaaatgaccaccaacatatcagatataaccccttgcaggacgaatgggtgctcgtaagtgcacacaggatgaagagaccttggcagggtcaggtagagccgcagctgttgaagacagttccccggcatgaccccctgaatcccttatgccccggcgccatcagggctaatggagaagtgaaccctcagtacgactcaacgtttttattcgataacgattttcctgcactccaacctgatgcaccgagtcccgggcccagcgatcatcccctgttccaagctaagagcgctcgaggcgtctgcaaggttatgtgcttccacccctggtctgatgtgaccctacccctaatgtccgttcctgagatcagggccgtggtggacgcttgggcttctgtcacagaggaactgggcgcacagtatccctgggtgcagattttcgaaaacaagggggccatgatgggctgtagcaatccccatccacattgccaggtgtgggccagtagctttctgccagacattgcacagcgcgaagagaggagtcaacaggcttataagagtcagcatggtgaaccgctcttaatggagtacagcaggcaggaactgctgcggaaagaaaggctggttttgacgtccgaacactggctggtcctcgttccattctgggctacttggccctatcagacactgctgttgccgcggcgccatgtgagaaggctgccggaactaaccccggccgagagggatgatctggcgtctattatgaagaaattgctgaccaagtatgataatctttttgaaacttcctttccttactcgatgggttggcatggtgcccctactggctcagaagccggagccaattggaaccactggcaattgcacgctcattattacccacccctcctgaggagtgctacggttaggaaattcatggtggggtatgaaatgctggcccaggcccagcgggatctaacccctgaacaggcagccgaaagactgagagcactgccggaagtccattaccatcttggccagaaggatagagagaccgctacaatagcg

SEQ ID NO: 12057 - DNA, 1137 bp, Artificial Sequence
  Description of Artificial Sequence: Synthetic coding sequence
atgagcagatcagggaccgatcctcaacagcgtcaacaagcgtctgaagcagacgcagccgccgcaacttttagggccaacgatcatcaacacatccgatacaacccgctgcaagacgaatgggtcctggtgtcggcacaccggatgaaaagaccttggcaaggacaggtggaacctcagctgttgaaaaccgtgccccggcatgaccctcttaatcctctgtgcccgggcgctatccgtgctaacggtgaggtcaacccacaatacgatagcacgtttctttttgataatgatttcccagccctgcaacctgatgcaccttcgcccggtccatcagaccatccactctttcaagccaagtcggccagaggagtgtgtaaggtgatgtgctttcatccctggtcggacgtgacgctccctcttatgagcgtccctgaaattcgggcagtggttgatgcatgggcgtccgtgaccgaggagcttggagcacaatacccttgggtgcagatctttgagaataagggggcgatgatgggttgttcgaacccacaccctcattgtcaggtgtgggcatcatcgtttctgcccgatattgcacagagggaagaaagatcgcagcaagcgtacaagagccagcacggagaaccactcttgatggaatacagcagacaagaacttctgagaaaagagaggcttgttcttacctcagaacattggctcgtgctcgtccccttttgggcaacctggccttaccagacgctcctgcttcctcgcagacacgtccgtcgactccctgagctcacccccgccgaacgcgatgatctggcgtccattatgaaaaaacttcttacgaaatacgacaatctgtttgaaacttccttcccatacagcatggggtggcatggggcaccaactggttccgaggccggtgcgaactggaaccactggcagttgcacgctcattactacccaccacttctgcgctcagcaaccgtgagaaagtttatggttggctacgagatgctggctcaagcccagcgtgatctgactcctgaacaagccgcagagcgtctgcgagcactccccgaagtccactaccatctcggacagaaggaccgtgaaactgcgacgatagct

SEQ ID NO: 12058 - DNA, 1137 bp, Artificial Sequence
  Description of Artificial Sequence: Synthetic coding sequence
atgagccggtccggcaccgacccacagcagcgccagcaagcatctgaagcagacgccgccgcggctacctttcgggctaacgaccaccagcacatccggtacaaccccctgcaggatgagtgggtcctcgttagcgcacacagaatgaagcgaccgtggcaaggccaggtcgaacctcagctgcttaagacggtccctcggcacgacccgctcaacccattgtgtcctggtgcgatcagggctaatggagaggtgaacccacagtacgactcaactttcctgttcgacaatgacttcccggcactgcagccagatgccccgtcgccgggcccatcggatcatcctttgttccaagcaaagtcggcgcgaggagtgtgcaaggtgatgtgcttccacccgtggtccgatgtgaccctgccgctgatgtcagtgccagagatccgcgccgtcgtggacgcatgggcgtcggtgaccgaggagctgggggctcagtacccctgggtgcagatctttgaaaacaaaggagccatgatgggatgctccaatcctcatccccattgccaggtgtgggcgagctccttcctgccggacatcgcccagagagaggagcggagccaacaagcgtacaagagccagcacggggaaccgctcttgatggagtattcgcgccaagaactgctccgcaaggaacgccttgtgctgaccagtgaacattggctcgttctggtgccgttctgggccacctggccgtaccagaccctgctgctcccgaggagacacgtgcgtagactgccggagttgactcccgccgaacgcgatgacctcgcctcaattatgaagaaactgctgactaagtacgataatctctttgaaacttccttcccatactcgatgggatggcacggagccccaactggctcagaagccggtgccaactggaaccattggcaacttcatgcacattactaccctcctctgctgcgctccgccaccgtcagaaaattcatggtcggatacgaaatgctcgcgcaagcgcaacgggatcttactccggagcaagctgctgaacgcctgcgggcgctcccagaggtgcactaccacctcggacagaaagacagggaaacggccactatcgcc

SEQ ID NO: 12059 - DNA, 1137 bp, Artificial Sequence
  Description of Artificial Sequence: Synthetic coding sequence
atgagcagatcagggacagaccctcagcagcggcagcaggcgtcagaggccgatgcagcagctgccactttcagggctaacgaccaccagcatattcgctataaccctcttcaggatgaatgggtcctggtaagtgcacacagaatgaagcgaccttggcaaggccaggtcgagccacagcttctgaagacagttcccaggcacgacccacttaacccgctctgccctggggccatcagggctaacggagaggtcaacccccagtacgactccacattcctctttgacaacgattttcccgcactgcagcctgacgcgccgtctcccggcccttcagaccacccgttgtttcaagccaagagtgctaggggagtgtgcaaagtcatgtgtttccatccgtggtccgacgtcacactgccactcatgtccgtcccagagattcgcgctgtagtggacgcctgggcctcagtgacagaagagctcggggctcagtacccctgggtgcagatttttgaaaataaaggcgccatgatggggtgctcaaacccacacccccattgccaggtctgggcctcctcttttttgccagatatcgctcagcgagaagagaggagtcagcaagcttacaagagccagcatggcgagccactgctcatggagtacagccggcaagaactcctgcggaaggagcggctggtgctgacttccgaacactggctcgtgctcgtccctttctgggcaacctggccataccagaccttgttgctgccaagaagacatgtaagacggcttccggaacttacacccgctgagcgggatgatctggcatcaataatgaagaaactcctgaccaagtatgacaatctgttcgagacatcctttccgtatagtatggggtggcacggcgcgcccaccgggtctgaggccggcgctaactggaaccattggcagctccacgcacactactacccgcccctgctgagatcagcaaccgtgagaaagtttatggtgggatatgaaatgttggctcaggcacagcgggatctgacacctgagcaggcagcagaacgcttgagggcccttcctgaggttcactatcacctgggccaaaaagaccgcgagaccgcgaccattgcg

SEQ ID NO: 12060 - DNA, 1137 bp, Artificial Sequence
  Description of Artificial Sequence: Synthetic coding sequence
atgtcacggtcaggcacagacccccagcagaggcaacaggcctctgaagccgatgcggcagctgctacctttcgcgcgaacgaccatcagcacattagatataaccctttgcaagacgagtgggtacttgtatctgcacatagaatgaaacgcccatggcaaggacaggtggaaccacagctgttgaaaacagtgccaaggcacgatccattgaatcctctttgtcctggagccattcgggccaacggcgaggtaaacccacagtatgatagcaccttcctgtttgataatgattttccggcgttgcaacctgatgctcctagtcctggaccctcagatcaccctcttttccaggcgaagtcagcacgtggggtgtgtaaagtcatgtgcttccacccatggtcggatgtgacactaccactgatgtctgtccctgagatacgcgctgtggtcgacgcctgggccagcgtgaccgaagaactgggagctcagtacccatgggtgcagatattcgaaaacaaaggggccatgatgggttgctctaacccccacccccactgtcaagtgtgggctagctcctttctgccagacattgctcagagagaagaacgttcgcagcaggcgtataaatcacagcacggcgagcccctgctaatggagtactctcgacaagaactactccgcaaagaacgacttgtcctgacctcagagcattggttggtcctcgtgcccttttgggccacctggccatatcagacacttctgctgccacggaggcacgtgcgccggctgcccgagttaacccccgcagagcgcgatgacctcgctagcattatgaagaaactcctcacgaagtatgacaatctcttcgagacctcattcccctatagcatgggatggcacggagctccaaccggctctgaggccggggctaactggaaccattggcagctacacgcacattattacccacccctgctccggtccgcaactgtcaggaagtttatggttgggtacgaaatgctggcacaggcccagagggatcttacacccgagcaggctgcagagagattaagggctttgccggaagtgcactatcacctaggacagaaggatagggagactgccactattgcc

SEQ ID NO: 12061 - DNA, 1137 bp, Artificial Sequence
  Description of Artificial Sequence: Synthetic coding sequence
atgtcccgctctgggactgatccgcagcaacggcagcaggcaagtgaggccgatgccgcggctgctacatttagggccaacgaccaccagcacataaggtacaaccccttgcaagatgaatgggtattggtcagtgcccatagaatgaagcggccttggcagggacaggtagagccacagctgctcaaaaccgtcccgagacatgatcccttgaatccactgtgtcctggggctatcagggctaacggagaggttaatcctcagtacgactccaccttcctgtttgacaacgactttccagcactgcagccagatgccccgtctccgggtccatctgaccaccctctgttccaggccaaaagcgctcgcggtgtgtgtaaagtgatgtgctttcacccctggagtgacgtgactctccctctgatgtccgtgcccgagatacgggccgtggtggatgcatgggcctctgtcactgaagagctgggcgctcagtatccctgggttcaaatatttgaaaataagggagccatgatgggctgctcaaacccgcatcctcattgtcaggtatgggcatcttctttcctccccgacattgcacaaagagaggaaagatcccagcaggcctacaaatcccagcacggggagcctctgttgatggagtatagtcgacaggagctgctgcgcaaggagagattggtgttgactagcgaacattggctggtgctggtgccattctgggcgacctggccttaccagacactgctgttgccaagacgacacgtacgcagactccccgagctgacgcccgctgagcgggacgatctggccagcattatgaaaaagctgctgacaaagtacgataacctgttcgaaacatccttcccttattctatgggctggcatggcgctcctaccggttctgaagctggggccaattggaatcactggcagctgcacgctcattactatccccccctcctgcgaagcgcgaccgttaggaaatttatggtggggtatgaaatgctcgcgcaggctcagagagatcttactccagagcaggccgcggagcggttgagagctcttcccgaggtgcactaccatttgggccagaaggacagggagaccgccacaatcgct

SEQ ID NO: 12062 - DNA, 1137 bp, Artificial Sequence
  Description of Artificial Sequence: Synthetic coding sequence
atgtcgagatccggtaccgatccacaacagcgccaacaagcgtccgaagcagatgcggcggcggctacctttcgagctaatgaccaccaacacattaggtacaaccctcttcaagatgaatgggtcctcgtctcggcccataggatgaagaggccatggcagggacaggtggaaccccaactgctgaaaaccgtcccaagacatgatcctctcaacccgctttgccctggggccattcgtgcaaacggggaagtgaatccccagtatgacagcacctttctttttgacaatgactttccagcactgcaaccagatgcaccaagccctggaccatccgaccaccccctttttcaagcaaagtcagccagaggagtgtgtaaggtgatgtgttttcatccgtggtcagatgtcactcttcctctgatgtccgtgcctgaaattagagcagtggtggacgcatgggcgtccgtgactgaggaacttggagcacaatacccctgggtgcaaatcttcgaaaacaagggcgctatgatgggctgcagcaacccccatcctcactgccaagtttgggcctcctcatttctccccgacatcgcccagcgcgaagaaagatctcaacaggcttataagtcacagcatggcgaaccgcttctcatggaatactcccgtcaagaacttctgagaaaggagagattggtccttacttccgaacactggctggtcctcgtccctttttgggcaacctggccgtaccagactctgctgctgcctcgccgacatgtgagacgacttcctgagcttactcctgcagagcgcgacgatctggcatcgattatgaagaaacttcttaccaaatacgataatcttttcgaaacctcgttcccttactcaatgggatggcacggagcacctactggttccgaagcaggagcaaactggaaccactggcaactccacgcgcattactacccacctctccttcggagcgcaaccgtgcgcaagtttatggtcggctacgaaatgctggcgcaggcacaacgggacctcacgcctgaacaggccgcagagagactccgtgcgctgcctgaagtccactaccatctgggccagaaggacagagagactgcaactatcgct

SEQ ID NO: 12063 - DNA, 1137 bp, Artificial Sequence
  Description of Artificial Sequence: Synthetic coding sequence
atgtctcgcagcggcactgatccgcagcaacgccagcaggcttccgaggcggacgcggccgcagccaccttccgcgctaacgaccaccagcacataaggtacaacccgctccaggacgaatgggtgctcgtgtcagctcaccggatgaagaggccatggcagggacaggttgagccgcaactccttaaaactgttccgagacatgatccactgaatcctctctgtcctggggctataagagccaatggggaggtcaacccccagtacgactcaactttcctgttcgataacgatttcccagctcttcaacccgacgctcccagtccgggtccatccgatcacccgttgtttcaggcaaagtctgctagaggggtttgcaaagtcatgtgcttccacccatggtccgatgtcactttgccactgatgagcgtccccgagatccgggctgtggtggacgcttgggcatccgtgaccgaggaactcggcgcacagtatccatgggttcagatatttgagaataagggggcaatgatgggctgctcaaatccacaccctcactgccaggtgtgggcctcaagttttcttccggatattgcccagcgagaggagagaagtcaacaagcttacaaaagtcagcacggggagcccttgcttatggaatatagcagacaggaactcctgaggaaagagcgcttagtactcacgagcgagcattggcttgtcctcgtgcctttctgggccacgtggccctaccagacactgctactccctagacgacacgtgcgcagacttccagagttgactccagccgagcgtgacgacctcgcttccataatgaagaaactccttacaaagtacgacaatctgttcgaaacatccttcccctatagtatggggtggcacggggccccaaccggcagtgaggccggagccaattggaaccactggcagttgcacgcacactattacccccctctccttcgaagcgcaaccgttcgcaagtttatggtagggtatgagatgctggctcaagcccaaagggatctaacccccgagcaggccgcagagcggttgagggccctgcccgaggtgcactaccacctcgggcagaaagaccgcgaaacagccacaatcgcc

SEQ ID NO: 12064 - DNA, 1137 bp, Artificial Sequence
  Description of Artificial Sequence: Synthetic coding sequence
atgagccgatctggtacagaccctcagcagagacagcaggcttccgaggcagacgcagcagctgctaccttcagagcaaatgaccaccagcatatccggtacaatcccctgcaggacgagtgggtgctggtgtccgcgcacagaatgaagcggccatggcaaggacaggtggagcctcagctgctcaagactgtgccaagacacgatcccctcaaccctctgtgccccggcgccattagggctaatggtgaggtgaacccacagtatgattcaaccttcttatttgacaacgatttccccgcactgcagcccgacgctccatctccggggcccagtgatcaccctctgtttcaagccaagagcgcgcggggggtgtgcaaggtaatgtgttttcatccatggagcgacgtgacactgccactgatgtccgtacctgaaatcagagcggtcgtggatgcctgggcatccgtaacagaggagctgggtgcacagtacccctgggtgcagatcttcgaaaataagggagccatgatggggtgttcaaacccgcacccacactgccaggtttgggcttcctcctttctgccagacatcgcccagagagaagaaagaagccagcaagcatacaaatcccagcatggtgagcccctgctgatggagtatagccgccaggaactgctgaggaaagaacgcctggtgctgaccagtgagcactggctggtcttggtccccttttgggcgacttggccttaccaaacactgctgctgccacgccggcatgtgcggcgtctgcctgagctcacgcccgccgagagagatgacttagcaagcatcatgaagaagttgctgacaaaatacgacaatttatttgagaccagcttcccttactctatgggctggcatggagcccccactggctctgaggccggagcgaactggaatcactggcagctgcatgcccactactatcccccgctgcttcggtccgctaccgtccgaaagttcatggtgggctatgagatgctggcccaagcccaacgggatttgacccccgagcaggcggctgaaaggcttcgagccctgcctgaggtccactatcacctgggccaaaaagacagggaaactgcaaccatcgcc

SEQ ID NO: 12065 - DNA, 1137 bp, Artificial Sequence
  Description of Artificial Sequence: Synthetic coding sequence
atgtccaggtccggcactgaccctcagcaacgccagcaggccagcgaagcggacgctgcggctgcaacgtttagggctaatgatcaccaacacatcagatataacccactgcaggacgaatgggtccttgtgagcgcccacaggatgaaaagaccctggcaaggccaggtcgagccccagttgctcaaaaccgtgccgagacacgacccactcaatccattatgtcccggcgctatacgagctaatggagaagtcaacccccagtatgacagcaccttcttgttcgataatgacttccctgcacttcagcctgacgcaccctcaccaggcccgtcagatcacccactttttcaggccaagagcgctagaggcgtatgcaaggttatgtgtttccatccctggagcgacgtcacgcttccgcttatgtctgtgccggagatacgggcagtggtggatgcctgggcctctgtgacagaagaactgggggcccagtacccctgggttcagatcttcgaaaacaagggggctatgatgggatgcagcaatccacacccacattgccaggtgtgggcatcatcgtttctgcccgatatcgcccagagggaggaacggtcgcaacaggcctacaaaagccagcacggagagcccctgctgatggaatattcgaggcaagagctgttgaggaaggaaagactggtgttgaccagcgagcattggctcgttttggttccattttgggctacatggccttaccagacccttctgctaccaaggaggcatgtccgtcgactgccagagttaactccagccgagcgggacgacttggcctcaatcatgaaaaagctgctgactaaatatgacaacttattcgagacctccttcccatattcaatggggtggcacggagctccgaccggctcagaggccggagctaactggaaccactggcagctccatgcccactattaccccccactgttgcgttccgctacagtgcgcaaatttatggtaggttatgagatgttggcccaggctcagcgggatttaacccctgagcaggctgctgaacgtctgcgagcattgcctgaagtgcattaccatctgggtcagaaggatcgcgaaaccgctactatagct

SEQ ID NO: 12066 - DNA, 1137 bp, Artificial Sequence
  Description of Artificial Sequence: Synthetic coding sequence
atgtcacgtagtgggactgatccccagcaaaggcagcaggccagtgaggccgatgccgctgccgctacttttcgggcaaacgatcatcagcacatccggtataacccactccaggatgaatgggtgcttgtgtcggcgcataggatgaagagaccttggcaggggcaggtagaaccacagctcctgaagactgtccccagacacgaccctctcaatcccctctgccccggagccattcgcgccaacggggaagttaatccccagtatgatagtacatttctattcgataatgatttcccagctctccagcctgatgcacctagtccaggaccatccgaccatcctctttttcaggccaaatctgctcgaggagtctgtaaggttatgtgtttccatccttggtctgacgtgacattaccacttatgtccgtacccgagatccgggcggtcgttgatgcctgggcctcagtgactgaagaattaggggctcagtatccatgggtccagatattcgaaaacaaaggagctatgatgggatgttctaacccccatccccactgtcaagtctgggcatcatcctttctccccgatattgcacagcgggaggaacgaagtcagcaggcatataaatcccagcatggggagcccctactcatggaatatagtcggcaggagctcctgcgtaaagagagactagtgctcactagtgaacactggctcgtgctagttcctttctgggcgacatggccctatcagactttactgctgccgcgaaggcatgttagaaggctccccgagcttactcccgctgaaagggacgatcttgcctccatcatgaaaaaactcctgacaaaatatgacaatcttttcgagacatctttcccatatagtatggggtggcatggagcccccacagggtctgaggcaggagccaactggaaccactggcaacttcatgcccattattatcccccccttttaagatcagcgacagtacgcaagtttatggtgggatatgaaatgctcgcgcaggctcagcgtgatttaacaccagaacaggctgctgaaaggctgagggccctcccagaggtgcactaccacctgggacagaaagatagggaaacggcaactatcgcc

SEQ ID NO: 12067 - DNA, 1137 bp, Artificial Sequence
  Description of Artificial Sequence: Synthetic coding sequence
atgtcccggtccggtacggatccacagcaaaggcaacaggcttctgaggctgacgcagcggcagctacttttagggcaaatgaccatcagcatatcagatacaaccccctccaagatgaatgggtgctggtttctgcacacagaatgaaacgcccttggcagggacaggtggagccacagctgttgaagaccgtccctcggcatgaccccctcaaccccctctgtccaggcgcaattagagcaaacggcgaggtaaatccacagtacgactcgacatttctttttgacaatgattttcctgccctccagccagatgcgccttcccctgggccgtctgaccatcccttgtttcaagcgaagtccgctcgcggtgtatgcaaggtcatgtgctttcacccttggagtgatgtgaccctgcctcttatgtcagtgccagagatcagggctgtggtggatgcatgggccagcgtgactgaggagcttggcgcccagtatccctgggtgcagatttttgaaaataaaggcgcaatgatgggctgcagcaatccacatcctcactgtcaggtgtgggcctcctcattcctgccagatatagcccagagagaagagaggtctcagcaggcctacaaaagccagcatggggagcctcttctcatggaatattccaggcaggagcttctccgtaaggagaggcttgtgctcacctcagagcactggctggtcctggtccctttttgggctacttggccttatcagacactcttactgcctcgcagacacgtgaggcgacttcccgagctgaccccagcagagcgggacgatttggctagtatcatgaaaaaacttctgaccaagtatgacaacctattcgagaccagctttccttattcaatggggtggcatggtgccccgaccgggtcagaagccggagccaattggaaccactggcaactgcatgcacactactaccctccgttactgcggtcagctacagtgcgcaaattcatggtgggctatgagatgctggcgcaggcacaacgcgatctgacccccgagcaggccgcagaaagactgcgggcactacccgaagtgcattaccacctggggcagaaggatcgcgaaacagcaacaattgct

SEQ ID NO: 12068 - DNA, 1137 bp, Artificial Sequence
  Description of Artificial Sequence: Synthetic coding sequence
atgagccgctccggcactgacccgcaacaaaggcagcaggccagcgaagctgacgcggcggccgccacttttcgcgccaacgaccaccaacacatcagatacaacccgctccaggatgaatgggtgctggtgtccgcccatcggatgaagcggccgtggcaaggacaagtggagccccagctgctcaaaactgtcccccgccacgacccactcaacccgttgtgccccggagccatcagagctaacggggaggtgaacccacagtatgacagcactttcctttttgacaacgacttccccgccctccaaccggatgcaccttcaccgggaccttcagaccacccactctttcaggccaagtcagccagaggcgtctgtaaggtcatgtgttttcatccgtggtcagatgtgactttgccgctcatgtccgttcctgagatcagagccgttgtcgacgcatgggctagcgtgactgaggaactcggggcccagtacccatgggtgcagatcttcgagaacaaaggggctatgatgggatgtagcaacccgcatccgcactgtcaagtgtgggcgtcatccttcctcccagacattgcccagcgggaagaacggtcgcagcaggcctacaaatcgcagcacggagaaccgctgctcatggagtactcacgccaggagctgctgcggaaggaacgtctcgtcctgacctcggagcactggctggtcctggtccccttctgggctacctggccgtaccagaccctcctgcttccgcggcgccatgtgcgcaggctgccggaattgacgcctgcggaacgggacgacttggcctcaatcatgaagaagctcctgactaagtacgacaacctgttcgaaaccagcttcccgtactctatgggctggcacggtgccccgaccggctccgaagcgggagcaaactggaaccactggcagttgcacgcccattactaccctccgctgctgaggtcagcgacggtgcggaagttcatggtgggatatgaaatgctggcgcaggcccagcgggacctgaccccggagcaggcagccgagcgcctgcgcgccctgccggaggtgcactaccatcttggccagaaggatagagaaaccgcaaccattgca

SEQ ID NO: 12069 - DNA, 1137 bp, Artificial Sequence
  Description of Artificial Sequence: Synthetic coding sequence
atgtccagaagcggaaccgacccgcaacaacgacaacaagcctccgaagcagatgccgccgctgcaactttccgcgcgaacgaccaccaacacatcaggtacaatcctctgcaagatgagtgggttctagttagcgctcaccgcatgaaaaggccctggcagggccaagtcgaaccacagttgttgaagacagtgcccagacacgatccgcttaatcccctgtgtcccggtgctatcagagctaatggagaggtgaaccctcagtacgattcaactttcctgtttgataatgacttccccgcattacaaccagatgctcctagcccaggcccctcggatcatcccctctttcaggccaagagcgcccggggagtgtgcaaagtaatgtgctttcatccatggtctgatgtgactctgcccctgatgtcggtacccgaaatccgcgcggtggtggacgcttgggctagcgtgactgaagaactgggagctcagtacccatgggtgcagattttcgaaaataagggcgccatgatgggatgttctaatccacatccacattgccaggtttgggcctcttcattcctgcctgacatagcacagcgggaggagcggagccagcaggcctataaatctcagcatggagagccactcctgatggaatattcacggcaagagctgctgaggaaagagcgcctggtcctcacgtccgagcattggctggtacttgtccctttctgggccacatggccgtaccaaaccctcttactgccgcgtcggcatgtcaggaggcttccagaactcacgcccgcagaaagagacgaccttgcgtcaattatgaagaaacttctgacaaagtatgacaatctattcgaaacaagttttccgtattcaatggggtggcatggagctccaacgggttctgaggcgggggctaattggaaccattggcagctgcatgctcactattatcccccgctccttcgaagtgccacagtgaggaagtttatggtggggtacgagatgcttgctcaggcccagcgagacctcaccccagagcaggccgcagagaggctgcgagcacttcctgaagtccactatcatctggggcaaaaggaccgggagactgctaccattgcc

SEQ ID NO: 12070 - DNA, 1137 bp, Artificial Sequence
  Description of Artificial Sequence: Synthetic coding sequence
atgtccagaagcggcactgatccgcaacagcgccagcaagcatcggaggcggacgctgccgctgctactttccgggccaacgatcatcagcatataaggtacaatccgcttcaggacgagtgggtgttggtctccgctcaccgcatgaaacgcccgtggcagggacaagttgaacctcagctacttaaaactgtgcctcggcacgatccgctcaatcctctatgcccaggggcgattcgagctaacggcgaggtaaatccacagtacgacagtacgttcctgtttgataatgacttccctgccctgcagcccgacgctccatcccctggtccgtcagatcatcctctattccaggcgaaaagtgcacgcggcgtgtgtaaggtgatgtgcttccacccatggagcgatgtcactttgcccctgatgtccgtgcccgagatacgcgctgtcgtggatgcctgggcgtcggttacggaggagttaggagcccagtatccgtgggtgcagatattcgagaataagggcgccatgatggggtgtagcaacccccaccctcactgtcaggtctgggccagctcttttctgccagacatcgcacagagagaagagagaagtcagcaggcctacaagtcacaacacggggaaccgctactgatggagtacagtagacaggaattgctgcgcaaagagcgccttgttctgaccagcgaacactggctggtgcttgtgcctttttgggcaacgtggccataccaaacgttgctgctgccccgacgacacgtacgtagattgcccgaactgacgcctgcagagagagatgatctggccagcattatgaaaaaactgctgaccaaatacgataacctctttgagaccagtttcccatactctatgggttggcacggggctcctaccggctccgaagccggtgctaattggaatcattggcagctacacgctcactattaccccccactgcttcggtctgcaacagtaagaaagttcatggttgggtacgagatgttggctcaggctcagcgcgatctgactcccgaacaggccgcagagaggctccgtgcgctgccagaggtgcactatcacctcggacagaaggaccgcgagactgccaccattgct

SEQ ID NO: 12071 - DNA, 1137 bp, Artificial Sequence
  Description of Artificial Sequence: Synthetic coding sequence
atgtcgaggtccggtactgatcctcaacaaaggcaacaggcctctgaggcggacgccgcagctgcaactttccgagcaaatgatcaccaacacataagatacaatccgctccaagacgaatgggtcttggtcagtgcgcaccgtatgaagaggccgtggcagggtcaggtcgaacctcagctcctaaaaactgtacccagacatgatccgcttaacccactatgtccaggagcaatacgggctaatggtgaggttaacccgcagtatgactcaactttcctcttcgataacgattttcctgcgctacagccagatgccccttccccagggccaagtgatcatcctctctttcaagctaagagcgctcgcggagtgtgtaaggttatgtgttttcacccatggtctgatgtaacgcttcctttgatgagcgtgccagaaattcgtgctgttgtggatgcttgggcatcagttactgaagagcttggggcccaatacccatgggtgcaaatatttgaaaacaaaggagctatgatggggtgttctaatcctcaccctcattgtcaagtgtgggcttctagcttcctacccgatatcgctcaaagagaggaacggtctcagcaggcgtacaagtcccaacatggggagcctctgctaatggagtactcaagacaagagttgctgaggaaggaaagacttgtccttacttctgagcattggcttgtgcttgtgcctttctgggctacttggccctaccaaactctgctcctacctaggcgccatgttcgacgattgcccgaactcaccccggctgagcgggatgatctcgcatccataatgaaaaagttgttaacgaaatatgataatttgtttgagactagcttcccctattctatgggctggcacggagctccaacgggttccgaagcaggcgcaaattggaatcattggcagctgcatgctcattactatcccccattgctgcgcagcgctactgtcaggaaatttatggttggttatgagatgcttgcacaggctcaacgagatctaacgccagaacaagcggccgagaggcttcgagccctcccagaagttcactaccatctcggtcaaaaggatagagaaaccgccactatagct

SEQ ID NO: 12072 - DNA, 1137 bp, Artificial Sequence
  Description of Artificial Sequence: Synthetic coding sequence
atgagtaggtccggaacagatccacagcagcggcaacaggcaagcgaggccgacgctgcagctgcaacctttcgagcgaacgaccaccagcacattcgctataaccccctacaagacgaatgggtcttggtgagcgcccacaggatgaaaaggccatggcagggccaagtggagccccagctactgaagaccgtgccaaggcacgaccctctcaacccactttgtcctggtgccatcagggctaatggcgaagtcaacccacagtacgatagcacttttctgttcgacaatgactttcctgccttgcagccagatgctccctctcccggaccctctgatcaccccctcttccaggcgaagtccgcgcgtggagtgtgtaaggtgatgtgctttcatccatggtccgatgttaccctgccactgatgagcgtgcccgaaatcagagctgtggtggatgcctgggcctcagtgactgaggagttgggcgctcaatatccttgggtgcagatttttgagaataaaggggccatgatggggtgctctaaccctcatccccactgtcaagtctgggcttctagcttcctccctgatatcgcccaacgggaagagaggagtcaacaggcctataagtctcagcacggggaacctttgctcatggagtactcacggcaagagctgctcagaaaagaacgcctcgtgctaacttccgaacattggctggtgctcgtaccgttctgggcaacttggccgtaccagaccctgctgctgccccggagacatgtccgccgcctccccgaattgacccctgccgaacgagacgatcttgcttcaataatgaaaaagctcctcacaaaatatgacaatctcttcgaaacctcctttccatattccatgggatggcacggggctcccaccggttcggaggcaggggctaattggaaccattggcaattgcacgctcattattacccccccctgttgaggtctgcgacagtacggaaatttatggtcggatatgagatgctggctcaagcccagcgtgaccttacacctgaacaggctgccgaacgactgagagccctgcccgaggtgcactaccatctcggacagaaagacagggaaacggcgaccattgcg

SEQ ID NO: 12073 - DNA, 1137 bp, Artificial Sequence
  Description of Artificial Sequence: Synthetic coding sequence
atgtctaggagtgggacagatccacagcagcgacagcaggcctcagaggccgacgccgccgctgcgacgtttagagctaacgaccaccaacatatcaggtataatcccctgcaggacgagtgggtcctggtgtccgctcatcgcatgaaacgcccctggcaggggcaagtggagccccagctcctgaaaacagtaccccggcatgatcccctcaaccccctttgcccaggcgccattcgggcaaacggggaagtaaatcctcaatatgatagcactttcctcttcgataacgacttccctgccctgcaaccggacgccccatcccctggcccttccgaccaccctctgttccaggccaaatcagccaggggggtgtgcaaagtcatgtgtttccatccatggtctgacgtgactctgcctctgatgagcgtgcccgagattcgcgctgtggtcgatgcctgggcctccgtaaccgaggaattgggagctcagtacccctgggtccagatctttgagaataaaggcgctatgatgggatgctctaacccccacccccactgccaggtctgggcgagctcctttctgccggacattgcccagagagaggagcggagccaacaagcgtacaagtcccagcacggcgaaccacttctgatggaatattcccgccaggaacttcttaggaaagaaagactggtgttgacaagcgagcattggttggtcctcgtgcccttttgggctacgtggccataccagactctgcttctgccacgcaggcatgtgcgcagactgccggagctgacgcccgcagagcgggatgatttggcatctatcatgaaaaagctcctcaccaagtatgacaacctcttcgaaacctctttcccatactctatgggctggcacggggctccgaccggatcagaggccggggcaaactggaatcattggcagctgcacgcacactattacccacctcttctcaggtccgccacggtccgaaaattcatggtgggatacgagatgctggcccaggctcagcgggacctgacccccgaacaagctgcggaaagactcagggctctgcctgaggtgcattaccatctggggcagaaagatagagagaccgccacgatcgca

SEQ ID NO: 12074 - DNA, 1137 bp, Artificial Sequence
  Description of Artificial Sequence: Synthetic coding sequence
atgtcaagaagtggaactgatcctcaacaacgtcaacaagctagtgaagcggatgctgctgcagctactttcagagcaaatgatcaccagcatattaggtataatcctcttcaagatgaatgggtgttggtttctgcacatagaatgaaaagaccgtggcagggacaagtagagccacaattgttaaaaactgtgccacgtcatgatccacttaatcccctatgcccaggagccattcgagctaatggagaagttaatccgcaatacgatagtactttccttttcgataacgatttcccagccctgcaacctgatgctccgtcacctggaccaagcgatcacccgctgttccaggctaagagcgcaagaggggtttgtaaggtaatgtgtttccacccatggtccgacgtcactcttcctttaatgtcggtccctgaaatcagggcagtcgtggacgcttgggccagtgtgacggaagaattgggagcccagtatccgtgggtgcaaattttcgaaaataagggagccatgatggggtgttccaaccctcacccgcattgtcaagtttgggcgtcttcgttcctaccagatatagctcaacgagaagagcgcagccaacaagcatacaaaagtcaacacggggaacctttactaatggagtactctaggcaggagctccttcgaaaagaaagattggttctgacaagtgaacattggctagtgcttgttcctttctgggccacatggccatatcaaactcttcttcttccacgtcggcatgtgagacgattaccggaactgactccggctgaacgggatgaccttgcttctatcatgaaaaaactgctcacaaaatacgataaccttttcgagacttcctttccatatagcatgggatggcacggtgcgccaacaggatcagaggctggagccaactggaaccactggcaattacatgcacattattaccccccgcttctgcgttcagccaccgttcgtaagttcatggttggctatgaaatgttggcacaggcacagcgtgaccttacaccagagcaggccgcggaaaggctccgcgccttacctgaagtacattatcatctaggacaaaaagacagagaaacagcaaccatcgcc

SEQ ID NO: 12075 - DNA, 1137 bp, Artificial Sequence
  Description of Artificial Sequence: Synthetic coding sequence
atgagtagaagcgggaccgatcctcaacagaggcagcaggctagcgaggcagacgctgcagctgccactttcagagccaacgatcatcaacacatcagatacaaccccctgcaggacgagtgggttctggtttccgcacatagaatgaaaaggccatggcaaggacaggtggaaccccagctgttaaaaaccgtcccccgccacgacccactcaacccgttgtgcccaggagcaatccgcgcgaacggcgaggtgaatcctcagtacgatagtacctttttgtttgacaacgatttccctgcgttacagcccgacgctccaagccctggcccaagcgaccatccactgttccaagccaaatctgcccgtggagtgtgcaaggtgatgtgctttcacccctggtctgacgtgacattacctctgatgagcgtccctgagatcagggcagtcgtggacgcatgggctagcgtgacagaagaattgggagctcagtacccgtgggtgcagattttcgagaacaagggtgcaatgatgggctgcagcaacccacacccacattgtcaggtgtgggcatccagctttttgccagatatcgcccagagagaagaaaggtctcaacaagcctacaaatctcaacatggcgagcctctgttgatggaatactctaggcaggagctcctgcgaaaggagcggcttgtcttaacgtcagagcactggttggttctggtccccttctgggccacctggccctaccaaactctcttgttacctcgaagacacgtccgaagactgccagagctgacaccagcagagcgcgatgatctggccagcattatgaaaaaactccttacaaagtatgacaacctgttcgaaacatccttcccatatagcatgggatggcacggcgccccaaccggctcggaggccggagccaattggaatcattggcagctccacgctcattactatcccccattgttgaggagtgctacagttcggaagtttatggtgggatacgaaatgcttgcccaagcacagagagacctgacccccgagcaagctgctgagaggcttagagcccttcctgaggtccattaccacttgggacaaaaagatagagagaccgctactatcgcg

SEQ ID NO: 12076 - DNA, 1137 bp, Artificial Sequence
  Description of Artificial Sequence: Synthetic coding sequence
atgtcacgcagtgggaccgatccacaacaacggcaacaggcatccgaagcagacgccgcggcagcaactttccgcgcaaatgatcatcagcatatacggtataacccactgcaggacgaatgggtccttgtgtcggcacatcgtatgaagaggccctggcaaggccaggtggagccccagcttcttaagacggtgcccaggcatgatccgctgaaccctctgtgtcctggagcgattcgggccaacggagaggtgaacccccaatacgatagcacgttcctctttgataatgattttcctgccctgcagcctgatgcaccttccccaggcccatcggaccatccactctttcaggcaaaatcggcacgaggcgtttgtaaggtgatgtgctttcatccctggtcagatgtcaccctgcccctgatgtcggtgcctgaaatcagagctgtggttgatgcttgggcctcggtcaccgaggaactgggagcccaatatccgtgggtgcagatatttgagaacaagggagccatgatgggctgttccaacccacatcctcattgccaagtgtgggcatcttccttccttccagatattgcccagagagaggaaagaagccagcaggcatacaagtcccagcacggtgaacctctgcttatggaatacagcagacaagagctccttaggaaagaacgccttgtccttacctcggagcattggctcgtattggtgccattctgggcgacttggccatatcaaaccctgctcttgcccaggcgacacgttcggaggctccccgagctgactcccgctgaaagggacgatttggcctcgattatgaagaaacttcttactaaatacgataacctctttgaaacctcgttcccttactcaatgggctggcatggggcacccactggttccgaagcaggagcaaactggaaccactggcaactgcatgcacattactaccctcctttgcttcggtcggcaacggtgcggaaattcatggtgggttacgagatgctggcacaagcacaacgcgaccttactcctgaacaggcagcagaaaggttgagagcgctgcctgaagtgcactaccatctggggcagaaagacagggaaaccgcaaccattgca

SEQ ID NO: 12077 - DNA, 1137 bp, Artificial Sequence
  Description of Artificial Sequence: Synthetic coding sequence
atgtcccgcagtggaacagacccccagcaaaggcagcaagcttccgaggcggatgccgcagcggctacatttagagcaaatgaccatcagcatattcgttacaacccattacaggatgaatgggttctggtgagcgcccacaggatgaagcggccatggcaggggcaggtagaacctcagctgttaaaaacagtacctagacatgacccgttgaatcccctgtgtcctggcgctattagagccaacggcgaggttaacccacagtacgattcgaccttcctctttgataatgactttcctgcgctgcagccggacgccccaagccctggcccatctgatcaccccctgtttcaagccaaaagcgcccgaggcgtctgtaaggtgatgtgttttcacccttggtccgatgtgaccctcccactgatgtccgtccctgaaatcagggccgtggtggacgcctgggcgtcagtgactgaagagctgggagctcaatatccatgggtccagattttcgagaacaagggtgctatgatggggtgctccaaccctcaccctcactgccaagtatgggcttcatccttcctgcccgacatcgcgcagcgggaggaacgcagtcagcaggcttacaagagccagcatggagaaccattgctcatggagtattcacgacaggagctcctcagaaaagaacggctggtgttaacctccgagcactggctagtactggttccattctgggccacttggccatatcagacattgctgctccctcggagacacgttaggcgacttccggagctcacacctgcggagcgggacgatctggcttccataatgaagaaactgctcaccaagtacgataatctgtttgagaccagcttcccttatagtatgggatggcatggagcacctacaggtagtgaagccggagcgaattggaaccattggcagctgcatgctcattactatcctcccctgttgcgcagtgccacagtgcgcaaattcatggtgggttatgaaatgctggcccaggcccagcgggacctgacacctgaacaggcggccgagcgccttcgcgccttaccggaggtgcactatcacctcggccagaaggacagagagacagccacgatcgcc

SEQ ID NO: 12078 - DNA, 1137 bp, Artificial Sequence
  Description of Artificial Sequence: Synthetic coding sequence
atgtccagatcaggaaccgatccacagcaacgccagcaagcatcggaggccgacgccgcagctgccacgttccgcgcaaacgaccaccagcatattcggtataatccattgcaggatgaatgggtcttggtgtcggcgcatcgtatgaagcgcccatggcaagggcaggtggaaccacaactgctgaaaactgtcccacgccacgatcctctcaacccactctgtcctggggcaattcgcgcaaacggtgaagtcaacccgcagtatgactccacttttcttttcgacaatgattttccggctctgcaacctgacgctccttcgcctggaccgtcggaccatccactttttcaggcaaagtcggcaagaggagtgtgtaaggtgatgtgtttccatccatggtccgatgtcaccctgcccctcatgagcgtccctgaaatcagagccgtggtggacgcctgggcctccgtgaccgaggagctgggggcgcagtacccttgggtgcagatttttgaaaacaaaggcgcaatgatgggatgttcaaatccgcatccacactgccaagtgtgggcgagctcatttcttccagatattgcacaacgtgaagaacgatcgcagcaggcttacaaatctcagcacggagagccactgctcatggagtattccagacaagaacttttgagaaaagagcgcttggtgcttacttcggagcactggctggtcctggttcctttctgggcgacctggccgtatcaaactctcctgctgcctaggcgccatgtgagacgactcccagagttgactcctgcagaaagagatgatttggcctccattatgaaaaagctcctgactaagtacgataacctttttgaaaccagctttccttactccatgggatggcatggcgcacctactggttcagaggccggcgcgaactggaaccattggcaactgcacgcccattactacccacctctcctcaggtcggcaaccgtccggaagtttatggtgggttacgagatgttggcccaagcccaaagagatctgaccccagaacaagcagcagaaagactcagagcacttcctgaagtgcattaccatctgggacaaaaagaccgtgagacggcgaccatagca

SEQ ID NO: 12079 - DNA, 1137 bp, Artificial Sequence
  Description of Artificial Sequence: Synthetic coding sequence
atgtccagaagcggcaccgatccacaacagcgccagcaagcttcagaggccgacgcagcggccgccacctttcgcgcgaatgatcaccagcatattcgctacaacccactccaagatgagtgggtgctcgtgagcgcgcaccgtatgaaacggccgtggcagggacaggtggagccgcaattgctgaagaccgtacctcgccacgaccctctcaatccgttgtgtccgggcgcgattcgcgcgaatggtgaagttaaccctcagtatgatagcacattcctgtttgacaacgatttcccagcacttcaaccggatgcgccaagccctggcccctccgaccaccctctgtttcaagccaagagcgcccgcggtgtgtgtaaggttatgtgcttccacccgtggagcgacgtgacgttaccgctgatgtccgtcccagagatacgcgccgttgttgacgcatgggcatctgtgacggaagaattgggtgcgcagtacccttgggtgcagatcttcgaaaataaaggtgcgatgatgggttgtagcaacccgcaccctcattgtcaggtgtgggcgagctctttcctccccgatatcgcccagcgcgaagagcgctcacaacaggcctacaagtcgcagcacggtgagccattgctgatggagtactctcgccaagagttgctacgtaaagagcgcctggtgttaaccagcgaacactggttagtgttggtaccattctgggcgacctggccgtatcagacccttttgttgccgaggcgtcacgtgcgtagattgcctgaattgactcccgcagaacgcgacgacttggctagcattatgaagaagttgctaactaagtacgacaatctgtttgagacgagcttcccgtactccatgggatggcacggtgccccaaccggttctgaagcaggagccaactggaaccattggcaactgcatgctcattactaccctccgctgctgagatctgcgacagtcaggaaatttatggtgggttacgagatgctcgcccaagcacagagagacctgaccccagaacaagccgcagaacggctgcgagcgctgcctgaggtccactaccacttgggtcagaaggaccgcgagactgccaccattgca

SEQ ID NO: 12080 - DNA, 1137 bp, Artificial Sequence
  Description of Artificial Sequence: Synthetic coding sequence
atgagtaggtcgggaactgacccccaacagcggcagcaggcctctgaggcagacgccgccgctgctaccttccgcgccaatgatcatcaacacattcggtataacccactccaggatgagtgggtgcttgtgtcagcgcacagaatgaaaagaccttggcagggccaggtagagccacagctgctaaagaccgtgccaaggcacgacccactgaatcccctctgcccgggcgcgattcgcgcaaatggggaagttaaccctcagtatgatagtacatttctattcgacaacgatttccctgccttgcagccagatgctccctcacctggcccttctgaccatccactatttcaggcaaaatcggccagaggcgtttgtaaggtgatgtgttttcatccgtggtccgatgttactcttccactgatgtctgtgccagagatccgggccgtggtggacgcttgggcctctgtaaccgaagagctcggggcccagtacccatgggtgcagattttcgagaataagggcgccatgatgggctgtagtaacccccatccgcattgccaggtatgggccagttcatttctgcctgacatcgctcagagggaagagcggagccagcaagcttataaatcccagcacggagagcctctcctgatggagtactcccggcaagagcttcttagaaaggagcggttagtgctaaccagcgaacactggctggtgctcgtgcctttttgggctacatggccctaccagacgttgctgctgccgcggagacacgtgaggcgtttacccgagttgaccccggccgagcgcgacgatctggcgagcattatgaaaaagctgcttactaaatatgacaatctctttgaaacttcctttccgtattccatgggctggcacggtgcccccacgggctccgaggctggagccaattggaaccactggcaactccatgcccattattacccacccctgcttcggtccgcgaccgtgcggaaattcatggtaggatatgaaatgttggcccaggcccagcgggatctgaccccagagcaggcggcggaacgcctgcgggctctgccagaggttcactaccatttagggcagaaggatcgcgagactgctacgatagct

SEQ ID NO: 12081 - DNA, 1137 bp, Artificial Sequence
  Description of Artificial Sequence: Synthetic coding sequence
atgtctaggtctggaacggatccgcagcaaagacagcaggcttctgaagctgacgccgcagcagcaacctttagggctaacgaccatcagcacattaggtataacccactccaagatgagtgggttctcgttagcgctcatcgcatgaagagaccttggcagggacaggtggagccacagttgctgaagacagtcccaagacatgaccccctcaatccactgtgtccgggcgccatacgcgctaacggagaagtgaatccacaatatgactccaccttcctttttgataatgatttccctgccctgcaacctgatgccccctccccaggaccaagcgaccatccattattccaagctaagtctgctagaggagtatgtaaagttatgtgctttcacccttggtctgatgtaaccctgcctttgatgtcagtgcccgagataagggccgtggtggacgcctgggcctcggtcacagaagaactcggggctcaatacccttgggtgcagattttcgaaaacaaaggagcaatgatggggtgcagcaaccctcatcctcattgccaggtgtgggcctcgtctttcctgcctgatatcgctcagcgagaggagaggagccagcaagcatataaatcccagcatggtgagcctttgctgatggagtacagcagacaggaactcctgagaaaagagaggttagtccttacttccgagcattggctggtgcttgttccgttctgggctacctggccctaccaaacactactcctgcctcgtcgccatgtgcggcgattgcctgaactgacccccgccgagagggatgatcttgcctctattatgaaaaaattgctgacaaaatacgacaacctgttcgagaccagcttcccctattctatgggatggcacggcgcccccactggaagcgaagcaggggctaattggaaccactggcagcttcatgcgcactactacccccctttacttcgaagcgccacggttcggaagttcatggtcgggtatgaaatgctggctcaggcccaacgggacctcacccccgaacaagctgctgagagactccgtgctcttcccgaggtgcattaccatctgggtcaaaaggatagggagacagctactatcgcc

SEQ ID NO: 12082 - DNA, 1137 bp, Artificial Sequence
  Description of Artificial Sequence: Synthetic coding sequence
atgtcacgatctggcacagatccacagcagcgacaacaagccagcgaggccgacgccgctgctgccacgtttcgtgccaacgatcaccagcatatcaggtacaatcctctgcaggacgaatgggtgcttgtgtccgcccatagaatgaaacgcccctggcaggggcaagtcgagcctcagctcctgaagaccgtccctcgtcatgatcccttgaacccactgtgtcctggcgcaatccgggccaacggcgaagtcaacccccagtatgatagcactttcctatttgacaacgacttccccgccctacaacccgacgccccctcacctggcccttccgaccacccactttttcaggccaaatccgccaggggggtgtgcaaggtcatgtgttttcatccctggagcgacgtcaccctgcctctgatgtctgtgcctgagataagggccgtggtcgacgcatgggcaagcgtgaccgaagaactaggcgcgcagtacccttgggtacagatttttgagaataagggcgcaatgatggggtgtagcaacccccatccccactgccaagtgtgggctagctcattcctccccgatattgcacagcgtgaggaaaggtctcagcaggcatacaagtctcagcacggagaacccctcctcatggagtattcaaggcaggaactcctgagaaaggagcgactagtgctcacctccgaacactggctggtgctggtgcccttttgggctacttggccgtaccagactcttttgctgcccagacgacatgtgcgccggttgcctgagttgacacctgccgaacgcgatgatctggcctccataatgaaaaaattgctgacaaaatacgacaacctctttgaaacatcattcccttatagtatgggctggcacggggcccctaccggaagcgaggcaggcgcgaactggaaccactggcagctgcatgcccattattatcctcccctcctgcgctctgctaccgtgcgaaaattcatggtgggttacgaaatgctcgcacaagcccaacgcgatctgactcccgaacaggccgcagagcggcttcgcgctctgcctgaggtccactaccacctcgggcagaaggacagagagaccgccacaatcgcg

SEQ ID NO: 12083 - DNA, 1137 bp, Artificial Sequence
  Description of Artificial Sequence: Synthetic coding sequence
atgagtaggtcaggtactgatcctcagcagagacagcaggcgagcgaagcggatgctgccgccgcgacgttccgagctaatgatcatcagcacataaggtacaaccctctgcaggacgaatgggttctggtgagcgcccatcggatgaaaagaccctggcaaggccaggtggagccccagctgctgaagactgtgcccagacatgacccactgaatcccctgtgccccggcgccatacgagccaacggagaggtcaacccccagtacgattctaccttcctgtttgataatgacttcccagcactgcaacccgacgcgccctcccccggacccagtgatcatccgcttttccaggccaagtcggccagaggggtctgtaaagtaatgtgctttcacccttggagcgacgtcacactcccgcttatgtcagtaccagagattcgcgccgtggtggatgcctgggcaagcgtaacagaggaactcggagcccagtatccatgggtgcagatcttcgagaacaaaggcgccatgatgggatgtagtaacccccaccctcactgccaggtgtgggctagctcattcttgcccgatatagcccaacgagaagaaagatcccagcaggcctacaagtcacagcatggcgaaccactgttaatggaatactcccgacaagagcttctccgaaaggagagactggtgcttaccagtgaacattggctggtcctggtgccattttgggctacctggccctaccagactctcctcttacctcgtagacatgtgcggcgactgcctgaactcacccctgcggagagagatgacctggctagcatcatgaagaagctgctgactaaatatgacaacctcttcgagacctccttcccctactcaatgggttggcacggtgccccgaccgggtccgaggcaggtgcaaactggaaccactggcagttacacgcccattattatccccctctcctgcgatctgctaccgtccgcaaatttatggtgggttacgagatgcttgcgcaggcccagcgcgatttgaccccagaacaagcggcggaaaggctgagagctctccccgaagttcactatcacctcggacagaaagaccgagagacggctacaatcgct

SEQ ID NO: 12084 - DNA, 1137 bp, Artificial Sequence
  Description of Artificial Sequence: Synthetic coding sequence
atgtcccgtagtggaaccgacccccagcaacgtcagcaggcctctgaagccgatgccgcggcagccaccttccgagccaacgatcaccagcatatacgctacaatcccttgcaagacgagtgggtgttggtatctgctcatagaatgaagaggccttggcaggggcaggtcgagccacagctactgaaaacggtgcctcgccatgacccattgaaccctctatgtccgggcgcgatcagagctaacggcgaggtcaacccgcaatacgactcaacttttttgttcgataacgacttccctgctctccagcccgacgcacccagccctggacctagcgaccatcctctcttccaagctaagagcgcccgcggcgtgtgcaaagtgatgtgttttcatccttggtcagacgtaaccctgccccttatgtcagttcctgaaatacgagctgttgttgacgcctgggcttctgtcaccgaagagctcggcgcccaatatccttgggtgcagatttttgaaaataagggggccatgatggggtgctccaatccgcatccccactgtcaggtatgggctagctccttcttgccagacatagctcagcgagaggagcggtctcagcaggcatacaagtctcagcacggcgagcctctgctaatggagtattcaaggcaagaactgctcaggaaggagcggctcgtcctaactagtgaacattggcttgtattggtgcctttttgggccacttggccttatcagaccttgttgctcccgcgccggcatgtgaggaggctgcctgaactcacaccagccgagagagacgatctcgcatccatcatgaaaaaactgctcactaagtacgataacttattcgaaacgagctttccttattctatgggttggcacggggccccaacaggctctgaagccggagctaattggaaccactggcagctacacgcgcactattacccccccctgctgcgctcagccacagtgcggaagtttatggttggctacgagatgctcgcacaggctcagcgtgacctaacacctgaacaggccgccgagcgactgagagccctgccggaagttcattatcatctcggacaaaaggatcgagaaactgcgaccatcgct

SEQ ID NO: 12085 - DNA, 1137 bp, Artificial Sequence
  Description of Artificial Sequence: Synthetic coding sequence
atgtctcgaagcggaacggacccccagcaacgccaacaagctagcgaggctgatgctgctgcggcaacgtttagagctaatgatcatcagcatattcgatataacccgctgcaggatgagtgggtgctggtctcggctcatcgcatgaagcgaccttggcagggtcaagtcgagcctcagctactaaagactgtccctcgccacgacccattgaatcccctgtgcccgggcgccattcgcgcaaatggtgaggtgaatccccagtacgactctacatttctttttgacaacgactttcccgctctccagcctgatgctcccagcccggggccatctgaccacccactgttccaggctaaaagtgctaggggggtatgcaaggtaatgtgtttccacccatggtccgatgtcacactgcccctgatgagtgtgccagagatacgcgctgtagttgacgcctgggcttctgtgacagaggagctgggcgcccagtacccttgggttcagatatttgaaaataagggcgctatgatggggtgttccaaccctcaccctcactgccaggtgtgggccagctcctttttacctgacattgctcagcgcgaggagcggtctcaacaagcttataaatcacagcatggagagccgcttcttatggagtactcgcggcaggagcttttgagaaaggaacggctggtcctaaccagcgaacactggcttgtcttggtccccttctgggcaacctggccctatcaaaccctgctgctgccaagaaggcatgtgagacgccttccggaattgacccctgccgaacgcgacgacctggcctctatcatgaagaagctgctgacaaaatacgacaacctgttcgaaaccagcttcccatattctatgggctggcatggggcccctaccggcagtgaagctggggcaaactggaatcactggcagctccacgcgcactactatcctcctctcctccgttcagctacagttaggaagtttatggtaggctatgaaatgcttgcacaggctcagagagacctcacccccgaacaggcggccgagaggctgagggcactgcccgaagttcattaccatctgggtcagaaggatagggaaaccgcaaccatcgcc

SEQ ID NO: 12086 - DNA, 1137 bp, Artificial Sequence
  Description of Artificial Sequence: Synthetic coding sequence
atgagtcgcagcggtactgaccctcagcaaagacagcaggctagcgaggccgacgctgcagccgctacctttcgagctaacgatcaccagcatatacgatataaccccttacaggatgaatgggtcctagttagcgcacaccgaatgaaaagaccctggcagggccaggtggaaccccagctattaaagacagtgccacgtcatgaccctctgaatccactgtgcccaggcgctattagagcaaatggggaagtgaatccacagtacgactctaccttcctatttgacaacgatttccccgcactccagccagatgcacctagccctggcccaagtgatcatcccttgttccaagctaagtcagccagaggcgtttgcaaggttatgtgcttccacccctggagcgatgtgacacttcctctgatgtccgtccccgagatacgcgccgtggtggacgcatgggcctcagttactgaggagctgggcgcccagtacccatgggttcaaatcttcgagaataagggtgctatgatgggctgttccaatccccatccacattgtcaagtttgggcatccagctttctgcctgatatagcacaacgggaagaaaggtctcaacaggcttacaagtctcaacacggcgaaccactcctgatggagtattctcggcaggaacttctcagaaaggagcgacttgtgctaacttccgaacattggctggttctcgtgccattttgggcaacatggccttaccagaccctgctcctgccaaggaggcatgtgcggaggctgcccgaactgactccagcagagcgagacgatcttgcatcaattatgaagaagctgttaactaagtacgataatttatttgaaaccagcttcccttatagcatggggtggcatggtgccccaaccgggtctgaggctggagccaactggaaccactggcagctccacgcccactattatccaccactgctacggagtgctaccgtcagaaagttcatggtggggtatgagatgttagctcaggcccagagggacctaacaccagagcaggccgctgaaaggttaagagccctccctgaagtgcattatcaccttggacagaaagatcgagaaaccgctacaatcgcc

SEQ ID NO: 12087 - DNA, 1137 bp, Artificial Sequence
  Description of Artificial Sequence: Synthetic coding sequence
atgtcccgctcaggaaccgatccacagcaaagacaacaagcttccgaggctgatgccgctgctgccacatttagggctaatgaccatcagcatattaggtataatccgctgcaggatgagtgggttttagtatcggcgcatcggatgaaaaggccatggcaagggcaggttgaacctcagctgttgaaaacggttccgcgtcatgatcccctgaatccgttgtgcccgggagctattcgcgcaaacggagaagttaatcctcaatatgatagcacgtttttattcgataatgactttccagcactgcaaccggatgctccgtctccgggacctagcgatcatccgttgtttcaggctaaatccgcacgaggagtgtgcaaagtaatgtgctttcatccttggtcagatgtcacactgcctttgatgtcggttccggaaatacgcgctgtcgtcgacgcgtgggcgtctgtcacagaagagctgggtgctcaatacccttgggttcagatcttcgaaaacaaaggtgccatgatgggctgttcgaatccccacccgcattgccaggtctgggctagcagttttctcccggacatcgcgcagcgtgaagaaaggtctcagcaagcgtataaaagtcagcatggagaaccactgcttatggagtattcacggcaagaacttcttagaaaagaacgccttgtactcacctcagaacattggcttgtactggttccgttctgggcaacatggccgtaccaaaccttgctgcttccaaggcgccatgttcggcggcttccggaattaacacctgccgaacgcgatgatctggcgtcaatcatgaaaaaactcttaactaaatatgataatcttttcgaaacatcatttccgtatagtatgggttggcacggagcaccaacagggagtgaagcgggagctaactggaaccactggcaactgcatgcgcattattaccctccattgctgcggtctgcgacagtccgcaaatttatggtaggatacgaaatgctagcccaggcgcaacgcgatcttacgccagaacaggcagccgagcgcctgagggcgctcccggaagtccattaccatcttggacagaaagatagagagactgccacgatcgca

SEQ ID NO: 12088 - DNA, 1137 bp, Artificial Sequence
  Description of Artificial Sequence: Synthetic coding sequence
atgtcaagatccggtaccgatccacagcaacgccagcaggctagcgaagctgatgccgctgctgctacctttagagctaacgatcaccagcacataaggtacaaccctcttcaggacgaatgggttcttgtgtccgcccaccgtatgaagaggccttggcagggtcaggttgagccacaacttctcaagactgtgcccaggcatgatcctcttaatccattgtgccctggtgccatcagggctaacggtgaggtaaacccacagtatgactctacttttttgttcgacaacgacttccccgctctgcaacctgatgctccatcaccaggtccatctgaccaccctctctttcaggccaagagcgcaaggggagtttgtaaggtcatgtgcttccacccatggtcagatgtgactctgcctctgatgtctgtccccgagatcagagctgtcgttgacgcttgggccagcgtcaccgaggaactgggcgctcagtatccttgggtgcaaatttttgagaataaaggcgccatgatgggctgttcaaaccctcatcctcattgtcaagtgtgggcttctagttttctgcccgatatcgcacagcgcgaagaacgttcccaacaagcttacaagtctcaacacggtgagcctctgctcatggagtactccaggcaggaattgctgcgcaaggagcgtctcgtcttgacatccgaacactggctcgtcctggtgccattttgggctacatggccttaccagactctgttgctgcctcgccgccatgtgaggaggctccctgaactgactcccgcagagagagacgacctcgcctccatcatgaagaaactcctcaccaagtacgacaacctctttgagaccagttttccttactcaatgggttggcacggtgctcctaccggcagcgaagctggagcaaactggaaccactggcaactgcacgcccactactaccctccactgctgagatccgccactgtgaggaagtttatggtgggttatgagatgctggctcaagcccagcgtgatctcactccagagcaagccgccgagcgcctgcgcgccctgcctgaagtccactatcacctgggccagaaggaccgtgaaacagccaccattgca

SEQ ID NO: 12089 - DNA, 1137 bp, Artificial Sequence
  Description of Artificial Sequence: Synthetic coding sequence
atgtcccgatctggaactgacccgcagcaacgccaacaggcgagcgaggccgatgctgccgctgccaccttccgggcaaacgaccatcaacacatcagatacaatccgcttcaagatgagtgggtccttgtgtctgcacaccgcatgaagcggccatggcagggacaggtggagccacagctgctcaaaactgtgccccggcatgatccgctgaacccactttgcccgggtgctattcgcgcaaatggagaggtgaacccgcaatacgattcaaccttcctgtttgacaacgatttccctgcactgcagccggacgctccgtcaccgggcccttccgatcatccactctttcaggctaaaagcgccaggggcgtgtgtaaggtcatgtgcttccacccatggtcggacgtgaccctgcccctgatgtcggtcccggaaatcagggctgtggtggacgcgtgggcgtcggtgaccgaagagctgggtgcccagtatccatgggtgcagatcttcgaaaacaaaggggccatgatgggctgctcgaacccgcatcctcactgccaggtgtgggccagctcgtttctgccggacattgctcaacgggaggaaaggtcccagcaagcatacaagtcacagcacggggagccgctgctcatggagtactcccggcaggaactgctgcgcaaagaaagactggtcctgacctcggaacattggctggtgctcgttccgttctgggctacgtggccgtaccagaccctgctgctgcctcgcagacatgtccgccggttgcctgagctgactccagccgagagggacgacttggcctcgatcatgaagaagctgctgacgaagtacgacaacctgttcgaaacttcattcccatacagcatgggatggcacggtgccccgactggatctgaggcgggagcaaactggaaccattggcagctccacgcgcactactatccgccacttctgcggtcggcaactgtgcggaagtttatggtgggatatgaaatgttggcgcaagcccagcgggacctcactccagaacaggcagcagaacgcctcagggcgctgccggaagtgcactaccacctcggacagaaagatagggagactgccactatagct

SEQ ID NO: 12090 - DNA, 1137 bp, Artificial Sequence
  Description of Artificial Sequence: Synthetic coding sequence
atgtcacgtagtgggaccgacccccagcaaaggcagcaagccagtgaggccgacgccgccgccgcaaccttccgtgcgaatgaccaccagcatatcagatacaatccactccaggacgaatgggtattggtctcagctcaccgcatgaaacggccttggcagggccaggtggagccccagctattgaaaacagtcccacgccatgatcccttaaaccctctttgcccgggcgctatcagagctaacggtgaagtcaacccccagtacgattcaacttttttatttgacaatgatttcccggctctccaaccagacgccccctctcccggccccagtgaccacccactcttccaggccaaaagtgcgcgaggggtctgcaaagttatgtgctttcacccatggtcagacgtgaccttgcccctgatgtctgtgccagagattagagccgtggtagacgcgtgggctagtgttacggaagaactgggcgcccagtacccctgggtgcagatatttgaaaataaaggggctatgatgggatgttctaatcctcatcctcactgccaggtgtgggctagtagcttcctccccgacattgctcagagggaggaacggagtcaacaggcctacaaatcccagcatggggagccacttctcatggaatactcgcggcaggaactgctaagaaaagagagacttgtgctgacaagtgagcattggctggttttggtccctttttgggctacctggccataccagaccctcctcctcccccggcggcatgtgaggcggctgcccgaacttactccagctgaacgagacgacctggcttctatcatgaaaaagctgctgaccaaatacgataacctgttcgagacctcctttccatactccatgggttggcatggagctcctactggtagcgaagccggcgccaactggaatcactggcagctacatgcccactattatcctcctctgctccgaagtgccaccgtgagaaaattcatggtcggatatgaaatgcttgcgcaggcacagagagacttgacacccgagcaggccgctgagcgactgagggccctgcccgaggtccattatcatcttggccaaaaagaccgggagaccgccactatcgcc

SEQ ID NO: 12091 - DNA, 1137 bp, Artificial Sequence
  Description of Artificial Sequence: Synthetic coding sequence
atgtctaggtctggtacagacccgcagcagcgccagcaggcctccgaagccgatgccgccgcggccacttttcgcgcaaatgaccatcaacacattcggtacaatcctctccaggatgagtgggtgctcgtgtccgctcatcgtatgaaaagaccttggcagggccaggttgagcctcagctcctgaaaaccgtgcctcggcatgatcccctgaaccccctatgccccggagccatcagggccaacggagaagtcaacccgcagtatgacagcacgttcctgttcgacaacgacttccccgctctgcagcctgacgcaccctcacccggaccaagcgaccacccattattccaagccaaaagtgcacggggagtgtgcaaggtgatgtgttttcatccctggagtgacgtgaccctgcctctcatgtcagtacctgagatacgggccgtagtagacgcttgggccagcgtgacggaggagctgggcgcccagtacccatgggtgcagatctttgagaacaagggggcaatgatggggtgtagcaatccccacccccactgtcaggtttgggcaagctcgtttctccccgacatcgcccagagggaggagcgctctcagcaggcctataagagccaacatggcgaacctctgctgatggaatatagccgccaggagctgctccggaaagagcgtcttgtcttgacctcagaacattggttggtgttggttccgttctgggctacatggccctaccaaacactattgctgcctcgacgacatgttcggcggttgcccgaactcacccccgctgaaagagacgacctcgcttctataatgaagaaactcctgacgaaatatgataacctgttcgagacaagtttcccttactcaatgggctggcacggggcccctacgggctctgaggctggagccaattggaaccactggcagctgcacgcccattattaccctcctctgctgagatccgccacagtacggaagtttatggtgggttatgagatgttggctcaggcccagcgggacctaacaccggagcaagcggctgaaagattgagagccttacctgaggtgcattatcatctgggacagaaggatcgagaaactgctacaatcgcc

SEQ ID NO: 12092 - DNA, 1137 bp, Artificial Sequence
  Description of Artificial Sequence: Synthetic coding sequence
atgtcacgctcgggaactgatcctcaacaaagacagcaagcatccgaagccgatgcagcagcagctaccttccgcgcgaacgatcaccagcatattcgatacaaccctctgcaggacgaatgggtgcttgtgtcagcgcatcgcatgaagcgcccttggcagggccaagtggagccccagcttctgaaaactgtgcctagacatgatcccctgaatcctttgtgtcccggcgcgattcgagcgaacggggaagtgaatccacaatacgattcgacttttctttttgacaacgattttcctgcactgcaaccagatgcaccgtcccccggtccctcggatcaccctcttttccaggccaagtcggcacggggagtgtgtaaagtgatgtgtttccatccttggtcagatgttactctccctctcatgtcagttccagaaattcgcgcagtcgtcgatgcatgggcctcagtgactgaggagctgggagcacagtacccatgggttcaaatcttcgaaaacaagggggccatgatgggttgctccaacccacatcctcattgccaggtctgggcatcgtcctttcttcccgacatcgcgcagcgcgaagagagatcacagcaagcatacaagtctcagcatggtgagcctcttctgatggaatattcgaggcaggaacttctgagaaaagagagacttgtccttacttccgaacattggcttgtcttggtgcccttctgggcaacctggccttaccaaaccttgcttcttcccaggagacatgtgcgtaggctcccggaacttacccctgccgagcgagatgatctggccagtattatgaagaaactgcttaccaaatacgataatctgtttgaaaccagctttccttacagcatgggttggcatggggcgccgaccggttccgaagcgggcgctaactggaaccactggcagctgcacgcgcactactaccccccactgctgcggtccgcaaccgttcgtaagtttatggttgggtacgagatgttggcccaggcccaaagggacctcacgccagagcaggctgcagaacgtttgcgcgcactcccggaagtccactaccacctgggtcaaaaagaccgggaaacggcgactatcgca

SEQ ID NO: 12093 - DNA, 1137 bp, Artificial Sequence
  Description of Artificial Sequence: Synthetic coding sequence
atgtcgcgttcgggtacggatccgcaacaacgacaacaagcgtcggaagcggatgcggcggcggcgacgtttcgtgcgaatgatcatcaacatatacgttataatccgttacaagatgaatgggtattagtatcggcgcatcgtatgaaacgaccgtggcaaggtcaagtagaaccgcaattattaaaaacggtaccgcgacatgatccgttaaatccgttatgtccgggtgcgatacgtgcgaatggtgaagtaaatccgcaatatgattcgacgtttttatttgataatgattttccggcgttacaaccggatgcgccgtcgccgggtccgtcggatcatccgctatttcaagcgaaatcggcgcgtggtgtatgtaaagttatgtgttttcatccgtggtcggatgtaacgttaccgctaatgtcggtaccggaaatacgtgcggtagtagatgcgtgggcgtcggtaacggaagaattaggtgcgcaatatccgtgggttcaaatatttgaaaataaaggtgcgatgatgggttgttcgaatccgcatccgcattgtcaagtatgggcgtcgtcgtttttaccggatatagcgcaacgtgaagaacgttcgcaacaagcgtataaatcgcaacatggtgaaccgctattaatggaatattcgcgtcaagaattattacgtaaagaacgattagtactaacgtcggaacattggctagttttagttccgttttgggcgacgtggccgtatcaaacgttactactaccgcgacgtcatgtacgtcgtctaccggaattaacgccggcggaacgtgatgatttagcgtcgataatgaaaaaattactaacgaaatatgataatctatttgaaacgtcgtttccgtattcgatgggttggcatggtgcgccgacgggttcggaagcgggtgcgaattggaatcattggcaactacatgcgcattattatccgccgctattacgatcggcgacggtacgaaaatttatggttggttatgaaatgctagcgcaagcgcaacgagatttaacgccggaacaagcggcggaacgtctacgtgcgctaccggaagttcattatcatttaggtcaaaaagatcgtgaaacggcgacgatagcg

SEQ ID NO: 12094 - DNA, 1137 bp, Artificial Sequence
  Description of Artificial Sequence: Synthetic coding sequence
atgagccgcagcggtaccgatccgcaacaacgccagcaagcgtcggaagcggatgctgccgccgcaacttttcgcgcgaacgatcaccagcatatccgctacaatccgctgcaggacgaatgggtccttgtgtccgcccaccgcatgaagcggccatggcagggacaggtggagccgcaactgctgaaaactgtgcctagacatgacccactcaacccactgtgtccaggagccatcagggcgaacggagaggtgaacccgcagtacgactcaactttcctctttgacaatgacttcccagcactgcagccggacgcccccagcccgggtccgtctgaccatccgcttttccaggccaagtccgcgaggggagtctgcaaagtgatgtgcttccatccttggagcgacgtcactctgcctctcatgtccgtccccgaaatccgggctgtcgtcgacgcgtgggcatcggtgactgaagaattgggagcgcaatacccgtgggtccagatcttcgaaaacaagggtgccatgatgggatgttccaacccccatccacactgccaagtgtgggcatcgagctttctccctgacatcgcccagagagaggagaggtcccagcaggcgtacaagtcccaacacggcgaacctttgctgatggaatattcccgccaggaactgctccgcaaggaacgcctcgtgctgacgtccgaacattggctggtcctggtgccgttctgggccacttggccgtaccaaaccctgctgctcccacgccgacacgtgcggcggctgccagaactcacccctgccgagcgggacgaccttgccagcatcatgaagaagttgctgaccaaatacgataacctgtttgaaacctcctttccatactcgatgggctggcatggcgccccaactggatctgaggcgggtgccaactggaatcactggcagctccacgcccactactatccgccactcctgagatcggcaaccgtgaggaaattcatggtggggtacgaaatgcttgcccaggcacagcgggacctgaccccagaacaggcggccgagcggctgagggcgcttcccgaggtgcactaccacttgggccagaaagacagagaaactgcgactatcgcc

SEQ ID NO: 12095 - DNA, 1137 bp, Artificial Sequence
  Description of Artificial Sequence: Synthetic coding sequence
atgtcgaggagtggtaccgatcctcagcagcggcaacaggcttcagaagcagacgccgcagcggcaacgtttcgggccaacgaccaccagcatattaggtataatccccttcaggatgaatgggtcctagtaagtgcacatcgcatgaagaggccgtggcagggccaggttgaacctcagctacttaaaaccgttccccggcatgatccgctcaatcctctctgcccgggcgccatacgcgccaatggcgaggtgaacccacagtacgacagcacgtttctcttcgataatgacttccctgctctgcaaccagatgctccttcccccggaccctctgatcaccccttgttccaagcaaaatcggctcgaggagtatgcaaagtgatgtgttttcatccttggtccgatgtgacgctacctctgatgagcgtcccagagataagagccgtagtggacgcttgggcgtccgtaactgaggagctgggtgcgcaatacccctgggtccagatttttgaaaacaagggagccatgatgggttgtagcaatcctcatccccattgtcaagtttgggcttcctcttttctgccagacattgcccaacgagaagagagatcccagcaggcatataagagtcagcatggggaacctctactgatggagtatagtcgccaagagctcctcaggaaagaacgcctggtgcttacgtcggagcattggctggttcttgtcccattctgggcaacgtggccttaccagaccctgctgctcccgcgccggcatgtgaggcggctgcccgaattgacgcctgcggaacgagacgacctggcaagtataatgaagaagctccttactaagtacgataatctgtttgaaacatccttcccctacagcatgggttggcacggcgcacccactggctctgaagcaggagctaactggaaccactggcagctacatgcacactactacccacctctgctcagaagtgctacggttcggaaatttatggtgggctacgaaatgctagctcaagcccaaagggatttgacgcctgagcaggcagcagagcgcttacgggcactgccagaggtacactaccacttggggcagaaggatcgagagacagccaccatcgcc

SEQ ID NO: 12096 - DNA, 1137 bp, Artificial Sequence
  Description of Artificial Sequence: Synthetic coding sequence
atgtcacgcagcggaaccgacccccagcaaaggcagcaggcttccgaagctgacgcagctgcagcaacattccgggcaaacgatcatcaacatataagatacaacccgttgcaggacgagtgggtgctagtctccgcccacagaatgaaacgaccatggcaaggtcaggtcgaaccccagctactcaaaaccgtacccagacatgatcccctgaacccactgtgtcccggagctattcgggccaatggggaagtcaatccacagtatgattctacatttctgttcgataacgacttccctgccctgcagcccgacgcaccaagccccggcccttccgaccaccccttgttccaagctaagtctgctagaggcgtctgcaaagtcatgtgcttccatccctggtcagatgtgaccctgccactaatgtcagttccagagatcagagccgtggtagatgcttgggcctccgtgaccgaggagctaggcgcccagtatccttgggtacagatcttcgagaataagggcgcaatgatggggtgctctaatccacatccacactgccaagtctgggccagttccttcctgcccgacatcgcccagcgggaggagaggtcacagcaagcctataagtcacaacatggcgaacccctgttgatggaatatagccgacaggaactcctccgaaaggaacggcttgttctcaccagcgagcactggctcgttctagtccctttctgggctacctggccctaccagacccttttgctgcccagaaggcacgtgcgaaggctgcccgagctgaccccagccgaaagggatgatctggcctctatcatgaagaaacttctaacgaaatacgataacctattcgaaacgtcttttccttactctatgggctggcatggagctcctacgggaagcgaggcgggcgctaattggaatcactggcagctgcatgctcattattacccccctttgttacgatcagctacagtgagaaagtttatggtcggatacgaaatgttggcacaggcccagcgggatttaacaccagagcaagcagccgagcgtttgcgcgcgttgccagaagtgcactaccatttggggcagaaggatagggaaactgctaccattgcc

SEQ ID NO: 12097 - DNA, 1137 bp, Artificial Sequence
  Description of Artificial Sequence: Synthetic coding sequence
atgtcgcgatctggaaccgaccctcaacaaaggcagcaggcatcggaagccgatgcagcagcagcaaccttcagggccaatgaccaccaacatattcgctacaatcctctgcaggatgaatgggtgcttgtgtcagcacatcgtatgaagaggccttggcagggtcaggtggaaccccagttgcttaagaccgtccctcgccacgatcccctgaacccactctgtccaggagcaattagagcaaatggcgaggtcaatccacaatacgacagcacgtttctgttcgataacgatttcccggccctgcaaccggacgcaccatcgcctggtcccagcgatcaccccttgtttcaagccaaatcggcccgtggagtgtgtaaggtgatgtgttttcatccctggtcggacgtcaccctgccgctcatgtccgtgcctgaaatccgggcggtggtggacgcatgggcatcggtcaccgaggaactcggggcacaatacccttgggtccagattttcgaaaacaagggagcgatgatgggttgttcgaaccctcatccccattgtcaagtgtgggcatcgtcctttctgcctgacatagcacaaagagaggagcgatcccagcaggcatataagtcacaacatggagagcctctcctgatggaatactcccgccaggagttgctgcggaaggagaggctggtccttacgagcgagcattggcttgtcctcgtcccattttgggcgacctggccttaccaaaccctcctcctccctcgccggcatgtccgtagactgccagaattgactccagcggaacgagacgatctcgcatccattatgaagaagctccttaccaaatacgataacctcttcgagacttcgtttccttacagcatgggatggcatggagcaccaactggcagcgaggcaggcgcgaactggaaccattggcagctgcatgcccactattaccctcctcttttgcggtcagcgactgtgagaaagtttatggtcggctacgagatgctggcacaagcccagcgcgatctcaccccagagcaagcggcagaaagattgcgggcactgccggaagtgcactaccacctgggacaaaaggaccgcgagactgcaaccattgca

SEQ ID NO: 12098 - DNA, 1137 bp, Artificial Sequence
  Description of Artificial Sequence: Synthetic coding sequence
atgtccaggtcggggacagatccacaacaacgccagcaagcatcagaggcagatgcggcagccgccacattccgggcaaacgaccatcagcatattcgttataatcctttgcaggacgagtgggtactcgtttcagcccaccgcatgaaacgaccgtggcaaggacaagttgaacctcaattgctcaaaactgtcccgagacacgatcccttgaaccccctatgccccggtgcgattcgtgcgaacggcgaggtgaaccctcagtatgactctacatttttatttgataacgactttccagccttgcaacctgacgctccgagcccgggtccctccgaccatccactttttcaggcgaagtccgcccgcggggtctgtaaggttatgtgttttcatccgtggtctgacgtgaccttgcccctcatgagtgtaccagagatccgggcggtagttgatgcatgggcaagtgttacagaagagttgggggctcagtacccctgggttcagatttttgaaaacaaaggagccatgatggggtgcagtaacccacacccacactgtcaagtttgggcctcgtccttccttccagacatcgctcagcgagaggagagaagccagcaagcctataaatctcaacatggtgagccactactcatggagtactccaggcaggaattactgcgaaaagagagactggtcttaacaagcgagcattggctcgttctcgttccattctgggctacgtggccataccagacgctactgctcccgcgacgacatgtcagaaggcttccagaacttacccctgcagagagggacgatctggctagtataatgaaaaagctgttgactaagtacgataacctttttgagacgagcttcccctacagcatgggatggcacggcgcaccgaccggcagtgaagctggcgcgaattggaaccattggcaacttcatgctcattactaccctccgttgctccgaagcgctacagtccgcaagttcatggtcggatatgaaatgctggcgcaggcacagcgggaccttacccccgaacaggctgcggaacgacttcgggccttgccagaggtgcattatcacctggggcaaaaggatagagagactgcaaccattgcg

SEQ ID NO: 12099 - DNA, 1137 bp, Artificial Sequence
  Description of Artificial Sequence: Synthetic coding sequence
atgtccagatcggggaccgatcctcagcagcgccaacaggcttcggaggctgatgctgctgcagctacctttcgggcaaatgatcatcaacacattcgctacaatccgctgcaagatgaatgggtgcttgtgtccgcccatcgcatgaagaggccgtggcagggacaggtggaaccccaactgctcaagaccgtccctcggcacgacccgctcaaccctctctgcccgggggcaatccgggccaacggcgaggtgaaccctcaatacgacagcacctttctcttcgacaatgatttccctgccttgcagcctgacgctccttcgccgggcccgtccgatcacccactgtttcaagctaagtccgcgcggggcgtctgcaaggtgatgtgcttccacccctggtcggatgtcaccctgccactgatgagcgtcccggaaatcagagctgttgtggacgcttgggcatctgtgaccgaagagctgggcgcgcaatacccatgggtccagatcttcgaaaacaaaggtgccatgatgggatgttccaacccccatccgcattgtcaggtgtgggcttcctcatttctgccggacattgctcaaagggaggagagatcacagcaggcttacaagtcgcagcatggagagccccttctcatggaatactcccgccaggaactcttgcggaaggagcgcctcgtcctgacctcggaacactggttggtgctggtgccgttctgggcgacgtggccgtaccagactcttctgctcccacgccgacacgtccgtaggctgccggaattgactccggcagagagagacgatctcgcttcaatcatgaagaagctcctcaccaaatacgacaatctgttcgaaacctcattcccgtattcaatgggatggcatggcgccccaaccgggtctgaggccggagctaactggaatcactggcaactccacgcccactattacccaccgctccttagatccgcgaccgtgcgcaagttcatggtggggtacgagatgctcgcacaagcacagcgcgacctgacgccagaacaggccgcggaacgactgcgggcgctgccggaagtgcattaccatctgggccaaaaagaccgggaaaccgccactatagcc

SEQ ID NO: 12100 - DNA, 1137 bp, Artificial Sequence
  Description of Artificial Sequence: Synthetic coding sequence
atgagcagatcaggaactgatccgcaacaacgccagcaggcatcggaggctgatgctgcggctgcaaccttccgcgctaacgaccaccagcatatcagatataacccgttgcaggacgaatgggtgttggtatcggcccatcggatgaagcggccgtggcaaggccaggtggaaccgcaactgctgaaaacggttccacgccatgatcctctgaatccactgtgtccaggcgcgatcagggcaaatggagaggtgaacccgcagtacgactccacgtttctgttcgataatgatttcccagccctccaaccagacgctccgtcacctggccccagcgaccatcctctctttcaggcaaaatccgcgaggggcgtgtgcaaagtcatgtgcttccacccgtggagcgacgtgactctcccgctgatgagcgttccagaaatccgcgccgtggtcgacgcatgggcttccgtgactgaggaactcggagcccagtacccttgggtgcagatattcgagaacaagggagccatgatgggttgttcaaatccgcacccgcattgccaggtctgggcatcgtcgtttctcccggatatcgcgcagcgggaagagcggagccagcaggcctacaaatcccaacatggcgaacccctcctgatggagtacagcagacaggaactgctgcgcaaagagcgtctcgtcctgacgtcggagcactggctggtccttgttcccttctgggcaacctggccgtatcagacgttgctgctgccacgcaggcacgtgagacgcctcccagagcttacccctgccgagcgggatgacttggcatccatcatgaagaagctgctgactaaatacgacaatttgttcgaaacttcattcccttattcgatgggatggcacggtgccccgactgggagcgaagcaggagctaactggaaccattggcaactgcatgcccattactacccgcctcttctgcggagcgcgactgtgcgaaagttcatggtcggatacgagatgttggcccaagctcaacgggatctgaccccagaacaggccgcggaaagactgcgggctctgcctgaggtgcactaccatctcggccagaaggaccgcgaaaccgcgaccatcgct

SEQ ID NO: 12101 - DNA, 1137 bp, Artificial Sequence
  Description of Artificial Sequence: Synthetic coding sequence
atgtctaggtcaggaaccgacccacagcaacgacagcaggcatcagaagcagacgcagctgcagcaacctttagggcgaatgatcaccagcacatcaggtacaatcctcttcaagatgaatgggtgctcgtgtcagcacatcgcatgaaaagaccgtggcaaggccaggtggagccacagcttctgaaaaccgtgcctcgccatgatccgctgaacccactttgcccgggagctattcgcgctaacggagaagtcaacccacagtacgatagcacttttctgtttgacaacgactttccagcactccaacccgacgcaccctctccagggccttccgatcatcctctgttccaggcaaaaagcgcaaggggagtctgtaaagtcatgtgttttcatccttggagcgatgtgaccctgcccctcatgtccgtccctgaaattcgagccgtggtcgatgcctgggcaagtgtgactgaagagcttggagcacagtacccgtgggtccagatcttcgagaacaagggtgcgatgatgggatgttcgaaccctcatccgcattgtcaggtgtgggcctcgtcatttctgcccgacattgcacagcgtgaagaaagatcgcagcaagcatataagtcgcagcatggggaaccattgcttatggagtattccaggcaagaacttttgcggaaggaacgcttggtacttacctctgagcattggctggtcctcgtccccttctgggctacttggccataccaaactcttctgctgcctcggagacacgtgaggagactgcccgaacttactccagcagagcgggatgacctggcatcgattatgaagaagctgttgaccaagtacgataatctgttcgaaacttcgtttccttattccatgggatggcacggtgcacctactggttccgaagcgggggccaattggaatcattggcaactccatgcacattactaccctccactcctgagatcggccactgtgcgaaagtttatggtcggatacgaaatgctcgcacaagcgcagcgcgatctcacccctgagcaggcagccgagcggctcagggctcttcccgaagtgcattaccatttgggccaaaaggaccgcgaaaccgccaccatagcc

SEQ ID NO: 12102 - DNA, 1137 bp, Artificial Sequence
  Description of Artificial Sequence: Synthetic coding sequence
atgagtcggagcggaacagatccgcaacagaggcagcaagcctctgaagctgatgccgcggccgcaacattccgcgccaacgatcaccaacatatccgctataatcccctgcaggacgagtgggtgttggtgtccgctcaccggatgaaaaggccctggcaggggcaggtcgaaccccagctgctgaagaccgtccctcggcatgaccccctgaatcccctttgcccaggtgccatccgtgccaatggggaggtcaatcctcagtatgatagcacttttctgttcgataatgatttcccagcattacagccagatgctccatcgccaggcccatctgatcatccactgttccaggctaagagtgcaaggggtgtctgcaaagtgatgtgtttccatccttggtcggacgtgacgctgccgctaatgtctgtacccgagatcagggctgtagtcgacgcttgggcctctgtgacagaagagcttggcgctcagtatccttgggtgcaaatttttgagaataagggagcaatgatgggttgcagtaacccccatcctcactgtcaggtttgggcctcaagctttctgccagacattgcacagagggaagagagatctcagcaggcctacaaaagccagcacggagaacccctcttaatggaatattcacgccaggaattgctccgcaaagaaagattagtccttacttctgagcactggttagttctggtccccttctgggccacctggccttaccaaactttgttattgcccaggagacatgtcagacggctgccagagttaacccccgccgaaagggatgatctggcttctattatgaaaaaactgctgaccaaatacgacaacctgtttgaaacatctttcccttatagtatgggttggcacggcgctccaaccgggagcgaagcgggggccaactggaaccattggcagcttcatgcacactattacccccctctcctccgaagcgccacagtgagaaagtttatggttggatatgaaatgcttgctcaagcgcaaagggacttaacgcctgaacaggcagcggagagactacgggcacttccggaggttcactatcacctaggccagaaagatagagaaacagctaccatagcc

SEQ ID NO: 12103 - DNA, 1137 bp, Artificial Sequence
  Description of Artificial Sequence: Synthetic coding sequence
atgtccagatccggtaccgaccctcagcaaagacaacaagcctccgaagcagacgctgcggccgcaacgtttagggcaaacgaccatcagcacatccggtacaacccactgcaagacgagtgggttctcgtcagcgcacacagaatgaaacgaccttggcaaggtcaggtcgagccccagctcctcaagactgtccctcgacatgaccctcttaacccactgtgccccggtgcaattagagcaaacggtgaggtgaatccacaatacgattcgacgtttctctttgataatgactttccagcacttcaacccgatgcaccctctcctgggcctagcgatcatcctttgttccaggcgaagtcagcgcgtggcgtgtgcaaagtgatgtgttttcacccctggtcggatgtgaccctgccactcatgtccgtgccggaaatcagagcagtcgtggacgcgtgggcttcggttaccgaagaacttggggcacaatacccttgggtacagattttcgagaataagggggccatgatgggatgtagcaaccctcatcctcattgtcaggtgtgggcatcgtcatttcttccggacatagcacagcgcgaggaaagatcccagcaggcatacaagtcgcaacatggtgagccactgctgatggaatactcgcgccaagaactgcttcggaaggaacgtcttgtgctgacgtcggaacactggctggtccttgtgccgttttgggctacttggccttaccaaacgctgcttctccctcgtcgccacgtgcgaaggctgccagaactgacgcctgccgaaagggatgatctcgcaagcattatgaagaagctgcttacgaagtatgataacctctttgaaacctcgtttccatactcgatgggatggcatggggcaccgactggatccgaagccggcgcaaattggaaccactggcaactgcatgcacactactaccctcccctcctccgtagcgccactgtgcgtaagtttatggtcggatacgaaatgctggcacaggcacaacgtgatttgactccagagcaggcggcagaaaggcttagagcattgccagaggtgcattaccatctgggacagaaagatcgggaaacggctaccattgct

SEQ ID NO: 12104 - DNA, 1137 bp, Artificial Sequence
  Description of Artificial Sequence: Synthetic coding sequence
atgtcgaggtcgggaactgatccccaacaacgccaacaggcatcagaggcggatgcagccgcggcaacttttagggcaaatgatcaccagcatatccggtacaacccactccaagatgagtgggtgcttgtctccgcgcatcgcatgaaaagaccttggcagggacaagtggaaccgcagctgttgaaaaccgtgcctaggcatgatcctttgaaccccctttgtccaggcgccatccgcgcaaacggtgaagtcaatcctcaatacgattcgacgtttctgtttgacaatgattttcccgcactccaaccagacgccccatcgcctgggccctcggatcatcctctgtttcaagcaaaaagcgcaagaggcgtgtgcaaggtgatgtgttttcatccgtggtccgatgtcaccctgcctctcatgagcgtccctgaaattagagcagtggtggatgcctgggcctcagtgaccgaggagctcggtgcgcagtacccctgggttcagatctttgagaataaaggggccatgatggggtgctccaacccgcacccacactgtcaggtgtgggcatcgtcattcctgcctgacatagcacaacgcgaagaaagaagccaacaggcttacaagtcgcagcatggtgagcccctgctgatggaatacagccgccaagagctcctgcgcaaggaacgcctcgtgcttacttcggaacattggctggtgctcgtcccattttgggcaacttggccataccaaactctcctgctgccacggcgtcatgtgagacggttgcctgaactcactcccgcagaacgcgatgatcttgcaagcatcatgaagaaactgctgaccaagtacgataatctgtttgaaacgtcgttcccttactcaatgggctggcatggtgcacccaccggttctgaggcaggtgccaattggaaccattggcagcttcacgcccactactaccctccgctgcttagaagcgccaccgtgaggaagtttatggtcggatacgaaatgctcgcacaagcccagcgcgatcttacccctgaacaagctgcggagagactgcgtgcactcccagaagtgcactaccatcttggccaaaaggatagggaaaccgcaactatcgct

SEQ ID NO: 12105 - DNA, 1137 bp, Artificial Sequence
  Description of Artificial Sequence: Synthetic coding sequence
atgtcgcgctctgggacggaccctcagcagcggcagcaggcctcggaggcggatgccgcagcagcgaccttccgcgccaacgaccaccagcacatccgctacaaccctttgcaggatgagtgggtgctcgtctcggcccacagaatgaagcgaccatggcagggtcaagtggaaccacagctcctgaaaactgtgccgagacatgacccgctgaacccactctgtcccggagctatcagggcgaatggcgaagtgaacccgcaatacgattcgacctttctgttcgataacgacttcccggctctccagccggacgctccgtcccctggcccatcagatcatccactgttccaagctaaatcagctagaggagtgtgtaaagtgatgtgctttcatccatggtccgatgtgactctcccactgatgtctgtccctgaaatcagagctgttgttgacgcttgggcctcggtcactgaagaactcggcgcacaatacccttgggtgcaaatcttcgagaacaagggtgccatgatgggatgctcaaacccgcatccacactgccaggtgtgggcatcctcgtttctcccggatatcgcccagcgcgaggaacgcagccagcaggcttacaagtcgcagcatggcgaaccgctgctgatggaatactcaagacaggaactcttgcggaaagaacgccttgtcctcacttcggaacattggctggttctggtccctttctgggcgacctggccgtaccagaccctgcttctgccgagaaggcacgtgcggagactgcccgaactgactccagccgaacgcgacgacctcgcttcaatcatgaagaagctgcttactaagtacgacaacttgtttgagacgtcgttcccttatagcatgggctggcacggagccccgaccggatccgaagccggagctaattggaaccactggcaattgcatgcacattactatccgccgcttctgcgctcggccactgtgaggaagttcatggtcggatacgaaatgttggcacaagcccagcgcgacctcactccagagcaagcagcggaacgcctgcgggccctcccagaggtccactaccatctgggacagaaagaccgcgaaaccgcaacgatcgcg

SEQ ID NO: 12106 - DNA, 1137 bp, Artificial Sequence
  Description of Artificial Sequence: Synthetic coding sequence
atgagccgctcaggaacggacccacaacagagacaacaggcatccgaggctgacgcggcggcggcaacctttagggcgaatgaccatcaacacataaggtacaaccctctgcaggacgaatgggttctcgtgagcgcacacaggatgaaaagaccttggcaaggacaggtggaaccgcagctgctcaagaccgtgccaaggcacgaccctctgaaccctctttgcccaggagccatcagagccaacggcgaggtcaacccgcagtacgacagcacctttctgttcgacaacgatttcccagccctgcagcctgatgcaccaagcccaggcccctcggatcatccgctttttcaagcaaaatcggcgcgcggagtgtgcaaagtgatgtgcttccatccatggagcgatgtcactctcccattgatgtccgtgccggaaatcagagctgtggtggacgcctgggcctcagttactgaagagctcggagctcagtacccgtgggtgcagatcttcgagaacaagggagctatgatgggctgcagcaacccgcacccgcactgccaggtctgggcctcgtctttcctgccagacattgcccagcgggaagaacggtcccagcaggcttacaagtcgcaacacggagaacctctcttgatggaatactcccgccaggaactcctccgaaaggagcgtctggtcctgacttcggagcattggcttgtccttgtccccttctgggccacctggccataccagactttgttgctgccgcgcagacacgtgcggcgcctgccagaactgaccccggccgagagggatgatcttgcttcaatcatgaaaaagctcctgactaagtacgataaccttttcgagactagcttcccgtacagcatgggatggcatggtgcacccaccggctccgaggccggagcaaactggaatcactggcaacttcatgctcactactatccaccgctgctgcgctcggcaaccgttagaaagtttatggtcggatacgaaatgcttgcacaggctcagcgcgatctgactcccgagcaggcggctgagcgcctcagagccttgccagaagtgcattaccatctgggacagaaggatcgcgaaacggcgaccattgcc

SEQ ID NO: 12107 - DNA, 1137 bp, Artificial Sequence
  Description of Artificial Sequence: Synthetic coding sequence
atgagccgatcaggcactgatcctcagcaacgccaacaagctagcgaagccgacgcagccgcagcaactttccgggctaatgaccaccagcatataagatataaccccctgcaggacgagtgggtgttggttagtgctcaccgaatgaaacgaccctggcagggacaggtcgagccccagcttttgaaaaccgtcccgagacacgatcctctcaatcccctctgtccgggtgcgattcgcgccaacggcgaggtcaaccctcagtatgactctacctttcttttcgacaacgacttcccagcactgcagcctgacgccccgagtcccgggccttcagatcatccactattccaggcaaaaagcgcccgcggagtgtgtaaggtgatgtgctttcacccatggagcgatgtaacactgcccctgatgtcagtgccagagattcgcgcggtagtggatgcctgggcctccgttaccgaagagttgggggctcagtatccatgggttcagatcttcgagaacaaaggtgcgatgatgggatgctccaaccctcatccacactgtcaggtctgggcctcaagctttcttccagatattgcccaaagagaagagcggagtcagcaggcatataagtcacagcacggagaaccactattgatggaatatagtcgtcaggagttgctccgaaaagagaggctcgtgctcactagtgaacattggctcgttctggtcccattttgggcaacctggccgtatcagaccctgctgctaccccggcgccacgtccggaggctgccggaattgacccctgctgagcgcgatgatttagcttctattatgaaaaaactgctgactaaatacgataatttgtttgagactagttttccctactcaatgggctggcacggggcacccaccggaagcgaggcaggggcaaattggaaccattggcagctccacgcgcactattatccgccccttctgcgtagcgccacggtgaggaaattcatggtgggttatgaaatgctcgcacaggctcaacgggacttgactcccgaacaagcagccgagaggctgagggctctacccgaggtgcattaccatctgggacaaaaagatagagagacagcaactattgcc

SEQ ID NO: 12108 - DNA, 1137 bp, Artificial Sequence
  Description of Artificial Sequence: Synthetic coding sequence
atgtcacgttccggtaccgatccacaacagcgtcagcaagccagcgaggcggatgccgccgccgccacgttccgcgctaatgaccaccagcacatccggtacaaccccctgcaggacgagtgggtcctggtctctgcgcatcgcatgaagaggccgtggcaaggacaggtcgagccccaacttctcaagaccgtcccccgtcacgacccacttaacccactgtgtcccggtgcgatccgtgccaacggtgaggtcaaccctcagtacgactccacctttcttttcgataatgatttccctgcacttcagcctgatgccccctctcccggtccaagcgatcaccccctgttccaagctaagtcggctcggggcgtatgcaaggtgatgtgctttcacccctggtcggacgtcaccctgcctctcatgtccgtcccggagattcgtgccgtggtggatgcttgggcttccgtcactgaggaattgggtgctcagtacccctgggtccagatctttgagaacaaaggcgccatgatgggctgctcgaacccccacccccactgccaggtctgggcgtcgagcttcctccctgacatcgcccagcgcgaggagcgctcccagcaggcctacaagtcccagcacggggagccgttgttgatggagtactcaagacaagaattgcttcgaaaggagcgcctcgttcttactagcgagcattggctggttctggttcctttttgggctacctggccctaccagaccctcctactcccgcggcggcatgtgcgtcgactgccggaattgactcccgccgagcgcgacgacctcgctagtattatgaagaaactgcttacaaagtatgacaatctcttcgagaccagctttccttactctatggggtggcacggagccccaactggctcagaagccggcgcgaactggaatcactggcagctgcacgctcattactacccgccgctcctcagaagcgccaccgttcggaagttcatggtcgggtacgagatgctggcgcaggcccaacgcgatctgacacctgaacaggccgccgagcgtcttcgggccctgcccgaggtacactaccacctgggtcaaaaggaccgggagaccgccaccattgcg

SEQ ID NO: 12109 - DNA, 1137 bp, Artificial Sequence
  Description of Artificial Sequence: Synthetic coding sequence
atgtcgcggagcggaactgacccccagcagcgccagcaagccagcgaggccgacgcggcagctgccacgtttagagcaaacgatcaccagcatatccgctacaacccgttgcaggacgagtgggtgctggtcagcgcacaccgcatgaagcgcccatggcaagggcaagtggagcctcagctgcttaagactgtgccaagacacgatccgctcaacccactgtgtccaggagccattagggccaacggggaggtgaatccgcaatacgatagcactttcctgtttgataatgatttcccggcgctccagccagacgccccttcgccggggccatccgatcacccactgtttcaggctaagtcggcaagaggagtttgcaaggtgatgtgctttcacccatggtccgacgtgaccctgccgttgatgtccgtcccggagatcagggcggtggtggatgcctgggcaagcgtgactgaggaactgggagcccagtacccctgggtgcagatcttcgaaaacaagggcgctatgatgggttgctcaaacccccacccgcactgtcaagtgtgggcctcttccttcctccccgacattgcacaacgggaagaacggagccagcaggcatacaaatcccaacatggagagccgctgcttatggaatactcgaggcaggaactgctgagaaaggaacgcctggtgctgacttccgagcattggcttgtgctggtgccgttctgggctacttggccgtaccaaaccctcctgcttcctcggcggcacgttaggcgcctgccagaactgaccccggcggagcgcgacgatctggcctccatcatgaaaaagctgctgactaaatacgacaacctcttcgaaacctcgtttccttactcgatgggctggcatggtgccccgaccggatccgaagctggagccaactggaatcactggcagctccacgcacactactaccccccgcttctgcgtagcgctactgtgaggaaattcatggtgggctacgaaatgctggcccaagcgcagagagacttgacgccggaacaagccgcagaaagactgcgggcgctgccggaagtgcattaccacctgggacagaaggaccgggagactgctactatcgcc

SEQ ID NO: 12110 - DNA, 1137 bp, Artificial Sequence
  Description of Artificial Sequence: Synthetic coding sequence
atgtctcgatccggtactgaccctcaacaacgccagcaggcatccgaagctgatgcagcggctgcaacttttagagcgaacgatcatcaacacatcagatacaatcctcttcaggacgagtgggtgctcgtcagcgcgcaccgcatgaagaggccgtggcaaggccaggtggaaccccaactgctgaaaacggttcctaggcatgatcccttgaatcctctctgcccaggagcaattcgggcaaacggggaagtgaacccccaatatgactcaacgtttctcttcgacaatgacttccctgcactgcaacctgacgcgccttcaccaggtccatcagatcatcctcttttccaagctaagtcggcaaggggggtctgcaaagtcatgtgttttcatccttggtcggacgtcactcttcctttgatgtcagtcccggaaataagagcggtggtggacgcatgggcatcagtcaccgaagagctcggcgcgcagtacccttgggtgcagattttcgagaacaagggagcgatgatgggttgttcgaacccacatccgcactgccaagtgtgggcctcgtcattcctccctgacatagcacaacgggaagaacgaagccaacaggcatacaagtcgcaacacggagagcctctgcttatggagtactcgagacaggaactgttgagaaaggaacggcttgtgttgacttccgagcattggcttgtgctcgtgcctttctgggccacttggccataccagacccttctgcttccgcggcgtcatgtgcgtagactcccagagctgaccccagcagaacgtgatgaccttgcttcgattatgaaaaaacttctcactaaatacgataacttgtttgaaacctcgtttccctacagcatgggatggcatggagcaccgaccggaagcgaagcaggggcaaactggaatcactggcagctccacgcacattactaccctccattgctgcggagcgcaaccgtgcggaagttcatggtgggctacgaaatgctggcccaagcgcaaagggaccttaccccggagcaagccgctgagcgattgagagcactgccagaagtgcactatcatcttggtcaaaaagatagagaaactgcaacgattgca

SEQ ID NO: 12111 - DNA, 1137 bp, Artificial Sequence
  Description of Artificial Sequence: Synthetic coding sequence
atgagccgttcaggaactgatccacaacaaagacaacaagctagtgaagctgatgctgcagctgcaacttttcgtgctaatgaccatcaacatattcgttataatccattacaagatgaatgggttttagtttctgcacacagaatgaaaagaccatggcaaggacaagttgaaccacaattacttaagacagttcctagacatgatccattaaatcctttatgtcctggagcaattagagccaatggagaagttaatcctcagtatgactcaacatttctttttgataatgattttccagcattacaaccagacgctccttcccctggaccatcagatcatcctttatttcaggctaaatctgcacgaggtgtttgtaaagttatgtgttttcacccatggtcagacgttactcttccattgatgtctgtaccagaaataagagcagtcgttgatgcttgggcaagtgttacagaagaacttggagcacaatatccatgggttcaaatatttgaaaataaaggtgcaatgatgggatgttcaaatcctcatcctcattgccaagtttgggcatctagtttccttccagatattgcacaaagggaagagagatcacaacaagcatataaatctcaacatggagaaccattattaatggaatattcaagacaagaattattaagaaaagaaagacttgttctaacatcagaacattggttagtcttagttccattttgggcaacatggccatatcaaacattacttcttccaagacgacatgttagaagacttccagaattaacaccagcagaaagagatgatttagcttctattatgaaaaaattattaaccaaatatgataatttatttgaaacatcatttccatacagtatgggttggcatggtgctccaacaggatcagaagctggtgccaattggaatcactggcagttacatgctcattactatccaccattgttaagatcagcaacagttcgtaaatttatggttggatatgaaatgttggctcaagctcaaagagaccttacaccagaacaggctgcagaaagattaagagcacttccagaagtacattaccatttaggtcaaaaggatagagaaacagctacaattgct

SEQ ID NO: 12112 - DNA, 1137 bp, Artificial Sequence
  Description of Artificial Sequence: Synthetic coding sequence
atgtctcgtagtgggaccgaccctcaacagcgtcagcaggcctctgaagcggatgccgctgctgccacatttcgtgctaacgatcaccaacacatccggtataacccccttcaagacgagtgggtcttagtgtccgcccatcgcatgaagcggccttggcaaggacaggttgagccacaactcctgaaaactgtaccacggcatgatcctctaaaccccttgtgtcccggcgctatacgcgccaacggcgaggtgaacccgcagtacgatagcacattcctgttcgacaacgactttcctgcacttcaaccggatgcaccgtcccccggcccgagcgaccatccactttttcaagctaaatccgcacgtggtgtgtgcaaagtcatgtgttttcatccgtggagcgacgtgactctcccactgatgagtgtccctgagatacgcgctgtggttgatgcttgggcatctgtgactgaagagctgggggcacagtacccttgggtgcagattttcgagaacaaaggtgccatgatgggttgcagcaacccacatcctcattgccaggtctgggcgtctagtttcctacccgacattgcccagagagaggagcgatcccagcaggcgtataagtctcaacacggcgagcccctactcatggagtattctcgtcaggagctgctgcgaaaagagagattggtgttgacttctgagcattggctggtgctcgtaccgttttgggcaacgtggccttaccagactctgctgttgcctcgtcgccatgtgagacgcctgccggaacttacaccagctgaaagagatgaccttgcatctataatgaaaaaattgttgacgaagtacgataatctgttcgagacttccttcccatatagcatgggctggcacggcgcgcctaccggttctgaggccggcgccaattggaaccactggcaacttcatgcccactattacccccccctcctacggtcggccaccgttaggaaattcatggtgggatacgagatgcttgcccaggcacagcgcgatttgacaccggagcaggctgctgagcgcctcagagcgcttccagaggtccactatcatctgggacaaaaggaccgcgaaacagcgacgatcgcg

SEQ ID NO: 12113 - DNA, 1137 bp, Artificial Sequence
  Description of Artificial Sequence: Synthetic coding sequence
atgtctagaagcggcacggacccgcagcaaaggcagcaagccagtgaggcggatgccgctgctgccacatttcgcgcgaatgaccatcagcatatccgctacaacccactgcaagatgagtgggttcttgtctcagcccacaggatgaagaggccctggcagggccaggttgagccgcagcttctcaagactgtgccccgccatgaccctctcaaccctctttgtccaggcgctatcagagctaacggtgaggtaaacccccaatacgattctactttcctgtttgacaacgacttcccagctctgcagccggatgctccctcaccgggaccctccgaccatcccctgtttcaagcgaaatctgcgaggggtgtgtgcaaggtgatgtgcttccacccatggtccgacgtcactttgccgttgatgagcgttcctgagatccgcgccgttgtggatgcatgggcctctgtgactgaggaacttggcgctcagtacccctgggtgcagatctttgaaaacaaaggtgccatgatgggttgctccaatcctcatccccattgccaggtatgggctagctcattcctccccgatatcgctcagagggaggagcgcagtcaacaagcgtacaaatcccagcatggcgagcctttgctgatggagtacagtaggcaggagctgctgagaaaggaacgcctggtcctcacttccgaacactggctggtgctggtgcccttttgggcaacttggccctaccagacactcctgttgccacgcagacacgtgcgccgcctgcctgagttgacccccgcggagcgcgatgatcttgcctccatcatgaaaaagctgcttactaaatatgataacctgttcgagacctctttcccgtactccatgggttggcatggagctccaactggcagcgaagccggtgcaaactggaaccactggcaactgcatgcacactactatcctcctctcctgagaagcgctacagtaagaaagttcatggtcggctacgaaatgctggcacaggcccagagagacctcactccagaacaggccgctgagaggctcagggcgctcccggaggtccactatcacttgggccagaaagaccgcgaaaccgccacaatcgcc

SEQ ID NO: 12114 - DNA, 1137 bp, Artificial Sequence
  Description of Artificial Sequence: Synthetic coding sequence
atgagtagaagcgggactgatccccagcaaagacaacaggcatccgaagccgatgcagccgcagcaacctttagagccaacgatcatcagcatatacgatacaatccattgcaggacgaatgggtgctggtttcggcccatcggatgaagcgcccttggcaagggcaggtggaacctcagttgctcaaaactgtacccagacatgatccccttaatcctctttgtcctggggcaatccgcgctaacggcgaggtgaaccctcaatacgactcaacctttctgttcgataatgattttcctgcactgcaacccgacgcaccgagtcctggaccgagcgaccatcctctcttccaagcgaagtccgctcgaggagtgtgcaaagtgatgtgtttccacccctggtcggatgtcaccctcccgctcatgtcagtgccagaaattagagcagtggtggatgcatgggcaagcgtgaccgaggagctgggtgcacaatacccttgggttcagatttttgaaaacaaaggtgcgatgatgggatgcagcaacccccatccgcactgtcaagtctgggcatcatcgttcctgccagatatcgcacagagggaagaaaggagtcaacaagcgtataagtcccagcacggtgaacccctgctcatggaatatagcagacaagaacttttgcgaaaggaaaggttggtcctgacgtccgagcactggcttgtgcttgtgcctttttgggcaacttggccttaccaaacccttctgctcccccgtcgccacgtgcggcgactgccggaactcacccccgcagagcgcgatgacctcgccagcattatgaagaagctgcttaccaaatacgataacctttttgagacttcgttcccatactcgatgggctggcatggagcacctaccggttccgaagcaggagcgaactggaatcattggcagctgcacgcccattactacccccctctgcttcgttcggcgacggtccgcaagtttatggtcggatacgagatgttggcccaagcacagcgggaccttaccccagagcaagcagcagaacgccttcgggctctcccagaagtccattaccaccttgggcaaaaggacagagagactgccactattgca

SEQ ID NO: 12115 - DNA, 1137 bp, Artificial Sequence
  Description of Artificial Sequence: Synthetic coding sequence
atgtctagatcgggtactgatccccagcagcgccagcaagcttccgaggctgacgctgcagctgcaaccttccgcgccaatgatcatcagcacatcaggtataaccccctccaggacgaatgggtgctcgtgtccgcccacaggatgaaacggccatggcaggggcaggttgagccgcagttgctgaaaactgtgccaagacacgaccccctcaaccctctgtgtcctggcgccattcgggctaatggtgaggtcaatccacagtatgattctacatttctcttcgataatgacttcccagcactccaacccgacgccccttctcccggcccgagcgaccatccattgttccaggccaagagtgcgcggggtgtgtgtaaagttatgtgttttcacccatggagcgatgtcaccctgccactaatgtccgtgcccgagatacgggcagtcgtagacgcatgggctagcgtgacagaggaactcggcgcccaatatccctgggtccagatttttgagaacaagggggcgatgatgggctgcagcaatccacatcctcattgccaggtgtgggcctctagctttctacccgacatcgcccagcgtgaggagcggtcacagcaggcctataaaagccagcacggagaacctctcctcatggagtattcaagacaggaactgctccgtaaggagcggctggttctgacatcagaacattggctggtcttagtacccttttgggccacttggccttatcagactctcttgctccctcgacgacacgtgaggcgcttacctgagctgacaccagcagaacgggacgacctagcatcaattatgaagaagcttttaaccaaatacgataacctcttcgaaaccagctttccctactcaatgggatggcacggggccccaactgggtccgaggctggcgccaactggaaccactggcagctgcacgcgcattactatcctccactactgcgttccgccactgtgcggaagttcatggtgggttatgagatgctggcgcaggcccaaagagaccttacccctgagcaggcagccgagcggctgagggcactgcccgaggttcattaccacctgggccaaaaagacagagagacggcaacaatcgca

SEQ ID NO: 12116 - DNA, 1137 bp, Artificial Sequence
  Description of Artificial Sequence: Synthetic coding sequence
atgtccagatcagggactgacccacaacaacgccagcaggcttcggaagctgacgctgccgccgcgaccttccgggcgaacgatcaccagcacatccgctacaatccgctgcaggacgaatgggtcctcgtctcggcgcatcggatgaaacgcccgtggcagggccaggtcgagccacaactgctcaagaccgtcccgcgccacgacccgctcaaccccttgtgtcctggcgccatcagggcaaatggagaggtgaacccacaatacgattcaactttcctgttcgacaacgatttcccagcccttcagccagacgcaccatcaccaggaccgtccgaccacccactgttccaggcaaagtcagcaagaggcgtctgtaaggtcatgtgctttcacccgtggagcgacgtcacccttccgctcatgtcggtccccgaaatccgggcagtcgtggatgcatgggcctccgtgaccgaggaactgggagcacagtacccatgggtgcagatctttgagaacaaaggagcgatgatgggatgctcgaatccgcatccgcactgccaggtgtgggctagctccttcctccctgatatcgcccagcgggaggagaggtcccagcaggcttataagtcgcaacacggggagccactcttgatggagtacagccgccaggaactgctgcggaaggagcgccttgtgctgacttcggagcattggctcgtgctggtccctttctgggcgacttggccgtatcagactctccttctgcctaggcgccacgtgagacgcctgcccgaactgaccccggcggagcgggacgatctcgctagcattatgaagaaactgctgaccaagtacgataatctctttgaaacctctttcccgtactcgatgggctggcacggagccccgactgggtctgaagccggggctaactggaatcattggcaacttcacgcccattactacccgcccttgctgcggtcggcaaccgtacggaagttcatggtgggatacgagatgctggcccaagcccagcgcgacctcacccctgagcaggccgcggagagactccgggcactcccagaggtgcactaccatctgggccagaaggaccgggaaacggccaccatcgct

SEQ ID NO: 12117 - DNA, 1137 bp, Artificial Sequence
  Description of Artificial Sequence: Synthetic coding sequence
atgtcccggtccgggacagatccacagcaacgtcagcaggcctccgaggcagacgccgccgctgccacttttcgagccaacgatcatcagcatatacgatacaatcctctgcaggatgaatgggtcctggtatcggctcaccggatgaagcgaccctggcaaggacaggttgagcctcagttgctcaaaaccgttcctagacacgaccctctcaatcctctgtgtcccggcgctataagagccaatggggaggtcaatcctcaatatgactcaacattcctgttcgacaatgactttccagccctccagcctgatgcccccagcccagggccttctgaccaccctctgtttcaagctaaatcggctaggggagtctgcaaggtgatgtgtttccatccgtggagcgacgtgacattgccgctcatgagcgtcccagaaatccgggccgtggtggatgcctgggcctcagtgacggaggaactgggggctcagtacccctgggtgcagatcttcgagaacaaaggtgccatgatgggatgttcaaacccacacccccattgccaagtgtgggcatcttcctttctgcctgacatcgcacaacgggaagaaaggtcacaacaggcatataagtctcagcatggggaaccactgttgatggaatactcccgccaggagttgttgcgtaaggagagactggtactgacaagcgagcattggttggtccttgtgcccttctgggcaacctggccctatcaaaccctgctgctgccacggagacacgtaaggaggcttccggagctcacacccgctgaaagggacgacctggccagcattatgaagaaacttctgacaaagtacgacaacctcttcgagacctccttcccgtacagcatgggctggcatggcgcccccactggtagcgaggctggcgccaattggaatcactggcaactgcacgcacattattacccccctttgcttagatcggccactgttcgaaagttcatggtgggctacgagatgctggctcaagcccagcgggatttaacaccggagcaggccgccgagagattaagggccctgcctgaagtccattatcatctcggccagaaagacagggaaaccgctaccatcgca

SEQ ID NO: 12118 - DNA, 1137 bp, Artificial Sequence
  Description of Artificial Sequence: Synthetic coding sequence
atgtcccgctcgggtaccgacccgcagcagcgccagcaagcctccgaggccgacgcagccgcagccaccttccgggccaatgaccaccaacacatccgctacaacccgctgcaggacgagtgggtcctcgtgtcggcgcatcgcatgaaaagaccgtggcaagggcaggtcgaaccgcagctccttaaaactgtgccgcggcatgaccctcttaacccattgtgtccgggagccatccgcgccaacggcgaggtgaacccgcagtacgactccaccttcctcttcgacaacgacttcccggccctccagccagatgctccgtcgccgggcccctccgatcatccgctgttccaggccaagtcagcgagaggtgtgtgcaaagtcatgtgctttcatccatggtccgatgtgactcttcctctgatgtcggtgccggaaatccgggcagtggtggatgcatgggccagcgtgactgaggagctgggtgcccagtacccgtgggtccaaatctttgagaataagggagccatgatggggtgttcaaacccccacccgcactgccaagtgtgggcctcctcgttcctcccagatatcgcccagagagaagaaagatctcagcaggcttacaagtcgcagcacggggaaccgctgctgatggaatactcaagacaagaactgctgcgcaaagaacggctcgtcctcacctcggagcactggctggtgctcgttccgttctgggcaacgtggccttaccagaccttgttgctgccgcggagacacgtgcgcagactgccggagcttaccccggcggagcgcgacgatctggcttcaatcatgaagaagctgcttaccaagtacgataacctgttcgaaacctcatttccgtacagcatggggtggcacggcgcgcccactggatctgaggccggagccaactggaaccactggcaacttcacgctcactactaccccccgctcctcaggtcggctaccgtgcggaagttcatggtgggatatgagatgctggcccaagcgcagcgcgatctcaccccagaacaggccgccgaaagactgagggctctcccggaagtgcattaccatttggggcagaaggatcgggaaaccgcgactattgca

SEQ ID NO: 12119 - DNA, 1137 bp, Artificial Sequence
  Description of Artificial Sequence: Synthetic coding sequence
atgtctcgaagcggcactgatccacagcagcgacaacaggccagtgaggccgacgcagccgctgccacttttcgagcaaacgaccaccaacacattcgctataatccactccaagacgagtgggtcctggtctctgcccaccggatgaagcgtccctggcagggccaggtggagccgcagctactaaagacggttccgcggcacgacccgctcaatccgctgtgtcccggagcaatccgagcgaatggcgaggtcaatccacagtacgattccacgtttctgtttgacaatgactttcccgcactgcaaccggatgcaccctcccccggcccatcggaccatcctctgttccaagccaagagtgcccgcggcgtgtgcaaggtcatgtgcttccatccctggagcgatgtgaccctgccgttgatgtccgtccccgagattagagcggttgtcgacgcctgggccagcgttaccgaagagctgggcgcccagtatccctgggtccagatcttcgagaacaagggcgcaatgatgggatgcagtaatccacacccacattgccaagtgtgggcaagcagctttctgcccgatattgcccagagggaagaacggtcccaacaagcttacaagtcgcagcacggagagcctctgctgatggagtactcccgacaggaactactcagaaaggagcggctggtgctaaccagtgagcattggctggttcttgtgcccttttgggcaacctggccatatcaaaccctgctgctgccacgtcgtcatgttcgtcgcttacctgaactgaccccagctgagagggatgatctcgcctcaattatgaaaaagcttctgaccaaatatgacaacctttttgagaccagttttccatattcgatgggatggcacggtgccccgacgggaagcgaggcaggcgcgaattggaatcattggcagctgcacgcccactactacccgcccctcctgcgtagcgccactgttcgtaaatttatggtgggctacgagatgcttgctcaagcccagcgcgacctgacacccgagcaggccgccgagagattacgagcccttccggaagtgcactaccacctgggccaaaaggatcgtgagacagccacaatcgct

SEQ ID NO: 12120 - DNA, 1137 bp, Artificial Sequence
  Description of Artificial Sequence: Synthetic coding sequence
atgtcaagatcaggaaccgatcctcagcaaagacaacaggcatccgaggctgatgcagcagcagccactttcagagcaaatgaccatcaacacatccgatacaatccacttcaggacgagtgggtgctcgtctcggcacaccggatgaagcggccctggcagggacaggtggaaccacagctgttgaaaacggtgcctagacatgatcctctcaacccactgtgcccgggcgcgatacgggcaaacggagaagtgaaccctcaatatgattcgacttttctgtttgataacgattttcctgccctgcagccagacgcaccctcgcctggcccaagcgatcatcccctttttcaagcgaagtcggccagaggcgtgtgtaaggtcatgtgttttcatccatggagcgacgtcaccttgccattgatgagcgtgcctgagattagagccgtggtcgatgcctgggcttccgtcaccgaagagctgggagcccaatacccctgggtgcaaatctttgaaaacaaaggagccatgatgggatgttccaacccacaccctcactgccaggtgtgggcctcatcatttctgccagatattgcacagagggaggaaagaagccaacaggcttacaaatcccaacacggagaacccctcctcatggaatacagccgccaggagctgctgcgaaaggaacgcctggtcctcacttcggagcattggctcgtcctcgtgccattttgggcaacttggccttaccaaactttgttgctcccgcggcggcatgtcaggaggctcccagaacttacccccgcggaaagggatgatcttgcttcaataatgaaaaaacttcttaccaagtacgacaacctgtttgaaactagcttcccatactcgatgggttggcacggcgctcccactggatcggaggcaggcgccaactggaatcattggcaactgcatgcacattactacccgcctttgctgcggtcggcaaccgtgcggaagtttatggtgggatacgagatgctcgcacaggcacaaagagatcttactccagagcaggccgcagaaaggctccgcgcacttccagaggttcattaccatctggggcagaaggaccgtgaaacggcgacgattgcc

SEQ ID NO: 12121 - DNA, 1137 bp, Artificial Sequence
  Description of Artificial Sequence: Synthetic coding sequence
atgtctcggtcaggcacagatcctcagcagcggcagcaggctagtgaagccgacgctgcggctgcgaccttccgggctaacgaccaccaacacatcaggtataatcccctgcaggacgagtgggtgctggtgtcagcgcaccgcatgaaaaggccatggcagggccaggtggaaccgcagctgctcaagaccgtcccacggcatgacccactgaaccccctgtgccctggcgcgattagagccaacggagaagttaacccccagtacgatagcacattccttttcgataatgactttcctgccctacaacccgatgctcctagcccaggcccgtcagaccatccgttgttccaggctaagagcgctcgcggagtgtgtaaggttatgtgtttccatccttggtccgacgtcacactacccttgatgtcagtgcccgagatcagggcagtggtcgacgcctgggctagcgtcacggaggagctgggtgcacagtatccttgggtgcaaattttcgagaataagggggctatgatgggctgttcaaaccctcatcctcactgccaagtgtgggcttctagttttctcccagatattgcgcagcgcgaggaacggtcacagcaggcttacaaatctcaacatggtgaacccctgcttatggaatactctcgccaggaacttctccgcaaggaacgactggtgcttaccagcgagcattggcttgtgttagtgcccttctgggccacctggccctatcagacgctcttgttgccacgccgccatgtcagacgcctacctgagcttacgcccgcagagcgggacgatctagcctctattatgaaaaagttgttaaccaagtacgataacctattcgagacatcctttccctatagtatgggctggcatggcgctccgacgggcagcgaggccggcgccaattggaaccactggcagctccatgctcattactatccgcctttgctgagatcagccactgtgcggaagttcatggtgggttatgagatgctcgctcaagcacagcgggatcttaccccagaacaggccgccgagcggttacgagctctgcccgaggttcactaccacctgggtcaaaaggatcgagaaaccgcgactattgct

SEQ ID NO: 12122 - DNA, 1137 bp, Artificial Sequence
  Description of Artificial Sequence: Synthetic coding sequence
atgtcgagatccggtaccgacccccagcaaagacaacaggcgtcagaagcagatgcagcagccgcaaccttcagagccaatgatcaccaacacattagatacaaccctcttcaggacgagtgggtcctggtgagcgcacatcgtatgaagcgcccttggcaaggccaggtggaaccccagctgcttaaaaccgtccctcggcatgaccctctcaacccactttgcccgggagcaattagggccaacggtgaagtgaatccacaatatgactcgactttcctttttgataatgatttcccggccctgcaacctgatgcaccatcgcctggacctagcgatcatcctctgttccaggccaaatcagcaaggggagtgtgtaaggtgatgtgttttcacccttggtcggatgtcaccctcccactcatgtccgtccccgaaattagagcagttgtggatgcatgggcatccgtcactgaagaactgggggcacagtacccttgggtgcagatttttgaaaacaaaggtgcaatgatgggatgctcaaatccccatccgcattgtcaagtgtgggcatcgtcgttccttcctgatatcgcccaacgagaggagcgttcacaacaagcgtataagagtcagcacggagagcctctgttgatggaatactcgcgccaggagttgttgagaaaggagcgcctggtgttgacttcagaacactggctggtccttgtgccgttttgggcaacctggccataccagacccttcttctgcctcgacgtcatgtgcgacgcctgcctgaacttactccggcagaaagggatgacctcgcatccataatgaagaagctgcttaccaaatacgataaccttttcgaaacctctttcccttactccatgggctggcacggggctccaactggtagcgaggcaggtgcaaattggaaccattggcagcttcacgctcactactacccaccactccttcgttcggccactgtgagaaagtttatggtgggctatgagatgcttgcccaagcacagcgggatcttacgccggaacaagctgcggagcggctgcgagcgcttccagaagtacattaccacctcgggcaaaaggatcgcgagacggcaaccatagct

SEQ ID NO: 12123 - DNA, 1137 bp, Artificial Sequence
  Description of Artificial Sequence: Synthetic coding sequence
atgtcgcgcagcgggaccgacccgcagcagaggcagcaagcgtccgaggcagatgctgcagcggccaccttcagggcgaacgatcaccagcacatccggtacaacccgctccaggatgagtgggtgctcgtctcagcacacagaatgaaacggccttggcaaggacaggtggagccgcagctgctgaaaaccgtcccgaggcacgatccgttgaatccgctctgcccgggggccatccgggcaaatggagaagtgaacccacaatacgacagcacttttctcttcgacaatgacttcccggcgttgcaaccagacgccccttcgcctggaccctcagaccatccgctgtttcaggccaaatcggctcggggagtgtgtaaggtgatgtgcttccacccctggtcggacgtgaccctgccactgatgagcgtccctgaaatccgggccgtcgtggatgcatgggcttccgtgaccgaagagctgggcgctcagtacccgtgggtgcagatcttcgagaataagggcgcgatgatgggatgctcaaaccctcatccacactgtcaggtgtgggcctccagcttcctgcctgacatcgcacaacgtgaggagcggtcgcagcaagcatacaaatcccagcacggggaacctctgctgatggagtattccagacaagaactgctgagaaaagagcgtctggtcctcactagcgaacattggcttgtcctggtcccgttctgggccacctggccgtaccaaaccctgctgctgcctcggcggcacgtgcgtcggcttcctgagctgactccagcggagcgggacgacctcgcttcaatcatgaagaagttgctgactaagtacgacaacctgtttgaaacctcattcccctactctatgggttggcacggagctccgaccggctcggaggccggagccaattggaatcactggcagctgcacgcacactactacccaccgctcctcaggtccgccactgtgcgcaagtttatggtcggatacgaaatgttggctcaggctcagcgcgatttgaccccagagcaagccgccgaacgcctccgggcactgccggaggtgcattaccatctcggccagaaagatcgagaaaccgccacgatcgcc

SEQ ID NO: 12124 - DNA, 1137 bp, Artificial Sequence; identical to SEQ ID NO: 12065
  Description of Artificial Sequence: Synthetic coding sequence

SEQ ID NO: 12125 - DNA, 1137 bp, Artificial Sequence
  Description of Artificial Sequence: Synthetic coding sequence
atgtcccgctcaggaacggatccgcagcaacgacaacaggccagcgaagctgacgccgcggcggctactttccgggcgaacgaccatcaacacatccggtacaacccgctgcaggatgaatgggtgctcgtgtcggcccaccgcatgaagcggccttggcaaggacaggtggaaccgcaactcttgaaaaccgtcccacgccacgacccactgaatccactctgcccgggggcgattcgtgcgaacggggaagtgaatccgcaatatgacagcactttcctcttcgacaatgatttcccggccctgcaacccgacgccccatctccgggtccgtccgatcacccactctttcaagcaaagtcagccaggggtgtgtgcaaggtgatgtgtttccacccgtggtcagacgtgacgctcccactgatgtcagtcccagagatcagagctgtcgtcgacgcgtgggcatcggtgactgaagaactgggagcccagtacccttgggtgcagatcttcgaaaacaagggtgcgatgatgggatgctccaacccacacccgcattgccaggtgtgggcctcgtcgtttctccccgacatcgcgcaaagggaggaacgatcccagcaggcgtataagtcccagcacggagaacccctgttgatggaatattcccgccaggagcttcttcggaaagagaggctcgtgttgactagcgagcactggctggtcctggtgccattttgggccacctggccgtaccagacccttttgctgccgagacgccacgtgaggcggctgccagaactgactccagcggagcgggacgatctggcgtcaattatgaaaaagctgctgactaagtacgataacctgttcgaaacctccttcccatactcgatgggatggcatggcgccccgactgggtccgaagcgggggcgaattggaatcactggcagcttcatgctcattactacccgccattgcttagaagcgctaccgtccgcaaattcatggtcggatacgaaatgctcgcacaggcccaacgcgacctgaccccagagcaagccgccgagcgcctgcgcgcactgccggaggtgcactaccacctgggacagaaggacagggaaaccgccactatcgcc

SEQ ID NO: 12126 - DNA, 1137 bp, Artificial Sequence
  Description of Artificial Sequence: Synthetic coding sequence
atgtcccgttcgggaactgacccccagcagcgacagcaggcatcagaggcagatgccgccgccgcaacttttcgtgcaaatgaccatcaacatattcgctacaacccgcttcaagatgaatgggtgcttgtcagcgcccatcgcatgaaaagaccatggcaaggccaggtggaaccacaactgctcaagacggtccccagacatgatcccctcaaccccctgtgtcctggagctatccgggctaacggtgaggtgaaccctcaatacgattccaccttcctttttgacaacgatttccctgctctgcagccggatgcaccttcacctgggccatccgatcatccgctcttccaggcaaagtcggcacgcggcgtgtgtaaggttatgtgttttcacccatggtccgatgtcaccctgccactgatgagcgtgccagaaatccgggcagtcgtcgacgcgtgggcatcggtcaccgaggaattgggtgcacaatatccttgggtgcagatttttgagaacaagggggcaatgatgggatgtagcaatccacatcctcactgtcaggtctgggcttctagcttcctcccagatattgcccaacgcgaggagcgcagccagcaagcctacaagagccagcatggcgaaccactgctgatggaatacagccgacaagagcttcttagaaaggagagacttgttctgacgagcgaacattggctggtgcttgtccccttttgggcaacgtggccataccagaccttgcttctgcctagacgccatgtgcggcggctccctgagcttactcctgcagaaagggacgacctcgcatcgatcatgaagaagctgcttactaagtatgacaatctttttgaaacctcgtttccttactcaatggggtggcatggagcacctaccggttcggaagccggtgccaattggaatcattggcagctccacgcacactactacccaccactgcttaggtccgcaaccgtcagaaagtttatggtgggatacgaaatgctggctcaggcacaaagagacttgacccctgaacaggcagcagaaagacttcgggccttgcccgaagtgcattaccacctcggacagaaagacagagaaactgccactattgca

SEQ ID NO: 12127 - DNA, 1137 bp, Artificial Sequence
  Description of Artificial Sequence: Synthetic coding sequence
atgtccaggtcgggcaccgatccacaacagcgccagcaggcatcagaagccgacgccgctgcagccactttccgcgccaatgatcaccaacacatcaggtacaatccactgcaggacgagtgggtcctggtttcagcccaccggatgaagcgcccttggcaaggccaggtcgaaccgcaactgcttaagaccgtcccgcggcatgatccgctgaacccgctctgccctggagccatccgagcaaatggagaggtgaatcctcaatacgacagcaccttccttttcgacaacgatttcccggcgctccaacctgacgctccgtcgccaggtccgtcggaccatccactctttcaggcgaagtcggcaagaggagtgtgcaaagtgatgtgttttcatccttggtccgacgtgaccctccctctcatgagcgtcccggaaatccgggccgtcgtggatgcgtgggcgtcggtcactgaggagctgggtgcccagtacccgtgggtgcagatctttgagaataagggagccatgatgggctgctccaaccctcatccgcactgtcaggtgtgggcgtccagcttcctgccggacattgcccagcgcgaagagaggtcccagcaggcatataagtcacagcacggcgaacctctgcttatggaatactcgcggcaggaacttcttaggaaggaacgcctcgtgctcaccagcgaacattggctcgtcctggttccgttctgggccacctggccttaccaaactctcctgctgccacgccggcacgtccgaagattgccggagctgactccggcagagagagacgatttggcgtcgattatgaaaaagttgctgactaaatacgacaacctctttgaaacgagctttccgtacagcatgggatggcacggggccccgaccggatcagaggcgggggccaattggaaccattggcagcttcatgcccactactacccaccgcttctgcgctcagccaccgtgcgcaagttcatggtcggctacgaaatgctggcgcaagcccagcgcgatctgaccccggagcaggctgcggaacgcttgagagcgctgccggaagtgcactatcacctcgggcagaaggatagagaaaccgcgactatcgca

SEQ ID NO: 12128 - DNA, 1137 bp, Artificial Sequence
  Description of Artificial Sequence: Synthetic coding sequence
atgtcgagaagcggaaccgatccgcagcagcgccagcaggcctcagaggctgacgcggccgccgccactttccgggcaaacgaccatcaacacatccgctacaatcccctgcaggacgagtgggttcttgtctccgcgcacagaatgaaaaggccttggcaagggcaggtggagccgcagctgttgaaaactgtgccacgccacgatcctctgaacccactttgcccgggggcaatccgggcaaatggagaagttaacccccaatatgattccactttcctgttcgacaatgattttccggctctgcagccggacgccccttcccctgggccaagtgaccaccctctgttccaggctaagagcgctcggggcgtttgcaaggtgatgtgcttccacccttggtccgacgtgactctgccgctgatgtcagtcccggagatccgcgcggtggtggatgcatgggcgtcagtgactgaggagctgggagcacaatatccgtgggtgcaaatcttcgagaataagggggcaatgatgggctgctccaacccgcacccgcactgtcaagtctgggcgagctccttcctgccagatatcgcacagcgcgaagagcgctcccagcaagcgtacaaatctcagcacggagaacccctcctgatggaatactcaaggcaggaattgctcagaaaagaacgccttgtgctgacctcagaacattggctggtgctcgtgcctttctgggccacctggccctatcagaccctcctcctgccgagacgccatgttagaaggctccctgagctcaccccagccgagcgggacgatttggcttcaataatgaagaagctgctcacgaagtacgacaatctgttcgaaacttcatttccatactcgatgggctggcacggagctccaactggctcagaagcgggggcgaactggaaccattggcaattgcacgcacattactacccaccgctgctgcggtcggccacggtccggaagttcatggtgggatacgagatgctggcccaagcgcagcgcgatcttaccccggagcaagctgccgagcggctgcgcgccctccccgaggtccactaccatctcgggcagaaggacagagaaactgcgactattgcc

SEQ ID NO: 12129 - DNA, 1137 bp, Artificial Sequence
  Description of Artificial Sequence: Synthetic coding sequence
atgtctaggtccggaaccgacccccagcagcgacaacaagctagcgaggctgatgctgctgccgcaacttttcgagccaacgatcaccaacacattcgatacaacccactgcaggatgagtgggtgctggtttccgcacatcgcatgaagcgtccttggcaaggacaagttgagccacagttattgaaaaccgtacccagacacgaccctctgaaccccctctgccccggtgcgatcagagcaaacggggaagtgaatccgcagtatgacagcacctttctcttcgacaatgatttccccgcactgcagccagacgccccctcacctggaccgtccgatcacccactgtttcaagcaaaaagcgcccgaggggtgtgcaaagtaatgtgtttccacccgtggtcagatgtcaccctccccctaatgtctgttcctgagataagagctgtcgtggacgcctgggcatctgtcaccgaagaactcggtgcccagtatccctgggtgcagatttttgagaacaaaggggcgatgatggggtgcagtaacccacatcctcattgccaggtttgggcctcgtccttcctgcctgacatcgcccaacgggaagaaaggtctcagcaggcatacaaatctcagcacggggagccactgctcatggaatactcgaggcaggaactgctaagaaaggagaggctcgtccttacttccgagcactggctggtactggttccattttgggccacctggccataccaaaccctactattacctcgaagacatgttcgaagactgccagaactgacacccgcggagcgggacgatttagcttctattatgaagaaactactgaccaagtacgataacctgttcgagacaagtttcccctactccatgggttggcatggagctccaactggctccgaagcgggcgccaactggaaccattggcagttacacgctcactattaccctccgctgctcaggtcagctactgtgcgaaagtttatggtgggatacgaaatgctggctcaggctcagcgagatttgactcctgaacaggctgccgagcgactccgtgcgctgcctgaagtacactatcatctggggcagaaggacagggagaccgcgaccattgca

SEQ ID NO: 12130 - DNA, 1137 bp, Artificial Sequence
  Description of Artificial Sequence: Synthetic coding sequence
atgagccgctctggaacagacccgcaacagagacagcaagctagcgaagccgatgcagctgctgccacttttcgcgcgaacgaccatcaacatatcaggtataacccacttcaagatgaatgggttttggtgtccgcgcatcgaatgaagaggccatggcaaggccaagtagagccgcagctacttaagaccgtccctaggcatgatccgctgaatcccctctgtcctggtgccatccgtgccaatggtgaagtgaatccccagtatgactcgacgtttttatttgacaatgatttcccggcattacagccagacgcaccgagccctggcccatctgatcatccgttattccaagcaaagtctgcccgcggtgtctgcaaggttatgtgctttcacccgtggtccgatgttactctcccgctaatgtcggttccagaaatccgggcagtggttgacgcttgggcaagcgtcaccgaggaattgggtgctcaatacccttgggtccaaatttttgagaataaaggcgcgatgatggggtgtagtaatcctcatcctcattgtcaagtatgggcctcttcttttttgccggatatcgcgcaacgggaggaaagatcacaacaggcctataagtcacaacatggagaaccacttttgatggagtactcaagacaagaattacttagaaaagaaagacttgtacttacgagcgaacattggctggtacttgttccgttttgggcgacttggccttaccagacccttcttttaccgcgacggcatgtccggcgccttcctgaattaactccagcggaaagggatgatctagctagtataatgaaaaagttattgacgaaatatgataatctgtttgaaacgtcttttccatatagcatgggctggcatggagcgccaaccgggtcagaagcgggggctaattggaatcattggcagctgcatgctcactattatccgcctcttctgcgatcagctaccgttaggaaatttatggtagggtatgaaatgcttgctcaggcccaaagagatctgacacccgaacaagccgcagagcgtctacgtgcattacctgaggtacattaccaccttggccaaaaagatagagagacagctacgattgcg

SEQ ID NO: 12131 - DNA, 1137 bp, Artificial Sequence
  Description of Artificial Sequence: Synthetic coding sequence
atgtcgcgcagtggtaccgatccccagcagcgccagcaggcaagcgaagccgatgcagccgctgccacgttcagggccaatgaccaccagcacatccgttacaatcctctgcaggatgaatgggtcttggtgtctgcccaccgaatgaagcggccctggcagggtcaggtggagcctcagctgttaaagaccgtcccacggcacgaccctctgaaccccttatgtccgggggcgatccgcgcaaacggcgaggtgaacccccaatacgactctacttttttgtttgacaatgatttcccagcacttcaacccgacgccccatccccaggtccctcggatcatccactgttccaggcaaagtctgctaggggggtgtgcaaagtgatgtgtttccacccttggtccgacgtgaccttaccacttatgagtgtcccagagatccgtgcagtcgtggatgcatgggcaagtgtcacagaagagctgggtgctcaatatccgtgggtccaaattttcgagaataagggggctatgatgggatgtagtaatccacatccccactgccaagtttgggctagctccttcctccccgacattgctcaaagggaagagcgctcacagcaggcttacaaatcccagcatggcgagccactgttaatggagtactcccgccaggagctactcagaaaagagagacttgtgcttacttctgagcactggctggtgcttgtgccattctgggccacatggccataccagaccctactgctcccccggcggcatgtacggcgtctccctgaactcactcccgcggagcgggatgacctcgcaagtattatgaagaaattgctcaccaagtacgacaatctcttcgagactagtttcccgtacagcatggggtggcacggagcccctactggttctgaggccggcgccaactggaatcactggcagctgcatgcccactactacccacccctgctgaggagtgccacagtgaggaaattcatggttggctacgaaatgctcgctcaggcccaacgggacctcacacccgagcaggccgccgagaggcttagggccttgcctgaggtgcattatcacctgggacagaaagaccgcgagactgccaccatagca

SEQ ID NO: 12132 - DNA, 1137 bp, Artificial Sequence
  Description of Artificial Sequence: Synthetic coding sequence
atgagcagaagtggaactgatccacagcagaggcagcaggcttctgaggctgatgccgctgccgcgacatttcgcgctaacgaccaccaacatatcagatacaaccccttgcaagatgaatgggtattggtgtccgcccatcggatgaaacgcccttggcagggccaggtggaaccccaactgctcaagacagtcccaaggcacgaccccttgaaccccctgtgccctggtgctattagagctaacggggaagtgaacccacaatatgactctacctttctgtttgacaatgatttccctgcgttgcaaccagacgcaccaagtcccgggcctagcgatcatccacttttccaggccaaaagcgctaggggtgtgtgtaaggtcatgtgtttccatccctggtccgatgttactctgcccctgatgagcgtgccagaaatcagggctgtggtggatgcctgggcttcagtgactgaggaacttggagcgcagtacccatgggtgcagatattcgaaaacaaaggcgcaatgatgggatgcagcaaccctcacccccattgccaagtatgggctagttcatttctgccggacatagcccagagggaagagaggtctcagcaggcgtacaaatcccaacacggcgaaccactcttgatggagtactctcgccaagagctccttaggaaggagcgactggtgttgacatccgaacattggctggtgttggtgccattttgggcaacctggccttaccaaaccctgcttctgccaagacgtcacgtcagacggttgccggagcttacccccgctgagagggatgacctcgctagtatcatgaagaagctgttgaccaagtatgacaatctgttcgaaacctcatttccttattctatgggatggcatggtgcacccacaggttctgaagctggcgccaactggaaccactggcaacttcacgcacactattaccctcccctgctgagatccgccactgtgcgcaaattcatggttggctatgaaatgctggcccaggcccagcgggacctcacccccgaacaggcagctgaacgactgagggccctccccgaagtgcattatcatttgggccagaaggacagagagacagccacaattgct

SEQ ID NO: 12133 - DNA, 1137 bp, Artificial Sequence
  Description of Artificial Sequence: Synthetic coding sequence
atgtctcggtccggtacggatccgcaacagcgccagcaagctagcgaagcagatgctgccgccgcgacgttccgcgccaatgaccatcagcacatacggtacaacccattacaggacgaatgggttctggtctcagctcaccggatgaagaggccctggcagggtcaagttgaaccccagcttctcaagacagtgccccggcacgatcccttgaacccactctgcccaggggctattcgggctaacggggaagttaacccccagtacgattctacattcctctttgataatgactttccagcgcttcagccggatgcaccttcacctgggccctccgatcacccccttttccaagctaaatccgctcgaggagtgtgtaaagtaatgtgtttccacccatggtctgacgtgaccctgccgctgatgtctgtgcctgaaattcgggcagtggtcgacgcatgggccagtgttaccgaagagctgggcgctcaatacccctgggtccagatcttcgagaacaaaggcgcaatgatgggctgctctaatccccatcctcattgtcaggtatgggcttcatctttcctacctgacatcgcccagcgagaagagcggtcacagcaggcatataaatcacagcacggcgagcccctgttgatggagtactcaagacaagaactgttgcggaaagaacgcctggtcttaacctccgaacactggctggtgctagtgcctttctgggcaacttggccctatcagactcttctgcttcccagacgtcacgttagacgcctgcccgagctgacccccgccgaaagagatgacctggcatcgatcatgaagaagttgcttactaagtacgacaacctcttcgaaaccagtttcccctactcaatgggttggcacggagcacccacggggtcagaggcaggcgcaaactggaatcattggcagttgcatgcacactattaccctccattacttaggtccgctaccgtcagaaagtttatggtcgggtacgagatgctggctcaggctcagagggatctaacacctgagcaggcagccgagcgactacgcgccctgccagaggtacattaccacttgggacagaaagatcgagaaactgctacgatagct

SEQ ID NO: 12134 - DNA, 1137 bp, Artificial Sequence
  Description of Artificial Sequence: Synthetic coding sequence
atgagccgctccggtaccgatccacagcaacggcagcaggccagcgaggcagatgccgccgcggccacgttccgcgcgaatgaccatcagcatatccgctacaacccacttcaagatgagtgggttctcgtctcggcccatcgcatgaagcgaccctggcagggacaggtagaaccccagctactaaaaacagtccctcggcacgaccccctgaaccccctgtgtcctggcgcaatcagggcaaacggagaggtgaatcctcaatacgattcgactttcctgttcgataatgatttcccagcactgcaaccagacgcgccgtcaccaggtccatcagaccaccccctctttcaggccaagtccgctaggggcgtgtgtaaggttatgtgcttccacccttggtcagacgtgacactcccactgatgagtgtgcctgagatcagggccgtggtcgacgcatgggcatcagtgaccgaggagcttggagcacagtatccgtgggtgcagatcttcgagaataagggcgcaatgatgggctgttctaacccccaccctcattgtcaggtctgggcctcttctttcctgcctgatatagcacagcgggaggaaaggagccaacaggcctataagtcccagcacggcgaaccactgctgatggagtatagccgccaggagctgcttcggaaggagagattggtgctgacatccgaacactggttggtcctggtccccttctgggctacctggccctaccagaccttgcttctaccgcggcggcacgttaggcggttgcccgagcttacacccgctgagagggatgacctcgcgtcaattatgaaaaagctactgacgaagtatgacaacctgttcgaaacatcattcccttacagcatgggttggcatggcgcacccactgggtctgaggcaggtgccaattggaaccactggcagcttcacgctcattactacccacccctcctgcggtccgccaccgtgaggaagttcatggttggatatgaaatgctagcccaagcgcagagggacttgacccctgagcaggcggctgagcgcctaagggccttacctgaagtacactaccacctcggccagaaggaccgcgagactgccacgatcgct

SEQ ID NO: 12135 - DNA, 1137 bp, Artificial Sequence
  Description of Artificial Sequence: Synthetic coding sequence
atgtctagatccggcacagaccctcagcaaagacagcaggcttccgaggccgacgccgctgcggccacctttcgcgccaacgatcaccagcatatcagatataaccccctgcaggatgagtgggtgctggttagcgcacacagaatgaagcgcccttggcagggacaggtggagccccagctgctcaagacggtgccgcgacacgacccactcaacccactctgcccaggagcaatccgcgccaacggcgaagtcaatccacagtacgattccaccttcctctttgacaacgatttccctgcattgcagccggacgctccctcacctggccccagtgatcacccactgtttcaggcaaagagtgcacgtggcgtctgcaaggtgatgtgtttccatccctggtcggacgtcacactgcccctaatgtcggtgccggagatccgtgcggtagtggacgcttgggccagcgtcaccgaggagttgggtgcacagtacccttgggttcagatcttcgagaacaagggagcaatgatggggtgttctaacccgcacccccattgccaggtctgggctagttctttcctgcccgacattgcccagcgagaagagcggagccagcaggcctacaagtcccagcacggcgaaccgctgctcatggagtactctcgtcaggagctgctgcgtaaggagcgcctggtgctcacgtccgagcattggctggtactggtccccttttgggccacctggccgtatcagaccctgcttcttcctcgtcgtcacgtccgccgcttgccggagctgaccccggccgaacgggatgacctggcgtcgatcatgaagaagcttctgaccaaatatgacaatttgttcgagacgtctttcccatactccatgggatggcatggcgcacccaccggctccgaggcaggagcaaattggaatcattggcaacttcatgctcattattacccgccgttgcttcgctccgccaccgtgcgcaagttcatggtgggatacgagatgctcgcccaggctcagcgcgacctgacccccgagcaggccgctgaacgtctacgtgctctcccagaggttcactaccacctcggccaaaaggatcgtgagacagctacaatcgcg

SEQ ID NO: 12136 - DNA, 1137 bp, Artificial Sequence
  Description of Artificial Sequence: Synthetic coding sequence
atgtctcgaagcggaacggatccacaacaaagacagcaggcttcagaggccgatgcggccgcagcgacttttcgtgctaacgaccaccagcatataagatacaaccccttgcaagacgagtgggtacttgtttctgcgcatcgtatgaagagaccttggcaaggccaggtggagcctcagttgctgaagacagtgccccgacacgacccgctgaaccccttatgcccgggggcaattagagctaacggagaggtcaatccccagtacgattctacctttctgttcgataatgattttccagctctccagccagacgcgcctagcccaggtccctctgatcaccccttgttccaggctaagtctgcacgcggcgtatgcaaagttatgtgttttcacccatggagcgatgtcactctcccactcatgtctgtgcctgaaattagagccgtcgtcgacgcctgggcgtcagttaccgaagaactgggagctcaatacccatgggtgcaaatcttcgagaacaagggcgcgatgatgggctgttccaacccccatccccactgtcaggtctgggcctctagctttttgcccgatattgctcagagggaggagcgaagccagcaggcttataagagccagcacggagagcccctgttgatggaatactcacgacaggaactgctgcgtaaggaacggcttgtgctaacctctgagcattggctcgtgctggttcctttttgggccacgtggccataccaaaccctgttgctaccacgacgacatgttcgtagactgcctgaactgactccagcggagcgagatgacttagcaagtattatgaagaaactcctgactaagtatgacaatctattcgaaacctctttcccttatagcatgggttggcacggggccccaaccggtagtgaggccggggctaattggaaccactggcagttgcacgcgcattactacccaccccttcttagaagtgccactgttagaaaattcatggtaggatatgaaatgcttgctcaagcacaacgtgatcttacccctgagcaagctgctgaaaggttgcgagccctacctgaggtccactaccacctaggccaaaaggaccgggagactgccacaattgct

SEQ ID NO: 12137 - DNA, 1137 bp, Artificial Sequence
  Description of Artificial Sequence: Synthetic coding sequence
atgtcgcgttcgggtacggatccgcaacaacgacaacaagcgtcggaagcggatgcggcggcggcgacgtttcgagcgaatgatcatcaacatatacgatataatccgttacaagatgaatgggtactagtatcggcgcatcgtatgaaacgaccgtggcaaggtcaagttgaaccgcaactactaaaaacggttccgcgacatgatccgttaaatccgttatgtccgggtgcgatacgagcgaatggtgaagtaaatccgcaatatgattcgacgtttttatttgataatgattttccggcgctacaaccggatgcgccgtcgccgggtccgtcggatcatccgctatttcaagcgaaatcggcgcgtggtgtatgtaaagttatgtgttttcatccgtggtcggatgttacgctaccgctaatgtcggtaccggaaatacgagcggtagttgatgcgtgggcgtcggtaacggaagaactaggtgcgcaatatccgtgggtacaaatatttgaaaataaaggtgcgatgatgggttgttcgaatccgcatccgcattgtcaagtttgggcgtcgtcgtttctaccggatatagcgcaacgagaagaacgttcgcaacaagcgtataaatcgcaacatggtgaaccgttactaatggaatattcgcgtcaagaactattacgaaaagaacgactagttctaacgtcggaacattggttagtactagtaccgttttgggcgacgtggccgtatcaaacgctattattaccgcgacgacatgttcgacgtttaccggaactaacgccggcggaacgtgatgatctagcgtcgataatgaaaaaactattaacgaaatatgataatctatttgaaacgtcgtttccgtattcgatgggttggcatggtgcgccgacgggttcggaagcgggtgcgaattggaatcattggcaactacatgcgcattattatccgccgctactacgttcggcgacggtacgtaaatttatggtaggttatgaaatgctagcgcaagcgcaacgtgatctaacgccggaacaagcggcggaacgattacgtgcgttaccggaagttcattatcatttaggtcaaaaagatcgtgaaacggcgacgatagcg

SEQ ID NO: 12138 - DNA, 1137 bp, Artificial Sequence
  Description of Artificial Sequence: Synthetic coding sequence
atgtccagatcaggaacagatccacaacaaagacaacaagcaagtgaagcagacgcagcagctgcaacttttagagcaaatgatcatcaacatattcgttataatccacttcaagatgaatgggttttagttagtgctcatagaatgaaaagaccatggcaaggacaagtcgaacctcaattacttaaaactgttccaagacacgatccactaaatccactttgtcctggagcaataagagctaatggtgaagtaaatccacaatatgatagtactttcttatttgataatgattttccagctcttcaaccagatgcaccatctccaggaccatctgatcatccattattccaagctaaatcagcaagaggtgtttgtaaagttatgtgtttccatccatggtcagatgtaacattaccattaatgtcagttccagaaatacgtgcagtagttgatgcatgggcttcagttactgaagaattaggagctcagtatccatgggttcaaattttcgaaaataaaggagctatgatgggatgttctaatcctcatccacattgtcaagtatgggcatctagtttcttaccagatatagcacaaagagaagaaagatcacaacaggcatataagtcacaacatggagaaccacttttaatggaatactcaaggcaagaattattaagaaaagaacgtttagttctaacaagtgaacattggcttgttttagttccattttgggctacatggccatatcaaactcttttacttccaagacgacatgttagaagattgccagaattaacaccagcagagagagatgacttagcttcaattatgaaaaaattattaacaaaatacgacaatttattcgaaacatcatttccttattcaatgggttggcatggtgctccaacaggatcagaggctggagctaattggaatcattggcaattgcatgctcattattatccaccacttttaagatctgctactgtaagaaaatttatggtgggatatgaaatgcttgctcaagcacaaagagaccttactccagaacaagccgcagaaagattaagagcattacctgaagtacattatcatcttggtcaaaaggatagagaaacagcaactatagca

SEQ ID NO: 12139 - DNA, 1137 bp, Artificial Sequence
  Description of Artificial Sequence: Synthetic coding sequence
atgagtcggtccggcacggacccccagcaacgtcaacaggcctccgaggccgatgctgccgccgctacttttagggccaatgaccatcagcacatcagatataacccgctgcaggatgagtgggttcttgtgagcgcccatcgcatgaaacggccctggcagggacaggtggaaccccaacttctaaagaccgtgccgagacatgatccactgaatcccttgtgcccgggagctatacgggccaacggggaagtcaacccccaatacgattcgacattcctgtttgacaatgacttccctgctcttcagccagatgcacccagccctggaccatctgatcatcccctgttccaggccaagtctgcccggggcgtctgtaaggtgatgtgcttccacccatggtcagatgttacacttccgctaatgtccgtgccggagattagagcagtggtagatgcctgggcctctgttactgaggagctcggtgcacaatacccatgggtgcagatcttcgaaaacaagggggccatgatgggatgctcaaaccctcatccacactgccaagtttgggcctcttctttcttgcccgacatagctcagagggaggaacgttcgcagcaggcctataaaagccaacacggagaacctcttctgatggagtatagccgccaggagctgcttcgtaaggagcggcttgtgctcacaagcgaacattggctcgtattggtgccattctgggcaacttggccctatcaaacgttactccttcctcggagacatgtccgtagactgcccgaactcacgccggctgagcgggatgacctggccagtattatgaaaaagctgctgaccaagtatgataaccttttcgagacgtcatttccgtactctatggggtggcacggcgcccctacaggttcagaggccggcgccaattggaaccactggcagctgcatgcacactactaccccccgttgctgcgcagtgctacagtccggaaatttatggtgggctatgaaatgctggcccaggcccaaagggatctgactcctgagcaggcagcagagagactaagagctctcccagaggtacactaccacctaggacagaaagacagggaaacagcaacaatcgct

SEQ ID NO: 12140 - DNA, 1137 bp, Artificial Sequence
  Description of Artificial Sequence: Synthetic coding sequence
atgtcaagatcaggtaccgatccccagcagagacagcaggcttccgaggccgacgcagcggccgccaccttcagggcaaatgaccaccagcacattcggtacaatcccctccaggatgagtgggtgctcgtgagtgcccaccggatgaagaggccttggcagggccaggtcgagccccagctgctcaagacagttccccgccacgatcccttaaacccgttgtgccctggagcgatccgggctaacggagaggtcaaccctcagtatgacagcactttcctcttcgataacgatttcccggcactccagccagatgcaccttcacccggtccttctgatcaccctttgttccaagcaaaatctgctcgcggggtgtgcaaagtcatgtgcttccatccgtggtctgacgtgacactgcctttgatgtccgtcccagagatcagggccgttgtagacgcgtgggcttcagtcacggaagaactcggagcacaatatccgtgggttcaaatctttgaaaataaaggggctatgatggggtgctcgaacccacatccacactgtcaggtgtgggcgagttcctttctgcctgacattgcacagcgagaagagaggagtcagcaggcttacaaatcacaacatggagagcccttgctgatggagtatagccgccaggagctgctgcgtaaagaaaggctcgttctgacctccgaacactggctcgtgttggtgccgttctgggcgacatggccgtatcagaccctgttactcccaaggcggcacgtgcgtcgccttccagagctgactcctgctgagcgtgacgatctggcttctataatgaagaaactgttgacaaagtatgacaacttattcgagacaagcttcccgtacagcatgggatggcacggagccccaaccgggtccgaggccggcgctaactggaaccattggcagctgcatgcccactactacccaccactgctgaggagtgccaccgtgagaaagtttatggtgggctacgaaatgctggcacaggcacaaagagacctgactccagaacaggctgccgagcgtctgcgagctttacccgaagtgcactaccacctgggccagaaggatagagaaactgctacaatcgct

SEQ ID NO: 12141 - DNA, 1137 bp, Artificial Sequence
  Description of Artificial Sequence: Synthetic coding sequence
atgagtagatccgggacagacccgcagcaaagacaacaagcttctgaagcggacgctgctgcagcgacctttcgagctaacgaccatcaacacattcgatacaatccactgcaagacgaatgggtacttgtgtctgcccaccgaatgaaaagaccgtggcaaggacaggtcgagccacagttgctaaaaactgtgccgagacacgacccactaaacccactctgtcctggagctatcagggccaatggagaagtgaaccctcagtatgactctacatttttattcgataacgactttccagcccttcaaccggacgctccatcgccaggaccatcagaccacccacttttccaggcgaagtccgcacggggagtctgtaaagttatgtgcttccatccatggagcgatgttacgctccctctcatgtccgtgcccgagatcagagctgtggtggacgcctgggcctctgtgacagaagaactgggagctcaatatccatgggttcagatcttcgagaacaaaggggccatgatgggatgttctaacccgcacccacactgccaggtatgggcatctagcttccttcctgacattgctcagcgggaagaaaggtcacaacaagcctataagtcacaacacggagagccattgcttatggagtactcacgtcaggaattgctcagaaaggagcgccttgtgttgacatcagaacactggctggttctcgtgccattctgggccacatggccataccagacattgctgttgcccagacgtcatgtgcggcgacttccagaactgactcctgctgaacgagacgacctcgcatcaattatgaagaagctactgacaaagtatgataatcttttcgagacatcattcccgtacagtatgggatggcacggagctccaacgggatccgaagcaggtgcaaactggaatcattggcaattgcacgcacactattatcccccgctgttgcgctcggccactgttcgtaagtttatggtcggatatgaaatgcttgcgcaagctcagagagatctcactcctgaacaagctgccgagagactcagagctcttccggaggtccattatcatctgggtcaaaaggacagggaaactgcaactatagca

SEQ ID NO: 12142 - DNA, 1137 bp, Artificial Sequence
  Description of Artificial Sequence: Synthetic coding sequence
atgtcacggtcaggcaccgacccacaacagcgacagcaggcctctgaagcagacgcagctgctgcaacattccgagccaacgaccatcagcatatcagatataacccattgcaggatgaatgggtcctggtgtcagcccaccgtatgaagcgcccgtggcaaggccaggtggaaccccagctgctaaagacagtgcccagacatgatcccctgaacccactctgcccaggagctattcgagccaatggagaagttaatccgcagtatgatagcaccttcctctttgataacgattttcctgcattgcagccggacgcccctagccctggacctagtgaccacccgcttttccaggcaaaatccgctcgcggggtgtgtaaggtgatgtgcttccacccgtggagcgacgtgaccttacccctgatgtccgtacccgaaatcagggccgtcgtcgatgcctgggctagcgtcactgaagagctaggtgcccaatatccatgggtccagatctttgagaataagggagcgatgatggggtgtagcaacccacaccctcactgtcaagtttgggcatctagcttcctgcccgacattgcacagagagaagagagatctcagcaggcttacaagagccagcacggtgagcctctgctaatggagtactcgcgacaggaattgctgcgaaaggaacgtctcgtgctgaccagtgagcattggctggtccttgttcctttttgggcaacctggccctatcaaacactgttattgcctcgaaggcatgtccggcggcttcccgaactgacccccgcagaaagagatgacctggcctcgatcatgaagaagctgcttactaagtacgataatctttttgaaacctcttttccctactccatgggctggcacggtgccccaacagggagcgaagctggcgcaaactggaaccattggcagttgcacgcacactattatcctccgctgttgagaagtgcaaccgtgcgcaagttcatggtcgggtacgaaatgctcgcacaagctcagagagatttaactcccgagcaggctgctgaaaggttgcgggccctgccagaggtccattatcacctgggtcagaaggaccgggaaactgccacgatcgcc

SEQ ID NO: 12143 - DNA, 1137 bp, Artificial Sequence
  Description of Artificial Sequence: Synthetic coding sequence
atgtcgcggtcgggaactgatcctcagcagcgccagcaagccagcgaagctgacgcagccgccgctaccttcagagccaatgatcaccagcatatccggtacaatccgctgcaggatgaatgggtactggtgtcggctcatcgcatgaaacggccgtggcaaggacaggtggaaccccagctccttaaaaccgtcccacgccatgacccgctcaatcctctttgccctggtgccattcgggccaacggagaggtgaacccccagtacgactcaacgtttctgttcgacaacgacttcccggcgctgcagccggatgccccttcgccaggcccctcggaccatccactgttccaggcgaagagcgcgagaggggtgtgcaaggtgatgtgttttcacccctggtctgacgttaccttgccgctgatgagtgtgccagagatccgcgctgtggtggacgcgtgggcctccgtcactgaagagctgggagcccagtacccgtgggtgcagatcttcgaaaacaagggagccatgatggggtgcagcaacccacacccgcattgccaagtctgggcttccagcttccttccggacatcgcgcaacgagaggaacgttcacaacaggcctacaagtcccaacatggagaacctctgctcatggagtattcccgccaggagctcttgcggaaggagcggctggtgttgacctcagaacactggctggtcctggtgccgttctgggcaacttggccgtaccagaccctgctgctccctcgccgccatgtccggcgcctgccggagctcactcctgcagagagggatgacctcgcatccatcatgaagaaattgctcactaagtacgacaaccttttcgaaacctcgttcccgtactcaatgggatggcacggcgccccaacgggttccgaagcaggcgccaattggaaccactggcagctccacgcccactactacccaccactgctgagaagcgcgaccgtgagaaaatttatggtgggctacgagatgctggctcaagcgcaacgcgatctcactcccgaacaggcggcggagaggctgagagcactgccggaagtccactaccacctcggacaaaaggatagggaaactgccaccatcgca

SEQ ID NO: 12144 - DNA, 1137 bp, Artificial Sequence
  Description of Artificial Sequence: Synthetic coding sequence
atgtcgaggtccggaaccgatccacaacagagacagcaggcatcagaagctgacgctgctgcagccacttttcgagcaaacgaccaccaacatattagatataatccgctgcaagatgaatgggtcctggtttctgcccaccgcatgaaacggccgtggcagggccaggttgaaccccagcttcttaaaaccgtcccgcgacatgacccactgaacccgttgtgcccaggggccatcagagctaacggagaagttaacccgcagtatgactcgacgtttctcttcgataatgacttccccgcactacagcccgacgcaccgtcacccgggccttcagatcacccattgttccaggcgaagtcagcacgcggtgtctgtaaagttatgtgttttcacccttggagcgacgttaccctgcctctgatgtccgttcccgagatccgggcggtggttgatgcctgggcgtcagttacagaagagctgggagcgcagtatccatgggttcagatctttgagaataaaggtgccatgatgggctgcagcaatccacatccccactgtcaagtttgggcttcgtcattcttacctgatattgcgcagcgagaggaacgaagtcaacaggcgtataagagccagcatggagaaccgctcctcatggaatactctcgccaagaactcctccgcaaggagcggctcgtgctcacgagcgagcattggttggtccttgtgccgttctgggcaacatggccttaccagactttgctacttcctcgacgccacgtacgccgtctgcccgaattaactccggcggagcgggacgatctggcgtcgataatgaagaagctgctaaccaagtatgacaacctattcgagacaagcttcccgtactctatgggttggcatggtgccccgactggatctgaggcgggagctaattggaatcattggcaacttcatgcccattactaccctcctttactgcgcagtgcgactgtgcgcaagttcatggtcggctatgagatgctcgcgcaggcccaacgcgatctgactccagaacaagccgcagagcgccttcgcgcgttgccggaggtccactatcatctcggccaaaaagacagggaaactgccacgatcgcg

SEQ ID NO: 12145 - DNA, 1137 bp, Artificial Sequence
  Description of Artificial Sequence: Synthetic coding sequence
atgtcccgttcaggcacggacccccagcagcgacaacaagcatccgaggccgacgcggcagcagccacctttcgcgcgaatgaccaccagcacatccgttacaaccctcttcaagatgagtgggtgctggtatctgcccaccggatgaagaggccgtggcaaggccaggtggaaccccagctcctgaagaccgtgcctcgccacgacccgcttaaccctctctgtcccggggctataagagccaatggggaagtcaacccacagtatgactcaaccttcttgttcgataatgatttccctgcactgcagcccgatgctccgtcacctggaccctctgatcaccctttgtttcaggctaaatctgcaaggggcgtgtgtaaagtaatgtgcttccacccatggtcggatgtcacactcccgctgatgtccgtccccgaaattagagccgtggtggatgcatgggcctctgtgacagaggaactgggtgctcagtatccctgggtccagatttttgagaataagggagctatgatggggtgttccaacccccatccccactgtcaggtttgggcatcttcattcctccctgatatcgcccagcgggaggagcgtagccaacaggcttacaagagtcagcatggagagccactcctgatggagtattcgcgtcaggagctgctgcgcaaagaaagactcgttttaacttctgagcattggctcgtgctcgtcccattctgggcaacctggccatatcagacacttctgctgccaaggaggcatgtgcggaggctgcccgagcttacacctgccgaaagagacgacctggcaagcataatgaagaagctcttgaccaagtatgataatctgttcgaaacatcattcccatacagcatggggtggcacggtgcgcctacgggctccgaggccggcgccaactggaatcattggcagttacacgcccattactacccacccttactgaggagtgccacagtgagaaagtttatggtgggctatgagatgctggcacaggcccaacgggaccttacgccagagcaggcagcagaacgcttgcgagccctgccagaggtccactatcatctcggtcagaaagatcgcgagacagctacgattgcc

SEQ ID NO: 12146 - DNA, 1137 bp, Artificial Sequence
  Description of Artificial Sequence: Synthetic coding sequence
atgagcagaagtggaaccgacccccagcagaggcagcaggcaagcgaggccgacgccgccgctgccacattcagggccaacgatcaccagcacatccgttacaatccactgcaggatgagtgggtcctggtgtctgctcatcgtatgaagaggccctggcagggacaagtggaaccacagctcttgaaaaccgtgccccgccatgaccccctcaatcccctgtgcccaggcgctattagggcaaacggagaggtgaaccctcagtacgatagcaccttcctcttcgacaacgactttccagcacttcagcccgatgctccaagtcccggccccagtgaccatcctctcttccaggccaaatcagcacgtggtgtatgcaaggtgatgtgtttccatccttggtccgatgttaccttgcccctcatgagcgtgcccgagattagggctgtggtggacgcttgggcatccgtgaccgaggagctgggtgctcagtacccctgggtgcagattttcgagaataagggtgccatgatgggatgtagcaacccccatccccattgccaggtgtgggctagttccttcctgcctgacattgcccaacgtgaggagaggagccagcaagcttataaaagccagcacggagaacctcttttgatggaatattccaggcaagagctgcttcgtaaggaacgcttggtcctgacaagcgagcactggcttgtactcgtacctttttgggctacatggccctatcagacactgcttctgcctaggagacacgtgagacgccttcctgagctgacacccgccgaacgtgacgatcttgcttccatcatgaaaaagctgctcacaaagtatgataatctgtttgagacttcattcccatatagcatgggttggcatggcgcccccaccggatccgaagccggcgcaaactggaaccattggcaactgcatgcacactattatcctcccctgttgcgttctgccacagtgcgcaagttcatggtgggctacgaaatgcttgctcaggctcagagagacttgactccagagcaagctgccgaacgccttcgcgctttgccagaagtccactatcacttgggacagaaggatagggagacagctactatcgca

SEQ ID NO: 12147 - DNA, 1137 bp, Artificial Sequence
  Description of Artificial Sequence: Synthetic coding sequence
atgagtcgttctggtactgatccacaacaaagacaacaagcttcggaagctgatgctgcagcagcgaccttcagagctaacgatcaccaacacattcgatataacccattacaggatgagtgggttttggtttcagcgcaccgaatgaaacgtccttggcagggccaggtggaaccacagctcttaaagaccgtcccacgtcatgatcctcttaatccactttgcccaggtgcaataagagctaatggcgaagtaaacccacagtatgattcaactttcctgttcgataatgactttcctgcgttgcagccagatgcaccatcacctggtcctagtgaccatcccttgtttcaggccaagtctgctcgaggcgtgtgcaaagttatgtgttttcacccttggagtgatgtcaccctgccacttatgagtgtgccagaaataagggccgtggttgatgcatgggcatcagttaccgaagagctgggagcccaatatccttgggtccagattttcgaaaacaagggtgctatgatgggttgctctaaccctcatccacactgtcaagtttgggcctcctcttttctacctgatattgctcaaagggaggaacgatcacaacaagcttataaatcccagcatggagaaccacttcttatggaatatagtagacaggaactcctccgtaaggagcgacttgtgcttacaagcgagcattggcttgtgctcgtgcctttttgggctacctggccataccaaacgttgctacttccgaggcgtcacgttcgacgcttacccgagctcactcctgctgaaagagatgatcttgctagcataatgaagaagttgctcacaaagtatgataaccttttcgagacctcatttccttatagtatgggatggcatggagctccaactgggtcggaggccggagccaattggaatcactggcaactgcatgctcattactatccacctctgctgcggtccgctaccgtgagaaagttcatggttggatacgaaatgcttgcgcaggctcaaagggatttgacgcctgaacaagcagctgagcgtcttcgagcgttgccagaagttcattatcatttaggacaaaaggatcgggagaccgctacaatcgcc

SEQ ID NO: 12148 - DNA, 1137 bp, Artificial Sequence
  Description of Artificial Sequence: Synthetic coding sequence
atgtcccgatccgggacagacccccagcagagacagcaggcaagtgaagctgatgccgccgccgccacattccgagccaacgatcaccagcacatacgatataaccctctccaggatgaatgggtgcttgtgtcagcccatcggatgaaaagaccctggcagggacaggtggaaccacagctgctaaagacagtcccaaggcatgatcccctcaatcccctatgccctggagctatacgcgctaacggggaagtcaacccccagtatgattctacttttttatttgataacgatttccccgccttacagcctgatgctccatcacccggacctagtgatcacccactcttccaggccaaaagtgccagaggagtctgtaaagtgatgtgttttcatccatggtccgatgtgactctacccctcatgtccgtccccgaaatcagggcagtcgtcgatgcttgggcatctgtgactgaagagctcggggcccagtacccctgggtccaaattttcgaaaacaaaggggccatgatgggatgtagtaatccccatcctcactgtcaggtgtgggcttcctcgtttttacctgacatagctcagagggaagaacggtcccagcaggcttataaatcccagcatggggaacctctgcttatggaatattctagacaggaactgcttcggaaagaaaggctggtgttaacttccgaacattggctcgtgctcgtgcccttttgggcaacatggccatatcagacactacttcttccccggcgacatgtccgacgcctcccagagctcacaccagcggaaagggacgatttagcttcaataatgaagaagctcctgacaaagtatgacaaccttttcgaaacttcttttccttactcaatggggtggcacggggctcctactgggtctgaagccggggcaaattggaatcattggcagcttcatgctcattattatccacctctactgaggtccgccactgtgcgcaaatttatggtaggatatgagatgcttgcccaggcccagcgggatcttactccggaacaggcagccgaacggctccgggctctgcctgaagttcactaccacctgggacagaaagatcgagagacagccactatagct

SEQ ID NO: 12149 - DNA, 1137 bp, Artificial Sequence
  Description of Artificial Sequence: Synthetic coding sequence
atgagtcgctctggaacggatccccagcagaggcagcaggcatccgaggcagatgcagctgctgcgacatttagagccaacgaccatcaacatattaggtataacccgctgcaggatgagtgggtgctggtcagcgcacatagaatgaaaagaccatggcaaggtcaggtagagccccagctgctgaaaacagtgcctaggcacgacccgttaaacccgctgtgtccaggtgccatccgggccaacggcgaggttaacccgcaatacgattctacatttctcttcgataatgatttccccgccttacaacccgatgctccaagtccgggcccctctgaccatccactcttccaggccaagtcagcacgcggtgtctgtaaagtgatgtgtttccatccctggtctgatgtaacgcttcccctgatgtcagtgccagagattcgggccgtcgtcgatgcatgggcgagcgttactgaggagctgggcgctcagtatccatgggtgcagatatttgaaaacaaaggtgccatgatgggatgctccaatccccatcctcactgccaggtctgggcgtcttctttcctgccggatatcgctcagcgtgaggagcgtagccaacaagcttacaaatctcagcacggcgaacccctgctaatggaatattctcggcaggaattgctccgaaaagagagattggtgctaacttccgaacattggctagtcctcgtcccattctgggcaacgtggccatatcagacgctactactgcctcgtaggcacgtccgaagactgccggagctgacacctgctgaacgcgatgatctcgcctcaataatgaaaaaacttctaacgaaatatgataatctatttgaaacatccttcccatacagcatgggatggcacggcgccccgaccggttctgaagcaggagctaactggaatcactggcagttgcatgcccactactaccctccccttctgcggtccgctacagttcggaagtttatggtcgggtatgagatgttagcacaggctcagagagatctgacgcctgagcaggcggcagaaagactccgcgctctgcccgaagtgcactaccatctgggacaaaaggacagagagaccgccacaatagcc

SEQ ID NO: 12150 - DNA, 1137 bp, Artificial Sequence
  Description of Artificial Sequence: Synthetic coding sequence
atgagccgcagcgggaccgatccgcagcagcgtcagcaggcgtctgaagcggatgctgccgctgcgacgtttcgggcgaacgatcatcagcacatccgctacaaccctctgcaggacgaatgggtgctggtgtctgcacacagaatgaagcgtccgtggcaaggccaggttgaaccgcagttgctgaagaccgtccctcgacatgatcctctgaatccgctgtgcccaggcgccatacgtgcaaacggagaggtcaatccgcaatacgacagcacattcctatttgataacgatttccctgcattacaacctgacgcgccttcgccgggtccaagtgatcatccgctgttccaagccaaatctgctcgaggtgtgtgtaaggtgatgtgcttccatccgtggagcgatgtgaccctgcccctgatgtctgttccagagataagggcagtggtcgatgcgtgggcttccgttaccgaggagctgggcgcgcagtacccatgggtccagatctttgagaataagggtgcaatgatggggtgtagcaatccacaccctcactgccaggtctgggcgtcaagctttctgccagatatcgcacaacgcgaggagcgcagccagcaggcctataaaagccagcacggtgagccgttgctcatggagtatagccgccaagaattactgcgaaaggaaaggctggtcttgaccagcgaacactggcttgttctagtgcctttttgggcgacgtggccatatcaaaccttgctgcttccgcggcgccacgtgcgccgcctgcccgagctcaccccggcggaacgcgatgatcttgcatctatcatgaagaagctgctgacgaagtatgataacctgttcgagacctccttcccctactcgatgggatggcatggggcgccgaccggtagcgaagcaggagctaactggaatcactggcagctgcatgcacactactacccgccactgctgcggagcgcgaccgttagaaagttcatggttggttatgagatgctggcccaggctcagcgtgatctgacgccggagcaggccgcagagcgtctcagggcattgccagaagttcattaccatctgggccaaaaggacagggaaacggcaaccatcgct

SEQ ID NO: 12151 - DNA, 1137 bp, Artificial Sequence
  Description of Artificial Sequence: Synthetic coding sequence
atgagcagatcagggacagatccgcagcagcgacagcaggcctccgaggccgatgctgctgcggctacattcagggctaacgaccaccagcatatccgttataaccctctgcaggatgagtgggtcttggtttccgctcacagaatgaaaagaccctggcagggccaagtcgaaccacagttgctgaagacggtacccagacacgaccctttgaaccctctgtgccccggagctattcgcgcaaatggggaagtgaacccccaatacgattccactttcctattcgacaatgatttcccagcactccagcccgatgccccaagcccaggcccgtccgatcaccctctcttccaggccaagagcgcacgaggcgtatgtaaagtgatgtgtttccacccgtggtcagatgtcacactcccattaatgtccgtcccagagattcgtgcggtggtagacgcctgggcctccgtcacagaagaactgggggcccagtacccctgggtgcagattttcgagaacaaaggggctatgatgggatgttctaatccgcacccgcattgtcaggtctgggcatccagttttttacctgacatcgctcagagggaggagcgcagccaacaggcgtataaaagccagcatggcgagcccctgctcatggaatactcccggcaggagctgctgcgtaaggagcggctggtacttactagcgagcattggctggtcctggtccctttttgggccacatggccctaccaaaccctgttactgccgcgccgtcacgttcgaaggctgccggaattgacaccggcggagagggacgacctggcctcaatcatgaagaagctgcttacaaagtatgataatctctttgagacatcttttccttacagtatgggttggcacggggcccccaccggttccgaagctggcgccaactggaaccactggcagctgcacgctcattattacccaccactactcaggtcggcaaccgtacggaagtttatggttggatatgagatgctcgcccaagcccagcgggatcttaccccggagcaagcagcggaaagacttcgggccctccccgaggtgcattaccatctggggcagaaagacagagagactgctaccatcgcc

SEQ ID NO: 12152 - DNA, 1137 bp, Artificial Sequence
  Description of Artificial Sequence: Synthetic coding sequence
atgtcccgcagcggcacggacccccagcagaggcagcaggccagcgaagcagatgccgcagccgcaacttttcgcgctaatgaccatcagcacataagatataaccccctgcaggatgagtgggtattggtgtcggcccaccgaatgaagcgtccgtggcagggacaggtggagccccagctgctcaagactgtgccgaggcatgatccgctgaacccgctctgtccaggagcaatccgcgccaatggcgaggtcaacccgcagtatgactcgacgtttctgtttgataacgacttcccggcactacagccagacgctccctcccccggcccctccgatcaccccctgttccaggctaagagcgctcgaggcgtctgcaaggtgatgtgttttcatccttggtccgacgtgacactgcccctgatgagcgtcccggaaattcgcgccgtggtagatgcttgggcatctgtgactgaagagttgggggcccaatacccatgggtccaaatattcgaaaacaagggggcgatgatggggtgctcgaatccccacccgcattgtcaggtgtgggcctcgagctttctgccggatatcgcacaacgcgaggagcgatcccagcaggcctacaagtcacaacatggagagccactgctgatggaatacagtcgccaggagcttttgcgcaaggagaggcttgtgctgactagcgagcattggctggtgctggttcctttttgggccacttggccctaccagacgctgttgctaccccgcaggcatgtgcgacgcctgcccgaactcacgcccgccgagcgcgatgatttagcctcgatcatgaagaagctgttgacaaaatatgataacctttttgaaacatcttttccttactcgatgggctggcacggcgcccccaccggctccgaggcaggagcgaactggaaccactggcagttacacgcgcactactatccccccctgctgcgcagcgctacagtacgcaagttcatggtgggatacgagatgctggcccaggcacagcgcgacctcactccggagcaggcggccgaacgcctgcgagccctgccggaagttcattaccatctcggtcagaaggacagagaaacggcgacgattgct

SEQ ID NO: 12153 - DNA, 1137 bp, Artificial Sequence
  Description of Artificial Sequence: Synthetic coding sequence
atgtctagatccggaactgacccccaacagcggcagcaagcttcagaggcagatgcggccgcggcgactttcagagctaacgaccatcagcacattagatacaacccattgcaagatgagtgggttctcgtgagcgcccacaggatgaaacggccctggcagggccaggtggagcctcagctcctgaagactgtgcccagacatgacccactcaaccccctgtgtcctggcgccatccgcgctaatggtgaggtgaatccccaatacgattcaacgttcctgtttgataatgactttccggcgctccaacccgacgccccgagcccaggtcctagcgatcacccactgttccaggctaagtccgctaggggcgtttgcaaggtgatgtgtttccacccatggtcagacgtcactttgcctttgatgtctgtcccggagatacgagcagtggtggacgcctgggccagtgttactgaggagctcggtgcccagtacccatgggtgcagatttttgagaacaaaggcgcaatgatgggttgtagcaacccccatccacactgtcaggtttgggcttcttcattcctgccagatatcgctcagagagaagagagatctcagcaggcctacaagagtcaacatggagaacctctcctcatggagtacagccggcaggaactcttgcgcaaggaacggctggtccttacctctgaacactggctggtactggtgccgttctgggcgacatggccgtaccagactctgctcctgccaagacggcatgtgaggcgcctgcctgagctgactcctgccgagagggacgatttggcctctatcatgaagaagctgctcacaaagtatgacaacctctttgagaccagttttccttattccatgggctggcacggtgcgccaaccggtagcgaggctggtgctaattggaaccactggcagctccatgctcactactatcctccccttcttagaagcgcgacggtcaggaagttcatggtcggttatgaaatgttggctcaagcccagcgcgaccttacccccgagcaggccgcagagaggctgcgagccctgccggaggtgcattatcacctggggcagaaggatcgggaaaccgcaacaattgct

SEQ ID NO: 12154 - DNA, 1137 bp, Artificial Sequence
  Description of Artificial Sequence: Synthetic coding sequence
atgagcagaagtggcacagatcctcagcagcgccaacaggcttcagaggccgacgccgctgccgcaactttcagagctaatgatcatcagcatatccgctacaacccgctgcaagatgagtgggtgctcgtctctgctcacaggatgaagcgtccttggcagggacaggttgaaccacaactgttgaagaccgtacctcgacacgatccactgaaccctctatgtcccggcgcgatccgagcgaacggcgaggtgaacccacagtacgattcaacatttctcttcgacaatgatttcccagcgctgcaaccagatgcccctagccccggaccctcggaccacccactgtttcaagctaaaagtgcacgcggagtttgcaaggttatgtgtttccatccatggtccgacgtaaccctgcctctgatgtcagttcccgaaatcagagctgtggtggatgcctgggcctccgtgaccgaggagttgggtgcccaatacccatgggttcagatcttcgagaataaaggcgccatgatggggtgtagtaacccccaccctcactgtcaggtgtgggcttcctctttcctgcccgatatagcccagagagaggaacgatcccagcaggcttacaaaagtcagcacggtgaaccacttcttatggagtacagccgccaggaactgctgcgtaaagaacggctagtcttaacatctgaacattggttggtgctcgtgcccttttgggccacgtggccctatcagaccctgctacttcctagaagacacgtccgacgcttgccggagctgactcctgccgagagggatgatctggcctccataatgaaaaagctcctgactaagtatgacaatctttttgaaacatccttcccctatagtatgggttggcatggggctccaacaggatcagaagccggcgctaactggaatcactggcagctgcatgcacattactaccctccgctgctccggagcgccacggtgagaaaattcatggtggggtatgagatgctcgcccaggcccaaagggacttaactcccgagcaagctgcagaaagactccgggctcttcccgaggtgcattatcatctgggccagaaggaccgcgagactgccactattgct

SEQ ID NO: 12155 - DNA, 1137 bp, Artificial Sequence
  Description of Artificial Sequence: Synthetic coding sequence
atgagtcgatccggaacagaccctcagcagagacaacaggcaagcgaggccgacgccgcagcagctaccttccgcgccaatgatcaccagcacattcggtataatccactgcaggacgagtgggtgctcgtgtctgcccaccggatgaagagaccttggcaggggcaggttgaaccacagctgcttaaaacagtcccacggcacgatcccttaaaccccctgtgcccaggtgcgataagggcgaacggcgaagtaaaccctcagtatgacagcacatttctgtttgataatgacttccccgcacttcagccggacgcacccagccctgggccttctgatcatccgttgttccaggccaagtctgctagaggcgtgtgtaaggtgatgtgttttcacccttggtccgacgtcactcttcccctaatgtccgtgcccgaaataagagccgtggtcgatgcgtgggcttctgtgacggaggagctgggtgcacaatacccttgggtccagatctttgagaacaagggggcaatgatgggctgctcaaaccctcaccctcactgtcaggtgtgggcttcaagctttttgcctgacattgctcagcgtgaagagcgtagtcagcaggcttataaatcccaacatggcgagccactgctgatggaatatagcaggcaagaactgctccggaaagagaggttggtgcttactagtgagcattggctcgtcttggtgcccttctgggccacctggccataccagaccttgcttcttccgaggcgtcacgttcgacggctccccgaactgacaccagctgagagagatgacctggcgagcattatgaaaaagctgctgacgaaatatgacaatctgtttgaaacaagcttcccctacagcatgggatggcatggagccccgacgggatcagaggccggtgccaactggaatcactggcagttgcacgcgcactactacccgccactgcttaggagtgccacagtgcgtaagttcatggtgggctacgaaatgctagcacaggcccagagagatctgacaccagaacaagcagccgagcggttgagggccctgcccgaagtgcactatcaccttggacagaaagatagagaaactgcaactattgct

SEQ ID NO: 12156 - DNA, 1137 bp, Artificial Sequence
  Description of Artificial Sequence: Synthetic coding sequence
atgtcacgatccggaaccgacccacagcagaggcagcaggcatccgaggcagacgcagccgctgcaaccttccgggcaaatgaccaccagcacattcggtataaccccctccaggacgaatgggtgttggtttccgcgcataggatgaaaagaccctggcagggtcaggtggagccacagctgctgaagactgtgcctagacacgaccccttgaacccactgtgtcctggagctattagggcgaatggtgaagtgaatccccagtatgacagcacttttctgttcgataatgacttcccagccctccagcccgatgcacctagtcccggaccgagtgaccacccactgtttcaagccaagagtgcaagaggcgtctgcaaggttatgtgctttcacccatggtccgatgtgaccctgcccctgatgtccgtgcccgagattcgggctgtagtagatgcctgggcatcagtaaccgaggagctcggtgcgcagtacccgtgggtgcagatctttgagaataaaggggccatgatgggctgctcaaatcctcacccacattgtcaagtgtgggcatccagcttcctgcccgacatcgctcagagggaagagcggtcccagcaagcctataagtcacaacacggcgaacctttgctgatggagtattctcggcaggaacttctccgaaaagagcggctggtgctcacatcagaacactggttggttctcgtccccttttgggctacgtggccataccaaacgctgctgctgcctcggcggcacgttcgaagactgccggagctcactccagccgaacgcgacgatctcgcctctattatgaagaagctgctcacaaagtacgataacctgtttgagactagctttccctactccatggggtggcacggcgcccctacaggaagtgaggctggtgccaactggaaccactggcagctccacgcacattactatccacccctcctgcggtctgcgacggttagaaagttcatggttgggtacgagatgctggcgcaagcccaaagagacctgacacccgagcaggccgcagagagactgagagctctgccagaagtgcactaccatttgggacagaaagacagagaaactgctacaattgcc

SEQ ID NO: 12157 - DNA, 1137 bp, Artificial Sequence
  Description of Artificial Sequence: Synthetic coding sequence
atgtctagatcagggaccgaccctcagcagagacaacaggcttctgaagccgacgccgccgccgcaacctttcgcgctaatgatcaccaacatatacggtataaccccctacaggacgagtgggtgttagtgtcagcccatcgaatgaaaaggccttggcagggccaggtggagcctcagctgctgaaaacagtcccaagacacgaccctctgaatcccctctgccctggtgcaattagggcaaatggagaggtgaaccctcagtacgatagcaccttcctgtttgacaacgattttcccgcactgcagcccgacgccccttctccaggaccctcagaccaccctctgtttcaagcaaaatctgctagaggcgtttgcaaagttatgtgctttcacccatggagtgatgttaccctgcccctgatgtctgtgcccgaaatccgagccgtggttgacgcctgggcctccgttactgaagagctgggggcccagtatccatgggtgcaaatctttgaaaacaaaggcgctatgatgggctgcagcaatccccaccctcactgccaggtgtgggctagcagttttctacccgatatcgctcagcgagaggaaaggagccagcaggcatacaagtcccagcatggggaaccattactcatggagtatagtagacaggaactgcttaggaaggaacggctggtgctgacctccgaacattggctcgttctggtgcctttctgggccacatggccttatcagacactattgctgcctcgcagacatgtgcggcgcctccctgaactaactcccgccgaaagagacgatctggcctctatcatgaaaaagctgctgactaaatatgataacctgttcgagactagcttcccttattccatgggctggcatggcgcacctacaggcagcgaggctggtgcaaactggaaccactggcaacttcatgcacactactaccctcccttactgcgctctgcaacagtcagaaagttcatggtgggctatgaaatgctcgcccaggctcagcgggatttaacccctgaacaggctgcagagcgactcagagcactacccgaagtgcactaccacctgggtcagaaggatagggagaccgcaaccatcgct

SEQ ID NO: 12158 - DNA, 1137 bp, Artificial Sequence; identical to SEQ ID NO: 12140
  Description of Artificial Sequence: Synthetic coding sequence

SEQ ID NO: 12159 - DNA, 1137 bp, Artificial Sequence
  Description of Artificial Sequence: Synthetic coding sequence
atgtccagaagtggcaccgatcctcaacagagacagcaggcctcagaggcagatgcggctgcagctactttcagagctaacgaccatcagcacatacgttacaatccactgcaggacgaatgggtcctcgtttcagctcatagaatgaagaggccgtggcagggccaagtggagccacagctacttaaaacagttcctcggcacgatccactgaatccgctttgccccggggccatccgcgctaacggcgaggttaatcctcagtacgattccacatttctcttcgataacgattttcccgcattacaacctgatgcccctagccccggacccagtgatcacccactcttccaggcaaaatctgcaagaggtgtgtgcaaggtgatgtgctttcacccctggagtgacgtcacactgccgctgatgtctgtgcccgaaatcagggcagtcgtggatgcatgggctagcgtgaccgaggaactgggcgctcaatacccctgggttcagatcttcgagaataagggcgcgatgatggggtgttctaaccctcatcctcactgccaagtttgggcttcaagtttcctgcctgatatcgctcaaagggaagaaaggagtcagcaggcctataagagccagcacggggaacccctcctcatggaatatagtagacaggaactgctaagaaaggaaaggctcgtcctaacaagtgaacactggctggtgttagtccccttctgggccacatggccttaccagaccttattgctccctaggcgtcatgtgagacggctgcccgaacttaccccagctgagcgagacgatctagcaagcatcatgaaaaagctattgaccaaatacgataacctgtttgagacgtctttcccatactccatgggttggcacggcgccccaacaggctccgaagctggagcaaattggaaccactggcagctccatgcccattattatccccccctcttgcgatccgccacagtgcgcaagtttatggtgggatatgagatgctagcccaggcacagcgcgatttaacacccgaacaggctgccgagaggctcagggctctcccagaggtgcattaccatctggggcagaaggacagggaaacagccacgatcgca

SEQ ID NO: 12160 - DNA, 1137 bp, Artificial Sequence
  Description of Artificial Sequence: Synthetic coding sequence
atgtcacggtcaggaacagatcctcagcaacgccagcaggcctcagaagccgatgccgctgctgcgacattcagagcaaatgatcatcagcacatcaggtacaaccctcttcaggatgaatgggttttagtctcagcacaccgaatgaaaagaccttggcaggggcaggtggaaccacagcttctcaaaacagtcccccgacacgatcctcttaaccccctctgcccaggagctatcagagcaaatggggaagtaaacccacagtatgattcgacttttctctttgataatgattttccggcgttacagcccgatgctccttcccccggacccagtgatcatcccctcttccaggctaaatctgctcgaggggtgtgtaaggtgatgtgtttccatccctggtcggatgtgacattaccccttatgagtgtcccagaaatacgggccgtggtggatgcatgggcaagtgtgacagaagaattaggagcccagtatccttgggttcaaatatttgaaaacaaaggagctatgatggggtgctccaatccccatccccattgccaagtgtgggcctcttcttttcttcccgacatcgcccagcgggaagaacgctcacagcaggcctacaaaagtcagcacggagaaccactccttatggagtatagtcggcaggaactcttaaggaaagaacggcttgtcctgacatctgaacactggctagtgctcgttcctttctgggctacttggccttatcagactctccttctccccaggcgccatgtaaggcgcctacctgaactgactcccgcagaaagagatgatctagcctcaatcatgaaaaaactccttacaaaatatgataacctctttgaaacatcattcccatattctatgggatggcacggagcccctactgggtctgaagccggagcaaactggaaccactggcagttgcacgcacattactatcctccactcttgaggtctgcaactgtaaggaaatttatggtgggatacgaaatgttagcccaggcccagagagatctcacaccagagcaggccgcagaacggctaagagccctaccagaagtgcactaccatttggggcaaaaagatcgggagacagctacaattgcc

SEQ ID NO: 12161 - DNA, 1137 bp, Artificial Sequence
  Description of Artificial Sequence: Synthetic coding sequence
atgagccgtagtggcactgatcctcagcagcgtcagcaggccagtgaggctgatgccgcggcggcaacctttcgggcaaacgatcaccagcacattaggtacaaccccctccaggatgaatgggtgctcgtgtccgcccatagaatgaagcgcccttggcagggacaggtggaaccacaactgttgaaaacagtgccacggcacgatcctctgaatcccctctgtcccggcgccattcgagctaatggcgaagtgaaccctcagtatgactccactttcctattcgacaatgattttcctgccctgcagcccgatgccccatctcccggaccgtctgaccaccccctgttccaggccaagtcggcccggggggtgtgcaaggtgatgtgcttccatccttggagtgatgttacactaccactcatgagcgtacctgagattagagcggttgtcgacgcttgggccagcgtgactgaagaattgggcgctcagtatccatgggtgcagatctttgagaacaaaggcgcaatgatgggctgtagcaacccccacccacattgtcaagtatgggcttcttcctttttgccagacatcgctcagagagaagagcggtcgcagcaggcctataaatctcagcacggggagcctttgctgatggagtattcccggcaagagctcctacgcaaggaaaggctggtgttaacatcagaacactggctggtcttggtgcctttttgggcaacttggccctaccaaactctcctgctccccaggcgacacgtgcggagactgcccgagctgacaccagctgaaagggatgatctggcctcaattatgaagaagctgctcaccaaatatgacaacctgtttgaaactagcttcccatatagcatgggttggcatggcgcaccaacaggaagtgaagcgggcgctaactggaatcattggcagctgcacgcacattactatccccctctactacgctcggcgaccgttagaaagttcatggtcggttacgagatgcttgcccaggcacagcgagacctgacgcctgagcaggcagctgaaagactcagagctctgccggaggtgcactaccacttgggccagaaggatagggaaacggccacaatcgct

SEQ ID NO: 12162 - DNA, 1137 bp, Artificial Sequence
  Description of Artificial Sequence: Synthetic coding sequence
atgagcaggtccggcactgacccgcagcagcgccagcaggcctcagaagccgacgccgctgccgccaccttccgggctaatgaccatcagcacataaggtataacccattgcaggacgaatgggtgctggtgtccgcccatcggatgaaaaggccgtggcaagggcaggtcgaaccccagctgcttaagactgtgcctaggcatgaccctttaaacccactctgccccggagccatacgtgccaacggcgaagtgaacccccagtacgattctactttcttgttcgataacgattttcccgcgcttcagccagatgctcctagccctggtccctcagaccatcctctctttcaggccaaatcagcccgcggtgtgtgtaaggttatgtgttttcatccatggtctgacgtgaccctccctttgatgtctgtacccgaaatcagagccgtggttgacgcgtgggcctccgtgaccgaagagctgggagcacagtatccctgggtgcagatctttgaaaataaaggtgctatgatgggatgctccaacccacacccgcactgccaggtgtgggcttcatcctttctgcccgacatagcacaacgcgaggaacgctcgcagcaagcttataagtcccagcacggggagccgttgctgatggaatattctcgccaggaactgctcagaaaagagaggctcgtcctgactagcgagcactggctggtgttagtgccattctgggccacttggccataccagaccctcctgcttcctcgcagacacgtccgtcgactgcctgaactcacacccgcggagcgggacgacctggcatcaatcatgaagaagctgcttacaaagtatgacaacctgttcgaaacctcctttccatactcaatggggtggcacggcgcccccaccggctcagaggcgggggccaactggaaccactggcaactgcacgctcattactatccacctctcctcaggagtgccaccgttcgaaaattcatggtgggatacgaaatgttggctcaggcccaaagagatctgactcccgaacaggctgccgaacggctgagagccttgccagaagtgcactatcatttgggtcagaaggatagagaaactgcaactattgct

SEQ ID NO: 12163 - DNA, 1137 bp, Artificial Sequence
  Description of Artificial Sequence: Synthetic coding sequence
atgtccaggtcaggcacagaccctcaacagcgacaacaagcatccgaggcggatgctgccgctgcaacgtttcgagccaacgaccaccaacatattagatacaacccactgcaggatgagtgggtcctagtgtctgcacaccggatgaaacgtccctggcaggggcaggttgagccccagcttctaaaaaccgtgcccaggcacgaccccttgaatcccctgtgcccaggggccattagggccaacggcgaagtgaatccgcaatatgatagcacttttctgttcgataatgacttccctgctctgcaaccagatgccccatcccctggacctagcgatcatcccttattccaggctaaatcagcccgcggggtctgtaaggtgatgtgctttcatccctggtcagacgtgacactaccgttgatgtcagtgcccgaaattagggctgtagttgacgcttgggcatccgtgacagaagagctgggggcgcagtacccgtgggtgcagatctttgagaacaagggagcaatgatgggctgctctaatccccaccctcactgtcaggtttgggcctcatccttcctcccagatatagcccagcgggaggaaagaagtcagcaagcctataaaagtcaacatggtgagcctctgttaatggagtacagcaggcaggagctgctgcggaaggagagattagtcctgactagtgaacactggctcgttctcgttccattctgggccacctggccctatcaaactctactgttacctcggcggcacgtgcggagactcccggagttgacaccagcagagcgagatgatttggcctctataatgaaaaaattgttgaccaagtatgacaatcttttcgaaacatccttcccatatagcatgggctggcatggcgcaccaactggctcggaggccggagccaattggaatcactggcagctgcacgcacactattatcccccactattgagatctgcaacagtcaggaagttcatggtggggtatgaaatgctggctcaagcccagcgtgacctgaccccagagcaggccgcagagcggcttcgcgccctgccagaagttcattatcatttaggccagaaggacagggaaaccgccactatcgcc

SEQ ID NO: 12164 - DNA, 1137 bp, Artificial Sequence
  Description of Artificial Sequence: Synthetic coding sequence
atgtctcgaagcggcactgacccccagcagaggcaacaggccagcgaggcggatgcggcggctgcaacattccgcgcaaacgaccatcagcatatcaggtataaccccctgcaggatgaatgggtgcttgttagtgcgcatcggatgaagaggccttggcagggccaagtcgagccccagctgctgaaaaccgtgccacgacacgacccactgaaccccttgtgtccaggagcaatcagagctaatggagaggttaacccacagtacgactccaccttcctcttcgataacgatttcccagccctacagcccgacgcacccagtcccggcccatcagaccaccctctgttccaggcgaaatcggcgagaggggtgtgtaaagtaatgtgttttcatccctggagtgatgtaactcttccactgatgagtgtccctgagatccgcgccgttgtggacgcgtgggcatccgtaaccgaagagctgggggcccagtatccttgggttcagatttttgagaacaagggcgccatgatgggctgctccaatcctcatccacattgtcaagtttgggcgagttcattccttcctgacattgctcaaagggaggaacggtcccagcaggcgtataaatcacagcacggagagccacttttgatggagtacagtagacaggagctccttcggaaggagcggctagtgttaaccagtgaacactggttggtgcttgtgccgttctgggcaacttggccctaccagacccttctgctccctcgacggcacgttcgtagactgccggaactaactcctgctgaacgcgatgaccttgcgagtatcatgaaaaagctcttgacgaaatacgacaacctgttcgagactagttttccctattcgatgggctggcacggagccccaacaggctccgaagccggagcgaattggaaccactggcagctgcatgcgcactactatccacccctcctacggtccgccacagtacgaaagttcatggtcggctacgaaatgctggcacaggcacaacgggacctaacccccgaacaggccgctgaacgcctccgcgcgctacctgaggtccactatcacctcggccagaaggaccgagaaacagctacgatagct

SEQ ID NO: 12165 - DNA, 1137 bp, Artificial Sequence
  Description of Artificial Sequence: Synthetic coding sequence
atgtcaagatccggaaccgatccacaacagcgccagcaggcatcagaagccgacgccgccgctgctactttcagagccaatgaccaccagcatatccgctacaaccccctccaggatgaatgggtgcttgtctcagcccatcggatgaaaagaccttggcaggggcaggtcgaaccccaacttctgaaaactgttcccagacatgaccctctgaacccattgtgcccaggtgccattcgggcaaacggggaggtgaacccacagtacgattccactttcctttttgacaatgactttcccgctttgcagccagatgctccctctccgggtccttccgaccacccactttttcaggccaagtccgcacggggggtgtgtaaagtgatgtgctttcacccatggagtgatgtgaccttgcctttgatgtccgtgcctgagatccgggcggtggtggacgcctgggccagtgttaccgaagaactcggggcccagtatccctgggtccagatatttgagaacaaaggggctatgatgggctgcagcaatcctcacccccattgccaggtttgggccagctccttccttcctgacatcgcccagagggaggaaaggtctcagcaggcatataaatcccagcatggggagcctctgttgatggagtattctaggcaggaactgcttcggaaggaaaggctcgtgctgacttcagaacactggctcgtcctcgtgcccttttgggccacttggccatatcagacgctgctgctccctcggaggcacgttcggagacttcccgagttgactcctgccgaaagagatgatctggcaagtataatgaagaagctcttgactaagtatgataacctgtttgagacgtcctttccatatagtatggggtggcacggggctcccacgggctctgaagcgggcgctaactggaatcattggcagttgcatgcccattattaccccccattgctgcggagtgctactgtgagaaaatttatggttggatatgagatgctggcccaggcacagcgggatcttacaccagagcaggctgcagaacgactcagagctcttcccgaagtacattatcacctgggacaaaaagaccgggagacagctaccattgct

SEQ ID NO: 12166 - DNA, 1137 bp, Artificial Sequence
  Description of Artificial Sequence: Synthetic coding sequence
atgagtcggagcgggactgatccacagcagcgacagcaggcatcagaggctgacgcagcggcggcaactttcagagcaaatgaccaccagcatatcagatacaacccattgcaagacgagtgggtcctggtgagtgcacaccgaatgaagcgaccatggcaaggacaggtcgagcctcaactgctgaagacagttcccagacacgaccctctaaacccattatgtccgggcgcaatcagggccaatggtgaggtgaacccacagtacgacagcacgttcctgtttgacaatgacttccccgccctccaacctgatgccccttcccctggtccaagtgatcaccccctctttcaagcaaaatcggctcggggcgtgtgtaaagtgatgtgtttccatccgtggtctgacgtgacactcccactcatgtccgtcccagagattagagccgtggtggacgcttgggcgagtgtaaccgaagaactgggggcccagtatccctgggtgcagatcttcgagaataaaggggcgatgatgggatgctcaaacccccatccccactgccaggtgtgggcatccagttttttgcctgatattgcccagagagaggaacgctcccagcaggcatacaagagccagcacggcgagcccctgctcatggagtatagccgacaagagctactgagaaaggagaggctggtgctcacctctgagcattggctggttttagtgccattctgggccacttggccgtaccagacgctcttacttcccaggcggcacgtccggagactgccggagcttacccctgccgaacgcgacgatcttgcctctatcatgaaaaagcttttgacaaagtatgacaatttgttcgaaacatctttcccctatagcatgggctggcatggggcacccacaggctccgaagcgggcgcgaattggaaccattggcaattgcatgctcattattatcctcccctgcttaggagcgctaccgtaagaaagtttatggttggatacgaaatgctggcgcaggcgcaacgtgatctgacccctgagcaggccgcggaaagactacgcgcactgcctgaggtgcactaccatctgggtcagaaggatcgggagactgcaaccatcgcc

SEQ ID NO: 12167 - DNA, 1137 bp, Artificial Sequence
  Description of Artificial Sequence: Synthetic coding sequence
atgtcccgctccggtaccgaccctcagcaacgtcagcaagcttctgaagcggacgcagctgctgctaccttcagagcaaacgaccaccagcatattagatacaaccctctgcaggacgagtgggtgttggtgtccgcccaccgcatgaagagaccttggcagggccaggtggagcctcagctactcaagacagttcccagacatgatcctctcaaccccctttgcccgggagcaatacgagcaaatggggaggtgaacccgcaatatgattccacttttctcttcgacaacgacttccctgcattgcagcctgatgctccatcgcctgggccatcagatcatcccctgttccaagcgaagagcgccaggggtgtctgtaaggtgatgtgcttccacccctggtctgacgtcacccttccacttatgagcgtccctgagatacgtgccgtcgtcgacgcatgggcatccgttactgaggaactgggcgcccaatatccatgggttcagatttttgagaacaagggggcgatgatgggatgctctaatcctcacccgcattgccaagtgtgggcttctagctttttacccgatatcgctcagcgcgaggaaagatcgcagcaggcctacaagtcacaacacggcgagccactcctgatggaatactccaggcaggaactcctccgaaaggagagactggtcctgactagcgaacattggctggtgctggtgccgttctgggccacttggccgtaccagacattactccttccgcggcgtcacgtgcgccgcctacctgagctgacacctgctgagcgggacgacctcgcaagtattatgaagaaactgctgactaaatacgacaatctctttgaaaccagttttccctattctatgggctggcacggggcccccaccggctccgaagccggggctaattggaaccactggcagcttcacgcccactactaccctccactgctgaggtctgcaaccgtaaggaaattcatggtgggctacgaaatgcttgctcaagcacagcgagacctcacccctgaacaggctgcagaaaggctgcgtgctctccccgaagttcactaccaccttggccagaaagatcgcgagacagccacgatagct

SEQ ID NO: 12168 - DNA, 1137 bp, Artificial Sequence
  Description of Artificial Sequence: Synthetic coding sequence
atgagtcgatccggcacggacccccagcaaagacagcaggcctccgaagccgacgcagccgccgctacgttccgcgctaatgaccatcagcacatcaggtacaaccctctacaggatgaatgggtcttggtgagcgctcaccgcatgaaacgtccatggcaggggcaagtggagcctcagcttctgaaaaccgtgcccagacacgacccgctgaatcctctgtgcccaggtgccatacgcgcaaacggcgaagtcaatccccagtacgactccactttcttgtttgacaatgatttccccgccttgcagcccgacgcacccagtcccgggccttctgaccacccgctctttcaggctaagagcgcacggggcgtctgtaaggtaatgtgcttccacccctggtcagatgtaacactaccactcatgagtgtgcctgagattcgggcggtggtcgatgcttgggcaagcgtgacagaggagctcggcgctcaatacccttgggtgcagatcttcgaaaataaaggcgccatgatgggctgttctaatccacatcctcattgccaagtgtgggcaagttccttcctgcctgatattgcgcagcgcgaggagagaagtcaacaggcatataaatcacagcacggagaacccctgcttatggagtactcccgtcaggaactcttgcggaaggaacgcctcgtactgacctccgagcattggttggtccttgttccgttctgggcaacctggccttaccagacactgctgctacctcggcgtcatgtccggcgactccctgagctcacacccgcggaacgcgatgacctcgctagtattatgaagaaactgctcaccaaatacgacaatctctttgagacatcattcccctatagcatgggttggcacggcgcccctaccggtagcgaagcaggggccaactggaaccattggcaactgcatgctcactattatccgcctctgctgcggtccgccaccgtccgaaaatttatggtcgggtatgagatgctggctcaagctcaacgcgatttgactcccgaacaagcggcagaacgacttcgggcccttccagaagttcattaccatcttggacagaaagatcgcgaaacagccacgatcgca

SEQ ID NO: 12169 - DNA, 1137 bp, Artificial Sequence
  Description of Artificial Sequence: Synthetic coding sequence
atgtccaggtcaggaaccgacccacagcagcgccagcaagcctcagaggctgatgccgccgccgctacattccgggctaatgaccaccagcatattagatataaccctctgcaagatgaatgggtgttggtgagtgctcacagaatgaagcgcccatggcaaggtcaggtggagccccagctgctgaagacagtcccgcgacatgaccccctgaaccctctgtgtcccggcgctataagggccaacggagaagtgaacccgcagtatgactcaacttttctgttcgacaatgacttccccgcacttcagcccgacgctccatcgcctgggccctccgatcacccactttttcaggcaaagagcgcccgaggagtctgcaaggttatgtgctttcacccttggtctgatgttaccctccctctgatgtctgtccctgagatacgggctgtcgtagatgcctgggcctcggtaaccgaagaattgggtgcccagtatccctgggtccagatattcgaaaacaagggagctatgatgggatgctcgaacccacaccctcactgccaggtgtgggcgtcaagcttcctcccggatatagcccagagagaggagaggagtcagcaggcatacaaaagtcagcacggcgagcctctgctgatggagtatagtagacaggaactgctccggaaggaacggctggtgctaacctcagagcactggctggtgcttgtgcccttctgggcaacctggccctatcagactctgctactcccaaggcggcatgtgagacgcctgcccgagctaacgcccgccgaacgggatgacctggcaagtatcatgaagaagctcttaactaaatacgataatttattcgaaacctctttcccgtactccatggggtggcacggagcccccaccggttccgaagccggagctaactggaaccactggcagttacacgcccattactatccccctctgctgagatccgcgaccgtgaggaaattcatggtcggttatgagatgctcgctcaggcacagagagaccttacacctgagcaggcagccgaaaggctgagggccctacccgaagtgcactaccacctgggtcagaaagaccgcgagactgcaaccatcgcg

SEQ ID NO: 12170 - DNA, 1137 bp, Artificial Sequence
  Description of Artificial Sequence: Synthetic coding sequence
atgtccagatctgggacagatccgcagcaacgccagcaggcaagcgaggctgacgcggctgctgctacattcagagccaatgaccaccagcatatccggtataacccgctccaggatgagtgggtgttggtctctgctcatcggatgaaacgcccttggcagggccaggttgaaccccagttactcaagaccgtgcctaggcacgaccctcttaaccctctgtgtcccggagcgattcgcgcgaatggggaggttaacccacagtacgatagcacattcctgttcgacaatgatttcccagccctccagcccgacgccccatcacccgggccatcagaccatcctctgtttcaggccaaaagtgctagaggcgtttgcaaagtgatgtgcttccatccttggtccgatgttaccttaccactcatgtcagtgcctgaaatcagggctgtggtggatgcatgggcttccgttaccgaggaactgggcgctcagtatccttgggtccaaatatttgaaaataagggcgccatgatgggttgctcaaatccacacccgcattgtcaggtctgggcgtccagctttttgccagacatcgcccagcgcgaagagaggagtcagcaggcctataagagtcagcatggcgagccattactgatggagtactctcgccaggagttgttaaggaaagagcggctggtgctcacctcagagcattggctcgtgctggtgccgttttgggcgacttggccctaccagactctccttctcccgcgtagacatgtgaggcgtctacccgagctgacccctgcggaacgtgatgatttggcgagtattatgaaaaaactgctcacaaagtatgataatctcttcgaaacaagtttcccctactctatgggctggcacggcgctcccactggatcagaggctggagcaaattggaaccattggcagttgcacgcgcactactaccctcccttgctgcgttcggctacagttaggaagttcatggttggctatgagatgctcgcacaagcgcaacgggatctcacgcccgagcaggcggcagaacgactgagagccttgccagaggttcattaccatctcggtcaaaaagaccgggagactgccaccatagct

SEQ ID NO: 12171 - DNA, 1137 bp, Artificial Sequence
  Description of Artificial Sequence: Synthetic coding sequence
atgagtaggagcggcaccgaccctcagcagagacaacaagcctctgaagccgatgccgcagctgccacctttagagctaacgatcaccaacatatccgctataacccgctgcaggatgagtgggtgctcgtgtcagcccataggatgaagcgaccctggcaaggccaagtggagccgcaactgcttaagaccgtcccgagacatgatcctttgaatcccctgtgccccggagctatcagagctaacggcgaggtgaacccacagtacgatagcaccttcctgttcgataatgatttcccagccctgcagcccgacgcccccagccccggcccgagcgatcatccccttttccaggcaaaaagcgctcggggagtgtgcaaagtaatgtgcttccacccttggagcgatgttaccctccctcttatgtcagtgccagaaatccgcgcagtggtggacgcatgggcatcagttacggaggagctcggagcacaatatccctgggtacaaatctttgagaacaagggagctatgatgggctgcagtaacccccatccccactgtcaagtctgggcgagtagtttcttaccagacatcgcacagcgcgaagaaaggagccagcaagcatataagtcacagcatggggagccgttgttaatggaatatagcaggcaggagctgcttcgtaaggaaaggttggttcttacctctgagcactggctggtccttgtgccattctgggctacgtggccataccagacacttttgctgccgcggcggcacgtaaggaggttgcccgaacttaccccagctgaacgcgatgatctcgcgtcgatcatgaaaaagctcttaactaagtacgataacctgtttgaaacgagtttcccttacagtatgggctggcacggtgccccaaccggctcagaggccggagcaaattggaatcactggcagctgcatgctcattactaccccccactgctgcgtagtgccacagtcagaaaattcatggtggggtacgagatgctagcacaggcccagcgtgacttgacgcctgaacaggctgcagaacgcctcagggcgcttcctgaagtgcactatcacctcggacagaaggaccgtgagaccgcaaccatcgca

SEQ ID NO: 12172 - DNA, 1137 bp, Artificial Sequence
  Description of Artificial Sequence: Synthetic coding sequence
atgtcaaggtcagggacagacccgcagcagcggcagcaggccagtgaggcagacgccgccgctgcaacgtttcgagctaacgaccatcagcacataaggtacaaccctcttcaggacgagtgggttcttgtgtctgcccacagaatgaagcgaccttggcagggtcaggttgaaccacaactgctgaagacagtcccccgccacgaccctctgaatccactgtgcccaggtgctattcgtgccaacggggaggtaaatcctcagtatgactccacgtttctcttcgataacgactttcccgcgctgcagccagatgccccgagcccgggcccgtctgatcaccccctcttccaggcgaagtccgccagaggtgtctgcaaggtgatgtgcttccacccgtggtcggacgtgacactgccacttatgtccgtcccagaaatacgggccgtcgttgacgcctgggcgagcgtcacagaggaattgggtgcccaatatccgtgggtgcagatctttgaaaacaaaggtgccatgatgggatgctccaatcctcacccacattgccaggtgtgggccagtagtttcctacctgatatcgctcagcgagaagagaggagccagcaagcctacaaatctcagcacggggagcctctattaatggagtactcacggcaggaactgcttcgaaaggaacgcctcgtgctgacttcagagcattggctggttttagtgcccttttgggcgacctggccctaccagacactcctgttgcctcgccgccacgtgcgccgactacccgagctaactccggccgagcgggacgatcttgcgtcaattatgaaaaagctgctgactaagtacgataacctgtttgagacatcattcccttactcgatggggtggcatggggctccaactggaagcgaagcaggtgcaaattggaatcattggcagctccatgctcattattacccccctcttctgagatccgctaccgtgcgtaagtttatggtgggatacgaaatgttggctcaggcacagcgggatttgacccccgaacaggctgccgagcgattgcgagccctccccgaagtacattatcacctggggcagaaagatagggagacggccaccatcgcc

SEQ ID NO: 12173 - DNA, 1137 bp, Artificial Sequence
  Description of Artificial Sequence: Synthetic coding sequence
atgagcagaagcgggaccgatccacaacagcggcagcaggcatctgaagcagatgctgccgctgcaacattccgcgcaaatgatcatcagcatatccgctacaatcctttgcaggacgagtgggtcctggtatccgctcaccggatgaagagaccttggcaaggccaggtggagccacagctcctgaagactgtgccacgacatgatcctctcaacccgctgtgtcccggggctatccgggcgaatggtgaggtgaatccacagtacgacagcacattcctgttcgacaatgacttccctgctttacagccggacgcaccatccccgggtcccagcgatcatccgttattccaggccaaatctgcccgtggagtgtgcaaggtcatgtgcttccacccctggagcgatgtgaccctgcccctgatgagcgtacccgagatccgcgcagttgtcgacgcttgggcatccgtcactgaggagttgggcgcgcagtatccttgggtgcagatttttgagaataagggtgccatgatgggctgtagcaacccccatcctcattgccaggtgtgggcttcttcattcctgccagacatagctcagagagaggaaagaagccagcaagcttacaaatcccagcatggggaacccctgctgatggaatacagtagacaggagctcctgcggaaggagagactggtgctgacatccgagcactggcttgtgctggtccccttctgggctacatggccataccagactctgctgctgcctagacgtcatgtaagaagattgccggagctgacacctgccgagcgagacgatttggcctctattatgaaaaagctgctgacaaagtatgataacttgtttgagacatctttcccttacagcatggggtggcacggagctccaactggcagcgaggctggggcaaattggaatcactggcagctccacgcgcactactatcctccattactgaggtctgctacggtgaggaagtttatggtgggatatgagatgctggcccaagctcagcgggatctgactcctgaacaggctgctgaaaggctgagggcgctgcccgaagttcactaccacctgggacagaaagatagggaaacagccacgattgct

SEQ ID NO: 12174 - DNA, 1137 bp, Artificial Sequence
  Description of Artificial Sequence: Synthetic coding sequence
atgagcaggagcggcacagatccacagcagcgccagcaagccagcgaggccgacgctgccgcagctacatttcgggctaacgaccatcagcacatcagatacaatccgttgcaggacgaatgggtcctggtttcggcgcaccggatgaaaagaccctggcaaggccaggtggagccacagctccttaaaaccgttccgaggcacgaccccttgaacccgctgtgtcccggcgctattcgggccaacggtgaagtgaatccgcagtatgattcaactttcttgttcgataatgacttcccagcactacaaccagatgccccatctcccggtccaagcgatcaccctctgtttcaggccaaaagcgcgcggggagtctgcaaggtaatgtgcttccatccatggtcggacgtcacgttgccgctaatgagcgtgcccgagattagagccgtggtggacgcatgggcgagtgttactgaagagctgggcgcacagtacccgtgggtgcagatattcgagaataagggagccatgatgggctgttcgaatcctcacccacactgtcaagtgtgggcatctagctttctgcctgacattgctcagcgagaggaacgctcccagcaagcctataagagccagcatggagaacccctcctcatggaatactctagacaagaactgctccggaaggagcgcctcgttttaacttccgagcactggctcgtattggtccctttctgggccacgtggccctatcaaacgctgctgctaccgaggagacacgtacgcagactgcctgagctgacaccagctgagcgcgatgacctggccagcattatgaaaaagctgctcacgaaatatgacaaccttttcgaaacctccttcccttatagcatgggatggcatggtgcccccaccggaagcgaggcaggcgccaactggaatcactggcaattacacgcccattactaccccccacttctgcgatcggcaacagtgaggaagtttatggtgggctacgagatgctcgcacaggcacaaagggatctgacaccagaacaggccgcagagcgtctgagggcactgccagaggttcactaccatcttgggcaaaaagaccgcgagacagctacaatcgcg

SEQ ID NO: 12175 - DNA, 1137 bp, Artificial Sequence
  Description of Artificial Sequence: Synthetic coding sequence
atgtcaagatctggaactgatccacagcagcgtcagcaggctagtgaagccgacgctgccgccgccactttccgcgctaatgaccatcaacacatacggtataatccattacaagacgaatgggtgctcgtgtccgctcaccgaatgaagagaccgtggcagggccaggtggaacctcagctcctcaaaacagtcccacgccatgatcctctgaatcccctgtgtcctggcgccatcagagcaaacggcgaggtgaaccctcaatatgattcgacttttttgttcgacaacgactttccagcccttcagcctgatgccccaagccctggcccttccgatcatcccctatttcaggcaaaatctgcccggggagtttgcaaagttatgtgtttccacccttggtcagacgtcactctccctcttatgtcagtgcccgagataagagccgtggtcgacgcgtgggccagcgttacagaagaactgggcgctcaatacccttgggtgcagattttcgaaaacaaaggagccatgatggggtgttcaaatccccatccgcactgtcaggtgtgggcctccagttttttacctgacatcgcccagagagaagagagatcgcagcaagcatacaagagccagcacggagagcccctcttgatggagtactcccgacaagaactgctaagaaaggaacgcctcgtattgaccagtgagcactggctggtgctcgtaccattctgggccacctggccatatcagaccctgctgctgccaaggcggcacgtccgcagactgcccgaactgacgccggcagagagggatgacctggcctcaatcatgaaaaagctgctgactaagtacgacaatctgttcgagacatcattcccttactcaatgggatggcatggcgcccccacaggtagtgaggctggagctaattggaatcattggcagctccacgcacactattatcccccactgctgaggtccgcaacggtgcgcaagtttatggtgggttacgagatgctggctcaagcacagcgagatctgactcctgagcaagcggccgaaaggttaagggctctccccgaggtccactatcatcttggacagaaggacagagagacggctacaattgcc

SEQ ID NO: 12176 - DNA, 1137 bp, Artificial Sequence
  Description of Artificial Sequence: Synthetic coding sequence
atgtcacgctccggtacagatcctcagcaaagacaacaggctagtgaagctgacgctgccgccgccacctttagggccaatgaccaccaacatatcagatataaccccttgcaggatgagtgggtgcttgttagcgctcacaggatgaaacgcccttggcagggccaggtggagccgcaactgctgaagacagtaccgcgccacgacccgctgaacccactctgccccggagccatacgcgccaacggtgaggtcaatcctcagtacgacagtacatttctctttgacaacgattttcccgcgttgcagcctgacgccccatccccaggtccttctgaccacccattgttccaagccaagtcagcccgcggtgtgtgtaaggtgatgtgctttcatccttggtctgatgtcacgttgcctctcatgagtgtccccgagattagagctgtggtggatgcgtgggcctccgtgaccgaagaactgggtgctcaatatccatgggtgcaaatcttcgagaacaagggagccatgatgggttgctcaaacccacatccccattgccaggtttgggcttcctcatttcttccagacattgcccagagggaggaaagatcccaacaggcgtacaaatcacagcatggcgagcccctcctcatggaatactctaggcaagagttgcttagaaaggagcgcctcgtgctgacatctgagcactggctggtcttggtccccttttgggctacatggccgtaccaaactctgctgctgccacgcagacacgtaagacgcctccctgagctcaccccagccgaaagggatgaccttgcttctatcatgaagaagttgctgactaagtatgacaatctctttgagacttccttcccatacagcatgggctggcacggtgcgccaacgggatcagaggctggcgctaattggaatcattggcagttgcatgcccattattaccctcccctccttagaagcgctaccgtaaggaaattcatggttggatatgaaatgctggcacaggcccagagggacctgactcccgagcaagcggctgagaggctcagggcattgcctgaagtacactatcacctgggtcaaaaggacagagaaacagctactatagct

SEQ ID NO: 12177 - DNA, 1137 bp, Artificial Sequence
  Description of Artificial Sequence: Synthetic coding sequence
atgtcacggtctggcaccgatccccaacagcgccagcaagcttccgaggcagacgccgctgcagctacattccgtgcaaacgaccaccagcatatcagatacaacccactgcaggatgagtgggtgctggtgagtgcacaccggatgaagagaccctggcagggacaggtcgagccacagttacttaagactgttccaagacacgaccctctcaacccactatgtcccggggcaatcagggccaatggcgaggtgaatccccagtatgattcaacctttctttttgacaacgacttccccgccctgcagcctgatgcaccctcccctggccccagcgatcatcctctcttccaggctaaatccgccaggggagtgtgtaaagtgatgtgcttccatccgtggtcagatgttactctgccactcatgtctgtccctgagatcagagcagtggttgatgcatgggcctcggtgactgaagaactgggcgcacagtatccctgggtccagatttttgagaataaaggggccatgatggggtgttctaatccccatccacactgtcaagtgtgggcgtctagttttctcccggatatcgctcagagagaagaacgctctcaacaagcttacaaatcgcagcacggggagccactcctgatggaatactcccgccaagagttgctgaggaaagagaggttggtgcttacctccgagcactggctcgtgctggttcctttctgggcgacgtggccatatcagacacttctcctcccccgcaggcatgtgcgacgtctgcccgaactcactcctgcggagagagacgacctagccagcatcatgaagaaattactaaccaaatatgacaacttgtttgagacttcctttccctattctatgggctggcacggagcacctactggctccgaggcgggagctaattggaatcactggcagttgcacgcccattattatccacccctgctgaggagtgctacggtgcgcaaatttatggtgggatacgagatgctggcgcaggctcaacgcgacctgacacccgagcaagccgccgagcgacttagggcgttgcctgaagttcactaccatctaggccagaaggatcgagaaactgccaccattgca

SEQ ID NO: 12178 - DNA, 1137 bp, Artificial Sequence
  Description of Artificial Sequence: Synthetic coding sequence
atgtcccgctcagggacagacccacagcagcgccagcaggcctctgaggcggacgcagctgcggctacctttcgtgctaacgaccaccagcacattcggtataatcccctgcaggacgagtgggtcctggtgtctgcgcatagaatgaagaggccttggcagggccaagtggagccgcagctcctgaagacagtacctcgccatgatcccttgaatcccttgtgccctggtgcaatcagagccaacggcgaggtcaatcctcagtacgatagcaccttcttgtttgataatgacttccccgcactgcagcccgacgccccctcacccggacccagcgaccatcctctgttccaggccaagagcgcccgaggggtgtgcaaggtcatgtgctttcatccctggagcgacgtcactctcccgctcatgtccgtccctgaaatccgggctgtcgtagatgcctgggcgtcagtcacagaagaactcggagctcaatatccatgggtccagatattcgaaaataagggggccatgatggggtgtagcaaccctcacccacattgccaggtgtgggctagttcattcctgcccgacatagcacaacgggaggagaggagccaacaggcctataagtctcagcatggcgagccgctcttgatggaatatagccggcaggagctccttaggaaggaacgcctcgtattaacgtctgagcattggctcgtgctggtccctttttgggccacttggccttatcagacactgctgctccccagacgtcacgtgaggcgcctgcccgagcttacccctgcggaaagagatgatctggcgtctatcatgaagaagctactgacaaagtatgacaacctgttcgagacctcttttccgtatagtatgggctggcacggggcccctactggaagtgaagccggagcaaattggaaccactggcagctgcacgctcactactatccccctctgctgcggagcgcaaccgtgcgcaaatttatggtaggatatgaaatgctcgcacaggcccagcgggacctgacacctgagcaggcagcggaaagactcagggcactgccggaagttcactaccacctaggacagaaagatcgtgagactgccaccatcgcc

SEQ ID NO: 12179 - DNA, 1137 bp, Artificial Sequence
  Description of Artificial Sequence: Synthetic coding sequence
atgtcccgttctgggaccgacccccagcaaaggcaacaggcatcagaagcagacgctgccgcggccacattccgagcaaatgatcaccagcatattcggtataacccacttcaggatgaatgggtactggtgtcggctcaccgcatgaagcgtccgtggcaaggtcaggtggaacctcagctgctcaagacggttccccggcacgacccacttaacccattgtgccccggagcaatccgagccaatggcgaggtgaatcctcagtacgactctacattcctgttcgataacgatttcccagcactgcaacccgacgccccttcccccggtccctccgatcaccccttatttcaggctaagtctgccaggggagtgtgtaaggtgatgtgctttcatccgtggtctgatgttaccctgcccctgatgtccgtgcccgagatccgtgctgtcgttgacgcatgggcttctgtgaccgaagaattgggcgcccagtatccttgggtccagatcttcgaaaacaagggcgcaatgatgggatgctccaacccccatccccattgtcaggtatgggctagttcctttctgcctgatatcgcacagcgagaggagcgcagtcagcaagcttataaaagccagcacggagagccactgcttatggaatatagtaggcaagagctccttcggaaggaacggttggtcctgacctcagaacactggctcgttctcgttccgttctgggccacttggccctatcagacgctgctgctaccaagaagacatgtgcgacgattgcccgagttgacacctgccgagcgagatgacctcgcctccattatgaaaaaactccttaccaaatatgataatctgtttgaaaccagcttcccgtattcaatgggatggcatggggccccgacagggtccgaagccggggctaactggaaccactggcagcttcatgcccactattatcctccactgctcagatctgcaaccgtgcgtaagttcatggtggggtatgagatgctggctcaagcacagcgagatttgactcccgagcaggcagcagaacgacttcgggctcttccagaggtgcattatcacctggggcagaaagaccgcgagaccgctactatcgct

SEQ ID NO: 12180 - DNA, 1137 bp, Artificial Sequence
  Description of Artificial Sequence: Synthetic coding sequence
atgtctcgcagtggaacagatccccaacagagacaacaggcaagtgaagcagatgccgcagctgcgacgttcagagcgaatgatcaccagcacatccgttacaacccactccaggacgagtgggtcttggtatctgctcaccgtatgaagagaccgtggcaaggccaagtggagccacagttgttaaagactgtgccacgccatgatcctcttaacccattgtgcccaggcgccataagagctaacggcgaagtgaatccacagtacgactcaacattcttattcgacaacgacttcccagccctgcagccggacgcaccatccccgggccccagcgaccacccgctgttccaagccaaatctgcccgtggggtgtgcaaagttatgtgcttccatccctggtctgatgtaacactccctttaatgtctgtgccagagattcgggcagtagtcgacgcctgggccagcgtcacagaggagctcggcgcgcagtacccgtgggtccagatttttgaaaataaaggggcaatgatgggctgttccaatccgcaccctcactgtcaggtgtgggcttcctccttcttaccagatattgctcagagagaggaacgttcacagcaagcatataagtcccagcatggagaaccactgcttatggaatactcaaggcaggagttacttcggaaggaaaggctcgttctaaccagcgaacactggctggttttggttccattctgggccacgtggccttaccagactcttctgttaccacggaggcacgtccgccggttgcctgaattgactccggccgagagggatgatctcgcttctatcatgaagaagttgcttacgaagtacgacaacctattcgaaacaagctttccttatagcatggggtggcacggagctcccacggggtctgaggccggcgcaaattggaaccactggcaactgcacgcacattattaccctcctttgctccggtctgctaccgtgaggaagtttatggtagggtacgagatgttggcacaggcacagagggacctgacaccggaacaggcagccgagcgcctgagggccctgccggaagtccactatcaccttggacagaaggatcgggaaaccgccacaatcgcc

SEQ ID NO: 12181 - DNA, 1137 bp, Artificial Sequence
  Description of Artificial Sequence: Synthetic coding sequence
atgtccagatccggaacggacccacagcagagacagcaagcctcggaggcggacgccgccgccgcgacttttcgcgccaacgatcatcagcatatacgttataaccccctacaggacgagtgggtgctcgtgtccgcccatcgcatgaagaggccctggcagggacaagtagaaccccagttactgaaaaccgtaccccgccatgacccactcaacccactgtgccccggtgccataagagccaatggcgaagtgaatccccagtatgattccactttcctcttcgacaatgatttccctgcgctacagcccgacgccccttctcccgggccttccgatcatcctctgttccaggctaagtctgccagaggagtgtgtaaagtcatgtgctttcatccgtggtctgacgtcaccttgcctcttatgagcgtgccagaaatacgcgctgtggtggacgcctgggcaagtgtcaccgaagaattgggggcccaatatccatgggtgcagatcttcgagaataaaggcgcaatgatggggtgcagcaacccacacccacattgccaggtatgggcttcctcctttttgcccgatatcgctcaaagggaagagcggtcgcaacaagcttacaagtctcagcacggcgaaccgttactgatggaatactcgcgtcaggagttactgcgcaaagagcgcttggtgctcacctccgaacactggctagtgttggtgcctttctgggcgacttggccctaccagaccctccttctgcctcgccgacatgtcaggagactccccgagctgactcccgcagagcgggacgatctggcctctattatgaaaaagttactgacaaagtacgataacctctttgagaccagcttcccttattctatgggctggcacggagcccccaccggaagcgaggcaggagctaactggaaccattggcagcttcatgcccactactacccacccttgctacggagtgctaccgtgagaaagtttatggtgggctatgagatgcttgcacaggcacagcgagacttaacacccgagcaggcggcagagcgcttgcgcgccctgcctgaggtgcactatcatctcggccagaaagatagggaaacagctacaatagct

SEQ ID NO: 12182 - DNA, 1287 bp, Artificial Sequence
  Description of Artificial Sequence: Synthetic coding sequence
atgcagctgaggaacccagaactacatctgggctgtgcactcgcccttcgcttccttgcactggtgagctgggatatcccgggcgcacgggctctggacaacggccttgcacgcactccaactatgggatggctccactgggagaggttcatgtgtaacctggactgtcaggaggagccagattcatgcatcagtgaaaagctgttcatggagatggccgagctcatggtgtccgagggttggaaagacgctggatacgagtacctatgcattgacgactgctggatggctccacagcgcgactccgagggtcgactgcaagctgacccacagcggtttccacatggcattcgccagttggccaattacgtgcatagcaagggattgaagttaggaatctatgcggacgtgggcaataaaacctgtgccggattcccaggcagctttggatattacgacattgatgctcagacatttgccgattggggggtggacttgcttaagttcgatggttgctattgcgacagtctcgagaacctcgccgacggatacaagcacatgtcgctggcactgaatcggactggaaggtccatagtgtattcttgtgaatggccgctgtacatgtggccatttcagaagccaaactatacggaaattcgacagtactgtaatcactggcggaatttcgccgatatcgacgactcttggaagtcgattaagagcattctggattggacctcttttaaccaggagcgtattgtagacgtcgccggaccgggggggtggaacgaccccgatatgctcgttattgggaacttcggattaagctggaatcagcaggtcacccagatggcgctctgggcaattatggccgcgccactgtttatgtccaacgacctgagacacatctcaccacaggctaaagccttgctgcaggataaggacgtaatcgcaatcaaccaggatcctctcggaaaacagggatatcagctacgtcagggcgacaacttcgaagtctgggaacggcctctgtctggtctggcctgggccgttgcgatgatcaatcgccaggaaatcggcggtccacggagttataccatcgccgtggctagccttggaaagggcgtagcctgtaatcccgcctgcttcatcacccagctgctgccggtcaaaaggaagctcggtttctatgagtggaccagccgactccggagtcacatcaatcctacaggaactgtgctcttacagctggagaatacaatgcagatgtcgctgaaagatctactg

SEQ ID NO: 12183 - DNA, 1287 bp, Artificial Sequence
  Description of Artificial Sequence: Synthetic coding sequence
atgcagctgcggaatccagagctccacctgggatgcgccctcgcactgcggttcctggcgttggtcagctgggacatcccaggagcaagagccctggataatggactggcgcgcaccccgactatgggttggcttcattgggagcgattcatgtgcaaccttgactgtcaggaagaaccggattcttgcatctctgagaagctgttcatggaaatggcggaacttatggtatccgaaggttggaaagatgcgggatacgagtacttgtgtatcgacgactgctggatggccccgcaaagagactcggaaggccgcctccaggccgacccgcaacggttcccgcacggcattcggcagttggcaaactacgtgcattcgaagggcttgaaactgggaatctacgccgacgtgggcaacaagacctgcgccggctttccgggttcatttggttactatgacatcgacgcccagaccttcgccgattggggagtggatctcctgaagttcgatggctgctattgtgatagcttggagaacctggccgacggatacaagcatatgagcctggcgttgaatcggactggacggtcaatcgtgtacagctgcgaatggccgctctacatgtggcctttccagaagcccaattacaccgaaatccgccagtactgtaatcactggcgcaacttcgcagatatcgatgattcgtggaagagcattaagtctatcctcgactggacgtcctttaaccaggaacggattgttgacgtggcgggtcctggaggttggaacgatccagatatgttggtcatcggaaatttcggattgtcgtggaaccagcaagtgacccagatggccttgtgggcgattatggccgcccccctgtttatgagcaatgacctcaggcacatcagcccacaagcaaaagcgctcctgcaagacaaggatgtgatcgctattaaccaagacccgctcggcaaacaaggctaccagctgagacagggagacaattttgaggtctgggaacggccgctgtcagggctcgcctgggcggtcgccatgatcaacagacaggaaatcggtgggccacggtcgtacaccatcgcagtggccagccttggtaaaggagtcgcttgcaaccccgcgtgcttcatcacccaactgctccctgtgaagcgaaagctcgggttctacgagtggacctcgagactgcggtcgcatatcaaccctactggaaccgtgctgctgcagctggagaatactatgcaaatgtcgctgaaggatctgctc

SEQ ID NO: 12184 - DNA, 1287 bp, Artificial Sequence
  Description of Artificial Sequence: Synthetic coding sequence
atgcagctccgcaatcccgaactccacctgggatgtgctttggctctcaggttcttggctctcgtgtcgtgggatatcccgggcgcacgagctcttgacaacggtctggcgcgcaccccgaccatgggatggctgcactgggagcggttcatgtgcaacctcgattgccaagaggagcccgactcgtgcatctcggaaaagctgttcatggagatggcagaactcatggtttccgaaggatggaaagatgctgggtacgaatacctctgcatcgacgactgctggatggcgccgcagcgggattccgaaggacggctgcaagctgacccgcagcggttcccgcacggcatccgacaactggctaactacgtccacagcaagggactgaaacttgggatctacgccgacgtcggtaacaaaacttgcgcggggttcccggggagcttcggatactacgacatcgacgcccagactttcgcggattggggagtggacctcctcaaattcgacggctgttactgtgactcccttgaaaacctcgccgacggctacaagcacatgtcgctggccctcaacagaacgggtcgctcgatcgtgtactcatgcgaatggccactgtacatgtggccttttcagaaaccgaactacaccgaaatcaggcagtactgcaatcattggcgcaattttgcggacatcgacgattcctggaagagcatcaaatccattttggattggacctcctttaatcaggaaagaattgtggatgtggcgggaccgggcgggtggaatgacccagacatgctggtgatcggcaactttggattgagctggaaccaacaggtcacgcagatggctctgtgggcaatcatggctgcaccattgttcatgtccaacgatctgcggcatatcagcccacaggccaaggcgctcctgcaagataaggacgtgatcgccatcaaccaggacccactcggaaaacagggataccaactgagacagggcgataacttcgaagtgtgggagcggcctctgtctgggctcgcctgggccgtcgctatgatcaatcgccaggaaattgggggcccgagatcgtataccatcgccgtcgcgtcacttggcaagggagtggcatgcaacccagcatgtttcatcactcagctcctgccagtgaaaagaaaactgggcttctacgaatggacgtcgcgcctcagatcgcatatcaatcctactggaaccgtgctccttcaattggagaacactatgcagatgtcactcaaagatctgctg

SEQ ID NO: 12185 - DNA, 1287 bp, Artificial Sequence
  Description of Artificial Sequence: Synthetic coding sequence
atgcaattgcggaaccccgaattgcacctgggctgcgctctcgccctgagatttctggccctggttagctgggatattcccggggctcgcgctctggataatggtctggcaaggaccccaactatgggttggctgcattgggagaggtttatgtgcaacctcgattgccaggaagaaccggattcctgcatctcggaaaaactgttcatggagatggcggagctgatggtgagcgaaggttggaaggacgcaggctacgagtatctctgcatagacgactgctggatggccccgcaacgagactcggaaggtcgcctccaagcagaccctcaacggtttccgcatggcatcaggcaattggctaactacgtgcactcgaaggggctgaaactgggaatctacgcagatgttggtaacaagacgtgtgcaggtttcccgggatcgttcggctactacgacatcgacgcccaaaccttcgcggattggggcgtggacctgctgaaatttgacggctgttactgtgattcactcgaaaacctcgctgatggatacaagcacatgtctttggccttgaatcggaccggccggagcattgtctactcctgcgagtggccactgtatatgtggcctttccagaagccaaactacaccgagatcagacagtactgcaatcactggcgtaacttcgctgatatcgacgattcatggaaaagcataaagtcaattttggactggactagcttcaaccaggaacgcatcgtggacgtggcgggtccaggcgggtggaacgatccggacatgctggtgatcgggaacttcggactgagctggaatcagcaggtaacgcaaatggccctgtgggcgatcatggctgcgcctctcttcatgtccaacgacttgaggcatattagtccccaagccaaggccctcctccaggataaagacgtgatcgctatcaatcaggatccacttggaaaacagggataccagctgcgccagggagataactttgaggtctgggagcggcctctctctggattggcctgggccgtggctatgatcaaccggcaggaaatcggaggcccaagatcctacactatcgccgtcgcctcgctcggaaagggtgtggcctgcaacccggcttgtttcatcacccaactgttgcctgtgaagcgcaaactcggattctacgaatggacttccagactcagatcccacatcaatccgactggaaccgtgttgctccagctcgaaaatactatgcagatgtcgctcaaggacctgttg

SEQ ID NO: 12186 - DNA, 1287 bp, Artificial Sequence
  Description of Artificial Sequence: Synthetic coding sequence
atgcagctgcgtaatcccgagctccacttgggatgcgcccttgctttgcgattcctagcgctggtcagttgggacatacccggtgctcgagcgctagataacgggcttgcgagaacacctactatgggctggctccactgggagcgatttatgtgtaatttggactgtcaagaggagcctgacagctgcatctcagagaaacttttcatggagatggctgaactcatggtcagcgaggggtggaaggacgccgggtacgagtatctgtgcattgacgactgctggatggccccacagagggattcagaggggcgactccaggcagacccgcagcgtttcccacatggaattcgccagctggcgaactacgtacactccaagggactgaagcttggaatttacgcagatgtcggaaataagacctgtgcgggattcccggggtccttcggatattacgacatcgacgcccaaactttcgccgattggggggtcgatctattgaagtttgatggttgctactgcgattcccttgagaatcttgccgatggttacaagcacatgtcgctagcgttgaaccgtacgggccgatcaatagtctatagttgcgagtggcccctgtatatgtggcccttccagaagccaaattatacagaaatccgtcaatattgcaatcattggcggaacttcgctgatatcgacgatagttggaagtcgatcaaatcgatacttgactggacttcgtttaatcaagaacgaatcgtcgatgtcgccggcccagggggatggaacgatccagatatgctcgtcataggcaactttggcctcagttggaaccagcaggtgacccagatggcactgtgggctatcatggcagcgccgcttttcatgagcaacgatcttcggcacatttctccccaagcaaaagcgttgctgcaggataaggacgttattgcgattaatcaggaccctctgggaaagcaaggttaccagctccgacaaggagacaacttcgaagtatgggaaaggcccctgagtggtttagcctgggcagtggcgatgatcaatcggcaagagatcgggggtccgcgatcctatactatcgcggttgcttccctaggaaagggtgtggcgtgcaatcctgcctgcttcatcacccaacttctcccggtgaaaaggaagctagggttctatgagtggacgtcgcggcttcggtcccatataaaccctaccggcaccgtgctgctccagctcgaaaacacaatgcagatgtcgcttaaagacctcctc

SEQ ID NO: 12187 - DNA, 1287 bp, Artificial Sequence
  Description of Artificial Sequence: Synthetic coding sequence
atgcaactgagaaatccggaactacacctcggttgcgccctcgcacttcgattcttggcattagtgagttgggacatccccggcgcaagggcgctcgacaacggcctcgcccggacccccaccatggggtggctccattgggagcggtttatgtgcaatttagactgccaggaggaaccagattcttgtatctctgaaaagctgtttatggaaatggcagaactcatggttagcgagggatggaaggatgcaggctacgaatatctctgcattgatgactgctggatggcacctcagagagactctgagggacggttgcaggccgatcctcaaagattcccccacgggatccgccagctcgccaactacgtgcactctaaaggtttaaagttaggcatctacgcagacgtgggtaataagacctgcgccggatttcctggtagttttggctactacgatatcgacgctcagacgtttgcggattggggcgtcgacctgctcaagttcgatggctgttattgtgactctctcgagaacctggcagacggttataaacatatgagccttgcccttaacaggacgggtagatctatcgtttactcttgtgagtggcctctgtatatgtggcctttccagaagcctaactacacggaaatccggcaatactgcaatcactggaggaacttcgccgacatagacgatagctggaagagcatcaaatcaatcttagattggacttcttttaatcaggagaggatcgttgatgtcgctgggcctggcggctggaacgaccccgatatgctggtgatcggaaacttcggtctctcctggaaccaacaagtgacccagatggctctgtgggctatcatggccgcccctctgttcatgtccaacgaccttcggcatataagtcctcaggccaaggccttgctccaggacaaagacgtgatcgccattaaccaggaccctttggggaaacaggggtatcagctgcgccagggggataatttcgaggtgtgggaacggccactctctggcttggcttgggctgtggctatgatcaacaggcaggagattggcggacctcggtcctacaccatcgctgtggcatcactgggaaagggcgtggcatgtaacccagcttgctttatcacccagctgttgccagtcaagcgcaaactggggttttatgaatggacatccagactgcggtcacatattaaccctacagggaccgtgttgctgcagctggagaataccatgcagatgagtctaaaggacctgcta

SEQ ID NO: 12188 - DNA, 1287 bp, Artificial Sequence
  Description of Artificial Sequence: Synthetic coding sequence
atgcaattgcgtaaccccgagttgcacttgggctgcgcccttgctctgaggttccttgccctggtgtcctgggacatccctggtgcccgcgccctggataacgggctggctagaaccccgacgatgggctggctccattgggagcggtttatgtgcaaccttgattgccaggaagaaccagacagctgcatctccgagaagctctttatggagatggcggagctgatggtttcggaggggtggaaggatgcgggctacgagtacctctgcattgacgactgctggatggccccgcagcgggattccgagggcagacttcaggctgacccgcagcgtttcccgcatggaattcggcagctggctaactacgtccacagcaagggcttgaaacttggtatctatgcagatgtcggtaacaaaacctgcgccggtttccccggtagcttcggatattacgacatcgatgcccagacgttcgccgattggggggtggacctccttaagttcgatgggtgctattgcgactctctggaaaatcttgccgacggttacaagcatatgagccttgccctcaataggacgggtcgcagcatcgtctactcgtgcgagtggcccctgtacatgtggcctttccagaagcctaactacactgaaatccgtcagtactgcaaccactggcgcaactttgccgatatcgacgactcctggaaaagcatcaagtcgattctagactggacgtcattcaaccaagagcgtatcgtagacgtcgcgggtcccggaggctggaacgaccccgacatgctagtgatcggaaactttggcctgtcttggaatcagcaggtgacccagatggccctctgggccatcatggctgctccgcttttcatgagtaatgatctcagacatatttcccctcaagccaaggccctccttcaagacaaggacgtcatagcgatcaaccaagaccctctcggcaagcaaggttaccaactcaggcaaggtgataacttcgaggtgtgggagcgcccgctgagcggcttggcttgggccgtcgccatgatcaaccgtcaagagatcggtggcccccgctcctacaccatcgccgttgcttccctggggaagggcgttgcgtgcaaccctgcctgctttatcacacaactgctgcccgtgaagcgtaagcttggcttctacgaatggaccagccgtctgcggtcgcatatcaatcctaccggcaccgtcttactccaactggagaataccatgcagatgagcctgaaggatttgctc

SEQ ID NO: 12189 - DNA, 1287 bp, Artificial Sequence
  Description of Artificial Sequence: Synthetic coding sequence
atgcagctacggaaccctgaattgcatttaggatgcgccctagcactacgctttctagcactcgtgagctgggatatacccggcgccagggcccttgacaacggactggcacgaacaccaacaatggggtggctgcactgggaacgtttcatgtgtaacctcgattgtcaggaggagcccgactcatgcatttctgaaaagttatttatggagatggctgagctgatggtcagcgagggctggaaggacgccggctatgaatacctgtgcatcgacgattgctggatggcgccacaaagggactcggagggtaggctgcaagccgatcctcaaaggttcccccacgggattcggcaactcgctaactatgtgcatagcaagggactaaagctgggaatatacgccgatgtgggtaacaaaacctgcgcagggttcccaggatcattcgggtactatgacatcgatgcgcagaccttcgctgattggggcgtagacctgctcaagttcgacggctgctattgcgattcattggagaatttggctgatggatacaagcacatgtcactggctcttaatcggaccggacgaagcattgtctactcttgtgaatggcctttatacatgtggccttttcagaagcccaactacaccgaaatccgccagtactgcaaccattggaggaacttcgctgacattgacgattcctggaagtctatcaagtctatactggactggaccagctttaaccaggaacggattgtagacgtcgccggccccggaggatggaatgatccagatatgttagtgatcgggaacttcgggctgtcctggaatcaacaggttactcaaatggcactttgggctatcatggcagcaccactgttcatgtcgaatgatcttcgacatatttctccacaggccaaagcactgctgcaagataaagacgttatcgcaatcaatcaggaccctctagggaaacaggggtaccagctccgacagggagacaacttcgaggtttgggagaggcctctgtcgggcctcgcctgggccgtggccatgataaacagacaggaaataggaggaccccgcagctacaccattgcagtcgcaagcctgggcaagggcgtagcatgtaaccccgcgtgttttataacacagttgctgcccgtaaagaggaaactaggcttctacgaatggactagccgattgagaagccacataaaccctaccggcactgtcttgctgcagctggaaaatacgatgcagatgtccctcaaagatctgctt

SEQ ID NO: 12190 - DNA, 1287 bp, Artificial Sequence
  Description of Artificial Sequence: Synthetic coding sequence
atgcaactccggaaccccgaactgcacctcggttgtgcactcgcgctgagattcctcgccctggtgtcctgggatatcccgggcgcgcgggctctggacaacggccttgccagaacgcctactatgggatggcttcactgggaaagattcatgtgtaacctggactgccaggaggagccggactcctgcatctcggagaagctcttcatggaaatggcagagttgatggtgtcagaagggtggaaggacgcaggttacgaatacctctgcatcgacgactgctggatggcccctcagcgggactccgagggcagactgcaggcggacccacagcgctttccacatggaataaggcaactggctaattacgtgcacagcaaaggactcaagctgggaatttacgccgacgtcggtaacaagacctgtgcgggattcccaggctcattcggctactacgacatcgacgcccaaacgtttgcagactggggggtggatctgctgaagttcgacggctgctattgcgactcacttgagaacctggcggatggatacaaacatatgtcgctggcattgaaccgcaccggcagatcgatcgtgtactcatgcgagtggccgctttacatgtggccgttccagaaaccgaactacactgaaatcagacagtactgcaaccattggcggaactttgcggatatcgacgacagctggaagagcatcaagtccatcttggattggaccagcttcaaccaggagcggatcgtcgatgtggccggtccgggaggatggaacgatccggacatgctggtgatcggaaatttcggcctcagctggaatcaacaggtgacccagatggccctttgggccatcatggccgcaccattgtttatgtcgaacgatctccggcacatctccccgcaggctaaggccctcctgcaggacaaggacgtcattgccatcaaccaagatccactcggcaagcagggttaccaactgcgacaaggcgacaatttcgaggtgtgggagcgcccgctcagcggcctggcgtgggctgtggccatgatcaaccggcaggagatcggcggtcctcgctcctacactatcgcggtggcatccctggggaagggggtggcgtgtaacccggcttgcttcatcacccaacttcttcctgtcaaacgcaagctgggattctacgagtggacctctaggctccgctcacatatcaaccccaccggaactgtgcttctgcaactggaaaacaccatgcagatgagcctgaaggacctgctg

SEQ ID NO: 12191 - DNA, 1287 bp, Artificial Sequence
  Description of Artificial Sequence: Synthetic coding sequence
atgcagcttagaaaccccgaactgcatctgggttgcgccctcgcacttagattcctggcgctggtgtcgtgggacattccaggcgcacgagccctcgacaacggacttgcaaggacccctaccatgggatggttgcactgggaacggtttatgtgtaaccttgattgccaagaggagccagatagctgtatatcagaaaagttgttcatggagatggcggaactgatggtatcagaaggatggaaggatgccgggtatgagtacctttgcattgatgattgttggatggcaccacagcgcgattcagagggaaggctgcaagcagatcctcagcggttcccacatggaattaggcagcttgcaaattacgtccattcgaaaggactcaaacttggtatctacgcagatgtgggcaataagacctgtgctggctttcctggttcatttggctactatgatattgatgctcaaaccttcgcggactggggtgtcgacttgctcaagtttgatggttgttactgtgactcccttgaaaacctcgcagacgggtacaagcatatgtcactcgcactcaatagaaccggtcgtagcattgtttactcgtgtgaatggcctctgtacatgtggccgtttcaaaagccaaactacaccgaaatcagacagtactgcaaccactggcgaaactttgcagacattgacgactcctggaaatccatcaaatccattcttgattggaccagctttaaccaagagaggatcgtggatgtggcgggtcctgggggatggaacgatccagatatgctggtgattgggaactttggcctgtcctggaatcaacaagtcactcagatggccctgtgggccatcatggccgccccccttttcatgtcgaatgacttgcgtcatattagccctcaagcgaaagcacttctccaagataaggatgtaattgccataaaccaagaccccctcggaaagcaaggctatcaacttcgccaaggagataacttcgaagtgtgggaacgtccattgtctggccttgcctgggcagtggcaatgatcaatagacaggaaatcggtggaccccgatcctacactattgcagtcgcgtcgttgggaaagggggtggcttgcaaccctgcatgcttcattactcagcttctgcctgtgaagcgcaagctgggattttacgaatggacttcccgccttagatcccacatcaacccaactgggacggttctgcttcaactcgagaataccatgcagatgtccctgaaggatcttctg

SEQ ID NO: 12192 - DNA, 1287 bp, Artificial Sequence
  Description of Artificial Sequence: Synthetic coding sequence
atgcagctgagaaatccggaacttcatcttggatgtgcacttgctctgaggtttctggcactggtgtcgtgggacattcctggagcacgcgcactggataacgggctggcgaggaccccaactatgggctggctccactgggaaagatttatgtgcaaccttgattgtcaggaggaaccagattcatgcattagcgaaaagctgttcatggaaatggctgaactgatggtgtccgaagggtggaaagatgcagggtatgaatacctgtgcattgatgattgttggatggcgcctcagcgtgactcggaaggtagactgcaagccgatccgcagagattcccccatggaatccgtcagctggcgaattacgtgcattcgaagggtcttaaacttggcatatacgccgacgtggggaataagacctgcgctggattcccgggttcgtttggatattacgacatagatgcacagacctttgctgattggggagtcgatcttctgaagtttgatggttgctactgtgattcgctcgagaacctggccgacggatacaaacatatgagcctggccctcaacagaacgggccggtccatcgtgtacagctgtgaatggcctctgtacatgtggccctttcaaaagcccaattacaccgaaatccgccaatactgcaaccattggcgcaactttgcagacattgatgatagctggaagtcaataaagtccattcttgattggacctcgtttaaccaggaaagaatcgtggacgtggcgggccccggaggttggaacgatcctgatatgcttgtgattggaaacttcggactgtcgtggaaccaacaggtgacccaaatggccctgtgggccatcatggcagcccctctgtttatgtcgaacgaccttagacacatctctcctcaggcaaaggcacttctccaggacaaagatgtgatcgcaattaaccaggaccccctgggcaagcagggataccagctgagacaaggggataacttcgaggtctgggaacggcctctttcaggcctggcctgggccgtggccatgatcaatcgccaagagatcggtggtccacgctcttacaccattgcagtggcaagccttgggaaaggagtggcctgtaatcctgcgtgtttcataacgcaactgcttcctgtgaagagaaaattgggtttttacgaatggacgagccggcttcggtcacacatcaatccaactggaaccgtcctgttgcaactggaaaacactatgcagatgtctcttaaggatctgctg

SEQ ID NO: 12193 - DNA, 1287 bp, Artificial Sequence
  Description of Artificial Sequence: Synthetic coding sequence
atgcagcttagaaatccagagctgcacctcggctgtgcacttgccctgagattcctcgcattggtgtcatgggacatcccgggtgctagagcccttgacaatggcctggcgcggacacctaccatgggatggctccactgggaaaggttcatgtgcaatttggattgtcaggaggagccggattcatgcatttccgagaagctcttcatggagatggccgagctgatggtctctgaaggttggaaggacgccggatatgagtatctttgcattgacgattgctggatggcgccacagagagactccgaagggaggctgcaagctgacccgcagagatttccgcatggcatacgccaactggccaactacgtgcactctaagggcctcaaactgggcatttacgcagatgttggcaataagacctgtgcgggcttcccggggagttttggctactatgatattgacgctcaaaccttcgcagactggggggtggacctcctgaaatttgacgggtgttactgtgatagtctggaaaatctggctgacgggtataaacacatgtctctggctctgaaccggacaggccgcagtattgtctacagctgtgagtggcctctctacatgtggcccttccagaagccaaactacaccgaaatccgacagtactgcaatcactggagaaacttcgcagacattgatgactcatggaagtccatcaagagtatccttgactggacctctttcaatcaggagcggattgttgacgtagccgggccagggggatggaatgaccctgacatgctcgtcatagggaactttggtttgagctggaatcagcaagttactcagatggcactgtgggctataatggccgcgcctctgtttatgtcaaatgatctgcggcacatctcccctcaggcaaaagctctgctgcaggataaagacgtcatcgcaattaatcaggaccctctgggcaagcaagggtatcagttgcggcaaggagataacttcgaggtctgggagcgacccctttccggactggcctgggctgtggcaatgatcaacaggcaggagattggaggcccccggtcttataccatagccgtcgccagtctggggaaaggtgtggcatgcaatccagcatgttttatcactcagctcctgccggttaagcggaagttgggcttttacgaatggacatctcgactccggagccatatcaatcccaccggcaccgtgctgctgcaactggaaaacaccatgcaaatgtccctgaaagacctgctc

SEQ ID NO: 12194 - DNA, 1287 bp, Artificial Sequence
  Description of Artificial Sequence: Synthetic coding sequence
atgcagctgcggaaccccgagcttcatctgggatgtgcactggcattgcgatttctggccctggtgtcatgggacatccccggagcccgagccctggacaatggccttgccaggacccccactatggggtggttgcattgggagcgctttatgtgcaatctggattgtcaggaggaacctgattcttgtatttcagaaaaactttttatggagatggcagaactgatggtttctgagggatggaaggatgccgggtatgaatacctgtgtatagatgactgttggatggcacctcagagagattctgaggggcgcctgcaggccgatccccagaggttcccccacggaatacgccagctggccaattacgtgcattctaaaggactaaaattggggatttacgctgatgtcggcaacaaaacctgcgctggctttccagggtcctttggatattacgacatcgatgcacagacgttcgcagactggggcgtggacttgctgaaatttgacggttgctactgcgactctttagaaaaccttgccgacggatacaagcatatgagtctggccttaaacagaacaggcagatctatcgtgtatagctgtgagtggccactatatatgtggccatttcagaaaccaaattatacagagatccggcagtactgcaaccactggagaaactttgccgacatagatgactcctggaaatccatcaaatctattctagattggacatctttcaaccaagaacgtattgtggatgttgcaggccctggcggttggaatgatccagatatgcttgttattggcaacttcgggttatcatggaaccagcaggtgacccagatggcgctgtgggctataatggctgcccccctttttatgagcaacgacctgcggcatataagcccacaggccaaggcacttttgcaggataaagacgtcattgcgatcaaccaggatcccctaggaaaacaggggtaccaactgcgccagggcgacaactttgaggtgtgggaaaggcctctgtcaggcctggcatgggccgtcgcaatgatcaatcggcaggaaatcggtggcccccggtcttatacaattgctgtggctagcttgggcaagggcgtagcctgcaatcccgcatgtttcataacacaacttcttcctgtaaagcgaaagctgggcttctatgagtggacttctaggctgcgcagccacattaacccaaccggaacagtcctgttgcaactggaaaataccatgcaaatgtcactcaaggatctactc

SEQ ID NO: 12195 - DNA, 1287 bp, Artificial Sequence
  Description of Artificial Sequence: Synthetic coding sequence
atgcagctgcgaaaccccgaactccacctgggctgtgccctcgctctgcggtttctcgcactggttagctgggacattcctggggcgcgagcactggacaacggactggctaggactcccacaatggggtggctccattgggagcgctttatgtgcaatctagattgtcaggaggagcctgacagttgcatctcagagaaactgtttatggagatggctgagctgatggtgtcagaggggtggaaagatgctgggtacgaatacctatgcatcgatgactgctggatggctccccagagagattctgaggggcgcctgcaagccgaccctcaaaggtttccccatggaattagacagctggcgaattatgttcattcaaagggcttaaaactgggtatctacgctgacgtaggaaacaagacctgcgcgggattccctggctcattcggttactacgacattgacgcccagacttttgctgattggggagtggacttgctgaagtttgatggctgttactgtgattctttggagaatttggcagacggatataaacatatgtcactagcattgaatcggacaggccgcagcatcgtttatagttgcgaatggcccctgtacatgtggccgttccagaaacccaattatacggaaattcgacagtattgcaaccactggagaaactttgctgatatcgacgatagttggaagagcatcaagtctatactggactggacaagttttaaccaagaacggattgtggacgtggctggtccaggtggttggaacgaccctgatatgctggtgattggcaacttcggcttgtcttggaatcagcaggtgacacagatggcactatgggcaattatggctgctcctctgttcatgtccaacgacctacgtcatataagtccccaggccaaagcattgctgcaggataaagatgtgatcgcaataaaccaggaccccctgggcaagcaaggctatcagttgcggcagggagataacttcgaggtctgggaacgaccactgagcggacttgcatgggccgttgcaatgattaaccggcaggagatcggcgggcctcggagttatactatcgccgtcgcctcacttggaaagggagtggcttgcaatccagcatgcttcattacgcagcttctgcccgtcaaaagaaagctgggcttctatgagtggacaagtcgactgagatcccatatcaatcccactggcaccgttctcctgcaacttgaaaatacaatgcaaatgtcactcaaagatcttttg

SEQ ID NO: 12196 - DNA, 1287 bp, Artificial Sequence
  Description of Artificial Sequence: Synthetic coding sequence
atgcagttgagaaatccggaactccacctgggatgtgcactggctctcagattcctggccctggtgagctgggatattccgggggcccgggcactggataatgggctggctagaaccccgaccatggggtggctgcattgggaacgctttatgtgtaaccttgactgtcaggaagaacccgactcctgcatctcggaaaagctgtttatggaaatggcggaactgatggtgagcgagggatggaaggatgccgggtatgagtacttgtgcatcgacgactgctggatggccccacaacgcgacagcgagggacggctccaagccgacccacaacgcttcccgcatggtatcaggcagctcgccaactacgtgcattcgaaaggacttaagctcggaatctacgcggacgtgggcaacaaaacttgcgctggctttcctggatcgttcggatactatgatatcgacgcgcagacttttgccgactggggagtggatctcctgaagttcgacggatgctattgtgactcccttgaaaacctggccgacggctacaagcatatgtcgttggccctgaatcgaacgggacggagcatcgtctactcctgtgaatggcctctgtacatgtggccattccagaaaccgaattacactgaaatcagacaatactgcaatcattggcggaatttcgctgatattgacgacagctggaagtccattaagagcatcctcgactggacgtcattcaaccaagagaggattgtggacgtggccggccctgggggctggaatgacccagacatgctggtcatcggtaacttcggactgagctggaatcagcaggtcactcagatggccttgtgggctatcatggctgcacccctgtttatgtcgaacgatcttcggcacattagccctcaggccaaagctctgctgcaggataaagacgtgatcgcaatcaaccaggacccgctggggaagcagggctatcagctccgccaaggagacaacttcgaagtgtgggagcgccctctgtcgggcctcgcctgggcggtggcaatgatcaataggcaagagattgggggacccaggtcgtacaccatcgcagtggcttcactgggaaagggagtggcttgcaatccggcatgcttcatcactcagctccttcccgtgaagaggaagctgggtttttacgaatggacctccaggctgcggtcccatatcaaccctaccgggactgtcttgcttcaactggagaataccatgcagatgtcactcaaagacctgctg

SEQ ID NO: 12197 - DNA, 1287 bp, Artificial Sequence
  Description of Artificial Sequence: Synthetic coding sequence
atgcagctgagaaatcccgaacttcatttgggatgcgcactggcacttagattcctcgcacttgtgtcgtgggatatccctggtgcaagagcacttgacaatggactcgctcgtactcccactatgggctggctgcattgggagcgattcatgtgtaatcttgactgtcaggaggaacctgattcctgcatttcggaaaaactgttcatggagatggcagagctgatggtgagcgagggatggaaagacgccggatacgagtacctttgtattgatgattgctggatggccccccaacgggattccgaaggacgtctgcaagcagatccacaaaggtttcctcatggcattcggcaactcgcaaattacgtgcattctaaaggacttaaacttggaatttacgcagacgtgggaaacaagacgtgtgccggttttcctggttcctttggttactacgacatcgatgcacaaaccttcgccgattggggtgtggacttgctcaagtttgacgggtgctactgcgattcgctcgaaaatctggcggatggatacaaacacatgtcattggcgctgaaccgaactggccgatcgattgtgtacagctgtgagtggccgctttacatgtggccctttcaaaagcctaactataccgaaatccgccagtactgtaaccattggcgcaattttgcagatatcgacgattcctggaagagcatcaaatccatcctcgattggacctcttttaaccaagagcgtattgtggatgtggcaggtccaggcggttggaacgatccagacatgcttgtcattggtaacttcggactttcgtggaaccaacaggtgacccaaatggcactgtgggccattatggcagcaccgctcttcatgtccaacgatcttcgtcatatttcgccacaagcaaaggcccttttgcaggacaaggacgtgattgccattaaccaagacccattgggtaagcagggataccagcttagacaaggtgacaattttgaagtttgggagcggcctcttagcggtcttgcttgggccgtggcaatgatcaatagacaggagattgggggccctaggagctataccatagcagtggcatcccttggtaaaggggttgcctgtaatcctgcatgttttatcacccaacttttgcctgtcaagagaaaacttgggttttacgagtggacgtcgcgcctcaggtcacacattaatcccaccggcaccgtgctgttgcagctggaaaacaccatgcagatgtccctgaaggatctgctc

SEQ ID NO: 12198 - DNA, 1287 bp, Artificial Sequence
  Description of Artificial Sequence: Synthetic coding sequence
atgcagctcaggaatcctgagctgcaccttggttgcgccctcgctctgcggtttctggctctggtaagttgggatattcccggggctagagctctggataatggtctggcacgcaccccaaccatgggatggctgcactgggagcgctttatgtgcaatctggattgtcaagaagaacccgactcttgcatctccgagaagctctttatggagatggccgagctgatggtgagtgaggggtggaaggacgccgggtacgaatatctgtgtatagatgactgctggatggcccctcaaagagacagcgaaggccggctgcaagccgacccccaacgcttccctcacggcatacggcagctggcaaactatgtacattccaaagggctgaagctgggaatatatgctgatgtcggtaataaaacatgtgctggctttccaggatcctttggctactacgatatcgatgcccagactttcgccgactggggtgtagatctgttaaagtttgacggttgttattgcgactctctggagaaccttgccgatggatataagcacatgtctttagctctaaaccgaaccggccgcagtattgtgtacagctgcgagtggccactctacatgtggccttttcagaagccaaactatacagaaattcgccagtattgtaaccactggcgaaattttgccgatattgacgactcttggaagtctattaaatccatcctggattggacttcttttaatcaggagcgaattgtggacgtggcaggacccggaggttggaatgaccctgatatgctcgtgattggtaactttgggctttcttggaatcagcaggtgactcagatggctctgtgggctattatggctgctcctttgttcatgagcaacgatctgcggcatatctctccccaggccaaggccctactgcaggataaggacgtcatcgccataaaccaggacccactaggtaagcagggttaccaactgcgacagggggacaatttcgaagtgtgggagcggcctttaagtggcctggcctgggcagtggccatgatcaaccgccaggagatcggcgggcccagaagctacactattgctgtggcttctctaggtaagggagtggcttgcaatcccgcttgcttcatcacacagctgctgcctgtgaagcgcaagttagggttctatgaatggacttcacggttaagaagtcacatcaacccaaccggcacagttctgttacagttagagaacaccatgcagatgagtttgaaagatctactg

SEQ ID NO: 12199 - DNA, 1287 bp, Artificial Sequence
  Description of Artificial Sequence: Synthetic coding sequence
atgcagttgaggaaccctgaattacatctcgggtgtgcactggccctgcgcttcctggctctggtgagttgggatataccaggtgcacgggctctggataacggcctcgctagaactcctaccatgggttggctacattgggaacgattcatgtgcaacttggattgccaagaggagcctgactcttgtatcagtgaaaagctgttcatggagatggcggagttaatggttagtgaagggtggaaagatgcagggtatgaatacctgtgcattgatgactgctggatggcgccccagcgggactctgagggccgtctgcaggccgatccgcagaggtttccccatggcatccggcagcttgctaattatgtccacagcaaggggttaaaattggggatctacgccgacgtgggtaataagacctgcgcaggatttcctgggagttttggctattacgatattgacgcacagactttcgcagattggggggttgatctgttaaagttcgacggctgctactgcgactctctcgaaaatctggccgatggctacaagcacatgagtctggctctgaataggacaggacgcagcattgtgtatagctgtgaatggccgctctacatgtggccatttcagaagcccaactatacagagattagacaatattgtaaccactggcgaaatttcgcagacatcgatgactcttggaaatccatcaaatctatattggattggacctctttcaaccaggagcgtattgtggatgtggccgggcccggtggatggaacgatccggacatgttagtgattgggaattttggccttagttggaatcagcaggtaacgcaaatggctctctgggctatcatggccgcaccactgtttatgagtaacgatttaaggcacatctcaccacaggccaaggctctgttgcaggataaagatgtgatcgctatcaaccaggaccctctgggaaaacaggggtaccagctacggcagggagacaacttcgaggtctgggagcgcccactgtccggactagcctgggcggttgccatgatcaaccggcaagaaataggcggccccaggtcctatacgatagccgtggccagcctgggcaagggtgtggcctgcaacccagcgtgttttataacgcagttacttcctgtgaagcggaaacttggcttctacgagtggacatcaagactacgaagccacattaatcctacagggaccgtgttgctacagctggagaacaccatgcagatgtcgttgaaagatctactg

SEQ ID NO: 12200 - DNA, 1287 bp, Artificial Sequence
  Description of Artificial Sequence: Synthetic coding sequence
atgcaactcagaaacccagagctgcacctggggtgcgcactggcgctgcgattcctggccttggttagctgggacatccctggagcacgggccctggataatgggcttgcccgcaccccaactatgggatggttacattgggagcggtttatgtgtaacctcgactgtcaagaggaacctgattcgtgcatctccgagaaattgtttatggaaatggcggagcttatggtgtcagaaggctggaaggatgctggctatgaatatttatgtatcgacgactgctggatggccccccagagagactccgaaggcaggctgcaggccgacccccaacggtttcctcacggcattcgacagctggccaattacgttcactccaaagggttgaagctaggaatatatgcagatgtggggaataaaacttgcgcaggtttcccgggatctttcgggtattatgatatagatgcccagacctttgccgactggggcgttgacttgctcaaattcgatggctgttactgtgactccttagagaatttggccgatggctataagcatatgtccctggccttgaaccggaccgggcgcagtattgtctatagctgcgagtggcccttatatatgtggcccttccagaaacccaattatactgagattcgccaatactgtaatcactggaggaatttcgcagacatcgacgatagctggaagtcaatcaagtctattctggactggacctcctttaaccaggagcgcatagttgacgtggcaggcccaggaggatggaacgatccagatatgttagtgatcggaaatttcggcctctcgtggaatcagcaggttacgcagatggccctctgggcaataatggcagcacccctctttatgagcaacgatctgcggcacatttcaccccaggccaaagccttgctgcaagataaagacgtgatcgccatcaaccaggatccacttgggaagcaaggctatcaactgcgtcagggggataacttcgaggtatgggaacggcccctgtccggcctggcgtgggcggtagctatgataaaccgtcaggagattggaggcccccggtcttataccatcgctgttgcctcactggggaagggggtggcttgcaaccccgcctgtttcatcacacaactgttacccgttaaacggaagctgggattttacgagtggacatcccggcttcgctcacacataaacccgaccggaacagtcctgctccagctcgagaacactatgcagatgagcctcaaggacctgctg

SEQ ID NO: 12201 - DNA, 1287 bp, Artificial Sequence
  Description of Artificial Sequence: Synthetic coding sequence
atgcagttgagaaaccctgaactgcatctcggatgcgccctggcactcagatttctcgccctggtgtcttgggatattcctggtgccagagccttagacaatggtctcgccaggaccccaacaatgggatggctgcattgggaaagattcatgtgtaatttggactgccaggaggagcctgatagctgcatctctgagaagctgtttatggaaatggccgagctcatggttagcgagggttggaaagacgctggatatgagtacctgtgcatcgacgactgctggatggcaccccagcgtgatagtgaagggaggttgcaggccgatcctcagcggtttccccacggcatccggcagctcgctaattacgttcactctaagggcctgaagctagggatttatgccgatgtcggaaacaaaacctgcgcggggttccccggcagctttgggtattacgatatcgacgcccaaacatttgctgattggggggtggacctccttaagttcgatgggtgctactgtgacagcctagagaatctggcagacggctataagcatatgtcacttgctcttaataggacgggccgcagcatcgtctacagttgtgagtggcctctgtacatgtggcctttccagaagcccaactacacagagatcagacagtactgtaatcactggcgcaactttgccgacattgacgatagctggaaatctataaagtccatattagactggacgtcattcaatcaggaaaggattgttgacgtggcggggcccggcggttggaatgaccctgacatgctggtgattgggaatttcggactgtcttggaaccagcaggtgactcagatggcactgtgggccatcatggctgctccactgtttatgtccaacgacttgcggcacatctccccccaggctaaggcactgttgcaagataaggatgtgatcgcgattaaccaggacccactgggtaaacagggctatcagctccggcaaggggataacttcgaggtctgggagcggccactatccgggctggcttgggctgtggcaatgatcaaccgtcaggagattggcgggccacggtcttacacgatcgcggtggccagcctgggaaagggagttgcctgtaaccctgcatgtttcattacacagctgcttccagtaaaaaggaaattaggtttctacgaatggacatctcggttgagatcccacattaaccccacagggacagtgctgttgcagctggagaatacgatgcagatgagccttaaagaccttttg

SEQ ID NO: 12202 - DNA, 1287 bp, Artificial Sequence
  Description of Artificial Sequence: Synthetic coding sequence
atgcagctgagaaatccggaactgcatctcggctgtgctctcgctctccggttcctggctcttgtgtcatgggacatcccgggcgcccgcgctctcgacaacgggctggctagaacacccacaatggggtggttacattgggagcgatttatgtgcaatctggactgtcaagaagaacctgatagttgcatctcagaaaaactgttcatggagatggcagaactgatggtgtctgagggctggaaggacgcaggatatgagtatctatgtatagatgattgttggatggcccctcagcgcgacagtgaggggaggctgcaggctgatccgcagcgatttcctcatggaatcagacagcttgcgaactatgttcactccaaagggctcaaactagggatttacgccgacgtaggaaataagacatgtgctggcttcccagggagcttcgggtattacgacattgatgcccagaccttcgcagactggggggtagacttgctcaaattcgatgggtgttactgcgatagcctggagaatcttgccgatgggtataaacacatgtctctggctctgaatcgcacaggccggagtattgtgtattcttgtgaatggccgctttatatgtggccttttcagaagccaaactacacggaaatccgacagtactgcaatcattggaggaacttcgctgacattgacgatagctggaagtctatcaagtctatcttggactggacgagctttaaccaggagcgcatagtggacgtggcaggacctggaggatggaatgacccagacatgctggtaatcggcaatttcgggctgagttggaatcagcaggtgactcagatggccctctgggccattatggctgcccctcttttcatgtctaacgaccttcgtcacataagtccacaggcaaaagcactgttgcaagataaggatgttatcgcgattaaccaggatcccctggggaaacagggttaccagctgcgtcagggggataactttgaagtgtgggagcgccccctgtccggcttagcatgggcagtggcaatgattaatagacaggagatcggagggccacggagctatactatagctgtcgcttcactgggaaagggtgtggcttgcaatcctgcttgtttcatcacacagctcctgccagttaagcggaagctgggcttttacgaatggactagcagactacgcagtcatatcaatcccacagggactgtattgctacaattggagaacaccatgcagatgagtttgaaggacctgctt

SEQ ID NO: 12203 - DNA, 1287 bp, Artificial Sequence
  Description of Artificial Sequence: Synthetic coding sequence
atgcaactgcgcaatcctgagcttcacctcgggtgcgccctcgcccttcgattcttggcccttgtgtcgtgggacattccaggagcgcgtgctcttgataacgggctcgcccgtaccccaaccatgggatggctccattgggaacgcttcatgtgcaatcttgattgccaggaagagccggactcgtgtatttccgaaaagctgtttatggagatggccgaactgatggttagtgaaggctggaaggacgccggttacgagtacctctgtatcgatgattgttggatggcacctcaacgggactcggagggacgcctccaagcagacccacaacgcttcccgcatggaatccggcagctcgctaactatgtgcactccaagggactgaagctgggaatttacgcagacgtgggaaacaagacttgcgccggatttcctggcagcttcggttactacgatatcgacgctcagaccttcgcggattggggggttgacttgttgaagttcgatggctgttactgcgactccctggagaacttggcagacgggtacaagcacatgtcactcgcactgaacagaacgggaagatccatagtgtactcgtgcgaatggccactttacatgtggccattccagaaacctaattacactgaaattaggcagtactgcaatcactggaggaatttcgctgacatcgatgatagctggaagagcatcaagtccatccttgactggacttccttcaaccaggaaagaatcgtcgatgtggccggaccggggggctggaacgacccggacatgctcgtcatcggcaactttggattgtcgtggaaccagcaggtgacccaaatggcactctgggctataatggccgccccactgtttatgagtaacgacctgaggcacatctcaccgcaggctaaagcactcctccaggacaaggatgtgattgccattaatcaggatccgctcggcaaacagggttaccaactgcggcaaggcgataacttcgaggtgtgggagcggccgctgagcggcctcgcttgggcggtggccatgatcaatcgccaagaaatcggaggacccagaagctataccatcgcggtcgcttcgctgggtaagggggtagcctgcaaccctgcctgtttcatcactcaactgcttccggtgaagcggaaactgggtttctatgaatggactagccgactgcgctcacatatcaatccgaccggaactgtcctcctgcagctggagaataccatgcaaatgtcactgaaagacctgttg

SEQ ID NO: 12204 - DNA, 1287 bp, Artificial Sequence
  Description of Artificial Sequence: Synthetic coding sequence
atgcaattaaggaaccctgaactacatttgggatgtgcactcgcgctgaggttcctcgccctggtgagctgggatattcctggcgctagggcattggataatggcttagcccgcacacccacgatgggctggttgcactgggagcgttttatgtgtaacctggactgtcaggaggagccagattcctgcatctccgagaagctttttatggaaatggccgagctgatggtttctgagggctggaaggatgctggctacgaatatctgtgcatagacgattgctggatggctccccagcgcgactctgagggtaggctgcaggctgacccacagcgctttccccacggcatcaggcagctggctaactacgtacactctaaagggcttaagttgggcatttatgccgacgtaggtaacaagacctgcgctgggttccccggcagcttcggttattacgacatcgacgcccagaccttcgcggattggggggtggacctactgaaattcgacggatgttactgtgactcactggagaacctggctgatggttacaagcacatgagtctcgcgctgaatagaaccgggaggagcatcgtctatagttgcgaatggccgttgtacatgtggccttttcagaagcccaattatacggaaatccggcagtactgtaaccactggcgcaatttcgcggacattgatgattcctggaaatcaattaaaagcatccttgactggacaagttttaatcaggaaaggattgtggacgtggctggccccgggggatggaatgaccccgacatgctggtaatcggaaattttggactctcatggaaccagcaggtcacacagatggcactgtgggctattatggcggccccactgttcatgtccaacgacctccgtcacatcagcccacaggctaaggctctgcttcaagacaaggacgtgatcgcgatcaaccaggatcctctggggaaacagggataccagcttcgccagggggacaacttcgaggtctgggagagacccttgagcggtctcgcatgggcggtcgccatgataaatcgccaggaaataggcgggcccagatcctacaccatagctgtggcaagtcttggcaaaggagtcgcttgtaatcctgcctgcttcatcacacaattacttcccgtcaaacgcaagctgggattctatgaatggactagcaggctgaggagccatataaaccccaccggcacagtcttgctgcagctggaaaatacgatgcagatgagccttaaagatttgctt

SEQ ID NO: 12205 - DNA, 1287 bp, Artificial Sequence
  Description of Artificial Sequence: Synthetic coding sequence
atgcagctgcggaatccggaactgcacctgggatgcgccttggcgctgcgcttccttgccctcgtctcctgggacatccctggtgcgcgggccctcgacaatggactcgctagaaccccaaccatgggctggctgcattgggagcggttcatgtgtaatctcgactgccaggaagaaccggacagctgtatctcagagaagctgttcatggaaatggccgaattgatggtttcagagggctggaaagacgcgggatacgaatatctgtgcatcgatgattgctggatggccccgcaacgggactcagaagggcggctgcaagccgatccacaacggtttccgcacgggattcggcagctggccaattacgtgcactctaagggactgaaactcggcatctacgccgacgtgggcaacaagacctgcgcgggattcccgggttcatttggatactacgacattgatgcacaaaccttcgctgactggggcgtcgacctgcttaagttcgacggatgctactgcgattcgctggaaaacctggcagatgggtacaaacacatgtcactcgccctgaaccggactggtcggagcatcgtttactcgtgtgaatggccgctctacatgtggccatttcaaaagcccaactacaccgaaatcaggcagtactgcaatcattggagaaatttcgccgatattgacgactcatggaagtccattaagtcgatcctggattggacttccttcaatcaggagaggatcgtggacgtggcaggacccgggggatggaatgatcccgacatgctggtcatcggtaatttcggcctctcctggaatcagcaagtcactcagatggcactgtgggccatcatggcggcacccctcttcatgtccaacgaccttcgccacatctcgccccaagccaaagcgctgctccaggataaagatgtgatcgccatcaatcaagacccgctgggcaagcagggataccagctccgccagggagataactttgaggtgtgggaacgccctctgagcggtttggcctgggctgtcgccatgatcaaccgccaggaaatcggcggaccgagatcgtacactatcgcagttgcatccctcggaaagggagtggcatgcaaccccgcctgcttcatcacccaactcctgcccgtgaagcgaaagttgggcttctacgaatggacgtcacgcctgaggtcgcacatcaaccctactggaactgtgcttctgcagctcgaaaataccatgcaaatgtccctcaaggacctgctg

SEQ ID NO: 12206 - DNA, 1287 bp, Artificial Sequence
  Description of Artificial Sequence: Synthetic coding sequence
atgcagcttcgaaacccagagttgcacttgggatgcgctctggcactgcggttcctggctctggtgagctgggatattccaggcgcaagggctctggataatggccttgcccgcacaccaaccatggggtggttgcattgggagagatttatgtgcaacttggactgtcaggaagagcccgactcatgtatctctgagaaactgttcatggaaatggctgaactgatggtgagcgagggctggaaggacgcaggatatgaatacctttgcatcgacgactgctggatggcaccacagagggactctgagggccgccttcaggcggacccgcagagattcccacatggaatcagacagctcgccaactacgttcactctaagggtcttaagctgggcatctacgctgatgtgggtaacaaaacctgtgccggatttcctggtagctttggatactacgatatcgatgcgcaaacctttgcagactggggcgtggacttgctcaagtttgacggatgctactgcgacagtttggaaaacttggccgatggatacaagcacatgtcccttgcccttaatagaaccggtagatccatcgtatacagttgcgagtggcctctgtacatgtggcctttccaaaagcctaactacacagaaatacgtcagtactgtaaccactggcgcaatttcgccgatatcgacgacagctggaagagtatcaagagtattctggattggaccagctttaatcaagagcgcatcgtggatgttgctggtcctggcgggtggaatgaccctgatatgttagtcatcggaaacttcggcctcagctggaaccagcaagttacacagatggctctgtgggctatcatggccgctcctctttttatgtctaacgatctccgccacattagccctcaggctaaggcactcctgcaggataaagacgtcattgccatcaaccaggacccactggggaaacagggatatcagctgcgtcaaggcgacaacttcgaggtctgggagcgcccactttctggcctggcctgggcagtggccatgataaacaggcaggaaatcggaggccccaggagctacaccatagccgtcgcttctctcggaaagggcgtcgcctgcaaccctgcttgcttcatcactcagctcctgcctgtaaaacgcaaattagggttctacgaatggacctctagactcagatcccatattaaccccaccggcaccgtcctgttgcagctggaaaacacaatgcagatgtctctcaaagacctgctc

SEQ ID NO: 12207 - DNA, 1287 bp, Artificial Sequence
  Description of Artificial Sequence: Synthetic coding sequence
atgcagttgcggaacccagaattgcacctgggatgcgccctggcactgaggttcttggcattggtgtcctgggacatcccgggagcccgcgccctggataacggactcgccagaaccccaactatgggatggttgcattgggaacgctttatgtgtaaccttgactgccaggaagagccggattcctgcattagcgagaaactgtttatggaaatggccgagcttatggtgtcagagggatggaaggacgccgggtacgagtacctttgcatcgatgactgctggatggcgccgcagcgcgactctgaaggacggctgcaagcagaccctcagagattccctcacggaatccggcaactcgccaactacgtccatagcaaaggactcaaacttggaatttacgcggatgtcggcaacaagacttgcgccggcttccctggatccttcgggtattacgacattgatgcacaaaccttcgctgactggggagtggacctcctgaaatttgatggctgctactgcgacagcctcgaaaatctcgcggacggctacaagcacatgtcactcgcgctcaaccgcacggggcgatctatcgtctactcgtgtgagtggcccctttacatgtggccatttcaaaagccaaattacacggaaatacgacaatactgtaaccattggcgtaatttcgccgatatcgacgatagctggaagagcatcaaatcgatcctggactggacctcattcaaccaagaacgtattgtcgatgtggcagggcccgggggatggaacgacccggatatgctggtgatcggaaacttcggtctgtcatggaatcagcaggtgactcagatggcgctgtgggctatcatggccgcgccgctgttcatgtcgaatgatctgagacacatttccccgcaagcaaaggctctgctgcaagacaaagacgtgatagccattaatcaagaccctctgggaaagcagggttaccagctgcggcagggtgataacttcgaagtgtgggagaggccgctctctggactggcttgggcggtggcaatgatcaaccggcaggaaatcggcggaccacgctcgtatactatcgcggttgctagccttggtaagggtgtggcttgcaaccccgcatgtttcatcacccagctccttccagtcaagagaaagctcggcttctacgagtggacttcgagactccgctcgcacatcaatccgactggtaccgtgcttctccaactggaaaataccatgcagatgtcgcttaaggatctgctg

SEQ ID NO: 12208 - DNA, 1287 bp, Artificial Sequence
  Description of Artificial Sequence: Synthetic coding sequence
atgcaactccggaatcctgagctccacctcggttgtgcactggctctgcgctttctggcgctggtgagttgggatatccctggagcaagggcactcgacaatgggttggcacgaactccaaccatgggctggctccactgggaacggtttatgtgtaacctggactgccaggaagaaccagattcgtgcatcagcgaaaagctgtttatggaaatggcagaactgatggtgtctgaaggatggaaggatgcaggatacgagtacctgtgcatcgatgattgttggatggcccctcaacgcgactccgagggtcggctccaggcggatccacaaagatttccacacggtattcggcaactggcgaattacgtgcattccaaaggactgaagctgggaatctacgcagatgtcggtaacaagacctgtgcaggattcccgggctctttcggatactatgatattgatgcacaaactttcgccgactggggagtggacctgcttaagttcgatggttgctactgcgattcacttgaaaacttggcagatggttacaagcacatgtccctggcactcaatcgtacgggtcgatcgattgtctacagctgcgaatggccactctacatgtggccattccagaagcctaactatacggagatacgtcagtactgtaatcactggaggaactttgcggacatagatgactcttggaagtccataaagagcattctcgactggaccagctttaatcaagaacgaattgtcgacgtggcagggcctggtggatggaatgatcctgatatgttggtgatcgggaactttggactgtcatggaaccaacaggtgactcagatggcattgtgggctatcatggccgcaccactgtttatgtccaacgacttgaggcatatttcgccacaggcaaaggccttgctgcaggataaggatgtgattgccattaatcaagaccccctggggaaacaaggataccaactgcgccaaggtgataactttgaggtctgggaacgccccctctccggactggcctgggcagtcgctatgattaaccgacaagagatcggtggaccccggtcctacactattgctgtggcatcgttgggaaagggcgtggcatgcaaccctgcctgcttcattactcaactcctgccagtgaaaagaaaactgggcttctacgagtggacctcgagacttagaagccacattaaccctactgggaccgtcctgctccagctcgaaaacaccatgcagatgtcacttaaggatttgctt

SEQ ID NO: 12209 - DNA, 1287 bp, Artificial Sequence
  Description of Artificial Sequence: Synthetic coding sequence
atgcaactgagaaatcctgaacttcatctgggatgtgcactggcacttaggtttctcgccctggtgtcctgggacattccaggtgcccgcgcacttgacaacgggctcgcaagaactccaactatggggtggcttcattgggagcgctttatgtgtaacctggattgtcaggaagagcctgactcgtgtatttccgaaaagctgttcatggaaatggctgaacttatggtatcagaaggatggaaggacgccggttacgaatacttgtgtattgacgattgttggatggcaccgcaaagagactccgaagggagactgcaggcagaccctcaacggtttcctcacggcatacgacagctggcgaattacgtgcactccaagggattgaaattgggcatatacgcagatgtcggtaataagacttgtgccggttttccagggagctttgggtactacgacattgacgcccaaacgttcgcggattggggcgtggatcttctgaaatttgatggctgttactgcgatagccttgagaatttggcggatggctataaacacatgtcgcttgccctcaacagaactggaagatcgattgtttactcgtgcgaatggccactttacatgtggccgtttcaaaagccaaactacactgaaattcggcaatactgtaatcattggcggaactttgcagacattgatgattcgtggaagtctattaagtcgattctggattggaccagcttcaaccaggaacggattgtggatgtcgccggccccggaggatggaacgatccagacatgcttgtgatagggaattttggtctgagctggaatcaacaagtgacccaaatggcactgtgggcaattatggcagcaccactcttcatgagcaacgacctgagacatatttcaccccaggcgaaagcacttctccaggataaggatgttatcgctattaaccaagatcctctggggaagcaaggctaccagctcagacagggtgataacttcgaggtgtgggaacggcccctgagcggtcttgcttgggctgtggccatgatcaacaggcaagaaataggagggccaagatcgtacaccatcgcagtggcatccttgggaaagggtgtcgcctgcaatcctgcttgtttcataactcaactcctcccagtcaagaggaagctgggattctacgaatggactagccgcctgagaagccatatcaacccgactgggacggtgcttctgcagctggaaaacactatgcaaatgtcactgaaggaccttctg

SEQ ID NO: 12210 - DNA, 1287 bp, Artificial Sequence
  Description of Artificial Sequence: Synthetic coding sequence
atgcaattaagaaacccagaattgcacctgggatgcgcattggctctcagatttctcgctttggttagctgggacattcccggggcacgtgctcttgataacggacttgcaaggacccccactatgggatggcttcattgggaaaggttcatgtgcaaccttgattgccaagaggaacccgactcatgcatttccgaaaaacttttcatggagatggctgagttgatggtttctgaaggatggaaagatgcaggctatgaatatctctgcattgatgactgctggatggccccacaaagagatagcgagggtcgtttacaagccgatcctcagagattcccacatggaataaggcagcttgccaactatgttcatagcaagggattgaagctcggaatttatgccgacgttggaaataagacgtgcgctggatttccaggtagtttcggatattacgatattgacgctcaaaccttcgccgactggggcgtcgacctcctcaagtttgatggttgctactgtgacagcctggaaaaccttgcagacggctataagcatatgtcccttgcattaaaccgtaccggacgatctatcgtttatagttgcgagtggcctctgtatatgtggccattccagaagcctaactacactgaaatcagacagtattgtaaccattggaggaattttgcagatatagacgactcctggaagagtataaagagtatcctcgattggacctcctttaaccaggaacgtatagtggatgtcgctggccctggtggatggaacgaccccgacatgcttgtgattggaaacttcggtttgtcatggaaccaacaagtgacccaaatggcactttgggctataatggccgctccattgttcatgtcaaacgacctaaggcacatcagcccacaagctaaagcgcttcttcaggacaaagatgtaattgccattaatcaggatccgcttggaaagcaggggtatcaacttaggcagggagataattttgaggtgtgggaaaggcccctttcagggttggcctgggcagtagcaatgattaatagacaagagataggcggtcccaggtcgtacacaatcgcggtcgcttcattgggaaagggagtcgcttgcaatccagcttgttttattacccaattattacccgttaagcgtaagttgggtttttacgagtggacgtccagactccgcagccatatcaaccctactggtaccgttctgctccaactagagaatacaatgcaaatgagccttaaggatttgttg

SEQ ID NO: 12211 - DNA, 1287 bp, Artificial Sequence
  Description of Artificial Sequence: Synthetic coding sequence
atgcagctgagaaacccggaactccacctgggctgtgccctggcgctccggttcctggccctggtgagttgggacattccgggagcccgcgcgctggacaacggactcgccagaacgccaactatgggatggctgcactgggagcggtttatgtgtaatctggattgccaagaggaaccggattcgtgtatctccgagaagctcttcatggaaatggccgagctgatggtgtccgaaggatggaaggacgccggatacgagtacctctgcatcgatgactgctggatggcgccgcagagggattccgaaggacgcctgcaagcggatccgcagcgcttccctcatggcattcggcaactggcgaattacgtccattcaaaggggctcaaattgggaatctacgctgacgtcggcaataagacttgcgcaggattcccggggtctttcggatactacgatatcgacgcgcaaaccttcgccgattggggcgtggatcttctgaaattcgacgggtgctactgcgattccctggagaaccttgccgacggctataaacacatgtcactggccctcaatcgcactggaagatccatcgtgtactcgtgcgagtggccgctctatatgtggcctttccagaagcccaattacaccgagatcagacagtactgcaaccactggcggaacttcgccgacatcgacgattcctggaagtcgatcaagtcgatcctggattggacttcatttaaccaagaacgcatagtggacgtcgcgggcccgggaggatggaatgacccagatatgcttgtgattggaaatttcggtctttcttggaaccaacaagttactcagatggcgctgtgggccattatggccgcgccactgttcatgtctaacgacttgcgccacatttccccacaagccaaggcgcttctgcaggacaaggacgtcatcgccatcaatcaggatcctctgggaaaacagggataccaactcagacaaggcgacaacttcgaggtctgggagcgacccctgtccggcctggcatgggcggtggctatgatcaaccggcaggagattggcggcccgaggagctacactatcgccgtcgcgtcgctgggaaagggggtggcatgcaacccagcctgtttcatcacccagctgctccctgtcaagcggaagctgggtttttacgaatggacctcgcgactgagatcacacattaaccctactggtacggtgctcctgcaactcgagaacacgatgcaaatgtcgctgaaagacttgctt

SEQ ID NO: 12212 - DNA, 1287 bp, Artificial Sequence
  Description of Artificial Sequence: Synthetic coding sequence
atgcagctccggaatccagaactgcacctgggatgcgccctggccctgcgcttcctggccctcgtctcgtgggatatcccgggtgcaagagcgctggacaacgggcttgcccggactccgaccatggggtggttgcattgggaacgcttcatgtgtaacctggattgtcaggaggaaccagacagctgcatctcagaaaaacttttcatggagatggccgagctgatggtgtcggagggatggaaggatgctggttacgagtacctctgtatcgacgactgctggatggctccacagcgcgactcggagggtagacttcaggctgacccccagcgcttcccgcatggaattagacagctggccaattacgtgcactcgaagggcctgaagctggggatttacgcagacgtgggaaacaagacctgcgcgggattcccaggctcgtttggctactacgacattgatgcccagaccttcgccgattggggagtcgatctcctgaaattcgacggatgctactgcgattcgcttgaaaacctcgcagacggatacaagcacatgtcgcttgccctgaaccgcaccggccggtccatcgtctattcctgcgagtggcccctgtacatgtggcccttccagaagccaaattacaccgaaatccggcagtactgtaaccattggcgcaacttcgcagacatcgacgactcgtggaaaagcatcaagtccatcctggattggacctccttcaatcaggagcggatcgtcgacgtggccggaccgggagggtggaatgaccctgacatgctggtcattggaaactttggactcagctggaaccaacaggtgacccagatggcactgtgggctatcatggccgcacctctctttatgtcgaacgacctgcgccatatttcccctcaagccaaggctcttctccaagacaaggacgtcattgctatcaaccaggacccgcttggcaaacaaggctaccagctgcgccaaggcgataacttcgaagtctgggagcggccgttgtcaggcctggcatgggcagtcgccatgatcaatcgccaagaaataggaggtccccggagctatactatcgccgtggcttccctgggaaagggagtggcttgtaaccctgcttgtttcatcactcaactcctgcccgttaagcggaaactcggcttctacgagtggacttccaggttgcgaagccacatcaatcctaccggaacggtcctgctgcagctcgaaaacaccatgcagatgtccctgaaggacctgctt

SEQ ID NO: 12213 - DNA, 1287 bp, Artificial Sequence
  Description of Artificial Sequence: Synthetic coding sequence
atgcagctgcgtaaccccgaacttcatctggggtgtgcattggcattgagatttttggctctggtgagctgggacatacccggcgcacgcgcactggacaatggcctcgcacgaaccccaaccatgggttggctccactgggaacgttttatgtgcaacctggactgtcaggaagaacctgattcgtgtatttccgaaaagctctttatggagatggctgaactcatggtgtcagaaggctggaaggatgccgggtacgagtacctttgtatcgacgactgttggatggcaccgcaaagagattccgaaggtcgtttgcaggctgaccctcagagattcccacatggaatcagacagcttgctaactacgtgcactctaagggactgaagctcgggatttacgcggatgtcgggaataagacttgcgcaggttttcccggatcatttggatactacgatattgacgcccaaacttttgccgattggggagtggatcttttgaaatttgatggatgttattgtgatagcctggaaaacctcgcagatgggtacaaacatatgtccctcgcacttaatcggacgggtcgttctatcgtctacagttgcgagtggccactgtacatgtggccttttcaaaagcctaactacaccgagattagacaatactgcaatcattggcggaatttcgcagatatcgacgattcgtggaaaagcatcaaatccattcttgactggacgtcctttaaccaggagcggatcgtggatgtcgcagggcctggcggatggaacgatccagatatgcttgtgatcgggaatttcggactgtcatggaaccaacaggtgactcagatggcgctttgggcgatcatggccgcaccccttttcatgtcgaacgatcttcggcatatttcgcctcaggccaaagcgcttctgcaagacaaggatgtcattgccattaaccaagatccactgggaaagcaaggctaccagcttagacaaggagacaatttcgaggtgtgggaacgcccacttagtgggctcgcatgggccgtggccatgataaaccgccaggagatcggcgggccccgttcctacactatcgctgttgcatcgttgggcaaaggtgtggcatgcaatccagcctgtttcataactcagctcctgccagtcaagcgtaagctcggattctatgaatggacctcccgtctgcgatcgcacattaaccccactggaaccgtgctgcttcaactcgagaacaccatgcaaatgagcctgaaggatctgctt

SEQ ID NO: 12214 - DNA, 1287 bp, Artificial Sequence
  Description of Artificial Sequence: Synthetic coding sequence
atgcagttgagaaatcccgagcttcacctggggtgcgccctggcgctgaggtttctcgccttggtcagctgggacatcccaggagcccgcgcgctggataatggacttgcgagaaccccgactatgggctggctccactgggagcgttttatgtgtaacctggactgccaggaggagccggattcgtgcatctcggaaaagctcttcatggagatggccgagctgatggtgtctgaaggctggaaagatgcaggctacgaatacctctgtatcgatgattgttggatggcaccacaacgcgacagcgagggccggctgcaggcggatcctcaacgttttcctcacggaatcaggcagctggcaaactacgtgcattcaaagggcctgaaattggggatctacgccgacgtcggtaacaagacctgcgccggattcccgggatctttcggatactacgatatcgacgcacaaacctttgccgactggggcgtagacctgctgaaattcgacggatgttattgtgactcacttgaaaacctggcagatgggtacaaacacatgtccctggccctcaacagaactggtcggagcatcgtttactcgtgtgaatggccactctacatgtggccgttccaaaagcctaattacaccgagatccggcagtactgcaatcattggcgcaacttcgctgacatcgacgattcctggaaaagcatcaaatcgatcctggactggacttccttcaatcaggaacggatcgtggatgtggccggacctggaggatggaatgacccagatatgctcgtgattgggaattttggattgtcctggaaccagcaggtgactcagatggccctctgggcgattatggctgccccgctgttcatgtcaaatgaccttcgccatatctcgcctcaagcgaaggcgctgttgcaggacaaggacgtcatcgccattaaccaggatccgctgggcaagcaaggataccagctccgccaaggagataacttcgaggtgtgggaacggccactgagcggactggcatgggctgtcgcaatgataaaccggcaagaaattggaggcccacgatcctacactatcgccgtggcctccctcggaaagggcgtagcctgcaacccagcgtgcttcatcacccagcttctccccgtcaagcgcaagctcggtttctatgaatggaccagccgcctgaggtcgcacataaatccgactggtacggtgctgttgcagcttgaaaacaccatgcaaatgtcactgaaggatctgctc

SEQ ID NO: 12215 - DNA, 1287 bp, Artificial Sequence
  Description of Artificial Sequence: Synthetic coding sequence
atgcagctgcgcaaccccgaactccatctgggctgcgcccttgcgttaaggttcctcgccctggtgtcatgggatattccgggggctagagcactcgacaacgggctggctcgcacccctacaatggggtggctgcattgggaacgctttatgtgcaacctggattgccaagaagaaccagatagctgcatctctgagaagctctttatggaaatggctgagctcatggtaagcgagggatggaaggatgccgggtacgagtacctctgcattgatgactgctggatggctccgcaaagggattcagagggcagactacaagctgatccccagcgattcccccatgggatccggcagctggccaattacgtgcacagcaagggcctgaagttaggaatctacgccgatgtgggtaacaagacgtgtgctggatttcccggctccttcggttattatgacatcgacgcacaaactttcgcagactggggcgtggatcttctaaagtttgatggatgttattgcgacagtctggaaaatctggccgatggatacaagcatatgtctttagcactgaaccgcaccggccgaagtattgtatactcttgtgagtggcctctgtacatgtggccatttcagaagcctaattacaccgaaattcgacaatattgcaatcattggcggaacttcgccgacatagacgactcctggaaatcaatcaaatctatcctggactggactagcttcaatcaggagagaatcgtagatgttgccggccccggtggatggaatgaccctgacatgctagtgattggaaatttcgggctgagttggaaccaacaagtcacccagatggccctgtgggctattatggctgcacctttgttcatgtctaatgatctgcgccacatctccccccaggccaaggcactattgcaagataaagatgtcatcgcgatcaatcaggatcctttaggcaagcaaggataccagctgcgccagggagataacttcgaagtctgggagcggcctctgagcgggctggcttgggctgtcgcaatgatcaataggcaagaaatcggtggtcctcgttcatacacgatcgcagtcgcctccttaggcaagggggtggcttgtaatcctgcctgctttattacccagctgctacctgtaaaacgcaaactaggcttctatgagtggacgtcgaggctccgatctcatattaatccaactgggaccgtccttcttcaactagaaaacactatgcagatgagtcttaaggacttactg

SEQ ID NO: 12216 - DNA, 1287 bp, Artificial Sequence
  Description of Artificial Sequence: Synthetic coding sequence
atgcagctcaggaaccctgaactgcacctgggatgcgcacttgccttgagattcctggctctcgtctcatgggacatacctggggcgagagcgctggataacggacttgcccgaacccccacgatgggttggctccactgggaaaggttcatgtgtaacctcgattgtcaagaagagcctgacagttgcattagtgaaaagctgtttatggaaatggcagaactcatggtgtctgagggctggaaagacgccggttacgagtacctgtgtattgacgactgttggatggcgccccagcgcgacagcgagggtcgtctacaggctgatccccagagatttccacacggcattaggcagctcgctaattatgtgcatagcaaggggctaaaactagggatctacgcagacgtggggaacaagacctgcgccggatttcccgggagctttgggtactacgatatcgacgcccagacgttcgctgattggggcgtggatttgcttaagtttgacgggtgctattgtgacagtctagaaaacttagccgacgggtataagcatatgtctttggcactgaataggacaggcagaagcatcgtatactcttgcgaatggcccctgtacatgtggccatttcagaaacctaattacacagaaattagacaatattgtaatcactggaggaactttgcagacatagacgactcttggaagtctatcaagagcatcctggattggacaagctttaaccaggagcgaattgtggatgtcgctggtccgggcgggtggaatgatcctgacatgctggtaattggaaatttcggactgagttggaatcaacaggtgacccaaatggctctgtgggcaattatggccgcgccattgtttatgtccaatgacttacgacacatctccccgcaagccaaggccctgctgcaggacaaggacgtgattgccatcaaccaagacccgctcggtaaacagggatatcagctgcgccagggggataattttgaggtgtgggaaaggccactaagcggactggcatgggccgtggcaatgattaaccgacaggaaatcggaggccctagatcctataccatagctgtggccagcctcggcaagggggttgcttgcaatccagcgtgtttcataacccagctcttaccagtgaaaaggaaactggggttctatgaatggacaagccgcttacgtagtcatatcaatcctacaggcaccgtgttgctgcaattggaaaataccatgcagatgtcactcaaggacctcctg

SEQ ID NO: 12217 - DNA, 1287 bp, Artificial Sequence
  Description of Artificial Sequence: Synthetic coding sequence
atgcagcttcgcaatccagaacttcacttgggctgcgccctggcccttagatttctcgccttagtgagctgggatatcccaggagcaagagctctcgataatggcctggccaggacacctaccatgggttggttgcattgggagagattcatgtgtaacctggattgccaggaggagcctgattcatgtatctctgagaaactgttcatggaaatggctgaactgatggtgtccgaggggtggaaggatgctggttatgaatacctctgcattgatgactgttggatggctccccaaagagattccgagggtaggctacaggccgacccacagagattcccccatggcattaggcagcttgcaaattatgttcactccaagggcctgaagcttggaatttacgcggacgtgggaaacaaaacctgtgcagggtttcccggctcttttggttattacgatattgatgctcagaccttcgcggattggggggtcgaccttttaaagtttgatggctgttactgtgatagcctggagaacctcgcagacggatataaacacatgagcttagctctgaataggactgggcgctctatcgtgtacagttgcgagtggcctttgtatatgtggccattccaaaaacccaattacacagagatccggcagtactgtaatcactggagaaattttgcagatattgatgatagctggaagagcatcaagtccatcttggattggaccagcttcaaccaggaacgcatcgtcgatgtcgccggccctggaggctggaacgacccagacatgctcgtgattgggaactttgggctgagctggaaccaacaagtgacccagatggccctatgggcaattatggcagcacctctgtttatgagcaacgacctgagacatatcagcccccaggccaaagcactgttacaggacaaggacgtgatcgccataaaccaagacccccttggaaaacaaggctatcagctgagacaaggtgataacttcgaggtttgggagagaccattgtcaggactcgcttgggctgtcgccatgatcaatagacaggagatcggcggacctagatcctacaccatcgcagtggcgagccttggaaagggcgtcgcttgcaaccccgcttgcttcatcacacaacttctgccagtgaagcggaagctcgggttttacgaatggacaagcaggctgaggagccacattaaccctactggaaccgtgctgctgcagttggaaaacacaatgcagatgagcctgaaggatctcctc

SEQ ID NO: 12218 - DNA, 1287 bp, Artificial Sequence
  Description of Artificial Sequence: Synthetic coding sequence
atgcaactgcgcaatcctgagttgcacctgggctgtgcactggcattgcggtttctcgcacttgtcagttgggatatcccgggggctcgcgcgctcgataatggcctcgcacgcacccctaccatgggctggcttcactgggaaagatttatgtgtaacctggattgtcaagaggagcccgacagctgcatctccgaaaagctgtttatggaaatggcggaactgatggtcagcgagggctggaaagatgcaggatacgaatatctttgcattgacgactgttggatggcgccccaaagagattcagagggccgcctccaggcagatccacagagattcccgcatggtattcgtcagctcgctaattacgtgcattccaaaggtctgaagctcggtatatacgcagatgtgggtaacaagacttgcgcaggctttcctggatccttcggttactacgacattgatgcccaaacgtttgcagattggggcgtggaccttcttaagtttgatggttgttattgcgacagcctcgaaaatcttgcggatgggtacaagcacatgtcgctggcacttaaccgcactggtcgttcaattgtgtattcatgtgaatggcccctgtacatgtggccttttcagaaaccgaactacaccgagattcgccaatactgcaaccactggcgcaacttcgcagatatagatgattcgtggaaatcgattaagtcgatcctggattggacttcattcaatcaggagcgaattgtggacgtggctggaccaggaggatggaacgacccagatatgctggtcatcgggaactttggtctttcctggaaccagcaggtcacccaaatggcactttgggcaatcatggccgcacccctgtttatgtcgaatgatcttagacatattagcccacaggccaaggctctccttcaggataaagatgtgattgccattaatcaggacccactgggaaagcagggataccaactcagacagggcgataactttgaggtgtgggaaaggcccctttctggtctggcatgggcagtcgccatgattaatcgccaagaaataggaggtccgagaagctacacgatcgctgtcgcatcgctggggaagggagtcgcctgtaacccagcctgctttatcactcagctgctgcctgttaagagaaagctgggcttttacgagtggacctcgcgactgaggagtcacataaatccaactggaactgtgctgctgcaattggaaaacacgatgcagatgtcgctgaaggaccttctg

SEQ ID NO: 12219 - DNA, 1287 bp, Artificial Sequence
  Description of Artificial Sequence: Synthetic coding sequence
atgcagcttcgtaatccagaactgcacctggggtgcgcccttgcactgagatttctcgcgcttgtctcctgggatatccctggggctagagcgcttgacaacggattggcgaggacccctaccatgggttggctccactgggagcgtttcatgtgcaatctggactgccaggaggaaccagattcctgtatcagtgaaaagctgtttatggagatggccgaattaatggtaagcgaaggttggaaagacgctgggtacgagtatctttgcatcgacgactgctggatggcaccccaacgagattccgagggaagactgcaggcggacccgcagcggtttcctcacggcattcgccaactggccaattacgtacattccaaaggcctaaagttaggtatctacgccgacgtgggcaacaaaacttgcgcagggtttcccggatcgttcgggtactatgacatagatgcccagacttttgcagactggggagtggatctgctcaagttcgatggttgctattgtgattcactcgagaacctcgccgacgggtataaacatatgtctctcgccctaaatcgaacaggccggagtatcgtatactcctgcgaatggcctctgtacatgtggccctttcagaaacctaattacaccgaaatcagacagtattgcaatcactggcgaaacttcgctgacattgatgatagttggaaaagtatcaaatctatattggattggacctcttttaatcaggaaagaatcgtagacgtggccggtcccggaggctggaatgacccagatatgctggtaataggaaactttggcctgagctggaatcaacaagtaacacagatggcgttatgggccatcatggcagctcccctttttatgtctaacgaccttcggcacatctcacctcaggccaaggcactcttacaggacaaggatgtgatcgctatcaaccaggaccccctcggaaaacaggggtatcagctgcgacagggtgacaattttgaggtgtgggagcgtccgctgtcagggctggcctgggcagtggccatgataaatcggcaggagatcggcggccctaggagttacactatcgccgtcgcctccctcggcaaaggtgtggcatgcaacccagcatgcttcattacccagttactccctgtgaagcggaaactcgggttctacgagtggaccagccgccttagatcgcacataaatccaacaggcaccgttctgctgcagttagaaaacacaatgcaaatgagtctgaaggacctctta

SEQ ID NO: 12220 - DNA, 1287 bp, Artificial Sequence
  Description of Artificial Sequence: Synthetic coding sequence
atgcagcttcggaacccggaattacatttgggttgcgcactggctttgcgcttccttgctcttgtctcctgggacatccctggtgcccgcgcccttgacaacggtctggcacgtaccccgacgatggggtggctgcactgggagcggttcatgtgcaatttagattgtcaggaagaacctgattcttgtatttccgaaaaactgtttatggaaatggcagagttaatggtctccgaaggttggaaggatgctggatacgaatatctctgcattgatgattgttggatggcgccgcagagggatagcgagggccgccttcaagctgacccgcaacgcttcccgcatggcattcgccagttggcaaattacgttcatagtaaggggttaaaactggggatctacgctgacgttggcaacaaaacttgtgcaggattcccgggcagctttgggtattatgatattgatgcacagacgtttgcggattggggtgttgatcttttgaaattcgatgggtgttattgcgatagcttagaaaatcttgcagacggctacaaacatatgagcctggctttaaataggacgggacgcagcatcgtctactcttgtgagtggccattatatatgtggccatttcaaaaaccgaattacacagagatccgacagtattgtaaccattggaggaactttgcggatattgatgattcgtggaaatcgattaaatctatactagattggacatcatttaatcaagaacgcatagtcgatgtcgcgggtccgggtggttggaatgacccggatatgttagtgattggcaatttcggcctatcatggaatcagcaggtaacccaaatggctctgtgggctataatggcagccccgctttttatgagcaatgatttgcgacatataagcccgcaggccaaagcactgctacaagacaaagatgtcatcgcgatcaaccaagacccgctgggcaaacaaggctatcagctcaggcagggagataattttgaagtctgggaacggccgttaagtggcctggcgtgggcagttgcaatgatcaataggcaagagatcggaggcccacgctcctatactatcgcagtcgcgtccctggggaaaggggtcgcgtgcaatccagcttgctttatcactcaactgctcccggtgaagagaaagctcggattttacgaatggacatcaaggcttagaagtcatatcaatccgacgggtacggtgttgctacagctggaaaatacaatgcagatgtcgttgaaagacttactg

SEQ ID NO: 12221 - DNA, 1287 bp, Artificial Sequence
  Description of Artificial Sequence: Synthetic coding sequence
atgcagctacggaatccagaacttcacttgggatgtgctctcgctctgcggttccttgccctcgtctcatgggacattccaggagctcgggctctggataatggacttgccaggacacccacaatgggatggttacattgggaaaggtttatgtgtaacctcgactgccaggaagaacctgattcatgcatatccgaaaaactcttcatggaaatggctgaactcatggtatctgaagggtggaaggatgcaggatatgagtatctgtgtattgatgattgttggatggcaccccagcgcgacagtgaagggcggctccaggctgatcctcagcgattccctcatggaatcagacagctagccaattatgtgcactcaaaggggctgaagctggggatatacgcagatgtgggaaataagacttgtgccggatttcccgggtccttcgggtactatgatatagatgcccagacatttgcagattggggagtggatctcctgaaattcgatgggtgctattgtgattcgctcgaaaacctcgcagatgggtataaacatatgtccctcgctttgaatagaacaggacgaagtatagtgtactcttgtgaatggccactgtatatgtggccctttcagaaacctaattatacagaaatacggcagtattgcaatcactggcggaattttgctgatatcgatgattcttggaagagtatcaaatccatcttggattggacttcctttaaccaggagcggatagtggatgttgctggaccgggagggtggaacgatcctgatatgctggtcatcgggaatttcggactctcctggaatcagcaagtgacacaaatggcactttgggccattatggcagctccccttttcatgtcaaatgatctacgacatatctctccacaggctaaggccctcttgcaggataaggacgttatagccatcaatcaggatcccttaggaaaacagggatatcagttgcggcagggggataacttcgaagtgtgggaacggcctctcagtggactcgcctgggccgtggctatgataaatcggcaggaaataggaggacctagatcttatacaatcgctgtagccagtcttggaaaaggagtggcttgcaatccagcctgctttatcacacagctgctcccagttaaacggaaactcggattctatgaatggacaagtagactcagatcgcatatcaaccctacagggactgtactccttcagttagaaaacacaatgcagatgagtttaaaagatcttctt

SEQ ID NO: 12222 - DNA, 1287 bp, Artificial Sequence
  Description of Artificial Sequence: Synthetic coding sequence
atgcaactccggaatccggaactgcacctgggctgtgcactggctttgcgcttcctggcactggtgtcgtgggacattccaggagcgcgcgctttggataacggactggcccggaccccaactatgggttggcttcactgggaaagattcatgtgcaatctggactgccaggaggagccggactcgtgtatctccgaaaaactcttcatggagatggccgaattgatggtgtcagagggatggaaagatgcggggtacgaatatctttgcattgatgactgctggatggcacctcagagagactcggaaggacgcctccaagcggaccctcaacggttcccacatgggattagacagttggcaaactacgttcacagcaagggcctcaagctgggcatctacgctgatgtgggcaacaaaacctgcgcgggattccctggatcattcggatattacgatatcgatgctcagacttttgcagattggggagtggatctcctgaaattcgacggatgctactgtgacagcttggagaacctggcggacggttacaaacatatgtccctcgcgctcaatcgcacgggaagatccatcgtgtactcatgcgaatggcccctgtacatgtggcccttccaaaagccaaattacaccgagatcaggcagtactgcaatcactggaggaatttcgccgatatcgacgacagctggaaatccattaagtcaatcctggattggacttccttcaaccaggagcgcattgtggatgtggccggaccgggaggatggaacgacccggacatgctcgttatcggaaatttcggtttgtcgtggaaccaacaagtcactcagatggcactgtgggcgatcatggccgcccctctgttcatgtcaaatgacctgcgccacatctcgcctcaggctaaagccctcctccaagacaaggacgtgatcgcaatcaatcaggatccactcggaaagcaagggtatcagctcagacaaggtgataacttcgaagtctgggaacggccgttgagcggactggcctgggcagtggcgatgatcaaccggcaagagattggcggcccacgctcctacactatcgccgtcgcttccctgggcaaaggagtcgcatgcaatccggcttgttttatcactcagctgctgccagtcaaacgcaagctcgggttttacgagtggacttcgaggcttcggtcacatatcaacccgactggcacggtgctgctgcaactggagaatactatgcagatgagcctcaaggacctcctg

SEQ ID NO: 12223 - DNA, 1287 bp, Artificial Sequence
  Description of Artificial Sequence: Synthetic coding sequence
atgcagttacgtaatcctgaactgcacttggggtgtgccttggcactgagattcttggcactggtgagttgggatattcccggcgcccgagctctggacaatggactggcccgtactcctaccatgggctggctgcattgggagcggtttatgtgcaatctggattgccaggaggagcccgactcctgtatatccgaaaagctgttcatggagatggccgagcttatggtctcagaaggctggaaggacgcaggatatgagtatttgtgcatcgacgactgctggatggcccctcagagggactccgaggggcgtcttcaggcggacccacaaaggtttccacatgggatcagacagttggcgaactacgttcacagtaaagggttgaagctgggtatctatgccgacgtgggcaataagacatgtgccggtttccccgggtctttcgggtattatgatatcgatgcccagacctttgcagattggggcgtcgatctgttgaagttcgacggatgttactgtgacagtctggagaatctggcagacggctacaagcatatgagtctagctcttaatcggactggacggtctatcgtttattcatgtgagtggcccttatacatgtggccgtttcagaagccaaactacactgagatccgacagtactgtaatcactggcggaacttcgctgacattgacgactcctggaagtcaattaagtccattctagattggacctcgttcaaccaggagcggatcgtggatgtggccggtcctggaggatggaacgatcctgacatgctagtaattggtaacttcggtctgtcttggaatcaacaggtgacccagatggctctgtgggcaatcatggctgccccacttttcatgtcaaatgatctcaggcacatttctccccaggctaaagcattgctgcaagataaagacgtcatcgccataaatcaggatccacttggaaaacagggataccagctgaggcagggagataattttgaggtttgggagagaccactgtctggtcttgcttgggcagtcgctatgatcaaccggcaggaaattggtgggcctcgttcttatactatcgctgtcgcatcgctggggaaaggcgtcgcctgcaaccccgcatgttttataactcaactgctgccagtgaagcgaaagctaggcttttacgaatggacgagcagattaagaagtcacattaatccgacgggaacagtcctgctgcagctggaaaacaccatgcaaatgtctctcaaggatttgcta

SEQ ID NO: 12224 - DNA, 1287 bp, Artificial Sequence
  Description of Artificial Sequence: Synthetic coding sequence
atgcagctgcgcaatccagagttgcacctgggttgcgctctggcccttcgcttcttggcactcgtgagctgggacattcctggagcaagggccctggataacggtctggctcgaacgcctactatgggctggctacactgggagcggtttatgtgcaatctggactgccaggaggagccagactcatgcatttctgaaaaactgttcatggaaatggctgagctgatggtttctgagggctggaaggacgcgggttacgaatatctgtgtattgacgactgctggatggccccacagcgtgacagcgaaggtcgcctgcaggctgaccctcagcggttcccacatgggattcgccagctggcgaactacgtccatagcaaaggtctcaaactgggtatttatgcagacgtcggcaataagacctgcgctggttttccaggcagctttggctattatgatattgatgctcagacctttgctgattggggagtcgatttgctaaagtttgatggttgctactgcgacagcctggaaaatttggcggacggctataaacacatgagcctggcgctcaatcgcaccgggcgcagcatcgtctacagctgcgagtggccactgtacatgtggcccttccaaaagcctaactatacggagatcagacagtactgtaaccattggagaaacttcgcagacatagacgactcttggaagtccatcaaatcgattctggactggaccagctttaaccaagaacgtattgttgacgtggccggcccgggtggttggaatgaccccgacatgctggtgatcggcaactttggcctgagttggaatcagcaagttacccagatggcgctatgggctatcatggcggcaccactgtttatgtccaatgacctgcgccacatctcccctcaggcaaaggcactgttgcaggacaaggacgtcatcgccattaaccaggaccctctgggaaaacagggctatcaactgcggcaaggcgataatttcgaggtctgggaacgtccgctgtcaggcctggcatgggccgtggcgatgattaacagacaagagatcggcggccctcgctcctacaccattgccgtcgctagcctgggcaagggtgtggcttgcaatcctgcctgcttcatcacgcaattactgcccgtgaaacgcaaattgggattctatgagtggaccagcagactgcgctcccacatcaaccctactggtaccgttctgctacagctggaaaatactatgcaaatgagtctgaaggatctgctg

SEQ ID NO: 12225 - DNA, 1287 bp, Artificial Sequence
  Description of Artificial Sequence: Synthetic coding sequence
atgcagttgcgtaacccagaactgcacctcggctgtgcgctggccttgcgatttctggctctggtgtcctgggacatccctggagcccgagcgctggataatgggctcgcccgcactcccaccatgggttggctccactgggagcggttcatgtgtaacctggattgccaggaagaaccggatagctgtatcagcgaaaaactgttcatggaaatggccgagctcatggtgtcggaaggttggaaggatgccgggtacgagtacctctgtatcgacgactgctggatggcgccgcaacgggactccgaaggaaggttgcaagctgacccgcaacggttcccgcacggtatccgccagctcgctaactacgtgcactcgaagggactcaagttgggaatctacgcagatgtgggcaacaaaacgtgcgccggcttcccggggtcatttggctactacgatattgatgcccaaacttttgcggactggggagtcgacctgctgaagttcgacggctgttactgtgatagcctggaaaacctggcggatggttacaagcatatgagtctggcccttaaccgcactggacgctccatcgtgtactcctgcgagtggcctctctacatgtggccattccaaaaaccgaactataccgagatccgccagtactgcaaccattggaggaattttgctgacattgatgactcgtggaaatccataaagtcgatcctggattggacttcgttcaatcaggaaaggattgtggatgtcgccggtccggggggatggaatgatccagacatgctcgtcatcggcaattttggcctttcgtggaatcagcaagtgacccagatggctttgtgggccatcatggctgctccgctgttcatgtccaacgatctgagacacataagcccccaagcgaaggcactgctgcaggacaaggacgtaatcgccatcaatcaagatccgctgggaaagcagggatatcagctgagacagggggacaacttcgaagtgtgggaacgcccgttgagcggactggcttgggccgtggccatgatcaaccggcaagagatcgggggcccacgcagctacaccatcgcagtggcatcactggggaaaggggtggcctgcaacccagcctgcttcatcactcaactgctgccagtcaagcgcaagctcggattctacgaatggacttcgagactccggtcgcatatcaatccgaccggcaccgtgttgctgcagctcgagaacactatgcagatgagcctgaaagacctcttg

SEQ ID NO: 12226 - DNA, 1287 bp, Artificial Sequence
  Description of Artificial Sequence: Synthetic coding sequence
atgcagctgcgcaacccggagctgcacctcgggtgcgctctcgcactgcggtttcttgccctggtgtcttgggatatcccgggtgcccgcgcactcgataatggcctcgcccggaccccgactatgggctggctccattgggaacgctttatgtgcaacctcgactgtcaggaggaaccggatagctgcatctcagagaagttgttcatggaaatggcggaactgatggtgtcagaaggttggaaggacgcaggatacgagtacctttgcattgatgactgttggatggccccacaacgcgacagcgaaggacgcctccaggcagaccctcagcgattcccgcacggaatccggcaactcgccaactacgtacattcgaagggactgaaattgggaatatacgccgacgtgggcaacaagacctgcgcgggattccccggctccttcggatactacgatatcgatgcccaaacttttgcagactggggagtggacctgttgaagttcgacggatgctattgcgatagcctggaaaacctggcggatggatacaagcatatgagcctcgcactcaatagaaccggacggtcgatcgtctactcgtgtgagtggccgctgtacatgtggccatttcaaaagccaaactacaccgagatccgacagtattgcaatcactggcgaaacttcgcagacatcgacgactcgtggaaaagcatcaagtccatcctggactggactagcttcaaccaggaaagaatcgtcgacgtcgcaggccccggcgggtggaatgacccagatatgttggtgatcggaaacttcggcctctcctggaaccaacaggtgacccaaatggcgttgtgggccatcatggcagccccccttttcatgagtaacgacctgcgccacatctcaccccaggccaaagctctcctgcaggacaaagacgtgatagctattaaccaggatcctctcggtaaacagggctaccaactccggcaaggggacaacttcgaagtctgggaacgtccgttgagcgggctggcttgggcggtggctatgattaacagacaagagatcggaggccctaggtcatacacgatcgcggtggcatcgctcggaaagggtgttgcttgcaatcctgcctgtttcattactcagctgctgccggttaagcggaagttgggattttacgagtggacttcaaggctgcggagccatatcaatccaactggaactgtgctccttcaactcgagaatacgatgcagatgtccctcaaggatctgctc

SEQ ID NO: 12227 - DNA, 1287 bp, Artificial Sequence
  Description of Artificial Sequence: Synthetic coding sequence
atgcaacttaggaacccggaacttcaccttggttgtgcgctggcactccgatttctcgcactggtgtcctgggacattccgggtgcgcgtgctcttgataatggccttgcacgcacccctaccatgggttggctgcactgggaacggtttatgtgtaacctggactgtcaggaagaaccagacagctgtatttcggaaaagctgttcatggagatggcggagctcatggtgtcggaagggtggaaggatgccggatacgaatacctttgtattgatgattgttggatggcaccccagcgcgactccgaaggccggttgcaagcagaccctcaacgcttcccccatgggataaggcaactcgcaaattacgtgcattcgaagggactgaagctgggaatctacgcagacgtgggaaacaagacttgcgcaggattcccaggatcatttggctactatgatatcgatgcccaaacctttgccgactggggagtggacctgctcaaatttgatggttgttactgcgattcccttgagaacctggctgacggttataagcacatgtccctggcccttaatcggaccggtagaagcatagtctactcatgcgaatggccgctttacatgtggcctttccaaaagccaaattacactgaaataagacaatactgtaaccactggcgcaacttcgcggacatcgatgattcgtggaagtcgatcaagtcaattctggactggactagtttcaaccaagagaggattgtggacgtggcgggtcctggggggtggaatgaccctgatatgctggtgatagggaactttgggctttcgtggaaccaacaggtgactcaaatggccctgtgggcaataatggcagcccctctgtttatgtcgaacgatttgaggcatatttcacctcaggcaaaggcgcttctgcaagataaggatgttatcgcgattaatcaagaccctctcggaaagcaaggctaccagctgagacagggagataacttcgaagtctgggaaagaccattgtcaggattggcatgggcggtggccatgattaatcgacaagagatcggtggacctcggtcgtacaccattgccgtcgcaagcctgggaaagggcgtggcctgtaacccagcctgctttatcacccaactgttgcccgtgaagcgcaaacttggcttttacgaatggacctcaaggctgcgctcccatatcaatcccaccggaaccgtgctgcttcagctggaaaacaccatgcaaatgtcgcttaaggatcttctt

SEQ ID NO: 12228 - DNA, 1287 bp, Artificial Sequence
  Description of Artificial Sequence: Synthetic coding sequence
atgcagctccggaaccctgagctccacctggggtgtgccctcgccctgaggttcctggccctggtcagttgggacattcctggcgcccgcgctctggacaacgggcttgcgaggacacctaccatgggttggctccattgggagaggttcatgtgtaatctggactgtcaagaagagcccgactcttgcatcagcgagaagctttttatggagatggcagaactcatggtttcagaggggtggaaagatgccgggtacgaatatctttgcattgatgactgctggatggccccgcagagagactccgagggccgactgcaggcagacccccagagatttccccatggcatcagacagctggcgaattacgtccattccaaaggactgaaacttggaatctacgctgatgtgggcaacaagacctgtgccgggttccctggatcttttggctattatgacattgacgcccagacatttgctgattggggggtggatctgttgaaatttgatggatgttattgcgactcactggagaaccttgccgacggctataaacacatgagtcttgccctgaatcgaaccggacggtcaattgtatatagctgtgagtggcccctctacatgtggccctttcagaagccgaactataccgaaatccggcaatactgcaaccattggcggaacttcgctgatattgacgactcctggaaatctattaaaagtatcttggattggacttcgttcaatcaggaaaggatagtcgatgtagccggtccagggggatggaacgatcccgacatgctggtcatcgggaatttcggactgagttggaaccaacaagtcacgcagatggccctgtgggctatcatggctgctcctctctttatgagcaatgatttgcgacatatatcccctcaggctaaggctctgctgcaggacaaagacgtgatcgccatcaatcaggaccctctcggcaaacagggataccagttgcgccagggggacaatttcgaagtgtgggaacgccccctgagtggcctggcgtgggcagttgcaatgatcaacagacaagagattggtgggccgcgctcttatacgatcgccgtggcatctttaggaaaaggcgtagcctgcaatcctgcgtgctttatcacccagctgcttcctgttaagcgtaaattaggattctacgaatggacatccagactccggtcccacattaatcccactgggaccgttttgttacagctcgaaaataccatgcaaatgtccctgaaggacctgctg

SEQ ID NO: 12229 - DNA, 1287 bp, Artificial Sequence
  Description of Artificial Sequence: Synthetic coding sequence
atgcaactgcgcaatccggaactgcacctgggctgtgctttggccctcaggtttctggccttggtgagctgggacataccgggagccagagctctggacaatggcctggcccggactccaacgatgggatggcttcactgggaacgatttatgtgtaacctcgactgccaagaagaaccggattcctgcatctcagagaaactattcatggagatggccgaactgatggttagtgaagggtggaaggacgcgggatacgaatacctttgcatcgacgattgctggatggctccccagcgggactcagaaggtcggctgcaggcagacccacagaggttccctcatggtatccgtcagctcgccaattatgtacacagtaaggggctcaagctgggtatttatgcagacgtaggtaataagacctgcgccggattcccgggaagcttcggatactatgatatagacgcccaaacctttgccgactggggcgtcgatttgttgaagttcgacggctgctactgtgactccctcgagaacctggcggatggctacaagcatatgtctctagcactcaacaggaccggcaggagcattgtctattcctgtgaatggccgctctacatgtggcctttccagaagccgaactatactgaaatccggcagtactgcaatcactggagaaatttcgcagatatcgatgacagctggaagtcaattaaatctatcttggattggacaagctttaaccaggaaagaatcgtcgacgttgctggccccggcggatggaacgaccccgatatgttggtcatcggtaatttcggactctcgtggaaccaacaggttacccagatggcactctgggcaatcatggcagcgcctctgttcatgtcaaacgacttgcggcacatttctcctcaagcgaaggccctgcttcaggacaaagacgtgatcgccatcaaccaggatccgctcggaaagcagggttatcagttaaggcagggggataatttcgaggtttgggaacggccactgtcaggactggcatgggcagtcgcaatgatcaatcgccaggagattgggggccctaggagttacaccattgctgtggcgagtctgggcaagggggtggcatgtaacccagcctgtttcatcacacagcttctgcctgtgaaacggaaattaggattctacgaatggacttctaggctgcggtctcacatcaacccaacagggactgtgctgcttcaactagaaaatacgatgcaaatgagtctaaaggacctgctg

SEQ ID NO: 12230 - DNA, 1287 bp, Artificial Sequence
  Description of Artificial Sequence: Synthetic coding sequence
atgcagctaagaaatccggagcttcatctgggctgcgcgctcgcacttcggtttttggccttggtgagctgggacatccctggcgcacgagcgctagataatggcctggcaagaacaccaaccatggggtggttgcactgggagcgttttatgtgtaatcttgattgccaggaggagcccgactcctgtataagtgagaaactattcatggaaatggctgaactgatggtgagcgagggctggaaagacgctggctatgagtatctgtgtatagacgattgctggatggctccccagagagattccgagggccgactacaggctgatcctcagcgctttccccatggaattaggcaactagccaattatgttcattctaagggtcttaagctagggatatatgctgacgtaggcaataagacctgcgcgggcttcccaggctctttcggttactacgatatcgatgctcagacctttgccgactggggagtagatctcctgaagtttgatgggtgctattgcgactcacttgagaacctggcggacggatacaagcatatgagcctggccctgaaccgtaccggaaggagcatagtgtattcttgcgagtggccactgtacatgtggccattccagaaaccgaattatacagagattcgacagtactgcaatcactggagaaatttcgcagatatagatgactcttggaaatcaattaaatctatcctcgactggactagtttcaatcaggagagaatcgtggacgtggccggccctggcggctggaacgaccccgacatgctggtgatcggtaatttcggtctcagctggaaccagcaggttactcagatggcactttgggcgatcatggcggcccctttgtttatgtccaatgacctccgtcacatctcccctcaggctaaagccctgctccaagacaaggacgtgattgccatcaatcaggaccctctgggaaagcaggggtatcagctacgccaaggagataatttcgaagtgtgggagaggccgctctcagggcttgcatgggcagtcgcaatgatcaataggcaagaaattggcggcccacgctcatataccatcgccgtggcgtccttggggaagggtgttgcatgtaacccggcctgtttcattactcagctccttccagttaaacggaaattaggcttttatgaatggacatctagattgcgcagtcacatcaatcccactggtaccgtccttttgcagttggagaacaccatgcaaatgtcattaaaagatctgctc

SEQ ID NO: 12231 - DNA, 1287 bp, Artificial Sequence
  Description of Artificial Sequence: Synthetic coding sequence
atgcagctccggaaccctgagctgcaccttggatgtgctttggcccttcgcttcctcgcgcttgtgtcatgggatatccccggtgcaagagcacttgataacggtcttgcacggacccccacgatgggatggctgcattgggaacggttcatgtgtaatctggattgccaggaggaaccagattcctgtatttccgaaaaacttttcatggaaatggcagagcttatggtgtcggagggctggaaggatgcaggatatgaatatctttgtattgatgactgttggatggcaccgcaacgcgactcggagggtcgccttcaggccgaccctcaacgttttccacacggaatcagacaacttgcgaactacgtgcactcgaaggggctcaaactcggtatttacgcagatgtgggtaataagacttgcgcaggtttccctggttcctttggttattacgatatcgatgctcaaacctttgccgattggggtgtggatctgctgaaatttgacgggtgctactgcgactcattggagaatctggctgacggctacaaacatatgagccttgcacttaacagaacgggacgctccatagtgtactcgtgtgaatggcccctctacatgtggccattccaaaagccaaactacaccgaaattcgccagtactgtaaccattggcgtaacttcgcggacattgatgattcgtggaaatcgatcaaaagcatacttgactggacctcgtttaatcaagaacgaattgtggatgtggccggtcctggcggttggaatgacccagatatgctggtcatcggaaactttgggctgtcatggaatcaacaggtcactcaaatggctctgtgggcaattatggcggcgcctttgtttatgtccaatgatctgcgacatattagcccacaagctaaggcactcttgcaggataaggacgtgattgccatcaaccaagatccgctgggtaaacaaggctaccagcttcggcaaggtgacaatttcgaagtctgggaacgccctctgtccggtcttgcctgggcagtggcgatgatcaacagacaagaaatcgggggtccccgttcgtatactatcgcagtggcctctctgggtaagggagtcgcatgtaacccagcatgcttcatcactcaactgcttccagtcaagcggaagctgggtttttacgagtggacctctcgactgcggtcacatatcaacccgactgggactgtgctcctgcaacttgagaataccatgcagatgtcccttaaggacttgctc

SEQ ID NO: 12232 - DNA, 1287 bp, Artificial Sequence
  Description of Artificial Sequence: Synthetic coding sequence
atgcaactgaggaacccggaactccacctggggtgcgctctggctttgcgatttctggcgctcgtgagctgggatatcccgggggccagagcactcgataatggcctcgctagaactcctactatggggtggcttcattgggaacggtttatgtgcaatctggactgtcaggaggagccagattcttgcatttcagaaaaacttttcatggagatggctgagcttatggtctctgaaggatggaaagatgcgggatatgagtatctgtgcatcgatgactgttggatggcacctcaacgagacagcgaggggcgcctccaggctgaccctcagcggtttcctcacggtattcgccagttggcgaattacgtgcatagcaagggcctcaagctgggtatctacgccgacgtaggtaacaagacatgtgcaggattcccagggtcttttggttactatgacatcgacgcccagaccttcgccgattggggtgtggatctgctgaaatttgatggttgttactgtgacagcttggaaaacctcgcagatgggtacaagcacatgagtctggccctcaaccggacaggaagaagcattgtgtacagttgcgagtggccgctgtatatgtggccgtttcagaagcccaattatactgagattagacagtactgcaaccattggagaaatttcgcggatatcgatgattcatggaagtccatcaagagcattctggattggacaagctttaatcaggaacggattgtggatgtggctggcccgggaggctggaacgacccagatatgcttgtaatcggcaactttggcctgagctggaaccagcaggtgacccagatggccctgtgggctataatggctgctccactgttcatgtcaaacgatctgcgccacatcagccctcaggctaaggctctgcttcaggacaaggacgttatcgccatcaatcaggatccactgggaaaacaggggtaccagctgagacaaggggataacttcgaagtgtgggagcgcccgctctccggactcgcgtgggctgttgcgatgatcaatcgacaggaaatcggcgggcctagatcttacacgatcgctgtagcttcattggggaagggggttgcatgtaatccagcctgcttcatcactcaactgttgcccgtgaagcgcaagctggggttctacgaatggaccagcagactgcggagtcatatcaaccccactggcactgttctgttgcagctggaaaatacaatgcaaatgagtctgaaagacttgctg

SEQ ID NO: 12233 - DNA, 1287 bp, Artificial Sequence
  Description of Artificial Sequence: Synthetic coding sequence
atgcagcttcgaaatcctgagcttcaccttggatgcgctctcgcccttcgattcctcgcgctggtgtcttgggatatcccaggggcacgggcactggacaatggactcgcgcgtactccgactatgggatggctccattgggaacgatttatgtgtaatctcgattgtcaagaagaaccagattcctgcatcagcgaaaaactttttatggagatggctgagttgatggtgagtgaaggctggaaagatgctggctacgaatacctgtgtattgatgattgctggatggctccgcaacgggattcagaaggacgtcttcaagccgatcctcaaagatttccgcatggaataaggcagcttgccaattatgtacactcaaagggactgaaacttggtatttacgctgatgtaggtaataagacatgcgcaggattccctggatccttcggttattatgacatcgatgctcaaacctttgctgattggggagtcgatctcctcaagtttgatggctgctactgtgactccctcgagaatctcgctgatggctacaaacatatgagtctcgccctcaatcggacaggccgtagtatagtctatagttgcgaatggcctctgtatatgtggcctttccaaaaaccaaactatactgaaataagacagtactgcaatcattggaggaacttcgctgatatagacgattcgtggaagagcatcaagagtattctagattggacatcattcaaccaagaaagaattgttgacgtagctggtccaggaggatggaatgatccggatatgttagttattggtaattttggattgtcatggaatcaacaggtgacccaaatggcgctttgggctatcatggcagcccctctctttatgtctaatgatcttcggcatatttcgccacaagcaaaggcactcctacaagataaagatgtgattgctatcaatcaagatccactgggaaagcaaggatatcagctccgtcaaggagataacttcgaggtttgggaaagaccactgagtggactggcttgggccgttgccatgattaaccgccaagagattggaggtccgcggtcgtacacaatcgcagtggcttcactcggaaaaggtgtcgcttgtaatccggcgtgtttcatcacacaactacttccagtgaagcgaaagcttggtttttacgaatggacgtcacgtttgagatctcatatcaatccaactggtacagtcctcttacaattggaaaacaccatgcaaatgtcattaaaggatttactt

SEQ ID NO: 12234 - DNA, 1287 bp, Artificial Sequence
  Description of Artificial Sequence: Synthetic coding sequence
atgcaacttagaaacccagagctgcacctgggctgcgccctggcgctgcgcttcctggcgcttgtgtcatgggacatcccaggcgcccgggccctggataatgggctggcccgcactccgactatgggatggttgcactgggaaagatttatgtgcaatctggactgccaggaagaacctgattcgtgtatctcggagaagctgtttatggagatggctgaacttatggtgtcagagggatggaaagacgctggatacgaatacctgtgcatcgacgattgctggatggccccgcagcgcgactccgaagggcgcctccaggccgatcctcaaaggttcccgcatggaatccggcagctggccaactacgtccattcaaagggcttgaagctcggaatttacgcggacgtgggaaacaagacttgtgcgggatttccaggatccttcggctactacgatattgatgcgcaaaccttcgcagactggggggttgaccttctcaagttcgacggctgctactgtgattcgcttgagaatctggccgatgggtacaaacacatgagcctcgcactcaacaggactggacggtcgatcgtctacagctgtgagtggccgctgtacatgtggccgttccagaaacccaactacaccgagatccggcaatactgcaatcactggagaaactttgccgatatcgacgacagctggaagtccatcaaatccatcctcgactggaccagcttcaatcaggagaggattgtggatgtggcaggcccaggcgggtggaatgacccagacatgctcgtcatcggaaacttcggtctgtcctggaaccagcaagtcacccagatggcgctctgggctatcatggccgccccgctgttcatgtctaatgacctccggcacatcagccctcaggctaaggcgctgctgcaggacaaggacgtgatcgctataaaccaagatcccctcggcaagcagggatatcaactgcggcagggagataatttcgaagtctgggaacgcccgctgtcaggtctggcgtgggccgtggctatgatcaacagacaagaaatcggaggaccccgctcgtacactatcgcagtggcatcgttgggtaagggtgtggcctgcaaccctgcatgcttcatcacccagttgctcccggtgaagcgaaagctgggattttatgagtggacctcacgcttgcgttcgcatattaacccgacgggaacggtgctcctgcagctcgaaaacaccatgcagatgtccctgaaagacctgctc

SEQ ID NO: 12235 - DNA, 1287 bp, Artificial Sequence
  Description of Artificial Sequence: Synthetic coding sequence
atgcaactcaggaaccctgaactgcatctgggctgtgcactggcactgcgttttcttgccttggtgtcctgggatatccccggcgcacgggctctggataatggacttgcccgtaccccaaccatgggatggctccattgggagagattcatgtgtaacctggattgccaggaggaacccgactcgtgtatatcagaaaagctgtttatggaaatggcggagctcatggtatccgaaggctggaaggacgcaggttacgagtacctgtgcattgacgactgttggatggccccacaacgggactccgaaggccgcctgcaggcagacccccaacgatttccacatggaattagacagcttgccaattacgtgcactcaaaaggtcttaaactggggatctacgcagatgtcggaaataagacctgtgcaggttttccagggtcgttcggatactacgacattgacgcacagacctttgcagattggggagtggatctcctcaagttcgacggttgctactgtgatagcctcgaaaacctcgcggatgggtacaagcacatgtctcttgccctcaaccgtactggacgctcaattgtctactcgtgtgaatggccactgtacatgtggccatttcaaaagccaaactacacggagatcagacaatactgcaatcattggaggaactttgccgatattgacgatagctggaaatcgatcaagtcgatccttgactggacctcgttcaaccaggagcgaatcgtggatgtggcgggtcctgggggttggaatgatcctgatatgttggtgatcggtaactttgggctgtcatggaatcaacaggttacccagatggccttgtgggccatcatggccgcaccactgtttatgtccaacgatctgcgccatataagccctcaggcgaaggcactgctgcaagataaggacgtgattgccatcaaccaagaccctcttggtaagcaaggttatcagctccgtcaaggagataacttcgaagtgtgggaacgtcctctttcgggactcgcatgggcagtggccatgatcaatagacaggaaattggaggacctcggtcgtacaccatcgcagtggcttcccttggtaaaggcgtggcctgcaatccggcatgtttcattactcaactccttcccgtgaagcgcaaactgggattctacgagtggacttcacgtcttagaagccacattaatcctaccggaacggtgttgcttcaactggaaaataccatgcagatgagcctgaaggacctgctg

SEQ ID NO: 12236 - DNA, 1287 bp, Artificial Sequence; identical to SEQ ID NO: 12215
  Description of Artificial Sequence: Synthetic coding sequence

SEQ ID NO: 12237 - DNA, 1287 bp, Artificial Sequence
  Description of Artificial Sequence: Synthetic coding sequence
atgcagcttcgtaaccctgagcttcacctcggatgcgccctggcgctccgtttcctagctctcgtctcttgggatattccgggtgcacgggccctggacaatgggttggcccggacccccactatgggatggctccattgggaacgcttcatgtgcaatctcgattgccaggaggaacctgacagctgcatctctgagaagctgtttatggaaatggctgagctgatggtgtccgaggggtggaaggatgccggctacgagtacctgtgcatcgatgattgctggatggcacctcagagggattcagaaggacggcttcaggctgacccgcagcgatttcctcacgggatccggcagttggctaactatgtccactctaaaggtcttaaactggggatctatgctgatgtcggtaacaagacatgcgcaggctttcctggaagtttcgggtattatgacatcgatgcgcagactttcgcagattggggcgtggacttgctgaagttcgatgggtgttattgcgactcactcgagaacctggccgacgggtataagcatatgtccctcgccctaaatcgtacaggtaggagcattgtctactcctgcgaatggcctctgtacatgtggcctttccagaagcctaattacacagagatcaggcagtactgtaatcactggcggaacttcgcagacatagatgatagctggaagagcatcaagtcaatccttgattggacttcttttaatcaggaacgcatagtagacgtggccggcccagggggatggaacgaccctgacatgctagtgattgggaatttcggtcttagctggaatcagcaggtgacgcagatggccctgtgggccatcatggcagctccgctgttcatgagtaatgatttgaggcacatctctccgcaagccaaggccctgctacaggataaggatgtgatagctataaaccaggatccgttggggaagcagggttaccagctccgtcagggggataacttcgaagtgtgggaaaggcctttgagcgggttagcatgggccgtggcaatgatcaaccgccaggagatcggcggacccagatcttatactatcgctgtggcctccttagggaaaggagtcgcctgtaatccagcctgcttcatcacacagctgctgcctgtaaagcgtaagctcggtttttatgagtggacctccaggctcagatcacatatcaatcctactggcacagtgctgctgcagctcgaaaacactatgcagatgtcacttaaggatttactt

SEQ ID NO: 12238 - DNA, 1287 bp, Artificial Sequence
  Description of Artificial Sequence: Synthetic coding sequence
atgcagctgcgtaacccggaacttcatctgggatgcgcacttgcacttaggttccttgcacttgtctcttgggacattcctggcgcccgagctcttgataacggtcttgcgagaactcctaccatgggttggctccattgggaaagatttatgtgtaatctcgattgtcaagaagagcctgactcgtgcatttccgagaagctctttatggaaatggcagaactcatggtgtcagaaggctggaaagatgcaggttacgaatacctgtgtatagatgactgttggatggcaccgcagcgggacagcgaaggaagattgcaggcggatcctcaaagattccctcatgggatacgacaacttgcaaattacgtgcattccaagggtcttaagctgggcatttacgcagatgtgggtaataagacttgtgcgggctttcctgggagctttggttactatgatattgacgcacagaccttcgccgactggggagtcgatctcctgaaatttgatggatgttactgtgactcgctggaaaaccttgcagatggctacaagcatatgagcctggcgctgaacaggactggcagatcgatcgtgtacagctgtgaatggccactttacatgtggccgttccagaagccgaactacaccgaaatcaggcaatactgtaaccactggaggaacttcgcagacatagatgactcatggaagtcgataaagtcgattttggattggacctccttcaaccaagaacggatcgtggatgtggctggacctggtgggtggaacgatccagacatgcttgtgattgggaacttcggactgtcctggaaccaacaagtcacccaaatggccctttgggcaatcatggcggccccactctttatgtcaaacgatctgagacatatctcaccacaggccaaggcccttcttcaagataaggacgtcattgcaataaaccaggaccctcttgggaagcaaggctaccaactccgccaaggagataacttcgaggtctgggagcggcccttgagcggtcttgcttgggcagtggcaatgattaacagacaggagattggcggtcctcggagctacactattgcggtagcatcccttggaaaaggcgtcgcatgtaatcccgcctgtttcattactcagcttttgccagtgaagcgaaagctgggattttacgaatggacctcccgcctccgctcccacatcaaccccaccggtaccgtgcttctgcagttggagaacaccatgcaaatgtcgctgaaggatctgctg

SEQ ID NO: 12239 - DNA, 1287 bp, Artificial Sequence
  Description of Artificial Sequence: Synthetic coding sequence
atgcaattacgtaatccagaattgcatcttggatgtgctcttgcacttagatttttagcacttgtatcatgggatattccaggtgcacgtgctttagataatggtcttgctagaacaccaactatgggttggctacattgggaaagatttatgtgtaatttagactgtcaagaggaaccagattcgtgtataagtgaaaagctttttatggaaatggctgaattaatggtttctgaaggttggaaagatgctggttatgaatatttgtgtattgacgattgttggatggcaccacaacgagactcagaaggtcgtttacaagcagatccacaacgttttcctcatggtatcagacaattagctaattatgttcattctaaaggtttaaaattgggaatttacgcagatgttggaaataaaacatgcgcaggattccctggatcatttggatattacgacattgatgcacaaacttttgctgattggggtgtagatttacttaaatttgatggttgttattgtgattcattagaaaatcttgctgatggatataaacatatgtcattagcattaaatagaactggacgatccatagtctattcatgtgaatggccattatacatgtggccatttcaaaaacctaactatacagaaatcagacaatattgcaatcattggaggaatttcgcagatattgatgattcatggaaatcaattaaatctattcttgactggacttctttcaatcaagagagaattgtagatgtggcaggacctggaggttggaatgatccagatatgttagttattggaaattttggattatcatggaaccaacaagttacacaaatggctttatgggcaattatggcagctccattatttatgagtaatgatcttagacatatttctccacaagctaaagcacttttgcaagataaagatgttattgcaattaatcaagatccattaggaaaacagggatatcaacttcgtcaaggtgataattttgaagtttgggaaagacctctttcaggattagcttgggcagttgctatgattaatagacaagaaataggaggaccaagatcttatacaatagctgtagctagtttaggtaagggagttgcatgcaaccctgcatgtttcattactcaacttttaccagtaaagagaaaattaggattttatgaatggacttcaagacttagaagtcatattaatccaactggaactgttttattacaacttgaaaatactatgcaaatgtcacttaaggatcttttg

SEQ ID NO: 12240 - DNA, 1287 bp, Artificial Sequence
  Description of Artificial Sequence: Synthetic coding sequence
atgcagctacgcaatccagagctgcatttggggtgcgcactggcattgcgcttcctagcattggtgtcttgggacatccccggcgctcgcgcgctggataatggattggccaggacccccaccatggggtggttacattgggaaaggttcatgtgcaacttggattgtcaggaggaacccgatagctgcatttccgaaaagctgttcatggaaatggcagagttaatggtaagcgagggctggaaggacgccggctacgaatacctgtgcatagacgattgctggatggccccccagcgggattcagaaggcaggctccaggctgatccgcaacgttttccgcacggcatcaggcagcttgcaaactacgtgcacagcaaaggtcttaagctgggtatttatgctgacgtggggaataagacctgcgctggctttccgggctcctttgggtactatgatatcgacgcccagactttcgccgactggggggtagacctcctgaaattcgacggctgttactgcgactccctggaaaacctcgctgacggttacaagcacatgagcctggctctgaacaggacgggacgctcaatcgtatatagctgcgagtggccactttatatgtggccctttcagaaaccaaactataccgagatccgccagtattgtaaccactggagaaactttgcggatatcgacgactcttggaaatctattaagtccatactggactggacgtccttcaaccaggaacgcatcgtggatgtggctggcccgggaggatggaacgaccctgatatgctggttattgggaacttcggcctgtcatggaaccagcaggtcactcagatggccctctgggccataatggccgcccctctgttcatgtccaacgacctgcgccacatctccccccaggctaaagccttgcttcaggataaagatgtcattgcaatcaaccaagaccctttaggaaagcagggctatcagctgagacagggagataatttcgaagtttgggaaaggcccctaagcggcttggcctgggccgtagctatgataaatcggcaagaaatcggcggccctcgatcatacacgatcgctgtggcttctctcggcaagggcgttgcgtgcaaccctgcgtgcttcattactcagcttctgcccgtcaagcggaaactgggattttatgagtggaccagtagactgcggtcccacatcaaccctaccggcacggtccttctccaattggaaaatacaatgcagatgtccctgaaggacctcctg

SEQ ID NO: 12241 - DNA, 1287 bp, Artificial Sequence
  Description of Artificial Sequence: Synthetic coding sequence
atgcagttgcgcaaccctgagttgcacctgggttgcgccctggccctaagattcctcgctcttgtgagttgggatattccaggagcccgggctttggacaacggacttgctcggacacccacaatggggtggctgcactgggagaggtttatgtgcaatttagattgtcaggaggaaccagattcgtgcatcagcgagaaactgtttatggagatggcagaattaatggtgtcagaaggctggaaagacgccgggtatgagtatctctgcattgacgactgctggatggccccacagagggattcagagggcagactacaggcagacccccaaaggttcccgcatgggattcgacaactggcgaattacgtgcattcaaaggggctgaagttggggatttatgctgacgtgggcaacaagacctgcgcaggattccctgggagtttcggctactatgatatcgacgcacaaactttcgcggattggggggtagacctcctcaagttcgatggatgctattgcgactcccttgagaacctcgccgatgggtacaaacatatgagcctcgctttgaaccgcactggcagatccatcgtttacagctgtgaatggccactttacatgtggcccttccagaagcccaattatacagaaattcgtcaatattgcaaccactggaggaattttgctgacatcgatgatagttggaaatccatcaaatccatcctggactggacatcctttaaccaagagagaatcgtcgacgtggcagggccgggaggatggaacgatcctgacatgctggtgatcggcaattttggtctgtcttggaatcaacaggtcactcagatggccttgtgggcaataatggccgcaccactctttatgagtaacgacctgcgccacatctccccccaggccaaggccctgctccaggataaggatgtcatcgctataaaccaggaccccctgggtaagcaaggatatcagcttcgccagggagataattttgaagtctgggaacgacctctctcgggactggcctgggcggtggccatgattaacaggcaggagatcggagggccccggtcctacaccatcgccgtggcgtcactgggcaaaggggtcgcctgcaaccctgcctgctttatcacccagttacttcccgtgaaacgtaaattgggattctatgaatggacgtcccgattgcgatcacatatcaatcctactggtaccgtgttgcttcagctggaaaacactatgcaaatgtccctgaaggacttactt

SEQ ID NO: 12242 - DNA, 1287 bp, Artificial Sequence
  Description of Artificial Sequence: Synthetic coding sequence
atgcagctgaggaacccggaactccatctggggtgcgccctcgcactgcggttcctggcgctcgtgagctgggacatcccaggagcgcgtgccctggacaacggactggcgcgcactccgactatgggatggctccattgggaacgcttcatgtgcaaccttgattgtcaggaggaacctgactcctgtatttcagaaaagctgttcatggagatggcggaactcatggtgagcgaaggttggaaggatgcggggtatgaatacctctgcatcgatgattgctggatggccccacaacgcgactccgagggtagactgcaggccgatccacagcgcttcccgcacgggattcgccagctcgccaattacgtccattccaaagggctcaaacttggcatttacgcagacgtcggtaacaagacttgcgctgggttccctggatcgttcggatactacgatatcgacgcgcaaaccttcgccgactggggagtggacctcctgaagttcgacggatgctactgcgacagcctggagaatctggcagatggatataaacacatgtccctggcgctgaaccgtaccggtcgcagcatcgtctactcatgcgaatggcctctgtacatgtggccgttccagaagcctaactacacggagattcggcagtactgtaaccattggagaaacttcgccgatatcgatgactcctggaagtcgatcaagtccatcttggactggacctcattcaatcaagagcggattgtggacgtcgcagggccaggtggatggaatgacccggatatgctggtcattggcaatttcggcctgtcgtggaatcagcaggtcacccagatggccctgtgggccatcatggcagcgccgctcttcatgtccaatgacctcagacacatctcaccccaagcgaaggctctgctccaggataaagacgtgattgcgatcaaccaagatccgctgggaaagcaaggataccagctgcggcagggcgacaacttcgaggtctgggagcggccactttcgggactggcgtgggctgtcgcgatgatcaacagacaggagatcggagggccacgcagctacactatcgccgtggctagcctgggaaagggagtggcgtgtaatccagcctgctttatcactcaactgctcccggtgaagcggaaactcggattctacgaatggacctcaaggctccggtcccatatcaatccgactggtactgtgcttctgcaacttgagaatactatgcagatgtccctgaaggaccttctg

SEQ ID NO: 12243 - DNA, 1287 bp, Artificial Sequence
  Description of Artificial Sequence: Synthetic coding sequence
atgcaactccggaaccccgaacttcacttgggatgtgccctggcgttgagatttctcgccctggtgtcgtgggatatacctggcgcacgcgcacttgataacgggttggcgcggactcctactatgggatggctgcattgggaacgcttcatgtgcaacctcgattgtcaggaggaacctgactcgtgtatctccgaaaaacttttcatggagatggctgaacttatggtgtccgaagggtggaaggatgcaggctacgagtatctgtgtatcgatgattgctggatggccccccagagagacagcgaaggacgacttcaggcagacccccaaagattcccccacggaattagacaactggctaactacgtccattccaagggtttgaagctgggcatttacgcggatgtgggaaataagacgtgcgctggctttcctggtagctttggatactacgatattgatgcacaaacctttgctgactggggcgtggatctccttaagtttgacggatgctactgtgattcgctcgaaaatcttgcagatgggtacaagcatatgtccctcgcattgaaccggaccggtcggagcattgtgtactcgtgtgagtggcctctgtacatgtggccgtttcagaaacccaactatactgaaatccgtcaatactgtaaccattggcggaattttgcagacatcgatgactcatggaagtcaattaagtcaattcttgattggactagctttaaccaggaaagaattgtggatgttgcaggcccaggaggctggaacgaccctgatatgcttgtgataggaaactttgggctctcatggaatcagcaagtgacccaaatggcactctgggcaattatggccgctccactgttcatgtccaatgacctccgccacatttcgcctcaggcaaaagcactgcttcaggacaaggatgtgatcgccattaaccaagatcccctcgggaaacaaggctatcaactgcgtcagggtgataactttgaggtgtgggaaaggcctctgtccgggctggcatgggccgtggcaatgattaacagacaagaaataggtgggcctaggtcgtacacgatagctgtcgcatcactcggaaagggcgtcgcatgtaatccagcatgcttcatcacccaacttctccctgttaaaagaaaacttggcttctacgaatggacctcccgcctcagatcacatatcaacccaaccggaacggtgcttctccaactggaaaatactatgcaaatgagccttaaggaccttctt

SEQ ID NO: 12244 - DNA, 1287 bp, Artificial Sequence
  Description of Artificial Sequence: Synthetic coding sequence
atgcaacttcgcaacccggaactgcatctcggatgcgccttggccttgcgctttcttgccctcgtgtcgtgggatattccgggggcgcgcgctcttgacaatggcctggcccgtactccgactatgggatggctgcactgggaacgattcatgtgcaacctcgactgtcaagaagagccagatagctgcattagcgagaaactctttatggagatggccgaacttatggtgtccgaaggatggaaggatgcgggatatgaatacctgtgcatcgacgattgctggatggcgccgcagcgggactcagaaggccggctccaggccgacccgcagcggttcccccatggcattcggcagctggccaactacgttcacagtaagggactgaagctgggtatctacgcagacgtcggaaataagacctgcgccggatttcctggatcattcggttactacgatatcgatgcgcagactttcgcggactggggcgtggatctgctgaaatttgacggctgttactgtgattcactcgagaatctcgcggacggctataagcacatgtccctcgcgctgaacaggaccggtcggtccatcgtgtactcgtgtgaatggccgctgtacatgtggccattccaaaagccgaattacaccgaaatcagacaatactgcaatcactggagaaatttcgcagacatagacgattcttggaagtctatcaaatcgatcctcgactggacctctttcaaccaagagcgaatcgtggacgtggcggggcctggtggatggaacgacccggacatgcttgtgatcggcaatttcggcctgtcatggaatcagcaggtcacgcagatggcactctgggccatcatggccgctcctcttttcatgtcgaatgacctgagacacatcagcccgcaggcgaaggcattgctccaagacaaggacgtcatcgcaattaaccaggatcctctgggaaagcagggatatcagcttcgccaaggggataactttgaagtgtgggagcggccactctccggacttgcatgggctgtggccatgatcaacaggcaggaaatcggaggccctaggtcgtatactatagccgtcgcgtcactgggtaagggggtggcttgtaacccagcatgtttcatcacccaactgttgccagttaaacgtaaactggggttctatgagtggacctcacgcctgcgctcccatatcaaccccactggaaccgtcctgctgcaactcgagaacactatgcaaatgtcgctcaaggacctcctc

SEQ ID NO: 12245 - DNA, 1287 bp, Artificial Sequence
  Description of Artificial Sequence: Synthetic coding sequence
atgcagctgcgcaatcccgagctgcatctgggctgcgcactggccctccggttcctcgccttggtttcctgggatataccaggagctcgggcactggacaatggactagcccgaactccgactatggggtggcttcattgggaacgctttatgtgcaatctggattgccaggaggagccagattcgtgtatctcagagaagctgttcatggagatggcagagctgatggttagcgagggatggaaggatgctgggtatgaatacttatgcatcgatgattgctggatggcccctcagagagattccgagggacgtctgcaagccgacccacagcgcttcccccatggaatcagacagctggctaactacgttcactccaaagggctgaagctgggaatttacgctgatgtaggcaacaagacttgcgcaggatttcccggctcatttgggtattacgacatcgatgcccagacgtttgctgactggggagttgatcttctcaaattcgacggatgttactgcgattccctggagaatctggctgatggttacaaacacatgagtttggctctcaatagaacaggacgttctattgtgtattcctgtgagtggccactgtatatgtggccttttcagaaacctaactatactgagatcagacagtattgcaatcactggaggaatttcgctgatattgacgacagttggaagtctatcaaaagtattcttgattggacctcatttaaccaagaacgcattgtcgacgtggccggacccggcggctggaacgaccctgatatgctggttattggaaacttcgggctgtcatggaaccagcaagtcactcagatggcattatgggcaattatggccgctcctctcttcatgagcaacgacctgaggcatatctccccgcaggctaaagccctcctacaggataaggatgtgatcgccattaatcaggaccccctgggcaaacagggataccagctccgccaaggagataattttgaagtgtgggagcggccactcagcggcctggcctgggcagtagcaatgattaaccgccaagagataggaggacccagatcttacaccatagctgttgcttcactgggtaaaggtgtggcctgcaatcccgcctgctttataactcaactcctaccagttaagcggaaactcggtttctacgaatggacgtcaagactgagatctcatatcaatcccaccggcactgtcctgctccagctggagaacaccatgcagatgtccttgaaggatctgtta

SEQ ID NO: 12246 - DNA, 1287 bp, Artificial Sequence
  Description of Artificial Sequence: Synthetic coding sequence
atgcaactacgaaatccggaattacatttaggttgtgcgttagcgttacgatttttagcgttagtttcgtgggatataccgggtgcgcgtgcgctagataatggtctagcgcgaacgccgacgatgggttggttacattgggaacgatttatgtgtaatttagattgtcaagaagaaccggattcgtgtatatcggaaaaactatttatggaaatggcggaattaatggtttcggaaggttggaaagatgcgggttatgaatatctatgtatagatgattgttggatggcgccgcaacgagattcggaaggtcgtctacaagcggatccgcaacgttttccgcatggtatacgacaattagcgaattatgtacattcgaaaggtttaaaactaggtatatatgcggatgtaggtaataaaacgtgtgcgggttttccgggttcgtttggttattatgatatagatgcgcaaacgtttgcggattggggtgtagatttactaaaatttgatggttgttattgtgattcgttagaaaatctagcggatggttataaacatatgtcgttagcgctaaatcgaacgggtcgttcgatagtatattcgtgtgaatggccgctatatatgtggccgtttcaaaaaccgaattatacggaaatacgacaatattgtaatcattggcgtaattttgcggatatagatgattcgtggaaatcgataaaatcgatattagattggacgtcgtttaatcaagaacgaatagtagatgtagcgggtccgggtggttggaatgatccggatatgctagtaataggtaattttggtctatcgtggaatcaacaagtaacgcaaatggcgctatgggcgataatggcggcgccgctatttatgtcgaatgatttacgtcatatatcgccgcaagcgaaagcgctattacaagataaagatgttatagcgataaatcaagatccgttaggtaaacaaggttatcaactacgacaaggtgataattttgaagtatgggaacgtccgctatcgggtctagcgtgggcggtagcgatgataaatcgacaagaaataggtggtccgcgttcgtatacgatagcggtagcgtcgttaggtaaaggtgtagcgtgtaatccggcgtgttttataacgcaactattaccggtaaaacgaaaactaggtttttatgaatggacgtcgcgactacgatcgcatataaatccgacgggtacggttttattacaattagaaaatacgatgcaaatgtcgctaaaagatctatta

SEQ ID NO: 12247 - DNA, 1287 bp, Artificial Sequence
  Description of Artificial Sequence: Synthetic coding sequence
atgcagcttcggaaccccgagctgcacctgggctgcgccctggctctgcggttcctggctcttgtatcttgggatatacctggtgctagggcattggataatggcttggctaggacacccaccatgggttggctgcactgggagcgctttatgtgcaatctggactgtcaggaagagcccgactcctgcatttctgagaagctgtttatggagatggctgaattgatggtaagcgagggttggaaggacgctgggtacgagtatctttgcatagatgattgctggatggctcctcaacgagatagcgaaggcagactccaagcagatcctcagcgctttcctcatggcattagacaattggctaattatgtgcacagtaagggcctcaagttgggaatctatgcagatgtgggtaataagacttgcgcgggtttcccaggaagcttcggctactatgatatcgacgcccagacttttgctgactggggcgtggacctccttaagtttgatgggtgctattgtgatagcctcgaaaatctggccgatggatataaacatatgtcactggccctgaaccgcaccggaaggtccatcgtgtactcatgtgagtggcctctctacatgtggccctttcaaaagcccaattataccgaaatccggcagtactgcaaccattggagaaacttcgctgatatcgacgacagttggaagtccatcaaatcaatcctggattggacaagctttaatcaggaacgcatagtcgacgtcgctggcccagggggatggaacgacccagacatgctcgtcatcgggaattttggactgagctggaatcagcaagtgacccagatggctctgtgggcaatcatggcggcgcccctctttatgagtaatgacctgaggcacataagccctcaagctaaggcactgcttcaagataaggacgtcatagcaataaatcaggatcccctggggaagcagggttatcagcttcgccagggggataactttgaggtctgggaacgccccttgtccggacttgcgtgggccgttgccatgatcaataggcaggagatcggcggccctcgatcatatacaatcgccgtggcttccctgggcaagggggttgcctgcaatcccgcttgctttattactcagctgctcccggtgaaacgaaagctgggattctacgagtggacatcacgcttgaggagccacatcaatcctacaggaactgtcctgctgcagctcgaaaataccatgcaaatgtccttgaaggatctcctc

SEQ ID NO: 12248 - DNA, 1287 bp, Artificial Sequence
  Description of Artificial Sequence: Synthetic coding sequence
atgcagttgcgaaaccctgaacttcaccttggttgcgcactcgcactcagattccttgcactcgtctcctgggacatccctggtgcacgagcactggataacggcctggcaaggacgcccactatgggatggctgcactgggagcgattcatgtgcaatcttgattgccaagaggagccagatagctgtatcagcgaaaagctgtttatggaaatggcagaacttatggtgtcggagggatggaaggacgcagggtacgagtacctttgcattgatgattgttggatggcaccccaacgagatagcgaagggagacttcaagcagaccctcagaggtttccccacggaatccggcaactcgccaactacgtccactcgaaaggactgaagctcggtatatacgcggatgtgggaaataagacctgtgcaggttttcctggctcatttggctactacgacatcgacgctcaaacttttgccgattggggcgtggatcttctcaagtttgacggttgttactgtgattcgctggaaaatctggcagatggctacaaacatatgtcgcttgcgcttaaccgcactggtagatctatcgtgtactcgtgtgaatggcctctgtatatgtggcccttccaaaaaccaaactacactgagattcgtcagtactgtaatcactggcgtaactttgcggatattgacgattcatggaaatccatcaagtcgatccttgactggacctcatttaaccaggaacggatagtggacgtcgcgggaccaggggggtggaatgatcctgatatgctggtgataggtaacttcggtttgtcgtggaatcaacaggtgactcaaatggcactttgggcaatcatggcagcacctctgtttatgtcgaacgacctccgccatatatcgccacaggcaaaggcacttcttcaagataaggatgtcatagcaattaaccaggacccactgggcaagcagggctaccagttgaggcaaggagacaacttcgaggtgtgggaacgtccgctgtccggtctggcatgggccgtggctatgattaacagacaagagattggtggaccacgcagctacactattgcagtcgcgtcccttggaaaaggcgtggcgtgtaatccagcttgcttcataacccagctcctcccagtgaagcggaagttgggtttctatgaatggacttcgcggcttcgctcccatatcaacccaacggggaccgttctcctgcaactggagaacaccatgcaaatgtctctgaaggatctgctg

SEQ ID NO: 12249 - DNA, 1287 bp, Artificial Sequence
  Description of Artificial Sequence: Synthetic coding sequence
atgcaactcaggaacccagaactgcatcttggttgcgcacttgccctgagatttcttgcacttgtctcatgggatatccctggagcaagggctcttgataatggactggcgcggacgcctactatgggatggcttcattgggaaaggtttatgtgtaatctggattgccaggaagaaccagactcgtgcatttcagaaaaactcttcatggagatggcagaacttatggtgtcggagggatggaaagacgcgggatacgagtacctttgtattgatgattgttggatggcacctcaacgggattccgaaggccggcttcaagcagatcctcaaaggttcccacatggcatcagacagttggcaaactacgtgcactcgaagggactgaagctcggcatctacgcagatgtgggaaacaaaacctgtgcggggtttcctggttcctttggctattacgatattgacgcacagacgtttgcagattggggtgtcgatctcttgaagtttgacggctgttactgcgatagcctcgagaatctggcggacggatacaagcacatgtcacttgcccttaataggaccggaagatctattgtgtactcgtgtgagtggcccctttacatgtggccgttccaaaagccaaactataccgagattcgacaatactgtaaccattggcggaatttcgcagatattgatgactcatggaagtccattaagagcatactggattggacgtcattcaatcaagaaaggattgtggatgtcgcagggcctggaggatggaacgatccagacatgcttgtgattgggaactttggactgtcatggaatcaacaggtgacccagatggcgctttgggcgataatggcagctcctctgtttatgtcgaatgaccttcggcacatatccccacaggccaaggcactgcttcaggataaggatgtcattgccatcaaccaagatcctcttggcaagcaaggctatcagcttaggcaaggggataacttcgaagtgtgggaacgtccgctgagcgggcttgcatgggcagtggccatgattaacagacaggaaataggaggacctagatcctacaccattgcggtggcatcccttggaaaaggagtggcatgtaatccagcatgtttcattacccagctgctgcctgtgaagcgcaaactgggattttacgaatggacttcccgcttgagatcgcacatcaacccaaccggaactgtgctccttcaactcgaaaacactatgcagatgagcctcaaggacctgctg

SEQ ID NO: 12250 - DNA, 1287 bp, Artificial Sequence
  Description of Artificial Sequence: Synthetic coding sequence
atgcaactgagaaacccagaactgcatcttggttgtgcgctggctctccgttttctggcgcttgtgagctgggacattcctggggctcgcgcactggataacggactcgcaagaacgccaactatgggatggctgcactgggagcggtttatgtgtaatctggactgtcaagaggagccggactcgtgtatcagcgaaaagctgttcatggagatggcagaactgatggtgtccgaaggttggaaagacgcgggatacgaatacctttgtattgatgattgctggatggcgcctcaacgcgatagcgaaggacgtctccaagctgatccacaacggtttcctcacggaattaggcaactcgcaaactacgtgcattcgaagggcctgaagctgggaatatacgccgacgtcggaaacaaaacttgtgcagggttcccagggagcttcggatattacgacattgatgcacagaccttcgcagactggggcgtggaccttctcaagtttgatggttgctactgtgactccctcgaaaacttggcggatggatacaaacatatgagcctggcgctgaatcgcaccgggaggtcgatcgtgtactcatgtgaatggccactttacatgtggccttttcagaaacccaactacacggaaattagacaatactgcaatcattggagaaactttgccgatattgatgattcctggaagtctataaagtccattctcgattggactagctttaatcaagaacggatagtggatgtggcaggacctggaggttggaacgaccctgatatgctggtgattgggaacttcgggctctcctggaatcaacaagtcacccaaatggcgctctgggcaatcatggcagctccactgtttatgtcaaatgatcttagacacatctcccctcaggccaaggccctccttcaagataaagacgtcattgcaatcaaccaggaccctctgggtaaacaggggtaccaacttagacagggtgacaattttgaggtgtgggagcggccactttcgggcctggcatgggcagtggcaatgatcaacaggcaagaaatcggtggtcctcgctcgtataccattgcagtagcatcacttggtaagggggtcgcctgcaatccagcctgcttcattacgcagttgcttcctgtcaagcgaaagttgggcttttacgaatggacctcgaggctgcgctcccacatcaaccctactggtactgtgctgctgcaacttgaaaacaccatgcaaatgtccctcaaggaccttctg

SEQ ID NO: 12251 - DNA, 1287 bp, Artificial Sequence
  Description of Artificial Sequence: Synthetic coding sequence
atgcaactccggaaccccgagctgcaccttggatgcgcccttgctctgcggttcctggcgctggtgagttgggacatcccgggcgcccgagcactagacaacggactcgcccgtaccccaacaatgggatggctccactgggaaagatttatgtgtaacttagactgtcaagaggagccagattcttgcatcagcgaaaagctatttatggaaatggccgagctcatggtgtctgagggatggaaagatgccggatacgagtacttgtgtatcgacgactgctggatggcgccacagagagactcagaaggcagactgcaagctgatcctcagagattcccccatggcatacggcagctcgcaaattacgtacatagcaagggcctgaaattgggaatctacgcagacgtggggaacaaaacatgtgctggctttccaggcagttttggctactatgacattgacgcccagacgtttgcggactggggggttgatctgttgaagttcgacggctgttactgtgattcgctggagaatctggccgatggctataaacacatgagtcttgctcttaacaggacaggaagatctattgtctactcttgcgagtggcccctgtacatgtggccctttcagaaacctaactacacagagattagacagtattgtaaccattggcgaaatttcgccgatattgacgactcatggaagtccatcaaatccatcttagactggacatcgttcaatcaggagcgaatcgtagacgttgctggccctggggggtggaatgaccccgacatgctcgtaatcgggaatttcggattgtcatggaaccagcaggtgacccagatggccctttgggctattatggctgccccactgtttatgtctaatgacctgaggcacatttctccccaggcaaaggccctactgcaggacaaagatgtcatagccatcaaccaggaccctttgggcaaacagggataccagcttaggcagggcgataacttcgaggtgtgggagcggccattatccggccttgcctgggccgttgccatgatcaacagacaggaaatcggtggcccccgctcctatacaatcgccgtggcgagcctaggaaaaggcgttgcgtgcaaccctgcatgtttcattacccagctactgccagttaaaagaaaattgggattctacgagtggacgtctcgcctgagaagccatatcaatcctactggcacagttctattacaattggagaatacgatgcagatgtctttaaaggatctcctg

SEQ ID NO: 12252 - DNA, 1287 bp, Artificial Sequence
  Description of Artificial Sequence: Synthetic coding sequence
atgcagctccgcaatcccgagctgcacctgggctgtgctcttgccttgcgctttctcgcacttgtatcatgggacatcccaggagctcgcgcgcttgataatggcctcgccagaacccctactatgggttggcttcactgggagagatttatgtgcaatctggactgtcaggaagagccagactcttgtatttcagagaagctgtttatggagatggcagaactgatggtgtccgagggatggaaggatgccggatacgaatatctgtgcatcgacgactgttggatggccccacagagggacagcgagggacgcttgcaggccgacccccagaggttcccgcatggcattaggcagcttgcaaactatgtgcactctaagggattgaaacttggtatatatgctgatgtcggtaacaagacttgcgccggcttcccaggatctttcggttactacgacattgacgcccagacattcgctgattggggagtggatctcctgaaattcgacggctgctattgtgattcattggaaaacctcgctgatggatacaagcacatgtctctcgcattgaaccgcaccggtcgcagcattgtgtactcatgcgaatggcccctctatatgtggcctttccagaaaccaaactatacagagatcaggcaatactgtaatcactggcgcaatttcgcagatatcgatgattcatggaaatcaattaaatctatcctggactggacttctttcaatcaggagaggatcgtcgacgttgccggccccggcggatggaatgatccggatatgttggttattggcaacttcggcctgagctggaaccaacaggtgacacagatggcactctgggctatcatggcggccccactgttcatgtctaacgatcttaggcacatctccccgcaggctaaggcacttttgcaggacaaggacgtaatagccatcaaccaagacccacttggaaagcagggataccaactgcgccaaggcgacaattttgaagtttgggagagaccactgagtggcctggcatgggcagttgctatgattaatagacaggaaatcggcggccctaggagttacacgatcgcagtggcttctctcggaaaaggtgttgcttgcaaccctgcctgctttatcactcaactgttgccggtgaaaaggaaattgggattctacgaatggacctcccgcctccgctcacatatcaaccccacaggtactgttctgctccaactggagaatactatgcagatgagcttgaaggatcttctg

SEQ ID NO: 12253 - DNA, 1287 bp, Artificial Sequence
  Description of Artificial Sequence: Synthetic coding sequence
atgcagctccggaaccctgagcttcacctgggatgtgctcttgcgttgagatttcttgcacttgtgtcctgggatatacctggagcccgggcgctcgataacgggctcgcaaggacgcctactatgggttggcttcactgggagaggttcatgtgcaacctcgattgtcaagaggagcccgattcctgtatttccgagaagctctttatggaaatggcggaattgatggtgagcgagggatggaaagacgcgggctacgaatatctgtgtatagacgattgttggatggctccccagcgtgacagcgagggtcgcctgcaggccgatccgcaacgcttcccgcacgggattagacagttggccaattatgtccattccaagggtctgaaacttggcatttacgccgatgtggggaacaaaacttgtgccggtttcccagggtcgtttggatactacgatattgatgcacaaacttttgcagattggggggtggacctgctgaagtttgacggatgctattgcgattccctggagaatctggcagatggttacaagcatatgagcctggcactgaaccggactggacgctcgattgtgtactcctgcgagtggccgctctacatgtggccatttcaaaagccaaattacaccgagatccgacagtactgtaatcactggagaaacttcgccgacatagatgattcatggaagagcattaagtccatcctggactggactagcttcaaccaagagcgtattgtggacgtggccggaccgggtgggtggaacgaccctgacatgcttgtcattgggaattttggactttcctggaaccaacaagtgacgcaaatggcattgtgggcaattatggccgccccactgttcatgtcgaacgatcttcgacacatcagcccacaagcaaaggcacttctgcaggataaggacgtcattgcgattaatcaggatccactcggtaagcaaggataccagctgagacaaggagataacttcgaagtgtgggaacggccgctgtcgggacttgcatgggcggttgcaatgattaacaggcaagagatcggcggcccaaggtcctacactatcgcggtcgcatctctgggcaagggtgtggcctgtaaccctgcctgttttatcactcagcttctgcctgtgaagagaaaactcgggttctacgagtggacttcgcgcctgagatcacacatcaacccaaccggtaccgtgcttctgcaacttgaaaacaccatgcagatgtccctcaaagatttgctt

SEQ ID NO: 12254 - DNA, 1287 bp, Artificial Sequence
  Description of Artificial Sequence: Synthetic coding sequence
atgcagttgcgtaatcccgagttacacctgggctgtgcgctggctctcaggtttctcgcactcgtgtcttgggacatcccaggggcacgcgctctggataacggcctggccagaactcccaccatgggttggctgcattgggaacgatttatgtgtaacttagactgtcaggaggagccagactcttgcattagcgagaagctcttcatggagatggccgagctcatggtgagcgaggggtggaaggatgccgggtatgaatacctgtgcatagacgactgttggatggcgccccaaagagactctgaaggaagactgcaggccgacccccagagatttcctcacggcattaggcaactcgctaactacgtacactcgaagggtctgaaactcggcatctacgcagacgtgggcaacaagacttgtgccggtttccccggcagcttcggctattacgacattgatgcgcagacatttgccgattggggtgttgatctgctgaagtttgacggatgctactgcgattcgttggagaatctggcggatgggtacaaacacatgtctttggcactgaatcgaactggcaggagtatcgtgtactcttgtgaatggccactgtacatgtggccttttcagaaacctaactacacagagattaggcagtattgcaaccattggagaaattttgccgacattgacgattcatggaaatcgatcaagtcgattctcgactggacaagcttcaatcaagaaaggatcgtcgatgttgccggcccagggggctggaatgatcccgacatgctggtgatcggaaactttgggttgagttggaaccagcaggttacacaaatggccctgtgggccatcatggcagcacccctgttcatgtctaacgacctgaggcatatcagccctcaagccaaagcccttctgcaggacaaggatgtcatcgccataaatcaggaccccctgggtaaacagggctatcagctgagacagggagataacttcgaggtctgggaacggcctctctcggggcttgcctgggcggtcgctatgatcaaccgacaggaaattggcggaccacgcagctataccattgctgtggcctctctgggaaaaggtgtcgcctgcaatccagcttgctttatcacccaattactgcccgtgaaaaggaaactgggattttacgagtggacaagtagactccgctctcacattaaccccactggtacagtactgttgcagctggagaataccatgcagatgtcactcaaggatctgctg

SEQ ID NO: 12255 - DNA, 1287 bp, Artificial Sequence
  Description of Artificial Sequence: Synthetic coding sequence
atgcagctaaggaatcccgaactgcatctagggtgcgccctggccctgcgctttttggcactggtaagttgggacatccctggggctagggctcttgataatggcttggcgcgcacgccaactatgggctggctccactgggagaggttcatgtgtaacctcgattgccaggaagaaccagattcttgtatctccgagaagttgttcatggaaatggcagagctgatggtctcagaagggtggaaggatgccggatacgagtacctctgcattgacgattgctggatggctccgcagcgcgattcagaaggtcggctccaggcagacccccagcgatttccccatggaattcgacagttggccaactacgtgcattccaagggtctgaaactgggcatctacgccgatgtcggtaacaagacatgcgcagggttcccgggcagtttcggatattatgacatcgacgcacagaccttcgctgactggggagtggatcttcttaagtttgacggttgttactgcgattccctggagaacttggctgatggctataaacacatgagcttggcgttgaaccggacaggtcgatccattgtctactcgtgtgagtggccgttatatatgtggccctttcaaaaacccaactacactgaaatcagacagtattgcaatcactggcgaaactttgcagacattgacgacagttggaagagtatcaaatccatcctagactggacgtctttcaaccaggaaaggattgtggacgtggccggaccaggcgggtggaacgatccggacatgcttgtgatcggcaacttcggactgtcctggaaccagcaggtaacacagatggcgctgtgggcaattatggcagctcctctatttatgagcaacgaccttcgtcatatttctccccaagctaaggccctgctgcaggataaagacgtgatcgctatcaaccaggacccccttggaaaacagggataccagctgagacaaggcgataacttcgaggtgtgggaacggccattaagcggcctcgcatgggctgttgctatgataaacaggcaggaaattggcggccctcggagctacactatcgcagtggcaagtctggggaagggcgtagcatgtaacccagcttgtttcattactcaactgctgcccgtgaaacgcaagcttgggttctacgaatggaccagccgactgaggtcccacataaaccctaccggaactgtcctactgcagcttgagaataccatgcaaatgtccctcaaagacttgttg

SEQ ID NO: 12256 - DNA, 1287 bp, Artificial Sequence
  Description of Artificial Sequence: Synthetic coding sequence
atgcaactgcgtaatcctgagctgcacctcggttgtgcgctcgcgctgcgatttcttgcactcgtctcgtgggacatacccggcgcccgcgctttggataatggcctggcccgcaccccaaccatgggatggctgcattgggagcgctttatgtgcaatcttgattgtcaggaggagccagacagctgcatttccgagaagctcttcatggagatggccgaacttatggtgagtgaaggctggaaggacgcgggctatgagtatctttgcatcgatgattgctggatggccccacagagggacagcgagggtagactgcaggcagacccccaacgatttccccacggcattagacagttggccaattatgtccacagcaagggcttgaagttgggcatctacgccgacgtgggcaataagacttgcgctggattcccgggctcttttggatactatgacatcgatgcccagactttcgctgattggggagtagacctactcaagttcgatggctgctactgtgattcgctggaaaatttggccgacggttacaagcacatgtcgctagctctgaatcgaaccggacgatcaatcgtgtattcctgtgaatggccactgtacatgtggccgtttcaaaagccaaattacacggagattagacaatactgcaaccactggcggaacttcgccgacatagatgattcatggaagtcgatcaagagcatactagactggactagctttaatcaggagcgtattgtggatgttgctggccccggaggatggaacgaccccgacatgctggtgattggcaatttcggcctgtcgtggaatcagcaggtgacccaaatggccttatgggcgattatggcagcgcccctgtttatgagcaatgatttgcgtcacatctccccgcaggccaaagcgcttttgcaagataaggatgtcattgctattaatcaggatccgttgggtaaacaaggctatcagctgagacaaggcgataatttcgaggtgtgggaacggccgctcagtggactcgcctgggctgtcgcgatgattaatcgccaggagatcggtggaccgcgctcctacacgatcgcggtagcatccttaggcaaaggcgtggcgtgcaaccccgcatgctttatcacccagctgctgccagtcaaacgtaagctgggattttacgaatggacttcgcgcctgcgtagccacataaatcccacaggcaccgttctgctgcagctggagaacactatgcaaatgagcctgaaggacctcctc

SEQ ID NO: 12257 - DNA, 1287 bp, Artificial Sequence
  Description of Artificial Sequence: Synthetic coding sequence
atgcaactgcggaaccccgagctgcacttgggctgtgccctggcccttcgcttcctcgcactcgtctcctgggacatcccaggcgctcgcgctttggataatggattggccaggacacccaccatgggttggctgcattgggagaggttcatgtgcaacctcgactgccaggaggaaccagattcctgcatctctgagaaactgttcatggaaatggccgagcttatggtttccgaagggtggaaggacgctggatacgagtacctgtgtatcgacgactgctggatggccccccaacgagatagcgagggcagacttcaggcagacccacaaagatttccgcacgggatccgccagctggccaactacgttcacagcaaggggctcaagctggggatttacgccgacgtgggaaataagacttgtgccggcttccccggaagctttggctattacgatatcgatgcgcagacattcgcagattggggggtcgacctactgaaatttgacggttgctattgtgacagtctcgaaaatctggcggacgggtataaacacatgtccctggcgttgaatcgcacaggccgtagtattgtgtattcatgcgaatggccactttacatgtggccctttcagaagcccaattacacagagattaggcaatattgtaatcactggcggaattttgcagacatcgacgatagttggaagagcattaaatctattctcgactggacgtctttcaaccaggaacgcatcgtcgacgtagccggcccaggaggatggaacgaccccgatatgttggtgatcggcaacttcggccttagttggaaccagcaggtgacccagatggccctatgggcaatcatggccgcaccccttttcatgagcaacgatttgcgacatatctcacctcaagctaaggccctactccaggacaaggacgttattgctatcaatcaggacccactgggcaaacagggctaccagcttagacagggagacaatttcgaagtgtgggaaagacccctgagtggccttgcttgggccgtggcaatgatcaaccgacaagagattggaggtcccagatcatataccatcgcagtagcttctctaggaaagggggtagcctgtaatccagcttgcttcatcactcagttattacctgttaagcgtaagctcggtttctacgaatggacttccaggctcaggagtcatatcaaccctactgggacggtcttgttgcagctggaaaataccatgcagatgagcctgaaagacttgctg

SEQ ID NO: 12258 - DNA, 1287 bp, Artificial Sequence
  Description of Artificial Sequence: Synthetic coding sequence
atgcagttaaggaacccagaactgcatctggggtgtgcgcttgccctgagattcttggcactggttagctgggatattcctggagcccgggcactggacaatgggctagctagaacccctacaatgggctggctgcactgggagaggttcatgtgcaatctggattgccaggaggagcctgactcctgtatctccgagaaactttttatggaaatggccgagctgatggtgagcgaaggctggaaggacgccgggtacgagtacttgtgcattgatgattgctggatggctcctcagcgggattcagaagggaggctccaggctgaccctcagcggttccctcatgggattcggcagttagcaaattatgtgcactctaaaggtttgaaactggggatctatgccgacgttggcaataaaacgtgcgccgggttccccggatcttttggctattacgatattgacgctcagacttttgcagattggggcgtggatttgcttaagttcgatggatgctactgtgatagtctggagaacttggctgacggctataagcatatgagtctggcgctgaacagaaccgggcggtccatcgtgtactcctgcgagtggcctctttacatgtggcctttccagaagcctaattatacggagattagacagtattgtaatcactggcgcaactttgcagacattgatgattcttggaagagtataaagtccattttggactggacgtcttttaaccaagaacgcattgtggatgtggccggacccggcggatggaatgaccctgacatgctggttatcgggaattttggactctcatggaaccagcaagttacacagatggcgctttgggccatcatggctgctcccctctttatgagtaacgatctgcggcatataagcccccaggcaaaggctctgctacaggacaaagacgtgattgctatcaaccaggatccgctggggaaacaggggtaccagcttagacagggggataatttcgaagtgtgggagaggcccctaagcggattggcgtgggcagtggccatgatcaacagacaggagatcggaggcccccgtagctacacaattgctgtggcatcattgggaaagggagtagcctgtaatcccgcttgcttcattacacagttactgcctgtgaaacggaaattaggattctacgaatggaccagccgactgcgttctcacatcaaccccacaggaacagtgctcttgcagctcgaaaacaccatgcagatgtcgctcaaggatctcctg

SEQ ID NO: 12259 - DNA, 1287 bp, Artificial Sequence
  Description of Artificial Sequence: Synthetic coding sequence
atgcagttgcgaaacccagagttgcatctgggctgcgccctggctctgcggttcttggccctggtgtcttgggacattcctggggctcgggcgcttgacaacggactggctaggacaccaaccatgggctggctgcactgggagagatttatgtgcaacttggattgtcaggaagaacccgactcttgtattagcgaaaagttgtttatggagatggctgaactgatggtgtctgaagggtggaaagacgctggatatgagtatctgtgtatcgatgactgttggatggcccctcaaagggattcagaagggcggctgcaagctgatccgcagagattccctcacggcatacgccagttagcaaactatgtacactctaagggtctcaaacttgggatctatgctgatgtagggaacaaaacatgcgccggctttcctggttcctttggctactatgatatcgacgcccagacgttcgcggattggggggtcgacctgctgaaatttgatggttgctattgcgattctcttgaaaacctggccgacggctacaagcacatgagcctggccctgaataggaccggccgttcaattgtatattcctgcgagtggcccctatacatgtggccattccagaaaccgaactacactgaaatccgccagtattgcaatcattggagaaacttcgccgacattgacgactcatggaaaagcattaagtcgatcctagactggacaagtttcaatcaggagcgtatcgtggacgtggctggccctggaggttggaatgaccccgacatgctggtgatcgggaacttcggactgagctggaaccaacaggtgacccagatggccctttgggcgatcatggccgcacctctctttatgtcgaatgatctcagacatatttccccgcaggcaaaggccctgcttcaggacaaggatgtcatcgccatcaaccaagatccgctcggcaaacaaggttatcagcttcggcaaggagacaatttcgaggtgtgggaaaggcctctatctggcttagcatgggcggtggccatgattaataggcaggaaattggaggaccccggagctacacaatcgcggtcgccagcctcggaaaaggggtggcctgtaaccccgcgtgcttcatcacacagcttctgccagttaaaaggaaactgggattctacgaatggacatcaagactgcggagccatatcaaccccacaggcaccgttctgcttcagctggagaacaccatgcagatgtctctcaaggatctgctg

SEQ ID NO: 12260 - DNA, 1287 bp, Artificial Sequence
  Description of Artificial Sequence: Synthetic coding sequence
atgcagctgcggaaccctgaattgcatctggggtgtgctctggcactgcgcttccttgcccttgtgagctgggatattcccggcgccagggcccttgacaatggacttgcacgtaccccgacaatgggttggctacattgggagagattcatgtgtaatctcgattgccaggaggagcccgactcatgcatcagcgaaaagctgtttatggaaatggctgagctgatggtgtctgaaggctggaaggatgccgggtatgaatacctgtgcattgatgattgttggatggctcctcagcgggactctgagggacggttgcaggcagacccgcaacggttcccccacggcatccgacagctcgctaattacgttcactccaagggccttaagctggggatttatgcagatgtgggaaacaagacctgcgccggattcccgggctccttcgggtactatgatatagatgctcaaactttcgctgattggggcgtcgatctgcttaaattcgatggatgttactgcgacagcctcgaaaaccttgcggatggatacaaacacatgtctttagctcttaataggaccgggcgctccatcgtgtactcttgtgaatggccactgtatatgtggccttttcagaagcctaattacaccgagatcagacagtactgtaatcactggcgtaactttgctgacatcgacgactcctggaagagtattaagtctatcttagattggacaagtttcaaccaggagcgcattgtggacgtggcaggacctgggggctggaacgatccagatatgcttgttattggaaattttggactaagctggaatcaacaggtgacacagatggctctgtgggcaataatggccgctcccctgtttatgagcaacgatctgcggcacataagcccccaggccaaagcactgctgcaagataaggatgtgattgcaattaatcaggaccctctggggaagcagggttaccagctaaggcagggggataacttcgaggtgtgggagagacctttgtctgggctcgcctgggcggtggctatgatcaatcgccaggaaatcgggggcccaagatcctataccatagcagttgcatcactgggcaagggagtggcctgtaatcccgcttgcttcattacacagttgctgcccgtgaaacggaagttaggcttctacgagtggacttcacgtctgcgatcacacataaatccaactggcacagtgctgctgcagctggagaatacgatgcagatgagtctgaaagacctgttg

SEQ ID NO: 12261 - DNA, 1287 bp, Artificial Sequence
  Description of Artificial Sequence: Synthetic coding sequence
atgcagttgcgcaacccggagctgcacctggggtgcgctctggcgctcaggtttttggctctggtgtcgtgggacatcccgggagccagggccttggacaacggattggcgagaaccccgaccatgggttggctccattgggagcgatttatgtgcaacttggattgccaggaggaacccgacagctgtatttcggagaaactgttcatggaaatggctgagctcatggtgtcagagggatggaaggatgcgggctacgaatacctctgtatcgacgactgttggatggcgccgcagcgcgacagcgaaggacgcctccaggccgatccgcagcggttcccacacggaattagacaacttgccaattatgtacactcgaagggactgaagctgggaatctatgccgatgttggtaacaagacttgcgccgggttcccgggatccttcggctactacgacattgacgcccaaactttcgcggattggggagtggatctgctgaaatttgacgggtgctactgcgactctctggaaaacctcgctgacggctacaagcacatgagcctggccctcaacagaacgggtcggtcgatcgtgtactcctgcgaatggccactctacatgtggccgtttcagaagccaaactacaccgagatacgccagtactgtaatcattggcgcaatttcgccgatatcgatgactcctggaagtcaatcaagtcgattctggactggactagcttcaaccaagagcggatcgtcgatgtcgcaggtcctggcggctggaacgatccggatatgctcgtcatcggaaactttggattgtcgtggaatcaacaggttactcaaatggccctctgggcaatcatggcagcacccttgttcatgagtaacgacctccgacacatctcgccgcaggctaaggccctgctccaggataaagacgtgattgctatcaatcaagatcctctgggaaaacagggctaccaactgaggcaaggcgacaatttcgaggtgtgggaaagacccctgagcggactggcctgggccgtggcgatgatcaaccgccaggaaattggtggaccgcggagctacaccatcgcggtggcctctctcgggaagggcgtggcgtgcaatccagcatgcttcatcactcagcttctgccggtgaagaggaagctgggcttctacgaatggacgtcccgcctccggtcgcatatcaacccaaccggcaccgtactgctgcagctcgaaaatacgatgcagatgtcacttaaggaccttctc

SEQ ID NO: 12262 - DNA, 1287 bp, Artificial Sequence
  Description of Artificial Sequence: Synthetic coding sequence
atgcagctccggaaccccgaactgcatttagggtgtgctctcgcccttagattcctcgctctcgtctcgtgggacatccccggggccagagcacttgataacggactcgctaggacaccaactatgggatggcttcactgggaacgcttcatgtgtaacctcgattgtcaggaagagcccgattcatgtatatcagaaaagctcttcatggaaatggccgaactcatggtatcagaagggtggaaagatgccggatatgaatacctgtgtatagatgactgttggatggccccccagcgagacagtgaagggcgactgcaggcagatccacagcgcttccctcacgggatcagacagctcgccaattatgtccactcgaagggactcaagttagggatatacgccgatgtcggaaacaagacatgtgccggatttccaggatcctttgggtattacgatattgatgctcagacatttgccgattggggggtggatctccttaagtttgatgggtgctactgtgactcactggagaacctcgccgacgggtacaaacacatgagtctggcattgaatcggactggacggtcaattgtgtactcatgtgaatggcctctgtatatgtggccattccagaaacctaattacacagagatacggcagtattgtaaccactggcggaattttgctgatatagatgacagttggaaatctataaagtcaatactcgactggactagttttaatcaggagcgaattgttgacgtggccgggccagggggatggaatgatcccgatatgctggttatcggaaattttggactgtcttggaaccagcaggtgacacaaatggcactgtgggcaataatggctgcccctctctttatgtctaacgatcttaggcatatctcccctcaggccaaagcccttcttcaggacaaagatgtgatcgctattaatcaggatcctctcgggaaacaggggtatcagctgaggcagggagacaacttcgaagtgtgggagaggcccctctctggactagcctgggccgtagccatgataaaccggcaggagattgggggaccacgatcttatacaatagccgtcgcctcactggggaaaggagtcgcatgtaatccagcctgctttataactcagctactcccagtcaaaaggaaattggggttttacgagtggacttctcgactgcgatcccacatcaaccccactggaacagtgctcctgcagctggagaacactatgcagatgtccctcaaggacttgctc

SEQ ID NO: 12263 - DNA, 1287 bp, Artificial Sequence
  Description of Artificial Sequence: Synthetic coding sequence
atgcagctgcgtaaccctgagctgcacctcggttgcgcacttgcgcttcgatttctcgccctggtcagctgggacattccaggtgcacgcgcgcttgataacggacttgcaagaacccctactatgggttggcttcattgggaaagatttatgtgtaacctggactgtcaagaagaaccagattcgtgtataagcgaaaagctgtttatggagatggccgaacttatggtcagcgagggctggaaagatgcaggatacgaatacctgtgtattgacgattgttggatggctcctcaaagggattcagagggaaggcttcaggcagaccctcagcggtttccccatggtatacgacagcttgcgaactacgtgcattcaaaggggcttaaacttggaatttacgctgacgtgggaaataagacttgtgcaggatttccaggtagctttggttactacgatattgacgcccaaacgttcgcagattggggtgtggatctgctcaagttcgatggctgttactgtgattcgcttgagaatctggcagatggttacaagcatatgtcgcttgcattgaaccgcaccggtagaagcattgtgtactcatgtgaatggcccctctacatgtggccttttcagaaacctaactacactgaaataagacagtactgtaaccactggaggaattttgcggatattgatgactcgtggaagtcgattaagtcaattctcgattggacttcatttaaccaggagaggattgtcgatgtggccggccctggagggtggaatgatcccgatatgcttgttattggaaactttggccttagctggaaccaacaagtgactcagatggcgctctgggcgattatggcagcccccctgttcatgagtaacgatctcagacacatttcccctcaggcgaaggcacttcttcaagataaggatgtgatcgcaatcaatcaggatccactcggaaaacaaggatatcaactccgacagggcgacaactttgaagtctgggaacggccactgtccggtctggcatgggcggtagcaatgatcaatagacaggagatcggagggccaaggtcctacactattgccgtcgcatcgcttgggaagggagtggcgtgcaatcctgcatgcttcataactcaactgctgcctgtgaagcggaaacttgggttctacgaatggacctccagactgagatcgcatatcaatcctactggtaccgtccttctgcaactcgaaaacactatgcagatgtcgctcaaggatctcctg

SEQ ID NO: 12264 - DNA, 1287 bp, Artificial Sequence
  Description of Artificial Sequence: Synthetic coding sequence
atgcagctgcgtaaccccgaactgcaccttggttgtgcacttgctttgcgtttcctcgccctcgtatcttgggatatcccaggcgcccgcgcactcgataacggactcgcacgcactcccacaatgggatggctccactgggaacgtttcatgtgtaatctggactgccaggaagagccagatagttgcatcagcgagaagttgtttatggagatggctgaactgatggtttctgagggttggaaggatgcaggatatgaatacctctgtatcgacgactgctggatggccccacagcgcgatagcgaaggtaggctccaggctgatccccaacgcttcccacacggcattagacagttggccaactacgtgcactctaagggtctcaagctgggtatctatgctgacgtgggaaacaagacatgcgctggtttcccaggttcctttggctattacgatatcgacgctcaaactttcgccgactggggtgtggatctgttgaaattcgatggctgctactgtgactcacttgagaatctggctgatggatacaagcatatgtcattggctttgaatagaaccggacgttccatcgtctatagctgcgagtggccactgtacatgtggcctttccagaaaccaaactacaccgaaatacgtcaatactgcaaccactggaggaacttcgctgatattgatgacagctggaagtctatcaaatctatacttgactggactagttttaatcaggaaaggatagtcgatgtagccggaccaggtggctggaacgatcccgacatgcttgtaatcggtaactttggattgtcttggaaccagcaggttacacagatggcactttgggctattatggctgctccactgttcatgtctaacgatttgcgccatatttctccccaggcaaaagctcttctgcaggacaaggatgtcatcgccatcaatcaggaccccctgggtaagcaaggataccaactccgccagggagacaattttgaggtctgggagaggcccctttcaggcctggcctgggctgtagccatgatcaacaggcaggagatcggtggccccaggtcttacacaatcgctgtggcctctctgggcaaaggcgtggcctgcaacccagcttgctttatcacacaactcctgcccgtaaagaggaaattgggattttacgagtggacctccaggctgagatctcacattaaccccacaggtacagtgctcctccagcttgaaaatactatgcagatgtccctcaaggacctgttg

SEQ ID NO: 12265 - DNA, 1287 bp, Artificial Sequence
  Description of Artificial Sequence: Synthetic coding sequence
atgcagctccgcaaccccgaattacacttggggtgcgcactggccctgcgtttcctcgctttagtgagctgggatatccccggagcccgtgcacttgataacggtctcgcaaggactcccaccatggggtggctgcattgggaacgcttcatgtgcaatctggattgtcaggaagagcctgattcttgcatcagcgaaaaactgttcatggaaatggcggagttgatggtcagtgagggctggaaagacgcgggctacgagtatctctgcatcgatgattgctggatggccccacagcgcgactccgagggtaggctgcaagccgaccctcagcgcttcccacatggcattcggcagctggccaactacgtgcatagcaagggattaaagctcgggatctacgctgatgttggtaacaagacgtgtgccggttttcctggaagcttcggctactacgatattgacgcccagacctttgccgattggggtgtcgaccttctgaagtttgatggctgttactgcgatagtctggagaatttggctgacggatacaagcatatgtccctcgcgctgaataggaccggtcggtccatagtttacagttgcgaatggcccctgtatatgtggcccttccagaagccgaactatacagagatcagacagtattgcaatcattggcgaaacttcgcggatatagacgattcctggaaatccattaagtccatcctggactggacctcctttaatcaagaaagaatcgtagacgtggcaggtcctggcgggtggaatgaccctgatatgctggttatcggcaactttgggctgtcttggaaccagcaggtcacacagatggccctctgggcgattatggcagcccccctgttcatgtcaaatgatctgcgccacatctctcctcaggcgaaggccctgctacaggacaaggatgttatagctattaatcaggatccactcgggaagcaggggtatcagctgcggcaaggagacaacttcgaggtttgggaacggcctctctcgggcctggcgtgggccgtggcgatgatcaaccgacaggaaataggtggacctaggtcctataccatcgctgtggcatctctaggtaagggtgtggcctgcaatccagcctgcttcattactcagctcctacccgttaagaggaagctcggattttatgaatggacatcacggctaagatcccacatcaacccaactggcactgtcctgcttcagctcgagaataccatgcagatgagcctcaaagaccttctt

SEQ ID NO: 12266 - DNA, 1287 bp, Artificial Sequence
  Description of Artificial Sequence: Synthetic coding sequence
atgcagctgcggaatcctgaactccacctgggttgtgccctcgctctgcggtttctggccctggtcagttgggatattcccggagcacgcgcactggacaacggcttggccaggacgcctactatgggctggctccattgggagcggttcatgtgcaacctggattgccaggaggaacctgactcctgcatctcggaaaaactgttcatggaaatggccgagctgatggtatccgaaggctggaaggatgccgggtatgagtacctttgcatagacgattgttggatggcgccacagagagactcggaaggacgcctgcaagcagacccgcagagattcccccacgggatccgacagctggccaactacgtgcactcgaagggactgaagttggggatctacgctgatgtgggtaacaaaacctgcgcgggtttcccgggatcgtttggatactacgacattgatgctcagacgtttgcagattggggcgtcgacctgcttaagttcgatggatgctactgcgactctctcgagaatctcgccgatggttacaaacatatgtccctggctctgaaccgaaccggaagatcaatcgtgtactcatgtgaatggccactgtacatgtggccgtttcaaaagccaaattacactgaaattcggcagtactgtaatcattggagaaacttcgcggacatcgatgacagctggaagtccatcaagtccatactggactggacttccttcaatcaggaacgaattgtggatgtggcggggccagggggctggaatgacccggacatgctcgtcattggaaatttcggtctgagctggaaccaacaggtgacccagatggcgctttgggccatcatggcagcgccgctgttcatgtcaaacgatcttcgccacatctcccctcaggcaaaggcgcttctccaggacaaagacgttatcgcgattaaccaagatcctctgggtaagcaggggtaccagctgcggcaaggagacaacttcgaagtgtgggaacggccgttgagcggtcttgcctgggccgtggcgatgatcaatcgccaagaaatcggaggcccccgctcctacaccatcgccgtggcctcactggggaaaggagttgcctgcaacccagcttgcttcattacccagttgctcccggtgaagcgcaaactcggattctacgagtggacgagtcggctcaggagccacatcaaccctactggaaccgtcctgctgcagctggagaacaccatgcagatgagcctgaaggatttgctg

SEQ ID NO: 12267 - DNA, 1287 bp, Artificial Sequence
  Description of Artificial Sequence: Synthetic coding sequence
atgcagctccgtaatcccgaactgcatctgggctgcgctttggctctgcggtttctcgcgctggtctcctgggacataccaggtgctagggctttggacaacggactcgcacgaaccccgaccatgggatggctgcattgggagaggttcatgtgtaatcttgactgccaggaagagcctgattcttgcataagcgagaaattattcatggaaatggccgagttgatggtgagtgaaggttggaaggatgcagggtacgagtacctctgcattgatgactgctggatggcgccacaacgggatagcgaaggtcgcctccaggctgacccgcagcggttccctcatggaatccgccaactggcaaactacgttcactcgaaaggattgaagctcggcatatacgccgatgtgggcaataaaacttgcgctggcttccccgggtcatttggatactatgatattgacgctcagacctttgccgattggggggtggatctactcaagttcgacgggtgttattgtgattctttggagaaccttgcagatgggtacaaacatatgtctctcgccctcaatcgaacaggcagaagtattgtttactcctgtgaatggcccttatatatgtggccattccagaagcctaactatacggaaattcgtcagtattgcaatcactggaggaatttcgctgatatcgacgactcctggaaatcgatcaagagtatccttgactggacttcttttaaccaggaacgcatagtggacgtagcaggcccagggggctggaacgaccccgacatgcttgtgataggaaactttggcctgagctggaatcagcaggtaactcaaatggctctctgggcgattatggcagccccgctattcatgagcaacgacctgcggcacatctcgccgcaggccaaggccctcctgcaagataaagacgttatcgctataaaccaggaccccctggggaaacagggataccaactccgccagggagacaactttgaagtatgggaaagaccactgtccggcctcgcttgggccgtggccatgataaaccgtcaagaaattggtggccccaggagctacaccattgcggtcgcgtccctaggtaaaggagtggcctgcaacccggcatgctttatcactcagctgctgccggttaagcgcaagctaggattctacgaatggaccagtcgcctccgatcgcatataaaccctaccggaaccgtgctgctccagcttgagaatacgatgcagatgtctcttaaggacctccta

SEQ ID NO: 12268 - DNA, 1287 bp, Artificial Sequence
  Description of Artificial Sequence: Synthetic coding sequence
atgcaattgagaaatccagagctacacctcggttgcgcacttgcactcagattcctcgcactggtgagttgggatatcccaggggctagggcacttgacaatggcctggcgagaactcccactatgggttggctccactgggagcggttcatgtgcaacctagattgtcaggaggaacccgatagctgtatcagcgaaaagctgttcatggagatggccgagctgatggtgagtgagggctggaaggatgctggatacgagtatctctgtatcgatgattgctggatggcgccgcaaagagactcggagggccgacttcaagccgatccacagcggttccctcacgggattcggcagttggccaattacgtgcactccaagggtctgaaactgggaatttatgctgacgttggcaacaaaacatgcgcgggctttccaggatcttttggctactatgacatagacgcccagacgtttgctgattggggcgtcgatcttttgaagttcgatgggtgttactgcgacagcttagagaacctggcggatggatacaagcacatgtccctggcactgaaccgcacagggcgcagtattgtgtacagctgcgagtggcccttgtacatgtggcccttccagaaacccaattacacagagatacgccagtattgcaaccactggcggaacttcgcagatatagatgacagctggaagtctatcaagagtattctggattggacgtccttcaatcaggagagaatcgtggatgtcgctgggccaggaggctggaatgaccccgacatgcttgtgatcggcaactttggcttgtcctggaatcagcaggttacccaaatggccttgtgggctattatggccgccccactctttatgagcaatgatctgcgacacatatcccctcaagcgaaagcgctgctccaggataaggacgtgatagctatcaatcaggacccactgggcaagcagggctatcagctgagacagggggacaactttgaggtatgggagcggccgctaagtgggctcgcctgggctgtagctatgattaaccgccaagagatcggcggcccaagaagttatactatagccgtcgctagtcttggtaagggagtggcttgcaatccagcatgtttcatcacgcagctgcttccggtgaagcgtaagttgggtttctacgagtggacctcccggctccgcagccatataaacccaacaggcacagtactgttgcaattggaaaataccatgcagatgagtcttaaggatctcctg

SEQ ID NO: 12269 - DNA, 633 bp, Artificial Sequence
  Description of Artificial Sequence: Synthetic coding sequence
atgaagctctgggacgtggtggcagtgtgtctggttctgctgcataccgcatccgctttcccgctgccagcaggtaaaagacctcctgaagcccctgctgaagataggagcttgggcagacgccgggcgccttttgccctgtcctccgattccaacatgcctgaggactaccccgatcaatttgatgacgtgatggactttattcaagcaaccattaaacgactgaagcgtagcccagataagcaaatggcagtgctccctcggcgtgagagaaatagacaagccgcagcagcaaacccagagaactcgaggggaaagggcagacgtggacaacggggcaagaacagaggttgtgtgctgactgcaatccacctcaacgtcactgacttggggctgggatacgaaactaaagaggaactgattttccggtattgctcggggtcttgtgacgcagcagaaactacttacgacaaaattcttaagaacctttcaagaaaccgacgactcgtcagcgacaaggtcggacaagcatgttgtaggcctatagccttcgatgatgatctttccttcctggacgacaatttggtctaccatattcttagaaaacattctgccaagagatgcggttgtatt

SEQ ID NO: 12270 - DNA, 633 bp, Artificial Sequence
  Description of Artificial Sequence: Synthetic coding sequence
atgaaattgtgggatgttgtcgcagtgtgtctcgtcctccttcatactgcgtctgccttcccgctgccagccggcaaacgtcctcccgaggcccccgctgaagaccgctctctgggccgtaggcgggcacccttcgccctaagctccgatagcaatatgcctgaagactatcctgatcagttcgacgacgtgatggattttatacaggctactatcaagagactgaaaaggtcccccgacaagcagatggcagtgctgccccgtcgtgagcggaatagacaggccgccgctgcaaatcccgagaattctcgggggaaagggcggcgtggccagcgcgggaaaaacagaggctgtgttctcaccgctattcatcttaatgtgactgatctgggacttgggtatgagacaaaggaggaactgatcttccgatattgtagcgggagttgcgatgcggctgaaacaacctatgacaagattctgaagaacctcagcaggaataggcgattagtgagcgataaggtgggccaggcctgttgcaggcccattgcctttgatgacgaccttagtttcctcgatgacaatctggtgtaccacattttgagaaaacactccgcgaaacgctgcggatgcata

SEQ ID NO: 12271 - DNA, 633 bp, Artificial Sequence
  Description of Artificial Sequence: Synthetic coding sequence
atgaaattatgggacgttgtagccgtttgtctggtgctcttgcacaccgcatctgctttccctctgcccgccggaaagcggccacctgaagccccagcagaggaccggagtctcggaaggcggagagctccctttgcgttgtcgagcgacagcaatatgcctgaggattacccagatcagtttgacgacgtgatggacttcatacaggcaactatcaaaagactgaagaggagtcccgacaagcagatggcggtgctgcctaggcgagaaaggaataggcaggcagctgcagccaaccccgagaacagccgagggaaggggcggaggggacaacgagggaagaatcgaggctgcgtacttactgcgattcacctcaacgttacagatcttggtttagggtatgaaaccaaggaagaactaatttttcggtactgttccgggtcctgcgacgcagccgagactacctatgataaaatccttaaaaatctctcgcgtaatagaagactggtttcagataaggttggacaggcctgctgccgacctattgcttttgatgatgacctctcttttctggatgacaacctggtgtatcacatactgcggaagcatagtgcgaaacggtgtggctgtatt

SEQ ID NO: 12272 - DNA, 633 bp, Artificial Sequence
  Description of Artificial Sequence: Synthetic coding sequence
atgaaactgtgggacgtggtagccgtgtgtctcgtgctgttgcacacagcatctgcttttccgctacccgccggcaagcggcctccggaggctcccgcagaggatagatcccttggacgacgcagggctcccttcgctttgtctagcgactctaatatgcccgaggactatcctgatcagttcgatgacgtcatggatttcattcaagcaaccatcaagaggctcaaaaggagtcccgataagcagatggccgtgctcccgaggcgggagcgtaaccgccaggccgctgctgccaaccctgagaactcgagaggtaagggccgtcgcgggcagcgcggcaagaatcgcggttgcgtgctgacagccatccacttaaatgtgaccgacctcggcctcggatatgagaccaaggaggagctgattttccggtattgtagcgggtcttgcgatgcagctgagacaacttacgacaagatcctcaaaaatttatcccgcaacagaagactggtgagcgataaggtgggtcaggcctgttgccgtcctattgcttttgacgatgatttatctttcctggacgataatttagtatatcacattctccgaaaacatagtgctaagagatgtgggtgtata

SEQ ID NO: 12273 - DNA, 633 bp, Artificial Sequence
  Description of Artificial Sequence: Synthetic coding sequence
atgaagctctgggatgtcgtggcagtgtgtctggtgcttttgcacactgcatccgcatttcccttgcctgccggaaaacgtcctccggaggcacccgcagaagatcggagcctcgggagaaggagagctccattcgccttgtcatcggattcgaacatgcccgaggattaccccgaccagtttgatgatgttatggacttcatccaggcgaccattaaacgactgaagcgatcccctgacaagcagatggcagtgttgccgagacgcgaaagaaaccggcaagccgcggcagcaaatccagaaaactcgagaggaaagggcagacgcgggcaacgaggcaaaaaccggggatgcgtgttgaccgctatacatctgaatgtcaccgatcttggactgggttacgagactaaggaagaactgatctttagatactgttcaggttcgtgtgacgcagccgaaactacttatgacaagattcttaagaacctgtcccggaatagacggcttgtgtccgataaggtcggacaagcgtgttgcagacccattgcttttgacgacgacctctcattcctcgatgataacttggtgtaccatattcttagaaaacatagcgccaagcgctgcggttgcatt

SEQ ID NO: 12274 - DNA, 633 bp, Artificial Sequence
  Description of Artificial Sequence: Synthetic coding sequence
atgaagctttgggacgtggtcgcggtgtgtttggtgttgctgcacacagctagtgctttccctctgccagcaggaaaaagacctcccgaggcccctgccgaggataggagtctcggacgacgcagggcaccattcgcattgtcatcagactctaacatgcctgaggattatcccgatcaattcgacgatgtgatggacttcattcaggcgaccattaagcgtctgaagagaagtccagacaagcaaatggctgtcctgccgcgtcgtgagaggaacagacaggccgccgcggcaaaccccgagaacagcagggggaagggccggcgcgggcagagggggaaaaacagaggttgtgtgctgactgccattcatttaaacgtcaccgatctggggctcgggtacgaaactaaagaagagctgatctttcgctactgttcaggctcctgcgacgctgccgagaccacctatgacaaaatccttaagaatcttagtcgaaataggcgtctggtgtccgacaaggtgggccaggcctgttgccggccaatcgccttcgacgacgacctttccttcctggatgataacttggtatatcatattctccgcaaacactccgctaagaggtgcggttgtatt

SEQ ID NO: 12275 - DNA, 633 bp, Artificial Sequence
  Description of Artificial Sequence: Synthetic coding sequence
atgaagctgtgggacgtggtggccgtctgcctcgtactcctccacaccgcaagcgcatttcctttaccagccggaaagcggccacccgaagcaccagccgaggatcggtcactaggcagacgacgtgccccttttgctctgtctagcgatagtaacatgcctgaagattaccccgaccagttcgatgatgttatggatttcatccaagctacaatcaagcggcttaagagaagcccagataagcagatggccgtcttgccacgtcgggagcgtaaccgacaggctgcggctgccaaccctgagaattcacgaggcaaagggaggcggggacaacggggcaagaatagagggtgtgtcttgaccgcaatacatttgaatgttacagatctcggtcttggctatgagaccaaggaagagttgatctttcggtactgttcaggttcctgcgacgcggctgaaactacctacgacaagatcctcaagaatttatcgagaaaccgccgtctcgtttcagacaaggtgggacaggcatgctgtcgccccatcgccttcgatgatgatctgagcttccttgacgataatctggtgtatcatattctgcgcaagcactcagcaaagagatgcggatgtatt

SEQ ID NO: 12276 - DNA, 633 bp, Artificial Sequence
  Description of Artificial Sequence: Synthetic coding sequence
atgaagctgtgggatgtggtggcagtgtgcctggtcctgttgcacaccgcatcagccttcccactgccggcgggcaaacgacctccagaggcgcccgcggaagatcgcagcctgggtcgccgccgcgcacccttcgccctgtcgtcagatagcaatatgccggaggactatccggaccagttcgacgatgtcatggatttcatccaagcaaccattaagcgcttgaagcggtcgccagacaagcaaatggccgtgctgccacggagggagcgaaaccggcaggcggccgccgctaacccggagaattcgcgaggaaaaggacggcggggacagagaggaaagaatagaggctgcgtgttgactgctatccatctcaacgtcaccgatctggggttgggttacgaaaccaaggaagagctcattttccggtactgctccgggtcatgtgacgccgctgaaacgacttacgacaagatactgaagaacttgagtcgcaaccgacggcttgtttccgacaaagtcggacaggcatgctgtcgccctatcgcttttgacgacgacctctcgtttcttgatgacaatctcgtctaccacatcctgcgaaagcatagcgccaaacggtgcggctgcatt

SEQ ID NO: 12277 - DNA, 633 bp, Artificial Sequence
  Description of Artificial Sequence: Synthetic coding sequence
atgaagctgtgggacgtcgtggcagtgtgcctggtgctgcttcatactgctagcgcatttccactgcctgcggggaagaggccgcccgaagcaccagcagaggatcggtcgcttggccggcggcgtgccccgtttgcacttagctccgattcgaatatgcccgaggactaccctgatcagtttgatgatgtgatggacttcatccaggctactattaagcgccttaagagatcccctgacaaacaaatggccgtactccctcgccgagaacgtaaccgccaagcggctgcggcgaaccccgaaaactcacgtggtaaaggtcgcagagggcagcggggcaagaatagaggatgtgtgcttaccgccattcacctcaacgtgaccgacttgggccttggatatgaaacgaaggaggaactgatttttcgatactgctcgggtagttgtgacgcagccgaaactacctacgacaaaattctgaaaaacctgtcgcgaaatcggcgccttgtgtccgataaggtcggacaagcatgttgtcgtccaatcgcattcgacgatgatctctccttccttgatgataatctggtgtaccacatcctgcgtaagcattcagcaaagcgttgtggatgtatt

SEQ ID NO: 12278 - DNA, 633 bp, Artificial Sequence
  Description of Artificial Sequence: Synthetic coding sequence
atgaaactgtgggacgtggttgcagtttgtctggtccttctgcacaccgcatccgcctttcctctgcccgcaggcaagcggcccccagaagcgccagcagaggatcggagccttggccgcagacgggcacccttcgcactttcgtcggattcgaatatgcccgaagattacccggatcagtttgacgatgtgatggactttattcaagcaactattaagaggcttaagcgcagcccagataagcagatggccgtgctgcctcgtcgggaaagaaatagacaagccgccgcagcgaatcctgagaactcccgtggtaaaggtaggcgggggcaaaggggtaaaaacagggggtgtgtgctgaccgccatccatcttaatgtgaccgatctcggattgggatacgaaaccaaggaggaactgattttccgctactgtagcggatcctgcgacgcagcggagacgacttacgataagattctgaaaaacctttccagaaatagacgcttggtgtcggataaagtcggacaggcctgttgtagacctattgctttcgacgatgatctgtcttttcttgatgacaatcttgtgtaccatatcctcagaaagcattctgctaagaggtgtggatgtatt

SEQ ID NO: 12279 - DNA, 633 bp, Artificial Sequence
  Description of Artificial Sequence: Synthetic coding sequence
atgaaactctgggacgtggtagctgtctgcctcgtcctgcttcacaccgcatctgccttcccactccccgccggcaagcggcctcctgaagctcctgcggaagataggtccctgggtcgtagacgtgctcctttcgccctctcttctgactctaacatgcctgaagactatccggaccagtttgacgatgtgatggactttatccaagccaccattaagaggctgaaaagatcccccgataagcagatggcagtgctgccgaggagagaacggaatcgacaggccgccgctgcaaatccagaaaactcaagagggaaagggcgtcgaggtcagagggggaaaaacaggggatgcgtgttaaccgcaattcacttgaatgttacggacctgggcctgggttacgagaccaaagaagaactcattttcagatattgcagcggttcgtgcgacgccgctgaaacgacatacgataagatactaaaaaacctgagtcgaaatcgaagactcgtttcagacaaagtgggccaggcatgttgtcgcccaatcgcgttcgatgacgacctgtcctttctcgacgataaccttgtataccatatcctgcgaaagcatagtgctaagagatgtggctgcata

SEQ ID NO: 12280 - DNA, 633 bp, Artificial Sequence
  Description of Artificial Sequence: Synthetic coding sequence
atgaaattgtgggacgttgttgctgtctgtctggtgttgttgcacacagcttccgctttccccctccccgcaggaaaaagaccacctgaagccccggcggaagatagatccctgggccgcagaagggcaccctttgctctgtcatcagactcaaacatgccagaagactatcccgatcagtttgacgatgtgatggattttatccaggcaactatcaaacggctcaaacggagtccagataagcaaatggccgtgcttccgcggagagagcggaatcggcaagcggcagcagctaatcctgagaattcaaggggaaagggtcgcaggggccaaagaggcaaaaaccgaggttgcgtattaaccgcaatccacttaaatgttacagatttaggcctagggtacgagaccaaagaggagctcatcttccgttactgcagtggtagctgtgacgctgcagagacaacatacgataaaattttgaaaaacttgtcccgcaaccgccggctggtgagcgacaaggtaggccaggcctgctgcaggcctattgctttcgatgacgatttgagtttccttgacgacaacctggtataccacatactgcggaaacacagcgctaaacgctgtggctgtatc

SEQ ID NO: 12281 - DNA, 633 bp, Artificial Sequence
  Description of Artificial Sequence: Synthetic coding sequence
atgaagctgtgggatgtggtcgctgtctgcctggtgcttttgcatacggcatccgctttcccattgcccgcgggaaagcggcctcccgaggcacctgccgaggaccgctccttgggcagacggcgcgccccgttcgcactgtcgtcggattccaacatgccggaagattacccagatcaatttgatgacgtcatggatttcatccaggcaactatcaagagacttaaacgctcaccggataagcaaatggcggtgctgccgcgtagagagaggaatagacaggccgcggcggcgaatccggaaaatagtaggggaaagggccgcagaggtcaaagagggaagaacagagggtgtgtgctcaccgcgatccatctgaacgtgacggacctcggtctgggatacgagactaaagaagaactgattttcaggtactgctcagggtcgtgcgatgccgccgaaaccacgtatgacaaaatcctcaaaaatctgagccggaatagacggttggtgtcagacaaggtgggccaagcgtgctgtcggcctattgcctttgacgacgatctgtcatttctggacgacaacctggtctaccacatcctgcgcaagcactccgccaagagatgcggatgcatc

SEQ ID NO: 12282 - DNA, 633 bp, Artificial Sequence
  Description of Artificial Sequence: Synthetic coding sequence
atgaaactgtgggacgtggttgctgtctgcttggtgcttctccacaccgcctccgccttcccccttcctgccggcaagaggccgccggaggctccggctgaagatcgttctctcggtcggaggcgcgcccctttcgccctctccagcgactccaacatgccggaggactacccggatcagttcgacgacgtcatggacttcatccaggcaaccatcaagcgactcaagcgctctcctgacaaacagatggctgtcctcccaagacgcgagcgcaatcgtcaagcagctgctgcgaaccctgagaactccagaggtaaaggcaggcgaggccagcgtggaaaaaacaggggctgcgtactgaccgctattcacttgaacgtgaccgatctgggtctgggctacgagactaaagaggagctgatttttcgatactgtagcggctcttgcgatgcggctgagactacctacgacaagatcctgaagaacctatcccgcaaccgcaggttggtgtcagacaaggtcggtcaggcctgttgccgccctatcgcctttgacgatgacctatctttcttggacgacaacctcgtttatcacatattgaggaagcactctgctaagcgttgcggttgtatt

SEQ ID NO: 12283 - DNA, 633 bp, Artificial Sequence
  Description of Artificial Sequence: Synthetic coding sequence
atgaagctgtgggatgtcgtggctgtgtgcttggtgcttctgcatacagcatccgcgtttccgcttcccgcaggcaaaaggcccccggaggcgcctgccgaggatagaagccttggtaggcgccgtgccccatttgccctgagctctgattctaatatgccagaggattaccctgaccagtttgacgacgttatggactttatccaggcgaccatcaaacgtctgaagcggtcccccgataaacagatggccgtgttaccccggcgcgaacggaaccgacaagcggccgcggccaatcctgagaactcccgcggcaagggaaggcgggggcagcgggggaaaaaccgagggtgcgttttgactgccatccatttgaacgtgacagacctcgggctgggatacgaaacaaaggaagaactcattttccgctactgctccggaagttgcgatgctgccgagacaacctacgataagattctcaagaacctatccagaaatcgtcggctggtcagcgacaaggtgggccaggcctgctgccggcctattgcgttcgacgacgatctgagctttctggacgataacttagtgtatcacatcttgcgcaagcatagtgctaagcggtgtgggtgcatc

SEQ ID NO: 12284 - DNA, 633 bp, Artificial Sequence
  Description of Artificial Sequence: Synthetic coding sequence
atgaagctgtgggacgtggttgccgtttgcctggttctactgcataccgcaagcgcttttcccttgcccgccggcaaaaggccaccagaagccccagccgaagacaggtcccttggacgtcgccgggcgcccttcgccctctcaagcgattctaacatgccggaagactaccccgatcagtttgatgacgtgatggattttattcaagctaccattaagaggttaaaaaggtcacctgacaaacagatggccgttctgccacgacgggagagaaataggcaagccgccgccgcaaatccggagaattctaggggaaaaggtaggaggggtcagagaggaaagaacaggggctgcgtgctaaccgcaattcacctgaatgtgactgacttgggccttgggtacgaaaccaaggaagaactcatttttagatattgcagtgggagttgtgatgctgctgagacaacttacgataagatcctgaagaacctcagtagaaataggcggctggttagcgataaggtgggccaggcatgctgccgacctattgcatttgatgatgacctgtcattcctggacgacaacttagtgtatcacattctgagaaaacattcagcgaaacgatgtgggtgtata

SEQ ID NO: 12285 - DNA, 633 bp, Artificial Sequence
  Description of Artificial Sequence: Synthetic coding sequence
atgaagctttgggacgtagtagcagtctgcctggtgctgcttcacacagcctctgcctttcctctaccggcgggcaaaagaccacctgaggcgccagctgaggaccgttcactcggtagacgtagagcaccgtttgctttatcctctgactcaaacatgcccgaggactaccccgatcagttcgacgatgtcatggactttattcaggccacaattaagaggctcaaacggtcccccgacaagcagatggccgtactacccagacgggagcggaatcggcaggccgctgcagccaaccccgagaacagtcgaggtaaaggcaggcgagggcagaggggtaagaatagggggtgtgttctcaccgcaattcacctgaacgtgacagacctgggcctgggttacgaaaccaaagaagagctcatctttcgctactgtagcggatcctgtgacgcagccgaaactacttatgataaaatactgaaaaacctgtcccgaaacaggcgattagtctctgataaggtggggcaagcatgttgtcggcctattgctttcgacgacgacttgagctttttggacgataacctggtgtaccacattctgcgaaagcatagcgcaaagcgttgcggttgtatc

SEQ ID NO: 12286 - DNA, 633 bp, Artificial Sequence
  Description of Artificial Sequence: Synthetic coding sequence
atgaaactgtgggacgtggtggcggtatgcttggttctgctgcacacggcatcggccttccctctgccggccggaaaaagaccgccagaggcccctgccgaggatagatccctgggacggcgtagagcgccgttcgccctgtcatcagactcgaatatgccggaggactaccctgaccagtttgacgatgtcatggacttcatccaagcaactataaagagacttaagcgctcgccagataagcaaatggccgtgctgccgagacgcgaacgcaaccggcaggcagctgcagccaatccggaaaattccaggggcaaaggaaggaggggccagagaggcaagaaccgaggctgtgtgctcactgccatccacctgaacgtgaccgacctgggcctcggctatgagactaaggaagaattgattttcagatactgctcaggaagctgcgatgccgctgaaaccacgtacgacaaaatcctcaagaacctgtcaagaaatcggcgactcgtctcggataaggtgggacaggcttgctgccgcccgatcgcttttgatgatgatctgtccttcttggacgacaatctcgtgtaccatattctgcggaagcattccgctaagcggtgtgggtgtatc

SEQ ID NO: 12287 - DNA, 633 bp, Artificial Sequence
  Description of Artificial Sequence: Synthetic coding sequence
atgaagctgtgggacgtggttgcggtttgcctggtgctgctccatacggcgtccgcgttccctctccctgccggcaagaggccgcccgaggctccagccgaggaccgctcactcggtcggcgtagagccccgttcgctctgtcctcagattccaatatgcctgaagattatccagatcagtttgacgacgtgatggacttcatacaggcaacgattaagcggctcaagcgaagcccagataagcagatggccgtgctcccgcggcgggagagaaacaggcaggcagccgctgctaatccggagaacagcaggggtaaaggacggcgcggacaacgggggaagaatcgcggatgtgtcttgactgcaatccatctgaatgtcactgatctcgggctgggatacgaaaccaaagaagaactgatcttcagatactgctcaggatcttgcgatgcagcagaaactacctacgacaaaattctgaagaacctttcgcgcaaccggcgactcgtttctgacaaggtgggacaagcatgctgccgaccgatcgcatttgacgacgacctgtccttcttggatgacaaccttgtctaccacatcctgcgcaaacacagcgcgaagcggtgtggttgcatc

SEQ ID NO: 12288 - DNA, 633 bp, Artificial Sequence
  Description of Artificial Sequence: Synthetic coding sequence
atgaagctgtgggatgttgtggcagtatgcctggttctgctgcacacggcctcagcctttcctcttccggctggcaaaaggccgcctgaagctcccgccgaggacagaagcttaggacgacgccgagctccctttgccctctcatccgatagtaacatgccagaggattaccctgaccagttcgatgacgtgatggatttcattcaggcgactattaagagactgaagagatccccggataagcagatggccgttttaccccggcgggagcgtaaccgccaggcagcagcagccaaccctgagaactcacggggcaaaggccgtcggggccagagagggaagaatcgaggctgcgtacttacagccatccatctcaacgtgaccgatctggggctggggtacgaaaccaaagaggaacttatctttcgatactgtagcggcagctgtgatgccgccgaaacaacctacgataagatactaaagaatctttccaggaaccgacgtctcgtgtctgacaaggtgggccaagcctgttgccggccaatcgccttcgatgacgatttgtcattcttggatgacaatctggtctatcatattctccgtaagcattccgctaagcgatgtggctgtatt

SEQ ID NO: 12289 - DNA, 633 bp, Artificial Sequence
  Description of Artificial Sequence: Synthetic coding sequence
atgaagttgtgggatgttgtcgcagtttgtcttgttttattgcacaccgcctcagcatttccgctccccgctggaaagcgacctccggaagctccagctgaagatagaagcctaggtcgtaggcgcgctccttttgcattgtcttccgactccaatatgcctgaggactaccccgatcaatttgatgacgtgatggatttcattcaagctaccatcaagcgattaaagaggtctcctgacaaacaaatggcggtattgccacgtcgagagaggaaccgacaagctgcggctgcaaacccggaaaacagtcgaggcaagggtagacgtggacagcggggtaaaaaccgtggatgtgtactaaccgcaattcatcttaatgtcactgacttgggacttggttatgagaccaaagaagaacttattttcagatactgctcaggttcgtgcgatgctgcagaaacgacatacgataaaattttgaaaaatctctcaaggaacaggcgccttgtttctgataaagttggacaggcgtgttgccgtccgattgcattcgatgatgatctgtcgttcttggatgacaatttagtttatcacatcttgcgtaaacattctgccaaaagatgcggttgcata

SEQ ID NO: 12290 - DNA, 633 bp, Artificial Sequence
  Description of Artificial Sequence: Synthetic coding sequence
atgaagctttgggacgtcgtcgccgtctgccttgttctgctgcataccgcctctgcttttccactgcctgcagggaaaagaccaccggaggccccagcggaagacagatccctcggtcgaaggcgggccccgttcgcattgtcttctgatagtaacatgcctgaggattacccagaccagttcgatgacgtcatggatttcattcaagcaacaataaagaggctgaagcgatctcctgacaaacagatggctgtcctgccccggcgcgagagaaaccgccaagccgcggcagcgaatcccgaaaacagccgagggaaaggacgccgcgggcaaagaggcaaaaatcgtggctgcgttctgactgcaatccatttgaatgttacagatctcggcctgggatacgaaaccaaagaggaactgattttccgctattgctcgggatcttgtgacgcggctgagactacatacgataagattctgaaaaacctgagtcggaatcgacgtctagtgtctgataaggtcggacaagcttgttgtaggcctatagcatttgacgatgacttatctttccttgacgacaatctggtgtatcacatactgcggaaacatagcgctaagagatgtggctgcatc

SEQ ID NO: 12291 - DNA, 633 bp, Artificial Sequence
  Description of Artificial Sequence: Synthetic coding sequence
atgaagttgtgggacgtggtggctgtctgcctcgtgctgctccacactgcctccgcgttccctttgccggccggaaagaggccgccggaggcccccgcagaggaccgctcgttgggacgtcgcagagcaccattcgcgctttcatctgattcgaacatgccagaagattacccggaccagtttgatgatgtcatggatttcattcaggccaccattaagcggctgaagcggtcaccagataagcagatggctgttctgcccagaagagaacgcaataggcaggccgcagccgctaaccccgaaaacagcaggggcaaaggacggagaggtcagcgcggtaagaacaggggatgtgtgctgaccgctatccacctgaacgtcactgacctgggcctgggatatgagactaaagaagaactgatcttccggtactgcagcgggtcatgcgacgctgcagaaactacgtacgataagatcctgaaaaacctgtcgcggaataggcgacttgtgtcagacaaagtcggtcaggcgtgttgcagacctattgctttcgatgatgatctctccttcttggacgacaacttggtgtaccacatcctgagaaaacactccgcgaagcgctgcggatgtatc

SEQ ID NO: 12292 - DNA, 633 bp, Artificial Sequence
  Description of Artificial Sequence: Synthetic coding sequence
atgaaattgtgggatgtggtggcggtgtgcctggtgctcctccacacggcctccgcgttccctctgccggctgggaagcggccgccggaagccccagccgaggataggagcctgggccgccggagagctccgttcgccctctcgtccgactctaatatgccggaggactatccagatcaattcgacgacgtgatggacttcatccaggccactatcaagcggctgaaacgctcaccggacaagcaaatggcagtgcttccccgccgggaacggaatcggcaggcagccgccgctaatccagagaactcacgcggtaagggacggcggggccaacgaggaaagaaccgcggctgcgtacttaccgccatccacttgaacgtgactgacttgggattggggtacgaaaccaaggaggagcttatctttcgctactgctccggatcgtgtgatgcagctgaaaccacctacgacaagatcctgaagaatctgtcgaggaaccgcagactggtgagcgacaaggtgggacaagcatgctgcagacctatcgcgttcgatgacgacctgtcctttctggacgacaatctggtgtaccatattctccgcaagcactcggcaaagcgatgcggatgcatt

SEQ ID NO: 12293 - DNA, 633 bp, Artificial Sequence
  Description of Artificial Sequence: Synthetic coding sequence
atgaagttgtgggatgttgtggcagtttgtcttgtgctacttcataccgcaagtgcgttccctctgccagccggaaaacgaccacctgaagcacctgccgaggaccgttcccttggaaggaggagggcaccattcgccctttcttctgattctaacatgcctgaagattatcccgatcaattcgatgatgttatggactttattcaggcaactatcaaaagattgaaacgtagtccagacaaacagatggctgtgttgccaagaagagaaagaaacagacaagctgctgccgctaacccggagaattcaagagggaagggccgtcgtggtcaacgggggaaaaaccgaggatgcgtgctcactgcgatacacctgaacgtgacagatctgggtttggggtatgagaccaaggaagagctcatctttcgttattgttctgggagttgtgacgctgccgaaaccacctatgataagattttaaagaacctcagccgtaatcgccgccttgtttcagacaaggtgggtcaggcttgctgccgacctatagcattcgacgatgatcttagcttccttgatgacaaccttgtatatcatattctgagaaagcatagcgcaaagcgttgtggttgcatc

SEQ ID NO: 12294 - DNA, 633 bp, Artificial Sequence
  Description of Artificial Sequence: Synthetic coding sequence
atgaagctatgggatgtggtcgcagtctgcctggtcctgcttcacaccgccagcgcctttccactgcctgctggtaaacggcctccggaagcaccagccgaagatcgtagtctgggcaggaggagggcgcccttcgcactgagttcagattcaaacatgccagaagactaccccgaccaattcgacgacgtcatggactttatccaggcaacgatcaagcgtcttaagcgaagtcccgacaaacagatggctgttctgccgaggcgagaacgcaaccgacaggccgcagccgccaatcctgaaaactcgcgcggcaagggacgaaggggccagcgcggcaaaaacaggggatgcgtgctgactgcgattcatttgaacgtgactgatcttggcctgggttacgagaccaaagaggagttaatatttcgttattgtagcggctcatgtgacgctgccgaaactacctacgacaagatactgaaaaatctttctaggaatcggcggctggtctcggacaaagtcggtcaggcttgctgcagaccgatagcctttgatgatgacttgagcttccttgatgacaaccttgtctaccatatcctacggaaacactccgctaaacgctgtggctgcatt

SEQ ID NO: 12295 - DNA, 633 bp, Artificial Sequence
  Description of Artificial Sequence: Synthetic coding sequence
atgaagctgtgggatgttgtggccgtgtgcctcgtcttgctgcatacagcatcagctttcccactgcccgcaggaaaacgtccacctgaggcccccgctgaagaccgcagtctgggccgtcgccgcgctcccttcgcattgtctagcgattctaacatgcctgaagattacccagaccagttcgatgacgtgatggatttcatccaggccactatcaagcgcctcaaacgttcacccgacaagcagatggcagtgctgcctcgtagagaaagaaaccgtcaagctgcagccgctaaccccgagaatagtaggggaaagggtcgcagaggccaaaggggcaagaaccgtggttgcgtccttacagctatccatttgaacgtaaccgacctcggcctgggttacgaaaccaaggaggagctgatctttcgttactgctctggatcctgcgatgccgccgaaaccacctatgacaagatcctgaaaaacttgtcacgcaacagacgtctggttagcgataaagttggtcaggcctgctgtcgccccattgcctttgacgatgacctttctttcctggatgacaaccttgtgtatcatatactgcgtaagcactccgccaaacgctgcggctgcatc

SEQ ID NO: 12296 - DNA, 633 bp, Artificial Sequence
  Description of Artificial Sequence: Synthetic coding sequence
atgaagctgtgggatgtggtcgcagtgtgcctggtgctgctgcacaccgcgtctgcattcccgctgccagcaggtaaaagaccgcctgaggcaccagcagaagatcgctcgttgggcagaagaagagcacccttcgctctgtcaagcgatagtaacatgccagaagattatcctgatcagtttgatgacgtcatggacttcatccaagctaccataaaacggctcaaacggtccccggacaagcagatggcagtgctccctaggagagaaagaaatcgacaagccgcagcggcgaaccctgaaaattcgcgaggcaagggacggcgtggtcagcgcggaaaaaacagggggtgtgtgctgacggccattcatcttaacgtgactgatctgggtctgggatacgaaaccaaggaggaacttatctttcgctactgttctggatcatgtgatgcggctgaaactacctacgataagatcctgaagaacctctcccgcaatagaaggcttgtgtcggacaaggtcggacaagcatgttgccgcccgattgcatttgacgacgatctctcctttcttgacgataacctcgtataccacatacttagaaagcattcggcaaaaagatgtggttgcatc

SEQ ID NO: 12297 - DNA, 633 bp, Artificial Sequence
  Description of Artificial Sequence: Synthetic coding sequence
atgaaactttgggacgttgtcgcagtatgtcttgtgctgctgcacactgcaagcgcatttccgctgccagccggtaaaaggcctcctgaggctccggcggaggatcgatcgctgggccgtcgacgggccccatttgccctgtcgtcggattcaaatatgccagaggactatcctgatcaatttgacgatgtgatggatttcatccaggcaaccataaagcgtctcaagaggagtccagacaaacagatggcagtgttgccacgccgtgagaggaacagacaagcagccgcagctaaccccgaaaatagccgcgggaagggtcgccgcggacaaagaggaaagaatagagggtgcgtgcttactgcaattcatctcaatgtcaccgaccttggcctcggttacgagactaaagaagaattgatcttccgctactgtagcggctcgtgtgacgccgcagaaactacctacgacaaaatcctgaaaaacctttcaagaaacaggcggcttgtctcagataaggtggggcaagcatgttgcaggccaatcgcctttgatgatgatttgtccttccttgatgataatctcgtgtaccatattcttaggaagcactccgccaagcgatgtggttgcatt

SEQ ID NO: 12298 - DNA, 633 bp, Artificial Sequence
  Description of Artificial Sequence: Synthetic coding sequence
atgaaattgtgggatgtcgtcgccgtgtgcctcgtgcttctacataccgccagcgcattccctctgcctgccggaaagcgaccccccgaggctccagcagaggacagatctctggggcgtaggcgggctccttttgctctgtccagcgattctaacatgcccgaagattatccagatcagtttgatgacgtaatggacttcatccaggctaccatcaaaagattgaaacggtcccccgacaagcagatggccgtgctcccccggcgagagcggaatcggcaggccgccgccgctaacccagaaaactctaggggcaaagggcgacgggggcagagaggcaaaaacaggggctgtgtgttaaccgcaatacacctgaatgtaaccgatctcggcctcggatatgagacaaaagaggagctgatcttccggtactgtagtggatcctgcgacgccgcagagaccacctacgacaaaatcctgaagaatctgtccaggaacagacgcctggtgtccgataaggtcggtcaggcttgctgccggcccatagccttcgatgatgacctgagcttcctagatgacaacctggtttaccacattctgcggaaacacagcgccaagaggtgcggctgcatc

SEQ ID NO: 12299 - DNA, 633 bp, Artificial Sequence
  Description of Artificial Sequence: Synthetic coding sequence
atgaagctgtgggacgtggtcgcggtgtgtctggtgcttctccatactgcatcggcgttcccgctgcccgcaggaaagcggccgccggaggcccctgctgaggaccgctccctgggacggagacgcgcgccattcgcgctctccagcgactccaacatgcctgaggattatccggatcagttcgacgacgtgatggatttcatccaagcaactatcaagaggttgaagcggagcccggataagcagatggccgtcctgccaaggcgggagcggaacaggcaggccgccgcagcgaacccggagaactcgaggggcaagggcagacggggacaacgcggaaaaaaccgcggatgcgtgcttaccgctatccacctgaatgtcaccgatctcgggctgggctacgagacgaaggaagaacttatcttccgctactgcagcggatcctgcgatgctgctgaaaccacgtacgacaagattctgaaaaacctttcacgcaatcggcggctcgtctccgataaggtgggacaggcctgctgccggcctattgcattcgacgacgatctgtcctttctcgacgataatctggtctaccacatcctgaggaagcatagcgccaagcggtgcggatgcatt

SEQ ID NO: 12300 - DNA, 633 bp, Artificial Sequence
  Description of Artificial Sequence: Synthetic coding sequence
atgaagctatgggatgtggttgctgtttgcctggtcctgctgcatactgccagtgcgtttccactgcccgccggcaagcgcccgcccgaggcccccgcagaggatcggagtcttggtcggcgcagggcgcctttcgctctttctagtgacagcaatatgccggaagactaccccgaccaattcgatgacgtcatggacttcatccaggcgaccattaagaggctgaaacgatccccagataagcagatggcagttctgcctcgtcgtgaaaggaacagacaggctgctgccgctaacccagagaattcacgggggaagggcagaaggggccagcgaggcaaaaaccggggatgcgttctgaccgctattcatctgaatgtaactgacttgggattagggtatgagaccaaggaggagctgattttccggtattgcagcggttcctgtgatgctgcagagactacctacgataaaatcctgaaaaatttgtctagaaacagacggcttgtctcagataaagtgggacaagcgtgctgcagaccaattgccttcgatgacgacctgtccttcctcgatgacaatctggtgtaccacatcctgcggaagcactctgccaaaagatgtgggtgcatc

SEQ ID NO: 12301 - DNA, 633 bp, Artificial Sequence
  Description of Artificial Sequence: Synthetic coding sequence
atgaaactctgggatgtggtggcagtgtgtttggttcttctgcatacggcatctgcgtttcctcttcccgccggtaagaggccacctgaagcacctgcagaagatcggtcccttggacggcgaagggcgccttttgcactctcttccgacagcaacatgccagaggattacccagaccaatttgatgacgttatggacttcattcaagctaccatcaaacggcttaagagatcgccggataagcagatggcggtgcttcctagaagagagcggaacagacaggccgccgccgctaacccagagaactcgagaggaaagggtcgtagaggacagagagggaaaaacagaggctgtgtcctcactgcgattcatctcaacgtcacggatctgggacttggatacgaaaccaaggaagaactgatctttagatactgttcgggctcatgtgatgcagctgaaactacgtatgataagattctcaagaatttgtcacggaaccggaggctggtgtccgataaagtgggtcaagcctgctgtagacccatcgctttcgatgatgacctgtccttccttgatgacaacctggtgtaccatatccttcgaaagcatagcgcaaagcggtgcggttgtatt

SEQ ID NO: 12302 - DNA, 633 bp, Artificial Sequence
  Description of Artificial Sequence: Synthetic coding sequence
atgaagctctgggacgttgtggcagtctgccttgtcctgcttcacactgcctccgcctttcctctccctgcaggaaagcggcctccggaagcacctgctgaggaccggagcctgggccgcaggagggccccttttgcactgagctccgactcaaacatgccagaggattacccagatcagtttgacgacgtaatggacttcatacaggcaacgatcaagcggctgaagcgcagccccgataaacagatggctgtgctgccccgacgggaaagaaaccgacaggctgctgcagcaaaccctgagaatagccgaggtaaaggacgacgcggccagcgcggcaagaataggggttgtgtattgaccgctatacaccttaacgtgacggatctcggattgggttatgagaccaaggaagagctgatcttccgatattgctctggatcttgtgatgcagccgagacaacatacgataagatcctcaagaacttgtcaaggaataggaggcttgtcagcgataaagtcgggcaggcatgttgtcgccccattgcctttgatgacgatctgtcttttctggacgacaacctggtgtatcatatcctgcgaaaacacagtgcaaagcgctgtgggtgcatc

SEQ ID NO: 12303 - DNA, 633 bp, Artificial Sequence
  Description of Artificial Sequence: Synthetic coding sequence
atgaagttgtgggacgtggtggccgtgtgccttgtgcttttgcatactgccagcgccttccccctccctgctggaaagcggccaccggaggcccccgccgaggataggtctctcgggcgcagaagagcaccattcgcactgagttcagacagcaacatgcccgaggattaccctgaccagttcgatgatgtcatggactttatacaagctaccattaaaaggctgaagcggtctccagacaagcagatggccgtcctacccagacgagagcgtaacagacaggccgccgcagccaaccctgaaaattcaagagggaagggaaggaggggccagaggggcaaaaataggggctgtgtgctcacagcaattcacctcaacgtgaccgatttgggattaggatatgagacaaaggaggagctcatttttaggtattgctcaggtagctgcgatgccgccgaaacaacctacgacaagatattgaagaacctgagccgaaaccggcgactcgtgtccgacaaggtgggccaggcttgctgcaggcctatcgcctttgatgacgatctgagcttcctggacgacaatctggtctatcacattttacggaaacactcggccaagaggtgtggctgcatc

SEQ ID NO: 12304 - DNA, 633 bp, Artificial Sequence
  Description of Artificial Sequence: Synthetic coding sequence
atgaaactgtgggacgtggtagctgtgtgcctggtgctactgcacactgccagtgcattcccactcccagccgggaaacgccccccagaagcccccgctgaagaccgcagtctaggaagaaggagagcccctttcgccctgagttccgattccaacatgccagaagattacccagatcagttcgatgatgtgatggattttattcaggccacaatcaaaagactgaaaagatctcctgataagcagatggccgtgttgccccgccgggaacgaaatcgccaggctgccgcagccaaccccgagaattcccggggaaagggacggcggggacagcgagggaaaaacaggggatgcgtgctcactgccatccacctcaatgtgactgatctggggttagggtacgaaacaaaagaagagctgatatttcggtactgctctggaagttgcgatgctgccgaaactacatatgacaaaatactgaaaaacttgtcccgcaatagacggctcgtgtccgataaagtcgggcaggcctgttgtcggcccatcgcctttgatgatgatctctcctttctagatgataatttagtctatcacatcctgcggaagcatagtgcgaaacgctgcgggtgtatc

SEQ ID NO: 12305 - DNA, 633 bp, Artificial Sequence
  Description of Artificial Sequence: Synthetic coding sequence
atgaaactgtgggacgtggttgcagtgtgtctggtcctcttgcataccgcgtccgcgtttcctctgccagcaggaaaaagacctcctgaagcccccgcagaggatcggagccttggaagaaggcgcgctccatttgcactttcgagcgactcgaacatgcccgaggactacccggaccagttcgacgatgtgatggacttcatccaagcaacgattaagcggcttaagagatccccagacaagcaaatggctgtgctccctcggcgtgagagaaatcgccaggcagccgccgccaatcctgaaaattctcgaggtaaaggtagaagaggccagcgcggcaagaatcgaggatgcgtgctgactgcaatccacctgaacgtgaccgatctgggactgggatacgaaaccaaggaggagctgatatttcgctactgttccggttcatgtgatgcggccgagacgacttacgacaagatcctgaaaaatctctcccggaacagacgtctcgtgtcagataaggttggccaggcttgttgccgtcctattgcctttgatgacgatctctccttcctcgatgacaatctcgtctatcatattctcaggaaacattctgccaaaaggtgtggatgtatc

SEQ ID NO: 12306 - DNA, 633 bp, Artificial Sequence
  Description of Artificial Sequence: Synthetic coding sequence
atgaagctctgggacgtggtggccgtgtgtctggtgctgctccatactgcctccgcttttcctctgccggcggggaagaggccgccagaagctccagccgaggaccgatcactgggacggcgcagagctccgtttgccttgtcgagcgattccaatatgccagaggactacccggaccaattcgatgacgtgatggactttatccaggcgactatcaagcggctcaaaaggagcccagataagcagatggccgtgttgccgcggcgcgaaagaaaccggcaggcagcggccgcgaaccctgaaaactcccgaggaaaaggacgacggggccagcggggaaaaaaccggggctgtgtcttgaccgcaatccacctgaacgtcactgatctgggtctggggtacgaaaccaaggaagagctcattttccgctactgctcaggctcttgcgacgcagcagagactacctacgacaagatactcaagaatttgtcgcgcaatagacgcctggtcagcgataaggtcggacaagcatgttgccgcccgatcgcattcgatgatgacctttcgtttctggacgacaatctcgtctaccacattttgcggaaacattccgccaaacggtgcggatgcatc

SEQ ID NO: 12307 - DNA, 633 bp, Artificial Sequence
  Description of Artificial Sequence: Synthetic coding sequence
atgaaactgtgggacgtggtggcggtctgcctcgtgctgctgcatacagctagtgcatttcccttgcctgccgggaagcgcccccctgaggctcctgccgaagaccgaagcctggggagaaggcgggccccattcgctttgtcttctgatagtaatatgcctgaagactaccccgatcagttcgacgacgtgatggatttcattcaggctacaatcaaacggcttaagagaagccccgataagcagatggctgtcctgcctcgcagagaaagaaatcgtcaggccgcggctgccaaccccgagaatagccgcggcaaaggccgtcgtggacagagaggcaagaaccgcggatgtgtcctgacagctatccaccttaacgttaccgacctgggtctaggctacgaaactaaggaggagttgatcttcaggtactgctcaggatcctgcgacgccgctgaaacgacttacgacaaaatactgaaaaacttgtcacgcaacagacggttagtcagtgataaggtaggccaggcgtgttgtcggcctatcgcatttgatgacgatctctcgtttcttgatgataacttggtgtatcatatcctgcgcaaacactcggctaagagatgcggctgtatc

SEQ ID NO: 12308 - DNA, 633 bp, Artificial Sequence
  Description of Artificial Sequence: Synthetic coding sequence
atgaaactctgggacgtcgttgcggtgtgcctcgtccttctgcacactgcctcagcgttcccactgccagccggtaaaagaccgcctgaggctcccgcggaagatcgatcgcttggacggcgccgcgccccttttgcactgagctccgactcaaacatgccggaggactacccggaccaattcgatgacgtgatggattttatccaggcgacgattaagagattgaagcgctcgccggacaagcagatggccgtgctgcccaggcgtgagagaaatcggcaagccgctgcagccaacccggaaaatagccgcgggaagggcagacgcggccagaggggaaagaaccggggctgtgtgctcactgcaattcatctgaacgtcaccgatctcggactgggatacgaaaccaaagaagagctgatcttcagatattgctccggatcttgcgacgccgccgaaaccacttacgacaagatcctcaagaacttgtcgcggaacaggcggctggtgtcggacaaggtggggcaggcatgttgccgcccaatcgctttcgacgatgacctgtccttcttggatgataatctggtgtaccacatcctccgcaagcatagcgcgaaacggtgcggatgcatc

SEQ ID NO: 12309 - DNA, 633 bp, Artificial Sequence
  Description of Artificial Sequence: Synthetic coding sequence
atgaaactgtgggacgtggtggcggtgtgcctcgtcttgctgcacaccgccagcgccttccccttgcctgctgggaagaggccgccagaagcgccagccgaagacagaagcctgggcagaagacgcgccccgtttgcactgtcctccgacagcaatatgccggaggattaccccgaccagttcgatgacgtcatggactttatccaagccaccatcaaacggctgaagcggtcgcctgataagcagatggcggtgctcccgcgccgggaaaggaaccgacaagctgcggccgcgaaccctgaaaactcgcgcggaaaaggaagaagagggcagcggggtaaaaatcgtggatgtgtgctgaccgccattcaccttaacgtcaccgacctgggccttgggtacgaaaccaaagaagaattgattttcagatactgctcgggttcgtgcgacgccgcagaaactacttacgacaagatcctgaagaatctgtcgagaaacagaaggctggtgtcggacaaggtggggcaggcttgctgcagaccgatcgctttcgacgacgacctgtcgttcctcgacgataacctcgtctaccatattctgcgcaaacactcagcgaagcggtgcggatgcatc

SEQ ID NO: 12310 - DNA, 633 bp, Artificial Sequence
  Description of Artificial Sequence: Synthetic coding sequence
atgaagctgtgggacgtggttgcagtgtgccttgtcctgctgcatactgcatcggcattccccctgccagctgggaagcgcccgccagaagcccctgccgaagatcggtcactcggtcgtcgtagagccccatttgcactgtcctcagatagcaacatgccggaagattaccctgatcagtttgacgatgtgatggactttatacaagcaaccatcaagcggctgaagagatccccggacaaacaaatggcggtgctgccacgacgagagaggaatcggcaggcagcagcagcaaatccagagaactcgagaggcaaagggcgccgcggacaacgggggaaaaaccgcggatgcgtcctgaccgcgatccatcttaatgtgacggatcttgggctgggatacgaaactaaggaggaacttatctttcgctactgttcggggagctgtgacgcagccgaaacgacctacgacaagatccttaagaatctgtccagaaataggaggctggtgtccgacaaggtgggtcaagcatgttgtcgacccatcgcatttgacgatgatctgtcgttccttgatgacaatctggtttaccacattcttcggaaacattcggcaaagagatgtggttgtatc

SEQ ID NO: 12311 - DNA, 633 bp, Artificial Sequence
  Description of Artificial Sequence: Synthetic coding sequence
atgaagctgtgggatgtggtggcagtctgtctggtgttgcttcataccgcatccgcgtttcctctcccagcaggaaagcgaccaccagaagcaccagcagaggaccgttcgttgggaagaaggagagcaccttttgccctgtcctccgattcaaacatgcctgaagattaccctgaccagtttgacgatgtcatggatttcatacaggccacgattaaacgtcttaagcgcagccccgacaaacaaatggcggtccttccacgaagagaacgtaacaggcaagccgcggccgcaaaccccgaaaactcgcggggcaagggacggagaggtcagcgcggtaagaaccggggctgcgtgcttaccgcaattcatctgaacgtgacggatttgggcctcggttacgaaactaaggaggaactcatctttcgatactgtagcggatcctgtgacgcagcagaaaccacctacgacaagattctcaaaaacttgtcgcgcaatcgtagacttgtgtccgataaggtgggccaggcgtgttgcagacctattgcatttgatgatgacctgtcgttcctggacgacaacctcgtctatcatattctgcggaagcattcggcaaagagatgtggatgtata

SEQ ID NO: 12312 - DNA, 633 bp, Artificial Sequence
  Description of Artificial Sequence: Synthetic coding sequence
atgaaattgtgggacgtggtggcggtgtgcctggttttgctgcataccgcatcagcatttcccctgccagcagggaagcgccctcccgaggctcccgccgaggaccgctctctgggtaggcggcgggcacccttcgcgcttagcagtgatagtaatatgccagaggactaccctgaccagtttgacgacgttatggactttattcaggctacaataaaacgcctgaaacgaagccctgataagcagatggccgtcttgcctcggcgggagcggaacaggcaggcagcagccgccaatccagaaaactctagaggcaaggggagaagaggacagagggggaagaaccgcggatgcgtcttgactgctatccatttgaacgtgacggatttgggtcttggatacgaaaccaaggaagaactcatattcagatattgttctggctcatgtgacgcagctgagacaacctacgataagatcttgaaaaacctgtctcggaatcggcggctggtgtctgacaaggtcggccaggcttgctgcagaccgatcgcctttgacgacgatctgagctttctggatgataatcttgtgtaccacatcttgcggaaacactctgccaagcgctgcggctgtatc

SEQ ID NO: 12313 - DNA, 633 bp, Artificial Sequence
  Description of Artificial Sequence: Synthetic coding sequence
atgaagctgtgggatgtggtggccgtctgcctggtgctgctccataccgcttcagctttccctctccctgcaggcaagaggccgccagaagctccagctgaagatcgctcattgggccggagacgcgccccctttgctctttcgagcgatagcaatatgcctgaagattaccctgaccagttcgacgacgtcatggactttatccaggccactatcaagcggctgaaacgctcgccagataagcagatggccgtgctgccacggcgcgagaggaaccgacaggcggcagccgcgaacccagaaaatagccggggtaaggggcgccggggacaacggggcaagaatcggggctgtgtgctgaccgccatccacctcaacgtgactgatcttgggctgggctatgaaaccaaagaggaactgatattcagatactgttcgggatcttgcgatgcggctgagactacctacgacaaaatcctgaaaaatctctcccgcaaccgccggctggtgtcggacaaggtgggacaagcctgttgccgcccgatcgcgttcgatgatgacctgagcttcctggatgacaacctggtgtaccacatcctgcggaagcacagcgccaaacgatgcggatgcatc

SEQ ID NO: 12314 - DNA, 633 bp, Artificial Sequence
  Description of Artificial Sequence: Synthetic coding sequence
atgaaattatgggacgtggttgcggtctgtctcgttttgctccacaccgcctcagcattccccctgccagccgggaagcggccccccgaggcacccgcagaggatagaagtcttgggcgcaggcgggccccttttgccctgtcttctgattcaaacatgcctgaggactatcctgaccagtttgacgatgtcatggatttcattcaggccacgatcaaacgactgaagcgttcccctgacaagcaaatggcggtcctaccgagaagagaaaggaaccgtcaggctgccgccgctaaccctgagaatagcagagggaagggtcggagaggccagagaggcaaaaaccgggggtgcgttctgacagccattcacttgaacgttacagacttgggtttggggtacgagaccaaagaagaactgatctttaggtactgtagcggatcatgcgacgccgctgagactacctatgacaagattctcaagaacctctctaggaatcgacggcttgtgagcgataaggtcggacaggcctgttgcaggccgatagccttcgacgacgacctgagttttttggacgacaaccttgtgtatcatattctccgtaaacatagcgcaaagaggtgcggatgcatt

SEQ ID NO: 12315 - DNA, 633 bp, Artificial Sequence
  Description of Artificial Sequence: Synthetic coding sequence
atgaaattgtgggacgtggtggccgtgtgcctggtcttgcttcacacggcaagcgctttccccttacccgctggaaagaggccacccgaagctccagctgaagatcgctccctggggagacgtcgcgctcccttcgcactttcatccgatagcaacatgcctgaggattaccccgatcagtttgacgatgtgatggattttatacaggccactattaagcgccttaagcggtcgccagacaaacagatggccgtgctgccccgccgtgagagaaacagacaggcagctgccgctaatccggaaaattcacgaggcaaagggagacgtgggcagagagggaagaatcgggggtgcgtcctaaccgccatacacctgaacgtgacagacttgggcttgggctatgagaccaaggaagagctgatcttccgttattgttctggctcctgcgacgcagcagagacgacatacgacaaaattctcaagaacttatctcggaaccgacggctggtgagcgacaaggtagggcaggcatgttgtcggccaattgcctttgatgacgatttgagttttctggacgataatcttgtgtatcatatattgagaaaacactccgcaaagcggtgcggatgtatc

SEQ ID NO: 12316 - DNA, 633 bp, Artificial Sequence
  Description of Artificial Sequence: Synthetic coding sequence
atgaagctgtgggatgtggtggccgtgtgtctggtgttgctgcataccgccagcgcatttccacttccggctggtaaacgacctccagaggcaccggcggaagatagaagcctcggtaggaggcgcgccccatttgcactgtcgtcagactcgaacatgcctgaggactacccggatcaatttgatgatgtcatggatttcatccaagcgactatcaagagacttaagcggagcccagacaagcaaatggcagttctccctagacgggaaagaaaccggcaggccgccgctgcaaacccagaaaactcccgaggtaaggggagaaggggacagaggggaaagaaccgaggatgcgtgctgactgctattcacctcaatgttaccgatcttggtcttggctacgaaactaaggaagagctgatttttcggtactgttcaggctcatgcgatgcagcagagactacttacgacaaaattctcaagaacttgtctcgcaatcgccgtctcgtcagcgataaagtgggacaggcgtgttgccgcccaatagccttcgatgatgacctcagtttcctggatgataaccttgtgtaccacattctccggaagcactcagcaaaacgatgtggttgtatc

SEQ ID NO: 12317 - DNA, 633 bp, Artificial Sequence; identical to SEQ ID NO: 12315
  Description of Artificial Sequence: Synthetic coding sequence

SEQ ID NO: 12318 - DNA, 633 bp, Artificial Sequence
  Description of Artificial Sequence: Synthetic coding sequence
atgaaactttgggatgtcgtcgcagtgtgtctggtgttgctgcatactgcatccgcattccctctgcctgcgggaaagcgccctcccgaggcccccgcagaagatcgttccctcggccggaggagggccccttttgcactttccagcgatagcaacatgcccgaggactaccctgaccagttcgatgacgtcatggatttcatacaggcaactatcaagcgcctgaagcgatcacctgataagcagatggcagtccttccacgaagagaacgtaatcgccaagcagcagcagcgaaccctgagaattcaagaggaaaggggcggcgtggacagagaggaaagaatcggggatgtgtgttgactgcaatccaccttaacgttaccgatctgggattgggctatgaaaccaaggaggaactgatcttcagatactgttccgggtcctgtgacgcggccgaaaccacctacgataagatcctgaagaatctttctcgaaacagacggcttgtgtcggacaaggtgggtcaagcatgctgtcgccctatagcgtttgacgatgatttgtcattcctcgatgataaccttgtctaccacattctgcgcaagcattcggcaaaaagatgcggttgtatt

SEQ ID NO: 12319 - DNA, 633 bp, Artificial Sequence
  Description of Artificial Sequence: Synthetic coding sequence
atgaaactgtgggacgtcgtggctgtgtgtctggttctgctacacacagcctcagcattcccactccctgcgggcaagcggccaccagaggctcccgcggaggaccgctcgcttggacggcggcgagctccattcgccttgagctcggacagcaatatgcctgaggattacccagatcaattcgatgacgtgatggatttcattcaggcgaccatcaagcgacttaaacgctccccagacaagcagatggcggtgcttccgcgaagggaacgtaatcggcaagctgcagcggcgaatcctgagaattcgcgagggaagggtcgccgcggacagaggggtaaaaaccgaggttgtgtgctcacggccatccacctgaacgtgacggacctcggtctgggctatgagacgaaggaggagctgatcttccgctactgcagcggatcgtgtgatgccgccgagacaacttatgataagatccttaagaacctgagccgcaatcgccgtctggtctctgacaaggtgggccaggcttgctgtcgacccatcgcgttcgatgatgatctcagctttttggatgataacctggtctaccatattctgcgcaagcactccgccaagcgctgcggttgcata

SEQ ID NO: 12320 - DNA, 633 bp, Artificial Sequence
  Description of Artificial Sequence: Synthetic coding sequence
atgaagctatgggatgtcgttgctgtctgcctcgtgctgctccataccgcctctgcttttcccctgccagccggcaaaaggcctcctgaagcccccgcagaggatcggtcacttgggaggcgcagggcgccctttgccctgagctctgattccaacatgcctgaagactaccctgaccagtttgatgacgtgatggacttcatccaggccaccattaagcgactgaaacggtcccccgacaagcagatggctgtgctgcctaggcgtgagcgtaaccgacaggcagcggccgcaaatcccgaaaacagccgcggcaaaggccgtagggggcagaggggcaagaatcgaggatgcgtgctgacagcaattcatctgaacgttactgacctgggattggggtacgagaccaaggaagagctaattttccggtactgcagcgggtcttgtgacgctgccgagacgacttacgacaaaatccttaagaacctgtcgaggaaccggagactggtcagtgacaaagtcggccaagcctgctgccggccaatcgctttcgacgatgatctttctttcctagacgacaatttagtgtaccatattctgaggaaacattctgctaaaagatgcggctgtatc

SEQ ID NO: 12321 - DNA, 633 bp, Artificial Sequence
  Description of Artificial Sequence: Synthetic coding sequence
atgaaactgtgggacgttgtggctgtttgtctggttctgcttcataccgcaagcgcttttccccttcctgcagggaaacggccccccgaggcacctgccgaagatcgctccttgggcagacgccgcgctccattcgcattgagtagcgactcaaacatgcctgaagactaccccgatcagttcgacgacgtgatggactttatccaggcaaccatcaagcgattgaaaaggtctccagataaacagatggccgtactaccccgaagggaacggaatcggcaagccgccgcagcgaatcctgagaattctcgcggaaaaggcaggcggggccaacgtggaaagaatcgggggtgtgtgctgacagctatacacctgaacgtaacagatcttggcctcgggtacgagactaaagaggagctgatctttaggtactgctcaggcagctgtgatgccgccgagaccacatacgataagatccttaagaacttgagcagaaatcgtcgccttgtatctgacaaggtgggccaggcctgctgtaggcccattgcttttgatgatgacctgagctttctggacgacaacttagtgtaccacatcctgcgaaagcatagcgccaagcggtgtggctgtatt

SEQ ID NO: 12322 - DNA, 633 bp, Artificial Sequence
  Description of Artificial Sequence: Synthetic coding sequence
atgaaactgtgggacgtggtcgccgtctgcttggttctgcttcatacggcatctgcgtttccattgcccgcagggaaaagacccccagaagccccagcagaagacagatcgctggggcgacggcgggcacccttcgccctgtccagtgactccaacatgccggaagactacccagatcagtttgacgatgtgatggatttcattcaagcaaccataaagaggctcaaaagatcgcctgacaagcagatggctgtgctcccgcgtagagagcgcaacaggcaggccgccgctgccaatcccgaaaacagccgcggcaagggacgacgtggacagaggggtaagaacaggggatgcgtgctgaccgcaatacacttaaacgtgacagatctcggactgggatacgaaaccaaagaagagctaatatttcgctattgttctggaagctgtgatgcagcggagaccacgtacgacaaaatcctgaagaatctgtcccggaatagaagactcgtgagtgataaagttgggcaggcatgctgtcgtcccatcgcttttgatgatgacctaagcttcctggatgataaccttgtctaccatattctgcggaaacattcggccaagcggtgtgggtgtatt

SEQ ID NO: 12323 - DNA, 633 bp, Artificial Sequence
  Description of Artificial Sequence: Synthetic coding sequence
atgaagctttgggatgtggtagcagtgtgtcttgtgctgttacacaccgcaagcgcctttccattacccgcggggaaacggcccccagaagccccagcagaggacagatccttgggaagacggagggcacccttcgctctgtcatctgactctaacatgcccgaagactacccagaccaattcgacgacgtgatggacttcatccaagcgacaatcaaacgactgaaaaggtcccccgataagcagatggcggtgctgccacgacgtgaacgtaatagacaggccgccgcagccaaccccgagaattcaagaggaaagggtaggaggggccagcgtggtaagaatcgcggatgcgtgctgactgcaattcacttgaacgtgaccgacctgggactgggatatgaaaccaaagaggagctgatctttcgctactgctcgggctcttgtgatgccgctgagaccacttacgataagatcttaaagaatctctcccgcaacagaaggctcgtctctgacaaggttgggcaggcctgttgccgtcctatcgcctttgatgatgacctgtccttcctagacgacaatcttgtatatcatatactccgaaaacattccgctaagcgttgcggctgtata

SEQ ID NO: 12324 - DNA, 633 bp, Artificial Sequence
  Description of Artificial Sequence: Synthetic coding sequence
atgaagttgtgggatgtggtggcagtttgtctggtgctgcttcatacggcttccgccttcccactgccggctggtaagcggccacccgaagcgcctgcagaggatagaagtctgggcagacggcgcgctccattcgccctgtcatccgattccaacatgccggaggattatcccgatcaattcgacgacgtgatggacttcatccaggcaacaattaaacggcttaagaggagccctgacaagcagatggctgtgttgccaagacgggagaggaaccggcaagccgccgcagccaatccggagaatagccgaggcaaagggagaagaggtcaacgaggaaagaaccgcggatgtgtgctcacggccattcatctgaacgtgacagacctcggacttggttacgagacaaaggaggagctgatcttccggtattgttccggttcctgtgacgctgccgagacaacatacgacaaaatcctgaaaaacctctccaggaacaggagactggtctccgacaaagtaggccaggcatgttgcagacccattgccttcgacgatgacctgagttttctcgatgacaacctggtataccatattctgagaaagcactcagctaaacgctgcggttgcata

SEQ ID NO: 12325 - DNA, 633 bp, Artificial Sequence
  Description of Artificial Sequence: Synthetic coding sequence
atgaaactctgggacgtggtggctgtgtgtctcgttctgctccatactgcatccgcctttcctcttccagcgggcaaacgcccacccgaagcacctgcagaggacaggtcccttggaaggcggcgcgctccgtttgcattgagcagcgattcaaacatgcctgaggactaccctgatcagttcgatgatgtgatggatttcattcaggcaacgataaaacgactcaaaagatcgccagataagcagatggcggtactccctcggagggaaagaaacagacaagcagcagctgcaaatccggagaattcgagaggtaagggacgcagaggccaaagggggaagaaccgcggatgcgtccttaccgctattcacctgaacgtcaccgatcttgggctcggctatgagactaaagaagagcttatcttcagatactgttccggttcgtgtgacgcagctgagacgacctacgataagatcctgaaaaatctttcccgcaataggcgtctggtgtccgataaagtggggcaggcctgttgcagacctatagcatttgacgacgatctgtcatttctggacgataacctggtttaccatattctgcgaaagcacagcgcaaagcgctgcggatgtatt

SEQ ID NO: 12326 - DNA, 633 bp, Artificial Sequence
  Description of Artificial Sequence: Synthetic coding sequence
atgaaactttgggatgtcgtagctgtctgtcttgttttactgcataccgcatcggcgtttcctctgccagcgggcaagagacctccggaagcgcccgcagaagacagaagcttaggacgccgacgcgctccgttcgcactgagcagcgattcgaatatgcctgaagactacccagatcaattcgatgatgtcatggactttatccaagcgacaatcaaacgcttgaaacgctctccagacaagcaaatggctgtcttacctaggcgcgaaagaaatcggcaggcagctgccgctaacccggaaaacagcagaggcaaaggtagacgaggacagcgtggcaaaaacagagggtgcgttttaacagcaatccacctaaacgtaacggatcttggtcttggctatgaaacaaaagaagaattaatctttcgctattgcagcggctcttgcgatgcagcagaaacgacgtatgacaaaattctcaagaatttgtctcgcaatagacgtttggtctcagataaagtcggccaggcatgctgtcgcccgatcgcgtttgatgacgacctctcctttctcgacgacaacttggtctaccatattttacgcaagcactctgcgaaaagatgcggatgtatc

SEQ ID NO: 12327 - DNA, 633 bp, Artificial Sequence
  Description of Artificial Sequence: Synthetic coding sequence
atgaagctgtgggatgtggtcgcagtgtgtcttgtgcttctgcacactgcctcagcctttccgctgccggcaggcaagcgtcctcctgaagccccagcagaagatagatcgttgggacggcgccgcgcaccctttgcactgtcatcggattcaaatatgcctgaggattacccagatcagttcgacgatgtgatggatttcattcaggcgaccattaagcgcttgaagcgctcgcctgataaacaaatggcagtcctccctaggagagagcgcaacagacaagcagcagcagcaaatccagaaaactctaggggcaagggtcggcgcggccagagggggaagaatagaggttgtgtccttactgctatccatctcaatgtgaccgatctcggactcggctacgagactaaggaggagctcatcttcaggtactgttcgggttcatgtgacgcggcagaaaccacctatgacaagatccttaagaatctgtcaagaaaccggcgcctggtgtccgacaaggtcggtcaggcgtgctgccgccccattgcttttgacgacgatcttagctttcttgatgataacctggtgtaccacatactgcggaaacactcggcaaaaagatgcggttgcata

SEQ ID NO: 12328 - DNA, 633 bp, Artificial Sequence
  Description of Artificial Sequence: Synthetic coding sequence
atgaagctttgggatgtagttgcagtatgcttagttttgttacatactgcaagtgcattcccattaccagcaggtaagcgaccaccagaagcaccagctgaagatcgttctttaggaagaagaagagctccttttgctttatctagtgactctaatatgccagaagattacccagatcaatttgatgatgtaatggattttatacaagctactataaagagacttaagcgtagtccagataaacaaatggctgttttaccaagaagagaaagaaatagacaagctgctgcagctaatccagaaaatagtcgaggaaagggaagacgtggacaacgtggaaaaaatcgagggtgtgttttaacagctattcatcttaatgttactgaccttggattaggatatgaaacaaaggaagaattaatttttagatattgttcaggatcttgtgacgcagctgaaacaacttatgacaaaattttaaagaatttatcaagaaatagaagacttgtatcagataaagttggacaagcctgttgtagaccaatagcatttgatgatgatttaagttttcttgatgacaatcttgtttatcatattcttagaaaacattcagcaaaaagatgtggatgtatc

SEQ ID NO: 12329 - DNA, 633 bp, Artificial Sequence
  Description of Artificial Sequence: Synthetic coding sequence
atgaaactgtgggacgtcgttgctgtctgtctggtgcttttgcacacagcctccgcttttcctctgcccgcaggaaaaagaccacctgaagccccagccgaagatagatctctcggtcgaaggcgggctcctttcgctctgtcctccgacagcaatatgcccgaggattaccccgaccagtttgatgacgtgatggactttattcaggctacaattaagagattgaagcgaagcccagacaaacaaatggctgtcttgcctagacgtgagaggaaccgccaggccgctgcagcaaaccccgaaaactcccggggcaaggggcgcagaggccagagggggaaaaatcgaggatgtgttcttaccgccatacatttaaatgtcaccgacctgggactgggctacgaaacaaaggaggagttgatctttagatattgtagcggatcttgtgacgctgccgagactacctatgataagatattaaagaacctctcccgcaaccgccggttggtatccgataaagttggacaggcatgttgtagacccattgctttcgatgatgatctttcgttccttgacgacaatcttgtctatcacatactgcggaaacattccgcgaagcggtgcggttgtatc

SEQ ID NO: 12330 - DNA, 633 bp, Artificial Sequence
  Description of Artificial Sequence: Synthetic coding sequence
atgaagctatgggacgtggtggctgtgtgcctggttttgctgcatacggccagcgcattccctctgccggctggaaagagacctccagaagcacctgccgaggaccgcagcctgggacgccgtcgcgcaccatttgccctgagcagcgacagcaatatgcctgaggattatcctgaccaatttgacgatgtcatggattttattcaggcaacgattaagcgcttgaagcgcagtccggacaagcaaatggcggtgttacctcgtcgcgagcgcaatcgccaagctgccgcggcaaatccagagaactctcgtggtaaagggcggcgcggtcaacgcggcaagaatagaggatgtgttctgacagcgattcatctcaacgttaccgacctgggcctgggctatgagacaaaagaggaactgatcttccgctattgtagcggatcctgtgatgcagccgaaacgacctacgataagattctgaagaacctgagcaggaatcgccgtctggtttccgataaagttggccaggcgtgttgtcgcccaatcgcctttgatgacgatctttcattcctcgatgataacttggtgtaccacatactgcgtaaacacagcgcgaagcgttgcgggtgcatc

SEQ ID NO: 12331 - DNA, 633 bp, Artificial Sequence
  Description of Artificial Sequence: Synthetic coding sequence
atgaaactatgggatgtagtagcggtatgtctagttctattacatacggcgtcggcgtttccgctaccggcgggtaaacgaccgccggaagcgccggcggaagatcgttcgctaggtcgacgtcgtgcgccgtttgcgctatcgtcggattcgaatatgccggaagattatccggatcaatttgatgatgttatggattttatacaagcgacgataaaacgattaaaacgttcgccggataaacaaatggcggtactaccgcgacgtgaacgtaatcgtcaagcggcggcggcgaatccggaaaattcgcgtggtaaaggtcgtcgtggtcaacgaggtaaaaatcgtggttgtgttctaacggcgatacatctaaatgtaacggatttaggtttaggttatgaaacgaaagaagaactaatatttcgttattgttcgggttcgtgtgatgcggcggaaacgacgtatgataaaatattaaaaaatctatcgcgtaatcgtcgtctagtatcggataaagttggtcaagcgtgttgtcgtccgatagcgtttgatgatgatttatcgtttctagatgataatttagtatatcatatattacgaaaacattcggcgaaacgttgtggttgtata

SEQ ID NO: 12332 - DNA, 633 bp, Artificial Sequence
  Description of Artificial Sequence: Synthetic coding sequence
atgaaactctgggacgtcgttgccgtgtgcctggtgcttctccacaccgcgtccgcgttcccactcccggcgggaaagcggccgccggaagcgcctgcggaggatcggtccctcggtcggcggcgggccccgttcgcattgtcgtcagactcgaacatgccggaggattacccggatcagttcgacgacgtgatggacttcatccaggccaccatcaaacggctgaagagatccccggataagcagatggcagtgctcccaaggcgcgaacgcaacagacaagcagcagcggcgaatccggaaaactcgagaggcaagggccgccggggacagcgcggaaagaacagaggctgtgtgcttaccgccattcatctcaatgtgaccgatctcggtctgggatacgagactaaggaggagctgatcttccgctactgctcggggagctgcgatgccgctgaaacgacctacgacaaaatcctcaagaacctctcaagaaaccgccgcctggtcagcgacaaggtggggcaagcctgttgcaggcctatcgcgttcgacgacgatctgagcttcctggacgataacctggtttaccacatcctgcggaaacattccgcgaagagatgcggatgtatc

SEQ ID NO: 12333 - DNA, 633 bp, Artificial Sequence
  Description of Artificial Sequence: Synthetic coding sequence
atgaagttgtgggatgtcgtggcggtgtgcttggtgctcctccacactgcatcggcgttccccctccctgcgggaaaaagaccgccggaggctccagcagaggatcggagcctggggcggcggagggccccgttcgcgctgtccagcgattcgaatatgcctgaggactacccggatcagttcgacgacgtcatggatttcatccaggcgaccatcaagcgattgaagaggtccccggacaagcaaatggcggtgctgccgcgccgcgagcggaacaggcaggccgccgcggccaatcccgagaattcgcgcgggaagggacgccgcggccagcggggaaagaaccgcggttgcgtgctcactgccatacatctgaatgtcactgatctgggccttggatacgaaactaaggaagagcttatcttccgctactgctcaggaagctgcgatgctgcggaaactacctacgacaaaatcctgaaaaatctgtcccggaacagacgactggtgtcggacaaggtgggacaagcgtgttgccggccgatcgcttttgatgacgacctgtcgtttctggacgataatcttgtgtaccatatcctcagaaagcatagcgcgaagcggtgtggatgcatt

SEQ ID NO: 12334 - DNA, 633 bp, Artificial Sequence
  Description of Artificial Sequence: Synthetic coding sequence
atgaaactgtgggatgtcgtagctgtctgtctggtgcttctgcatacagcatccgcgtttcccctcccagccggaaaacgccctccagaagcaccagctgaagataggagtttaggacgacggcgggctccattcgccctcagtagtgacagtaacatgcccgaagattatcccgatcagttcgatgatgtgatggattttatacaggcaactatcaaacgcctgaaacggagtcccgataaacagatggccgttctacctaggagagaacggaatcggcaggctgccgctgcaaacccagaaaactcaaggggaaaagggagacggggacagagaggaaaaaatagagggtgtgtgcttactgccatacacctgaatgtgacagatctggggcttggatatgaaacaaaggaagaactaatcttccgatattgttcagggtcctgtgatgctgccgaaactacttatgataaaattctcaaaaatctgtctagaaatcgaaggctcgtgtccgataaagtggggcaggcatgctgtcggcccatcgccttcgatgatgacctgtcattcttagacgacaacctggtttatcatattctccggaaacactctgctaaaaggtgtgggtgtata

SEQ ID NO: 12335 - DNA, 633 bp, Artificial Sequence
  Description of Artificial Sequence: Synthetic coding sequence
atgaaactttgggacgtcgtggccgtgtgtctggtgctgctgcatacagcctcagcatttcccctgccagccggaaaaaggccaccagaggccccagctgaagatagaagcttgggaagaaggcgggcccccttcgctttgagctcagacagtaacatgccggaggactatcccgatcagtttgatgatgtgatggattttatccaagctacgatcaagcgcctcaaacgatcaccagacaagcagatggccgttttgccgcgaagggagcgcaataggcaggcagccgcagccaaccctgagaacagtcggggtaagggtcgccggggacagcgggggaaaaaccgaggctgtgttttgactgcgatccacttgaatgtcaccgaccttgggctgggatacgagactaaggaggaactcatctttcgctattgcagtggctcatgcgatgccgctgaaacaacctacgacaagatcctaaagaacctatctaggaatcggcgtctcgtctccgacaaagtgggccaagcatgctgtcgcccaattgcttttgatgacgatctctcctttcttgatgacaacctcgtctatcacatccttcgaaagcacagcgctaagcgttgtggatgcatc

SEQ ID NO: 12336 - DNA, 633 bp, Artificial Sequence
  Description of Artificial Sequence: Synthetic coding sequence
atgaagctgtgggatgttgtggccgtgtgtctcgtgcttctgcataccgcaagcgcattcccgcttcctgctggcaagaggcctcccgaagcgcccgcagaggatagatcactgggccggaggagagcccccttcgccctctcgtccgattccaatatgccagaagactatcctgaccaatttgacgacgtaatggattttatccaggctacaatcaagcgcctgaaacgctctccagataagcagatggctgtgcttccgcggagagagcggaaccggcaagccgccgcagctaacccagaaaactcaaggggtaaagggaggcgcggccagcgtggcaagaatagaggctgtgtgttgaccgcaatacatttgaacgtaaccgatctaggtctaggctacgagacgaaagaggagttgatatttagatattgcagcgggtcctgtgatgcagccgaaactacatatgataagatcttaaagaatctttctcgcaacagacgccttgtttccgataaagttggacaggcatgctgcagacctattgcttttgacgatgacttaagttttttggatgacaatctcgtgtaccatattctccgaaaacactccgcgaagcgttgcgggtgcatt

SEQ ID NO: 12337 - DNA, 633 bp, Artificial Sequence
  Description of Artificial Sequence: Synthetic coding sequence
atgaagctgtgggatgtggtggccgtctgcctcgtactgctgcacacagcttctgcgttcccgctgccggctggtaagaggccccctgaggcgcctgctgaggaccgctccctcggtaggagacgcgccccctttgctttgtcctccgactctaacatgcccgaggactacccagatcagtttgacgatgttatggacttcattcaagccactatcaaacgcctgaagagatcacccgacaaacagatggccgttctcccgaggagggaaaggaacagacaagccgctgctgctaatcccgagaatagtcgcggaaagggaaggcgcggacaacgcggtaaaaataggggctgtgtgctcacagctattcatctcaacgtcactgaccttggcctcggttatgagactaaggaggaactcatcttcaggtactgctccggatcatgtgacgcagccgagaccacatacgacaagatattgaagaatctctcacgcaaccgccgccttgtctccgacaaagtgggtcaagcatgttgccgcccaatcgcctttgatgacgatctgtcatttttggacgataacctcgtctaccacattctgaggaagcactctgcaaagcgctgcggatgtatc

SEQ ID NO: 12338 - DNA, 633 bp, Artificial Sequence
  Description of Artificial Sequence: Synthetic coding sequence
atgaaactttgggacgtggtcgcggtgtgcctggtgctgctgcataccgcttcagccttccctctgccggcgggtaaacgcccgccagaagcccctgccgaagatagatccctcggacggcggcgcgcccctttcgcgctcagctcggactcgaatatgccagaggactaccccgaccagttcgatgacgtgatggactttatccaagccactatcaaacgccttaaacgctccccggataagcagatggccgtgctgccgcgaagagaacgcaaccggcaggccgccgcggctaacccagagaacagccgcggaaaaggaaggagaggacagcggggcaagaacagaggatgcgtgctgactgccatccatctgaatgtgactgacctgggcctgggatatgaaacgaaggaggagctcatctttcgctactgctccgggtcatgcgacgcagcggaaaccacttacgataagatccttaagaatctctcccgcaatcggcgcctcgtgagcgacaaagtcgggcaagcgtgttgccggccaatcgcattcgacgacgacctgtcgtttctcgacgataacctggtgtaccacatcctgagaaaacatagcgcgaagcgctgcggatgtatc

SEQ ID NO: 12339 - DNA, 633 bp, Artificial Sequence
  Description of Artificial Sequence: Synthetic coding sequence
atgaagctgtgggacgtcgtcgccgtgtgcttagtgctgctgcacaccgcaagtgctttccccttgccagccggaaaacgccctcccgaggcacctgcagaggatcggtcgctcggcagaagaagagctcctttcgccctgtcctccgactcaaatatgcctgaggattacccagatcagttcgacgacgtcatggatttcattcaagcaacaataaagagactgaaacggtctcccgacaagcagatggctgttctgccacgcagagagaggaataggcaggctgccgcagctaatcccgagaacagtaggggcaaaggccgccggggtcagcgaggaaaaaacaggggttgcgtgctgacagcgatccacctcaatgttaccgacctcggactgggctacgagaccaaggaggagttgattttccgatattgttcaggtagctgcgatgccgccgagactacgtatgacaagatcctgaaaaatttgagtagaaacaggcggctagtatctgacaaagtcggacaggcatgctgtaggcctatcgcttttgatgacgatctcagctttctggatgataatctcgtgtatcacatccttcgcaagcacagcgccaaaaggtgtggctgtatt

SEQ ID NO: 12340 - DNA, 633 bp, Artificial Sequence
  Description of Artificial Sequence: Synthetic coding sequence
atgaaactgtgggatgttgtggcagtatgtctggtgttgcttcatacggcaagcgcatttccattacccgcaggcaaaagaccgccagaggctccagccgaggatcggtcgttagggcgcagacgagctcccttcgccctctcttccgacagtaatatgccagaagattatccagatcaatttgacgatgtgatggactttattcaggcaacgattaagcgactgaaacggtcacccgataaacagatggctgtcctaccccggagagagagaaacaggcaggcagccgccgccaatccagaaaactctagaggcaaggggcggcggggccagagaggtaaaaataggggatgcgtcttaacagcaatccatctcaacgtgaccgacctcgggctaggatatgagacaaaagaggagctcatatttaggtactgtagtgggtcatgtgatgccgccgagacgacttacgacaagatcctgaaaaacctgtcgaggaataggcggctagtgagtgacaaagtggggcaagcatgttgcaggcccatcgccttcgatgacgatctctctttcctggatgacaacttggtgtaccacatcctgaggaaacattctgcgaaacgctgtggttgtatc

SEQ ID NO: 12341 - DNA, 633 bp, Artificial Sequence
  Description of Artificial Sequence: Synthetic coding sequence
atgaaattgtgggatgtggtcgcagtgtgtctggttcttttgcacaccgcgtcagcattcccgctccctgctggaaaaagaccacctgaggcacctgcagaggatagatcacttggacggcggcgggctccgtttgcccttagctcggattcgaatatgccagaagattacccagaccagtttgatgacgtgatggatttcatccaagcgaccattaagcggcttaagaggagtcccgacaaacagatggcagtgcttcccaggcgtgaacgaaaccgacaagcagcggctgcgaaccctgaaaattccagaggaaaggggagacgaggtcaaagagggaagaaccgcggatgtgtgttgactgccattcacctgaacgtcaccgacctgggtcttggatacgaaacgaaagaagaactgatattcagatattgttcgggatcctgcgacgcagcagagactacctacgacaaaatccttaagaatctgtcacgcaaccggcgactggtgagtgataaggtaggccaggcttgttgccggccaatagcatttgatgatgatctgagctttcttgatgataacctcgtctaccatattctgagaaagcattccgccaagcggtgtggctgcatt

SEQ ID NO: 12342 - DNA, 633 bp, Artificial Sequence
  Description of Artificial Sequence: Synthetic coding sequence
atgaaattgtgggatgtggtggctgtgtgtttagtgctgctgcacaccgcctccgccttccctttacccgccggaaagaggccaccagaagcgcctgccgaagaccgcagcttgggcaggcgacgcgcaccatttgcacttagttctgacagtaacatgcccgaggactacccggaccagtttgatgatgttatggacttcattcaggcaacaattaagagactaaagcgctcacctgataagcagatggcagtcctgccaaggcgcgagcggaatcggcaagctgcagcagcaaatcccgagaacagtcggggcaaaggaaggcgcggtcagcgaggcaagaacagaggatgtgtgctaaccgctatccatctgaatgtgacggatttaggtttaggctacgagacgaaggaggagctcattttcaggtattgttccggcagctgcgacgcggccgaaactacatatgacaagattctgaagaacttgagccgcaacaggcgtctcgtgagcgataaagtgggtcaagcttgctgtaggcccattgccttcgatgatgatctgagcttcctggatgataacctggtctatcacatcctccgaaaacattctgcaaaacgctgtggctgtatt

SEQ ID NO: 12343 - DNA, 633 bp, Artificial Sequence
  Description of Artificial Sequence: Synthetic coding sequence
atgaagttgtgggacgttgtcgccgtatgcctcgtgctccttcacacggcaagtgccttcccactgccagcgggcaagcgacctcctgaggcgccagcagaggatcgctcactcggccgccggcgagccccttttgcattgtcctcggattccaatatgcccgaagactatcctgatcagtttgatgacgttatggatttcattcaggcaaccattaagaggctgaaaaggagcccggataagcagatggctgtgttgcctcgaagggagcggaataggcaagctgccgccgctaatccggaaaatagcaggggaaaggggaggcgaggacaaaggggaaaaaatcgagggtgtgtacttacagcaatccacctaaatgtaacggatctcggacttggctacgaaactaaggaagagctcatcttccgatattgctcgggttcctgtgatgctgcggaaacaacctatgacaaaatactgaagaacctgagcaggaataggcgcctggtctcagacaaggtcggccaggcgtgctgtaggccaatcgcttttgacgacgacctctcttttttggatgacaacctggtctaccatatcctgcgtaagcattctgccaagcgatgtggatgcatt

SEQ ID NO: 12344 - DNA, 633 bp, Artificial Sequence
  Description of Artificial Sequence: Synthetic coding sequence
atgaaactttgggacgtggtggcagtgtgtctggtgctgttacacaccgcaagcgcattccccctgccagccggcaaacgaccgcctgaggcccccgccgaggatcgctccctggggcgcagacgggctcccttcgccttgtcctccgacagtaacatgcccgaagactatcctgaccagtttgatgacgtgatggatttcatacaagcaacaatcaaacggttaaagaggtcaccagataaacagatggccgtcctcccccgtagagaacggaatcggcaggctgccgccgccaaccctgagaatagtagaggcaaggggagacgaggccaacgcggaaaaaatcgcggatgcgtgctaacagccattcacctaaacgtgactgatttaggactcggctatgaaacgaaggaagagctcatcttccggtactgttcgggatcatgtgacgccgctgagacaacttacgacaagattttaaaaaacctaagtcgaaaccggcgtctggtgtccgacaaggttggccaggcttgctgccgcccgatcgcatttgatgatgacctgtcatttctggacgacaatttagtctatcatattctccggaaacatagcgctaagcgctgtggctgcata

SEQ ID NO: 12345 - DNA, 633 bp, Artificial Sequence
  Description of Artificial Sequence: Synthetic coding sequence
atgaagttgtgggacgtggtcgccgtgtgcctggtgctcctgcatactgcgtcggccttcccgctcccggctggcaagcgaccgcccgaggctccagcagaagatcggtcactgggaaggcgtcgcgcgcctttcgccctgtcgtcggatagcaacatgccggaggactacccggatcagtttgatgacgtgatggatttcatccaggccactatcaaacgcctcaagcggagcccagacaagcagatggctgttctgccgcggagggagcggaacagacaggcggcggccgccaacccggagaactcacggggaaagggtaggagaggacagcgcgggaagaacaggggctgcgtgctcactgccatccatcttaacgtgaccgatctgggactcgggtacgaaacgaaggaagaactcattttccggtactgctcaggctcctgcgatgccgcagaaaccacgtacgacaagattcttaagaacctctcccggaatcgccgccttgtgtcagataaggtgggacaggcttgctgccggccgatcgcatttgacgacgacctgtccttcctggacgacaatctggtgtaccacatcctgcggaagcacagcgctaagcgctgcggatgtatt

SEQ ID NO: 12346 - DNA, 633 bp, Artificial Sequence
  Description of Artificial Sequence: Synthetic coding sequence
atgaaactttgggacgtggtggccgtgtgtttggtccttcttcacacggcatccgcattccctctgccagccggaaagaggcctccggaagctccagcagaagatcgcagcctgggacggagacgcgccccttttgcactctcctccgattcgaacatgccagaggactaccccgaccagtttgatgacgtgatggatttcattcaggcgaccattaagcgcctcaaaagatcacccgataagcagatggcagtgcttccaagacgtgagcgcaaccggcaagcagcagctgcgaacccagaaaattccagaggaaagggaaggcgcggccaaagaggaaaaaaccgtgggtgtgtgcttaccgcaatccatcttaatgtcacggacctcggtcttggttacgaaaccaaggaggaactgatttttcgttactgttctggttcgtgcgatgcggcggagactacttacgacaaaatcctcaaaaatctgtcccgaaataggagacttgtgtcggataaagtcggccaggcatgttgcaggcccattgcatttgacgacgacctttcattcctggatgacaacctcgtctaccatatcctgagaaaacattccgcgaagagatgcggttgcatt

SEQ ID NO: 12347 - DNA, 633 bp, Artificial Sequence
  Description of Artificial Sequence: Synthetic coding sequence
atgaagctttgggatgtggtggctgtttgtctggtgctattgcacactgcttcagcttttccccttcccgccgggaaacggccccccgaagcccccgcggaagacaggagcctgggccggagaagagcacccttcgctctctctagcgattcgaatatgcccgaagattaccctgaccaatttgatgacgtgatggactttatccaggcaactattaaacgcctgaagaggagtccggacaagcagatggccgtgctcccacgtagggagcgaaacaggcaggcagctgccgccaaccctgaaaactcccgcggcaaagggcggcgaggacaaagggggaagaaccggggatgtgtgttgaccgcaatccatttaaatgtgaccgatctggggcttggctatgagactaaggaggaactcatctttcggtactgctcaggatcatgtgatgccgctgaaactacctacgataaaatcctcaagaacctttcacgcaacagaaggcttgtctctgacaaagttggccaggcctgctgccgccctatcgcctttgacgatgacttatcttttctcgacgacaacttggtctatcatatcttgaggaagcactccgctaaacgctgtggatgcatt

SEQ ID NO: 12348 - DNA, 633 bp, Artificial Sequence
  Description of Artificial Sequence: Synthetic coding sequence
atgaaactgtgggacgtcgtggctgtctgtcttgtccttctccataccgcttcggcgttcccactgccggccggaaaacgcccgccagaagcccctgctgaggacagaagcctgggccggcgccgcgcgccgttcgcgctgtcaagcgactcaaatatgccagaagattaccctgatcaattcgacgacgtgatggactttatacaggcgaccatcaaaaggctgaagagatccccggataagcagatggcggtgctgccgcggcgagaaaggaaccgccaggccgccgccgcaaaccccgagaactcgagaggtaagggaaggagggggcagcgaggaaaaaaccgcggatgcgtgctcacggcaattcacctcaacgttaccgacctgggactcggttatgagactaaggaagaacttatcttcagatactgctcaggctcctgcgacgctgctgagactacctacgacaagatactgaagaatctctcgcgcaatcggaggctggtgtccgacaaagtggggcaagcctgttgccgcccgatcgccttcgatgacgatctgtcgtttctggacgataacttggtctaccacattcttagaaagcatagcgcaaagaggtgcggttgcatc

SEQ ID NO: 12349 - DNA, 633 bp, Artificial Sequence
  Description of Artificial Sequence: Synthetic coding sequence
atgaaactttgggacgtggtggccgtctgcctggtgcttctccataccgcatcggccttcccactgccagcgggcaaacgccctcctgaggcacctgccgaggatcgcagccttgggagacgccgagctccatttgcactctcgagcgattccaacatgccggaagattaccctgatcaatttgacgatgtcatggactttatccaggcaaccattaaacgtctgaaacgatccccagataaacagatggcggtcctccctcgtcgcgagagaaatcgccaggccgcagcagcaaacccagaaaactcgagaggtaagggtcggcgtggccaacgaggaaagaacagaggatgtgtgcttactgccattcaccttaacgttacggatctcggactcgggtacgaaactaaggaagagttgatatttcgctactgctccggttcctgtgacgcagcagaaactacctacgacaagatcttgaaaaatctgtcaagaaaccgacggctcgtgtccgacaaagtgggtcaggcttgttgcaggcctatagcatttgacgacgatctttcgttccttgacgacaatctggtctaccatattctccggaagcacagcgcaaagagatgtgggtgcatc

SEQ ID NO: 12350 - DNA, 633 bp, Artificial Sequence
  Description of Artificial Sequence: Synthetic coding sequence
atgaagctgtgggacgtggtggcagtatgtctggtgctgttgcacacggcatcagccttcccattgcccgcaggcaaacggcccccggaggcccccgctgaggaccgcagcttaggaagacgccgtgctcccttcgccctaagtagtgactcaaatatgccagaagattacccagatcaattcgatgatgtgatggacttcatacaggcaaccatcaagaggcttaagagaagccccgacaagcagatggcggtgttgccacgcagagaaaggaaccggcaagctgccgctgcaaaccctgagaactctaggggcaagggcagacgaggacagcgaggtaagaatcgaggatgcgtgctgacagccattcatttgaacgtcaccgacctggggttgggttacgagacaaaagaagagctgatttttaggtattgttcagggtcctgtgacgcagctgaaactacctatgataagattctgaagaacctcagtcggaaccgtcgcctggtgtctgacaaagtcgggcaggcatgctgccgccctattgcattcgatgacgatttatcattcctagacgacaacctggtgtaccacatcttgcgcaagcatagcgcgaaacggtgtggctgtatt

SEQ ID NO: 12351 - DNA, 633 bp, Artificial Sequence
  Description of Artificial Sequence: Synthetic coding sequence
atgaaactttgggacgtggtcgcggtttgtctcgtcttgcttcatactgcatctgctttccctctgcctgcgggtaaacggcctcccgaagcacctgcagaggacagatcgctgggtagacgccgggccccgtttgcgctctcatcggactcaaatatgccggaggactacccagatcagtttgatgacgtcatggatttcatccaagccaccatcaaacgcctcaaaagaagcccggataagcaaatggctgtgctgcctcgccgggaacggaacagacaggcagccgctgcgaaccccgaaaattcacgcggcaagggacgcaggggacagcgggggaagaaccgcggatgcgtgttgaccgctatccatctgaatgtgaccgatctgggattgggatacgaaaccaaagaagaactcatcttcagatattgctcgggctcctgcgacgcggccgaaaccacttacgacaagatcctgaaaaatctctcccgcaaccggaggctcgtgtccgataaagtgggacaggcatgctgcaggccaatcgccttcgatgatgacttgagcttcctcgatgataacctggtgtaccatatcctcagaaagcattccgcgaagaggtgcggatgcatt

SEQ ID NO: 12352 - DNA, 633 bp, Artificial Sequence
  Description of Artificial Sequence: Synthetic coding sequence
atgaagctgtgggatgtggtggccgtctgtctcgtcctcctgcataccgcgtctgcctttccgctgccagccggcaagcggccaccggaagctccggctgaggaccgatcacttggtcggcgccgtgctcccttcgccttgtcatcagactcgaacatgccagaggattaccctgaccagttcgacgacgtcatggatttcatccaggctaccatcaaacgcctgaaacgttcgcccgacaaacagatggccgtgcttccgcgccgggagaggaacagacaggccgcagccgcaaacccggaaaattcccgggggaagggccgcagggggcaacggggcaagaatagaggatgcgtgctgactgcgattcatctcaacgtgaccgatctcggattgggatacgaaacgaaggaggagctgatttttcgctactgcagcggatcgtgcgatgcggcggagactacctacgacaagatcctcaagaatctctcacggaacagaaggttggtgtcggataaggtgggacaggcctgttgccggcctatcgcatttgacgatgacctgtcgttcctggacgataatcttgtgtaccacatcctgcgcaagcattcagcgaagcggtgtggatgcatc

SEQ ID NO: 12353 - DNA, 633 bp, Artificial Sequence
  Description of Artificial Sequence: Synthetic coding sequence
atgaagctttgggatgttgtggcagtgtgcctggtgcttcttcatacagcctcagccttccctcttccagcaggaaaacgccctcctgaagcaccggctgaagatcgttccctgggcaggagaagggccccttttgcgctttccagtgactctaacatgccagaggattaccctgaccagtttgacgatgtcatggacttcattcaggcaaccatcaaaaggctcaaacgctctcccgataaacagatggccgtgttaccgcggagggaacggaaccggcaagctgcagccgccaacccagagaacagcaggggaaagggaagaaggggccagagagggaaaaatcgcggatgcgttctcaccgcgatacacctcaatgtgaccgatctcggactgggttatgaaaccaaggaggagctcatttttagatactgcagtggctcttgcgacgcagcagagaccacctacgacaaaattcttaaaaaccttagccgaaacaggagattggtcagcgataaggttggccaagcgtgctgccgacctattgcctttgacgacgacttgagcttccttgacgataatttagtttaccacattctacgcaaacactccgctaagcggtgtggatgtatc

SEQ ID NO: 12354 - DNA, 633 bp, Artificial Sequence
  Description of Artificial Sequence: Synthetic coding sequence
atgaaactatgggacgtggtggcagtgtgcttggtgctgctccacacagcctcggccttccctcttccagcaggaaaaagacccccggaggcacccgcagaggatagatcgttaggccgcagacgtgccccatttgcacttagcagcgacagtaatatgccagaagactatcccgatcagtttgacgatgtgatggacttcattcaagcgacaatcaaaaggctaaagcgctccccagataagcagatggccgtcctgccgaggcgcgaacgcaatagacaggcggctgccgcaaacccagagaactcacgcggaaaggggcgacggggccagagaggcaagaatagaggatgtgttctgaccgcgatacaccttaatgtgactgatctcggtctcggttacgaaaccaaagaggaactcatcttccgatactgctcgggctcctgcgacgccgctgagactacttacgacaagattctaaagaatcttagtcgtaacagacgactagtgtcagataaagtgggtcaggcttgctgcagacctattgctttcgacgacgacctttctttcctggacgataaccttgtgtatcacatcttgcggaagcattccgccaaacgatgcggatgcatc

SEQ ID NO: 12355 - DNA, 633 bp, Artificial Sequence
  Description of Artificial Sequence: Synthetic coding sequence
atgaagctctgggacgtcgtggccgtgtgcctcgtgcttcttcatactgcgtcagccttccctctgccggctggaaaaagacccccggaggcgccggcggaagatcgctccctgggtcgccggagggcaccattcgcgctgtcctccgacagcaatatgccagaggattacccagaccagttcgacgacgtaatggatttcattcaggctaccattaagagactcaagagatctccggacaagcaaatggctgtcctcccccgccgcgaacgcaacaggcaagccgccgccgctaaccccgaaaactcccgcgggaaagggcggcggggacagcggggaaagaatcgcggttgcgttctgacggcaatccaccttaatgtgactgatctgggcctcggatatgaaaccaaggaggaactgatctttcgctactgctcgggatcgtgcgacgccgccgaaacgacctacgacaaaattctcaaaaatctcagccgtaaccgacggctggtgtcggacaaagtgggacaggcatgttgtcgcccgatagctttcgacgatgatttgtcattcctcgatgacaacctcgtgtaccacatcctccgcaaacactcggcaaagcggtgtgggtgcatc

SEQ ID NO: 12356 - DNA, 171 bp, Artificial Sequence
  Description of Artificial Sequence: Synthetic coding sequence
atgaagtgggtgagcttcatctcgcttctctttctgttctcctcagcctacagcggctcgttggataaacggcacggagacgggtccttctcagatgaaatgaacaccattctggacaatctggcggcacgcgacttcatcaactggctcatccagaccaagatcactgac

SEQ ID NO: 12357 - DNA, 171 bp, Artificial Sequence
  Description of Artificial Sequence: Synthetic coding sequence
atgaagtgggtgagtttcatttctttgctgtttctgttctcatctgcgtattcaggaagtctcgacaagagacacggcgacggcagttttagcgacgaaatgaacaccatcctagacaacctggccgctagggattttatcaactggcttattcagacaaagatcaccgac

SEQ ID NO: 12358 - DNA, 171 bp, Artificial Sequence
  Description of Artificial Sequence: Synthetic coding sequence
atgaaatgggtgtctttcatctccctcctatttttgttctccagtgcctatagcggctctcttgacaagcgccatggcgacggaagcttcagcgacgaaatgaacacaatcctggacaatctggcagcgagagactttattaactggctgattcagacaaaaattacggac

SEQ ID NO: 12359 - DNA, 171 bp, Artificial Sequence
  Description of Artificial Sequence: Synthetic coding sequence
atgaagtgggtgtccttcattagcctgctgtttttgttctcgagcgcgtactcgggctccctggataagagacacggagatggatccttttccgatgaaatgaataccatcctcgataatctcgcagccagagactttatcaactggctcatccagactaagattaccgat

SEQ ID NO: 12360 - DNA, 171 bp, Artificial Sequence
  Description of Artificial Sequence: Synthetic coding sequence
atgaagtgggtttcattcatatctctactcttcttgtttagcagcgcttatagcgggagcctagacaagcgccatggcgatggaagtttttccgacgaaatgaacactatcctagacaaccttgctgcgcgcgattttattaactggctgatacagacgaagatcacagat

SEQ ID NO: 12361 - DNA, 171 bp, Artificial Sequence
  Description of Artificial Sequence: Synthetic coding sequence
atgaagtgggtttcttttatctcactcctctttcttttctcttcggcctacagcggctctctggataagcggcatggagacgggtcgttcagcgacgagatgaacacaattttagacaacctggcagcccgggactttatcaattggctgatccagacgaagatcactgac

SEQ ID NO: 12362 - DNA, 171 bp, Artificial Sequence
  Description of Artificial Sequence: Synthetic coding sequence
atgaagtgggtgtccttcatatcacttttgtttcttttttccagcgcttactccgggtcgcttgataagcggcatggagacgggtcttttagcgatgagatgaacaccatcctggacaatctcgccgcccgtgatttcattaactggctcatccagactaaaatcaccgat

SEQ ID NO: 12363 - DNA, 171 bp, Artificial Sequence
  Description of Artificial Sequence: Synthetic coding sequence
atgaaatgggtctctttcatttccctgttgttcctgttcagctctgcttatagcgggagtctcgataaaagacacggcgacggatcgttcagcgatgagatgaacacaatacttgataatctcgcagcgcgggacttcatcaattggctgatacagacaaagatcaccgat

SEQ ID NO: 12364 - DNA, 171 bp, Artificial Sequence
  Description of Artificial Sequence: Synthetic coding sequence
atgaagtgggtgtcatttatctccttgctctttctcttttcgtctgcgtactcaggatccctggataaaaggcatggagacggctccttttcagacgagatgaacaccatcctcgacaatcttgctgcaagagacttcataaactggcttattcaaacgaagataactgat

SEQ ID NO: 12365 - DNA, 171 bp, Artificial Sequence
  Description of Artificial Sequence: Synthetic coding sequence
atgaagtgggtgtcttttatctcgctccttttcctgtttagctctgcctacagtggcagcctagataagagacacggggacggcagtttttcagatgaaatgaacacgattttggataaccttgctgcaagggatttcatcaattggctaattcaaaccaagatcacagat

SEQ ID NO: 12366 - DNA, 171 bp, Artificial Sequence
  Description of Artificial Sequence: Synthetic coding sequence
atgaaatgggtttcatttatcagccttctgtttctgttttcaagcgcatactccggatccctggataagagacacggcgatggatccttctcggacgaaatgaacaccattttggacaatcttgctgcgcgcgacttcataaactggctcattcagacgaagattaccgat

SEQ ID NO: 12367 - DNA, 171 bp, Artificial Sequence
  Description of Artificial Sequence: Synthetic coding sequence
atgaagtgggtgagtttcatctcactactgtttctgttcagttcagcttattcaggaagcttagataaaaggcacggtgacggctccttctctgatgagatgaacacgatcctggacaacctggcggcccgtgattttatcaactggctgatccagactaagatcactgac

SEQ ID NO: 12368 - DNA, 171 bp, Artificial Sequence
  Description of Artificial Sequence: Synthetic coding sequence
atgaagtgggtttccttcattagccttctctttcttttttcgtcagcttacagcggttccctggacaaaagacatggagacggctcattttccgacgaaatgaataccatcttggataacctggccgcacgtgatttcatcaactggctgattcaaacgaagataactgat

SEQ ID NO: 12369 - DNA, 171 bp, Artificial Sequence
  Description of Artificial Sequence: Synthetic coding sequence
atgaagtgggtgtcgtttatctcgctcctgttcttgttcagcagcgcatactccggatcgttggataagcggcatggagacggatcctttagcgacgaaatgaataccattcttgataaccttgcagcccgtgactttatcaactggctgatccagaccaagataaccgat

SEQ ID NO: 12370 - DNA, 171 bp, Artificial Sequence
  Description of Artificial Sequence: Synthetic coding sequence
atgaagtgggtgagcttcatatcgctgttgtttcttttctcttccgcgtactccgggtctctggataagcggcatggggacggaagtttttcagatgagatgaataccattcttgacaatctggctgcccgagactttatcaattggctcatccaaacaaaaatcacggac

SEQ ID NO: 12371 - DNA, 171 bp, Artificial Sequence
  Description of Artificial Sequence: Synthetic coding sequence
atgaagtgggtgtcgtttatcagcctgctcttcctctttagctcggcgtactccggatcactggacaagaggcacggtgatgggtccttctccgatgaaatgaacaccattctggataaccttgccgcccgagacttcattaactggctgattcaaaccaagataaccgat

SEQ ID NO: 12372 - DNA, 171 bp, Artificial Sequence
  Description of Artificial Sequence: Synthetic coding sequence
atgaagtgggtttcttttataagcttgctttttctgttttcttcggcttattccggctccttagataaaagacacggtgatggtagttttagtgatgagatgaatacgatcctagataatctagccgcaagagattttatcaattggctgattcaaacgaagattacagat

SEQ ID NO: 12373 - DNA, 171 bp, Artificial Sequence
  Description of Artificial Sequence: Synthetic coding sequence
atgaagtgggtgtcattcatctccctgctgtttctcttctcgtccgcatactcgggctcactggacaaacgccatggagacggatccttttccgacgagatgaataccattctggacaacctggcggcccgcgactttatcaactggctgatccagactaagatcactgac

SEQ ID NO: 12374 - DNA, 171 bp, Artificial Sequence
  Description of Artificial Sequence: Synthetic coding sequence
atgaaatgggtgagcttcatttccttgcttttcctctttagctctgcatactctggaagtcttgacaaaagacacggggacggatcttttagtgatgagatgaatacaatactggataatttggcagctcgggatttcatcaattggctgatccagacaaaaatcacagat

SEQ ID NO: 12375 - DNA, 171 bp, Artificial Sequence
  Description of Artificial Sequence: Synthetic coding sequence
atgaagtgggtgtcctttatctccctactgttcctttttagcagtgcttactctggttcattggacaagcgccacggcgacggatctttctctgacgaaatgaacactattttagacaacctggccgcccgggacttcatcaactggttaattcaaacaaagattacagac

SEQ ID NO: 12376 - DNA, 171 bp, Artificial Sequence
  Description of Artificial Sequence: Synthetic coding sequence
atgaagtgggtgtcattcattagcctgctttttctgttctcgtcagcctacagcggtagccttgacaagcgccacggcgacggatcattctccgatgaaatgaacactatcctggacaacctggcggcccgggactttatcaattggctcatccaaacgaagataacggat

SEQ ID NO: 12377 - DNA, 171 bp, Artificial Sequence
  Description of Artificial Sequence: Synthetic coding sequence
atgaaatgggtgagctttatctcactgctctttcttttctcatcggcctactccggtagcttggataagagacatggagatggttccttttccgatgagatgaataccatcctcgacaacctcgccgcacgcgacttcatcaactggctgattcaaacgaagattactgac

SEQ ID NO: 12378 - DNA, 171 bp, Artificial Sequence
  Description of Artificial Sequence: Synthetic coding sequence
atgaaatgggtgagtttcatttcactcttgttccttttttcctcggcctacagtggaagcctggataagagacacggcgacgggtcgtttagcgatgaaatgaacactatcctggataacctcgctgcgcgggacttcatcaattggctgatccagacgaagatcaccgac

SEQ ID NO: 12379 - DNA, 171 bp, Artificial Sequence
  Description of Artificial Sequence: Synthetic coding sequence
atgaagtgggtgtcgttcatctccctgctcttcctgttctccagcgcctactccggctcgttggacaagcgacacggggacgggagcttctccgatgaaatgaataccatccttgacaacctcgcagctagagactttatcaactggctgattcaaactaaaatcacggat

SEQ ID NO: 12380 - DNA, 171 bp, Artificial Sequence
  Description of Artificial Sequence: Synthetic coding sequence
atgaagtgggtgagctttatctcattgctgttcctcttttctagtgcatattctggctctctggataagcgccatggagacggtagcttctctgacgagatgaataccattctggacaacttagccgcacgcgacttcatcaattggttgatacagacaaaaattaccgat

SEQ ID NO: 12381 - DNA, 171 bp, Artificial Sequence
  Description of Artificial Sequence: Synthetic coding sequence
atgaagtgggtctcattcatctcactgctgtttctattttcttctgcctactcgggatccctcgacaaacgtcatggtgacggctcattttctgacgagatgaacactattctggataacctggccgctcgagatttcatcaattggctgattcaaacaaagattacagac

SEQ ID NO: 12382 - DNA, 171 bp, Artificial Sequence
  Description of Artificial Sequence: Synthetic coding sequence
atgaagtgggtctctttcatatctctcttattcctgttctcgtcggcatactctggtagcctcgataagaggcatggtgatggttcgttctctgatgaaatgaacacaatcttggataacctggcagcccgcgatttcatcaactggctgatccagaccaagatcaccgac

SEQ ID NO: 12383 - DNA, 171 bp, Artificial Sequence
  Description of Artificial Sequence: Synthetic coding sequence
atgaagtgggtgtcctttatcagtctcctgttcctcttttcatcggcttactccggaagcctcgacaaaagacatggtgatggcagcttctcggacgaaatgaacactattctcgacaatctcgcggcccgggacttcatcaactggctcatccaaacgaagattaccgat

SEQ ID NO: 12384 - DNA, 171 bp, Artificial Sequence
  Description of Artificial Sequence: Synthetic coding sequence
atgaaatgggtatcgttcatctcgctcctgtttctcttctcaagcgcgtactccggatccctcgataagagacacggagacggatcgtttagcgatgaaatgaacactatacttgataacctggctgccagggatttcatcaattggctcattcagaccaagatcaccgac

SEQ ID NO: 12385 - DNA, 171 bp, Artificial Sequence
  Description of Artificial Sequence: Synthetic coding sequence
atgaagtgggtgtcgtttatctcccttctgtttctgttttcctccgcgtacagcggatcacttgataaacgccatggggatggctcattttccgatgaaatgaacaccattctggacaaccttgcagcacgagatttcatcaactggctgatccaaaccaagattactgac

SEQ ID NO: 12386 - DNA, 171 bp, Artificial Sequence
  Description of Artificial Sequence: Synthetic coding sequence
atgaaatgggtgagcttcatttcgctgctgttcctgttctcatctgcttacagcggatcccttgacaaaagacatggagacggatcgttttccgatgaaatgaacaccatcctcgacaatctggccgcgcgggactttatcaactggctgatccagactaagattacggac

SEQ ID NO: 12387 - DNA, 171 bp, Artificial Sequence
  Description of Artificial Sequence: Synthetic coding sequence
atgaaatgggtgagttttatatctctgctgtttctattctcttccgcctatagtggttctctcgacaaacggcacggtgacggatcattcagtgacgagatgaacactatactagacaaccttgctgcccgcgactttattaattggctgatacagacaaagatcaccgac

SEQ ID NO: 12388 - DNA, 171 bp, Artificial Sequence
  Description of Artificial Sequence: Synthetic coding sequence
atgaagtgggtgagcttcatctcgctgctttttctgtttagctccgcttactccggatcgctggacaagcgccatggcgatggctcattctcagacgaaatgaacactatcctggacaatttggcagctagggacttcatcaactggctcattcagactaagattaccgat

SEQ ID NO: 12389 - DNA, 171 bp, Artificial Sequence
  Description of Artificial Sequence: Synthetic coding sequence
atgaaatgggtctcgtttatctctctgctgttccttttctctagcgcatacagtggatcgctggataagcgccacggtgatggatcattcagcgatgagatgaacactattctggataacttggctgctagagactttataaactggctgatccagacaaaaataactgac

SEQ ID NO: 12390 - DNA, 171 bp, Artificial Sequence
  Description of Artificial Sequence: Synthetic coding sequence
atgaaatgggtgtcctttatctccctcctctttctgttctcttcggcatactcggggtcgctggataagcgccacggagacggctcattctcggatgagatgaacaccatactcgacaatcttgcggccagagacttcatcaactggctgatccagactaagattaccgac

SEQ ID NO: 12391 - DNA, 171 bp, Artificial Sequence
  Description of Artificial Sequence: Synthetic coding sequence
atgaaatgggtgtcgtttatctccctcttgttcctcttttcctccgcatactcgggatcactggacaagaggcacggcgacgggagcttctcagatgaaatgaataccatcttggacaacctggctgcgcgggatttcatcaactggctgatacagacgaagatcactgac

SEQ ID NO: 12392 - DNA, 171 bp, Artificial Sequence
  Description of Artificial Sequence: Synthetic coding sequence
atgaaatgggtatcgtttatatcgttattatttttattttcgtcggcgtattcgggttcgctagataaacgacatggtgatggttcgttttcggatgaaatgaatacgatattagataatctagcggcgcgagattttataaattggttaatacaaacgaaaataacggat

SEQ ID NO: 12393 - DNA, 171 bp, Artificial Sequence
  Description of Artificial Sequence: Synthetic coding sequence
atgaagtgggtgagcttcatcagcctgcttttcctcttctccagcgcatactcagggtcgctcgataagcggcacggggatggttccttttcggatgaaatgaacaccattctggataatcttgcagcacgggactttatcaactggctgatacagaccaaaatcactgac

SEQ ID NO: 12394 - DNA, 171 bp, Artificial Sequence
  Description of Artificial Sequence: Synthetic coding sequence
atgaagtgggtgtcttttatctccctccttttcctattctccagcgcatatagcggttccctggacaagcggcatggcgatgggagcttctcagacgaaatgaatactatccttgacaatctggcggccagagactttattaactggctaatccagacgaagatcaccgac

SEQ ID NO: 12395 - DNA, 171 bp, Artificial Sequence
  Description of Artificial Sequence: Synthetic coding sequence
atgaagtgggtctcctttatctcactgctgttcttgttttcgtccgcatacagtggctcattagataaacggcacggagatgggtcgttttccgatgagatgaataccattcttgacaacctcgcagcccgagactttattaattggttgatccagacaaaaattactgat

SEQ ID NO: 12396 - DNA, 171 bp, Artificial Sequence
  Description of Artificial Sequence: Synthetic coding sequence
atgaagtgggtgtcatttatctctctcctgtttcttttctcgagcgcatactcaggatcgctggacaaacggcacggtgacggctcattctccgatgagatgaacactatcctcgacaatctggcggcccgagatttcatcaactggttgatccaaacgaagatcaccgac

SEQ ID NO: 12397 - DNA, 171 bp, Artificial Sequence
  Description of Artificial Sequence: Synthetic coding sequence
atgaaatgggtgtcatttatcagcctgctttttctcttctcgtccgcctactcgggtagccttgacaagcgccacggtgatggttcctttagcgatgaaatgaacacgatcctggacaacctggcagcgagggatttcattaactggcttattcagaccaaaatcaccgat

SEQ ID NO: 12398 - DNA, 171 bp, Artificial Sequence
  Description of Artificial Sequence: Synthetic coding sequence
atgaagtgggtcagctttatctccttgctttttctgttctcttcggcctacagcggatcactggataagaggcatggggatggatctttttcagacgaaatgaacacgatccttgacaatctggcggcacgcgacttcattaactggcttatccaaactaagattactgat

SEQ ID NO: 12399 - DNA, 171 bp, Artificial Sequence
  Description of Artificial Sequence: Synthetic coding sequence
atgaagtgggtatcgtttatctcgctgctctttctcttcagtagcgcttattcgggttccctcgacaaacgccacggtgatggctccttctcagacgagatgaacaccatcctcgataacttagccgctcgagactttataaattggctaattcagacaaaaattacagac

SEQ ID NO: 12400 - DNA, 171 bp, Artificial Sequence
  Description of Artificial Sequence: Synthetic coding sequence
atgaaatgggtttctttcatttcattactttttcttttctctagtgcatattcaggaagtcttgataaaagacatggggatggatcctttagtgatgaaatgaatactattttagataatttagcagcaagagattttattaattggcttattcaaactaaaataactgat

SEQ ID NO: 12401 - DNA, 171 bp, Artificial Sequence
  Description of Artificial Sequence: Synthetic coding sequence
atgaagtgggtcagcttcatttcactcctgttccttttttcctcggcctactccggcagcctggacaagcgacacggagatggctcattttcggatgaaatgaacacgattctggacaaccttgctgcacgcgacttcatcaattggctgatacagactaagattaccgac

SEQ ID NO: 12402 - DNA, 171 bp, Artificial Sequence
  Description of Artificial Sequence: Synthetic coding sequence
atgaaatgggtcagcttcatctccttgctgtttctcttctctagcgcgtactcaggttctctggataagagacacggagacggatccttcagtgatgaaatgaatacaatcttggataacctggccgcccgtgacttcattaactggctgatccagactaagatcaccgac

SEQ ID NO: 12403 - DNA, 171 bp, Artificial Sequence
  Description of Artificial Sequence: Synthetic coding sequence
atgaaatgggtaagttttatcagccttttattcttgttctccagtgcttactcaggttcactcgataagcgacatggggacggcagtttttccgatgagatgaacactattctggataacctagccgctcgcgatttcattaattggctgattcagaccaaaatcactgac

SEQ ID NO: 12404 - DNA, 171 bp, Artificial Sequence
  Description of Artificial Sequence: Synthetic coding sequence
atgaaatgggtttcctttataagtctcctttttctgtttagttccgcatatagtggaagtttggataagcgtcacggagacggttctttttccgacgaaatgaacactatccttgataatttggctgctcgcgatttcatcaactggctcatccagacaaagatcactgac

SEQ ID NO: 12405 - DNA, 171 bp, Artificial Sequence
  Description of Artificial Sequence: Synthetic coding sequence
atgaagtgggtctccttcatctccctgctcttcctgttttcttcagcctacagcggaagtcttgacaagagacatggagacggcagctttagcgacgaaatgaacactattttagacaatctggccgcaagagatttcattaactggttgatacagactaagatcactgac

SEQ ID NO: 12406 - DNA, 171 bp, Artificial Sequence
  Description of Artificial Sequence: Synthetic coding sequence
atgaaatgggtgtcctttatctcacttctgttccttttttcgtcagcttactctggtagcctggacaagagacacggcgacggatcgttctcggacgagatgaataccatcctggacaacctggcggcccgcgatttcatcaactggctgatccagactaagatcacggat

SEQ ID NO: 12407 - DNA, 171 bp, Artificial Sequence
  Description of Artificial Sequence: Synthetic coding sequence
atgaagtgggtgtcgtttatcagtctcctttttctgttcagctctgcatattccggctcattagataaaaggcacggagatggtagcttctcagacgaaatgaacaccatcctagataatcttgctgcaagggactttattaactggctaatacagacgaagatcacagac

SEQ ID NO: 12408 - DNA, 171 bp, Artificial Sequence
  Description of Artificial Sequence: Synthetic coding sequence
atgaaatgggttagttttatctcactgctcttcctgttctcatccgcgtatagtggcagtctggacaagagacacggcgacggctccttctctgacgagatgaacacaatcttagacaacttggcagcacgagatttcatcaactggctgatacagacaaaaattactgac

SEQ ID NO: 12409 - DNA, 171 bp, Artificial Sequence
  Description of Artificial Sequence: Synthetic coding sequence
atgaagtgggtgtctttcatctcgcttctgttcttgttctcttccgcgtacagcggatcgctggataaaagacacggcgacggatctttctcagacgaaatgaataccatcttggataacctggcagctagggactttatcaactggctgattcagaccaagatcactgac

SEQ ID NO: 12410 - DNA, 171 bp, Artificial Sequence
  Description of Artificial Sequence: Synthetic coding sequence
atgaagtgggtatcattcatatctctgctctttctgttctcctctgcctattctggatctctagataaacgtcacggagatgggtcgttcagtgatgaaatgaacactatactggataaccttgccgctagggatttcataaactggctaatacagacaaaaataactgat

SEQ ID NO: 12411 - DNA, 171 bp, Artificial Sequence
  Description of Artificial Sequence: Synthetic coding sequence
atgaagtgggtgagctttatttcgttgctttttctgttttcgtccgcttattctggttcccttgacaagcgccacggagatggttcctttagcgacgagatgaacactattctggataacttagccgcccgagacttcatcaattggctgatacagactaagatcactgat

SEQ ID NO: 12412 - DNA, 171 bp, Artificial Sequence
  Description of Artificial Sequence: Synthetic coding sequence
atgaagtgggtctcttttatctcattgctgttcctgttcagtagcgcctattccgggtcgctcgacaagagacacggcgatggttccttctccgacgagatgaacacaatccttgataaccttgctgccagagattttattaattggctcatccagacgaagataaccgat

SEQ ID NO: 12413 - DNA, 171 bp, Artificial Sequence; identical to SEQ ID NO: 12387
  Description of Artificial Sequence: Synthetic coding sequence

SEQ ID NO: 12414 - DNA, 171 bp, Artificial Sequence
  Description of Artificial Sequence: Synthetic coding sequence
atgaaatgggtgtccttcatcagcctcctctttcttttttcctctgcctatagcgggagtctggataaaagacacggagacgggtccttttccgacgagatgaacactattcttgacaaccttgccgccagagatttcatcaattggctgattcaaacaaaaattaccgac

SEQ ID NO: 12415 - DNA, 171 bp, Artificial Sequence
  Description of Artificial Sequence: Synthetic coding sequence
atgaagtgggtgtccttcatttcactgctgttcctcttttcatcggcctactccggaagcctggacaaacggcacggagacgggtccttttccgatgagatgaatactatccttgacaacctggccgcccgcgacttcatcaattggctcattcagaccaagatcactgac

SEQ ID NO: 12416 - DNA, 171 bp, Artificial Sequence
  Description of Artificial Sequence: Synthetic coding sequence
atgaagtgggtgtctttcatatctctcctcttccttttctcgagcgcatattcgggctccctggacaaacgccacggagacggatcatttagcgacgaaatgaacaccatcctggataatctggccgcccgggactttatcaattggctcatccaaactaagattactgat

SEQ ID NO: 12417 - DNA, 171 bp, Artificial Sequence
  Description of Artificial Sequence: Synthetic coding sequence
atgaaatgggtctctttcatttcactccttttcctcttttcttcagcgtacagtggctcacttgacaaacgtcacggagatggcagtttttccgatgaaatgaatacgattcttgacaatcttgcagcccgcgattttatcaattggctgatccaaactaaaattacagat

SEQ ID NO: 12418 - DNA, 171 bp, Artificial Sequence
  Description of Artificial Sequence: Synthetic coding sequence
atgaagtgggtgtcctttatctcactgctgtttctgtttagctccgcctactccggcagtcttgacaaaaggcacggggatggcagcttttctgacgagatgaatacaattcttgataacttggctgctcgagactttatcaactggcttatccagaccaaaatcactgac

SEQ ID NO: 12419 - DNA, 171 bp, Artificial Sequence
  Description of Artificial Sequence: Synthetic coding sequence
atgaaatgggtaagctttatctctttactgttccttttctcatccgcttactccggatcactggataagaggcacggggatggctccttttccgatgaaatgaacaccattcttgataacttggcagcacgagatttcataaactggctgatccagacaaagatcacagac

SEQ ID NO: 12420 - DNA, 171 bp, Artificial Sequence
  Description of Artificial Sequence: Synthetic coding sequence
atgaagtgggtttcttttatcagtctcttgttccttttctcttctgcctatagtgggtcacttgacaagcgccatggagatggcagttttagtgatgaaatgaacaccatcctggacaacctagcagcccgtgactttataaattggctcatacaaaccaagatcaccgat

SEQ ID NO: 12421 - DNA, 171 bp, Artificial Sequence
  Description of Artificial Sequence: Synthetic coding sequence
atgaagtgggtctcattcatatcactgctctttctgttcagttccgcctatagtggtagtctagacaagcgacatggggacgggtctttcagtgatgaaatgaacaccatcctagataacttggccgctagagactttattaattggctgattcaaacaaaaattacagat

SEQ ID NO: 12422 - DNA, 171 bp, Artificial Sequence
  Description of Artificial Sequence: Synthetic coding sequence
atgaagtgggtcagcttcatctccctcctcttcctgttctccagtgcatactcgggttcgctggataaacgccacggagacggctcgttctcagacgaaatgaacactattctggataatctggccgcgagggactttatcaactggctcatacagacgaagatcaccgat

SEQ ID NO: 12423 - DNA, 171 bp, Artificial Sequence
  Description of Artificial Sequence: Synthetic coding sequence
atgaagtgggtgagtttcatatcattgctgttcttattttccagtgcttatagtgggtcactcgacaagaggcacggcgacgggtcattctccgacgaaatgaataccatcttagacaacttggctgccagagattttatcaactggttgattcagaccaaaatcaccgat

SEQ ID NO: 12424 - DNA, 171 bp, Artificial Sequence
  Description of Artificial Sequence: Synthetic coding sequence
atgaagtgggtctcttttattagcctacttttcttattctcttccgcctactccggaagtctggacaagcggcacggagacggttccttcagtgacgaaatgaacactatcttggacaatctggcggcacgggacttcatcaactggctgatccagactaagatcacagat

SEQ ID NO: 12425 - DNA, 171 bp, Artificial Sequence
  Description of Artificial Sequence: Synthetic coding sequence
atgaagtgggtgtcgtttatctccctgctgtttctcttctcctcagcctactctggcagcctcgacaaacggcatggtgatggatcgttttcagatgagatgaacactattctcgacaacctggccgcaagagacttcatcaattggttgattcaaactaagataaccgat

SEQ ID NO: 12426 - DNA, 171 bp, Artificial Sequence
  Description of Artificial Sequence: Synthetic coding sequence
atgaagtgggtgagcttcatctcgttgctgtttctgttttcaagcgcatactcgggttcactggacaaaagacacggtgacggcagcttctcagatgaaatgaacactatcctggacaatctggctgcccgggatttcattaactggctcatccaaacgaaaatcactgac

SEQ ID NO: 12427 - DNA, 171 bp, Artificial Sequence
  Description of Artificial Sequence: Synthetic coding sequence
atgaagtgggttagcttcatctcgctgctgttcttgtttagctccgcctatagcggttccctggacaaaaggcatggagacggtagcttttccgacgagatgaacacgattctggataacctggctgcgcgcgactttatcaactggttgattcaaaccaagattaccgac

SEQ ID NO: 12428 - DNA, 171 bp, Artificial Sequence
  Description of Artificial Sequence: Synthetic coding sequence
atgaaatgggtgtccttcatcagcctcctcttcctgttctcatccgcatactccggatcgctggacaagcggcacggggatggatcattctccgacgaaatgaacactatcctcgacaacctggcggcgagagacttcattaactggctgatccaaaccaagattacggat

SEQ ID NO: 12429 - DNA, 171 bp, Artificial Sequence
  Description of Artificial Sequence: Synthetic coding sequence
atgaagtgggtctcctttattagcctccttttccttttctcttcagcgtatagcggatctcttgacaaacgacatggcgacggctcattttccgacgaaatgaatacaattctagataatctcgccgccagggattttattaattggctgatccagaccaaaattaccgac

SEQ ID NO: 12430 - DNA, 171 bp, Artificial Sequence
  Description of Artificial Sequence: Synthetic coding sequence
atgaaatgggtttcattcatctccctgctctttttgttctcaagcgcttactccgggtcgctggacaaacgccatggggacgggtccttctccgacgagatgaacaccatcctggacaatctggccgccagagattttatcaactggttgatccagaccaagataacggat

SEQ ID NO: 12431 - DNA, 171 bp, Artificial Sequence
  Description of Artificial Sequence: Synthetic coding sequence
atgaagtgggtgtccttcatttcactgctcttcctgtttagtagcgcgtattccggttctctggacaaaaggcatggggacggctcattcagtgacgaaatgaataccattctggacaacctggctgcacgggactttattaattggctcattcagactaagatcacagac

SEQ ID NO: 12432 - DNA, 171 bp, Artificial Sequence
  Description of Artificial Sequence: Synthetic coding sequence
atgaaatgggtgagttttatatcactccttttccttttttcttccgcttactccgggagtctcgataagagacacggggatggatcgttctcagatgaaatgaacacaattctcgataatctcgctgcaagggatttcataaactggctcattcagacaaaaatcactgat

SEQ ID NO: 12433 - DNA, 171 bp, Artificial Sequence
  Description of Artificial Sequence: Synthetic coding sequence
atgaaatgggtgagctttatctccctgcttttcctctttagctcagcatactctggatccctggataagagacacggagatggctcattcagtgatgaaatgaataccatactggacaacctggccgcccgcgatttcattaactggctcatccagactaagatcactgac

SEQ ID NO: 12434 - DNA, 171 bp, Artificial Sequence
  Description of Artificial Sequence: Synthetic coding sequence
atgaaatgggtgagctttatcagccttctttttcttttttcatccgcttactcaggctcgcttgacaagagacatggagacggttcgttcagcgatgagatgaacactatcctggacaaccttgcagcaagggactttatcaattggcttattcagaccaagattaccgac

SEQ ID NO: 12435 - DNA, 171 bp, Artificial Sequence
  Description of Artificial Sequence: Synthetic coding sequence
atgaaatgggtgagcttcattagcctgctgtttcttttctcgagcgcatactcgggctcacttgacaagcgccatggcgacggatcgttcagcgatgaaatgaataccatactggacaatctcgctgcacgggactttatcaattggctgattcagacgaaaatcaccgat

SEQ ID NO: 12436 - DNA, 171 bp, Artificial Sequence
  Description of Artificial Sequence: Synthetic coding sequence
atgaagtgggtttctttcatctctttgctattcttgttttcatccgcatattctggcagccttgataagaggcacggcgatggcagtttcagcgacgaaatgaacactattctggacaacttggctgctcgagattttatcaactggctcatacaaactaaaatcaccgac

SEQ ID NO: 12437 - DNA, 171 bp, Artificial Sequence
  Description of Artificial Sequence: Synthetic coding sequence
atgaagtgggtatcctttatttctcttctttttctgtttagttccgcgtattctggttctctggataagcgacacggtgatggttccttttcagatgaaatgaacaccattcttgataacctggctgctcgcgactttatcaactggttgattcaaaccaagatcaccgat

SEQ ID NO: 12438 - DNA, 171 bp, Artificial Sequence
  Description of Artificial Sequence: Synthetic coding sequence
atgaaatgggtgagtttcatctccctgctgttcctttttagctcagcctactctggatccctggataagaggcacggggatggaagcttttctgacgagatgaatacaatcctcgacaacctcgctgctagggacttcatcaattggctgatccaaactaagatcacagac

SEQ ID NO: 12439 - DNA, 171 bp, Artificial Sequence
  Description of Artificial Sequence: Synthetic coding sequence
atgaagtgggtgtcctttattagcctcctgttcctatttagttccgcttactccggatccctggataaacgccatggcgatggcagttttagcgacgagatgaataccatcctcgataacttggctgcgagggatttcattaactggcttatccagactaagattaccgat

SEQ ID NO: 12440 - DNA, 171 bp, Artificial Sequence
  Description of Artificial Sequence: Synthetic coding sequence
atgaagtgggtttcatttatctcactgctcttcctgtttagctccgcttacagcgggagcctcgataaacgccacggcgacggttctttctcggacgaaatgaacaccatattggacaatctggccgcgcgggattttattaattggttgatacagacaaaaattacagat

SEQ ID NO: 12441 - DNA, 171 bp, Artificial Sequence
  Description of Artificial Sequence: Synthetic coding sequence
atgaagtgggtgagttttatttcccttcttttcctgttcagctcagcgtactcaggaagtctggacaaacgccacggggacggtagcttttctgatgaaatgaataccattctcgataatctcgctgctcgcgacttcatcaactggctgatccagaccaaaataactgac

SEQ ID NO: 12442 - DNA, 171 bp, Artificial Sequence
  Description of Artificial Sequence: Synthetic coding sequence
atgaaatgggtcagttttatctccctcttgttcctctttagctcagcatattccggcagtctggacaaaaggcatggcgacggatcatttagtgatgaaatgaacaccattctggataatcttgcggctagggatttcattaactggctgatccagaccaagatcacagac

SEQ ID NO: 12443 - DNA, 165 bp, Artificial Sequence
  Description of Artificial Sequence: Synthetic coding sequence
atgccatcatcagtgtcatggggaattctgctgctggcaggtctttgttgtttggtgccggtgtcccttgctcacgcagaaggaacttttacttccgatgtgtcgagctacttggagggacaggccgcgaaggaattcatagcatggctggtccgggggcgagga

SEQ ID NO: 12444 - DNA, 165 bp, Artificial Sequence
  Description of Artificial Sequence: Synthetic coding sequence
atgccatcaagcgtgtcctggggtatcctgctcctagccgggctgtgttgcctggtgccagtctctttggctcacgcagagggtaccttcaccagcgatgtaagtagctacctggaggggcaggcagccaaggaattcatagcctggctggtaagggggaggggg

SEQ ID NO: 12445 - DNA, 165 bp, Artificial Sequence
  Description of Artificial Sequence: Synthetic coding sequence
atgccatctagtgtgagttggggcatcttgttgctggcgggtctgtgctgccttgtacccgttagtctggctcacgcagagggaacgtttacctctgacgtgtcctcatatttggaagggcaggccgccaaagaattcatagcctggctggtgcgtggtcgggga

SEQ ID NO: 12446 - DNA, 165 bp, Artificial Sequence
  Description of Artificial Sequence: Synthetic coding sequence
atgcccagcagcgtgagttggggtattctcctgctcgcgggtctgtgctgcctcgtaccggtgtcactggcgcacgcagagggaacattcacgtctgatgtgtccagctatctggaaggacaggcggctaaagaatttatcgcatggctggtgagggggagaggt

SEQ ID NO: 12447 - DNA, 165 bp, Artificial Sequence
  Description of Artificial Sequence: Synthetic coding sequence
atgccgtcgtcggtatcgtggggtatattactattagcgggtttatgttgtttagttccggtttcgttagcgcatgcggaaggtacgtttacgtcggatgtttcgtcgtatttagaaggtcaagcggcgaaagaatttatagcgtggctagtacgtggtcgaggt

SEQ ID NO: 12448 - DNA, 165 bp, Artificial Sequence
  Description of Artificial Sequence: Synthetic coding sequence
atgccaagctcagtgtcttggggaatcttgctgttggccggtctttgctgcctggtgccggtgtccctcgcccatgccgagggaacttttaccagcgacgtgtcatcgtacctcgaaggccaggccgccaaggagttcattgcgtggctggtgaggggacgcgga

SEQ ID NO: 12449 - DNA, 165 bp, Artificial Sequence
  Description of Artificial Sequence: Synthetic coding sequence
atgccttcctccgtgtcatggggtattctgctgcttgcaggcctctgttgcctggtgcctgtgtccttggcccacgctgaaggcacttttacttccgacgtttcgagctaccttgaaggtcaagcagccaaggagttcatcgcttggctcgtgcgcgggcgtgga

SEQ ID NO: 12450 - DNA, 165 bp, Artificial Sequence
  Description of Artificial Sequence: Synthetic coding sequence
atgccaagcagcgtgagctggggaatcctgctcctggccggcctctgctgtctcgtcccggtgtcccttgctcatgcggaaggaacgtttacctccgacgtcagctcctacctggaggggcaggcggcgaaggagttcatcgcttggcttgtgcgcggtcgcggt

SEQ ID NO: 12451 - DNA, 165 bp, Artificial Sequence
  Description of Artificial Sequence: Synthetic coding sequence
atgcctagctcggtgtcctggggcattctcctgcttgcaggactgtgctgtctcgttcctgtctcgctggcccatgcagaaggtacttttacgtccgatgtgtcatcctacctggaaggacaggcagcaaaggaattcatcgcgtggttggtcagaggccgaggc

SEQ ID NO: 12452 - DNA, 165 bp, Artificial Sequence
  Description of Artificial Sequence: Synthetic coding sequence
atgccatcctcggttagctggggaattctgctgctcgcaggtctgtgttgccttgtgcccgtttcgctggcgcatgccgaaggaactttcacctccgatgtgtccagttacctcgaaggtcaagctgcaaaggagtttatcgcctggttggtcagaggacgtggc

SEQ ID NO: 12453 - DNA, 165 bp, Artificial Sequence
  Description of Artificial Sequence: Synthetic coding sequence
atgccttcaagcgtgtcatggggcattcttttgctggcaggactttgctgtcttgtccccgtgtccctcgcacatgctgaaggaacgtttacctcagatgtctcgtcgtacctggaaggacaggcagcgaaggaattcatcgcttggctcgtcagaggaaggggc

SEQ ID NO: 12454 - DNA, 165 bp, Artificial Sequence
  Description of Artificial Sequence: Synthetic coding sequence
atgcctagcagcgtatcctggggcattctccttctggcgggtctgtgctgcttagtcccagtgtccctcgcgcatgccgaaggcaccttcacgtccgacgtcagctcctatctggagggccaggcggcgaaagaattcatcgcttggctcgtcagaggcaggggt

SEQ ID NO: 12455 - DNA, 165 bp, Artificial Sequence
  Description of Artificial Sequence: Synthetic coding sequence
atgcctagcagcgtcagctggggaatcctccttctcgccggactttgctgtctggtgccagtatcgctggctcatgcagaaggaacctttacttctgatgtctcatcgtacctggagggccaagctgccaaggaattcattgcatggctggtccgcgggagaggt

SEQ ID NO: 12456 - DNA, 165 bp, Artificial Sequence
  Description of Artificial Sequence: Synthetic coding sequence
atgcccagcagtgtatcgtggggaatccttttgctcgccggcctgtgctgcctcgtcccggtctccttggctcacgcagaaggcacattcaccagcgacgtcagtagctaccttgaggggcaggcagccaaggaatttatcgcgtggctcgtgcgaggcagaggc

SEQ ID NO: 12457 - DNA, 165 bp, Artificial Sequence
  Description of Artificial Sequence: Synthetic coding sequence
atgccttcatctgtgtcttggggtattctcctccttgctggtctgtgctgcttggttcccgtttcactggcacatgctgagggcaccttcacttctgatgtcagttcgtatctggagggccaggcagccaaggagtttatcgcctggcttgtgcgcggaagaggc

SEQ ID NO: 12458 - DNA, 165 bp, Artificial Sequence
  Description of Artificial Sequence: Synthetic coding sequence
atgccctcttccgtgagctggggcatcctgttgctggccggcctgtgctgtctcgtgcctgtttctctggctcatgctgagggaacctttaccagcgatgtgtcttcctacctggaaggacaggcggccaaggagttcatcgcctggctcgttagaggaaggggc

SEQ ID NO: 12459 - DNA, 165 bp, Artificial Sequence
  Description of Artificial Sequence: Synthetic coding sequence
atgccgagctcagtcagctggggaatcctgctcctggccggactttgttgtcttgtgccagtgagtcttgcgcatgcagaaggcacattcacatcagacgtcagtagctatctcgaaggccaagctgccaaagagtttatagcctggctggtccgaggacgcggc

SEQ ID NO: 12460 - DNA, 165 bp, Artificial Sequence
  Description of Artificial Sequence: Synthetic coding sequence
atgccctcctccgtgagctggggcatcctgctcttggcgggtctgtgctgcctggtgccggtgtccctggctcatgcagaaggaacctttactagcgatgtgagttcctaccttgagggccaggccgcaaaagaattcattgcttggcttgttagaggaagagga

SEQ ID NO: 12461 - DNA, 165 bp, Artificial Sequence
  Description of Artificial Sequence: Synthetic coding sequence
atgccttcaagcgtttcttggggtattctactcctggccggtctgtgttgcctggttccagttagcctcgcacacgctgagggcacgttcacatctgacgtgtcctcgtacctggagggccaagcagcaaaggagttcatcgcctggcttgtcaggggtcggggg

SEQ ID NO: 12462 - DNA, 165 bp, Artificial Sequence
  Description of Artificial Sequence: Synthetic coding sequence
atgccaagctcagtctcatggggaattctcttgctggccggtttgtgttgcctcgtccctgtgtcgcttgctcatgctgagggcacctttactagcgatgtttcctcgtacctcgaaggacaagcggcaaaggaattcatcgcatggcttgtgaggggccgaggt

SEQ ID NO: 12463 - DNA, 165 bp, Artificial Sequence
  Description of Artificial Sequence: Synthetic coding sequence
atgccctcttccgtgagctggggcattctcttgcttgccggattgtgttgccttgttccagtttccctcgcacacgccgaaggaacattcacatccgatgtgtcttcttatctggagggtcaagccgccaaagaatttatagcctggcttgtccggggtcgcgga

SEQ ID NO: 12464 - DNA, 165 bp, Artificial Sequence
  Description of Artificial Sequence: Synthetic coding sequence
atgccctcctcagtgtcttggggcatactcctcctcgcgggactgtgttgcctcgttcctgtgtctctcgcacatgcggaggggaccttcacctccgacgttagctcatacctcgaaggtcaggccgcaaaggagttcatagcctggctggtgcgaggcagaggg

SEQ ID NO: 12465 - DNA, 165 bp, Artificial Sequence
  Description of Artificial Sequence: Synthetic coding sequence
atgccatcatcagtctcatggggtattcttctcctggctgggctctgctgtctggtgcctgtgagcttggcccatgcagagggtacctttacctcagacgttagctcctatctagaaggacaggccgctaaagaattcatcgcctggctcgtccgcgggaggggt

SEQ ID NO: 12466 - DNA, 165 bp, Artificial Sequence
  Description of Artificial Sequence: Synthetic coding sequence
atgccaagctccgtcagctgggggatcctactcctggcaggtctatgttgtctggtgccggtgtcgctggcccacgctgagggcacctttactagtgacgtgtctagttatctggaggggcaggcagccaaggagtttattgcatggctcgtaagaggacggggg

SEQ ID NO: 12467 - DNA, 165 bp, Artificial Sequence
  Description of Artificial Sequence: Synthetic coding sequence
atgccatcttcagtcagctggggtattctcttacttgctggtttgtgttgtcttgtccccgtaagtctagctcatgcagaaggaacttttacctcggatgtaagctcttatcttgagggacaagctgcgaaagagtttattgcctggctcgttcgaggacgagga

SEQ ID NO: 12468 - DNA, 165 bp, Artificial Sequence
  Description of Artificial Sequence: Synthetic coding sequence
atgccgtcatcggtgtcctggggaatcctcttgctggcgggcctctgctgcttggtccctgtgtcactcgctcacgctgaaggaaccttcacgagtgacgtctcgtcataccttgaagggcaggcagcgaaggagtttattgcctggctggtgcgcggacggggt

SEQ ID NO: 12469 - DNA, 165 bp, Artificial Sequence
  Description of Artificial Sequence: Synthetic coding sequence
atgccatcatccgtgagctgggggattcttctgctggcaggactctgctgtctggtcccagtctcccttgcccatgccgagggaaccttcacctcggacgtctcgagctacctcgaaggtcaagcagcgaaagaattcattgcctggcttgtgagaggtagagga

SEQ ID NO: 12470 - DNA, 165 bp, Artificial Sequence
  Description of Artificial Sequence: Synthetic coding sequence
atgccgtcgtcagtctcctgggggatcctcctcctggccggactgtgctgcctggtgccggtgtccctcgcccacgccgaaggcaccttcacgtccgatgtctcatcgtacctggaaggccaggctgcaaaggaatttatcgcgtggctggtgcgaggtagggga

SEQ ID NO: 12471 - DNA, 165 bp, Artificial Sequence
  Description of Artificial Sequence: Synthetic coding sequence
atgccctctagcgtgtcctggggaatcctgcttctggccggcttgtgctgtttagtgccagtatccttagcccacgccgagggcacctttactagcgacgtgagttcttatttggagggacaagccgccaaagagttcatcgcgtggctggtgcggggtcggggc

SEQ ID NO: 12472 - DNA, 165 bp, Artificial Sequence
  Description of Artificial Sequence: Synthetic coding sequence
atgccatcctcagttagctggggcatcctattgctcgccggcctctgttgtctcgttccagtgtcgctggcccatgctgagggaactttcacctcagatgtgtcatcctatttagaaggacaggccgccaaggagttcatcgcttggctggtgcggggcaggggc

SEQ ID NO: 12473 - DNA, 165 bp, Artificial Sequence
  Description of Artificial Sequence: Synthetic coding sequence
atgccgtcgagcgttagctggggaatcctgctgctcgccggactgtgctgtttggtgcctgtcagccttgcgcacgcagagggtaccttcacttcggacgtttcatcctatctggaaggccaggccgcgaaggagttcatcgcctggctcgtgagggggagagga

SEQ ID NO: 12474 - DNA, 165 bp, Artificial Sequence
  Description of Artificial Sequence: Synthetic coding sequence
atgccaagttcagtgtcgtggggcatcctgttgcttgctggcttgtgttgccttgtgcctgtgtccctggctcacgcagaagggacctttacttcagatgtgtcgtcatacctcgaaggccaggcggcgaaagagttcatcgcgtggctcgtgcggggacgcggt

SEQ ID NO: 12475 - DNA, 165 bp, Artificial Sequence
  Description of Artificial Sequence: Synthetic coding sequence
atgccctcttccgtttcctggggcatcttgttgcttgcgggactgtgctgtctggtcccagtgtccctcgcccatgctgaggggacctttactagcgatgtgtcatcctaccttgaggggcaggcggcaaaggaattcattgcgtggctggtcagaggacgagga

SEQ ID NO: 12476 - DNA, 165 bp, Artificial Sequence
  Description of Artificial Sequence: Synthetic coding sequence
atgcctagttctgtaagctggggtatactgctgttggccggtctgtgttgcctggttcccgtgtcgctggctcacgctgaaggaacgttcacctccgacgtcagctcatacttggagggccaagcggccaaagaattcattgcctggctcgtacgcggcaggggt

SEQ ID NO: 12477 - DNA, 165 bp, Artificial Sequence
  Description of Artificial Sequence: Synthetic coding sequence
atgccgtcttctgtgagttggggcatactgctcctcgcaggcctgtgttgtctggttcctgtgtcgctggcccatgcggagggtacctttacctccgacgtttcttcttatctggaaggtcaggccgccaaggaatttattgcctggctggtgcgcggtcgcggt

SEQ ID NO: 12478 - DNA, 165 bp, Artificial Sequence
  Description of Artificial Sequence: Synthetic coding sequence
atgccctctagcgtctcctggggcattctgctgctcgcaggcctctgctgtctggtacccgttagccttgcacatgccgaggggacctttactagcgatgtttcatcctatctcgaaggacaggctgccaaggagtttatcgcttggctcgtgcgcgggcgagga

SEQ ID NO: 12479 - DNA, 165 bp, Artificial Sequence
  Description of Artificial Sequence: Synthetic coding sequence
atgccctcctcagtgtcttggggtatcctgctcctggcaggactgtgttgcctcgtccctgtctctcttgcccatgctgagggaacctttacttcagatgtgtcgtcctacctcgaaggccaagcggccaaggaattcatagcatggcttgtgaggggtagaggc

SEQ ID NO: 12480 - DNA, 165 bp, Artificial Sequence
  Description of Artificial Sequence: Synthetic coding sequence
atgccaagctcagtgtcctggggcatcttgctgctggcgggactgtgttgcctcgtgcccgtctcccttgcacacgcggaaggcaccttcacctcggatgtctcgtcatacctggaagggcaggccgcgaaagaattcattgcgtggctcgttcgcggacgcggg

SEQ ID NO: 12481 - DNA, 165 bp, Artificial Sequence
  Description of Artificial Sequence: Synthetic coding sequence
atgcccagttccgtgtcatggggcatactgttgcttgccggcttgtgctgcctggtacccgtgtccctcgcccatgcggaaggaacattcacctctgacgtgtcatcatacctcgagggccaggcagccaaggagttcatagcgtggttggtacgcggccgggga

SEQ ID NO: 12482 - DNA, 165 bp, Artificial Sequence
  Description of Artificial Sequence: Synthetic coding sequence
atgccctctagcgtctcatggggcatattattgctcgctgggctgtgttgtctggtccctgtgagcttggcccacgcagaaggaacattcacctctgatgtgtctagttacctcgaggggcaggctgccaaagagtttattgcctggctggtgcggggacggggg

SEQ ID NO: 12483 - DNA, 165 bp, Artificial Sequence
  Description of Artificial Sequence: Synthetic coding sequence
atgccatcgtccgtcagctggggcatcttgctgcttgcgggactctgttgcctggtcccggtgagcctggcccacgcggaggggacttttacctcggacgtgtcatcctacctcgaaggacaggctgcaaaggaattcatcgcctggctggtgcgcggtcgggga

SEQ ID NO: 12484 - DNA, 165 bp, Artificial Sequence
  Description of Artificial Sequence: Synthetic coding sequence
atgccctcgtccgtgagctggggaattctgctcttggctggtttgtgctgtcttgtgccggttagtctcgcgcacgccgagggtaccttcacttctgacgtctcatcgtacttggaagggcaggctgcaaaggagtttatcgcctggctcgtgcggggccgcgga

SEQ ID NO: 12485 - DNA, 165 bp, Artificial Sequence
  Description of Artificial Sequence: Synthetic coding sequence
atgcccagttcagtgtcttggggcatccttctgctggctggtctctgctgtcttgtgccagtgagcctcgcccacgcagaggggacctttacttctgacgtctcctcttacttggagggccaagccgcaaaagaatttatagcctggctagtcagaggcaggggc

SEQ ID NO: 12486 - DNA, 165 bp, Artificial Sequence
  Description of Artificial Sequence: Synthetic coding sequence
atgcccagctccgtctcttggggtatattgctgctagcgggtctgtgctgtttggtaccagtctcgctggcccatgccgagggtacgttcacctctgacgtgtcctcttacttggagggtcaggcagctaaggagtttatcgcatggttggttcgggggagggga

SEQ ID NO: 12487 - DNA, 165 bp, Artificial Sequence
  Description of Artificial Sequence: Synthetic coding sequence
atgccatcatcagtgtcatggggaattctgcttttggccggcctctgctgtctcgttcctgtgagcctggcacatgctgaaggtacttttacctcggatgtcagctcctaccttgagggacaagcggcaaaggaattcatcgcatggctcgtaagaggacgcggg

SEQ ID NO: 12488 - DNA, 165 bp, Artificial Sequence
  Description of Artificial Sequence: Synthetic coding sequence
atgccttcaagcgtctcatggggaattctcctcttggccggcctgtgctgtctcgtcccagtctccctggctcacgccgagggtacgttcacttccgatgtcagcagctatctagagggccaagcagctaaggagttcatagcctggctcgttcgcgggcggggg

SEQ ID NO: 12489 - DNA, 165 bp, Artificial Sequence
  Description of Artificial Sequence: Synthetic coding sequence
atgccgtcatctgtgagctgggggattctgctgctggccggactctgttgcctggttccagtgtctctggctcatgctgagggcacgttcaccagcgatgtctccagctatctggagggacaggccgcaaaggaattcattgcatggttggtgagaggccgcgga

SEQ ID NO: 12490 - DNA, 165 bp, Artificial Sequence
  Description of Artificial Sequence: Synthetic coding sequence
atgccctcatcagtgtcatggggtatcctcctgctggccggactgtgttgccttgtacccgtttcactggctcacgctgagggcaccttcacttccgacgtgtcctcttacctcgaaggccaagctgctaaggaattcattgcctggttggttcgcggtaggggc

SEQ ID NO: 12491 - DNA, 165 bp, Artificial Sequence
  Description of Artificial Sequence: Synthetic coding sequence
atgccttcctctgtcagctggggaatcttacttcttgccggactttgctgtctggtgccggtgagcttagcgcacgctgagggaacatttactagcgatgtttcgagttacctggaaggacaggcggcgaaggagttcatcgcctggctggttagagggagaggt

SEQ ID NO: 12492 - DNA, 165 bp, Artificial Sequence
  Description of Artificial Sequence: Synthetic coding sequence
atgccttcttcagtaagttgggggattttacttttagcaggtttatgttgtttagttccagtatctcttgcacatgctgaaggtacattcacttcagatgtatcaagttatttagaaggacaagctgcaaaagaatttattgcttggttagtaagaggaagagga

SEQ ID NO: 12493 - DNA, 165 bp, Artificial Sequence
  Description of Artificial Sequence: Synthetic coding sequence
atgccgagctctgtctcctggggaatcctcctgcttgctggactgtgctgcctggtgccggtcagcttggcccacgccgaagggacgttcaccagcgacgtgtcgtcatacctggaaggtcaggccgccaaagaattcatcgcctggttggtgcgcggaagggga

SEQ ID NO: 12494 - DNA, 165 bp, Artificial Sequence
  Description of Artificial Sequence: Synthetic coding sequence
atgccctcatcagtttcttggggtattctgctcctggcgggcctctgttgcttggtccccgtgtccttagctcacgctgagggcacctttacttcggatgtcagcagctacctggagggccaggcagccaaggagtttatcgcatggctagtgcgcggtcgaggc

SEQ ID NO: 12495 - DNA, 165 bp, Artificial Sequence
  Description of Artificial Sequence: Synthetic coding sequence
atgccgtcaagtgtttcgtggggaattcttctcctcgcaggactctgttgcctcgtgcctgtatcgctagcccatgcggagggtacgttcacatctgatgtgtcgtcttaccttgaaggtcaagcagcgaaagagtttatcgcatggctcgttcgcggacggggg

SEQ ID NO: 12496 - DNA, 165 bp, Artificial Sequence
  Description of Artificial Sequence: Synthetic coding sequence
atgccctcatcggtgtcatggggaattttattactagcagggctgtgttgccttgtacccgtttctcttgcacacgccgaagggacatttacttctgatgtgtcatcttacctggaagggcaagccgccaaagaatttatcgcctggctagtcagggggagaggg

SEQ ID NO: 12497 - DNA, 165 bp, Artificial Sequence
  Description of Artificial Sequence: Synthetic coding sequence
atgccatcgtccgtgtcatggggaatcctgctcctggccggactgtgttgcctggtgccagtgtcacttgcccacgcggagggaacttttacctcggatgtgtcatcgtaccttgaaggacaagcagcgaaggaattcattgcttggctggtgagaggcaggggc

SEQ ID NO: 12498 - DNA, 165 bp, Artificial Sequence
  Description of Artificial Sequence: Synthetic coding sequence
atgcctagcagcgtgagctgggggatcttgctcctggcagggctctgttgcctcgttccagtgagcctcgcccacgccgagggcacttttacttccgatgtgagcagctacctcgagggccaggcagccaaagagttcatcgcatggctggtccgagggcgcggc

SEQ ID NO: 12499 - DNA, 165 bp, Artificial Sequence
  Description of Artificial Sequence: Synthetic coding sequence
atgcctagctccgtttcctggggaatactcctcttggcaggtctctgttgccttgttcctgtttctcttgcccatgccgagggcacgtttacttcggacgtctcttcatatctggaggggcaggctgcaaaggaattcattgcgtggcttgtaaggggaagggga

SEQ ID NO: 12500 - DNA, 165 bp, Artificial Sequence
  Description of Artificial Sequence: Synthetic coding sequence
atgccctcctctgtctcatgggggatcttgctcctcgcaggactctgctgtctggtgcctgtgtccctcgcacacgcagaaggaacttttacttccgatgtgtcttcctatctcgaagggcaggcagctaaggaatttatagcatggctcgtccgaggaagagga

SEQ ID NO: 12501 - DNA, 165 bp, Artificial Sequence
  Description of Artificial Sequence: Synthetic coding sequence
atgcctagctctgtctcctggggaatcctcctgcttgccggattgtgctgcttggttccggtgagcctggctcacgcagaaggcacctttacttcagacgtgtcgtcgtacctggagggccaggcggcaaaggaattcatcgcctggttggtgagaggacgcggg

SEQ ID NO: 12502 - DNA, 165 bp, Artificial Sequence
  Description of Artificial Sequence: Synthetic coding sequence
atgccgtcatcggtcagctggggaatcctgctcctggccggactgtgctgcctcgtgccagtgtccctcgcacacgccgaaggaacctttactagcgatgtgagctcgtacctggagggccaagcagcaaaagagttcatcgcgtggttggtccgcggtagagga

SEQ ID NO: 12503 - DNA, 165 bp, Artificial Sequence
  Description of Artificial Sequence: Synthetic coding sequence
atgccgtcctccgtcagctggggtatcctgctgctggcaggtctttgctgtcttgtgccagtgtcactggcacatgccgaaggtacctttacgagcgacgtgtcaagctacctggaaggtcaagcagcaaaggagttcattgcctggttggtgagaggacggggg

SEQ ID NO: 12504 - DNA, 165 bp, Artificial Sequence
  Description of Artificial Sequence: Synthetic coding sequence
atgccatcgtcggtgtcctggggaattctgctgctggccggcctgtgctgtttggtcccagtgtcacttgcgcacgctgaaggaaccttcacttccgatgtttccagctacctcgagggacaagccgcaaaggagttcattgcctggttggtgagagggcgggga

SEQ ID NO: 12505 - DNA, 165 bp, Artificial Sequence
  Description of Artificial Sequence: Synthetic coding sequence
atgccctcaagcgtctcatggggcatcctcctgctcgccggactgtgctgtttggtgccggtgagcctggctcatgccgagggaaccttcacttcggatgtgtcctcgtacctcgagggacaagccgctaaggagttcattgcatggcttgtgcgcggacgggga

SEQ ID NO: 12506 - DNA, 165 bp, Artificial Sequence
  Description of Artificial Sequence: Synthetic coding sequence
atgccctccagtgtatcatggggtatcctgctcctggccggcctttgctgcttggtgcccgtgtccttggctcacgctgagggtacctttacgtcagatgtgagctcataccttgagggacaggcggcaaaagagtttatagcatggctggtgcggggcagaggg

SEQ ID NO: 12507 - DNA, 165 bp, Artificial Sequence
  Description of Artificial Sequence: Synthetic coding sequence
atgccttcctccgtctcctggggtattctgcttctggcgggactgtgttgcctcgtgcccgtgagtctggctcatgccgaggggacgtttactagcgatgtgtcaagctaccttgaaggccaggcagcaaaggagtttatcgcttggctcgtgcgcggccgggga

SEQ ID NO: 12508 - DNA, 165 bp, Artificial Sequence
  Description of Artificial Sequence: Synthetic coding sequence
atgccaagctcagtttcctggggaatcctcctgttggccggactgtgctgtttggtcccggtgtcgctggcgcacgcggagggcacctttacgagcgacgtgtccagttacctggagggccaggccgccaaggaattcattgcttggctggttagaggacgcggg

SEQ ID NO: 12509 - DNA, 165 bp, Artificial Sequence
  Description of Artificial Sequence: Synthetic coding sequence
atgccttcgtccgtttcatggggtatcctccttctcgctggtttgtgctgtttggtgcctgtgtcacttgcacacgcggaaggaacgtttaccagcgacgtgtcgtcgtacctcgaaggccaggcagcaaaggagttcattgcctggctggtgagaggccgggga

SEQ ID NO: 12510 - DNA, 165 bp, Artificial Sequence
  Description of Artificial Sequence: Synthetic coding sequence
atgccgtcatccgtctcgtgggggatactgttactcgctggcttgtgttgcctcgtccccgtttcactggcccacgccgagggaacctttacgagtgacgtgtcctcttacctggagggtcaagccgccaaggaatttattgcttggctcgtccgtggcagggga

SEQ ID NO: 12511 - DNA, 165 bp, Artificial Sequence
  Description of Artificial Sequence: Synthetic coding sequence
atgccatcatccgtgtcttggggcatcctcttgttggctggtctctgctgcctcgtccccgtatctctcgcacatgctgaaggcacttttacaagcgacgtgtctagctatctcgagggacaggccgccaaagaatttatagcctggctggtgagaggaagggga

SEQ ID NO: 12512 - DNA, 165 bp, Artificial Sequence
  Description of Artificial Sequence: Synthetic coding sequence
atgcctagctccgtgtcctggggcattctgcttctcgctgggctgtgctgtctggtgcctgtgtcgcttgcacacgcagaagggaccttcacttcggatgtgtcatcataccttgaaggtcaagcagcaaaggagttcatcgcttggctcgtgcgaggtcgtgga

SEQ ID NO: 12513 - DNA, 165 bp, Artificial Sequence
  Description of Artificial Sequence: Synthetic coding sequence
atgccatcatccgtgtcctggggtatcttgcttctggccggcctttgttgtttggtgcccgtgagtctcgcccacgcggagggcactttcactagcgatgtatcatcatacttggagggacaggctgccaaggagttcatagcctggctggtgagaggtagaggc

SEQ ID NO: 12514 - DNA, 165 bp, Artificial Sequence
  Description of Artificial Sequence: Synthetic coding sequence
atgcccagcagcgtgtcatggggaatattgcttcttgctggtctgtgctgtctggtgcccgtgagtctagcccacgcggagggaacgttcacatctgatgtctcaagctatcttgaggggcaggcagctaaggaattcatcgcctggctcgtccgcggcagaggt

SEQ ID NO: 12515 - DNA, 165 bp, Artificial Sequence
  Description of Artificial Sequence: Synthetic coding sequence
atgccttcatctgtcagctggggaatcctcctgttggcaggcctctgctgtcttgtgccggttagccttgctcacgccgaggggacctttacttcagacgtgtccagctacctcgaaggacaggccgcaaaggaattcatcgcctggctggtccgcggacggggc

SEQ ID NO: 12516 - DNA, 165 bp, Artificial Sequence
  Description of Artificial Sequence: Synthetic coding sequence
atgccttcgtcagttagttgggggatcctcttgctcgcaggcctgtgctgcctcgtgcctgtatccctggcccacgcagaaggtacttttacatccgatgtgagctcctatctcgagggccaagccgcaaaggagtttatcgcatggctggtgaggggacgcggg

SEQ ID NO: 12517 - DNA, 165 bp, Artificial Sequence
  Description of Artificial Sequence: Synthetic coding sequence
atgccctcatccgtgagctgggggattctactcctagccggcctgtgttgccttgtacctgttagtctagcgcatgccgagggaactttcacctcggatgtgtccagctacctggagggccaagccgccaaggagtttatcgcttggctggtgcgcgggcgtgga

SEQ ID NO: 12518 - DNA, 165 bp, Artificial Sequence
  Description of Artificial Sequence: Synthetic coding sequence
atgccttccagcgtgtcctgggggatactcttgctggccgggttgtgttgcttagttccggtctctctggctcacgcagagggaaccttcaccagtgatgtgtcatcgtacctcgaggggcaggcagccaaggaattcatcgcttggcttgttaggggacgcggc

SEQ ID NO: 12519 - DNA, 165 bp, Artificial Sequence
  Description of Artificial Sequence: Synthetic coding sequence
atgccgagctcagttagctggggaatactgttgctggctggcctctgttgcctggtccctgtgtctttagcacatgcggaaggcaccttcacatctgatgtcagctcctacctcgagggccaagccgccaaggaattcattgcttggctcgtgagggggagaggg

SEQ ID NO: 12520 - DNA, 165 bp, Artificial Sequence
  Description of Artificial Sequence: Synthetic coding sequence
atgccgtccagcgtatcttggggcatcctgctcttagcgggactgtgttgtcttgttccggtgtctcttgcacatgccgagggaacatttacttcggatgtgtcttcgtatttagagggacaggcagcaaaagagtttatcgcatggcttgtacggggacgaggt

SEQ ID NO: 12521 - DNA, 165 bp, Artificial Sequence
  Description of Artificial Sequence: Synthetic coding sequence
atgcctagcagtgtgtcatgggggatactgctgcttgcaggtctctgctgcttggtgccggtgagccttgcgcatgccgaagggacttttacatctgacgtttcgtcttatctggaaggacaggccgctaaggaattcatagcttggctggtgcggggtaggggt

SEQ ID NO: 12522 - DNA, 165 bp, Artificial Sequence
  Description of Artificial Sequence: Synthetic coding sequence
atgccgtcgtctgtgtcatggggaatcctcctgctggccgggctgtgttgcctggtgccggtcagcctggcccacgcagagggaactttcacttcagacgtgtcatcgtaccttgagggccaagcggccaaggagtttatcgcctggctggtgagaggacggggc

SEQ ID NO: 12523 - DNA, 165 bp, Artificial Sequence
  Description of Artificial Sequence: Synthetic coding sequence
atgccaagctcagtgtcttgggggatactgctgctggccggactatgctgcttggtgccagtaagcctcgctcatgccgaggggacgtttactagtgacgtgagtagctacctggagggccaggctgccaaggagttcattgcctggctggtgagaggccgtggc

SEQ ID NO: 12524 - DNA, 165 bp, Artificial Sequence
  Description of Artificial Sequence: Synthetic coding sequence
atgccatccagcgtgtcttggggcattttgttactcgctggtctctgttgtctggtgccggtttcgcttgcccatgccgagggcaccttcacctcggacgtgtcgagttatctggaggggcaggcagctaaagagtttattgcctggctggttagagggagggga

SEQ ID NO: 12525 - DNA, 165 bp, Artificial Sequence
  Description of Artificial Sequence: Synthetic coding sequence
atgcctagctctgtgagctggggaatactgctactcgctggactgtgttgtctggttcccgtctcgctggcccacgccgagggaacgttcaccagcgacgtctcctcttacttggagggccaagctgctaaggagtttattgcttggctggttcgcgggagggga

SEQ ID NO: 12526 - DNA, 165 bp, Artificial Sequence; identical to SEQ ID NO: 12516
  Description of Artificial Sequence: Synthetic coding sequence

SEQ ID NO: 12527 - DNA, 165 bp, Artificial Sequence
  Description of Artificial Sequence: Synthetic coding sequence
atgccgtcgtcagtgtcctggggcattcttctgctggctggcctctgttgcctggttcctgtttcgctggctcacgcggagggaacctttacttcggacgtctcttcctaccttgaaggtcaggcagccaaggagttcatcgcgtggttggtgcggggacgcgga

SEQ ID NO: 12528 - DNA, 165 bp, Artificial Sequence
  Description of Artificial Sequence: Synthetic coding sequence
atgccttcctcagtgtcttgggggatcttgctgctggcgggcttgtgttgtctggtgccggtaagtctcgcccacgcagagggaacattcacatctgatgtatcatcgtacctggagggccaggccgccaaggaatttatcgcctggttagtccgcggaagagga

SEQ ID NO: 12529 - DNA, 165 bp, Artificial Sequence
  Description of Artificial Sequence: Synthetic coding sequence
atgccttcgtcagtgtcgtggggcattctcctcctggcaggactgtgttgccttgtgcccgtgtctctcgcgcacgctgaaggaaccttcacctctgatgtgtcctcgtacctggaggggcaagcagcaaaagagtttatcgcctggcttgtccgcggtcggggg

SEQ ID NO: 12530 - DNA, 165 bp, Artificial Sequence
  Description of Artificial Sequence: Synthetic coding sequence
atgaaatgggtgtctttcatctctttgctctttctgttctccagtgcgtactcaggaagccttgacaaacgccatgctgaagggacctttacatctgatgtgtcctcctaccttgaagggcaggctgcaaaagaattcattgcgtggcttgtgaaagggcgcgga

SEQ ID NO: 12531 - DNA, 165 bp, Artificial Sequence
  Description of Artificial Sequence: Synthetic coding sequence
atgaagtgggtctccttcatatctctgttattcctgttttcctcagcctacagtggtagcctggacaagagacacgcagaggggacatttacctcagacgtgtcttcttatctcgagggtcaggcggcgaaagaattcatcgcctggctcgtgaagggacgtggc

SEQ ID NO: 12532 - DNA, 165 bp, Artificial Sequence
  Description of Artificial Sequence: Synthetic coding sequence
atgaaatgggtgtccttcattagccttctgttcctgttctctagcgcttatagtgggagcctggataagcgccacgccgaagggactttcacaagcgatgtgagctcatatctagagggtcaggcagccaaagagtttatcgcttggttggtaaaggggagaggg

SEQ ID NO: 12533 - DNA, 165 bp, Artificial Sequence
  Description of Artificial Sequence: Synthetic coding sequence
atgaagtgggtgtcattcatctccctgctctttctgttttcgagcgcatacagcggatcacttgacaaaagacatgctgaagggaccttcacttcggatgtgtcctcgtatcttgaagggcaagcggccaaagagtttatagcatggttggtgaagggccggggc

SEQ ID NO: 12534 - DNA, 165 bp, Artificial Sequence
  Description of Artificial Sequence: Synthetic coding sequence
atgaagtgggtgtcatttatctcccttctgtttctgttcagctccgcctatagcggttcccttgataagaggcacgcagaaggaacctttacctcagacgtgtccagctacctcgagggccaagcagcaaaggagtttattgcgtggctggtcaagggcagagga

SEQ ID NO: 12535 - DNA, 165 bp, Artificial Sequence
  Description of Artificial Sequence: Synthetic coding sequence
atgaagtgggtcagcttcatctcgttgctctttctgttctccagcgcgtactccgggtcactggataagcggcacgcagaaggcactttcacctcagacgtgtcgtcgtacctcgaaggacaggccgccaaggagttcatcgcttggctggtgaaaggtcgcgga

SEQ ID NO: 12536 - DNA, 165 bp, Artificial Sequence
  Description of Artificial Sequence: Synthetic coding sequence
atgaagtgggttagtttcatatcattattgttcctattcagtagcgcctatagtggttctctggacaaaagacatgccgaaggcactttcacaagcgacgtgagcagttatcttgaggggcaggccgctaaagaattcatcgcatggcttgtaaaggggagggga

SEQ ID NO: 12537 - DNA, 165 bp, Artificial Sequence
  Description of Artificial Sequence: Synthetic coding sequence
atgaaatgggtctcattcatttccctgctgttcctgtttagctccgcctactctgggagtctggacaagcgacatgcagaaggaaccttcacatccgacgtgtcctcctaccttgagggacaagccgctaaagaattcattgcctggctggtgaaaggaagaggg

SEQ ID NO: 12538 - DNA, 165 bp, Artificial Sequence
  Description of Artificial Sequence: Synthetic coding sequence
atgaaatgggtctcctttatcagtttgttatttctgttttccagtgcatatagtggatcactggacaaacgtcacgccgagggcacgttcacctctgatgtgtcctcctacctcgaaggccaggcggctaaggagttcatcgcgtggctggtcaaggggaggggg

SEQ ID NO: 12539 - DNA, 165 bp, Artificial Sequence
  Description of Artificial Sequence: Synthetic coding sequence
atgaagtgggtgagcttcatatcccttttgtttcttttttcctcagcatactcgggctcactcgataagagacacgctgaaggtacgtttaccagcgacgtgtcatcatacctcgagggacaagccgccaaggagtttattgcgtggctggtgaagggccgagga

SEQ ID NO: 12540 - DNA, 165 bp, Artificial Sequence
  Description of Artificial Sequence: Synthetic coding sequence
atgaagtgggtgtccttcatcagtctgctgttcctgtttagcagcgcatactcaggatccttggataagagacacgccgaagggacctttacctcagatgtctcatcgtacctcgaaggccaggcagcgaaagagtttattgcgtggcttgttaaaggtcgcgga

SEQ ID NO: 12541 - DNA, 165 bp, Artificial Sequence
  Description of Artificial Sequence: Synthetic coding sequence
atgaaatgggtgtcgttcatctcgctccttttcctgttcagcagcgcttactcagggtcgcttgataagagacacgccgaaggtacctttacttcagacgtgtcctcatacctggagggacaggcggctaaggaattcatcgcctggctggtgaaagggagaggc

SEQ ID NO: 12542 - DNA, 165 bp, Artificial Sequence
  Description of Artificial Sequence: Synthetic coding sequence
atgaaatgggtatcttttatttcacttttatttttattttcatcagcttattctggatcacttgataaaagacatgcagagggaacttttacttcagatgttagttcttatttagaaggtcaagctgcaaaggaatttatcgcttggttagttaaaggtagagga

SEQ ID NO: 12543 - DNA, 165 bp, Artificial Sequence
  Description of Artificial Sequence: Synthetic coding sequence
atgaaatgggtctcattcatctctctgttgtttctgttcagttctgcctattccggctcactagacaagcgccacgctgaaggtacattcacctcagatgtttcctcatacttggagggtcaggccgcaaaggagtttattgcctggctggtaaagggacgcgga

SEQ ID NO: 12544 - DNA, 165 bp, Artificial Sequence
  Description of Artificial Sequence: Synthetic coding sequence
atgaaatgggtttccttcatatctctgctgtttttgttctcgagcgcctacagtggtagcttggacaagcgtcacgctgagggtacgttcacctccgacgttagcagctacttggagggtcaggctgcaaaagagttcatcgcgtggctggtgaagggccgtggc

SEQ ID NO: 12545 - DNA, 165 bp, Artificial Sequence
  Description of Artificial Sequence: Synthetic coding sequence
atgaagtgggtttcgttcatctctctcctgttcctctttagctcagcttacagcggatccttggacaagcgccacgcggaaggaactttcacctcagatgtgtccagctacttggagggccaggcagccaaggagtttatcgcatggctcgtgaaaggtagaggg

SEQ ID NO: 12546 - DNA, 165 bp, Artificial Sequence
  Description of Artificial Sequence: Synthetic coding sequence
atgaaatgggtgagcttcatatcgctgctttttctgttttcaagcgcttattcgggtagcctggataagcggcatgcagagggaaccttcacttcagacgtgtcatcgtacctggaaggacaggccgcaaaggaattcattgcgtggcttgtgaaaggacgtggt

SEQ ID NO: 12547 - DNA, 165 bp, Artificial Sequence
  Description of Artificial Sequence: Synthetic coding sequence
atgaaatgggtttcatttatttctctgttattcctcttctcttctgcctattccggatctctggacaagcgccacgctgagggaacattcacctccgatgtgtctagttacctcgaggggcaagccgctaaggagttcatcgcgtggcttgtgaagggccgggga

SEQ ID NO: 12548 - DNA, 165 bp, Artificial Sequence
  Description of Artificial Sequence: Synthetic coding sequence
atgaagtgggtgtccttcatctcccttctgttcctcttttcctcggcgtactcgggatccctcgacaaacgccacgcggagggcactttcacctcggacgtgtcatcatacctcgagggtcaggcggcaaaggaattcatcgcgtggctggtgaagggacggggt

SEQ ID NO: 12549 - DNA, 165 bp, Artificial Sequence
  Description of Artificial Sequence: Synthetic coding sequence
atgaaatgggtttcctttatttcacttctttttttgttttcgagtgcttattcaggttcactagataaaaggcatgccgaaggtacctttacatcggacgtatcatcttatctcgagggacaagcagcaaaagagtttatcgcctggctcgttaaaggtcgagga

SEQ ID NO: 12550 - DNA, 165 bp, Artificial Sequence
  Description of Artificial Sequence: Synthetic coding sequence
atgaagtgggtctcgttcatcagcctgctgttcctcttttctagcgcatactctgggtcgttggataagcggcatgctgaagggacattcacatccgatgtgtcaagctacctggagggacaggcggctaaggaattcatcgcgtggctggtcaagggacggggc

SEQ ID NO: 12551 - DNA, 165 bp, Artificial Sequence
  Description of Artificial Sequence: Synthetic coding sequence
atgaagtgggtgtcattcatttcactgttgtttctgttctcgtcggcgtattcaggatcgctggacaaacgccacgcggaagggactttcaccagcgacgtcagctcgtacctggaaggtcaggcagctaaggagtttatcgcttggctggtcaaaggccgggga

SEQ ID NO: 12552 - DNA, 165 bp, Artificial Sequence
  Description of Artificial Sequence: Synthetic coding sequence
atgaagtgggtcagctttatctccctgcttttcctgttctcgtccgcctactccgggtccctcgacaagcgccacgccgaagggacgttcactagcgatgtgtcgtcgtaccttgagggacaagccgcgaaggaattcatcgcctggctggtcaagggacggggc

SEQ ID NO: 12553 - DNA, 165 bp, Artificial Sequence
  Description of Artificial Sequence: Synthetic coding sequence
atgaagtgggtgtctttcatttcgctcctgttcctgttttcgtcggcttacagcgggtcccttgataaaagacatgcagaaggtacctttacttcagatgtgtcatcctaccttgaggggcaggcagcaaaggaattcatcgcgtggctggtcaagggccgcgga

SEQ ID NO: 12554 - DNA, 165 bp, Artificial Sequence
  Description of Artificial Sequence: Synthetic coding sequence
atgaagtgggtgtcctttatctcgctcctgtttctgtttagctcggcgtacagcggtagcttggacaagagacatgctgaaggcacttttaccagcgatgtgtccagctacctggaaggtcaggcggcaaaggagtttattgcatggcttgtgaaaggtagagga

SEQ ID NO: 12555 - DNA, 165 bp, Artificial Sequence
  Description of Artificial Sequence: Synthetic coding sequence
atgaagtgggtgtcattcatttccctgctgttcttgttttcctctgcctattcagggtcactggataaaaggcatgcggaaggaacctttactagtgacgtatcctcctacctggaaggtcaggccgccaaggaattcattgcctggctggttaagggacggggc

SEQ ID NO: 12556 - DNA, 165 bp, Artificial Sequence
  Description of Artificial Sequence: Synthetic coding sequence
atgaaatgggtatcgtttatatcgttattatttttattttcgtcggcgtattcgggttcgttagataaacgtcatgcggaaggtacgtttacgtcggatgtatcgtcgtatttagaaggtcaagcggcgaaagaatttatagcgtggctagtaaaaggtcgtggt

SEQ ID NO: 12557 - DNA, 165 bp, Artificial Sequence
  Description of Artificial Sequence: Synthetic coding sequence
atgaagtgggtgtccttcatctccctgctgttcctctttagcagcgcgtactctggatcgctggacaaacgccatgcagagggaactttcacgtcggacgtatcgtcgtacctggaaggacaggccgccaaggagtttatcgcgtggttggtgaagggccgcgga

SEQ ID NO: 12558 - DNA, 165 bp, Artificial Sequence
  Description of Artificial Sequence: Synthetic coding sequence
atgaagtgggtaagctttatcagcctgctctttctgttcagcagcgcgtatagcggcagtttagataaaagacacgccgaaggaacgttcacgtccgacgtgagctcgtacctggaaggccaggccgccaaggagtttattgcttggctggtcaagggacggggg

SEQ ID NO: 12559 - DNA, 165 bp, Artificial Sequence
  Description of Artificial Sequence: Synthetic coding sequence
atgaaatgggtcagcttcatttccctgctgtttttgttttcatccgcctacagcggctccttggataaacgtcacgccgaagggacgtttacctcagacgttagtagctatctcgaagggcaagctgcgaaagagtttatagcttggctggtcaaggggagaggc

SEQ ID NO: 12560 - DNA, 165 bp, Artificial Sequence
  Description of Artificial Sequence: Synthetic coding sequence
atgaagtgggtctctttcatctcccttcttttccttttctcatcagcgtattctggcagcttggacaaaaggcatgcggaggggaccttcacgagcgacgtgtcctcatacctggagggccaggctgctaaagagttcattgcctggctggttaagggcagaggt

SEQ ID NO: 12561 - DNA, 165 bp, Artificial Sequence
  Description of Artificial Sequence: Synthetic coding sequence
atgaagtgggtctcgtttatatcccttctcttccttttcagctccgcctactccgggtcactcgataagcggcacgctgaaggcacattcacctccgacgtaagctcgtatctcgaaggtcaagccgccaaggagttcatagcttggttagtcaaggggcgaggg

SEQ ID NO: 12562 - DNA, 165 bp, Artificial Sequence
  Description of Artificial Sequence: Synthetic coding sequence
atgaagtgggtgtcttttatctccctgctgtttctcttctcgtcggcctatagcgggagcctcgacaaaaggcatgccgaaggaactttcacgtcggatgtgtcatcatacctggaaggacaagccgcgaaggagttcatcgcctggcttgtcaaggggcgcgga

SEQ ID NO: 12563 - DNA, 165 bp, Artificial Sequence
  Description of Artificial Sequence: Synthetic coding sequence
atgaaatgggtctcattcatttccctactgttcctcttcagttctgcctactcgggatcactagacaaaaggcatgcggaaggcacgtttacgtcagacgttagttcatatttagagggccaggccgccaaagaattcatagcatggttggtaaaaggtcgcggc

SEQ ID NO: 12564 - DNA, 165 bp, Artificial Sequence
  Description of Artificial Sequence: Synthetic coding sequence
atgaagtgggtttcctttattagcctgctgttcctcttctctagcgcctactccgggagcttagataaacggcatgccgagggaaccttcacttctgacgtctcatcgtatctggagggccaggccgccaaggagttcattgcctggttggtgaagggtcgcggg

SEQ ID NO: 12565 - DNA, 165 bp, Artificial Sequence
  Description of Artificial Sequence: Synthetic coding sequence
atgaaatgggtgtcgttcatcagcctccttttcctcttttcatcagcctactcgggatccctggacaagagacatgccgagggtacctttacctccgacgtgtcatcgtacctcgaaggtcaagcagctaaggagtttatagcgtggcttgtgaaaggacgggga

SEQ ID NO: 12566 - DNA, 165 bp, Artificial Sequence
  Description of Artificial Sequence: Synthetic coding sequence
atgaaatgggtgagtttcatctcccttctattcctgttttcaagcgcatattctggctccctagataagcgacatgccgaaggaacattcacaagtgatgtgagttcttacctggaagggcaggctgctaaagagttcatcgcttggctggtaaaagggaggggg

SEQ ID NO: 12567 - DNA, 165 bp, Artificial Sequence
  Description of Artificial Sequence: Synthetic coding sequence
atgaaatgggtgtcctttatttctctgcttttcctcttctcttcagcctacagcggctctctggacaagaggcacgctgagggcacattcacatccgatgtctcttcctacctcgaaggacaggctgctaaggaattcatcgcttggcttgtgaagggtcgcggt

SEQ ID NO: 12568 - DNA, 165 bp, Artificial Sequence
  Description of Artificial Sequence: Synthetic coding sequence
atgaagtgggttagcttcatcagcctgctctttctcttctcctccgcatactcaggcagtctcgataaacgccacgctgaagggacgttcacgagcgacgtgtcatcgtatcttgagggccaagcagccaaagaattcatcgcttggctggtcaagggacgggga

SEQ ID NO: 12569 - DNA, 165 bp, Artificial Sequence
  Description of Artificial Sequence: Synthetic coding sequence
atgaagtgggtgtccttcatttccctgttgttcctattttcttctgcttactctggaagtctcgacaaaagacacgcagagggaacgtttacctcagatgtatcaagttacttagagggccaagcagccaaggagtttatcgcttggctcgtgaaaggtcggggg

SEQ ID NO: 12570 - DNA, 165 bp, Artificial Sequence
  Description of Artificial Sequence: Synthetic coding sequence
atgaagtgggtgtccttcatctctctcttgttcctgttttctagcgcctactccggctcgctcgataagcgccacgcagagggcaccttcacctcggacgtctcgtcgtacctcgaaggacaggccgcgaaagagtttatcgcctggctggtgaagggaaggggt

SEQ ID NO: 12571 - DNA, 165 bp, Artificial Sequence
  Description of Artificial Sequence: Synthetic coding sequence
atgaaatgggtttcattcatttcactcctgttccttttctcatcagcttactccggaagcctggacaagcgccatgcggaaggcacgttcacctccgacgtgtcctcctacctcgaaggacaggccgccaaggagtttatcgcatggctggtcaaaggcagaggc

SEQ ID NO: 12572 - DNA, 165 bp, Artificial Sequence
  Description of Artificial Sequence: Synthetic coding sequence
atgaagtgggtgagcttcatttccctgctctttctgttctcgtccgcatactcaggaagcctggacaagcggcacgcggagggaaccttcaccagcgacgtgagctcctacctggaggggcaggctgcgaaagagttcatcgcatggcttgtgaagggccgcggc

SEQ ID NO: 12573 - DNA, 165 bp, Artificial Sequence; identical to SEQ ID NO: 12560
  Description of Artificial Sequence: Synthetic coding sequence

SEQ ID NO: 12574 - DNA, 165 bp, Artificial Sequence
  Description of Artificial Sequence: Synthetic coding sequence
atgaagtgggtgagcttcatctcactgctgtttcttttttccagcgcatattctggaagtttagacaagcgccacgcagaggggacttttacctcagacgtttcaagctatctggagggacaggctgccaaagagtttatcgcttggcttgtcaagggcaggggc

SEQ ID NO: 12575 - DNA, 165 bp, Artificial Sequence
  Description of Artificial Sequence: Synthetic coding sequence
atgaagtgggtttctttcatttccttgctctttttattcagctccgcttattccggctctctggataaacggcatgctgagggcaccttcacatctgacgtgtcctcctacctcgagggacaggctgccaaagaattcattgcatggttagttaagggtaggggg

SEQ ID NO: 12576 - DNA, 165 bp, Artificial Sequence
  Description of Artificial Sequence: Synthetic coding sequence
atgaagtgggtgtcgtttatctcactgctctttctttttagctcggcgtactcgggttcccttgataagcggcacgctgaagggactttcaccagcgacgtgagctcataccttgaaggacaggcagctaaggagtttatcgcatggctcgtgaagggaaggggt

SEQ ID NO: 12577 - DNA, 165 bp, Artificial Sequence
  Description of Artificial Sequence: Synthetic coding sequence
atgaaatgggttagcttcatttcactcctctttctttttagtagcgcctacagcggttctcttgacaagcgccacgccgaaggcacgttcaccagtgacgtaagtagctatctcgaagggcaagccgccaaggagttcatcgcatggctggtcaaaggccgcggc

SEQ ID NO: 12578 - DNA, 165 bp, Artificial Sequence
  Description of Artificial Sequence: Synthetic coding sequence
atgaaatgggtttctttcatctcgcttctgtttctgtttagctccgcctactccggctccttagacaagagacatgctgagggaaccttcactagcgacgtgtcttcgtaccttgaaggccaggcagccaaagaatttatcgcctggctagtgaagggacgcggc

SEQ ID NO: 12579 - DNA, 165 bp, Artificial Sequence
  Description of Artificial Sequence: Synthetic coding sequence
atgaagtgggtaagctttataagtcttctgtttttgttttctagtgcctacagcggatctctggacaaacgccatgcggaaggcacgtttacgtcggatgtctcgagttatctcgagggacaggctgctaaagaattcatcgcttggttagttaaaggccgcggc

SEQ ID NO: 12580 - DNA, 165 bp, Artificial Sequence
  Description of Artificial Sequence: Synthetic coding sequence
atgaagtgggtcagttttatctctcttcttttccttttctctagtgcctactcaggcagtctggataagcgccacgctgagggcacttttacctcggatgtgtccagctacctcgaagggcaagctgctaaggaattcattgcatggctcgtgaagggaagaggc

SEQ ID NO: 12581 - DNA, 165 bp, Artificial Sequence
  Description of Artificial Sequence: Synthetic coding sequence
atgaaatgggtgtcctttatctcactgctgttccttttcagctcggcatactcgggatccttggacaagcgccacgcagagggtactttcacctcagacgtgagctcttatctggaagggcaggccgcaaaggagtttatcgcgtggctggtcaagggaagaggc

SEQ ID NO: 12582 - DNA, 165 bp, Artificial Sequence
  Description of Artificial Sequence: Synthetic coding sequence
atgaagtgggtctcatttatctcgctgctgttcttgtttagctctgcatacagcggatcgctggacaagaggcacgctgaaggaaccttcacaagcgatgtcagctcatatctcgagggtcaagccgctaaagagtttatcgcatggcttgtaaagggtcgggga

SEQ ID NO: 12583 - DNA, 165 bp, Artificial Sequence
  Description of Artificial Sequence: Synthetic coding sequence
atgaaatgggtgtcctttatcagtctgttattcctcttcagttccgcctacagtggaagtctcgataagcggcatgccgaaggcacgttcacttcagacgtcagttcgtacctggaaggccaggccgcgaaagagtttatcgcatggttggtgaaagggcgcgga

SEQ ID NO: 12584 - DNA, 165 bp, Artificial Sequence
  Description of Artificial Sequence: Synthetic coding sequence
atgaaatgggtgagctttatctcgttgctcttccttttcagctccgcctattcaggatcgctggacaaacggcacgccgagggtacctttacttccgacgtctcatcttaccttgagggacaggctgccaaggagttcattgcgtggctcgtgaagggcagggga

SEQ ID NO: 12585 - DNA, 165 bp, Artificial Sequence
  Description of Artificial Sequence: Synthetic coding sequence
atgaagtgggtgtcgttcatctcactgctgtttttgttcagcagcgcgtactcggggagccttgataagcggcatgctgaaggaacgtttacctccgacgtttcgagctacttggaaggccaagccgcaaaagagtttatcgcatggctcgtcaaaggtcgcgga

SEQ ID NO: 12586 - DNA, 165 bp, Artificial Sequence
  Description of Artificial Sequence: Synthetic coding sequence
atgaaatgggtatccttcatatctctcctattcttattttcatccgcgtattccggaagtctagataaaaggcacgcggagggaacatttacatccgatgtctcttcttatctagaggggcaggccgccaaagaatttattgcatggctggtgaaaggacgcggg

SEQ ID NO: 12587 - DNA, 165 bp, Artificial Sequence
  Description of Artificial Sequence: Synthetic coding sequence
atgaagtgggtgtcctttatcagcctcctcttcttgtttagctccgcctactcgggatcccttgataagagacatgctgagggcacttttaccagcgacgtctccagctaccttgaaggacaagcggcaaaagaattcatcgcatggctggtgaagggcagggga

SEQ ID NO: 12588 - DNA, 165 bp, Artificial Sequence
  Description of Artificial Sequence: Synthetic coding sequence
atgaagtgggtgagcttcataagcttgctgtttctattttcttccgcgtactctggttctctggacaagagacatgctgaagggacatttacttccgatgtcagtagttatcttgaaggacaggccgctaaggaattcatcgcatggctcgtaaaaggaagaggt

SEQ ID NO: 12589 - DNA, 165 bp, Artificial Sequence
  Description of Artificial Sequence: Synthetic coding sequence
atgaagtgggtgtcgttcatctcgctcctgttcctgttctcgtccgcgtacagcggatcgcttgacaagcggcacgccgaagggacttttacctcagacgtgtcatcttacctcgagggccaagcggcaaaggaattcatcgcttggctggtcaagggcagaggg

SEQ ID NO: 12590 - DNA, 165 bp, Artificial Sequence
  Description of Artificial Sequence: Synthetic coding sequence
atgaaatgggtgtccttcatctcactgctgttcctcttcagctcagcttactccggatccctggataaacgccacgccgaaggaactttcacctcagatgtgagctcctacttggaagggcaggccgccaaggagttcatcgcgtggctcgtcaagggacgggga

SEQ ID NO: 12591 - DNA, 165 bp, Artificial Sequence
  Description of Artificial Sequence: Synthetic coding sequence
atgaagtgggtctctttcatcagcctgttattcctgttttcatccgcgtattctggttccttggataagaggcacgctgaggggacctttacctctgatgtctcttcctatctggaaggccaagcagcaaaagagttcatcgcgtggctggtgaaaggtcgtggc

SEQ ID NO: 12592 - DNA, 165 bp, Artificial Sequence
  Description of Artificial Sequence: Synthetic coding sequence
atgaagtgggtaagtttcatctccctcctgttcttgttttcaagcgcctacagcggtagcctggataagagacacgcagagggcacatttacctccgacgtgagttcttacttggaaggtcaggcagccaaggaattcatcgcctggctcgtaaaaggacgtggc

SEQ ID NO: 12593 - DNA, 165 bp, Artificial Sequence
  Description of Artificial Sequence: Synthetic coding sequence
atgaagtgggtgtctttcatcagtctgctgtttctgttctcatcagcctactcaggaagcctagacaaacgtcacgccgagggaactttcacctctgacgtctcatcatatctagaaggacaggctgcaaaggaattcatcgcttggctcgtaaaaggccgcgga

SEQ ID NO: 12594 - DNA, 165 bp, Artificial Sequence
  Description of Artificial Sequence: Synthetic coding sequence
atgaaatgggtatcttttatatctctactattcctcttctcttccgcttattctggatcactcgataagagacatgccgagggaactttcacaagtgatgtatcaagttatttggaagggcaggccgctaaagagtttatcgcttggcttgtgaaagggcgcggg

SEQ ID NO: 12595 - DNA, 165 bp, Artificial Sequence
  Description of Artificial Sequence: Synthetic coding sequence
atgaagtgggtatcctttatctcgcttctctttcttttttcatccgcatacagtggttccctggacaaacgccatgctgaaggaactttcacctctgatgtgagctcatacctcgaaggacaagcagcaaaagagttcattgcctggctggtcaagggaagaggg

SEQ ID NO: 12596 - DNA, 165 bp, Artificial Sequence
  Description of Artificial Sequence: Synthetic coding sequence
atgaaatgggtgagcttcatttctttgctcttcctatttagctctgcgtattctggatccctggacaagcggcatgcggaaggcacctttacaagcgatgtgtcctcttacctcgagggccaagccgccaaagaatttatcgcctggttggtcaaaggacgcggc

SEQ ID NO: 12597 - DNA, 165 bp, Artificial Sequence
  Description of Artificial Sequence: Synthetic coding sequence
atgaaatgggttagctttatttcactcttatttctattttcctccgcatactctggaagcttagacaaacgacacgctgaaggtactttcacctcagatgtctctagctacttggagggccaggccgctaaagagttcatcgcgtggctggtgaaaggacgcgga

SEQ ID NO: 12598 - DNA, 165 bp, Artificial Sequence
  Description of Artificial Sequence: Synthetic coding sequence
atgaagtgggtgtcgttcatctcgctccttttcctctttagcagcgcatactctgggtccctggataagcgtcatgccgaaggcacttttacctcagatgtgagctcatacctggaaggacaagcggcgaaagagttcattgcatggttggttaagggccgcgga

SEQ ID NO: 12599 - DNA, 165 bp, Artificial Sequence
  Description of Artificial Sequence: Synthetic coding sequence
atgaagtgggtctcttttattagcctgttgttcttgttctcttctgcctactctggatccctggacaaacgacatgctgagggaactttcacttccgacgtgtcgagctatctcgaagggcaggctgctaaggaatttatcgcatggctggtgaagggaaggggt

SEQ ID NO: 12600 - DNA, 165 bp, Artificial Sequence
  Description of Artificial Sequence: Synthetic coding sequence
atgaagtgggtgagttttatatctctgctgtttttgttctccagcgcttactccggcagtctggacaagcgccacgctgaaggcacattcacctctgacgtttcctcttacttggaaggccaggccgccaaggaattcatcgcctggctggtaaagggcaggggt

SEQ ID NO: 12601 - DNA, 165 bp, Artificial Sequence
  Description of Artificial Sequence: Synthetic coding sequence
atgaagtgggtcagcttcatctctctcctctttctcttcagctccgcctattcgggttccctcgataagaggcatgctgaggggactttcaccagcgacgtctcctcctacctggaagggcaggccgcgaaggaattcatcgcatggctggtgaaaggacgggga

SEQ ID NO: 12602 - DNA, 165 bp, Artificial Sequence
  Description of Artificial Sequence: Synthetic coding sequence
atgaagtgggtgtccttcatcagccttctgttcctgttttcgtcggcctatagcggatccttggataagcggcacgcggaaggtacttttacctctgacgtctcgagctacttggaggggcaggccgcgaaagaattcatcgcatggctcgtcaagggacgcgga

SEQ ID NO: 12603 - DNA, 165 bp, Artificial Sequence
  Description of Artificial Sequence: Synthetic coding sequence
atgaagtgggtcagcttcatctctcttctgtttctttttagctcggcatactcgggttcacttgacaagcgacacgccgagggaacgtttacctcggatgtgtcctcatatcttgaaggacaagcagcaaaggaattcattgcttggttggtcaagggcaggggt

SEQ ID NO: 12604 - DNA, 165 bp, Artificial Sequence
  Description of Artificial Sequence: Synthetic coding sequence
atgaagtgggtgtcatttatttcactcctgttcttattctcctctgcatatagtgggagtcttgataagcgccacgcagaaggcacttttacttccgacgtaagtagctatctggaggggcaggcggcaaaggagtttattgcctggctggtgaagggtaggggc

SEQ ID NO: 12605 - DNA, 165 bp, Artificial Sequence
  Description of Artificial Sequence: Synthetic coding sequence
atgaaatgggtgagcttcatctccctcttgttcctcttcagctcagcttactccggttcattggacaaacgacatgccgaagggacatttacaagcgatgtttcttcatacttggagggccaggccgccaaggagttcatcgcctggttggttaaaggtaggggg

SEQ ID NO: 12606 - DNA, 165 bp, Artificial Sequence
  Description of Artificial Sequence: Synthetic coding sequence
atgaaatgggtgtcctttatttctttactctttctgttcagctcagcgtattccgggtcactggacaagcgccacgcagagggcacttttacctcggacgtgagctcctatctggagggccaggctgccaaggagttcatcgcttggttggtcaaaggccgaggc

SEQ ID NO: 12607 - DNA, 165 bp, Artificial Sequence
  Description of Artificial Sequence: Synthetic coding sequence
atgaaatgggtgtcatttatctccctcctgttccttttctcgtcggcgtactcaggctcgctggataagcgtcacgctgagggaacttttacctccgacgtgtccagctaccttgaagggcaagccgctaaagagtttattgcatggttggttaaggggcggggc

SEQ ID NO: 12608 - DNA, 165 bp, Artificial Sequence
  Description of Artificial Sequence: Synthetic coding sequence
atgaaatgggtttccttcatatctctcctttttctgttttcgtcggcatactcaggctcgttggataagagacatgcagaagggacttttaccagtgatgtgagcagctacctggaagggcaggcagcgaaagaattcattgcctggctggtgaagggacgcggt

SEQ ID NO: 12609 - DNA, 165 bp, Artificial Sequence
  Description of Artificial Sequence: Synthetic coding sequence
atgaagtgggtgtcatttatcagccttctgtttcttttctcgtccgcgtactcaggctcactggataagagacatgcagaagggactttcacgtcggacgtctcatcgtacttggaaggtcaagcagcaaaagaattcattgcgtggttggtgaaaggtcgggga

SEQ ID NO: 12610 - DNA, 165 bp, Artificial Sequence
  Description of Artificial Sequence: Synthetic coding sequence
atgaagtgggtgagcttcattagtctcctgttcctcttctcttctgcctatagcggttcattggacaagcgccacgccgagggtacgttcaccagcgatgtgagttcatatctcgaggggcaagccgctaaggagtttatcgcctggctcgtaaaggggcgggga

SEQ ID NO: 12611 - DNA, 165 bp, Artificial Sequence
  Description of Artificial Sequence: Synthetic coding sequence
atgaagtgggtgtccttcatctctctgttattcctgttttcatctgcatattcaggcagcctggacaagagacacgctgagggaactttcacctccgacgtgtcaagttatttggagggacaggccgcaaaggaattcattgcatggttggtgaaaggccggggc

SEQ ID NO: 12612 - DNA, 165 bp, Artificial Sequence
  Description of Artificial Sequence: Synthetic coding sequence
atgaagtgggtgtctttcatcagtctattgtttctgtttagcagtgcctacagtggcagtttagacaagaggcacgccgagggcacctttacaagcgatgtcagttcatatctggaggggcaggccgcaaaagagtttattgcctggctcgtcaaaggaagagga

SEQ ID NO: 12613 - DNA, 165 bp, Artificial Sequence
  Description of Artificial Sequence: Synthetic coding sequence
atgaagtgggtgtcattcatctctttactattcctgttctcatctgcctactcgggctcgctggataagcgacacgcggaaggcacctttaccagtgacgtcagttcatatctggagggccaggctgccaaggaatttattgcctggcttgtgaagggcagaggt

SEQ ID NO: 12614 - DNA, 165 bp, Artificial Sequence
  Description of Artificial Sequence: Synthetic coding sequence
atgaaatgggtgagtttcatatctctgctttttttattttccagcgcatattcgggttcgctggacaagaggcacgcggagggcacctttacaagtgacgtcagcagctatctagaagggcaagcagcgaaagaattcattgcctggctggtgaaagggagaggc

SEQ ID NO: 12615 - DNA, 165 bp, Artificial Sequence
  Description of Artificial Sequence: Synthetic coding sequence
atgaagtgggtatcattcatcagcctgctcttcttgttttcatcggcctactccggctctcttgacaagcgccacgctgaaggaacttttacttccgatgtgtcgagctacctggagggacaggccgcgaaggagttcatcgcgtggctggtgaagggacgaggg

SEQ ID NO: 12616 - DNA, 165 bp, Artificial Sequence
  Description of Artificial Sequence: Synthetic coding sequence
atgaagtgggtgtcttttatcagtctgctcttcctcttctcctccgcgtactcaggcagcctcgataagcgccacgccgaaggaacctttactagcgacgtctcttcatacctggaaggacaggccgctaaggagttcatcgcgtggctggttaaaggccggggt

SEQ ID NO: 12617 - DNA, 165 bp, Artificial Sequence
  Description of Artificial Sequence: Synthetic coding sequence
atgaagtgggtgagcttcatctcgctcctctttctgttttcatctgcatacagtggcagcctggacaagaggcatggcgaaggcactttcacatccgacgtgtctagttacctcgaagggcaggctgccaaggaatttatcgcctggctggtgaagggcaggggg

SEQ ID NO: 12618 - DNA, 165 bp, Artificial Sequence
  Description of Artificial Sequence: Synthetic coding sequence
atgaaatgggtctcctttatcagtctcctgtttttgttcagctctgcctattcagggagcttggacaagcgtcacggcgagggcaccttcacaagcgacgtatcaagctatctcgagggacaggcggctaaagagttcatcgcatggctcgtgaagggcagggga

SEQ ID NO: 12619 - DNA, 165 bp, Artificial Sequence
  Description of Artificial Sequence: Synthetic coding sequence
atgaagtgggttagcttcatttctttgctctttctgttctcgtccgcatacagcgggagccttgataagaggcatggagagggaacgtttacttcagacgtctcctcgtaccttgaaggtcaggcagcgaaagaattcattgcatggcttgtgaaagggcgggga

SEQ ID NO: 12620 - DNA, 165 bp, Artificial Sequence
  Description of Artificial Sequence: Synthetic coding sequence
atgaagtgggtatctttcatctccttgcttttcctgttttcttctgcatactcaggcagcctcgataagcgccacggagagggaaccttcaccagcgatgtgagcagctacctggaaggtcaggcagccaaagaatttatcgcttggctggtcaagggccgtgga

SEQ ID NO: 12621 - DNA, 165 bp, Artificial Sequence
  Description of Artificial Sequence: Synthetic coding sequence
atgaaatgggtatcttttattagtctcctgttcctcttcagtagcgcttattcaggcagcctcgataagagacatggcgagggaacctttactagcgacgtcagtagctatctggagggtcaggcagccaaagagtttatcgcgtggctggtcaaagggagaggc

SEQ ID NO: 12622 - DNA, 165 bp, Artificial Sequence
  Description of Artificial Sequence: Synthetic coding sequence
atgaagtgggtgtcctttatctcactgcttttcctttttagctcggcatattccgggtcgctcgataagagacatggtgaaggcacttttacctccgacgtgtctagctacctcgagggacaagccgcaaaagaattcatagcctggcttgtcaaagggcgggga

SEQ ID NO: 12623 - DNA, 165 bp, Artificial Sequence
  Description of Artificial Sequence: Synthetic coding sequence
atgaagtgggtgagcttcatctcccttctgtttcttttctcctcagcttattccggatcgctcgacaaacggcacggagaaggcacttttacctcagatgtgtcctcgtacctcgaaggtcaagcggccaaggagtttattgcctggctggtcaaggggagagga

SEQ ID NO: 12624 - DNA, 165 bp, Artificial Sequence
  Description of Artificial Sequence: Synthetic coding sequence
atgaaatgggtgtcattcataagcctactgtttctgttctctagcgcctattccgggtcactggataagcgacatggcgagggcactttcacctctgacgtgagttcctatctggaaggacaggccgctaaggaatttatcgcctggctggtcaaggggaggggg

SEQ ID NO: 12625 - DNA, 165 bp, Artificial Sequence
  Description of Artificial Sequence: Synthetic coding sequence
atgaaatgggtcagctttatcagcctgctgtttctgtttagctctgcttacagtggaagtctggataaacgccatggagaaggcacattcacttcagacgtgagcagttatttggagggtcaggccgccaaagaattcattgcctggcttgtgaagggacgcggc

SEQ ID NO: 12626 - DNA, 165 bp, Artificial Sequence
  Description of Artificial Sequence: Synthetic coding sequence
atgaagtgggtgtcgtttatctcgttgctgttccttttcagctcagcgtactcgggttccctggataagagacacggcgaaggtactttcacttcagacgtcagctcatacctggaaggacaagccgcgaaggagttcatcgcctggctcgtgaagggcagagga

SEQ ID NO: 12627 - DNA, 165 bp, Artificial Sequence
  Description of Artificial Sequence: Synthetic coding sequence
atgaagtgggtgtcctttatctcgctgctgttccttttttcgtcggcatacagcggatccttggacaagaggcatggtgaaggcactttcactagcgatgtcagctcataccttgaagggcaggctgcaaaagagttcattgcatggctcgtgaagggcagaggg

SEQ ID NO: 12628 - DNA, 165 bp, Artificial Sequence
  Description of Artificial Sequence: Synthetic coding sequence
atgaaatgggtgtcgtttatctcactccttttcttgttttcctcggcgtattcgggctcgctcgataaacggcatggagagggtaccttcacttccgatgtcagctcgtacctggaaggccaagcagccaaggagtttatcgcatggcttgtgaagggacgcgga

SEQ ID NO: 12629 - DNA, 165 bp, Artificial Sequence
  Description of Artificial Sequence: Synthetic coding sequence
atgaagtgggtcagctttatctcgctccttttcctgttttcctcggcttactcgggatcattggacaagagacatggagagggaacctttacctcggatgtgagttcctacctcgagggacaggcagccaaggagtttattgcgtggcttgtgaagggaaggggt

SEQ ID NO: 12630 - DNA, 165 bp, Artificial Sequence
  Description of Artificial Sequence: Synthetic coding sequence
atgaaatgggtttctttcatctccttgctgtttctgttctctagcgcttatagcggctctctggacaaacggcacggcgaggggacttttacaagcgatgtgagctcttatctggaaggccaggcggctaaagagttcatcgcttggttggtcaaagggcgtggc

SEQ ID NO: 12631 - DNA, 165 bp, Artificial Sequence
  Description of Artificial Sequence: Synthetic coding sequence
atgaaatgggtgtccttcatcagcctcctctttctgttttcatccgcttatagcggaagtcttgacaagaggcatggcgaagggacctttacttctgatgtgagcagctatctggaggggcaggccgcaaaagagtttatagcctggttagtgaaaggacggggc

SEQ ID NO: 12632 - DNA, 165 bp, Artificial Sequence
  Description of Artificial Sequence: Synthetic coding sequence
atgaagtgggtcagctttatatctctgctgtttctgtttagtagtgcctatagtggaagcttggacaagaggcacggggaagggaccttcaccagcgatgtgagctcttacctggagggccaagctgctaaagagtttatagcttggctggtgaaaggcaggggt

SEQ ID NO: 12633 - DNA, 165 bp, Artificial Sequence
  Description of Artificial Sequence: Synthetic coding sequence
atgaaatgggtctcattcatcagtctcctcttccttttttcgtccgcttattccggctctttggataaacgacatggcgaaggtactttcacatcagatgtttcttcgtatctggaaggtcaagctgcaaaagaattcatcgcttggctggttaaaggcagaggt

SEQ ID NO: 12634 - DNA, 165 bp, Artificial Sequence
  Description of Artificial Sequence: Synthetic coding sequence
atgaagtgggtcagcttcatatcgctgctttttctgtttagcagcgcatactcaggctctcttgataagagacacggagagggcacctttacgtccgacgtgagctcctaccttgagggacaggcagcaaaagaattcattgcatggctggtgaagggacgcgga

SEQ ID NO: 12635 - DNA, 165 bp, Artificial Sequence
  Description of Artificial Sequence: Synthetic coding sequence
atgaaatgggtttcctttatttcccttctatttctcttcagtagcgcttattctggaagcctggataaacgccatggcgagggaactttcacctcagacgtatcaagttaccttgaagggcaggccgcgaaggagtttatcgcctggctagttaagggcaggggc

SEQ ID NO: 12636 - DNA, 165 bp, Artificial Sequence
  Description of Artificial Sequence: Synthetic coding sequence
atgaagtgggtttcatttatcagtctgctgtttttgttttcatcggcctactccgggtctttggacaagaggcacggtgagggcacctttactagtgatgtttcgtcctacttggagggccaagccgctaaggagttcatagcttggttggtcaaaggccgtggg

SEQ ID NO: 12637 - DNA, 165 bp, Artificial Sequence
  Description of Artificial Sequence: Synthetic coding sequence
atgaagtgggtttcctttataagcctgctgttcctgtttagctccgcgtacagtggcagcctcgacaagcgacatggagagggcacattcacttccgacgtgtcaagctatctggaaggccaagcagccaaagagtttattgcttggctcgtcaaagggcgcggc

SEQ ID NO: 12638 - DNA, 165 bp, Artificial Sequence
  Description of Artificial Sequence: Synthetic coding sequence
atgaagtgggtgagcttcatttctcttctgtttttgttttcttctgcatactctggctcattggacaaaagacatggcgaaggcacattcacgagtgatgtttctagttatcttgaaggtcaggctgctaaggagttcatagcctggttggttaagggcagagga

SEQ ID NO: 12639 - DNA, 165 bp, Artificial Sequence
  Description of Artificial Sequence: Synthetic coding sequence
atgaagtgggtaagtttcatttcattattatttttgttttcaagtgcatattcaggtagtcttgataaaagacatggagaaggtactttcacatctgatgtttcatcttatcttgagggacaagccgcaaaggagtttattgcttggctagttaaaggacgtggt

SEQ ID NO: 12640 - DNA, 165 bp, Artificial Sequence
  Description of Artificial Sequence: Synthetic coding sequence
atgaagtgggtcagtttcatctccctcctgttcctgtttagctcggcttattcaggctccctggataagagacacggagaaggaaccttcacttcggacgtgtcctcctacctcgaaggacaggcggcgaaggagttcattgcctggctggtcaagggacgggga

SEQ ID NO: 12641 - DNA, 165 bp, Artificial Sequence
  Description of Artificial Sequence: Synthetic coding sequence
atgaagtgggtgtcattcatcagtctcctcttcctgttttctagcgcatacagcggatcgctggacaagagacacggagagggcacttttacctcagatgtctcctcctaccttgaagggcaggcggctaaagaattcatcgcgtggctggtaaagggtagggga

SEQ ID NO: 12642 - DNA, 165 bp, Artificial Sequence
  Description of Artificial Sequence: Synthetic coding sequence
atgaagtgggtgtcattcatcagcctgctattcttgtttagttccgcttactcaggatcgctcgataagaggcacggagaaggcacattcacctcagatgtttcaagctaccttgagggccaggctgccaaagaattcatcgcctggttggttaaaggcagaggg

SEQ ID NO: 12643 - DNA, 165 bp, Artificial Sequence
  Description of Artificial Sequence: Synthetic coding sequence
atgaagtgggtttctttcatctcactcctgtttctgttctcttccgcttactccggctcactagataagaggcatggcgagggcaccttcacatccgatgtaagcagctatctggagggccaggccgctaaagagtttatcgcatggttggtcaagggacggggc

SEQ ID NO: 12644 - DNA, 165 bp, Artificial Sequence
  Description of Artificial Sequence: Synthetic coding sequence
atgaagtgggtgagcttcatatccttattgtttctgttttctagcgcttactccggctccttggataagaggcatggagaaggcacttttacttctgatgtttcttcttacctagaggggcaagcagccaaggaattcatcgcctggctggtgaaaggccgaggc

SEQ ID NO: 12645 - DNA, 165 bp, Artificial Sequence
  Description of Artificial Sequence: Synthetic coding sequence
atgaaatgggtcagtttcatttcactgctgtttcttttctcgtcagcctactcaggatctctcgataagcgccatggagagggaacttttacctccgatgtctcgtcgtacctcgagggtcaagcagcaaaggagtttatcgcgtggcttgtgaagggacgggga

SEQ ID NO: 12646 - DNA, 165 bp, Artificial Sequence
  Description of Artificial Sequence: Synthetic coding sequence
atgaagtgggtcagcttcatctcgctgctgtttctgttctcatcagcgtactccggatcgctcgataagcggcacggagaaggcactttcacttcggacgtgtcgagctatctggagggccaggccgcgaaggagttcatcgcctggcttgtgaagggacgcgga

SEQ ID NO: 12647 - DNA, 165 bp, Artificial Sequence
  Description of Artificial Sequence: Synthetic coding sequence
atgaagtgggtcagctttatctcactgctgttcctgttctcctccgcgtacagcggatccttggacaagcgccacggggaaggaacgttcacctccgatgtctcttcgtatcttgaaggccaggccgccaaggagttcatcgcatggctggttaaaggaagaggc

SEQ ID NO: 12648 - DNA, 165 bp, Artificial Sequence
  Description of Artificial Sequence: Synthetic coding sequence
atgaaatgggtgtcttttatcagcctgttgtttctgttctcttccgcttactcaggttcactggataagcgccacggcgagggcactttcacctccgacgtcagttcctacctcgagggacaggcagcgaaggaattcatcgcctggcttgtgaaaggaagagga

SEQ ID NO: 12649 - DNA, 165 bp, Artificial Sequence
  Description of Artificial Sequence: Synthetic coding sequence
atgaagtgggtaagcttcatcagcctgctgtttttgttctcttccgcttacagcggttcattggacaagcgccacggagagggcacttttactagcgacgtgtccagctacttggagggccaggctgccaaagagttcattgcatggctggttaaggggcggggt

SEQ ID NO: 12650 - DNA, 165 bp, Artificial Sequence
  Description of Artificial Sequence: Synthetic coding sequence
atgaaatgggtttcattcatctctctattattcttgttttcatcagcttacagtggctctcttgataagcggcacggagaaggtacttttacaagtgacgtatcaagctatcttgagggccaagcagcaaaggagtttattgcttggttagttaaaggacgggga

SEQ ID NO: 12651 - DNA, 165 bp, Artificial Sequence
  Description of Artificial Sequence: Synthetic coding sequence
atgaaatgggtctcatttatctcgctactgttccttttcagttctgcatactctggatcactggacaagaggcacggggaaggcaccttcaccagcgacgtttccagctatttggaagggcaagccgccaaagagtttatagcctggcttgtaaaagggagaggc

SEQ ID NO: 12652 - DNA, 165 bp, Artificial Sequence
  Description of Artificial Sequence: Synthetic coding sequence
atgaagtgggtgtcattcattagcctgctgtttctcttttcctccgcttatagcggtagcttggacaagagacacggcgagggaacattcacatccgatgttagctcttatctagagggacaggccgctaaggaatttatcgcttggttagtcaaaggcagaggc

SEQ ID NO: 12653 - DNA, 165 bp, Artificial Sequence
  Description of Artificial Sequence: Synthetic coding sequence
atgaagtgggtgtcttttatctcccttttgttcctgttctcatcggcttactccggatctctcgataagcgccacggtgagggaactttcaccagtgacgtgagctcatatttggaggggcaggcggccaaagaattcatcgcgtggctggttaagggcaggggc

SEQ ID NO: 12654 - DNA, 165 bp, Artificial Sequence
  Description of Artificial Sequence: Synthetic coding sequence
atgaaatgggtttcgtttatctctttgctgttcctgttttcctccgcttactccggaagcctggacaaacggcacggggagggcacctttacgtctgatgtgagctcctacctggagggtcaggcggctaaggaatttatcgcctggctcgtcaaagggcgggga

SEQ ID NO: 12655 - DNA, 165 bp, Artificial Sequence
  Description of Artificial Sequence: Synthetic coding sequence
atgaagtgggtgagcttcatatccctccttttcctgttctcgtcggcctattccggtagtctcgataagcgtcatggcgaaggtaccttcacgtctgacgtgagctcttacctggagggtcaagcagccaaggaattcatcgcttggttggtgaaagggcgtggc

SEQ ID NO: 12656 - DNA, 165 bp, Artificial Sequence
  Description of Artificial Sequence: Synthetic coding sequence
atgaaatgggtgtcattcatatcactccttttccttttctcctcggcatactcgggatcgctcgataaaaggcatggagaaggtacctttaccagcgacgtgagctcgtacctggaaggtcaggcggctaaagagtttatcgcctggctggtcaaaggcagaggc

SEQ ID NO: 12657 - DNA, 165 bp, Artificial Sequence
  Description of Artificial Sequence: Synthetic coding sequence
atgaagtgggtcagtttcatttccctgctttttctgttcagctccgcctacagtggctccctagataagcgtcacggagagggcacattcacatctgacgtgtctagctacctcgaaggacaggcggcaaaggaatttattgcttggcttgtaaagggcagagga

SEQ ID NO: 12658 - DNA, 165 bp, Artificial Sequence
  Description of Artificial Sequence: Synthetic coding sequence
atgaagtgggtttcattcataagcctgctttttctcttctcgtccgcttactcggggtcgctggataagcgccacggagaagggacgttcacctcagacgtgtcatcgtaccttgaaggtcaagcagccaaggagtttatcgcgtggctggtcaaaggaaggggc

SEQ ID NO: 12659 - DNA, 165 bp, Artificial Sequence
  Description of Artificial Sequence: Synthetic coding sequence
atgaagtgggtcagtttcatctcccttctctttcttttttcttccgcatactccggatccctagataaacgccatggagaagggacgtttacatctgatgttagttcatacctcgaagggcaggctgctaaggaattcatagcttggctcgtcaaggggagggga

SEQ ID NO: 12660 - DNA, 165 bp, Artificial Sequence
  Description of Artificial Sequence: Synthetic coding sequence
atgaaatgggtgtcatttatctcacttctgttcctgttttcgtccgcctactccggttccctggataaacgccacggcgaaggaacttttactagcgatgtgagctcgtacctggagggacaagccgccaaggaattcatcgcatggctcgtgaaggggagggga

SEQ ID NO: 12661 - DNA, 165 bp, Artificial Sequence
  Description of Artificial Sequence: Synthetic coding sequence
atgaagtgggtgtcattcatctcgctcctgttcttgttctcgtcggcttactccggatccttggacaagcggcatggcgagggtactttcacctcggatgtgtcatcctacctcgaaggacaggccgcaaaggagtttatcgcctggctggtcaaaggacgaggc

SEQ ID NO: 12662 - DNA, 165 bp, Artificial Sequence
  Description of Artificial Sequence: Synthetic coding sequence
atgaagtgggtatcattcatttccctgctgtttttgttctcctcggcatactcaggctcgcttgacaagcgacacggtgaggggacctttacgtccgatgtgagctcgtacctcgaaggccaagcagccaaagagtttatcgcctggctcgtgaaggggagagga

SEQ ID NO: 12663 - DNA, 165 bp, Artificial Sequence
  Description of Artificial Sequence: Synthetic coding sequence
atgaagtgggtttcttttatctcgctcctgttccttttctccagtgcatacagcggttctttggataaaagacatggcgaaggcacctttacttccgacgtctccagctacctcgaaggacaagccgctaaggagtttattgcatggctggtgaaaggaaggggg

SEQ ID NO: 12664 - DNA, 165 bp, Artificial Sequence
  Description of Artificial Sequence: Synthetic coding sequence
atgaagtgggtgtcgttcatctccttgctctttctgttctcaagcgcatactcgggctcccttgacaagcggcacggagaaggcaccttcacttcggatgtgtcgagctatctcgaaggacaagccgctaaagagtttatcgcgtggttggtgaagggcagaggc

SEQ ID NO: 12665 - DNA, 165 bp, Artificial Sequence
  Description of Artificial Sequence: Synthetic coding sequence
atgaaatgggtatcttttatctcccttctttttttgttttcgtctgcgtactccggctcactcgacaaacgacatggtgaggggactttcacttctgacgtgagttcatatctggagggacaggccgccaaagagtttattgcatggctggttaaaggaagaggg

SEQ ID NO: 12666 - DNA, 165 bp, Artificial Sequence
  Description of Artificial Sequence: Synthetic coding sequence
atgaaatgggtaagcttcatctccctcctttttttgttcagcagcgcctacagtggttccctggacaagcgccatggagaagggacctttacctccgatgtgtctagttacctggaggggcaggccgctaaggagttcatcgcatggctcgtaaagggcaggggc

SEQ ID NO: 12667 - DNA, 165 bp, Artificial Sequence
  Description of Artificial Sequence: Synthetic coding sequence
atgaagtgggtgagcttcatctcgctgttgttcctgttttcaagcgcgtacagcggatcgcttgataagagacatggtgaaggcaccttcacttccgacgtctccagctatcttgagggccaggccgcgaaggaattcattgcctggctggtgaaagggcgggga

SEQ ID NO: 12668 - DNA, 165 bp, Artificial Sequence
  Description of Artificial Sequence: Synthetic coding sequence
atgaagtgggtgtcattcatctcgctgctgttcctcttttcgagcgcctactccggtagccttgataagcgtcatggagaagggacctttacttcggacgtttcgtcgtacctcgaggggcaggccgcaaaagagttcatcgcatggctggtgaagggccggggc

SEQ ID NO: 12669 - DNA, 165 bp, Artificial Sequence
  Description of Artificial Sequence: Synthetic coding sequence
atgaagtgggtcagcttcatcagcctcttgtttcttttttcctcggcctactctggatcactcgacaaacgccatggtgaaggtactttcacctcggatgtgtcctcgtaccttgaaggacaagccgcaaaagagtttattgcttggctggtgaagggcaggggc

SEQ ID NO: 12670 - DNA, 165 bp, Artificial Sequence
  Description of Artificial Sequence: Synthetic coding sequence
atgaagtgggtgtcctttatttcccttctgttcctgttctctagcgcatactctggtagcttggataagagacacggggaaggcacgtttacaagtgatgtgagttcatacttagaaggtcaagcagccaaagaatttatcgcctggctcgttaaaggtagaggt

SEQ ID NO: 12671 - DNA, 165 bp, Artificial Sequence
  Description of Artificial Sequence: Synthetic coding sequence
atgaaatgggtttcttttataagcctgctcttcctgttcagctctgcctacagcgggtccttggataaacgtcatggggaaggcaccttcacctccgacgtttcgtcataccttgaggggcaggcggccaaagagttcattgcctggttggtcaaagggaggggc

SEQ ID NO: 12672 - DNA, 165 bp, Artificial Sequence; identical to SEQ ID NO: 12624
  Description of Artificial Sequence: Synthetic coding sequence

SEQ ID NO: 12673 - DNA, 165 bp, Artificial Sequence
  Description of Artificial Sequence: Synthetic coding sequence
atgaaatgggtgtcattcatcagccttctgtttttgttttcaagcgcatactcaggttcgttggacaagcgccatggtgaaggcacctttaccagcgatgtgtcgtcatatctcgaaggccaagctgcaaaggagtttattgcctggcttgtgaagggaagagga

SEQ ID NO: 12674 - DNA, 165 bp, Artificial Sequence
  Description of Artificial Sequence: Synthetic coding sequence
atgaagtgggtgtccttcatttccctgctgtttctgttcagctcagcgtactcaggatcgcttgataagagacacggagaaggcaccttcacttcggacgtcagcagctacctcgaaggtcaggcagcaaaggagtttatcgcttggttggtgaaagggcgaggc

SEQ ID NO: 12675 - DNA, 165 bp, Artificial Sequence
  Description of Artificial Sequence: Synthetic coding sequence
atgaagtgggtctctttcatctctctgcttttccttttcagctccgcatattcgggttcactggacaaacgccacggggagggaaccttcacatctgacgtgtccagctatctggagggtcaagcagctaaggagttcatcgcttggctagtaaagggtcgcgga

SEQ ID NO: 12676 - DNA, 165 bp, Artificial Sequence
  Description of Artificial Sequence: Synthetic coding sequence
atgaagtgggtttcctttatctcactcctgttccttttctcttctgcttacagtgggagtttagacaaacggcacggcgaaggtaccttcacaagtgacgtgagcagctatctcgaaggacaggcagccaaggagttcatcgcctggctggtcaagggccggggc

SEQ ID NO: 12677 - DNA, 165 bp, Artificial Sequence
  Description of Artificial Sequence: Synthetic coding sequence
atgaagtgggtcagttttatctccctcctgtttttgttctcctccgcttactcgggttctctggacaaacgacacggggagggtactttcacctcggatgtgtcgagctacctggaagggcaggccgccaaggaattcatcgcgtggctcgtgaagggccgcgga

SEQ ID NO: 12678 - DNA, 165 bp, Artificial Sequence
  Description of Artificial Sequence: Synthetic coding sequence
atgaagtgggtcagcttcatctcccttctgtttctcttctcgagcgcgtactcgggctctctggacaaacgccacggggagggtacctttacttccgacgtgtcctcgtacctcgaaggacaggccgccaaggaattcatcgcatggctggtgaagggaagaggg

SEQ ID NO: 12679 - DNA, 165 bp, Artificial Sequence
  Description of Artificial Sequence: Synthetic coding sequence
atgaagtgggtctctttcatctccctcctatttttgttctcctcagcctactccgggtccttggataaacgccatggcgaagggacatttacatcggacgtctcatcttacctggagggtcaggcagcgaaagaatttatagcttggcttgtcaaagggagaggt

SEQ ID NO: 12680 - DNA, 165 bp, Artificial Sequence
  Description of Artificial Sequence: Synthetic coding sequence
atgaaatgggtgtcttttatatcattattgttcttgttttcttctgcttacagcggatctctggacaaacgccacggtgagggcacttttacgtccgacgtgagtagttaccttgagggtcaggctgccaaagagttcattgcatggctcgtcaagggccgcggt

SEQ ID NO: 12681 - DNA, 165 bp, Artificial Sequence
  Description of Artificial Sequence: Synthetic coding sequence
atgaaatgggtgtctttcatatctctccttttccttttctccagcgcctacagcggttctctggataaacggcacggcgaggggacattcacaagcgatgtctcgagttatctcgaaggacaggcggctaaagaatttattgcctggcttgtgaagggccgcggt

SEQ ID NO: 12682 - DNA, 165 bp, Artificial Sequence
  Description of Artificial Sequence: Synthetic coding sequence
atgaagtgggtgtcgtttatctccctgctcttcctcttctcatccgcctactcgggatcactcgacaagcgccacggcgaaggaactttcacctcagatgtgtcgtcgtacctggagggacaggccgcaaaagaattcatagcgtggctggtcaagggacgggga

SEQ ID NO: 12683 - DNA, 165 bp, Artificial Sequence
  Description of Artificial Sequence: Synthetic coding sequence
atgaaatgggtgtcgttcatcagccttctcttcctgttctcgagcgcctactcgggatcgttggacaagcggcacggtgagggaacctttacgagcgatgtgtcgtcctacctcgaaggccaggccgcgaaggaattcatcgcctggctggtcaaaggaagagga

SEQ ID NO: 12684 - DNA, 165 bp, Artificial Sequence
  Description of Artificial Sequence: Synthetic coding sequence
atgaagtgggtcagttttatctcactcctgtttttgttctcgtcagcatactccggctcgctcgacaaacgccacggcgaaggaactttcacgagcgatgtgtcctcgtaccttgaggggcaagcggcaaaagaattcatcgcttggctggtgaagggtagggga

SEQ ID NO: 12685 - DNA, 165 bp, Artificial Sequence
  Description of Artificial Sequence: Synthetic coding sequence
atgaaatgggtgagctttatcagcttgctcttcctgttcagctccgcttacagcgggagtctcgacaagaggcatggagaaggtacctttacttcggatgtgtcctcttacctggaaggccaagcggccaaggagtttattgcatggctggtcaagggaagaggt

SEQ ID NO: 12686 - DNA, 165 bp, Artificial Sequence
  Description of Artificial Sequence: Synthetic coding sequence
atgaaatgggtctctttcatatcattgctgttcctcttctcctccgcctactctggcagcctggacaagcgccatggcgagggcacctttacaagtgacgtgtctagctacctagaggggcaggccgccaaggaattcatagcttggctggtaaaaggacggggg

SEQ ID NO: 12687 - DNA, 165 bp, Artificial Sequence
  Description of Artificial Sequence: Synthetic coding sequence
atgaagtgggtgtcgttcatcagcttgctgttcctcttctcctcggcatactcggggtcactggacaagcgccacggagagggcactttcaccagcgatgtgtcctcatacctcgaaggtcaggcggccaaggaatttatcgcttggctggtcaaaggacgggga

SEQ ID NO: 12688 - DNA, 165 bp, Artificial Sequence
  Description of Artificial Sequence: Synthetic coding sequence
atgaagtgggtgtcatttatctcccttctgtttctgttttccagcgcctactccggtagtttggataaacgccacggcgaggggacctttacgtccgatgtgtcatcttatctggagggtcaggccgcgaaagagtttatcgcatggctggtcaagggaagaggc

SEQ ID NO: 12689 - DNA, 165 bp, Artificial Sequence
  Description of Artificial Sequence: Synthetic coding sequence
atgaaatgggtgagctttatcagtctcctatttctcttttcctctgcttactcaggatccttagacaagaggcatggggagggcacgtttacatccgacgtgagctcctatcttgagggacaggccgccaaggagttcatagcttggctcgtaaagggacgagga

SEQ ID NO: 12690 - DNA, 165 bp, Artificial Sequence
  Description of Artificial Sequence: Synthetic coding sequence
atgaaatgggtatctttcatctcgctcctcttcctcttctcgtccgcatattctggcagcctcgacaaacggcacggtgagggcacgttcacctctgatgtctcctcttatttagagggccaggctgcgaaggagtttattgcatggctggtcaagggacgcggt

SEQ ID NO: 12691 - DNA, 165 bp, Artificial Sequence
  Description of Artificial Sequence: Synthetic coding sequence
atgaagtgggtgagcttcatatcgcttctgtttctctttagcagcgcttactccggttctctggataagcggcatggagaggggaccttcacttcagacgtctcatcctatctggaaggccaagcagccaaggaattcatcgcatggctggttaagggaagagga

SEQ ID NO: 12692 - DNA, 165 bp, Artificial Sequence
  Description of Artificial Sequence: Synthetic coding sequence
atgaaatgggtaagcttcatctccttgttgtttctgttttccagtgcctactctggaagtctcgacaaacggcatggtgaaggcacttttacatccgacgttagcagctacctcgagggacaggcggctaaagagttcatcgcatggctggtcaagggcagaggc

SEQ ID NO: 12693 - DNA, 165 bp, Artificial Sequence
  Description of Artificial Sequence: Synthetic coding sequence
atgaaatgggtatcttttatctctctgctgtttcttttttcctccgcctacagcggaagcctggacaaaaggcatggcgagggaactttcacctctgatgtgtctagttatttggagggccaggccgcaaaggagttcattgcctggctggtgaaaggacggggc

SEQ ID NO: 12694 - DNA, 165 bp, Artificial Sequence
  Description of Artificial Sequence: Synthetic coding sequence
atgaagtgggtgagtttcatttcccttctttttttattttcatccgcttatagtggctccctcgacaagagacatggtgaaggaacctttacctctgatgtgagttcatatctggagggtcaggctgccaaggagtttattgcgtggctggttaaagggaggggc

SEQ ID NO: 12695 - DNA, 165 bp, Artificial Sequence
  Description of Artificial Sequence: Synthetic coding sequence
atgaaatgggtgagcttcatttcgcttttattcctgttctcctcagcctacagtggctccttggataaaaggcatggggagggcactttcacaagcgacgtgtcttcatatttggagggccaggcagcaaaagaatttatagcctggctggtgaaggggcgtggg

SEQ ID NO: 12696 - DNA, 165 bp, Artificial Sequence
  Description of Artificial Sequence: Synthetic coding sequence
atgaagtgggtgtcattcatttcactgctgttcctgttttcatccgcctattcggggtctttggacaagaggcatggggaagggacattcacgagtgacgtcagttcgtatctggagggccaagctgctaaagaattcattgcctggctggttaaaggccgcggt

SEQ ID NO: 12697 - DNA, 165 bp, Artificial Sequence
  Description of Artificial Sequence: Synthetic coding sequence
atgaagtgggttagtttcataagcttattgtttcttttttcatccgcttatagtggctccctggacaaaaggcatggagaaggaacattcacatcagacgtgagcagttatttggaaggccaagccgccaaagagttcattgcttggctggtgaagggtcgagga

SEQ ID NO: 12698 - DNA, 165 bp, Artificial Sequence
  Description of Artificial Sequence: Synthetic coding sequence
atgaagtgggtgtcctttatctcgttgctttttctgttcagcagcgcctactccggatcactagacaagcgacacggcgaaggaactttcacttccgacgtttcttcatacctagagggacaggctgcgaaggagttcatagcctggttggtgaagggaagaggc

SEQ ID NO: 12699 - DNA, 165 bp, Artificial Sequence
  Description of Artificial Sequence: Synthetic coding sequence
atgaagtgggtttccttcatatcgctgctgtttctgttctcgtctgcatattccggcagcctcgataagcggcacggagaaggaacttttaccagcgacgtctcttcatacctggaaggacaagccgcaaaagagtttatagcttggctggtgaaggggagggga

SEQ ID NO: 12700 - DNA, 165 bp, Artificial Sequence
  Description of Artificial Sequence: Synthetic coding sequence
atgaagtgggtcagcttcatctcgctgctgtttctcttctcgtccgcatactccggatcactggacaagcggcacggtgaaggaacttttactagcgatgtctccagctacttggagggtcaggccgccaaggagttcatcgcgtggctggtcaagggaagggga

SEQ ID NO: 12701 - DNA, 165 bp, Artificial Sequence
  Description of Artificial Sequence: Synthetic coding sequence
atgaaatgggtttcctttatatcattgttatttcttttctctagtgcttattctgggtcactcgataagagacatggggaagggacatttacaagtgatgtgtcttcttatttagaaggacaggccgccaaagaattcatcgcctggctggtgaaagggcgcgga

SEQ ID NO: 12702 - DNA, 165 bp, Artificial Sequence
  Description of Artificial Sequence: Synthetic coding sequence
atgaaatgggtatcgtttatatcgctattatttttattttcgtcggcgtattcgggttcgctagataaacgtcatggtgaaggtacgtttacgtcggatgtttcgtcgtatctagaaggtcaagcggcgaaagaatttatagcgtggctagtaaaaggtcgaggt

SEQ ID NO: 12703 - DNA, 165 bp, Artificial Sequence
  Description of Artificial Sequence: Synthetic coding sequence
atgaaatgggtgtccttcatctccctcctgttcctgttctcttcagcctactctgggtccctggacaaaaggcacggcgaagggacctttacctctgacgtgtccagctacttagaaggacaagcagccaaagaatttatcgcctggttagtgaaggggagggga

SEQ ID NO: 12704 - DNA, 2106 bp, Artificial Sequence
  Description of Artificial Sequence: Synthetic coding sequence
atggccgccccaatgactcccgcagctagaccggaagattacgaagctgcacttaacgccgcgctggcagatgtgccggaactcgcgagactccttgaaatcgacccatacctcaagccttacgcggtagatttccagagacgctacaagcagttctcgcaaatcctgaagaatatcggtgagaacgaaggaggaatcgacaagttcagtcgcggctacgaatcgtttggggtgcatcggtgcgccgatggaggactctactgcaaggaatgggcacctggagccgagggagtctttttgaccggggatttcaacggatggaacccgttctcttacccgtacaaaaagttggactacggcaagtgggaactgtacatccccccgaagcagaacaaatcagtgcttgtgccacacggatcgaaactcaaggttgtgattacgtcgaagtcgggcgaaatcttgtaccgaatctccccatgggctaagtacgtggtcagagaaggcgacaatgtgaattacgactggatccactgggacccagagcactcctatgagtttaagcatagccgcccgaagaagccgcggtcattgcgcatatacgagagccacgtcggcatttcctcccatgagggtaaagtggcatcgtataagcactttacctgcaatgttctcccacggatcaaaggactggggtataactgcattcagctcatggccatcatggagcacgcctattacgcctccttcggatatcagatcacttccttcttcgcggcctcctccagatacggaactccggaagaactgcaggaactggtcgacactgcgcacagcatggggatcatcgtccttctggacgtggtccactcgcacgcgtccaagaatagcgccgatgggctgaacatgtttgacgggactgactcgtgttacttccattccggtccgagagggacccatgatctgtgggattcacggctcttcgcttacagctcttgggaaatcctgcgtttcctgctgtccaacattaggtggtggctggaagaataccggtttgacggattcagattcgatggcgtgacttcgatgctgtaccaccatcatggagtgggacaaggcttctcgggagattacagcgagtattttggactgcaagtggacgaggatgcgctgacgtacctcatgctggctaaccaccttgtgcacacgttgtgcccggactccatcaccatcgcggaggacgtttcaggtatgcctgccctctgctcgcccatcagtcagggaggtggagggttcgattatagactggcgatggcaatacctgataagtggattcagctgctcaaagagtttaaggacgaagattggaacatgggcgatatcgtatacacgctgactaacagacggtacctggagaagtgtattgcatatgccgagtcacacgaccaggcgctcgtcggagataagtcgcttgccttctggctgatggacgccgaaatgtacactaatatgtcagtgctgaccccgttcactccggtgatagatcgcggaatccagctgcacaaaatgattcgcttgattacccacggcctgggtggcgaggggtaccttaactttatgggaaacgaattcggccacccagagtggctggacttcccaagaaaaggaaataacgaatcctatcattacgcacgccggcaatttcacctgaccgacgacgacctgctccgctacaaatttctgaataacttcgatcgcgatatgaaccgcctggaagagaggtacgggtggttggccgctccccaggcatacgtgtccgaaaagcatgaaggaaacaagatcattgcgttcgaacgagctgggctcctgtttatcttcaatttccatccttcaaagtcctacactgattaccgggtgggaactgccctgccgggaaagttcaagatcgtcctcgattcagacgccgccgagtacggagggcatcaaaggcttgaccacagcacggacttcttcagcgaggcgttcgagcataacggacggccctactccctgctcgtgtatatcccttcccgcgtggccctcatcctccaaaacgtggacctgccaaat

SEQ ID NO: 12705 - DNA, 2106 bp, Artificial Sequence
  Description of Artificial Sequence: Synthetic coding sequence
atggccgcccctatgactcctgccgctagaccagaagattacgaggcagcgctcaacgccgcccttgcagatgtgccggaactggcaagactgctggagatcgatccatacctgaaaccgtacgcggtggacttccagcgcaggtacaagcagttttcgcagatcctgaagaacatcggtgaaaacgagggcggcatcgacaagtttagccggggttacgagtcgttcggcgtgcacaggtgcgcggacggtggcctgtactgtaaggaatgggcgcctggagcagagggagtctttctcaccggggacttcaacggatggaaccctttttcgtacccgtacaagaaactggattacggaaagtgggaactgtacattccacctaagcagaataagtctgtgctcgtccctcacggatccaagctgaaagtggtgatcacctcaaagtcgggagaaattctttaccgcatcagcccctgggccaaatacgtcgtgcgggaaggggataacgtgaactacgactggatccattgggacccggagcactcttacgaattcaaacactcgcgtcctaagaagccccggtcgcttcgcatttacgaatcgcacgtgggcatcagctcccatgagggcaaagtggcatcgtacaaacactttacgtgcaacgtccttccgcgcatcaagggactcggttacaactgtatccagctgatggcgatcatggaacacgcgtactacgcttcatttggataccagatcacctcattcttcgcggcctctagtcggtacgggactccggaggagctccaggaactggtcgataccgcccacagcatgggaattatcgtcctgctggacgtggtccactcccacgcatccaaaaactcggccgacggcctgaacatgttcgatggaactgactcgtgctacttccattccggcccccgcggaacccacgacctgtgggactccaggctttttgcctactcaagctgggagatcctgaggttcctcctgtctaacattcgctggtggctggaggagtacagatttgatggcttccggtttgatggagtgacgtccatgctctaccatcatcacggagtgggacaaggattctcgggagactactcggaatactttggactgcaggtcgacgaagatgccctgacctacttgatgcttgcaaaccatcttgtgcacactctctgcccggattcaatcaccatcgcagaagatgtctccggtatgccggcactctgcagcccgatctcccaaggtggcggtggattcgactaccggttggcgatggcgatcccagacaagtggattcaacttctcaaagaattcaaggacgaagattggaatatgggagacatcgtgtacactctcaccaacagacggtacctggagaagtgcatcgcctacgccgaaagccacgatcaggcacttgtcggcgataagtcgctcgctttctggctgatggacgccgaaatgtacactaatatgtcggtcctgactccgttcacccccgtgatcgatcgcggcattcaactgcacaagatgatccggctgatcactcacggactgggaggagagggttatttgaacttcatgggtaacgaattcggacatccggagtggctcgattttccaagaaagggcaacaatgagtcctatcactacgcgcgcagacagtttcatcttactgatgacgatctcctgcgctacaagtttctgaacaacttcgatcgggacatgaatcgcctggaagagcgctatggatggctcgctgccccgcaggcctacgtgtccgagaaacatgaagggaacaaaatcatcgccttcgaacgcgccggcctcctgtttatcttcaactttcacccatctaagtcctacactgattaccgggtgggtactgcgctgcccggcaaattcaaaatcgtgctggatagcgatgccgccgagtacggggggcaccaacgcctcgaccattccaccgacttcttttccgaagcgttcgaacacaacggaaggccgtacagcctcctggtgtacatcccatccagagtcgctctgatcctgcagaatgtggacctccccaac

SEQ ID NO: 12706 - DNA, 2106 bp, Artificial Sequence
  Description of Artificial Sequence: Synthetic coding sequence
atggcggcacccatgaccccagcagcacggccagaagactatgaagctgctctcaatgccgccctggctgacgtccccgagcttgcacggctgctggagatcgacccttacctgaaaccttacgctgtggactttcaacggcgctacaagcagttctcgcagatcctgaagaacattggcgaaaatgaagggggcattgataaattttctcgcggatatgagtcttttggtgttcaccggtgcgccgacggcggactctactgcaaggagtgggccccaggggcagaaggcgtattcctgaccggcgatttcaatgggtggaacccattttcttacccatataagaagctagactatggcaaatgggaattgtatattccccctaagcaaaataagagcgttttggtgcctcatggctcaaaattgaaggttgtaattacaagcaagtctggtgagatactgtaccggataagcccttgggccaagtatgtggttcgggaaggtgacaatgttaactatgattggattcattgggatcctgagcactcctatgaatttaaacactctcgacccaaaaaaccacggagtcttcgcatttacgaatcgcacgtggggattagctcccacgagggtaaagtggccagctacaagcatttcacttgtaacgtactgccacggatcaagggcttggggtacaattgcatccagctcatggcaattatggaacatgcatattacgcgagttttggttaccagatcacctcttttttcgccgccagctctcgctatggcacacccgaggagttgcaggaacttgtggatacagctcattctatgggtatcatcgtattacttgatgtggtgcatagccatgccagtaagaactccgccgatgggctcaacatgtttgacgggacagattcctgctatttccattctggccctcggggaacccacgatctgtgggacagcagactgtttgcctacagctcatgggagatcctgaggtttctgctctctaacattaggtggtggctagaagagtaccgcttcgatggctttcgattcgacggggtgacctctatgctgtatcatcatcacggggtcggacagggctttagtggcgactacagcgaatatttcggcctgcaggtggatgaagacgcactcacctacctgatgctcgccaatcaccttgtgcacaccttgtgtcccgacagcataaccatcgccgaagatgtaagcggtatgcctgctttatgctctcccatctcccaaggcggaggcggtttcgattatcggctcgcgatggcgatacctgacaaatggatccagctcctgaaggaatttaaggatgaagattggaacatgggagacattgtgtataccctgactaaccggcgctatctggagaagtgtattgcatatgcagagtcgcatgaccaggccctggttggcgataaaagcttggccttctggttaatggacgctgagatgtataccaacatgtctgtcctgacacccttcacccctgtgatcgaccgaggaattcaacttcacaagatgattaggctgattacccatgggctgggcggcgaaggctatctgaattttatgggaaatgagtttggtcatcctgaatggctcgattttccgaggaagggcaacaacgagtcctaccactatgctcgcagacagttccatctgactgacgacgatctacttcgctataaattcctgaataattttgatcgcgatatgaatcggctcgaggagaggtatggttggctggctgcccctcaggcatatgtctccgagaaacatgagggcaacaagattattgcttttgagcgcgccggacttctgtttatctttaatttccatccctccaaaagctacactgattacagggtcggaactgccttgcccgggaagtttaagatcgtcctcgatagtgatgccgcggaatatggtggccatcagcggcttgaccattccacggactttttttccgaggcctttgaacacaatggccggccctacagcttgcttgtatacataccttcaagagtggctcttatactccagaatgtggatctgcctaac

SEQ ID NO: 12707 - DNA, 2106 bp, Artificial Sequence
  Description of Artificial Sequence: Synthetic coding sequence
atggcagcacctatgacgcctgcggccagacctgaagattacgaggcagcactcaatgccgcccttgccgatgtccccgaactggctcggcttttggaaattgatccatacctcaagccatacgccgtcgatttccagcgcagatacaagcagttcagccagatccttaagaacattggtgagaacgaaggcgggattgataagttctcgaggggctacgaatcctttggggtgcatcggtgtgcagacggcggtttgtactgtaaggaatgggcaccgggtgcagaaggggtgttccttaccggagatttcaatggatggaacccattttcctatccatacaagaagctcgattacggcaagtgggaattgtacatcccgccaaagcaaaacaagtcggtccttgtgcctcatggatcgaagctgaaggtcgtcatcactagcaaatccggtgaaatactctaccgcatctctccgtgggcaaaatacgttgtgcgggaaggtgacaacgtgaactacgactggatacattgggatccagaacattcctatgagttcaagcactcacggccaaaaaagcctcggtcactcagaatttacgagagccacgtgggcatatcgtcgcatgaaggtaaggtggcaagctacaagcattttacgtgtaacgtgctgcccagaattaagggacttggttataactgcattcagctcatggcaatcatggagcatgcatactacgccagctttggataccaaatcacctcgttttttgcagcttcgtcacgatacggtacccctgaagaactccaagaactggtggacaccgcccattcaatgggtattatcgtgctgctggatgtggtgcattcgcatgcatcaaagaacagcgccgacgggctgaacatgtttgatggcaccgatagctgttactttcatagcggccctaggggtactcacgacctctgggactcaaggctgtttgcctactcctcctgggagatactgcggtttctgcttagcaacattcggtggtggcttgaggaataccggtttgatggattccgtttcgatggagtgacgtcgatgctttaccaccaccatggagtcggtcagggattttcgggggactactccgagtattttggactccaggtggacgaagatgcactcacttacctcatgctcgcaaatcatctcgtgcatactctttgtcccgactctattactattgccgaagatgtttcagggatgccggcgctgtgttcgccgatctcgcaaggaggtgggggttttgactacagactggcaatggcaatccctgataagtggattcagctgttgaaggagtttaaggatgaagattggaacatgggagacatcgtgtacacgcttactaataggcgttaccttgagaagtgcattgcctacgcagaatcccatgatcaggcgctggtaggcgacaagtccttggcattttggttgatggatgcagaaatgtacaccaacatgtcggtccttactcccttcactcccgtcattgatcggggcattcaactgcataagatgattcgacttatcacccacgggctcggaggtgagggatacctgaacttcatgggcaacgagtttggccatccagagtggctggattttccaagaaaaggcaataacgagagctaccactacgcacgtaggcaattccatttgacggacgatgatttgcttcgttacaaatttctgaacaactttgacagagacatgaataggctcgaagaacgctacggttggctggccgcaccacaggcttacgtgtcggaaaagcatgaaggaaacaagatcattgcatttgaaagagcaggtctgctcttcatattcaattttcatcctagcaagtcgtacaccgactaccgtgtgggtactgcgcttcctggcaagttcaaaatagtgcttgatagcgacgccgctgagtacggtggtcaccaaagactcgaccattccaccgactttttctcggaggcatttgaacacaacggacggccctactcactgcttgtgtacataccttcgagggtggcactgattctgcaaaatgtggatcttccaaac

SEQ ID NO: 12708 - DNA, 2106 bp, Artificial Sequence
  Description of Artificial Sequence: Synthetic coding sequence
atggccgcccccatgacacccgccgctcgcccggaggactatgaggccgctcttaatgcagcactcgcggatgtgccagaacttgctaggctgttggaaatcgatccttacctgaagccttacgcagttgattttcagcgccgatataagcagttcagccagattttgaagaacatcggtgagaacgagggggggatcgacaagttttctcggggttatgaaagcttcggcgtgcataggtgtgcagatggtggcctgtactgtaaggagtgggcccctggcgcggaaggggtttttctgactggggatttcaacggctggaacccgttctcctacccttataaaaagctggattatgggaagtgggagctgtatatccccccgaagcagaacaagagcgtgctggtccctcatgggtcaaagctgaaagtggttatcacatctaagagtggcgagatcctgtaccgcatatctccatgggcaaaatatgtggtccgcgaaggagataacgtgaactatgactggatccattgggaccccgagcactcttacgagttcaagcactcacggcctaaaaagcctcgttctttgcgcatctatgaaagccacgtcggcatctcctcccacgagggaaaggtggcatcttacaagcatttcacatgtaacgtgcttccacgcatcaaaggcctcggctacaattgcatccagctgatggccattatggagcacgcatactacgcgagttttggttatcaaatcacctctttttttgcagcaagcagtcgttacgggacccctgaagagctccaggagctagtggatacagcacacagcatgggcatcattgtcttgttggatgtagtgcactcccatgcgagcaagaatagtgcagacgggctgaacatgttcgatggcacagatagctgctacttccacagcggcccaagaggtacacacgatctctgggattcaaggctttttgcatactccagttgggagattttacgttttttgctttcaaacatacgctggtggctggaagagtaccgtttcgatgggttccgcttcgacggcgtgacatctatgttgtaccatcaccacggcgtaggccaggggttctctggggattatagcgaatatttcggtctgcaggttgacgaggatgctctcacttatctgatgctggcaaaccacctggtccacacattatgtcccgatagcataacaatcgcagaggatgtgagtgggatgcctgccctgtgcagccccatcagccaagggggtggcggttttgactatcggttggctatggcgatccccgacaagtggattcagctcctgaaagagtttaaagatgaggactggaacatgggggacatcgtgtataccctgactaacagacgctacctggaaaagtgcatcgcgtacgcagaaagccatgatcaagcacttgtgggggataaaagcctcgccttttggcttatggatgctgaaatgtatacaaacatgtcggtgctgactccttttacacccgtgattgacaggggtatccaactgcacaagatgatccggttgattacacatgggctggggggtgaggggtatctgaatttcatgggaaatgaattcggtcatcccgaatggcttgattttccacggaaaggaaataacgagtcttaccactatgcacgaagacagttccacctcaccgacgatgacctgctgaggtataaattcctcaacaactttgacagggatatgaaccggcttgaagaacgttatggttggcttgccgctccacaggcttacgtgtcagagaagcacgaaggaaacaagatcattgcattcgagcgagctggattactcttcattttcaatttccatccctcaaagtcatacacagattatagagtcgggaccgccctccctggtaagttcaaaatagttctggatagtgacgctgctgaatacggcggacaccaacgccttgatcattctactgatttcttcagcgaggcctttgaacacaatggacggccttacagtctcttagtctacattccgagtagggtggctttgatacttcagaacgtggacctgcccaac

SEQ ID NO: 12709 - DNA, 2106 bp, Artificial Sequence
  Description of Artificial Sequence: Synthetic coding sequence
atggcagctccaatgacaccagccgctaggccagaggattacgaagccgctttgaacgctgctctcgccgacgtgcctgaattggcaaggttgctcgaaatcgatccttacctgaagccctatgctgttgattttcagaggaggtacaagcagtttagccagattctgaagaatattggcgagaatgagggcggcatcgacaagttcagcaggggttacgagtcattcggtgtccacaggtgcgccgatggcggcttgtattgcaaggaatgggccccaggtgccgagggagtgttcttgactggcgacttcaacggttggaaccctttctcttacccctataagaaacttgactacggaaagtgggaactttacattcccccaaagcagaacaagtcagtactcgtcccgcatggatccaagctgaaagtggtgattacttctaaatctggagagatcctgtatcgcatctccccttgggcaaaatatgttgtgcgcgaaggagacaacgtgaactacgactggatccattgggacccggagcacagttatgagtttaagcatagcagacccaagaagccccgcagcctgaggatttatgaatctcatgtgggaatctcctcccacgaaggtaaagtagcaagctacaaacactttacatgtaacgttctgccccgcattaagggactgggctacaattgcattcagctgatggcgattatggagcatgcttattacgcatcctttggatatcaaatcacgagcttctttgccgcttcctccagatatggcacgcccgaggagttgcaggaactcgtcgacacggcacactccatgggcatcattgtgctgttggacgtggtgcacagccacgcgtctaagaattccgctgacggtctcaacatgtttgacggaactgactcctgttattttcatagcggcccaaggggtacacatgatctgtgggatagccgcctttttgcgtactcctcttgggaaatccttaggttcctgttgtctaatatccgctggtggttggaggagtatcgcttcgacggcttcagattcgacggagtgacatctatgctttatcaccaccacggtgttggacagggtttcagcggcgactacagcgagtacttcggcttgcaagtagatgaagatgccttgacttatctgatgctcgccaaccacctggtgcacactctgtgtcctgactctattacaatagcagaagacgtttcaggcatgccggccttgtgtagcccaatctcccaaggaggaggaggttttgactaccgccttgccatggctattcccgataaatggattcaacttctcaaagagttcaaggacgaggattggaacatgggagacattgtttatacactgactaatcgccgctatctggagaagtgcattgcctacgctgagtctcacgatcaggctttggtcggcgacaagtcacttgctttctggcttatggacgccgagatgtacacaaacatgtccgtgctgacccctttcaccccagtaattgacaggggcattcagctgcataaaatgatcagactcatcacccatggtctgggaggcgagggatatctcaatttcatgggaaacgagttcggacatcccgaatggttggatttcccgagaaaaggtaacaacgaatcataccactacgctaggagacaattccacctcacagacgatgatctgcttagatataagttcctgaacaacttcgacagagatatgaaccgcttggaggaaagatacggatggcttgcggctccccaggcttacgtttccgaaaaacacgaaggaaataagataatcgctttcgagagagcaggtctgctctttatattcaactttcaccctagcaaaagctacacggactatagggtgggtactgcgctgcctggcaagttcaagattgtgctggacagcgacgcggccgagtacggcggtcaccagaggttggaccatagcactgattttttctccgaagccttcgagcacaatggcaggccctatagtttgttggtatacatcccgtctcgcgtggcccttatcctgcagaacgttgacctcccgaat

SEQ ID NO: 12710 - DNA, 2106 bp, Artificial Sequence
  Description of Artificial Sequence: Synthetic coding sequence
atggccgcaccaatgaccccagcagcacgccctgaagattacgaagccgcacttaacgccgctttggcggatgtgccagaactggcgagactgcttgaaattgatccatacctcaagccatacgcagtcgattttcaacgaagatacaaacagtttagtcagattctgaagaacatcggggaaaatgagggaggtattgataagttttcgcgcggttacgaatccttcggtgtgcatcggtgtgcagacggcggcctgtactgcaaggagtgggcccccggagcggaaggagtgtttctcaccggcgatttcaacggatggaatccattctcgtatccttacaagaaactggattacggcaaatgggaactgtatattccacccaagcagaacaaatccgtcctggttccgcatggatctaaacttaaagtggtcatcacttcgaagtccggggagatcctctatcgcatttcgccatgggccaaatacgtggtgcgggagggagataacgtgaattacgactggatccattgggatcctgaacactcctacgaattcaagcactccaggcctaagaagccaagatcactccgcatttatgaatcgcacgtgggaatttcctcgcacgaagggaaagtggccagctacaagcattttacctgcaatgtgctgcctaggattaagggacttggttacaattgtattcagcttatggcaatcatggaacatgcttactacgcttcatttggctaccaaattaccagcttttttgcagcatcgtcacggtatggaacgcctgaagagctgcaggaattggttgataccgcacactccatgggcataattgtgctgcttgatgtggtgcacagccacgcttccaagaactcagcggatggactgaatatgtttgacggcactgacagctgctactttcactcagggccgagagggactcatgatctttgggattcacgtttgttcgcctacagctcctgggaaattctccgcttcctgctgtccaatattcgttggtggctggaagaataccggtttgacgggtttcggtttgatggtgtcacttcgatgctttaccatcatcatggtgtggggcaagggttctcgggtgattactcggaatacttcggcctccaagtggatgaggatgcccttacctacctcatgctggcaaatcatctggtgcacactttgtgtcctgactcgatcacgatagcagaggacgtgtcgggtatgcctgcgctctgttccccaatttcgcaaggcggaggcggctttgactaccggctcgcaatggcaattccagataagtggatccagcttcttaaggaattcaaggacgaggactggaacatgggagacatcgtttacacgcttaccaacagacggtaccttgagaagtgcattgcttacgcagagagccacgatcaggcacttgtcggagataagagcctggcattctggcttatggatgccgagatgtacaccaacatgtcggtccttactccctttactcccgtgattgatcgggggattcagcttcataagatgatccggcttattactcatggactcgggggtgaaggatacctgaatttcatgggcaatgagttcggccatcctgagtggcttgattttcccagaaagggcaataatgaatcctaccattacgcgcgaaggcaatttcatctcactgacgacgaccttctcaggtacaagtttttgaataactttgacagagatatgaatcgcctggaagaacgttatggttggctggcggctccacaggcatacgtcagcgagaaacacgaaggtaacaagatcatcgccttcgaacgagcagggctccttttcattttcaattttcatccatcaaaatcgtacactgattacagagtgggtaccgcgctgccaggaaagtttaagatcgtgctggattctgatgcagcagaatacggcggacatcagcgcctcgatcatagcactgatttcttctcggaagcgtttgaacataacggacggccctactcactgcttgtttacatcccttcgagggttgcgctcatcttgcagaacgtcgatctcccgaat

SEQ ID NO: 12711 - DNA, 2106 bp, Artificial Sequence
  Description of Artificial Sequence: Synthetic coding sequence
atggcggcaccaatgacccccgcggctcggccagaagattacgaggcagcacttaacgccgcacttgcagacgtgcccgaacttgcgcgccttcttgaaatcgacccttacctcaagccttacgccgtcgattttcaaagacggtataagcaattctcacagattctgaagaacatcggtgaaaacgagggagggattgataagttttcccggggttacgaatccttcggagtgcaccgttgtgcagacggcggcctttactgtaaggaatgggcaccaggagcagaaggtgtctttctcaccggtgacttcaatggatggaaccccttctcctacccctacaagaagctcgactacgggaagtgggagctctacattcctccaaagcaaaacaagagcgttctcgtccctcacggatcgaaattgaaagtcgtcattacttcgaagtcaggtgaaatcctttaccgtatttcgccttgggccaagtacgtcgtgcgtgaaggagataacgtcaactacgattggattcactgggatcccgagcattcctatgagtttaagcattcgcgccctaagaaaccacggtccctccgtatctacgaatctcatgttggtatttcctcccatgaaggaaaagtggcaagctacaagcactttacttgtaacgtgctgccacggattaaaggactgggatacaactgcattcagcttatggcaatcatggaacatgcatactacgcatcattcggttaccaaattacgtcattctttgcagccagctcacggtacggaacccctgaagaactccaggagctggtggataccgcacattccatgggcattattgtgctgcttgatgtggtgcatagccacgcatcgaagaattcggcagatggactcaacatgtttgacggcacggactcctgctactttcattcaggcccgagaggaacccatgacctctgggactcgagactgttcgcatactcctcgtgggagattttgagatttctgctttccaacatccgatggtggctggaagagtacagatttgatggttttcgatttgatggagtgacttcgatgctttaccatcatcacggcgtcggtcaaggattttccggagattacagcgaatactttgggctccaagtggatgaagatgcccttacctaccttatgcttgccaatcacctggtccatactttgtgcccagactccattaccatagcagaggatgtgagcggtatgccagcactgtgttcgcctatctcccaaggtggtggtggttttgattacagattggccatggcaatcccggataagtggatccaattgctgaaggagtttaaggatgaggattggaacatgggcgatatcgtgtacactctgactaaccgacggtaccttgaaaaatgcattgcgtacgcggaatcacatgaccaggcactcgtcggggataagtcgcttgccttttggcttatggatgctgaaatgtacactaatatgtcagtgctgaccccttttacgccagtcattgaccgcggaattcagctgcacaagatgattcggctgatcacccatggattgggcggtgaaggttaccttaactttatgggaaacgaatttggacatcccgaatggctcgattttccacggaagggtaataacgaatcataccactacgcgcgacgccagtttcacttgacggatgatgatctgctccggtacaagttcctgaataacttcgatagagatatgaatcgactggaagagcgatacggttggcttgccgcaccgcaggcatacgtctccgaaaagcatgaaggaaacaagattatagctttcgaacgtgccggtctgttgttcattttcaacttccatccatcgaaatcctacaccgactatagagtgggaactgccctgcctggaaagtttaagatcgtcctggattccgatgcagcagaatatgggggacatcagcgtctggatcatagcaccgacttcttttcggaagcctttgaacacaatgggcggccatactcgcttttggtgtatataccgtcaagggtcgcccttatcctgcaaaacgtggatctcccgaat

SEQ ID NO: 12712 - DNA, 2106 bp, Artificial Sequence
  Description of Artificial Sequence: Synthetic coding sequence
atggccgctccgatgaccccggctgcccgccctgaagattacgaagccgcgcttaacgccgccttggccgacgtgccggaactggcccggctgcttgagatcgacccgtatctcaagccctacgccgtggacttccagcgcagatacaaacaattctcgcagatcctgaaaaacatcggcgaaaacgaaggaggaatcgataagttcagccgaggatacgaatcatttggtgtccacagatgtgcggacggcgggctgtactgcaaggaatgggctccgggcgcagaaggagtgtttctcacgggggatttcaatggatggaatcctttctcctacccttacaagaagctcgactacggaaagtgggaactctacatcccgcctaagcaaaacaagtccgtgctggtgcctcatggaagcaagttgaaggtcgtgattacgtcaaagtcgggcgagattctctatagaatctccccgtgggccaaatacgtggttagggaaggggacaacgtgaactacgactggatccactgggacccggagcatagctacgagttcaaacactcccggccgaagaaaccaagaagtctgcgcatctacgagtcgcatgtgggaatttcatcccacgagggtaaagtggccagctacaagcacttcacctgtaacgtcctcccgcgtatcaaggggctcggatacaattgcatccaactcatggcgatcatggaacatgcctactacgcgtccttcgggtaccagatcacgtccttctttgctgcctcgagcagatacggaactccggaagagctgcaggaactggtcgacactgcccattcgatgggaatcatcgtcctgctcgacgtggtgcattctcatgcatccaagaactcggccgacggactcaatatgtttgatggcaccgattcatgctactttcactcaggcccccggggtactcatgacttgtgggacagcagactgttcgcctactcctcatgggagattctgagattcctgctgtccaatatccgctggtggctggaagaatacaggttcgacgggttccggttcgatggcgtcacctcgatgctgtaccaccaccacggcgtgggccagggattttcgggagactactcagagtacttcggacttcaggtggacgaggatgctctcacttacctcatgctggctaaccacctcgtgcataccttgtgtccggattcaataaccatcgcagaggatgtttcaggtatgccggctctctgctcaccgatttcacaaggagggggaggcttcgattaccggctggcgatggccatcccggacaagtggatccaattgctgaaagaattcaaggacgaggactggaacatgggggacatcgtgtacaccttgactaaccggcggtacctcgagaaatgtatcgcatacgcagagtcccacgaccaagcgctggtgggagataaatcgctggcattctggctgatggatgcagaaatgtacactaacatgtcagtcctgaccccgtttaccccggttattgatcgcggaatccagctgcacaagatgatcagactcatcactcacgggttggggggcgagggatacctgaatttcatggggaacgaatttggccatcctgagtggttggattttccaagaaagggcaataatgaatcgtaccattacgcacggcggcagtttcacctgactgatgacgatttgctgaggtacaagttcctgaacaattttgacagggatatgaaccggctggaggagcgctacggctggttggcggccccacaggcgtacgtgtcagagaagcatgaaggtaacaagatcatcgcatttgagcgggccggtctgcttttcatcttcaatttccacccgagcaaaagctacaccgactaccgcgttggtacggccctgccgggtaagttcaaaattgtcctggactccgacgccgcggagtacggaggccaccagaggctggatcattcgactgacttctttagcgaggctttcgaacataatggcagaccttactccctgctggtgtacatccctagcagggtggccttgatcctccagaatgtcgaccttccgaat

SEQ ID NO: 12713 - DNA, 2106 bp, Artificial Sequence
  Description of Artificial Sequence: Synthetic coding sequence
atggccgctcctatgacaccagccgccaggcctgaagactacgaagcggcgttgaatgctgctctggctgacgttcctgaactggccagactgcttgagattgacccttacctgaaaccctacgccgtcgattttcagcgcaggtataaacagtttagccagatactgaagaacattggtgaaaatgagggtggcatagataagttctcccgcggttacgaatcatttggcgtacatcgctgtgcggacgggggactgtactgcaaggaatgggcacccggcgccgagggggtgttcctaaccggggactttaacggatggaatccttttagctatccttacaaaaagctcgattacgggaagtgggagttatatatcccccccaaacaaaataagtccgtcctggttcctcatggcagcaagcttaaagtggtcattacgtcaaaaagcggggaaattctttacaggatttccccatgggctaagtacgttgtgagggaaggtgacaacgttaactacgactggatacattgggacccagaacactcttacgaatttaagcactcgcgtccgaaaaaaccgaggtcactgagaatttacgagtcgcacgtgggtatttcttcgcatgaagggaaagttgcttcttataaacattttacatgcaacgtccttcctcggatcaagggcctgggatataactgcatccagttgatggctatcatggaacacgcttactatgcgtccttcggctaccagataacatcatttttcgcggcttcctcccgctatggcactcccgaggagctgcaggaattggtcgacacggcccactccatgggcatcattgtccttcttgatgtggttcacagccacgcttccaaaaattctgccgatgggctcaacatgttcgatggtactgactcgtgttactttcattcaggccctcgcggcacccacgacctctgggattctcgtctgttcgcttattcttcatgggaaattttgaggttcctgttgagtaacatacgctggtggctggaagagtaccggtttgatggtttccgcttcgacggagtaacaagtatgctgtaccaccaccacggcgtgggccagggattttctggcgactactctgagtattttggacttcaggtcgacgaggatgccctgacatatctcatgctggccaaccaccttgtgcacactctgtgccctgactctatcacaatcgccgaggacgttagcggaatgcctgccctgtgcagcccaatcagccaggggggaggtggttttgattatagactggcaatggcaatccccgacaaatggatccagctgctgaaagagtttaaggacgaggattggaacatgggcgacattgtttacacactgaccaaccggcgttatctagagaagtgcatagcctatgcggaatcgcatgaccaggcgttagtgggcgataagagtctggcattctggctcatggacgcggagatgtacacgaatatgtctgtgctaacaccgtttacccccgtgatcgatagaggcattcagctacataagatgatacgcttgattactcatggcctcgggggcgaagggtatctgaatttcatgggcaatgaattcgggcacccggagtggttggattttcccaggaaaggaaacaatgagagctaccactatgcccggaggcaattccatctgacagacgatgacctgcttcggtacaagttcctcaacaactttgaccgggacatgaatagattggaagaacgctacgggtggctggcggcgcctcaggcttacgtttccgagaagcacgaaggaaacaagattattgcgtttgagagggcagggctgctgttcatcttcaatttccacccatcaaaatcctatacggattaccgggtggggaccgcactgcccggcaagttcaaaatagtgctggactcagacgccgcagagtacggaggccaccagagattggaccatagcacggactttttctctgaagcctttgaacataacggtagaccttactctctgctagtctacatcccgtcccgcgtcgctctgatcttgcagaacgtcgacctccctaat

SEQ ID NO: 12714 - DNA, 2106 bp, Artificial Sequence
  Description of Artificial Sequence: Synthetic coding sequence
atggccgcgcccatgacaccggccgctagaccggaagactatgaagctgccctgaacgcagccctggcggatgttcctgagctggctaggctgttagaaatcgatccatatctcaaaccttacgcagttgacttccagagacggtataaacagttttctcaaattctaaaaaatatcggagaaaacgagggggggatcgacaagttctctcgtggctacgagagcttcggagtgcacagatgtgctgacgggggtctgtactgtaaagaatgggccccaggagcagaaggcgttttcctgactggcgattttaacggctggaatccattttcctacccttacaaaaagctggattatgggaagtgggagctgtatattccgcccaagcaaaataaatcagttctggttccccatggaagtaagctgaaggttgttataacctctaaatcaggtgaaattctgtatcggatcagcccctgggctaagtacgtagtcagagagggtgacaatgttaactatgactggatccactgggacccagaacattcatacgaatttaagcacagtcgacccaagaaaccccgaagtttgcgaatctacgagagccatgtgggaatctctagtcatgaggggaaagttgcctcctataaacattttacctgcaatgtcttgccacgcataaagggacttgggtataattgcatccagcttatggcgattatggagcatgcttactatgcttcctttggttatcagatcaccagcttctttgccgcctcaagtaggtacggaaccccagaagagctccaggaattagtggatacggcacattctatggggatcattgtgcttctggacgtggttcatagtcatgcttccaagaattccgcagacggtctgaatatgttcgatggcaccgattcttgttattttcattcaggccctaggggcactcacgacctgtgggattctcgactgttcgcctactcatcatgggagattttacgatttcttctgtcaaacattcgttggtggctagaggaatacagattcgacggatttaggtttgatggcgtgacctcaatgctgtatcaccatcacggtgttggtcaggggttttccggagactactcggaatattttggactgcaggttgatgaagatgccttgacctacctaatgttggcaaaccaccttgtgcatacgctgtgtcctgattccattacgatagccgaagatgttagcgggatgccagcgctgtgtagtcccatctcccagggaggcggtgggtttgactatcggctcgccatggctataccggataagtggattcagctgctcaaggagttcaaagacgaagactggaacatgggcgacatcgtctatacattaacgaatagaaggtacttagaaaaatgtatcgcatacgcggagtcccacgatcaagccctggtcggagacaagtcattggcattctggcttatggacgctgaaatgtatactaatatgtcggtcctgactccttttacccctgtcatcgatcgaggcatccagctacacaaaatgatccggctaattactcatggactaggaggagaagggtatctgaattttatgggtaatgagttcgggcacccagaatggcttgacttcccacgaaagggcaacaatgagagttaccattatgccagaaggcagtttcacctgacggatgacgacttgctgcgatataaatttctgaacaattttgaccgggatatgaataggctcgaggaaaggtacggatggctagcagcaccccaagcgtatgtcagcgaaaaacatgagggcaataagatcatagcgttcgagagagctggcttgctcttcatcttcaactttcacccgtccaaaagctacaccgactaccgagtgggcacagctctaccagggaaatttaagatagttctggacagcgacgcggccgaatacggtggccaccagcgactcgatcactctactgacttcttctctgaagcgttcgagcacaatggccgaccctatagtctactggtatatatccctagtcgagtggccctgatcctacaaaacgtggatttacctaac

SEQ ID NO: 12715 - DNA, 2106 bp, Artificial Sequence
  Description of Artificial Sequence: Synthetic coding sequence
atggccgctcccatgacccccgccgcaagacccgaagattatgaggccgccctgaatgccgctctggccgacgtgccggaactggctaggttgcttgagattgatccctatctcaagccttatgctgtggactttcagcggagatacaaacagtttagccagatccttaagaatatcggagaaaacgaaggcggaattgacaaattttctaggggatacgagagcttcggtgtgcataggtgcgccgacgggggcctgtattgcaaagaatgggcgcctggtgcggagggcgtttttctgaccggcgatttcaatggctggaaccctttttcttacccgtacaagaagttggactatggaaagtgggagctgtacatcccccccaagcaaaataagtcggtgcttgttccgcacggaagtaagctaaaggtagtgatcacatcaaagtcaggcgaaatattgtatcgcatctctccttgggctaaatatgtggtgagagaaggcgataatgtgaactacgactggattcactgggaccctgagcacagttatgaatttaaacattctagaccaaaaaagcctagatccctccgaatctacgagtcccacgtgggtatcagttctcatgaggggaaggtggcttcctacaaacatttcacttgtaacgtcctgccacgaatcaagggcctgggatacaattgtatccagttaatggctattatggaacacgcatactatgcctccttcggttaccagatcacgagctttttcgcagcctcaagcaggtatggcacacctgaggaacttcaggagcttgttgatactgcccactctatggggatcatcgttctcttggatgttgtgcactctcacgcaagtaagaactcagctgatggattaaacatgttcgatggtacagatagttgttatttccattccggcccacgagggactcacgatctgtgggacagcagactatttgcgtactcttcttgggagatactgaggttcttgctgtcaaacattaggtggtggctggaagaatatagattcgacggttttcgattcgatggagtgacgtccatgctgtaccaccatcacggcgttggccagggcttttcaggggattacagcgaatacttcggactccaggtagatgaagacgccctcacatacctgatgctggccaaccatctggtgcacaccctctgcccggattcaatcactatcgctgaggacgtcagtgggatgcctgcactctgctcccccatctcacaggggggaggagggttcgactaccgacttgccatggccatcccagataagtggatccagctcctcaaggaatttaaagacgaagactggaacatgggcgatattgtgtacactctgacaaatcggaggtacctggaaaaatgtatagcttatgcggaatcccatgatcaggcgctggtgggagataaaagcctggcgttctggttaatggacgcagaaatgtataccaacatgtcggtcctcacacctttcactccagtaatagataggggaatacagttgcacaagatgattagactaatcacacatggcctggggggagaagggtatctcaatttcatgggcaatgaatttggccaccccgaatggctagacttcccacgtaagggcaacaacgaatcataccactatgcacgtcgtcagttccatctgactgatgacgaccttctgcgatacaaatttctcaataatttcgatcgagacatgaaccgattagaagagaggtatggctggttggccgccccgcaagcctatgtttctgaaaaacacgagggaaacaaaataatagcgttcgagagggccggcctattgtttatattcaatttccacccctctaaatcctatacagattacagagtcggtaccgcattaccggggaagtttaaaattgtgcttgactcagacgcagccgaatatgggggccaccagcgactggatcacagcactgacttctttagtgaagcatttgaacataacgggcgaccgtatagcctgttggtgtatattccatctagagtcgctctcatactgcagaatgtggacctgcctaac

SEQ ID NO: 12716 - DNA, 2106 bp, Artificial Sequence
  Description of Artificial Sequence: Synthetic coding sequence
atggctgccccaatgacccccgcggcacggccggaggactatgaagctgcactcaacgcagctcttgctgacgtaccggaactcgccaggctgctggaaatcgacccatacctcaagccatacgcggtagatttccagcgtagatataaacagttttcccagattttgaagaacatcggggagaacgagggagggatagataaattcagtagggggtatgaatctttcggcgtgcatagatgcgctgatggaggcctctattgcaaagagtgggcacccggggccgagggagtgttcctgaccggcgacttcaacggttggaatcctttcagttatccctacaagaagctggactacggcaagtgggaactttatataccccccaaacagaataaaagtgtgttagtcccccacgggagtaagctgaaagtggtcattaccagtaagtctggcgaaattctgtacagaatttctccctgggctaagtacgtggttcgagaaggagacaacgttaattatgattggatccactgggatccggagcactcatacgagttcaagcatagcaggcctaaaaaacctcggtctttacgcatctatgaatctcatgtggggatatctagtcatgagggcaaggtggcaagttacaaacactttacatgcaacgtgttaccacgcatcaagggactgggatataactgtatccagcttatggccataatggagcacgcatattatgcttcctttggataccagattacatctttttttgctgctagttctaggtacgggacccccgaggaactgcaggagttggtcgacaccgcgcattcaatggggatcatcgtgctgctggacgtggtacactcgcatgcatcgaagaacagtgccgacggcctaaatatgttcgatggcacagactcatgttactttcattcaggacctagggggactcacgacctttgggattccaggctctttgcttactcgagctgggaaatcctgcggtttctgctttctaacattcgctggtggctggaggaataccgttttgacgggtttcggtttgatggagtgaccagcatgctataccaccaccatggcgttggccaaggttttagtggcgattacagcgagtacttcggtctccaggttgatgaagatgcactaacctatctcatgctggctaatcatctggtacatacactctgcccggattcaatcactattgccgaggatgtcagcggcatgcctgcactgtgttcccctatctcacagggggggggaggtttcgactacaggctcgctatggccatcccagataaatggatccaacttctgaaggaatttaaagatgaggattggaacatgggggacatcgtctacacactgacaaatcgccggtatctggaaaagtgtattgcctacgcagagtctcacgaccaagccctggtcggagataaaagccttgctttctggttgatggatgccgagatgtacaccaacatgagcgtgctcaccccgttcacgcctgtcatcgaccgcggaatccagctccacaaaatgattcggcttattacacatgggctaggtggcgaaggatacttgaactttatgggcaacgagttcggccacccggaatggctcgactttccccggaagggaaataacgaaagctatcattacgcccgccgccagttccacctcacagacgacgatctattgcgttataaattcttgaacaattttgatcgtgacatgaaccgactggaggaaaggtacggctggctcgccgcaccacaggcatatgtgtctgagaagcacgagggcaacaaaattatagccttcgaaagagccggcttgttattcatatttaactttcacccttcgaagtcctacaccgactaccgagtcggcactgccttgcccggcaaattcaagattgtgctggacagtgatgccgctgagtacggcggccatcaaaggctcgatcattcgacggacttttttagcgaagccttcgaacataatggtagaccctatagcttattggtgtatattccaagcagagttgccctgatccttcaaaacgtggatttgcccaat

SEQ ID NO: 12717 - DNA, 2106 bp, Artificial Sequence
  Description of Artificial Sequence: Synthetic coding sequence
atggctgcaccaatgacacccgctgcgaggccggaggactatgaggcagccctaaatgctgccctggctgatgtgcctgagttagcccggttactggagattgacccctacctgaagccatatgcggtcgacttccaacgcagatacaagcagttttcacaaattctgaaaaatatcggggagaatgaggggggaattgataagttttccagagggtatgagagtttcggcgtgcatcgatgtgcggatggtggtctgtattgtaaggagtgggcacctggcgctgaaggggtttttctgaccggcgacttcaatggctggaatccattcagttatccgtataaaaagttggattacggaaaatgggaactgtacataccccctaagcagaataagagcgtattggtaccccatgggtctaagctgaaggttgtgatcacttccaagagcggcgagattctatatcggatcagcccctgggctaaatatgtggtgcgtgagggagacaatgtaaattatgactggatccactgggatcctgagcactcgtacgagttcaagcacagccgccccaagaaaccacgctcactgcgcatatacgagtcacacgtcggaatatcgagtcatgaaggaaaagtggcaagttacaaacactttacttgcaacgttcttcctcgaattaagggacttggatacaattgtatccagctcatggcgatcatggagcacgcatactacgcctcatttggctaccagataacatctttctttgcggccagttcccgatacggcactcctgaggaattgcaggaacttgtcgataccgcacacagtatggggatcatagtgctgttggacgttgtgcatagccatgccagtaaaaacagcgcagacgggctcaatatgtttgatggcacagactcttgttatttccattccggccctcgaggaacacacgatctgtgggacagtaggctttttgcctattcttcatgggaaatcctgagattcctcctgtctaacattcgctggtggttagaggaatatagattcgatggcttcaggtttgacggcgtgactagcatgctatatcatcatcacggcgtcggtcaagggttttcaggcgattattccgaatacttcggcctgcaggttgacgaggatgctctgacttacctgatgctggccaaccacctggtacacacgctttgtcctgattccatcacaatagcggaagatgtcagcgggatgcccgcgctgtgctcccctatatctcagggaggaggtggatttgattacaggctcgctatggccattcctgacaagtggattcagctgctgaaagagtttaaggacgaagactggaacatgggcgatatcgtctacacactgaccaatcgccggtatctcgagaaatgcatagcctatgccgaatcccacgaccaggccctggtgggggataagtctttagccttctggctcatggatgccgaaatgtataccaacatgtccgtcctgactcccttcacacccgtcattgatcgtgggatccagctccacaagatgattagacttattacgcacgggcttgggggggaggggtacctgaattttatgggaaatgagtttggacatcctgagtggctcgacttcccccgtaaaggtaataacgagtcataccactacgcacggcgccagtttcacctgaccgatgacgacctgcttcgctacaaatttcttaataattttgatagggatatgaatcgattggaggaaaggtacggatggctggcggccccccaagcatacgtgtctgagaagcacgagggcaacaaaattatcgctttcgaacgagccggcctgctgtttattttcaactttcaccccagcaaatcgtacacggactacagggtcgggactgcactcccggggaaattcaaaatcgtcttggattccgatgccgccgaatacgggggacatcaaaggttggaccattccactgactttttctccgaagcttttgagcacaatgggcgcccatactctctcttggtgtatatccctagtagggtggcgctgatactccagaacgtggatctacccaac

SEQ ID NO: 12718 - DNA, 2106 bp, Artificial Sequence
  Description of Artificial Sequence: Synthetic coding sequence
atggcggccccaatgacgccggccgcaaggccagaagattacgaagctgcactgaacgccgctcttgcagatgtgcctgaactcgcaagacttctggagatcgacccttacttgaaaccttacgcagtggattttcaacgaagatacaagcagttttcgcaaatcttgaagaatattggagaaaatgaaggtggaattgataagttttccagaggctacgagtcgttcggggtgcataggtgtgcagacggcggactgtattgcaaggagtgggcgcctggtgccgaaggggtgtttttgactggtgacttcaacggttggaacccattctcctacccttacaagaagctcgattacggaaagtgggagctttacatacctcctaaacaaaacaagtccgtcctggtgccccacggttcgaaactcaaagtggtgatcacttcgaagtccggagagatactttataggatatcaccatgggcaaaatacgtggtcagagaaggggataacgtgaactacgactggattcactgggatcccgaacacagctatgaattcaaacacagccgccccaaaaagcccaggtcccttcggatctacgaatctcatgtcggtatatcctcgcatgaaggtaaggtggcctcatacaagcattttacttgcaacgtgctgccacgaattaaggggctgggctacaactgtattcagctcatggcgattatggagcatgcatactacgcatcattcggataccaaataacctcgttttttgcggcctcgtcgaggtacggtactcccgaggaactgcaagaactcgtcgacactgcccattccatgggaatcatcgtacttcttgacgtcgtccattcacatgcgtcgaaaaactcggcagatggactcaatatgtttgacggcacggattcctgttacttccattccggacctcgaggaactcatgacctgtgggactccagactgtttgcatactcctcgtgggaaattcttcgttttctcctttcgaacattagatggtggctggaggaatacagatttgatggattccggtttgatggcgtgacttcgatgctgtaccaccatcacggtgtcggacagggcttcagcggagattactccgagtactttggacttcaagtcgacgaagatgcactgacctaccttatgctcgccaaccaccttgtgcataccctgtgtccggattcaatcactatcgcagaagatgtgagcggaatgccggcactgtgttccccgatctcccagggagggggtggattcgactacagactggcaatggcgattccggataaatggatccaactgcttaaggaattcaaagatgaagattggaacatgggagatatcgtctacactttgactaacaggcgttaccttgaaaagtgtattgcttacgctgagtcgcatgatcaggcacttgtgggtgataagtcgcttgctttttggcttatggatgcagaaatgtacaccaacatgtcagtgctcaccccgttcactccggtcatagatagaggtattcagctgcataagatgatccggctgattacccatggacttgggggagagggatacctcaactttatgggtaatgaatttgggcatcctgaatggcttgacttcccgcgaaaaggtaacaatgaatcctaccattacgcacgtagacagttccacctgactgacgacgacttgcttagatacaagtttttgaataacttcgaccgggatatgaacagactggaagagagatacggatggctggcagcacctcaagcatatgtcagcgaaaagcatgaagggaataagatcattgcctttgaacgagcaggactgctctttatcttcaactttcacccaagtaagtcatacaccgattaccgtgtcggcacggcactgccagggaagtttaagatagttctcgattccgatgctgcagaatacggaggacatcaacgtctggatcattcgaccgacttctttagtgaagcattcgaacataacggtcgcccatactcgttgctggtctacattccttcacgcgtggcacttattctccaaaacgtggatctcccaaac

SEQ ID NO: 12719 - DNA, 2106 bp, Artificial Sequence
  Description of Artificial Sequence: Synthetic coding sequence
atggcggcaccgatgacgccggcggctagaccggaagactacgaggctgccttgaatgcagccctagcggacgtaccggagcttgctaggttacttgaaattgacccgtatctcaaaccgtatgccgttgacttccagcgacgctataaacagttttctcagatattgaaaaacatcggagagaatgagggaggaatagataaattttctcgtggctatgagtctttcggggtacatcggtgcgcagacggagggttatattgtaaagaatgggcaccgggcgccgaaggggtatttctcacgggcgattttaacgggtggaatccgttttcctacccttacaaaaaactggactacggaaagtgggagctttacatccctccgaaacagaataagtctgtgttagtaccacatggatctaaattgaaagtcgtcattacgagcaaatccggggagattttatatagaataagcccatgggcgaagtacgtcgtcagagagggtgataatgtaaattacgactggattcattgggacccagaacactcctatgagttcaagcacagtcgcccgaagaagccgagatcattgcgaatatatgaatcgcatgtagggatctcatcacatgaaggtaaagttgcatcatataagcattttacatgcaacgtgttacccagaattaaaggcctgggatataattgtatccaattaatggccataatggagcacgcttattacgcttcttttggatatcagataacgagtttttttgcagcatcaagtcggtacggcacaccagaagaattacaggaactggtagatacagcccactctatgggaataatcgtcctgttagacgtagttcattctcatgctagtaaaaatagcgccgacggcttaaatatgttcgatggaacagattcgtgttatttccatagtggaccgagaggaacacatgatctgtgggattcgcgcctgttcgcatatagctcgtgggaaatcctccgtttcttactgagcaatatccggtggtggttggaggaataccgttttgacggctttcgttttgatggagtgactagtatgctttatcatcatcacggtgtcggacaggggttttcgggagattatagtgaatattttgggcttcaggttgacgaagacgctcttacttatttaatgctggctaatcatttggttcatacgttgtgcccggattctataacaatagcagaagacgtatcaggaatgccggctttatgttccccgatttctcaagggggaggagggtttgattatagacttgccatggctatccctgataaatggattcaacttctaaaagagttcaaggacgaggattggaacatgggtgatattgtttatacattgacaaatcgccgctatcttgaaaagtgcatagcctacgcagaaagccatgatcaagctcttgtgggcgataaaagcttagcattctggctgatggatgctgaaatgtacacaaatatgtctgttctcacgccatttactccggtcattgatcgaggtatccaactgcacaaaatgattaggctgattacacacggactaggcggcgagggatatctgaatttcatgggaaatgaattcgggcatcctgagtggttagattttccgagaaagggaaacaacgagtcataccattacgcaagaagacaatttcatctgactgacgatgaccttttgagatataaatttctgaacaactttgatcgagatatgaatcgattagaagaacgttatggctggctggctgcacctcaagcatacgttagtgaaaagcatgagggcaataaaatcatagccttcgaacgggctggcctgttgtttattttcaattttcacccttcaaagagctacacagactatcgggtgggcacggcattaccgggaaaatttaaaatagttttggattccgatgcagctgagtacggaggccatcaaagattagatcattcaacagattttttttccgaagcttttgaacacaacggcagaccttattctcttcttgtttatatccctagcagagtcgcactcattttacaaaatgttgatctccctaat

SEQ ID NO: 12720 - DNA, 2106 bp, Artificial Sequence
  Description of Artificial Sequence: Synthetic coding sequence
atggcggcaccgatgacccctgcggccagaccggaagattatgaggctgcactgaatgcggctttggcagacgtgcctgagctcgctcggctgctggaaatcgacccgtacctgaagccatacgccgtggactttcagcgcagatacaagcagttctcccagatcctcaagaacatcggagaaaatgagggcggtatcgacaagttctcaaggggttacgaatcattcggtgtgcaccgctgcgcagatgggggcctgtactgcaaggagtgggccccaggagccgaaggcgtgttcctgactggggatttcaacggatggaatcccttttcctacccgtacaagaagctcgactacggtaagtgggaactttacatcccaccgaaacaaaacaagtcagtgctggtgccgcacggaagcaagctgaaggtcgtgatcacttcaaagtcgggcgaaattctgtaccgcatctccccgtgggccaaatacgtggtccgggaaggggacaacgtcaattacgactggatccactgggatccggagcattcttacgagttcaagcattcgcggccgaagaaaccacgctctctgaggatctacgagtcgcatgtgggcatctcctcgcacgagggaaaggtcgcttcatacaagcactttacctgtaacgtgctgccgcgcatcaagggactgggatacaactgcatccaactgatggcaattatggaacacgcctactacgcatcctttgggtaccagatcaccagcttcttcgccgcctcgtcgcgctacggtacgcctgaggaactgcaagagctcgtggataccgcgcactcaatgggcatcatcgtcctgctcgacgtggtgcattcccacgcgtcaaagaattccgccgacggactcaatatgtttgacggtactgatagttgttacttccattcaggaccgcgcggaacccacgatctctgggattcacggctcttcgcgtactcctcctgggaaattctgcgcttcctgctgtcgaacatccgctggtggctcgaagaatacagatttgatggattccgcttcgacggagtgacctccatgctgtatcaccaccatggcgttgggcagggcttctccggcgactactcggaatacttcggacttcaggttgatgaggatgctctgacttacctcatgttggccaaccatcttgtgcacactctgtgtccagactcgatcaccatcgctgaggatgtgagcggaatgccggcgctctgttcgccgattagccaaggaggagggggattcgactaccggcttgctatggccatacccgataagtggatccaactgctgaaggaattcaaggacgaggactggaatatgggggacattgtgtacactctgaccaaccgccggtacctcgagaaatgcatcgcctacgcggagtcccatgatcaagcactggtgggagataagtcgctcgcgttctggctgatggacgccgaaatgtacactaacatgagcgtcctgactccgttcacccccgttatcgatcggggaatccagctccataagatgatccggctcatcactcacggacttggaggggaaggatacctgaacttcatgggaaacgagttcggacaccccgagtggctggacttcccgcgcaagggaaacaatgagagttaccactacgcccgacggcaattccacctcaccgatgacgatctgcttcggtacaagtttctgaataactttgatcgcgacatgaacaggctggaagagcggtacgggtggctggcggcaccgcaggcttacgtgtctgagaaacatgagggaaacaaaatcatagccttcgagcgcgccggacttctctttatcttcaactttcacccgtcaaagtcgtacactgattaccgggtgggcacggccctgccaggaaagttcaagatcgtcctggactcggacgcagccgaatacggaggccaccagcggttggaccattccaccgatttcttctcggaagcgtttgagcataatggacgtccgtactcgctccttgtgtacatccccagcagggtggccctgatcctgcaaaacgtggacctgccgaac

SEQ ID NO: 12721 - DNA, 2106 bp, Artificial Sequence
  Description of Artificial Sequence: Synthetic coding sequence
atggcagctcctatgacccctgcagcccgtcccgaggattatgaggctgccctcaatgcagcgttggcagatgtgccagaattggcacggctgctggaaattgacccgtaccttaaaccatacgccgtggactttcaaagacgatacaagcaattttcccaaatcttgaagaatattggagagaacgaaggggggatagacaagttttcacggggttacgagtcctttggagtgcatcgctgcgcagacggaggcctgtactgtaaggaatgggcgcccggagcggaaggagtgttccttaccggtgatttcaacggctggaaccctttctcatacccgtacaaaaaactggattacgggaaatgggagttgtacattccacctaaacagaacaagtccgtgctggtgcctcatggatcgaaacttaaggtggttatcacctccaagtccggtgagatcctttacagaatctccccatgggcaaaatacgtggtcagagaaggagacaacgtcaactatgattggattcactgggatcctgaacatagctacgagtttaagcatagcagaccgaaaaaaccgcgaagcctgagaatttacgaaagccacgtggggatttcgagccatgaaggcaaagtggcatcgtacaaacatttcacctgtaatgtcttgccacggattaagggacttggttacaactgtattcagcttatggcaattatggagcacgcatactacgcgtcctttgggtatcagattacctcgttctttgcggcgtcgtcccgctacggaaccccagaagagctccaagagcttgtggataccgcgcattccatggggatcatcgttctgctcgatgtcgtccatagccatgcctccaaaaacagcgccgatggtctgaatatgtttgatggcacggacagctgctactttcatagcggaccccggggtacccacgatctttgggattcgagactctttgcctactcaagctgggaaatactccggtttctcctctccaacattaggtggtggctggaagagtaccgtttcgatggctttcgttttgatggagtgacttcgatgctttatcaccatcatggggtgggtcagggatttagcggcgactactcggagtacttcggacttcaggtcgatgaagatgccctgacgtaccttatgcttgcaaaccatctggtgcataccctctgcccggatagcattactattgccgaggatgtcagcggaatgcccgcactgtgctctcctatttcacaaggaggcggaggctttgattaccggcttgctatggcaattccggataagtggattcaactgcttaaggagtttaaggatgaagattggaacatgggggatattgtctacactcttactaatcggaggtacctggaaaaatgcatcgcttacgccgagtcgcatgatcaggcattggtgggtgacaagagccttgccttttggctgatggatgcagaaatgtacaccaacatgtcggtgttgaccccctttacccccgtgattgataggggcatacaactgcataagatgatcagactcatcacccacggactggggggcgagggttacctcaatttcatgggcaacgaattcggtcatcctgaatggctggattttccgagaaagggtaacaatgaatcctaccattacgccagacgccagtttcatctgactgacgatgatcttctgagatacaagtttttgaacaattttgacagagacatgaatcgcctcgaagaacgctacgggtggctggcagccccacaggcatacgtgtccgaaaagcacgagggcaacaagatcatcgccttcgaacgggctggactgcttttcatctttaactttcatcctagcaagagttacaccgactacagagtgggtaccgcactgcctggaaaattcaagattgtgctggactcggacgctgccgaatacggaggtcatcagagactggaccactcgacggactttttcagcgaagcattcgaacataatggaaggccttacagcctgctcgtgtacataccttcacgtgtggcactgattcttcaaaatgtggacctgcctaac

SEQ ID NO: 12722 - DNA, 2106 bp, Artificial Sequence
  Description of Artificial Sequence: Synthetic coding sequence
atggccgcccctatgacacctgcggctagacctgaggattacgaggccgcattaaatgccgcccttgcagatgtgcccgaacttgcccgcttgctcgaaattgatccatatttgaagccttacgcggttgattttcaaaggcgttataagcagtttagccagattctgaaaaacataggagaaaatgagggtggaatcgataagttttctcgtggctatgaaagtttcggggttcatcgttgtgccgatggtgggctttattgcaaggaatgggctcccggtgctgaaggggttttcctaaccggagacttcaacggatggaacccattcagctacccgtataaaaaactggattatgggaaatgggaactttacatccctccaaagcaaaacaagtcggtacttgttcctcatggatccaagctaaaggtagtaattacgtctaagtccggcgagatactataccgtatatcaccatgggcgaaatatgtagttagggagggagataatgtgaactatgattggattcattgggatcctgaacatagttacgagttcaaacatagcagaccaaagaagcctaggtcacttcgcatatacgaatctcacgttggtatctcctcccacgagggaaaagttgcttcctataagcacttcacctgtaatgttcttcctcgtataaaagggttaggatataattgtatccagctgatggcgatcatggagcacgcatactacgccagcttcggctatcagattacgtcattcttcgcagcttccagccgttatggaactcccgaggagctacaagaacttgttgacaccgcccactcaatgggtatcatcgtgctgttggacgttgttcattcacatgcatcaaagaactccgcagacgggctcaacatgtttgatggtacagattcctgttacttccatagcggtcctcgtgggacccatgatttatgggacagcagattatttgcttactcaagttgggaaatattgagatttctcctttcgaatatcagatggtggttggaagagtacagatttgatggcttcaggtttgatggggtgacctccatgctctatcaccatcatggcgtgggtcaggggttctcgggggattattcagagtatttcgggttacaagtggatgaggacgcccttacgtacttgatgctggccaaccatttagttcacactctatgcccagactctattacaatcgctgaggatgtgtcaggtatgccagcgctatgttccccgatttcacagggaggaggggggttcgactacaggctcgcgatggcaattccggataaatggattcaacttctgaaggaattcaaggacgaggactggaacatgggggatatagtttatactcttaccaatagacgatatcttgagaagtgtatcgcatacgctgagtcccatgaccaggcattggttggggacaagtcattggctttttggttgatggacgcagaaatgtacactaatatgagcgtgttgacaccttttacgcctgttatcgacagggggatccagctccataaaatgattaggcttataacacatggcttgggtggtgagggatacctgaatttcatgggtaacgagttcggtcaccctgaatggcttgatttcccgaggaagggtaacaacgaatcttaccattacgctaggagacagttccatctaaccgacgacgatctattgcgatacaagtttttgaacaactttgatcgtgatatgaacaggttagaggagaggtacggatggttagccgctccacaagcttacgtcagtgaaaagcacgaagggaacaaaattattgccttcgagcgtgccggccttttgtttattttcaacttccaccctagtaagtcgtatacggattacagagtcggaacagcactgccaggaaagttcaagatcgtattagactcagatgccgcagagtacggtggtcatcaaagactcgatcattccacggatttcttctccgaggcttttgagcataacggtagaccctactctttgctcgtttatatcccttccagggtggctttgattcttcagaatgttgacctgcctaat

SEQ ID NO: 12723 - DNA, 2106 bp, Artificial Sequence
  Description of Artificial Sequence: Synthetic coding sequence
atggcagcacctatgaccccagccgcacgtccagaagactacgaagctgcattgaatgctgccctggccgacgtgccggaactcgctagattgctggagatcgatccctatctaaagccttacgccgttgacttccagcggcgctacaagcagttttctcaaatactgaagaatatcggggaaaatgaggggggcatagacaaattcagtaggggttacgagtcctttggggtgcacaggtgtgcagacggtggcttgtactgtaaggaatgggccccgggcgcagagggagtgttccttacaggcgatttcaatggctggaacccgtttagttatccttacaagaaactggactacgggaagtgggagctctatatccctcccaagcagaataaaagcgtcctggttccccacggtagcaagctgaaggtcgtcattacttccaaaagtggggaaattctgtaccgtattagtccttgggccaaatacgtagtccgcgaaggggataacgttaattacgattggattcactgggatccagaacacagctatgagttcaagcacagtaggcctaagaagcctaggagtctgcggatctacgagtctcacgtcggcatatctagtcatgagggtaaagttgcatcatacaaacatttcacatgcaatgttttacccaggattaaaggtctcggctacaattgcatccagcttatggccataatggagcacgcctactatgcttccttcggctatcagattaccagctttttcgctgcttctagtcggtacggcactccagaggagttgcaagagttagtggacactgcacattctatgggcatcatcgtgctgttagacgtagtgcacagtcacgcatcgaagaattctgccgatggcctgaacatgttcgatggcacagatagctgttattttcactcgggaccccgcggcacccatgacctgtgggatagccgactttttgcgtacagtagctgggaaatactgagatttctcctatcaaacattcgatggtggctcgaggaataccgatttgacggtttcagatttgatggtgtcactagcatgctctatcaccaccatggagtcgggcagggcttctccggggattactccgaatactttgggctccaggtggatgaggacgcactaacttacctgatgctggctaaccatcttgtgcatacactgtgcccagactcaataactatcgccgaagacgttagtggcatgcccgctctgtgctcccccataagccagggaggtggagggtttgactacaggctggcgatggcaattcccgacaaatggattcagctgcttaaagagtttaaagacgaggattggaacatgggtgacatcgtgtatacactgaccaatcgaaggtacctggagaagtgtatcgcttacgcagaatctcatgaccaggccctagttggagataaatctctggctttctggctgatggacgccgaaatgtacacaaatatgagcgtgttaactccattcaccccagtgatagacagagggattcagcttcataaaatgatccgcttgattacacacggactgggcggcgagggctatctgaacttcatgggcaacgagtttgggcatcctgaatggctggacttccctcgtaaggggaataacgaatcctatcactacgctcgccggcagtttcacttgacagacgacgacttgctgcgttataagttccttaacaactttgatcgtgacatgaaccgtctggaagagcgctatggctggctggccgcgccacaagcttatgtgtcagaaaagcatgagggcaacaaaattatcgcgttcgaaagagccggcttactcttcattttcaactttcatccatcgaagagttatactgattatagagtgggaacagcattgccagggaaatttaagattgtactcgacagcgatgctgcagagtatggcggtcaccagcggctggaccattctacagatttcttttctgaagcttttgaacacaatggccgcccatactcactcctggtttatattccctcaagagttgccctcatactgcaaaatgtcgacctccctaat

SEQ ID NO: 12724 - DNA, 2106 bp, Artificial Sequence
  Description of Artificial Sequence: Synthetic coding sequence
atggcagccccgatgactccggccgcccgcccggaggactacgaggctgctcttaacgccgcactggcagatgtgcctgagctggcgaggctgctggagattgatccttacctgaaaccgtacgccgtcgacttccagagacgttacaagcagttttcccaaatcttgaagaatatcggagaaaatgagggtggaatcgacaagttctcgagaggatacgaatcatttggcgtgcaccgctgcgcagacggaggtctgtattgcaaagagtgggctccgggagcggagggggtgtttctcactggggacttcaacggttggaacccgttcagctacccgtataagaagctggactacggaaagtgggagctttacatccctccaaagcaaaacaagtcggtcctggtgccgcatgggtcaaagctcaaggtggtgatcacttcgaagtccggagaaatcctgtacagaatctccccctgggccaagtacgtggtccgggagggagataatgtgaactacgactggattcactgggatccggaacattcatatgagtttaaacactcacgcccgaagaaaccgcggtccctcaggatctacgaatcccacgtcgggatttctagccatgaagggaaggtcgcgtcgtacaagcattttacttgcaatgtgctgccgcgcatcaagggcctcggctataactgtatccagctgatggctatcatggagcacgcttactacgcctcgtttggataccagatcacttcgtttttcgcggcatccagcaggtacggaaccccggaggaacttcaggagcttgtggacactgctcattccatgggtatcatcgtcctcttggatgtggtccactcacacgcttcgaagaactcggcggacggcctgaacatgttcgacgggaccgactcatgttacttccattcgggcccgaggggcacccatgacttgtgggatagccgcctgttcgcctactcatcctgggaaattctgcgcttcctgttgtcgaacatcaggtggtggctcgaggagtacagatttgatggatttcggtttgacggcgtgacctctatgctgtaccaccaccatggcgtggggcagggtttcagcggtgattactccgagtacttcgggctccaagtggatgaggacgccctgacttacctcatgctggccaaccacctggtgcacactctgtgcccggactcaatcaccatcgccgaagatgtgtcgggcatgcctgccctgtgctcgccaatctcgcagggaggcggcggatttgattacagactcgcgatggcgatcccagacaagtggatccagctgctgaaggaattcaaggacgaggactggaatatgggagacattgtatacaccctgaccaacagaaggtacctggagaaatgcatcgcgtacgccgagtctcatgatcaggccctggtcggagacaaatcactcgccttttggctcatggatgccgagatgtataccaacatgtccgtgctcactcctttcacgccggttatcgacaggggaatccaactgcataagatgatcaggctgattacccatggactggggggcgagggttacctgaacttcatggggaacgaatttggacatccagaatggcttgatttcccccggaagggaaataacgagtcataccactacgcacggagacagttccacctcaccgacgacgatctcctgcgctacaaatttcttaacaatttcgacagggacatgaaccgcctcgaagagagatacggatggctcgcagcgccgcaagcgtacgtctccgaaaagcacgaagggaacaaaatcattgcttttgagcgggccggattgctgttcatcttcaacttccacccgtcaaaatcctacactgattaccgggtgggaactgcactgccgggcaaattcaagatcgttctggattcagatgcggctgagtacggaggacaccagcgcctcgaccactcaaccgatttcttctcagaagcgttcgagcataatggacgaccttattcattgcttgtgtacatccctagccgggtggcgctcatcctgcaaaacgtggacctgccgaat

SEQ ID NO: 12725 - DNA, 2106 bp, Artificial Sequence
  Description of Artificial Sequence: Synthetic coding sequence
atggccgcaccaatgacgcccgccgcacggcccgaagactacgaggctgccttgaacgcggcactggccgatgtgccagaacttgcccggcttttggagattgacccttacctcaagccgtatgccgtcgatttccagaggcggtacaaacagttttcacagattttgaagaatatcggagagaatgagggaggaattgacaagtttagccgcgggtacgaatcctttggcgtgcaccgctgcgccgacggcgggctatactgcaaggagtgggcgcctggagccgaaggagtgtttttaaccggcgactttaatggctggaatcccttctcatatccatataagaaactcgattatggtaagtgggaactgtacatcccccccaagcaaaataaaagtgtgctagtgccacacggctctaaactcaaggtggtgattacaagcaagtcaggcgaaatcctttacagaatcagcccatgggctaaatatgtggtaagggagggggacaacgtgaactatgactggatacattgggaccctgaacacagttatgaatttaagcattcgcggcctaaaaaaccccggtctttacggatttacgagtcgcacgtggggatcagctcccatgagggcaaagtggcctcgtataagcacttcacttgtaatgtcctgcctaggataaagggcctgggatacaattgtatccaactgatggctatcatggaacacgcctattatgcttccttcggctatcagatcacctcttttttcgctgccagctctcggtatggcacacctgaggaacttcaagaattggttgacactgcccatagcatggggattatcgtcctactcgacgtggtgcattcccatgcgtctaaaaactccgccgacgggctgaacatgttcgatggaaccgattcgtgttacttccatagcgggcctaggggaactcacgacctctgggactctaggctgttcgcgtattcttcttgggagatcctccgcttcttgctctcgaatatccggtggtggttagaggagtaccggttcgatggttttcggttcgacggggtcacttccatgctataccaccaccacggcgtcggccaagggttcagtggcgattactccgaatacttcgggcttcaagtcgatgaggatgccctgacgtatcttatgctggccaatcatcttgtgcatactctgtgccccgattccattactattgcagaagacgtctctggaatgcctgcactgtgttctcccatttcccagggcggaggtggtttcgactatcgactcgcaatggctatcccggacaagtggatacagctgctgaaagagtttaaggatgaggattggaacatgggagatatagtttacacactgactaatagaagatatctcgagaagtgtattgcgtacgccgaaagtcacgaccaggctctggtaggcgacaaatctctcgctttctggctcatggatgctgagatgtacacaaatatgtccgtactgactcctttcacaccagtgatcgacaggggcatccagttgcataagatgataagacttatcacgcatggtctaggcggcgaaggctatctgaacttcatggggaatgagtttggccaccccgagtggcttgacttcccaagaaaaggcaataacgaatcctaccattacgctcggcgacagttccacttaacggatgacgatctacttcgctacaaattcctgaataatttcgaccgcgacatgaataggctcgaggagcgatacggctggttagctgctcctcaagcttatgtgtctgagaaacacgagggaaacaaaatcatcgcgtttgagcgagccgggctcttgtttatctttaactttcatcccagtaagtcctacaccgattatcgcgttggaaccgccctgcctggcaaattcaaaattgtgctcgacagtgacgccgcggaatatggcgggcaccagaggctggaccactctaccgactttttctccgaggctttcgagcataacgggcggccatatagcctgctggtgtacataccaagcagagtagctctgatcctgcaaaatgtggacctccccaat

SEQ ID NO: 12726 - DNA, 2106 bp, Artificial Sequence
  Description of Artificial Sequence: Synthetic coding sequence
atggctgccccaatgacccccgcggctagacctgaggactatgaagccgctctcaacgccgctcttgccgacgtgccggagctggcgcgcctacttgagattgacccttacttgaagccttacgcggtggactttcagaggcgctacaagcagtttagccaaatcctcaaaaacattggcgaaaacgaaggcggcattgataagttctcccggggatatgagtccttcggagttcatcggtgtgccgatgggggcttatattgcaaagagtgggcaccaggagccgagggggttttcctcacgggagacttcaatggttggaacccttttagttatccatacaagaaattagattatggtaagtgggaactgtacataccacccaaacagaataagtcagtccttgtgccgcacgggagcaagctgaaagtcgtgattacttctaagagtggcgagattctgtatagaatttccccatgggcgaagtatgttgtgagggagggggataacgtgaattatgactggatacattgggaccctgagcattcctacgagttcaaacacagcagaccaaagaagccccgctcgctgaggatctacgaaagccatgtagggatcagtagccacgaggggaaagtggcctcctacaagcacttcacctgtaatgtgctgccccggataaagggactcggatacaactgtatccaactgatggcaataatggaacatgcctactacgccagcttcggttatcagattactagtttttttgctgcctcttcacgctacggaacgcctgaagaactgcaggagctcgtagacactgcacactctatgggcatcatcgtgctgctggacgtagtacatagtcacgcttccaagaacagcgccgatggactgaacatgtttgatggcacggattcctgctacttccactccggtcctcggggcacacacgacctgtgggattcaagactgttcgcatacagttcgtgggagatactgagatttctgctgagcaatatccgttggtggcttgaggagtaccgtttcgatgggtttaggttcgacggggtcaccagtatgctttatcatcatcacggggtgggtcagggcttttccggcgattactctgagtacttcggactgcaggttgacgaggatgctctgacttatctcatgctggctaatcatcttgtgcacaccctgtgccccgattccatcacgatagcagaggatgtgtctggaatgccagcactttgtagcccaatctcgcaaggaggtggcgggttcgattaccggctggctatggctataccggataagtggattcaacttctcaaagagtttaaagatgaggactggaacatgggagacattgtgtataccctgactaatcggagatatttagagaagtgtatcgcatatgccgagtcgcatgaccaggctcttgtgggggacaaatcgctggccttttggctaatggatgctgagatgtacactaacatgtccgtgctcaccccgtttaccccagtgatagatcgaggtatacagctgcacaagatgatcagactaatcacccatggcttagggggagaaggatacctcaacttcatgggaaacgagttcgggcatcccgaatggctcgacttccccaggaaaggaaataatgaaagctaccactatgctagacgacagttccacctcaccgatgatgaccttcttcgctacaaattcctgaacaactttgaccgtgacatgaaccgcctcgaagagcgctatgggtggctcgcggctcctcaggcatatgtttctgagaagcatgagggcaacaaaattattgctttcgagcgtgcaggacttctgtttatttttaatttccatccttcaaagtcttacaccgactatcgggttggaaccgctctcccaggaaagtttaagatagtccttgactctgacgctgctgaatacggaggtcatcagaggctggaccactctactgactttttttccgaagccttcgagcacaacggtcgaccgtactcactcttagtgtacatccctagtagagttgccctgatattgcaaaacgttgatctgccgaac

SEQ ID NO: 12727 - DNA, 2106 bp, Artificial Sequence
  Description of Artificial Sequence: Synthetic coding sequence
atggcagcgcctatgacgccagcagcaaggcctgaagattacgaagcagcactgaacgcggcgctggctgacgtgcccgagctggcacggcttttggaaatcgatccttacctgaaaccctacgctgtggattttcagagaagatacaagcagttctcccaaatcctgaagaacataggagaaaatgaaggcggcattgataagttctcaagaggatacgaatcgtttggagtgcatcgctgtgcagacggtgggctttactgtaaggaatgggcaccaggcgcagaaggtgtgttcctcaccggagatttcaatgggtggaaccccttctcctacccctacaagaaacttgactacggcaaatgggaactctacatcccaccaaagcagaataagtcagtgcttgtgccacacgggagcaagttgaaggtggtcattactagcaagtctggcgaaatcttgtaccgcatctccccttgggcaaagtacgtggtgagagaaggtgataacgtgaactacgattggattcattgggaccccgaacattcctacgaattcaaacatagcaggcctaagaagccacgatcactgcggatatacgaaagccacgtgggcatttcctcccacgaaggaaaggtcgcatcatacaagcatttcacctgtaatgtccttcctagaattaagggactcggatacaactgtattcagctgatggccattatggaacacgcatattacgctagctttggataccaaattacctccttcttcgccgcttcctcccgctacgggacccccgaagaactgcaagagctggtggacaccgcccactcgatgggtattatcgttcttttggacgtggtgcacagccatgcatccaagaactctgcagatggactgaacatgtttgatggaaccgactcctgttacttccattcgggtccaagggggacccacgatctgtgggactcgcgtctttttgcgtactcgtcgtgggaaatcctgcgattcctcctgtccaacatcaggtggtggctcgaggagtacaggtttgatggcttcaggttcgatggtgtcacctcgatgctctaccatcaccacggagtgggacagggattcagcggagattactcggagtactttggattgcaagtggatgaggacgcccttacctacctgatgcttgctaaccatcttgtgcataccctttgcccagattccatcaccattgcagaggacgtctcaggaatgcctgcactttgttcgccaatcagccaaggtggagggggttttgactaccggctcgcaatggctatacccgataaatggattcaactgctcaaagagtttaaggatgaggattggaacatgggagatattgtgtacaccctgaccaacaggcggtatcttgagaagtgtattgcatacgcagaatcccacgatcaagcgctcgtgggtgataagtcgcttgcattttggcttatggatgcagaaatgtacactaacatgtcggtgcttactccttttaccccggtcattgacaggggcatacagctgcacaagatgattcgccttattactcatgggctcgggggtgagggctaccttaactttatgggaaacgaatttggccatccagagtggctcgacttccctagaaagggcaataatgaatcctaccactatgcaaggcgacagttccatcttactgatgatgatttgcttcggtacaagttcctcaataactttgatcgtgatatgaataggttggaagaacgatatggttggctggcagcaccgcaagcatacgtgagcgagaaacatgaggggaacaagattattgccttcgaaagggcaggtctgctgtttatcttcaattttcacccttcgaaatcttacaccgactacagagtcggaactgcactgcccggaaagttcaagattgtcctcgattccgatgccgcagaatacgggggacatcagcggctggaccattccactgacttcttttcagaggcatttgaacataacggacgtccttactccctgcttgtctacatccctagcagagtggcccttatactgcagaatgtggacctgcctaac

SEQ ID NO: 12728 - DNA, 2106 bp, Artificial Sequence
  Description of Artificial Sequence: Synthetic coding sequence
atggcggctcctatgacacccgcagctcggccagaggattacgaggccgcactgaatgccgcccttgccgatgtgccagaactggctcggctgctggagatagacccctacctgaagccttacgccgtggattttcagaggaggtacaagcagttcagccagattctaaaaaacatcggcgagaatgagggcggcattgataaatttagcagaggctacgaaagctttggtgtgcatcgctgcgccgatgggggtctgtactgtaaagagtgggcaccgggggctgagggcgtttttctgaccggcgattttaatggatggaacccctttagttacccttacaaaaagttggattatggaaagtgggagctgtacatcccacccaagcagaataagtccgtactagtcccccacggatccaagctgaaggttgtgatcacaagtaaaagtggagagatcctttacaggattagtccgtgggctaaatatgtggtacgtgaaggggacaatgtgaactacgattggatccactgggacccagagcactcatatgagtttaagcattcccgtcccaagaagccccgaagcttgagaatctacgagagccacgttgggatttcttcgcatgaaggcaaggttgcaagttacaagcactttacctgcaacgtgttaccccggattaaaggtctgggatacaactgcatacagctcatggctatcatggagcacgcgtactacgcgtcatttggctaccaaataacttctttctttgcagcatcctcgcggtatggcacacccgaggagctgcaggaactagtggacactgcccatagcatgggcatcatagtccttctggatgtggttcactcacacgcatcgaagaatagcgcagatgggctgaatatgttcgatgggacagactcatgttacttccattccggcccccgcggaactcacgatctgtgggattccaggctgttcgcctactcttcttgggagatcttacgattcctgctgtctaatatccgctggtggctggaagagtaccggttcgatggcttcaggtttgacggcgtcaccagcatgctgtaccatcatcacggggtaggccaggggttctccggggattattcagaatattttggacttcaggtcgacgaagatgccctgacttatctgatgcttgcaaatcaccttgtgcacacattgtgccccgatagcatcaccatcgctgaggatgtgtccggaatgcccgcgttgtgcagccccatctcacaggggggaggcggctttgattatagactggcaatggcgatccctgacaagtggatccagttgctgaaggagtttaaagacgaggattggaacatgggggatatcgtatataccctgaccaaccggagatacctggagaagtgcattgcatatgctgaaagccatgaccaagcactcgtgggggacaagtcacttgctttctggctgatggacgctgagatgtacactaacatgtctgttctgacccctttcactcctgtgatcgacagaggcatacagctgcataagatgatccggttaattactcacggcctcggaggcgagggctatttgaactttatgggcaatgagttcggacacccggagtggctcgactttccaaggaaaggaaataacgaatcataccactatgctcgtaggcaatttcatctgacggacgatgatctcctgagatacaaatttctcaacaatttcgatcgggacatgaacagactcgaagagcggtacggctggctggccgcaccacaggcgtatgtcagcgagaaacatgaaggcaacaaaattatcgcatttgagcgagctggtctcctgtttatatttaatttccatccgtctaaatcttacactgactaccgtgtgggtactgccctgcccggcaagtttaagatcgtgttggatagcgatgccgccgaatatggcggtcatcaaaggttagatcatagcactgatttcttctctgaggcatttgagcacaacggccgcccctatagcctcttggtatacatcccgtctcgcgttgcattgatcctgcagaacgtcgatctgcctaat

SEQ ID NO: 12729 - DNA, 2106 bp, Artificial Sequence
  Description of Artificial Sequence: Synthetic coding sequence
atggcggcacccatgaccccggccgcccggcctgaggattatgaggctgcgttgaacgctgctctggccgatgtgccagaattggccagactcctggagattgatccatatctaaagccctatgccgtcgactttcaacgcagatacaagcagttttcgcagattctcaaaaatatcggggagaatgaaggcggtattgacaaattctcaagaggctacgagagctttggcgtgcatcgttgtgccgacggcggcttgtactgcaaagagtgggcgcccggcgctgagggcgtatttctgactggggatttcaatggttggaacccatttagttacccctataaaaaactcgattacggcaaatgggagctatacattcctcctaagcaaaacaaaagtgtcctggtgccccacggatctaagttgaaagtggtgattacgtctaagtctggagaaatcctatacagaattagcccttgggctaaatacgttgtgcgggaaggagacaacgtcaattacgactggatccactgggatccagaacatagttacgagttcaaacactcccgcccaaagaagccgcgttctctaagaatctatgagtcccacgtcgggatttcctctcatgaagggaaggtcgctagttacaaacattttacctgtaacgtgctcccccggatcaagggacttggatacaattgcattcagctgatggccattatggagcacgcctattacgcatcattcggttaccagatcactagtttcttcgccgcttccagcaggtacggcacgccagaggagctccaagaactcgttgacacggcccattctatgggcatcattgtactgctcgacgtggtgcatagtcacgctagtaagaattccgcagacggcctgaatatgtttgacgggaccgattcctgttactttcattcgggaccccgcggaacccatgatctgtgggactctcgcctctttgcatatagctcatgggagatattgagatttctcttatctaatatccggtggtggctagaagaatatagattcgacggtttcaggttcgacggggttacctctatgctttaccaccatcatggcgtgggacaaggcttctccggtgattactctgagtacttcgggttgcaggtggacgaagatgccctgacctacctgatgctcgcgaatcacctagtgcacacactatgccctgactcaatcacaatcgctgaggacgtctctggaatgcctgccctgtgctcacctatcagccaagggggagggggctttgattatcgcttggctatggctattcctgacaaatggattcagctgctgaaagagtttaaagacgaagattggaatatgggggacatcgtgtatacgctaacaaatagacgatatctggagaagtgtattgcgtacgcagagtcacatgatcaggcactcgtaggggataagtcactagcattctggctgatggacgcagagatgtatacaaatatgagcgtactgaccccttttactcccgtaatagatcggggcattcagctacacaagatgatacggctgataactcacggtttgggcggcgagggctatctcaatttcatgggaaatgaattcgggcaccccgaatggcttgatttcccaaggaagggaaacaacgaatcatatcactacgcacgccggcaattccacctcaccgatgatgatttgctgcgctacaagttcttgaacaatttcgacagggatatgaatcggcttgaggagagatatggctggctcgcagcacctcaagcctacgtctctgagaaacatgaggggaacaagattatcgcgttcgagagggccgggctcttgttcatttttaacttccacccttctaaatcttatacagattacagggtggggacagctctgcccggcaagttcaagattgtgttggacagtgatgctgctgagtatggaggtcatcagcgcctggaccattccacagacttcttttccgaggcctttgagcataacggccgcccttactcattacttgtgtatattccatccagggttgccttgatactgcagaatgtggaccttcccaac

SEQ ID NO: 12730 - DNA, 2106 bp, Artificial Sequence
  Description of Artificial Sequence: Synthetic coding sequence
atggcagctccaatgactcctgctgcacgaccagaagattacgaggctgccctgaacgctgcactggccgatgtcccagaacttgcccggctcctggagatcgacccataccttaagccctacgcggttgactttcagaggcgctacaagcaattttctcagatcctgaaaaatattggtgaaaacgaaggaggaatcgacaaattctcccgggggtacgagagcttcggtgtgcatcgatgtgccgatggaggtctgtattgtaaggaatgggcgcctggggctgagggtgtcttcctgacgggggattttaacggttggaacccgttctcctatccatataagaaactggactatggaaaatgggagctctacataccaccgaagcagaacaaatctgtgcttgtccctcatggtagcaagcttaaggtggtaattactagtaagtccggggaaatactgtaccgcatctccccttgggccaaatatgtcgtcagagagggagacaacgtgaattacgattggattcactgggacccagaacactcatacgagtttaagcatagtcggccgaaaaagcccagatcactgaggatctacgaatcccacgtggggatcagttcacacgagggcaaggtggcatcatacaagcatttcacctgcaatgtactgccccggatcaagggtctggggtacaactgcattcagctgatggcaattatggagcacgcgtattacgcttctttcggataccagatcacctctttttttgccgcctcctctaggtacgggactcccgaggaactgcaagagctcgtggacactgcacactcaatgggaatcatagtattgctggacgtagtgcatagtcatgcttcaaaaaactcagcggatggactcaacatgttcgacggaaccgattcatgttactttcacagcggcccccgcggcacacacgatttgtgggattcccggctcttcgcctacagcagctgggagatcctgcgctttctgctgtccaatattaggtggtggctggaggagtataggtttgatgggttccggttcgacggtgtaacttccatgctgtaccaccatcatggggtcggacaagggttctcaggggattactctgaatattttggactccaagttgatgaagatgccctgacctatctgatgctggctaatcatctggtgcacacactgtgtccagacagcatcacgatagctgaggacgtctctgggatgcctgcgctctgctccccaatctcacagggcggagggggcttcgattaccggctggccatggcaatacccgacaaatggattcagctcctgaaagagttcaaagacgaggactggaacatgggcgatatcgtatacacactgaccaaccgccggtatcttgagaagtgtattgcgtacgctgagagtcacgatcaggccctggtgggggacaagagcctggcattttggctcatggacgctgagatgtacaccaatatgtccgtactgaccccttttacacccgttatagatcgcggtattcagctgcacaaaatgataaggctgatcacgcacggcctggggggggagggctacttgaacttcatgggcaacgagttcggccaccctgaatggctggatttccctcggaagggaaacaatgagagctaccactacgcaagacgccagttccatctcaccgatgacgacctgctgaggtataaattcctcaacaatttcgatcgcgatatgaacaggctcgaggagaggtacgggtggctcgctgctccccaagcttatgttagtgagaaacacgagggaaataagattattgcatttgaacgggctggcttgctgttcattttcaattttcaccctagtaagtcttacaccgactaccgcgtgggaactgcccttccgggcaagttcaaaattgttctcgattcagacgctgccgaatacggcggacatcagcggctggatcattctaccgattttttcagcgaggcttttgaacacaacggacgcccctatagcctgctcgtctacatcccgtcccgagtggctttgattttgcaaaacgtggatctgcctaac

SEQ ID NO: 12731 - DNA, 2106 bp, Artificial Sequence
  Description of Artificial Sequence: Synthetic coding sequence
atggccgcacccatgaccccagcagctcgtccagaggattacgaggcagccttgaacgcagcattggctgatgtgcctgaactggccaggcttctggaaatcgacccctatctcaagccatatgccgttgattttcaacgcagatataagcaattttctcagatcctgaagaacatcggcgagaatgaaggaggtatcgataagttttcacgcggatacgagagcttcggcgtccataggtgtgctgacggcggcctgtactgtaaagaatgggcccctggagcagagggtgtgttcttgaccggtgacttcaacggttggaatcctttttcatacccatacaagaagctcgattacggtaaatgggagctgtacatcccccctaagcagaataagagtgtgctggtgcctcacggatctaagcttaaggtcgtgatcaccagtaaatccggcgagattctctatcgcatttccccctgggccaagtacgtcgttagagagggagataacgtaaattacgattggattcactgggatcccgaacattcttatgaattcaagcactcaagaccaaagaagccccgctctctccgtatttacgaaagtcatgtaggtataagtagtcacgagggaaaggtggcctcctacaagcatttcacctgtaatgtccttcctaggatcaagggtctgggatacaactgtattcagttgatggctatcatggaacacgcatattacgcctctttcggctaccagatcacaagcttttttgccgcctcctccaggtacggcacccctgaagagttgcaggagcttgtcgacactgcacacagtatgggcattattgtcttgctcgacgttgtgcatagccacgcatctaaaaactcagccgacggacttaacatgtttgacggtaccgactcttgctatttccacagtggtccccgtggtacccacgacctgtgggactcacgtctctttgcttattccagttgggagatcctcaggttcctgttgtcaaatataagatggtggctcgaagaatatagatttgatggtttcaggttcgacggcgttactagtatgttgtatcatcaccatggagtcggacagggattctccggtgactatagcgaatattttggtttgcaggtcgacgaagatgctctgacttacttgatgctcgctaatcaccttgttcacaccctctgtcccgactcaatcacaattgcagaagatgtttccggtatgcctgcactctgtagtcccatctctcagggcggaggcggattcgactacaggttggccatggcaatccccgataagtggattcagctcctcaaggaattcaaggacgaggactggaatatgggcgacatagtatacactctgacaaaccgcaggtatctggagaagtgtatagcatatgcagagtcacatgaccaggcactggtgggcgacaaatccctggccttttggctgatggacgctgagatgtacacaaatatgtccgtgctgaccccatttacaccagtcattgacaggggtattcagctgcataaaatgattcgtttgattactcacggcttgggaggtgagggttaccttaacttcatgggtaacgaattcggacatccagaatggctggacttcccccgtaaaggcaataacgagagctaccattatgccaggcgtcaatttcacctgaccgatgacgatttgctgcgttataagttcctgaacaactttgatcgcgatatgaacaggttggaagaaaggtatggttggttggcagctccacaggcttacgtctctgaaaagcacgaaggcaataaaatcatcgcattcgagagggcaggactcttgttcatcttcaatttccacccaagtaagtcatataccgactatcgtgttggaactgcattgcctggcaaattcaaaatcgtgctggatagcgatgctgccgaatacggaggccatcaacgtttggatcacagtacagatttcttctctgaagcctttgaacataacggcaggccatacagtttgcttgtgtacatccccagtagggtggctctgatcctgcagaacgtggacctgccaaat

SEQ ID NO: 12732 - DNA, 2106 bp, Artificial Sequence
  Description of Artificial Sequence: Synthetic coding sequence
atggcagcccccatgacgccagccgcccgcccggaggattacgaggccgctttaaacgcggctcttgctgatgtcccagagctggccagactgctcgaaatagatccatatcttaagccatacgcagttgacttccagaggagatacaagcagttcagtcagatcttgaaaaatattggggagaacgagggcggcatcgataagttttcccgaggatatgagagctttggcgtccaccgttgtgctgacggcgggctgtactgcaaggaatgggcaccgggagccgaaggggtgtttctgaccggagatttcaacggctggaacccgttctcatacccctacaaaaagttagactacgggaagtgggagctatatattccgcctaagcaaaacaagagcgtgttagtgccccacggcagcaaattgaaagtggtgatcacatcaaagagcggagagatcctttacagaatctcaccgtgggccaagtatgtcgtgcgggagggcgataacgtaaattatgactggattcactgggaccccgaacacagctacgagttcaaacatagccgtcctaagaaacccaggtctctgcggatttacgagagtcatgtgggaatttcttctcacgaaggcaaagtggcttcctacaagcatttcacgtgcaatgttctgccacgaattaagggcttgggctacaattgtatccagttaatggccatcatggagcatgcgtattatgcttctttcggctaccagattacctctttctttgcggcatcctccaggtatgggactcctgaggagctacaagagctcgtagataccgcccactccatgggcattatagtgctgctggacgttgtgcattcacatgcatccaaaaatagcgcagatggactaaacatgtttgacggaaccgacagttgctactttcactctggcccaaggggaacccatgatctctgggattcccgactgtttgcttatagtagttgggaaatcctgaggttcctattgagtaatatcagatggtggcttgaggagtatcgctttgatgggtttcggtttgacggagttacttctatgctctaccatcaccacggcgtgggccaaggattctccggtgattactccgagtacttcggcctacaggtggacgaggacgctctgacatacctcatgttagctaaccatttggtccacacactctgtcctgattctatcaccatagcagaggacgtctctggtatgccagctctgtgtagccccatcagccagggaggcggtggcttcgactacaggctggccatggccataccagacaaatggattcaactgctgaaggaattcaaggatgaagactggaacatgggagatatcgtgtatacactgaccaataggcgttatctcgagaaatgcatagcatatgcggagtctcacgaccaggcgctagtgggggacaagtcccttgcattctggctgatggacgcagagatgtatactaacatgagcgtactgacaccttttaccccagtcatcgacagggggattcagctgcataagatgatcagattaatcactcacggcttaggaggagaaggatatctcaatttcatgggcaatgaatttggacaccccgagtggcttgacttccctcggaagggaaataacgagtcttaccattatgccaggaggcaattccacctcacagatgatgatctgttgcgttacaagttcctgaataatttcgaccgagatatgaaccgcctggaagagagatatggctggctggcggctccccaggcatacgtctccgagaagcacgagggtaataaaataattgcatttgagcgcgccggcctactgtttatcttcaacttccacccatctaaatcatataccgattatcgggtcggaacagccctccctggcaaattcaagatagtcctggactcggacgcagcggagtatggcggtcaccagagactggaccactcgacagatttcttctccgaagcctttgagcataacggtcgcccctattctctgttggtgtacattccaagtcgagtcgccctaattttacaaaatgtggatctacccaat

SEQ ID NO: 12733 - DNA, 2106 bp, Artificial Sequence
  Description of Artificial Sequence: Synthetic coding sequence
atggccgccccaatgacacccgctgcccggcctgaggattatgaggcagctctgaacgctgccctggccgatgtgcctgaacttgcccgcctactggaaatcgatccttatctgaaaccttatgccgtggatttccagcgtagatacaagcaattctcccagattctgaagaatataggcgagaacgagggcggcatcgacaagttctccagaggatacgaaagtttcggggtccatagatgtgccgatggcggcctgtactgtaaggaatgggcacctggcgcagaaggggtgttcctgactggcgactttaatggatggaaccccttctcttatccctacaagaaactcgactatgggaagtgggagctgtacatccccccaaagcaaaacaagagtgtcctggttccacatggaagcaaactgaaggtcgtgataacatcaaaatcaggcgaaattctttaccgaatcagcccctgggccaaatatgtcgtccgcgaaggggacaacgtcaactacgattggattcattgggaccctgagcacagctacgaattcaagcatagcaggcctaaaaagccacggagtctgaggatctacgaatctcacgttggcatctcaagccacgagggcaaggtcgcctcctacaaacattttacttgcaatgtccttcctcgaataaaaggtctcggctataactgcattcagttaatggcaatcatggagcatgcatactacgcctcattcgggtaccaaataaccagcttcttcgcagctagtagccgatatggaacacccgaggaattacaggaactggtcgacactgcccattcaatgggcatcatagtgctgctggatgttgtccattcccacgccagtaagaacagtgctgatggcctgaacatgtttgacggcaccgattcttgttactttcactccgggccacggggcacacatgacttgtgggattctcgcctttttgcttattcctcttgggagatcctgcggtttctgttatccaatattaggtggtggttagaggagtaccgctttgacggcttccggtttgatggcgtgacttccatgctgtatcaccaccacggggtgggccagggctttagcggggactacagtgagtatttcggcctgcaagtggacgaagatgctctgacctacctgatgctggctaaccatctggtgcacaccctctgcccagactctataactattgctgaggacgtttctgggatgcctgccctctgctccccaatctcccaaggtggcggtggctttgattatcggcttgccatggcaataccagataagtggattcagctgttaaaagaattcaaagatgaggactggaacatgggcgatattgtgtacacactgaccaacagacgctacctggaaaaatgtatcgcttacgccgagtcccacgaccaggctctggtgggtgacaagtccctcgcattctggttaatggacgctgaaatgtatactaacatgtctgtgctcaccccctttacccccgttatagacagaggcatccagctgcacaagatgatcagactgattacacatgggctggggggtgagggctatctcaattttatgggcaatgagttcggacacccagagtggttagacttccctcggaaagggaacaacgagtcctaccattatgcccgccgccagttccacctgacagacgatgatctattacgctataaatttctaaataactttgatcgggacatgaaccggctcgaggagcggtacggctggctcgccgcccctcaggcctacgtttccgaaaagcacgaagggaataaaattattgccttcgagagggcaggcctgcttttcattttcaatttccacccctccaagagctacacagactatcgggttgggactgccctgccaggcaagttcaagatcgtcctagatagcgacgctgccgagtacggggggcatcaacggctggaccacagcaccgactttttcagcgaagcctttgagcacaacggcaggccttattccctcctggtgtatattccctcccgggtggcactcatcctgcagaatgtcgatctgcccaac

SEQ ID NO: 12734 - DNA, 2106 bp, Artificial Sequence
  Description of Artificial Sequence: Synthetic coding sequence
atggcagcgccgatgacccctgcagccaggccagaggactatgaggccgcactgaatgccgccctggccgacgtgcctgaacttgcccggttgctggaaatcgacccctatctcaagccgtacgccgtggattttcaacggcgctacaagcaattcagccagatcctcaagaatatcggagagaacgagggagggatcgacaagttttcacgcggttacgagtcgttcggcgtccacagatgcgcggacggcggactgtactgcaaagaatgggctcctggagcagaaggggtctttctgactggggacttcaacgggtggaatccgttctcatacccatacaagaagctggattacggaaaatgggaactctacatcccacccaagcaaaacaaatcagtgctcgtgccacacggatccaagctcaaagtcgtgattacctctaaatcgggagagatcctgtaccgcatctccccgtgggcgaagtacgtggtgagggaaggcgacaatgtcaactatgactggattcactgggacccagagcactcgtatgagtttaagcactcgcgcccgaagaagcccaggtcattgagaatctatgagtcacacgtgggtatctcctcgcatgaaggcaaggtcgcatcttacaagcatttcacttgcaatgtgttgccccggattaagggactggggtacaattgcatccagcttatggcgatcatggaacatgcttactacgcctcattcggttaccagattacctcgttcttcgcggcaagcagcaggtacggaactccggaagaactgcaggaacttgtggacaccgcccactcaatgggaatcatagtgctgctggacgtggtgcactcgcacgcgtccaagaattcggctgatggattgaatatgtttgacggaactgatagctgctacttccactcaggcccgcggggaacccacgatctgtgggactcgcggttgttcgcctactcatcttgggagattctccggtttctgttgtcgaacattcggtggtggctggaggagtaccggttcgacggatttcggtttgacggggtgactagcatgctctaccatcaccacggcgtcggacagggcttctccggagattattccgaatacttcggattgcaagttgacgaagatgccctgacctacctgatgctggctaaccatctggtgcacaccctgtgtccagatagcatcaccatcgccgaagatgtgtccggaatgccggccctctgctccccaatctcacaaggtgggggcggattcgattaccgcctggcaatggcgatcccggataagtggatccagcttttgaaggagttcaaagacgaagattggaatatgggagacatcgtgtacaccctcactaacagaaggtaccttgagaagtgtatcgcttacgccgagtcacacgatcaagcccttgtgggtgacaaatccctggcgttctggttgatggacgcggagatgtacaccaacatgtccgtgctcaccccgttcactcccgtgatcgaccgcggtattcagctccacaagatgattaggctgatcactcatggacttgggggagaaggatacctgaatttcatgggcaacgaattcggccacccagagtggctggacttcccgcggaagggaaacaacgaatcttatcactacgccagacgccagttccacctcactgacgacgatttgctgagatacaagtttctgaacaactttgatcgggatatgaaccgcctcgaagagcggtacggatggctggcggcgccacaggcttacgtcagcgaaaaacacgaaggaaacaaaatcattgccttcgagcgggcgggactcctgttcatctttaacttccacccatcaaaatcgtacaccgattaccgcgtcggaaccgcactccctggcaaattcaagatcgtccttgattccgacgccgcagagtacggtggacaccagagactcgatcattcgaccgactttttctcagaagcattcgaacacaacggacgcccttactcgctgctggtgtacatcccaagccgagttgccctgatccttcaaaatgttgacctgcccaac

SEQ ID NO: 12735 - DNA, 2106 bp, Artificial Sequence
  Description of Artificial Sequence: Synthetic coding sequence
atggccgctccaatgaccccggcggccagaccggaggattacgaggccgcactcaacgccgcgctcgcggacgtgcctgaactggcccgcctgctggaaatcgatccgtacctgaagccgtacgccgtggattttcagcggcgctacaagcagttctcgcaaatcctgaagaacatcggcgagaacgaaggtgggatcgacaagttctccagaggatatgagagtttcggagtgcataggtgcgccgatggcggcctgtactgcaaggaatgggcccccggggcggaaggtgtgtttctcacgggcgactttaacgggtggaatcctttctcatacccgtacaaaaagctggactacggtaaatgggaactgtacattccgcctaagcagaacaagtcagtgctggtgccgcacggatccaagctcaaggtcgtgatcacttccaaatccggggaaatcctgtaccgcatctccccgtgggcgaagtacgttgtccgcgagggtgataatgtcaattacgactggatccactgggatcctgagcatagctacgaattcaaacactcgcgaccaaaaaagccgagatcgcttcgcatttacgaatcacacgtcggcatctcgtcacacgaaggaaaggtggcctcgtacaaacattttacgtgcaatgtcctcccaagaatcaagggactgggatacaactgcatccagctcatggccattatggaacatgcgtactacgcctcgtttggataccagatcaccagcttcttcgcggcatcgtcgagatacgggaccccggaggaactccaggaacttgtggacactgcgcattcaatgggaatcatcgtactgctcgacgtggtgcattcccatgcctctaaaaacagcgccgacggcctcaacatgttcgacggaacggactcctgttactttcattcaggaccgaggggtacccatgacctctgggatagccgcctcttcgcatacagcagctgggagattctgcgattcctgttgtcaaatatccggtggtggctggaagagtaccggttcgacgggttccggtttgatggcgtgacttccatgctctaccaccaccacggagtgggacaaggcttcagcggtgactacagcgaatacttcggactgcaagtggacgaggatgctttgacttatctgatgctggctaatcacctggtgcatactctttgtcccgacagcataactatcgccgaggacgtctcgggaatgccggctctctgctcccctatttcgcagggcggcggaggattcgactacagactggctatggcgatccctgataaatggatccaactgctgaaggagttcaaggatgaggactggaacatgggagatatcgtgtacactcttactaacaggcggtacctcgaaaagtgcatcgcatacgcagaaagccacgaccaagcactcgtgggcgataagtccctggccttttggctgatggatgcagaaatgtataccaatatgtcggttctgaccccgttcaccccagtgattgacaggggaatccagctgcataagatgatccgcttgatcacccacgggttgggaggagagggatacctcaacttcatgggaaacgagtttggacatcctgaatggctggattttcccagaaaaggcaataatgaatcgtaccactacgcgcggcggcaattccacctgaccgacgatgacctccttcgctataagttcttgaacaacttcgatcgcgacatgaaccgcctcgaagagcggtacggatggcttgcggccccacaggcttacgtctcagagaagcacgaaggcaacaaaatcatcgcattcgaacgggcaggactgctgttcatcttcaacttccacccaagcaagtcgtacaccgactaccgcgtcggcaccgcacttcccggaaagttcaaaattgtcctcgactccgacgctgccgaatatggagggcaccagcgcctggatcactctactgacttcttctccgaggcttttgagcacaatggtcgtccatactccctgttggtctacatcccatcacgggtggccctgatcctgcagaatgtggacttgccgaac

SEQ ID NO: 12736 - DNA, 2106 bp, Artificial Sequence
  Description of Artificial Sequence: Synthetic coding sequence
atggcagccccgatgactcccgccgcccggccggaggactacgaagctgcgcttaacgccgccctggcagacgtgcctgagctcgcgcgcctcttggagatcgatccatacttgaagccttatgctgtggacttccaacgtcggtacaagcagttctcgcagatcctgaagaatatcggagaaaacgaaggaggcatagataagttttcccgcggctacgaatcgtttggggtgcaccgctgtgcggatggtggattgtactgcaaggaatgggcccccggtgcggagggcgtgtttctgactggtgactttaatggctggaacccattcagctacccgtacaagaagttggactatggcaaatgggagctgtacatcccgccgaagcaaaacaagagcgtgctggtcccacacggcagtaaactcaaagtggtgattacgtccaaatcaggagagatcctctaccgcatcagcccgtgggccaagtacgtggtgcgagaaggtgataatgtcaattatgactggatccattgggacccggaacattcgtatgagttcaaacattcgcggcctaagaaacctcgctccctccggatctacgagtcgcacgtcggaatcagctctcatgaaggaaaggtggcgtcctataagcatttcacctgcaacgtgctccctagaattaaggggctcgggtacaactgcatccagctcatggccattatggaacacgcctactacgcatccttcggttaccagatcacctcctttttcgccgcgagctcgaggtatggaaccccggaggaacttcaggaactggtggataccgcccactcaatgggaatcatagttctgctggatgtagtccactctcatgcctccaaaaactctgccgacggactgaacatgtttgatggcactgattcctgctacttccattcaggacctcgcggtacccacgacctgtgggactcaaggttgttcgcatactcgtcgtgggagatcctgcgcttcctgctgtcaaatatccggtggtggctggaagaataccgtttcgatggttttagatttgacggagtgacttccatgctctaccatcaccatggagtgggacaagggttttcaggcgactacagcgagtacttcggacttcaggtggatgaggacgcccttacgtatctcatgctcgcaaatcacctcgtgcacaccctgtgtccggattcgatcactatcgctgaagatgtttcaggaatgccagctctctgcagcccgatctctcagggaggaggaggtttcgactaccggctcgcgatggccatacccgataaatggattcaactgcttaaggagttcaaggacgaagattggaatatgggagatatagtctacactctgactaacaggcggtacttggaaaagtgcatcgcttacgcggaatcccacgaccaggcgctcgtgggggacaagtcccttgcgttctggctgatggacgcggagatgtacacgaatatgtcggtgctcactccatttacgccggtgatcgaccggggaatccagctgcacaagatgatccgtttgatcactcacggactgggcggggaaggctaccttaacttcatgggaaacgaattcggacaccctgaatggctggactttccaaggaagggaaacaacgaaagctaccactacgcccggagacagttccatctcaccgatgatgatctgttgaggtacaagttcctgaataacttcgacagagacatgaatcgattggaagagagatatggttggctcgccgcacctcaagcgtacgtcagcgagaagcacgagggcaacaagatcattgctttcgagcgggccgggctgttgtttatcttcaacttccacccatcaaaatcgtataccgactacagggtcggaactgccctgccgggcaagttcaaaattgtgttggactccgacgcggctgaatacggagggcatcaacgcctggatcattccaccgacttcttcagcgaggcctttgaacacaatggcagaccctactcgctcctggtctacattccgagccgcgttgcgctcattttgcagaacgtggacctgccaaac

SEQ ID NO: 12737 - DNA, 2106 bp, Artificial Sequence
  Description of Artificial Sequence: Synthetic coding sequence
atggctgcccccatgacgcccgcagccaggcctgaggactacgaggccgcactaaatgcagccctagcggacgtgccggaactcgctcggctgctggagattgatccatacctaaaaccttatgctgtggatttccagaggagatacaagcaatttagccagatcttaaagaatatcggagagaacgaagggggtatcgataagttcagtaggggttatgagtcttttggcgtacaccgatgcgcagacggcggcctgtattgcaaagagtgggccccaggcgccgaaggggtattcctcacgggggatttcaacgggtggaacccgttctcatacccctacaaaaaactagattacggcaaatgggagctctacatcccaccgaaacaaaacaagagcgtgcttgtccctcacgggagcaagttgaaggtggttattacctcaaagagtggcgagatcctttatcggatctcaccctgggccaaatacgtcgtcagggagggggataatgtaaactacgattggatccactgggacccggagcactcatacgaatttaagcactctagacctaagaagccacggtctctgcggatatacgagagtcacgtgggcataagcagtcatgaaggtaaagtcgcaagctataaacattttacctgtaacgtgctgccacggataaaaggccttggctacaactgcatccagctgatggctatcatggagcatgcctactatgccagttttggctaccagatcacctctttttttgcagcgagttctagatatggcacacccgaagagctgcaagaactggtggacacagcccacagcatgggtattatagtcttgctggatgttgtccacagtcatgccagtaaaaactccgccgatggcctgaatatgttcgatggcactgatagttgctactttcactctggacctcgcgggactcacgacttatgggatagtaggctgtttgcctacagcagttgggagattctccggttcctcttaagtaacatacgttggtggcttgaggaataccggtttgatggtttcaggttcgacggcgttacctcaatgctctatcaccatcatggcgtggggcaggggttctccggcgactacagtgagtacttcggactgcaggtcgatgaagatgcacttacctacctcatgcttgccaatcacctggtccacacgctctgtcctgatagcatcacgatcgctgaagatgtcagtggaatgcctgccctgtgctctcccatttcacagggggggggtgggttcgactatcgcctggccatggctattccagataaatggatccagctgttgaaggaattcaaagacgaggattggaatatgggcgacatcgtgtacacacttacaaacagaagatacctcgaaaagtgcattgcctatgcagagtcccacgatcaggccctggtcggcgacaaaagtctagccttttggctgatggacgctgaaatgtacacgaacatgtcagttctcacaccttttactcccgttattgatcgcgggatccaactgcacaagatgatccggctgattactcatggcttgggcggggagggctacctgaacttcatggggaacgaattcggacacccggagtggcttgatttccctagaaaggggaacaatgaaagttatcattacgcacgcagacaatttcatctgacagacgatgatctgctgaggtacaaattcctcaataacttcgaccgagatatgaaccgactggaagagcgctacggatggctggccgccccgcaggcatacgtatccgagaagcacgaaggcaacaagattattgcattcgagagagcaggcctcctgtttatcttcaactttcacccatcaaagtcttacacagactatcgagttgggaccgcattacctggaaagttcaagatcgtactcgattctgatgcagcggaatatggaggccaccaaaggcttgatcactccaccgacttcttctcagaagcttttgaacacaacggaagaccctacagcctccttgtgtacatcccatccagggttgcccttattcttcagaacgtcgacctcccgaac

SEQ ID NO: 12738 - DNA, 2106 bp, Artificial Sequence
  Description of Artificial Sequence: Synthetic coding sequence
atggccgcccctatgacgccagccgccagaccagaggattacgaagccgccctcaatgccgcgctggctgacgtgccagagttggcacggctgctcgaaatcgacccgtacctgaaaccgtatgccgtggacttccagcgcagatacaagcagtttagccagattttgaagaatatcggagaaaatgaagggggaatcgacaagttcagccggggatacgaatcctttggagtgcatcggtgcgcggatggaggtctgtactgcaaggaatgggctccaggggctgaaggggtattcctgaccggagacttcaacggctggaaccctttcagctacccctataagaaattggactacggcaaatgggagctctacatccctccgaagcagaataagagcgtgctggtcccgcacggatcgaagctcaaagtggtgattacgtcgaaatccggagagatcctttacagaatctcgccatgggctaaatacgtcgtgagagaaggagacaatgtcaattacgattggatccactgggacccggaacattcgtacgagttcaagcattcgcgccccaagaaaccgaggtcactgcgcatttatgagagccacgtgggaatttcctcgcatgaaggaaaggtggcttcatacaaacactttacctgcaatgtcttgccacggatcaagggattgggatacaactgtatccaactgatggctatcatggaacatgcctactacgcatcatttggctaccaaatcacttcgttcttcgccgcgagttctcggtacggtacgcccgaagaactgcaagaactggtggacactgctcactctatgggcatcatcgtgctgctggacgttgtgcattcccacgcatcgaagaactcagccgatggacttaacatgttcgatggcactgactcgtgttacttccacagcgggccgcggggaactcacgacctctgggactccagattgttcgcctacagctcatgggaaatactgagatttctgctgtcgaatatccgctggtggctcgaagagtacagatttgacggattccggttcgacggggtgacgtcaatgctctaccaccatcacggggtgggacagggatttagcggcgactactcggagtactttggcctgcaggtggatgaagatgccctgacctacttgatgctggctaaccaccttgtgcacactctctgcccggactcaatcacgatcgcggaggatgtgtcaggaatgccggcactctgctccccaatctcgcaaggcggtggagggttcgactaccgcctggctatggcaatcccggataaatggatccaactcctgaaggagttcaaggacgaagattggaacatgggagacattgtctacaccctgaccaaccggcggtacctcgaaaagtgtatcgcttacgccgaatcgcacgaccaagccctggttggtgataagagcctcgccttctggctcatggacgctgagatgtatactaacatgtcggtcctgactcctttcaccccagtgatcgatcggggaatccagttgcacaagatgatcaggctgatcactcacggactcggcggcgagggctacctgaactttatgggaaacgaattcggacacccggaatggctggatttcccgaggaagggcaacaatgagtcgtaccactacgcacggaggcagttccacctgactgacgacgatctgctgcgctacaaattcctcaacaattttgatagagatatgaataggttggaagagcggtacggatggctggccgcgccgcaggcatacgtcagcgagaagcacgagggaaataagatcatcgcatttgaacgcgccgggctcctcttcatctttaacttccatccatcgaaatcgtacactgattaccgcgtcggtactgctctgccgggaaagttcaagatcgtcctggacagcgacgcagccgaatacggaggtcaccagcgcttggatcattcgaccgacttcttctccgaagcatttgagcataatggacgcccttactcgttgctggtctacatccctagccgtgtggctctcatcctccaaaatgtggacctgccgaat

SEQ ID NO: 12739 - DNA, 2106 bp, Artificial Sequence
  Description of Artificial Sequence: Synthetic coding sequence
atggccgcacctatgaccccggcggcacgaccagaagattacgaagcagcacttaacgccgcactcgcagatgtgccagagttggcgagactgctggaaatcgatccataccttaaaccttacgcggtcgactttcaaagacgctacaagcaattctcccaaattcttaagaacattggggaaaacgagggaggtatcgacaagttctcccgcggatacgagagcttcggcgtgcatcggtgtgcagacggtggactgtactgcaaagaatgggcaccgggagcagaaggcgtctttctcaccggagatttcaacgggtggaacccattctcctacccctacaagaagctcgactacggcaagtgggagctctatattccgccaaaacagaataagtcggtgcttgtgccacacggatccaaactgaaggtcgtgattacgtccaagtcgggtgaaattctttacagaattagcccgtgggcaaaatacgtggtgagggagggtgacaatgtgaattacgattggattcattgggatcccgaacatagctacgagttcaaacattcacggcctaagaagcctcggtcactgcgcatatacgaatcacacgtcggtatctcctcgcatgaaggtaaagtcgccagctacaagcattttacctgcaatgtgctgcctcggattaaaggactcggatacaactgcatccaactgatggccataatggaacacgcttactacgcatcgtttgggtaccagattacgagcttctttgcggcctcatcacgctacgggactcctgaggagcttcaagaactggtggacacggcacactccatgggcataattgtgctgctcgacgtcgtccattcgcatgcgtcaaagaactcggcagatggattgaacatgtttgatggcaccgattcatgttactttcactcaggtccaagaggaacccatgatctttgggattctcggctgtttgcatactcctcatgggagatcctcagatttcttctttccaatatccgatggtggctggaggaatacaggtttgatggattccggtttgacggggtgacttccatgctgtaccatcatcacggagtgggtcaaggattctctggagactacagcgaatactttggactgcaggtggatgaagatgcactgacgtaccttatgcttgcaaaccatttggtccacaccctgtgtccggatagcataacgatcgccgaggatgtcagtggtatgcccgccctttgttctcccatttctcaaggaggaggaggttttgattataggctggccatggctataccagacaagtggatacagctgctcaaggaattcaaggatgaggattggaacatgggagacattgtttatacgctgaccaatcgaagatacctggagaagtgtattgcatacgccgagtcccatgaccaggccctggtcggtgacaagtcgcttgcattttggttgatggacgccgaaatgtacactaacatgagcgttctgacccctttcacgcctgtgattgatcgtggaatccagcttcacaagatgatcagactcataacgcacggtctgggaggggaaggctacctcaacttcatgggcaacgaattcggtcatccggaatggttggatttccctagaaaaggaaataacgaatcctaccattacgcccggcgacagtttcacctcaccgatgatgacctccttagatataagttcctgaacaactttgatcgggatatgaaccggctggaggaacgatacggatggcttgcagcgcctcaggcatacgtctccgaaaaacatgaaggcaataagataattgcatttgagagagccgggctgctgttcattttcaactttcatccatcaaaatcgtacaccgactacagagtgggaaccgccctcccaggaaagtttaagattgtgttggactcggacgcagcggaatacggcgggcaccaaagactcgatcatagcaccgactttttctccgaagcatttgaacataatggtaggccttactcgctgcttgtgtacatcccttcaagagtggcgctgattcttcagaatgtggaccttcccaac

SEQ ID NO: 12740 - DNA, 2106 bp, Artificial Sequence
  Description of Artificial Sequence: Synthetic coding sequence
atggcggcaccgatgacccctgcagcaaggcccgaggactacgaggcagccctgaacgcagcccttgccgacgtcccggaactcgcgagactgcttgaaatcgacccttaccttaaaccttacgcggtcgacttccaaaggcgatacaagcaatttagccagattttgaagaatataggagaaaacgagggcggaatagataagttctcccgggggtacgaatcgttcggagtgcaccgatgcgcagatggaggtctgtactgtaaagaatgggcaccgggtgccgaaggggtgttccttacgggagacttcaacgggtggaacccattctcatatccatacaaaaagctggattacggaaagtgggagctgtatattccgccgaagcaaaacaaatcagtgttggtgccgcatggctcgaagctcaaggtcgtcattacgtcaaagtcgggtgagattctttatcggatctcaccttgggcaaagtacgtggtgagggaaggggacaacgtgaattatgattggatccattgggacccagagcactcctacgagtttaagcactcgcgccctaaaaagccacggtcccttcgcatttatgaaagccatgtcggtatctcttcacatgaaggtaaagtagcgtcatacaagcactttacttgcaatgtgttgccgagaatcaagggtctggggtataactgtatccaactgatggctattatggaacatgcatactacgcttcgtttggatatcagatcactagcttcttcgctgcatcgtcaagatacggaactcctgaggagcttcaggaactggtcgacactgcacatagcatggggattattgtgctgctggatgtggtccactcccacgcatcgaagaatagcgcagatgggttgaacatgtttgatggtaccgactcgtgttactttcattcgggacccagaggcacccatgacctgtgggactccagactctttgcatatagcagctgggagattcttcgattcctgctttcgaacattcggtggtggctcgaagaataccgctttgatggcttcagatttgacggagtgacctcgatgctctaccatcatcatggagtgggccagggattttccggtgattacagcgaatactttggtttgcaagtggatgaagatgcacttacttacctcatgcttgcaaaccacctggtgcatactctgtgtcccgattcgattaccatcgcagaagatgtttctggaatgccagcactttgcagccccatttcccagggtggaggtggatttgattaccgcctggcaatggcaatacccgataagtggattcaattgctgaaggagtttaaagatgaggattggaacatgggagatatcgtttacactctcaccaaccgccgctacctcgagaaatgtattgcttacgctgaatctcatgaccaggccctggttggagacaaatcacttgcattctggcttatggatgcggagatgtacacgaacatgtcagtgctgacccctttcacccctgtcattgatcgcggaattcaacttcataagatgattagacttataactcatggtttgggtggagaaggttacctgaactttatgggaaatgaatttggacatccagagtggcttgatttccctcggaaagggaataatgaaagctatcattacgctcgccgccagtttcaccttaccgacgatgacctcttgcgatacaagttcctgaacaattttgaccgcgatatgaatcgactggaggaacgatacggctggctggccgcaccacaagcatacgtcagcgaaaagcatgaaggcaacaagatcatagccttcgaacgcgctggattgctcttcattttcaactttcacccgtctaagtcctacaccgattacagagtgggtaccgcacttccaggaaaattcaagattgtgcttgattcagacgcagcagagtacggtggtcaccaaaggcttgaccatagcaccgactttttctcagaagcctttgaacataacggtagaccttactcgcttctggtgtacatcccatcgcgggtggcactgatcctccagaatgtggatctgcctaac

SEQ ID NO: 12741 - DNA, 2106 bp, Artificial Sequence
  Description of Artificial Sequence: Synthetic coding sequence
atggccgctcctatgactcccgcagcaagaccagaagattatgaagccgcgctcaatgctgcgcttgccgatgtgcccgagctcgcacgccttctcgagattgacccatacctcaaaccttacgctgtggactttcagcgcaggtacaaacaattttcgcagatactgaaaaacattggagaaaacgagggtggtatcgataagttttcccgcggatacgaatcgtttggagttcatcgatgtgcggacggcggactgtactgtaaggaatgggcaccaggggccgagggagtgttccttactggagactttaatggttggaaccctttctcctatccttacaagaaactggattacggtaaatgggaactttacatcccaccaaagcaaaacaaatcggtgcttgtcccacatggatccaagctgaaagtggtgattacctcgaaatcgggggaaattctgtaccgcatatctccctgggcaaaatacgtggttagagaaggtgataacgtgaattacgattggatccattgggatcctgaacattcttacgagtttaagcattcgcgtcctaagaagcctcggtcgctcagaatatacgaaagccatgtgggaatctcatcccatgagggtaaggtcgcctcgtacaagcacttcacctgcaacgtcctgcctcggatcaagggactgggctacaattgtattcaacttatggcaataatggaacacgcatactacgcgtcatttggttatcaaattaccagctttttcgcagcctcgtcgcggtacggaactccagaagagctgcaggagcttgtggacaccgcacactcgatgggtatcattgttcttctggatgtcgtccattcacatgcctcaaagaattccgccgatggcttgaacatgtttgacggaaccgacagctgctactttcactcggggccgcggggaactcatgacctctgggattcgaggcttttcgcttattcgtcatgggaaatccttcggtttcttctgtcgaacattcggtggtggctggaagaataccgtttcgatgggtttcgctttgatggcgtgacttcaatgctctaccaccaccacggagtgggccagggttttagcggtgattactcggaatacttcggacttcaagtggatgaggacgccttgacttatcttatgctcgcgaaccatctggtgcataccctttgtccggactcgattacgatagcagaggacgtgtccggtatgcctgcactttgctctcctatttcgcaaggaggcggggggttcgactaccggctggcaatggccataccagacaagtggatccagctgctgaaggagttcaaggatgaagattggaatatgggcgacattgtttacaccctgaccaatcggagataccttgaaaagtgtatagcatacgcagagagccacgatcaagcactggtcggagataagtcccttgcattttggcttatggacgcagaaatgtacactaatatgtcagtcctcactccctttacccccgtcattgatagagggattcaacttcataagatgattcgcttgataacccacggactgggcggagagggatacctgaactttatgggaaacgaattcgggcatcccgagtggcttgattttccgaggaaaggtaacaacgaaagctaccactacgcgcgcaggcagtttcacttgactgacgatgatcttcttcggtacaagttcttgaacaatttcgatcgcgatatgaacaggcttgaggagagatacggatggctggcagcaccacaagcatacgtgtccgagaagcatgagggcaacaagattatcgcctttgaacgagcagggctgttgttcatattcaactttcatcccagcaaatcgtatacggattaccgcgtgggtaccgcacttcctggcaagttcaagattgtgcttgatagcgacgcagcagagtacggtggacatcagagactggaccactccactgatttctttagcgaggcatttgaacataatggtcgtccgtactctctgctggtgtacattccttcccgggtggcattgattctgcaaaatgtggatctcccgaac

SEQ ID NO: 12742 - DNA, 2106 bp, Artificial Sequence
  Description of Artificial Sequence: Synthetic coding sequence
atggcagcccctatgaccccggcagcgcgcccagaagactacgaagccgccttaaatgctgcattggccgacgtgccagagctcgccaggctcctggagatagacccctaccttaagccctacgccgtggatttccagaggcggtacaaacagttttcacagatcctgaagaacattggtgaaaacgaggggggcattgacaagttctctcggggttacgagtcatttggcgtccatcgctgcgcagacggcgggttgtattgtaaggagtgggcgccaggggcggagggggtctttctgaccggagactttaatggctggaatcctttctcttacccctataagaagttagattacggaaaatgggagctgtatatcccacccaagcagaataagtcagtgctagtgccgcacggcagtaagctgaaggtagttatcacttccaaatctggcgaaatactatatcggatatctccttgggccaaatacgtggtgcgagagggtgataacgtgaactatgattggatccactgggatcccgagcactcgtacgagttcaagcatagcaggccgaagaaacccaggtcactccgcatatacgaaagccacgtgggcatctcaagtcacgagggcaaagtggcatcttataagcattttacttgcaacgtgcttccgaggatcaagggactgggctataattgtatccaactgatggcgataatggagcacgcctattacgcctcctttggttatcaaatcacctcgttttttgccgccagttctcgctacgggacacctgaagagctacaggagttggtggacacagcccattccatgggaattattgtgctcctggatgtggtgcattcgcatgcgtctaaaaacagtgccgacggcttgaatatgttcgatggcaccgacagttgctatttccatagtggaccacgcggtacgcacgatttgtgggattctcgactatttgcctatagctcttgggagattctccgatttctcctgtccaacattcgttggtggctcgaggaataccggttcgacggatttaggtttgatggtgtaaccagtatgctttatcaccatcatggcgtcggccagggcttcagcggtgactactccgaatacttcgggctgcaagtcgacgaagacgccttaacctaccttatgctcgccaaccatcttgtgcataccttgtgcccagattcaatcacaatcgcagaggacgtttccgggatgccagccctgtgtagcccaataagtcagggaggcggtggcttcgactacagattggccatggccattccggacaagtggatacagttgttgaaggagtttaaagacgaggattggaatatgggcgatattgtctatactctgaccaaccgtagatacctggagaaatgcatcgcatacgccgaatcgcatgaccaggcacttgtaggggacaagagtttggccttttggctgatggacgccgagatgtacaccaacatgagcgttttgacaccatttactcccgtcatcgaccgagggattcagctgcacaaaatgattcgtctcattacacacggcttgggcggcgagggatacctgaactttatggggaatgagttcgggcaccctgaatggttggattttccacgcaaaggaaataacgagtcataccactacgcacggcggcaatttcatctcactgatgatgacctgctgcggtataaattcctgaataatttcgaccgcgatatgaataggttggaggaacggtacggatggctcgctgctccccaggcctacgttagtgaaaagcacgagggtaacaaaattatagcattcgaaagagcaggattgctgttcatcttcaatttccacccttcaaaatcctacacagactatagagtgggaacggcattaccaggaaaattcaaaatagttctggactccgatgctgcagagtacggcgggcaccaacgtctagatcatagtactgactttttttctgaagccttcgaacacaatggacggccatatagtctcctagtctacatcccaagtagggttgcactgattctacagaatgtcgatcttccaaat

SEQ ID NO: 12743 - DNA, 2106 bp, Artificial Sequence
  Description of Artificial Sequence: Synthetic coding sequence
atggcggcgccgatgacgccggcggcgcgtccggaagattatgaagcggcgttaaatgcggcgttagcggatgtaccggaattagcgcgattactagaaatagatccgtatttaaaaccgtatgcggttgattttcaacgtcgttataaacaattttcgcaaatactaaaaaatataggtgaaaatgaaggtggtatagataaattttcgcgaggttatgaatcgtttggtgtacatcgatgtgcggatggtggtctatattgtaaagaatgggcgccgggtgcggaaggtgtatttctaacgggtgattttaatggttggaatccgttttcgtatccgtataaaaaactagattatggtaaatgggaattatatataccgccgaaacaaaataaatcggtactagtaccgcatggttcgaaactaaaagtagtaataacgtcgaaatcgggtgaaatattatatcgtatatcgccgtgggcgaaatatgtagtacgtgaaggtgataatgtaaattatgattggatacattgggatccggaacattcgtatgaatttaaacattcgcgaccgaaaaaaccgcgttcgttacgaatatatgaatcgcatgtaggtatatcgtcgcatgaaggtaaagtagcgtcgtataaacattttacgtgtaatgtactaccgcgaataaaaggtttaggttataattgtatacaattaatggcgataatggaacatgcgtattatgcgtcgtttggttatcaaataacgtcgttttttgcggcgtcgtcgcgatatggtacgccggaagaactacaagaactagtagatacggcgcattcgatgggtataatagtactactagatgttgttcattcgcatgcgtcgaaaaattcggcggatggtttaaatatgtttgatggtacggattcgtgttattttcattcgggtccgcgtggtacgcatgatctatgggattcgcgtctatttgcgtattcgtcgtgggaaatattacgttttttactatcgaatatacgatggtggctagaagaatatcgatttgatggttttcgatttgatggtgtaacgtcgatgctatatcatcatcatggtgtaggtcaaggtttttcgggtgattattcggaatattttggtctacaagtagatgaagatgcgttaacgtatctaatgctagcgaatcatctagtacatacgttatgtccggattcgataacgatagcggaagatgtatcgggtatgccggcgctatgttcgccgatatcgcaaggtggtggtggttttgattatcgtctagcgatggcgataccggataaatggatacaattactaaaagaatttaaagatgaagattggaatatgggtgatatagtttatacgttaacgaatcgacgttatctagaaaaatgtatagcgtatgcggaatcgcatgatcaagcgctagttggtgataaatcgctagcgttttggttaatggatgcggaaatgtatacgaatatgtcggtattaacgccgtttacgccggtaatagatcgtggtatacaactacataaaatgatacgtttaataacgcatggtttaggtggtgaaggttatttaaattttatgggtaatgaatttggtcatccggaatggttagattttccgcgtaaaggtaataatgaatcgtatcattatgcgcgtcgacaatttcatttaacggatgatgatttattacgatataaatttctaaataattttgatcgtgatatgaatcgattagaagaacgatatggttggctagcggcgccgcaagcgtatgtttcggaaaaacatgaaggtaataaaataatagcgtttgaacgtgcgggtctattatttatatttaattttcatccgtcgaaatcgtatacggattatcgtgtaggtacggcgttaccgggtaaatttaaaatagttctagattcggatgcggcggaatatggtggtcatcaacgtctagatcattcgacggattttttttcggaagcgtttgaacataatggtcgtccgtattcgttattagtatatataccgtcgcgtgttgcgttaatattacaaaatgtagatctaccgaat

SEQ ID NO: 12744 - DNA, 2106 bp, Artificial Sequence
  Description of Artificial Sequence: Synthetic coding sequence
atggcggctccaatgacgccggctgccagaccagaagattatgaggcggctctgaacgcagcacttgcggatgtgccggagctcgctcgtctgttggaaattgatccttaccttaagccatatgccgtagacttccaaagacgctataaacaattttcgcagattctgaagaatatcggagaaaatgagggaggaatcgataagttttcaagaggatatgaatcattcggagttcacagatgcgcggatggaggtctgtattgtaaggaatgggctcccggagcagaaggagtattcttgacaggagatttcaatggatggaatccattctcgtatccttacaagaagcttgactatggcaagtgggagttgtacataccgcccaaacagaataaaagcgtgttggttcctcacggtagcaagcttaaggtggtgattacttcgaagtcaggagaaatactctatagaatttctccatgggctaaatacgtcgtccgcgagggagataatgttaattacgactggattcactgggatccggaacacagttatgagtttaaacattctagaccgaaaaagcctagatcattgcgtatttacgagagtcacgttggaattagttcgcatgaagggaaagttgcctcatataagcactttacctgcaacgttttgccaagaatcaaaggccttggatacaattgcatacaactcatggccatcatggaacatgcctactacgcatcctttgggtaccagataacttctttcttcgcagcatcatcacgatacggcactccagaggaactgcaagaattggttgatacggctcatagcatgggaattattgtactccttgatgtggtccatagccacgcatctaagaactctgctgatggattgaacatgtttgatggaaccgattcgtgttatttccatagcggacctcgcggaacacatgatctgtgggattcgaggctctttgcgtacagctcgtgggaaattttgcgtttcttgctttcgaacataagatggtggctagaggaatacagattcgatggatttagattcgatggtgttacgtcaatgctttatcaccatcacggtgtgggacagggcttttcaggagactattctgaatactttggactgcaggtggatgaggatgctcttacatatcttatgctagcaaatcatttagtccataccttgtgtccagattcgattacaatcgctgaggatgtatctggaatgccggcactgtgctcaccaatttcgcaaggaggtggaggtttcgattatcgattggcaatggcaattcctgacaaatggattcaattgttgaaggaattcaaagacgaagattggaacatgggagatattgtgtacacattgactaacagacgatacttagaaaagtgtattgcttacgctgaatcccatgaccaggcacttgttggagataaaagtctcgcattctggttgatggatgctgaaatgtatactaatatgagcgtcttgacaccattcacacctgttattgatagaggtattcagttacataagatgattcgtttgatcacccatggacttggcggagaggggtaccttaattttatgggtaatgaattcggccatccagagtggcttgacttcccacgtaaaggaaacaacgaatcatatcactacgcaaggagacagttccatctaactgatgacgatcttttgagatataaatttcttaataacttcgatagagacatgaatcgccttgaggaaagatatggatggctggcagcgcctcaagcttatgtctcagagaaacatgaaggaaacaaaatcatagctttcgaaagagctggtctccttttcatcttcaattttcatccttctaaatcttataccgactacagggttggaactgcattgccaggaaaatttaaaattgtgcttgactccgatgccgctgaatatggaggacatcagcgtcttgatcattcgaccgattttttctccgaggccttcgaacacaatggacgtccatattcccttctagtgtatatcccaagccgtgttgctttaatcctgcaaaatgttgatttgccaaac

SEQ ID NO: 12745 - DNA, 2106 bp, Artificial Sequence
  Description of Artificial Sequence: Synthetic coding sequence
atggcggctccaatgaccccggccgctcgaccggaggactacgaagcagcgttgaacgccgccctggcagatgtgcctgaactcgcccgactcctcgagatcgacccgtaccttaagccgtacgccgtggattttcaacgccggtacaagcagttttcccagatcctcaagaatatcggcgaaaatgaggggggaattgacaaattctcgcgaggatatgagtccttcggggtgcacaggtgtgccgatggaggactttactgcaaggaatgggctccgggcgctgagggagtctttcttactggtgacttcaacggctggaacccattttcgtacccttacaaaaagttggactacgggaaatgggagttgtacatcccacctaaacagaataagtcagtgctggtgccgcacggatccaagctgaaggtggtcatcacctcgaagtctggagaaatcctgtaccgcatttccccttgggcaaaatacgtcgtcagagagggcgacaatgtgaactacgactggattcactgggaccccgagcacagctacgaattcaagcactcgcgcccaaagaagccaaggtccctccgcatttacgaatcacatgtgggtatctcgagccatgaaggcaaagttgcctcctataagcatttcacctgcaatgtgctgccccgcatcaaaggccttggatataactgtatccaactgatggctattatggagcacgcctattacgcatcgtttggatatcaaatcacgtcattctttgcagcctcgtcacgttatggcactccagaagaactccaggagctggtggataccgcgcactcgatgggcatcatcgtactcctggatgttgtgcacagccacgcgtcgaagaattcagctgatggactcaatatgttcgatggtactgatagctgctactttcattccggaccacgcggcacgcacgacctgtgggactcgcgccttttcgcctattcctcttgggaaatcctcaggtttctcctgtccaatattcggtggtggttggaagaataccggtttgacggatttcgctttgatggggtgaccagcatgctttaccaccaccatggggtcggccaggggttttcaggtgattactccgagtactttgggctgcaggtcgacgaagatgcactcacctacttgatgctggcaaaccacttggtgcacacgctgtgcccggattccatcaccatcgcggaggacgtgagcggaatgcccgcactctgcagcccgatctcgcagggcggcggcggtttcgactaccggctcgcgatggccatccccgacaagtggatccaactcctgaaagagtttaaggacgaggactggaatatgggcgacatcgtgtacactctgaccaacagacgctacctcgagaagtgcattgcctacgctgagtcccacgatcaggccctggtgggagacaaatcgctcgctttctggctcatggatgctgagatgtacactaatatgtcggtgctgaccccttttaccccggtgattgaccgaggcatccaattgcataagatgatccggctgattactcacggactgggaggagaaggatacctcaacttcatgggcaatgaattcggtcaccccgagtggctggactttcctagaaagggcaataacgagtcctaccattacgctcggaggcagttccatctcaccgacgacgatctgctgagatacaagtttctgaacaacttcgatcgtgatatgaaccggcttgaagaacggtacggttggctggcggcgccacaggcctatgtcagcgaaaagcatgagggaaacaagattatcgcatttgagagagccggactcctgtttatcttcaacttccatcccagcaaatcctacactgattatagggtcgggaccgcactgccagggaagttcaagatcgtgctggattccgacgccgctgaatacggaggccaccagcgcctggaccactcaaccgacttcttctccgaagccttcgaacacaacggtagaccttactctctcctcgtctacatcccaagcagggtggccctgatcctgcagaacgtggatctcccaaac

SEQ ID NO: 12746 - DNA, 2106 bp, Artificial Sequence
  Description of Artificial Sequence: Synthetic coding sequence
atggcggcgccgatgaccccggcagcaagacctgaagattacgaggccgccctcaacgcggcccttgcagacgtcccagaattggcccgcctcctggaaatcgatccttacctgaagccttacgccgtcgacttccaaagacgctacaaacagttctcgcaaatcctgaaaaacattggagagaacgagggtggcatcgataagttctcccgcggatacgaatcgtttggagtgcatcggtgcgctgacggcggcctgtactgcaaagagtgggcacccggggccgaaggagtgttcctgaccggggacttcaacggatggaacccattttcctacccgtacaagaaactggactacggcaaatgggaactctatatccccccgaagcagaataagtcggtgttggtcccgcacggaagcaagctgaaggtcgtgatcactagcaagagcggggagatcctttacagaatttcgccctgggcaaagtacgtcgtgagggaaggcgataacgtgaattacgactggatccattgggaccccgagcattcctacgagttcaagcattcgaggccgaaaaagcctcgctcacttagaatctacgaatcacatgtcggcatctcctcccacgaaggaaaagttgcctcgtacaaacacttcacgtgcaacgtgctgcccagaatcaaaggactcggctacaattgcatccaactgatggcgattatggagcacgcttactacgcgtcctttggctaccagatcacttccttctttgcagcttcatcacgctatggtacccccgaagaactgcaggaactcgtggatacggcacacagcatgggcatcattgtgcttctcgacgtggtgcactcacacgcgtcgaagaattcggcagacggactgaacatgttcgacggaaccgacagctgttactttcatagcggccctcggggaacccacgatctgtgggactccaggctgttcgcctactcgagctgggagatcctccggtttctgctgtcgaatatacgatggtggctggaggaataccggttcgatggattcagattcgacggagtgacctccatgctctaccatcaccacggagtgggccaggggttcagcggcgactactcggagtactttgggcttcaggtcgacgaggatgcactcacctacctgatgttggcaaaccacctcgtgcacaccctctgtcccgactccatcaccatcgccgaggacgtgtcaggaatgccagctctgtgctctccgatcagccaaggaggaggtggattcgattaccgcctggcgatggcaatccccgacaaatggatccagctgcttaaggaattcaaagacgaagattggaatatgggcgatatcgtgtacaccctgaccaatagacggtacctggagaagtgcatcgcctacgctgagtcacacgatcaagcgctggtgggcgataagtccctggctttttggctcatggacgccgaaatgtacactaatatgtccgtcctgactccgttcactcctgtgatagacagaggtatccaattgcataagatgattcgcctcattactcacggcctgggcggagaaggatatctgaactttatgggaaacgagttcggacaccccgagtggctggactttccacggaagggaaacaacgaatcgtaccattacgcccgccgccagttccatctcactgacgacgaccttctccgctacaagttcttgaataactttgatagagacatgaacagacttgaggaacgctacgggtggctcgcggccccgcaggcttacgtctcagagaaacatgagggcaacaaaatcattgcgttcgagagggccgggttgttgtttatctttaacttccatccatccaaatcgtacaccgactatcgcgtgggtaccgccctccctggaaaattcaagatcgtccttgattcggacgctgccgagtacggaggccatcaaaggttggatcattccacggacttcttctccgaggcgtttgaacataacggaaggccgtactcgcttctggtctacatcccgtcccgcgtcgcacttattctgcaaaacgtggacttgcctaac

SEQ ID NO: 12747 - DNA, 2106 bp, Artificial Sequence
  Description of Artificial Sequence: Synthetic coding sequence
atggccgctccgatgaccccagccgcgcggcctgaagattacgaagctgcgctgaacgcggccctggccgacgtgcctgaattggctcggctgctggagattgacccgtaccttaaaccttacgcagtggacttccagcggcgctacaagcagttctcgcagattctgaagaacatcggagaaaatgagggaggaatcgacaagttctcgcggggatacgaatcatttggggtgcaccggtgcgctgacggtggcctgtactgcaaggagtgggcaccgggagccgagggagtgtttcttaccggcgacttcaacggttggaacccattttcatacccgtacaagaagttggactacggaaagtgggagctgtacatccctccgaagcaaaacaagtcggtgttggtcccgcacggatccaagctcaaagtcgtgatcacctccaagtcaggcgaaatcctgtaccgtatttccccatgggctaagtacgtggtgagagaaggagataacgtgaattacgactggatccactgggatcctgaacattcctacgaattcaagcactcacgcccgaaaaaaccccgctccttgagaatttatgagtcacacgtgggaatctcctcacatgagggaaaggttgcatcatacaaacactttacttgcaatgtcctgccgcggatcaaaggcctcggatacaattgcatccagctgatggcgatcatggagcatgcgtactacgcgtccttcggataccaaattactagcttcttcgccgcttcgtcgcgctacgggaccccggaggagctgcaggaactcgttgacactgctcatagcatgggtatcatcgtgctgctggacgtggtgcattcgcacgcgtcaaagaattcagccgacggactgaatatgttcgacggcaccgattcctgctatttccatagcggtccgagaggaacccatgacctgtgggacagcaggctttttgcctacagctcgtgggaaatccttagattccttctgtccaatatcaggtggtggctggaagagtacagattcgatggattcaggttcgacggtgtgacgtcaatgctgtatcaccaccacggggtgggccagggattcagcggagactactcggagtacttcggccttcaggtggacgaagatgccctgacgtacctgatgcttgcgaaccacctcgtgcatactttgtgcccggactcgatcaccatcgccgaagatgtctcaggtatgccggctctctgctcgcctatctcgcagggcgggggcggattcgattacagacttgctatggctattcccgacaagtggatccaactgctgaaggagttcaaggatgaagattggaacatgggagacattgtgtacaccctcactaacagaagatacctggagaagtgtatcgcatacgcggagtcgcacgatcaagctctggtcggagacaaatcgctggcattctggctcatggacgccgaaatgtacaccaacatgtccgtcctgaccccgttcactccggtgattgatagaggcatccagctgcacaaaatgatccggctgatcactcacggcctgggaggagagggatatctgaatttcatgggaaacgaattcggccacccggaatggctcgactttccaagaaagggaaacaacgagtcctaccactacgcccggcggcagttccatctgactgacgacgacctgctgcgctataagttcctgaacaactttgaccgggatatgaacagactcgaggagcgctacgggtggctggccgctcctcaagcgtacgtctcggaaaaacatgaaggtaacaagattatcgctttcgagcgcgccgggctccttttcatcttcaacttccacccaagcaaatcgtacactgattaccgcgtcggaactgcactgccaggaaagtttaagattgtgctggactcagatgcagcagagtacggagggcaccaacggctggatcattcaaccgactttttctcagaggctttcgaacacaacggacgcccgtattcgctgctggtgtacatcccaagcagggtggcgctcatactgcagaacgtggatcttcctaac

SEQ ID NO: 12748 - DNA, 2106 bp, Artificial Sequence
  Description of Artificial Sequence: Synthetic coding sequence
atggcagctcctatgaccccagccgctaggcccgaggactatgaggcagccctcaatgctgcactggccgatgtccccgaactggctcgtctcctggaaatagacccatatctgaagccgtatgccgtggactttcaaagaagatataaacagttctcacaaatcctgaaaaacatcggggagaacgagggcggcattgacaagtttagcaggggatacgaatccttcggtgtgcaccgctgtgccgacggcggactgtactgcaaagagtgggctcctggggctgagggagtgtttcttaccggggattttaacggatggaacccgttcagttacccttataagaaattggattacggcaaatgggaattatacattccgcccaagcagaacaaatccgtcctggtgccccacggttcaaagctgaaagtagttatcacttctaagtcaggtgaaatcctttatagaatctctccttgggcaaaatacgtagttagagagggcgacaacgtcaactacgattggattcactgggaccccgagcactcatacgagttcaaacattcacggcctaaaaaacccaggtctctgcggatctacgagagtcacgtgggtatctcttcacatgaggggaaagttgctagctataaacactttacctgcaacgtcctcccacgcatcaaaggcctcggatacaactgcatccagttgatggcaattatggaacatgcatactacgcatccttcggatatcagatcacatccttctttgctgcctctagtcgctacggcacccctgaagagctccaggaactggtagataccgctcactccatggggatcattgtgctgctggatgtagtgcatagccacgcttccaaaaatagtgccgatggtctgaacatgttcgatggaactgatagttgctactttcatagtggaccgaggggaactcacgacctctgggactcacggctgtttgcatacagctcttgggagattttgagatttctgctgtccaacattaggtggtggttggaagaatatagatttgacggattccgatttgacggtgtcactagcatgctgtaccatcaccatggagtaggccaggggtttagtggagactattcggaatactttggccttcaggtcgatgaggatgctcttacctatttgatgctagcgaaccatctggtccacacactttgtccagacagtatcacaatagctgaggacgtttccggaatgccagctctctgttcaccaatctcccagggcgggggcggctttgattacaggctggcgatggctatccccgataaatggatccagctgctgaaagaatttaaagacgaggattggaacatgggcgacattgtgtataccctgaccaaccggcgctatctggaaaagtgcattgcatacgctgaaagtcacgaccaggcgctggttggtgataaatctctggcattctggctgatggacgcggagatgtacaccaatatgagcgtgcttaccccttttacaccagtcatagatcggggcatacaactccacaaaatgatcaggcttattacccacgggctgggaggcgagggatacctgaacttcatgggaaacgagtttggacatccagagtggctggacttcccaaggaagggaaacaatgagagctaccattacgctagaaggcagtttcatcttaccgatgacgatctgttgaggtacaaattcctgaacaactttgaccgggacatgaacaggcttgaggagcgttatggctggttggcagcaccccaggcttacgtctcagaaaagcacgagggcaataaaataattgcatttgagagagccggcctgctttttatttttaactttcatcccagcaaaagctacactgactatcgcgttggaaccgcattgcctggcaagttcaagattgtccttgacagtgatgccgcagagtacggtggccaccagaggcttgaccactccaccgatttcttttccgaagcatttgagcacaatggcagaccttactctctgcttgtgtacatccctagcagagtggcgctgattttgcagaacgtggatctccccaat

SEQ ID NO: 12749 - DNA, 2106 bp, Artificial Sequence
  Description of Artificial Sequence: Synthetic coding sequence
atggccgcacctatgacaccagctgctaggcccgaagattatgaggccgctctaaacgcggcattggccgatgtacccgagcttgcgaggttgctagaaattgatccttatctcaaaccatatgccgtcgatttccagcgccgctacaagcagttttctcagatcctcaaaaatataggagagaatgaaggagggatcgacaaattttcacgcggatatgaatcatttggagttcacaggtgtgcggatggaggactgtactgcaaagaatgggccccaggagcagagggggtttttcttacaggggattttaacgggtggaacccattttcttatccctataaaaagctcgattacggaaaatgggaactttacatcccaccaaagcagaacaaatcggtactcgtgcctcacgggtcaaaactcaaggttgtaattacatccaaatccggagaaatactctatagaatatccccatgggctaagtatgtcgttagagaaggggataacgtcaactatgattggattcattgggatccagagcattcttacgaattcaaacacagtagaccaaagaaacctagatctctaagaatatatgaatcccacgtcggaattagtagtcacgaagggaaagtggcgagttataaacactttacatgtaacgtactcccccggattaaagggctaggatacaactgtattcagctgatggccataatggaacacgcatattacgcttctttcggataccagatcacatcgttttttgccgctagttccaggtatgggacacccgaagaactgcaggagctcgtcgacacagcccactcaatgggaattatcgttttactagatgtcgtccatagtcacgcatccaagaattcagcagatggacttaatatgtttgatggaacagattcatgctatttccactctggaccccggggaacacacgacctttgggattctaggctctttgcatattcttcttgggaaatcctccggtttcttctttctaacatcaggtggtggctcgaagaatataggtttgacgggttcaggtttgatggagttacaagtatgctctaccatcatcacggagttgggcaggggttttccggggattacagtgaatattttggacttcaggttgacgaggatgcgctgacatatctaatgcttgccaatcacctcgttcacactctgtgtcccgattccattactatcgccgaagatgtttccgggatgcctgctctgtgtagtcctatatcacaggggggaggagggtttgactatcggcttgccatggctattcccgataaatggatccagttgctgaaagaattcaaggatgaagattggaacatgggagacatcgtttatactctcacaaaccgccggtatctcgaaaaatgtattgcatatgccgagtcccatgatcaggctctagtcggagataaatcgctggcattttggctgatggatgccgagatgtatactaacatgagtgtcctaactcccttcactcccgtcatcgatcgagggattcagctccacaagatgatacgcctcatcacacatgggcttgggggagaaggatatcttaactttatgggaaacgaattcggacacccagaatggctggattttccaaggaaggggaataacgaatcttatcattatgcacgacggcagtttcatttgactgatgacgatctcttgagatataaattcctaaacaactttgatcgagatatgaaccgattagaagaacggtacggatggctggcagcacctcaggcctatgtgagtgagaagcatgaaggaaacaaaatcatagcctttgaacgcgccggacttctctttatttttaattttcacccctcaaaatcttatacagattatcgggttggaacagctctgcccgggaaattcaagatagtgcttgattcagacgcagccgaatatgggggacatcaaaggctagatcattccacagatttttttagtgaggccttcgaacacaatggaaggccctactctctgttagtttacataccttctcgagttgcactcatcctgcagaatgtagatctccctaac

SEQ ID NO: 12750 - DNA, 2106 bp, Artificial Sequence
  Description of Artificial Sequence: Synthetic coding sequence
atggctgcccctatgacccccgctgcacgcccggaggattatgaggctgcgctgaacgccgctctcgccgacgtgcctgagctcgcacgtctccttgagatcgatccatacttgaagccctacgcggtcgacttccagcgtaggtacaagcagttttcccagatcctgaagaacatcggcgaaaacgagggcggcatcgataagttctctcggggctacgagagtttcggcgtgcaccgttgcgctgatggcggcctttactgcaaggagtgggcccccggtgccgaaggtgtgttcttgacgggcgattttaacggatggaaccccttttcttacccgtataagaagctggactacggaaagtgggagctctatatcccccctaagcaaaacaagtcggttctggtgccgcatggcagtaagctgaaggtggtcatcacctctaaaagcggtgagattctctatcgcatcagcccgtgggccaagtacgtggtgcgcgagggtgacaacgtcaattacgactggattcattgggaccctgagcatagctacgagtttaagcactctcgtcctaaaaagccccgctcgctgcgcatctacgagtcccacgtgggaatctccagccacgagggcaaggtcgcttcctataagcacttcacctgcaacgtattgccgcgtattaagggtttaggatacaactgtattcagctgatggcgattatggaacacgcatattacgcctcttttggataccagatcactagtttcttcgctgcaagttccagatacggtacccctgaggaactgcaggagctcgtcgacaccgcccattctatgggtattattgttctgctagatgtggttcacagccacgcaagtaaaaattcggctgacggcctcaacatgttcgatggcaccgattcttgctacttccactccggaccgagaggtacccacgatctttgggattcccgcctattcgcctattcctcgtgggagatcctccggttccttctttccaacattcgctggtggttggaagaatatcgttttgatggtttcagattcgatggggtcactagcatgttgtaccaccaccatggcgtgggtcagggcttctcaggcgattactctgagtactttggactccaagtcgacgaagatgcccttacctaccttatgctggcaaaccaccttgtccacaccctatgcccggacagcattaccatcgctgaggacgttagtggtatgcccgcgctctgttcgccaatcagccagggcggcggcggcttcgactaccgcctggctatggccatccctgacaagtggattcagctcttgaaggagttcaaggacgaggactggaacatgggtgacattgtgtacaccctgacaaaccggcgttatctggagaagtgcatcgcctacgcggagtctcatgaccaagccctggtcggtgacaagtctttggctttctggctgatggatgctgagatgtatacaaacatgtccgttttgacgcctttcacgcctgtgatcgatcgtggcattcagctgcacaagatgatccgcctgatcacacatggactcggcggagaggggtacttgaactttatgggtaacgaattcgggcaccccgaatggttggacttcccgcgcaagggaaataacgagtcttaccattacgcccggaggcaattccatctgactgacgacgatctgctgcgatacaaattcctgaataacttcgatcgcgatatgaaccggctggaggaacgctatggctggctcgccgcgccgcaggcctatgtctccgaaaagcatgagggcaacaagataatagcgtttgagcgcgcgggtctgctctttatttttaatttccaccccagcaagagctacaccgactaccgcgttggtaccgccctccccggcaagttcaagatcgtactagacagtgatgccgctgagtatggcggccaccaacgccttgatcactcgaccgacttcttctctgaggccttcgaacacaacggacgcccctactccctgctcgtttatattcctagccgtgtggcacttatcctgcagaacgtcgacctgccgaac

SEQ ID NO: 12751 - DNA, 2106 bp, Artificial Sequence
  Description of Artificial Sequence: Synthetic coding sequence
atggctgccccaatgactcccgcggctcgccccgaagactatgaggctgctttgaacgctgccctggcggacgtgccagagctagctcggctgcttgaaattgacccttacttgaaaccatatgctgttgactttcagcgacggtacaaacagttttcccagatcctgaagaacatcggagaaaatgaaggaggcattgacaaattctcaagaggctacgagtccttcggagtgcatcgttgcgctgacggcggtctttactgtaaggagtgggccccaggggccgaaggtgtcttcctcaccggggatttcaacgggtggaacccattctcatacccatacaaaaaactggactacggcaagtgggagctgtacataccacccaagcagaataagagtgtgctggtgccacacggatccaaactgaaggtggttataacgtccaagtcaggagagatcttgtaccgtattagcccctgggcaaagtatgttgtgagagaaggagataacgtcaactacgactggatccactgggatcctgaacatagctacgagttcaaacacagcaggccaaaaaagccccgttccttgcgtatttatgaatcccatgtgggaatatcctcacacgaaggaaaagtggcatcttacaagcatttcacctgtaatgtcctgccccggattaaaggcctgggatataactgcattcagctcatggccattatggaacacgcttactatgcctcattcggctaccagattaccagttttttcgcggctagttccaggtatggaacaccagaggagctgcaggaactggtagatactgcccactcgatggggataatcgtgctgctggacgtcgtgcacagtcacgcttccaagaacagcgccgacggactaaacatgttcgacggcactgatagctgctacttccacagcggtcccagggggacacacgacctgtgggatagcagactgttcgcctacagcagttgggagattctgaggtttctgctaagcaacatccgctggtggctggaagagtaccgatttgacgggtttaggttcgatggagtgacgagcatgctgtaccaccatcatggtgtgggccaaggattttcaggggattactctgagtactttgggctgcaggtagatgaggatgctctaacatacttgatgcttgccaaccacctggtgcacaccctgtgcccagactccatcaccatagccgaggatgtgagtgggatgccagccctgtgctcccctattagtcagggagggggggggtttgactacagactcgcaatggccattcctgataaatggatccagctgttgaaggagttcaaggacgaggattggaacatgggtgatattgtgtacacactcactaacagacgttacctggagaaatgtatcgcctatgcagagtctcacgatcaggcactggtaggggataaaagccttgctttctggctgatggacgcagagatgtatactaacatgtccgtgttaactccttttacgcctgtcattgataggggcatccagctccacaaaatgattaggttgatcacacacgggctcggtggcgagggctacctaaactttatgggtaacgagttcggtcatccagaatggctggactttccccgaaaaggcaacaacgagtcgtatcattacgctaggagacagttccacctgaccgacgacgatctcctgcgctacaagtttttgaataacttcgacagagatatgaaccgtctggaagagcgatatggatggctggcagccccgcaagcgtacgtatccgaaaaacatgagggcaacaaaatcatagcgtttgagcgtgcagggcttttatttatattcaatttccacccgtccaagtcctatacagattatagagtgggcacggccctcccaggcaaattcaagattgtcctggactccgatgctgccgagtacggcggccaccagagactggatcactctactgatttcttcagcgaggcatttgagcacaacgggagaccctatagtttgctcgtttacatccccagccgagtcgcgctgatactgcaaaatgtagatctgcctaat

SEQ ID NO: 12752 - DNA, 2106 bp, Artificial Sequence
  Description of Artificial Sequence: Synthetic coding sequence
atggcggcacccatgacgccagctgcgcgcccagaggactacgaggccgctcttaacgccgcattggccgatgtgcctgaacttgctcggctcctggagatcgacccatatctgaagccatatgccgtggactttcagagaaggtataagcagtttagccagattctgaagaacattggcgaaaatgaggggggcattgataagttcagtaggggttatgagagctttggagtgcatagatgcgcggacggcggcttgtattgcaaggagtgggcgccaggtgctgagggggtgttcctgaccggggactttaacggatggaatccattctcttatccgtacaaaaagctcgactatgggaagtgggagttgtatatccctccgaaacagaacaagtctgtgttggtgccccatggctctaagcttaaagtcgtaatcacatctaaatcaggagaaatcttgtatcggatctccccctgggccaaatacgtcgtcagagagggggacaatgttaattacgattggattcattgggacccagagcatagctatgaatttaagcactcacgccccaaaaaaccacgctctctgagaatctatgagtctcatgtgggaatttcttcccatgagggtaaagtggcatcctacaaacacttcacgtgcaacgtgctgcctcggatcaagggactcggatataactgtatccagctgatggccattatggagcatgcctattacgcctccttcgggtaccagatcaccagtttttttgccgcgagcagtaggtatggtacccctgaggaactgcaagagttggttgacaccgcacattctatgggtattattgtgcttctggacgttgtccactcccacgctagcaagaactctgccgacggtctcaatatgttcgacggaacagactcttgctacttccattctggcccccgaggcactcatgatctctgggactcccggcttttcgcctattcctcttgggagattctccggtttcttctgtctaacatacggtggtggcttgaggagtacaggttcgatggctttcggttcgatggggtgacatcaatgctgtatcaccatcacggtgtcggtcaagggttttccggtgactatagcgaatactttggactccaggtagatgaggatgcactgacatacctgatgctggctaaccatctcgtccacactctgtgtcccgattccatcacaatcgcggaagacgtctccgggatgccggcactgtgtagccccatttcccagggcggaggcggtttcgattaccgactggccatggcgattccggacaagtggattcaactgcttaaagaattcaaagacgaggattggaatatgggggacatcgtgtacactctgaccaaccgacgctatctggagaagtgtatcgcctacgcagagtcacacgatcaggcactggtgggtgacaagagtctggctttctggctgatggatgcagagatgtacactaacatgtctgtcttgaccccgtttacgcctgtcattgaccgggggattcagctgcataagatgatccgcctcatcactcacggccttgggggagaaggatatttgaacttcatgggcaatgaattcggacatcccgaatggctggacttccccagaaaggggaacaatgaatcttaccactatgccagacggcaattccatctgacagacgatgacctcctgaggtacaagtttctgaataactttgacagggacatgaacagactggaggagcggtatggttggctggccgccccccaggcgtacgtttccgagaagcatgaggggaataagatcatagcctttgagcgggccggactcttgttcatttttaatttccatccatccaagtcatacacagactatcgggtggggaccgccctgcctgggaagttcaagattgttctcgattccgacgctgcagagtacggtggacatcagaggcttgatcactccactgatttcttttcagaggcatttgagcacaacggcagaccttactctctgctggtgtacatcccatcacgggtggctctgatcctccagaacgtggacctgcctaac

SEQ ID NO: 12753 - DNA, 2106 bp, Artificial Sequence
  Description of Artificial Sequence: Synthetic coding sequence
atggctgctccaatgactccagctgctagaccagaagattatgaagctgcacttaatgctgctttagccgatgttccagaacttgcacgtcttcttgaaattgatccatatcttaaaccatatgctgttgattttcaaagaagatataagcaatttagtcaaattctaaagaatattggagaaaatgagggagggatcgataaattctctagaggatatgagagctttggagtacatcgttgtgcagatggaggattatattgtaaagaatgggctccaggagcagaaggagtttttttaacaggagattttaatggatggaacccattcagttatccatataaaaaattagattatggaaaatgggaactttatattcctccaaaacaaaataaatcagttttagtaccacacggatcaaaattaaaagtagttataactagtaaatcaggagaaattttatatagaatttcaccttgggccaaatatgtggttagagaaggagataatgtaaattatgactggattcattgggatccagaacacagttacgaatttaaacattctcgtccaaaaaaacctagatcacttagaatttatgaatcacatgttggtatttcaagtcacgaaggaaaggttgctagttataaacattttacttgtaatgtattaccaagaattaaaggattaggatataactgtatccaattaatggcaattatggaacatgcttactacgcttcattcggttatcaaataacatcattttttgcagcatctagtagatatggaactccagaagaattacaggaacttgttgatactgctcactctatgggaattatagttttattggatgttgttcatagtcatgcttctaaaaattctgctgatggacttaatatgtttgatggtacagattcttgttattttcactctggacctagaggtacacatgatttatgggattctagattatttgcttattcttcttgggaaattcttagattcttacttagtaatattagatggtggttagaagagtatagatttgatggatttagatttgatggtgttacttcgatgctttatcaccatcatggtgtaggacaaggattttctggtgattattcagaatattttggactacaagtagatgaagacgctcttacatatttaatgcttgcaaatcatttggtacatacattatgtcctgattcaataacaattgcagaagatgtttcaggtatgccagccttatgttctccaatttcacaaggaggaggaggatttgattatagacttgcaatggcaataccagataagtggattcaacttcttaaagaattcaaagatgaagactggaatatgggtgatatagtttatactttaactaatagaagatatcttgaaaaatgcattgcatatgctgaatctcatgatcaagcacttgttggagataaatctcttgctttttggcttatggacgctgagatgtatactaatatgagtgtgttaactccttttacaccagtaattgatagaggaattcaattacataagatgattagattaattactcatggattaggaggagaaggttatcttaattttatgggaaacgagtttggacatccagaatggcttgatttcccacgtaaaggaaataatgaatcttatcattatgcaagaagacaattccatttaactgatgatgatcttttgagatataaatttctaaataattttgatagagatatgaatcgacttgaagaacgatatggatggttagctgcaccacaagcatatgtatcggaaaaacatgaaggaaataagattattgcatttgaacgagcaggattattatttatttttaattttcatccatcaaaaagttatacagattatagagtcggaacagcacttccaggaaaattcaaaattgttctcgattctgatgctgctgaatatggtggtcatcaaagattagatcattcaactgattttttctcagaagcttttgaacacaacggtagaccttatagtctccttgtttatattccatcaagagtagctcttattttacaaaacgtcgacttaccaaat

SEQ ID NO: 12754 - DNA, 2106 bp, Artificial Sequence
  Description of Artificial Sequence: Synthetic coding sequence
atggccgcccctatgacccccgctgctcgacccgaggactacgaagccgccctgaacgccgctctggccgacgttccagaactcgcaaggctattagaaatcgatccttacttgaaaccatatgcagtggatttccaaagacgctacaaacaattctcccagatcctgaagaatataggggaaaacgagggaggaatagacaagttcagcagaggctacgagagctttggagtgcaccggtgcgccgatggcggactctactgtaaggaatgggcacccggcgcggaaggagtgttcctcacgggcgactttaacggatggaatccttttagctacccttataagaaactggattacgggaagtgggagctctacatcccccctaagcagaacaagtccgtgctggttccccacggatctaaactgaaagtggtgatcacctccaaatctggcgagatcctatatcgaattagcccttgggcgaagtacgtagttcgcgagggtgataacgtgaactatgattggatccactgggatcccgagcattcgtatgagtttaagcacagccgacccaagaaaccccggtctttgcggatctatgagagtcacgtcggcatcagtagccatgagggcaaggttgcctcttacaagcattttacatgcaatgtgcttcctaggatcaagggactgggctacaactgtattcagctgatggccattatggaacacgcgtattatgcttcattcggctatcagatcacttcgttcttcgctgcttccagccgctacggaactcctgaggagctacaggaactcgtcgataccgcacactccatgggcatcattgtattactggatgtggtccattcccacgcctccaaaaactccgcggatggcctgaatatgttcgacggcacagacagttgctattttcattccggacctcgcggtacccacgatctatgggattccaggttgtttgcctattcgagctgggagatcctgcgttttttgctgtcgaacattaggtggtggctcgaagagtacaggttcgatggcttccgtttcgacggcgtgactagcatgctgtaccaccatcatggcgtcgggcaggggttcagcggagattacagtgagtatttcgggctgcaggtcgacgaggatgccttgacatacctcatgctggcgaaccatttggtgcacaccttatgccccgattccatcacaattgcggaggatgtcagcgggatgccagccctctgctctccaatcagccagggcggaggaggctttgattacaggcttgctatggctattcctgacaagtggatacaactgctcaaggagttcaaagacgaggactggaatatgggagacatcgtctacaccctgacaaataggaggtatctggagaagtgtatcgcatatgcagaatcacatgaccaggccctggtgggagataaatcgctggcgttttggctaatggacgctgagatgtacacaaacatgtctgtcctcacacccttcactcccgtcatcgaccggggcattcaattgcacaagatgatcaggctcatcacccacggattaggaggtgaaggctacctgaactttatggggaacgaatttggacaccccgagtggttggactttccccgcaagggtaacaacgaatcctatcactatgcccggcgacagttccaccttactgacgatgatctgctacggtacaagttcctgaataacttcgacagagacatgaataggctggaggagcgctatggatggcttgccgcaccccaggcatacgtgagcgagaagcacgagggcaacaaaatcattgcattcgagcgcgcaggattactgttcatctttaacttccacccttctaagtcttacaccgactaccgggttgggaccgcattgcctgggaagtttaagattgtcttggactccgatgccgccgagtacggaggccatcagcgattagaccactcgacggattttttttctgaagccttcgagcataacggtcggccctattccctgctggtctatattccaagccgcgtggcactgatcctgcagaacgtggatctgcccaac

SEQ ID NO: 12755 - DNA, 2106 bp, Artificial Sequence
  Description of Artificial Sequence: Synthetic coding sequence
atggccgcccctatgacacctgcagccagaccagaagactacgaggcagccctgaacgcggctctcgccgatgttcctgagttagcacgtctcctcgagatcgacccttatttgaagccttacgcagtcgattttcagcgccggtacaaacaattcagccagattctgaaaaatatcggggagaatgaggggggcatcgacaagttctcccgtgggtatgaaagttttggtgtacatcggtgtgctgacggggggttgtattgtaaagagtgggcccccggtgccgagggtgtctttcttacaggtgactttaacggctggaacccgttcagctacccctataagaagctggattatggcaaatgggagctgtacatcccccccaagcagaataagtccgtcttggtgcctcacggaagcaagctgaaggtggtgataacttcgaaaagtggtgaaattctctaccggatctccccttgggcgaaatatgtagttagagagggcgacaacgtcaattacgactggatacattgggatcctgagcacagctacgaatttaaacacagcaggcccaaaaaaccaaggtcgttacgcatctacgagagtcatgttggtatctcgtctcatgaaggcaaagttgcatcttacaaacatttcacctgcaatgtacttcctcgaataaagggcctcggctataattgtatacagctgatggctattatggaacacgcatactacgcctccttcggataccagattactagctttttcgcagcgagctctaggtacggcacccccgaggagctccaggagctggtggacactgctcactccatgggcattatcgtgctcctggatgtggtccattcccacgcttccaagaatagtgctgatgggctgaacatgttcgatggcaccgattcatgctattttcacagtggccctcgggggacgcatgacttgtgggatagtagactgtttgcctacagtagctgggaaatccttaggttcttgttatctaacataaggtggtggttagaggaatatagatttgatggcttcaggtttgacggcgtaacttctatgctgtaccatcaccacggggtgggccagggcttttccggcgattactccgagtattttggccttcaggtggacgaagacgcattgacatacttgatgctcgcaaatcacttggtccacacattgtgtccggatagcatcactatcgcggaggacgtaagcggtatgcccgcactgtgcagtcccataagccagggaggcggaggcttcgattataggctggccatggccatccctgataagtggatccagcttttgaaggaattcaaagacgaagattggaatatgggcgacatcgtatatacgttgaccaatagacggtacctggaaaagtgtatcgcctatgccgagagccatgatcaggcactggtcggcgacaaatccctcgccttctggttgatggatgccgagatgtacaccaacatgagcgtccttacccctttcacgcccgtgatagataggggtattcagctgcataagatgattcgtctcatcactcacggactcggcggcgagggctatttaaatttcatggggaatgaatttggccacccagaatggttggacttcccacggaagggcaataacgaatcctaccattacgcccggcgccagtttcatttgaccgacgatgatctgctccgttataagttcctgaataactttgaccgcgacatgaacagactggaggagagatacggctggctcgccgcaccccaggcttacgtgtctgagaaacacgagggaaacaaaattattgcatttgaacgagccggactcctgttcatttttaattttcatccttctaagtcatataccgattacagggtggggactgcactgcctggaaaattcaagatagtgctggacagcgacgccgccgaatacggtggtcaccagcgcctcgaccactctactgatttcttttctgaagctttcgagcataatggacgtccctactctttgctggtgtacattcccagtagggtagctctgatccttcagaacgtcgacctcccaaac

SEQ ID NO: 12756 - DNA, 2106 bp, Artificial Sequence
  Description of Artificial Sequence: Synthetic coding sequence
atggcggctccgatgacccccgctgctcggcccgaggactatgaagctgccttgaacgcagctctcgccgacgtcccagaactagctaggctcctggaaatcgatccatacttgaaaccctatgctgtcgactttcagaggagatataaacagtttagtcagatactcaagaatattggagagaatgaaggcgggatagacaagttctctcgcggctacgagtcgtttggagtccaccgctgtgctgatggtggcctctactgtaaagaatgggcgcctggcgccgagggtgtttttctgaccggtgattttaacgggtggaacccctttagctacccatataagaaactggattacgggaaatgggaattgtatattccccctaagcagaacaaaagcgtgctggtcccccatggatctaagctaaaagttgtcataacatcgaagtccggagagatactctatcggatctctccctgggctaaatacgtggttcgggagggcgacaatgtgaactacgactggatccactgggacccggagcattcttacgaattcaagcattctagaccgaagaagcctagatctctgcgaatatacgaaagccatgtgggcattagtagccacgaaggcaaggtagcttcttataagcattttacctgcaacgtgctgcctcggataaagggcctgggctacaattgcatccaactcatggccatcatggagcacgcatattatgcctcctttggctaccagattaccagtttcttcgcagccagcagcaggtatggaactccggaagagctacaggagctggttgatactgcacattcgatgggtatcattgtgctactggacgtcgttcattcacacgcatccaaaaattctgccgacggcttaaacatgttcgatggaaccgattcttgctacttccacagcggccccagaggtacccacgatctgtgggacagccgcttgttcgcctactcttcatgggaaattctgagattcctactcagcaatatcaggtggtggttagaggagtatcgcttcgacgggtttcgctttgacggcgtgacatccatgctttaccaccaccatggtgttggccaggggttttccggagattactctgagtatttcggcctgcaggtggatgaagacgcgttgacctatctaatgttggccaaccatttggtgcacacactgtgtcccgattctatcacgattgccgaagacgtttccggcatgccggccctctgttccccgatttcacaggggggtgggggtttcgattatcgcctggctatggccattccggacaagtggatccagctgctaaaagagtttaaggacgaagattggaatatgggtgacattgtctacacgctgaccaatcgacgctatctagaaaaatgcatcgcctacgctgagagtcacgatcaggctctggttggcgacaaatctctcgcgttctggctgatggatgccgaaatgtatactaacatgagcgtgcttactccttttaccccagttattgatcggggaattcagctgcacaaaatgattcgcttaatcacccacggcttgggaggagaggggtacctgaacttcatgggcaacgagttcggacaccctgaatggcttgacttcccccggaagggcaacaacgaatcctaccactacgcccgaagacaatttcaccttactgacgatgatctgcttaggtataagttcctcaacaacttcgatcgggatatgaaccgtctggaagagcggtacggatggttggccgcaccacaagcttatgtgtctgagaagcatgaaggcaataaaataatcgcattcgaacgggccggtctgctgttcatctttaatttccatccaagtaaaagctacactgattaccgcgtgggtactgctctccccggcaaatttaaaatcgtactcgatagtgatgctgcagagtatggaggacatcaaaggctcgaccacagcactgattttttcagcgaggcatttgaacataacgggaggccttattccctccttgtctacattcccagtcgggtggcgttaatcctgcagaacgtagacttgcccaac

SEQ ID NO: 12757 - DNA, 2106 bp, Artificial Sequence
  Description of Artificial Sequence: Synthetic coding sequence
atggcagcccctatgacgcctgcagcgcgcccggaggattacgaagcagcactgaacgcggcacttgcagatgtgcctgaactggcacgtctgctggagattgatccatacctgaagccttacgcagtggatttccagagaagatacaaacaattctcacagatactcaagaatatcggtgagaacgaaggcgggattgataagttcagccgggggtacgagtcattcggcgtccatcgctgtgcagatggaggtctttactgcaaagaatgggcaccaggtgcagagggggtgtttctgactggcgatttcaatgggtggaatcctttttcctacccatacaaaaaactggattatggaaagtgggaattgtacatcccaccaaagcagaacaaatcagtgcttgtccctcatggatctaagctgaaggtggtgatcacctccaagtcgggggaaattctttaccgtatttcgccttgggcaaagtacgtggtgagggaaggcgacaacgtcaactacgactggatccactgggacccagagcactcctacgaattcaagcacagccggcctaagaagccacggtcccttaggatttatgagtcgcatgtgggaatatcaagccacgagggtaaagtcgcatcctacaagcatttcacttgtaacgtcttgccccgcattaaagggcttggatataactgtattcaattgatggcgataatggagcacgcctactacgcctcgtttggttaccaaattacctccttctttgcagcctcctcgagatacggtactccagaagagcttcaggagctggtcgacactgcacacagcatgggtatcattgtccttctggatgtggtgcattcccacgcgtccaagaactcggcggatggtcttaacatgttcgacggcaccgactcatgttactttcactcgggcccgcgcgggactcatgatctctgggattcgagactgttcgcctactcgagctgggagattctccgattcctgctctcgaacattcggtggtggttggaagaatacaggtttgatggttttagatttgatggggtgacttccatgttgtaccatcaccacggagtgggccaaggctttagcggagattactcggaatactttggtttgcaagtggatgaggatgcattgacctaccttatgctcgctaatcatcttgtgcataccctctgcccagattccattaccatcgcagaagatgtgagcgggatgcctgcgctttgcagccccataagccaaggtggtggaggatttgattaccgtctggcaatggcaattcctgacaagtggattcagctcctcaaggaattcaaagatgaggattggaacatgggtgacattgtctacaccctcaccaaccgccgttatctggaaaaatgtatcgcctacgcggaatcgcatgatcaggcactggttggagataagtcgctggccttttggcttatggacgcagaaatgtacactaatatgtcggtgcttactcctttcacgccagtgattgatcgcggtattcaacttcataagatgatccgtctcattactcatgggctgggcggtgagggatacctgaactttatgggaaacgaattcggccatccagagtggcttgattttcctagaaaggggaataacgaatcataccactacgcgcgtcggcagttccatttgaccgatgacgacctcctgcggtacaaatttcttaacaacttcgaccgcgacatgaacagactggaggaacgatacggatggcttgcagcaccccaggcctacgtctccgaaaagcacgagggtaataagattatcgcatttgaacgggcgggactgctgttcatctttaacttccatccgagcaaatcgtacactgactaccgggtcggaactgcacttcccggcaagttcaagattgtgctggactcagatgcggctgaatacggtggccaccaacggcttgatcactcaacggactttttctctgaggcctttgagcataatggacgaccatactcgctccttgtgtatatcccttcacgcgtcgcactgattcttcaaaatgttgatctcccaaat

SEQ ID NO: 12758 - DNA, 2106 bp, Artificial Sequence
  Description of Artificial Sequence: Synthetic coding sequence
atggctgcccctatgaccccggcagcccgccccgaggattacgaagcagcactgaacgctgctctcgcagatgtgcctgagctcgccaggctcttggagattgacccttacctgaagccttatgccgtggattttcagcgacgttataaacagtttagccagatcttgaaaaatatcggcgaaaatgagggtggtattgacaaattttccagggggtatgaaagcttcggggtgcaccgttgcgctgacggaggcctctattgtaaggaatgggcccccggcgcagaaggcgtgttcctgacaggggacttcaacggctggaatcctttttcctatccttacaagaagctggattacggcaaatgggagttgtatatcccaccgaaacagaacaagtctgtcctagtaccccacgggtcaaaattgaaggtcgtgattacctcaaaatccggcgaaatactgtataggatttccccttgggccaaatacgtcgtacgggaaggtgataacgttaactatgactggatacactgggacccagaacactcctacgagtttaaacactcccgccccaaaaaaccccgctcactgaggatatatgaatcccatgtaggcatctcctctcatgaaggcaaggtggcatcctacaagcacttcacatgtaatgtcctgcccaggataaaggggctggggtacaattgtatccagctcatggcaataatggaacatgcctattatgcctcattcggatatcagatcaccagcttttttgccgcttccagccgctacggcactcctgaagaactccaggaactagtggacaccgcccattctatgggcattatagtgctgctcgatgtagtgcatagccatgcctcaaaaaattccgcggacggactaaatatgttcgacggcacagactcatgctacttccactccggtcctagaggcacccacgacctgtgggactcccggctgtttgcatattcctcctgggaaatcctgcgtttcctgctgagtaacatccggtggtggctggaggagtaccggttcgatgggtttcgattcgatggggtgacgagcatgctctaccatcaccacggggttggacaggggtttagcggtgactattcggagtattttggcttacaggtcgacgaggatgctctgacctacttgatgctggcaaatcacttggtgcatacgctgtgccccgactctatcactattgccgaagacgtctccgggatgccggccctatgtagccctatcagtcaggggggaggggggttcgattatcgcttggccatggccatacccgataaatggatccagctgctgaaggagttcaaggatgaggattggaacatgggggatattgtgtacacgctgaccaatcggcggtacctggagaagtgcatagcctacgccgagtctcatgaccaggcgctggtgggcgataagtccctggcattttggctgatggatgcggagatgtatacaaacatgagtgtgctgacaccttttaccccggttatcgaccggggaatccagctgcacaagatgattaggttgatcacccatgggcttggaggcgaaggatatttgaattttatggggaatgaatttggccatcctgagtggctggattttccaaggaagggcaacaatgagagctatcattacgccagaagacaatttcatctgaccgatgacgacttgctccggtacaagttcctgaataacttcgatcgggacatgaataggctagaggagcgatatggatggctggcggctccccaggcttacgtgtctgagaagcatgagggaaataaaatcatcgcctttgagcgagcgggactgctgttcatctttaacttccacccaagcaagtcttacacagattaccgagtcgggaccgctcttccaggcaaattcaaaattgtgctcgactctgatgcagccgagtacggcggccaccagaggctcgaccactcaaccgatttcttcagcgaagcattcgaacataatggccggccatacagtctgctcgtgtatattccttccagagtggcgctgatcctgcagaatgtggatctgcccaac

SEQ ID NO: 12759 - DNA, 2106 bp, Artificial Sequence
  Description of Artificial Sequence: Synthetic coding sequence
atggccgctcctatgacccccgccgccaggccggaggactacgaggccgctctgaacgccgccctcgccgacgtgccagaactggcgaggctgctcgaaatcgacccctacttgaaaccctatgccgtggattttcagagacgatataaacagttcagtcaaatcttgaagaatatcggtgagaacgagggtgggattgacaagttttcccgtggatacgagagcttcggcgtgcatcggtgtgccgacggcggcctgtactgcaaagagtgggccccgggtgccgagggggttttcctcacaggcgactttaacgggtggaaccctttcagttacccatacaagaagttggattatggaaaatgggaactttacatccctcccaagcaaaacaagagtgtcctagtgccccacggttctaaacttaaggtggttatcacctcaaagtccggtgaaatactatataggatcagtccatgggccaaatatgtggttcgggagggagacaatgttaactacgattggattcactgggacccagagcactcatatgagtttaagcattccaggcccaaaaagccacgatccctgagaatctacgagtcacatgtaggcatttcaagtcatgaaggaaaggtggccagctataaacatttcacatgtaacgtactgccaaggataaaaggactgggttacaattgtattcagctcatggctatcatggaacacgcgtactatgcttctttcggctaccagatcacctcgttcttcgctgcatctagccgatatggtaccccggaggaactgcaggagctcgtggatacggcacatagcatgggcatcatcgttctgctggacgtggttcactctcacgcctcgaagaacagcgccgacgggcttaacatgttcgacggtactgacagctgttacttccactcagggccacggggcacccacgatttgtgggattcacgcctattcgcctattccagttgggaaatattgagatttctgctgtccaatattcgctggtggctcgaggagtaccgcttcgatgggttccggtttgatggcgtgacaagtatgttgtaccatcaccatggcgtgggccaaggcttctccggggattactcggagtatttcggtttgcaggtggacgaagatgcgctgacttatctgatgctggctaaccatctggttcataccctgtgtcctgacagcattacgattgctgaggatgtgagcggcatgccagcgctatgttctccaatcagccagggtggcgggggattcgattacaggctggcgatggcaattccggacaaatggattcaactcctcaaagagttcaaagacgaggattggaacatgggggatatagtgtatactctgactaacagacgctatctcgagaagtgcatagcatatgctgagagtcatgatcaggccttggtgggcgataagtccctcgctttttggcttatggacgccgaaatgtacactaacatgagcgttctgaccccttttacacccgtgattgaccgcgggattcagctccacaagatgatccggcttatcactcatggtcttgggggggagggatacctgaatttcatgggtaacgagtttggacaccctgaatggctggattttccacggaagggtaacaacgagtcctaccactacgcacgtcggcagtttcatcttactgatgacgacctactgagatacaagttcctgaacaactttgacagagacatgaatcggctcgaagaacgctatggctggctggctgccccgcaggcatatgtttccgagaagcacgaggggaataaaataatcgcattcgaacgcgccggactgttgtttatttttaactttcacccctccaagagttacaccgattacagagtgggtactgccctgccaggaaagttcaagatcgtgctggactctgatgcggcagagtacggtggacatcaacgcctcgatcattccactgactttttttctgaagcctttgagcacaacggccggccctacagtctgctagtgtacatcccctcacgggtggccctaatactgcagaatgtcgacctcccaaac

SEQ ID NO: 12760 - DNA, 2106 bp, Artificial Sequence
  Description of Artificial Sequence: Synthetic coding sequence
atggcagcgcctatgactccagccgctcgccccgaagattacgaggcagcactcaacgcagcactggccgatgtgcctgaattggcacgccttctggaaattgatccataccttaagccctacgccgtggacttccagagacgatacaagcagttttcgcagatacttaagaatataggggaaaacgaaggcggtattgacaagtttagcagaggatacgagagctttggcgtgcatagatgtgctgatggtggactgtactgtaaggaatgggctccaggagcagagggagtgttcctcaccggcgactttaacggatggaatccattttcttacccttacaaaaaactggactacggaaagtgggaactgtacatcccacccaagcagaacaagagcgtgctcgtgccccatggctcgaaactcaaggtggttattacgtcaaaaagcggtgaaattctgtaccggattagcccatgggcaaagtacgtcgtcagagaaggagacaacgtgaactacgactggattcattgggatcctgagcattcctacgagtttaaacattcgcggcctaagaagcctcgttcccttaggatttacgaatcacatgtggggatatcatcacacgaaggtaaggtcgcctcctacaagcattttacctgtaacgtgctgccccgcataaagggactcggctacaactgtattcagctcatggccatcatggagcacgcctactacgcgtcctttggataccagattacctctttctttgcagcaagctcacggtacggaacccctgaagaactccaggaattggtggatacggcccatagcatggggattattgtgctcctggatgtggtgcattcccatgcaagcaagaattccgcagatggactgaatatgttcgacggaaccgactcatgttactttcattccggaccccgcggtactcacgacctctgggattcgcgactctttgcttactcgagctgggaaatacttagattcctgcttagcaacatccggtggtggctggaggaataccgcttcgacgggtttcgttttgacggtgttacttctatgctgtaccatcatcacggagtcgggcaaggcttctcgggcgattactcggagtactttggacttcaagtggatgaagatgcgctcacttatcttatgctcgccaatcatctcgtccacactctgtgtcctgattcgatcaccattgctgaggacgtgtccggtatgccagcactgtgttccccaatttcccagggcggcggcggttttgattaccggctggcaatggcaattcctgataagtggatccaactccttaaggaattcaaggacgaggattggaatatgggtgatatcgtgtacactctcactaacaggcggtaccttgagaaatgcatagcgtacgcggaaagccacgatcaagcattggtcggtgacaagtcactggcattttggctgatggatgcagagatgtacaccaatatgtcagtgcttaccccctttacccctgtcatcgaccggggcatccaactccataagatgatcagattgatcacccacggtctgggaggcgagggatacctcaactttatgggtaacgaatttggacaccccgaatggcttgattttcctagaaagggcaataatgaaagctaccattacgccaggagacaatttcacctgaccgacgatgacctccttcggtataagtttcttaacaatttcgatcgcgatatgaatcggctggaagaaaggtatgggtggctcgccgcccctcaagcgtacgtgagcgaaaagcatgaggggaataagattattgcattcgaacgtgcaggtctgcttttcattttcaactttcatccctccaagtcctacactgattaccgagtcgggacggcactgcctggaaagtttaagattgtgctggacagcgatgcggcggaatacggaggacaccaaagacttgaccatagcaccgatttcttctcggaagcatttgaacacaatggccgcccatactcgctgctggtttacataccgtcacgcgtggcattgattcttcaaaacgtggacctgcctaac

SEQ ID NO: 12761 - DNA, 2106 bp, Artificial Sequence
  Description of Artificial Sequence: Synthetic coding sequence
atggcggcgcccatgactcctgcagcacgacctgaagattacgaagcagcgctcaatgcagccctggcggacgtgcctgaactcgcgcggctccttgagattgatccatatttgaaaccctacgcagtggacttccaacgacgctacaaacagttttcccagattcttaagaacataggtgaaaacgaaggaggtatcgacaaattctcccgtggatacgagtccttcggtgtccatcgctgcgctgacggtggactttactgtaaagaatgggcaccaggagcagagggagtgttcctgaccggagactttaacgggtggaatcctttttcgtatccttacaaaaagctcgactacggcaagtgggaactgtacattccaccaaaacaaaacaagtcggtgcttgtgccccacggatcaaaactcaaagtggtgatcacctctaagtccggcgagatcctgtacagaataagcccttgggcaaaatacgtcgtgagggaaggtgataacgtgaactacgattggattcactgggatcccgagcatagctacgagttcaagcactccaggcctaaaaagcctagatcgctcagaatttacgagtcgcatgtggggatttcaagccatgaaggtaaggtggcttcgtacaagcattttacctgtaatgtccttccccgcataaagggactgggttataactgcattcagcttatggcaattatggaacacgcatactacgcatcgttcggataccaaattacgtccttttttgccgcgtcatccaggtacgggaccccagaagagctgcaggagcttgtcgacactgcgcattcgatggggattatagtgctcctcgatgtggtgcactcccatgcatccaaaaactccgccgatggacttaacatgtttgatggaactgactcctgttactttcattcgggcccacgaggtacccatgatctttgggacagcagactttttgcatactcatcctgggagattctcagatttcttctgagcaatatcagatggtggctcgaagaataccgctttgatggttttaggttcgatggagtcacttcgatgctttaccatcatcacggggtcggccaggggtttagcggtgactacagcgagtacttcggacttcaggtggatgaggacgcactcacctaccttatgcttgcaaatcatcttgtccatactctgtgtccagatagcattaccattgccgaagatgtgtccgggatgccagcactgtgttcacccataagccagggtggaggaggtttcgactaccggctcgcaatggccattccagataagtggatacaacttcttaaggagttcaaagatgaagattggaatatgggagacattgtgtacactcttactaatagaagatacttggaaaagtgtattgcatacgcagaatcgcatgatcaagcattggtgggagataaatcgcttgcattctggctcatggatgccgaaatgtacaccaacatgtccgtgctgactccttttaccccagtcattgatcggggtattcaactgcacaaaatgatcagacttatcacccatggactcgggggagagggatatctgaactttatggggaacgaattcggtcatccggaatggctggattttccgaggaagggaaataacgagtcgtaccattacgcacggagacagtttcatcttactgacgatgatctgcttagatataagtttctgaacaatttcgaccgcgacatgaacaggcttgaggagaggtatggctggctggcagccccacaagcgtacgtgtcagaaaagcacgagggaaataagattatcgcattcgagcgggcgggcctgttgtttatcttcaattttcatccgagtaagagctacaccgattaccgggtaggcactgctcttcctggcaaattcaagatcgtgctggattcggatgcggcagaatacggaggtcatcagcgccttgaccatagcactgatttcttctccgaagcgttcgaacacaacggtaggccgtactcccttcttgtgtacattcctagcagggttgcacttattcttcagaatgttgatctccccaat

SEQ ID NO: 12762 - DNA, 2106 bp, Artificial Sequence
  Description of Artificial Sequence: Synthetic coding sequence
atggccgctccaatgacccctgccgcccgtccagaggactatgaggctgcgttaaacgcggcccttgcggatgtacctgaattggcgaggctactggagattgacccttaccttaagccctatgccgtcgactttcaacgtagatacaaacagttttctcagatcctgaagaatatcggcgagaacgagggtggaatcgacaaattctcccgaggttacgagagctttggcgtccatcgctgcgcggacgggggtctctattgcaaggagtgggcccccggggcggaaggtgtcttccttacgggggattttaacggatggaacccatttagctatccctacaagaaattagattatgggaaatgggagttgtacataccgcccaaacagaataagtccgttcttgttcctcacggttcgaagctgaaagtggtgatcacatctaagagtggtgaaatcctataccggatcagtccctgggcaaaatatgttgtccgtgaaggagataatgtcaattatgattggattcactgggatcccgaacattcatatgagtttaagcatagccgaccgaagaaacccaggagcctacgcatttacgagtcccacgtcggaattagctctcatgagggcaaggtcgcgtcatataagcactttacctgcaacgtactcccccgaattaaaggacttggctacaattgcatccagctcatggcgatcatggaacacgcctactatgcatcgttcgggtaccagatcactagttttttcgcggcatcaagccgctatggcactccagaggaattgcaagagttagtcgatacagctcactctatgggaattattgtgttgcttgacgtagtgcattcgcacgcttctaaaaattctgcagatggtctgaacatgtttgacggaacggattcctgttattttcactctgggccgcgaggcactcacgacctatgggactcacggctcttcgcttattcgtcctgggaaattttgcgtttccttctgtcaaatatccgatggtggctcgaggagtatcggttcgacggcttccggttcgacggggtcacgagcatgttgtatcaccatcatggcgtcggacaaggtttcagcggggattactcggaatactttggcttgcaagtcgacgaggatgctctgacgtacttaatgctggccaatcatctcgtccataccttgtgtccagattcgatcacgattgccgaggacgtttcgggaatgcctgcgctgtgctctccaattagtcaaggtggaggcggttttgattatcggctggccatggcgattccggacaagtggatccagctattgaaggagtttaaggatgaggattggaacatgggagacattgtgtataccttgacaaatcgccgatatctggagaaatgcattgcctatgccgagtctcacgatcaggcgctcgtaggggataagtcgctggctttttggctcatggacgcggagatgtatacgaacatgtcggttctgaccccctttacgccagtcattgaccggggaatacagcttcacaagatgatcagactcataactcatggtcttggaggtgaaggttacctgaactttatgggcaacgaatttggacatcctgagtggttggattttccgagaaaaggaaacaacgagagttatcattacgctcgtcggcagttccaccttacggatgatgaccttcttcgttataagtttttgaataactttgatcgtgacatgaatagattagaggagagatatggttggctggctgccccgcaagcttatgttagtgagaagcatgaagggaataagataattgccttcgagcgtgcggggcttctcttcatattcaattttcaccccagcaagtcgtacacggattatcgagtggggacagcactgcctgggaagttcaaaatagtccttgacagcgacgccgctgagtacggtggccatcagcgcctcgatcattccacggactttttcagcgaagcgttcgagcataacggtagaccatatagccttttggtgtacatcccctcccgcgtggctttgatactccagaacgtggatctacccaat

SEQ ID NO: 12763 - DNA, 2106 bp, Artificial Sequence
  Description of Artificial Sequence: Synthetic coding sequence
atggcagcgccaatgacccctgcagcacggcctgaggactacgaagcggcgctgaacgctgcccttgcagatgttccagaactggcaagactgcttgaaatcgacccttatcttaagccttacgcggtggacttccagagaaggtacaagcagttttcccaaatcctgaagaacattggtgagaacgaaggcggcatcgacaagttttccagaggatacgaatcctttggagtgcaccggtgtgcagatggcggactgtactgtaaggaatgggcaccgggcgcagagggtgtgttcctcactggtgactttaatgggtggaatcctttttcctacccatacaagaagctggattacggaaaatgggaactctacattccaccaaaacagaataagtccgtcctggtaccacatggaagcaaacttaaggtcgtcataacgtcaaagtcaggtgagatcctgtaccgtatttcgccatgggcaaaatacgtggtcagagaaggcgataatgtgaactacgactggatccattgggatcccgaacacagctacgaattcaagcatagcagacccaagaagcctagatcacttagaatttacgagtcccacgtgggtatttcgagccatgagggcaaagtggcttcctacaagcattttacttgtaacgtgcttcccaggattaaggggcttgggtacaactgtatccagcttatggccattatggaacatgcctactacgccagctttggctaccaaatcacttcgttcttcgcagcgtcgtcgagatacggcaccccagaagaactgcaggagctggtcgatactgcccacagcatgggcattatagttctcctggacgtcgtgcattcacatgcaagcaagaactccgcagatggactgaatatgttcgatggtaccgattcatgctactttcactccgggccccgtggaacccacgacctctgggacagccgtctgttcgcgtacagttcatgggaaattcttaggttcctgctgtcaaacatccgctggtggctggaagaatacagatttgacgggtttcgctttgatggagtgacctctatgctctaccatcaccatggtgttggacaaggattctcgggggactactcagaatactttggactccaggtcgatgaggacgctctcacctacctcatgctcgccaaccatctcgtgcatacgctttgtcctgactcaatcacgatcgcagaggacgtgtccggtatgcctgccctctgctctccaatctcacaagggggaggaggatttgattacagactggcaatggccattccagataagtggatacagctgttgaaggaattcaaggatgaagattggaatatgggtgacatcgtctacactctgactaaccgccgctacctcgagaagtgtatcgcatacgctgaatcgcatgatcaggcactggtcggagacaaatctctcgcattctggctgatggatgccgaaatgtacactaatatgtccgtgttgaccccttttaccccggtgatagaccgcggtatccagttgcataagatgattcggctgattactcatggattgggaggtgaaggatacctgaactttatgggaaacgaatttgggcaccctgagtggcttgatttcccgagaaagggtaataacgagagctaccattacgcacggagacaatttcatctgacggatgacgacctgctgcgatacaaatttcttaacaactttgatagagatatgaatcgactggaagaaagatacggttggctggcagctccccaggcttacgtttccgagaagcatgaaggaaacaagattattgccttcgagagggcaggactgctctttatcttcaacttccacccttcaaaatcctacaccgattaccgcgtgggaaccgcccttccggggaagttcaaaatcgtgctcgattccgacgccgctgaatacggtggacaccagaggctcgatcactcgactgatttcttttcagaggcatttgagcacaacggtcgcccatacagcctgttggtgtacattccatcaagagttgcactgatcctgcagaacgtcgacctgcctaac

SEQ ID NO: 12764 - DNA, 2106 bp, Artificial Sequence
  Description of Artificial Sequence: Synthetic coding sequence
atggccgccccaatgactccagccgcgaggcccgaagattacgaggcggcactgaatgctgcgcttgctgacgtgccagaactggcccggctgctggaaattgacccgtaccttaaaccatacgcggtggatttccaacgccgttacaagcagttctcgcagatcctgaagaacatcggcgaaaatgaaggaggcatcgacaagttctcacgcggatacgaatcatttggcgtgcaccgctgtgcagatgggggactctactgcaaggaatgggccccaggcgccgaaggagtgtttctgaccggggacttcaacggatggaatccgttttcttatccgtacaagaagttggactacggaaaatgggaactgtatatcccgcctaagcagaacaagtcagtgttggtgcctcacggatccaaactgaaggtggtcatcacgagtaagagtggagagatcctgtacagaatctccccttgggcgaagtacgtcgtgcgggaaggtgacaacgttaactacgattggatccactgggacccggagcatagttacgagtttaagcattcccgacctaagaagccaagatcactccgcatctacgaatcgcatgtcggaatctcaagccacgaagggaaagtggcgtcctacaagcacttcacctgcaatgtgctgcctcggatcaaaggcctgggttacaactgcatccaactgatggcaatcatggagcatgcctattacgcatcgttcggctaccagattacttcgttttttgccgccagctccaggtacggcactccggaagagcttcaagaactcgtggacacggcccattccatgggaatcatcgtcctgctggacgtggtgcactcgcatgcgtcaaaaaacagcgccgacggactgaacatgttcgatggcaccgactcctgctacttccactccggaccgaggggcacgcacgatttgtgggattcacggcttttcgcatactcatcatgggagatcctgcgttttttgctctcgaacatccggtggtggctcgaggaatatcgctttgacggatttcggttcgacggagtgactagcatgctgtaccaccaccacggcgtcggacaaggtttcagcggagattacagcgaatacttcgggctccaggtggacgaggacgcgctgacctacctcatgctggccaaccacctggtccatactctgtgtccggactctatcaccatcgctgaagatgtgagcggaatgccagccctgtgttcaccgatttcccagggcggcgggggatttgattacaggctcgcaatggccatcccggacaagtggatccaactgctcaaggagtttaaggacgaagattggaatatgggagacattgtgtacaccctgaccaatcgccggtacctcgagaagtgcatagcctacgcagaaagccacgatcaggctctggtgggggataagtcacttgcgttctggctgatggatgccgaaatgtatactaacatgagcgttttgacccctttcaccccagtcatcgatcgcggcatccagctccataagatgattcggctgatcacgcatggccttggtggagaaggatacctcaactttatgggaaacgagttcggccacccagagtggctggactttcctcgcaagggaaacaacgaaagctaccattacgctcgccggcaatttcacctcaccgacgatgatctgctgaggtacaaattcctcaacaactttgaccgggatatgaatcgcctcgaggaaagatacggttggctcgctgccccgcaagcatacgtgtcggagaagcacgagggaaataagatcatcgccttcgaacgggcaggtctgttgttcatctttaactttcatcctagtaagtcgtacaccgattatcgggtgggtaccgctttgccgggtaagttcaagatcgtgctcgattcagacgcggcggaatacggaggacaccagagactggaccactccactgatttcttctcggaagccttcgagcacaatggacgcccttacagcctgctcgtgtacatcccaagccgcgtcgcactgattcttcagaatgtggacctgccaaac

SEQ ID NO: 12765 - DNA, 2106 bp, Artificial Sequence
  Description of Artificial Sequence: Synthetic coding sequence
atggccgcaccgatgaccccggctgcccgtccggaggactacgaagcagccctgaacgctgccctcgccgacgtccccgaactggcgagactcctggaaatcgacccctacttgaaaccgtacgccgtggatttccaacgaagatacaagcaattctcccagatccttaagaatatcggagagaatgagggagggattgataagttttcacgcggctacgaatcctttggagtccatcgctgtgctgacggaggactctactgcaaggagtgggcgcctggtgcggaaggggtgttcctcaccggcgatttcaacggatggaacccgttttcctacccttacaaaaaactggactacggaaagtgggagctttacatcccaccaaagcagaataagagcgtgttggtgccgcatggaagcaaacttaaggtggtcatcacttccaaatcgggagaaatactgtacaggatctcaccttgggccaagtacgtggtgcgggaaggagataacgtgaactacgattggatccattgggacccggagcattcgtacgagttcaagcattcacgccccaagaagccaaggagtttgcggatctacgagtcacacgtcggaatttcctctcatgaaggaaaggtggcgagctacaaacatttcacctgcaacgtcctcccccgcatcaagggcctggggtataactgcattcagctgatggctattatggaacacgcttactacgcgagcttcggataccagatcacctccttcttcgccgcgtcgtcgcgctacggtactccggaagagctgcaagaactcgtggacactgcgcacagcatggggatcatcgttctgctcgacgtggtgcactcacatgcgagcaagaattctgccgacggcctgaacatgttcgacggaacggactcgtgctatttccatagcggccctcgcggcactcacgacctctgggactcaagattgtttgcatactcgtcgtgggaaatactgaggttcttgctgagcaacatccggtggtggcttgaagaataccggttcgacggctttcgctttgacggtgtaacttccatgctttatcaccaccacggagtcggccagggattctctggtgactattccgaatacttcggtctgcaagtagatgaagatgctctgacctatctcatgctggcgaaccatctcgtgcacaccctctgtcctgattcgatcactatcgcagaggacgtctcaggtatgccggctctctgttccccaatctcccagggtgggggaggattcgactaccgcttggcaatggcaatcccggataagtggatccagctcttgaaggagtttaaagatgaggattggaatatgggcgacatagtgtacacgctcactaaccgcaggtaccttgagaagtgcatcgcctacgcagagtcacatgaccaggcgcttgtgggcgacaagtccctggcgttttggctgatggacgctgaaatgtatactaatatgtcagtcttgaccccattcacccctgtcatcgataggggaatccaactgcacaaaatgattcgccttatcacccatggactgggcggagagggatacctgaacttcatgggtaacgaattcggacacccggaatggctggacttcccccggaagggaaacaacgagtcataccactacgcacgccggcaattccacctgactgatgatgatctccttcggtacaagtttctcaacaatttcgacagagatatgaatcggctggaggaacgatacggatggctggccgccccacaagcctacgtgtccgagaaacatgagggcaacaaaatcattgcttttgaaagagctggattgctgtttatcttcaatttccacccgtcgaaatcctacaccgattaccgcgttggcaccgcgctgccgggaaagtttaagattgtgctggattcggatgctgccgaatatgggggtcaccagcgccttgaccactccacggacttcttctcggaagcctttgaacacaatggtagaccgtacagcctcctggtgtacatcccctcccgggtggccttgatactccagaacgtggacttgcctaat

SEQ ID NO: 12766 - DNA, 2106 bp, Artificial Sequence
  Description of Artificial Sequence: Synthetic coding sequence
atggctgccccgatgaccccagctgcacgccctgaggactacgaagcagcgctgaacgcagcactggccgacgtcccggagctggcccggcttctcgaaattgacccatacctgaagccatacgcagtggattttcagcgaaggtacaaacagttctcgcaaatactcaagaatattggagagaatgagggcggtatagataagtttagtcgtggatacgaatcattcggcgttcatcgatgtgcagatggcggtctttactgcaaggaatgggcgcctggggccgaaggagtctttctgaccggcgactttaacgggtggaatcctttcagctacccctacaagaaattggactacggaaagtgggaactctatattcctcctaagcagaacaagagtgtgctggtgcctcacgggtcaaagctgaaagtggtcattactagcaagtcaggcgagattctttatcgcatttccccttgggcaaagtacgtcgtcagagaaggcgacaatgtgaactacgattggattcattgggatccagagcacagctacgagtttaagcattccagacccaaaaaaccacgttcacttaggatctacgagagccatgtgggtatcagctctcacgagggtaaggtggcaagttacaaacacttcacttgcaacgtgcttcctaggattaaaggacttggttacaattgcatccagctgatggccataatggagcatgcgtactacgcctccttcgggtaccaaattacctcatttttcgccgcaagctcccggtacggaacccccgaagagctgcaagaattggtggataccgctcacagcatgggtattatcgtcttgcttgacgtggtgcatagccacgcatcgaaaaacagcgcagatggactgaatatgtttgatgggaccgattcctgctactttcactcgggacctcggggaacccatgatctgtgggactcgaggctttttgcatatagttcgtgggaaattcttagatttcttctctcgaacatccgatggtggctggaagaatacagatttgacggtttccggttcgacggtgtcacttcgatgctctaccatcatcatggcgtgggccagggtttctccggcgactactctgagtactttggtctgcaggtcgatgaggatgcacttacttacttgatgctggctaaccaccttgtgcataccctgtgtccagattcaattactattgcggaagatgtgtcgggaatgccagctctctgtagcccgataagccaaggaggaggtggttttgactacagactcgcaatggcgatcccagataagtggatacaattgctcaaagagtttaaggacgaagattggaacatgggtgatattgtgtataccctcaccaaccgccggtacctcgaaaaatgtatcgcctacgccgaaagccatgatcaggcattggtaggagacaagtccctggcgttctggctgatggatgcagaaatgtatactaatatgtcggtgcttactcccttcactcctgtgattgacagaggaatccaactgcacaaaatgattcgcttgataacgcatggacttgggggagagggctaccttaacttcatgggtaacgaatttggtcacccggaatggctggatttccctcgtaagggaaataacgaatcttaccactacgccagacggcagttccatctgaccgatgatgatcttctgagatacaagtttctcaataacttcgatcgtgacatgaatcgtctcgaagaacgctacggatggctcgcagcaccgcaagcatacgtgtcggagaagcatgaaggaaataagatcattgcgtttgaacgcgcaggcctcctgttcatattcaattttcatccttcaaagtcttacaccgattatcgggtcgggaccgcacttccaggaaagtttaagatagtgctcgattccgacgcggcggaatatggtggtcatcaaagactggaccattcgactgactttttctccgaggcttttgagcacaacggaaggccatactcacttcttgtttacataccttccagggttgcccttattcttcaaaatgtggatctgcctaac

SEQ ID NO: 12767 - DNA, 2106 bp, Artificial Sequence
  Description of Artificial Sequence: Synthetic coding sequence
atggccgctcctatgacccctgccgcgcgtcccgaggattatgaagccgccctgaacgctgcgctcgccgacgttccagagctggcacgattgctggaaatcgacccatatctcaaaccctatgctgtggatttccagaggcgctataagcagtttagccagatccttaaaaacattggagaaaacgagggaggcattgataaattcagccgtggatatgaatcctttggcgttcatcgatgcgcagatggcgggctgtactgcaaggagtgggctcccggcgcagagggagtgttccttacaggggactttaacggatggaaccctttcagttacccctataagaagctcgactacggcaagtgggagctgtacatcccacccaagcagaataagtccgtcctggtccctcatggctcaaagttaaaagttgtgatcacgagtaagagcggagagattctttacagaatctctccctgggccaaatatgttgtccgcgaaggtgacaacgtcaattatgactggattcactgggaccctgagcacagctatgagttcaaacattcgcgtccgaaaaagccacgatcactcagaatctatgagtcacatgtgggtattagtagccacgagggaaaagtggcaagctacaaacactttacatgcaacgtgctgccaagaataaaggggctcggctacaactgtatccagttaatggcaattatggaacacgcctactatgcaagttttggttaccagattacttcattttttgccgccagcagcaggtacggaacccccgaagaactgcaagaattggttgacacagcacacagcatgggcatcatcgttctgctcgacgttgtccatagccatgcctcaaagaattccgctgatggacttaatatgttcgatggaaccgattcttgctatttccattcgggccctagaggtactcacgacctgtgggacagtaggttatttgcatacagctcctgggagatcctgagattccttctgtccaacattcgttggtggctagaagaatacagattcgacggtttcagatttgatggcgtgacgtcaatgctgtatcatcaccatggagtgggtcaggggttttccggcgattattccgaatacttcgggctgcaggtggatgaagacgcgttgacttatctgatgttggctaaccatcttgtgcataccctgtgccccgattctatcactatcgcggaggatgtgagtggcatgcccgccctgtgcagtccaatcagccagggcggagggggttttgattataggctggctatggctatacctgacaagtggatccaattgctcaaggagtttaaggacgaagactggaatatgggcgatattgtttacaccctcactaaccgaaggtacctcgagaaatgtatagcctacgcagaatctcacgaccaggcgctggtgggcgacaaatccttggcgttttggctaatggacgctgaaatgtatactaacatgtctgtccttactcccttcaccccagtgatcgatcggggaattcagctccacaaaatgatccggctcataacccatggcctcggcggcgaggggtacctgaatttcatgggcaacgagtttggccatcccgagtggcttgactttcccaggaaggggaacaatgagtcctatcattacgcccgcagacagttccacctgacagacgacgacttgttgagatacaaattcctgaacaattttgaccgtgatatgaaccggctcgaggagcgctacggttggcttgccgctccacaagcttacgtctcagagaagcacgaagggaataagatcatagcgtttgagcgggccggattgctatttatattcaactttcatccctccaagtcgtacaccgactaccgggtgggcactgcgcttcctggcaaatttaagattgtgctggatagcgacgccgccgagtacggagggcaccagagactggatcattccacggattttttcagcgaggcgtttgaacataacggccggccttacagtttgctggtctacatcccttccagggtggctctgatcctacaaaacgtggacctaccaaat

SEQ ID NO: 12768 - DNA, 2106 bp, Artificial Sequence
  Description of Artificial Sequence: Synthetic coding sequence
atggccgctcctatgactcccgctgcccgaccagaggactacgaagctgcacttaacgccgcgttggccgacgtccctgagttggcaaggctgcttgagatcgatccctacctgaagccttatgctgtcgactttcagaggcggtataaacagttctcacagattcttaagaatatcggtgaaaacgagggcgggattgataagttctctcggggatacgagagtttcggcgttcatagatgcgctgatggaggcctctattgcaaggaatgggcccccggggctgagggggttttcctgactggggatttcaacggctggaaccctttctcttatccttacaagaaactggattacgggaagtgggagctttatattccgccaaagcaaaacaagtcagtcctggtgcctcatgggagcaagctgaaagtggtgattacctcaaaaagcggggagatcctgtataggatctctccctgggcaaagtacgttgtgcgggagggcgacaatgttaattacgactggatacactgggatcccgagcactcttatgagtttaagcattctcgccctaaaaagcccaggagtctcagaatctacgagtcccatgttggtataagctcccacgagggcaaagtggcgagttataaacacttcacttgcaatgtgctgccacggatcaaaggccttggatacaactgcattcaacttatggcaattatggagcacgcttattacgcttccttcgggtaccagattacaagcttcttcgcagcctcctcccggtatggtacaccagaggaactgcaggagctcgtcgatacggcgcattccatgggcatcatcgtgctgttggacgtcgtgcatagtcacgcttctaagaattcagccgacggattgaatatgttcgatggcaccgactcctgctacttccattccggaccaagaggcacacacgatctctgggacagccgccttttcgcttattcatcctgggaaattctgcggtttctcctttctaacatcagatggtggctcgaggagtatcggtttgatggctttcgctttgatggtgtgacctccatgctgtatcaccaccatggtgtcggacagggatttagcggcgattactcagaatacttcgggttgcaagtggacgaggatgccctgacatacctcatgctggcaaatcacctggtacatacgctctgccctgacagtatcaccatagcagaggacgtctccggtatgcctgcattgtgttctcctatcagccagggcggggggggttttgattaccggcttgccatggcgatacccgataagtggattcagctgctgaaggaatttaaggacgaggactggaacatgggcgacatcgtttacacccttactaacagacggtacctcgaaaagtgtatcgcctacgctgaaagtcacgaccaggcgcttgtgggagataagtcacttgcattttggcttatggatgcagagatgtatacaaatatgagcgtgttgactccatttacccctgtaatcgaccgcggaattcagctgcacaagatgatcaggctcatcacacacggcctgggcggcgagggctatctgaatttcatggggaatgaatttggtcaccccgagtggctcgatttcccacgcaaaggcaataacgagtcataccattacgctcgcaggcagtttcatcttaccgacgacgatttgttgcgctacaagttccttaacaactttgatcgggatatgaaccgactggaggagagatacggatggttggccgctccgcaagcttacgtgtccgagaagcatgagggcaacaaaatcatcgcattcgaacgggcaggcctcctgttcatattcaattttcacccctccaagagctacaccgactaccgcgtgggaaccgcgcttcctgggaaattcaagattgtcttggattctgacgccgccgaatacggcgggcatcagagactcgatcattctacggattttttctcagaggccttcgaacataacggtcggccctactccctgctcgtctatataccgtctcgcgtggccctgatcctgcagaacgtagaccttccaaac

SEQ ID NO: 12769 - DNA, 2106 bp, Artificial Sequence
  Description of Artificial Sequence: Synthetic coding sequence
atggccgctcctatgactccagccgccaggccggaggactatgaagcggccctcaatgctgcactggccgacgtgcctgagttagccaggctgttggaaatcgatccataccttaagccatatgccgtggatttccagcgccggtataaacaattttcccagatcctgaagaacattggggagaacgagggagggattgataagttttccaggggatacgagagtttcggggttcacagatgcgcagacgggggtctgtattgtaaggagtgggccccaggagcggagggagtgttcttgacgggcgattttaatggttggaatccgttctcttacccctataaaaagctggactacggcaagtgggaactgtatatcccgcctaagcagaataaatccgtcttggtcccacacgggagtaaactgaaagtggtgatcacaagcaagtctggtgagattctgtaccgcatctctccctgggctaagtatgttgtcagggaaggggataatgttaattacgactggatccactgggaccctgagcattcctacgagttcaagcactccaggcccaagaagccaaggagcctcaggatctacgaatctcacgttggcatttcatcacacgagggcaaggtcgcctcctataaacacttcacgtgcaacgttctcccacgcatcaaaggactggggtacaactgtatccagctgatggctattatggaacacgcctactacgcctcatttggctatcagatcacgtctttcttcgctgcctccagccgctacggcacacccgaggagctacaggaactggtcgacaccgcacactctatgggaatcatagtgcttctggatgtggtgcactcacatgctagcaaaaattctgccgatggactgaacatgttcgacggtacagatagctgctacttccacagtgggcctcggggaacgcacgacctgtgggacagtaggctcttcgcttacagctcttgggaaatacttcggtttctattaagcaatattcggtggtggttggaggaatatagattcgacggcttccgcttcgatggcgtgacgtcaatgttataccaccaccacggagtgggacagggcttctccggtgattattccgagtatttcggcctgcaggtggatgaggatgctctcacctatctcatgctggctaatcatctcgtgcacactctctgcccagacagcatcactatcgcggaggatgtgtctgggatgcccgcgctgtgctctcctatatcccaaggggggggggggtttgactatagactggccatggcgattccagataagtggattcagctgctgaaggagtttaaggacgaagactggaacatgggcgatattgtgtatacactcaccaatagaagataccttgagaaatgcatcgcctacgctgaatcgcacgatcaagccctagtaggcgataagtctctggccttttggttgatggatgccgagatgtacaccaacatgagcgttctaacccccttcactcccgtcatcgatcgtgggattcagctccataaaatgattagactcatcacacacgggttgggcggcgagggctatctaaactttatgggcaacgagttcggtcatcccgagtggctggactttccaaggaaagggaataacgaatcgtatcattacgcccgaagacagttccacctgacagatgacgacctgctgcgatataagttcctgaacaatttcgaccgggacatgaataggctggaggaacggtatggttggctcgctgctccacaggcttacgtgagtgagaaacatgagggtaataaaatcatagcattcgaacgggccggcctgttattcatctttaatttccatccgtcaaaatcatatacagactatcgggtgggcactgctctgccaggcaagtttaagattgtcctggattccgatgctgccgagtacggaggtcaccagaggcttgaccactctactgacttttttagcgaggctttcgagcataatgggcgcccttactccctgctggtgtatattccgtctagggttgcgcttattttgcagaacgtggacttgcctaat

SEQ ID NO: 12770 - DNA, 2106 bp, Artificial Sequence
  Description of Artificial Sequence: Synthetic coding sequence
atggcagctccgatgactcccgccgcacgccccgaagattacgaggctgcccttaatgctgccctcgctgatgtgccagaactggctcggttgctagaaatagacccctacctgaaaccatatgctgtggacttccagaggcgatataagcagttctcgcagatcttgaaaaatataggggaaaatgagggcggtatcgacaagttttctaggggatatgaatctttcggcgtccatcgctgcgctgatggagggctgtactgtaaggagtgggctcccggtgctgagggggtttttcttacaggagatttcaacggatggaaccctttcagctacccctacaaaaagctggattatgggaagtgggagctgtacatcccaccaaaacagaacaaatctgtgttggtccctcacgggtccaagttaaaagtcgtgattacaagcaagtcgggcgaaatactctaccggatcagcccgtgggcaaagtatgtggtgcgggagggagacaacgtcaattatgattggattcactgggatcctgagcactcatatgagttcaagcactcaagaccgaagaagccccgctcactcagaatctatgaatcccacgttggaatctctagtcacgagggcaaagtggcctcttataaacactttacttgcaatgtgctgcctcgcattaaaggactgggctataattgtatccagctgatggccattatggagcatgcatactacgcatcattcggctatcagatcacaagttttttcgctgcctcctccaggtacggaactcccgaggagttgcaagagctcgtcgacacagcccattccatggggattatagttctgcttgacgttgttcattcacatgcctctaagaattctgccgacggtctcaatatgttcgacggtacggactcttgctattttcacagtggcccacgcggtacacacgatctctgggacagcaggctgttcgcctacagctcttgggagattctgcgatttcttctctcgaatattagatggtggttagaggagtaccgattcgatgggttcagattcgatggtgtaacaagtatgctatatcatcatcatggtgtcggccagggcttctcgggcgactactctgagtatttcggactgcaggtagatgaagatgctctgacttatctaatgctggctaatcacctcgttcatacactctgtcctgactcaatcacgatagctgaagatgtgtccggcatgcctgccctctgttccccaatatcccagggcggtggcggcttcgactacaggctggcgatggcgattcccgacaaatggatccagctccttaaggagtttaaggacgaggactggaacatgggtgacattgtgtatacactgacaaataggagatacctcgaaaaatgtattgcctacgcagaatcccacgaccaggccctggtgggcgacaagagtttggctttctggctgatggatgcggaaatgtacactaatatgagcgtgttaaccccctttaccccagtgatagaccgagggatccagctccataagatgatccggctcatcacccacggcctggggggggaagggtacctgaattttatggggaatgaatttgggcatccagaatggctggacttcccacggaaggggaataatgagtcatatcattacgcccgccgacaatttcacttgacagatgacgatttgctacgatacaaatttctcaataactttgacagggacatgaatagattagaggagcgttacgggtggcttgcagcaccccaggcctacgtctccgagaaacacgagggcaataagataatcgcttttgaacgcgcaggattactatttatttttaacttccatccttccaagtcctatactgactatagagtgggaacagccctcccaggcaagtttaagatcgtcttggattcggatgccgcagaatacgggggtcaccaaagactcgatcactcaaccgatttcttctccgaggcctttgaacacaatggccggccatactcactgcttgtgtatattccttctcgggtggcactcatcctccagaacgtggacctgcccaac

SEQ ID NO: 12771 - DNA, 2106 bp, Artificial Sequence
  Description of Artificial Sequence: Synthetic coding sequence
atggccgccccgatgaccccggccgcacgccccgaagattacgaagccgcgcttaatgcagcgttggctgatgtgccagagctcgcgcgcctgctcgaaatcgatccttaccttaagccatacgcggtcgactttcagaggcggtacaaacaattctcgcagattctgaagaacatcggtgaaaatgagggcggtatcgacaagttttcccgcggctacgagtccttcggcgtgcaccggtgtgctgacggaggactctactgcaaggaatgggccccgggggctgagggagtgttcttgactggggacttcaacggctggaaccctttttcgtacccctacaagaaactggattacgggaagtgggaactgtacatcccaccgaaacagaataagtccgtccttgtccctcatggcagcaagctgaaagtggtgatcacctcgaagagcggcgagatcctctaccggatctcaccgtgggcgaagtacgttgtgagggagggtgataatgtcaattacgactggatacattgggatcctgaacactcctatgaattcaagcattcacgtccgaagaagcctcggagcctccgtatttacgaatcccacgtcggcatcagcagccatgaaggaaaagtggcctcatataagcacttcacttgcaacgtgctgcctaggatcaagggactgggttacaattgtattcagctcatggcgatcatggagcacgcatattacgcctcattcggataccagataacttcctttttcgcggccagctcgcgctacggaacccccgaggagctgcaagaattggtggacacggctcattctatgggcattatcgtgctgctggacgtcgtgcattctcacgcatcaaagaatagcgctgatggactgaacatgttcgatggaaccgattcctgctatttccactctgggccacggggaacccatgacctttgggattcgcgcctgtttgcctacagctcatgggagatccttcggttcctgctgagcaatatccggtggtggctcgaagaataccggtttgatggcttccgcttcgacggagtgacctccatgctttaccaccaccacggggtgggacaaggattcagcggcgactattccgagtactttgggctgcaagtggacgaggatgctttgacctacctgatgctggcaaatcacctggtgcatactctgtgcccggattccatcaccatcgcggaggatgtgtctggaatgcctgctctgtgctccccgatctcgcaagggggaggtggttttgactatcgcctggctatggcaatccctgataagtggatccagttgctgaaggaattcaaggatgaggactggaacatgggcgacatcgtttacactctgactaatagaaggtaccttgaaaaatgcatcgcttacgcggaaagccacgaccaagcgttggtcggagataaatcgctcgccttttggctcatggacgccgaaatgtacaccaacatgagcgtgttgactccgtttactccggtgatcgatcgcggaatccagctgcacaagatgattcgcctcatcacccacggattgggaggagaaggttacctgaacttcatggggaacgagttcggccatccagaatggctggacttcccgcgcaaaggcaacaacgaatcgtatcactatgcccgccgccagttccatcttaccgacgacgacttgctgagatacaagtttctcaacaacttcgatagagacatgaaccgattggaagaacggtacggatggctcgcggcgccgcaggcctacgtgtccgaaaagcatgagggaaataagatcatcgcgttcgagagggctgggcttctgtttatcttcaacttccacccgagcaaaagctacaccgattacagagtgggcacggcactccccggaaagttcaagatcgtcctggattcagacgcagccgaatacggcggacaccaacgcctggaccattcaaccgacttcttctcggaggctttcgaacataacggacgtccttactcgctcttggtgtatattccgtccagagttgcactcatcctccaaaacgtcgacctgccgaac

SEQ ID NO: 12772 - DNA, 2106 bp, Artificial Sequence
  Description of Artificial Sequence: Synthetic coding sequence
atggccgctccgatgactccagctgctagaccggaggactatgaggcagcgctgaacgccgctctggctgatgtgccagagctcgcacgtctgctggagatagacccttacctgaagccatacgccgtcgatttccagcgccgctacaaacagtttagccagatactgaagaatattggcgaaaacgaaggcggcattgacaaattctcccgtggttacgagagcttcggcgtgcaccgctgtgcagatggcggtttgtactgtaaggaatgggctcctggcgctgagggagtgttccttaccggcgattttaacgggtggaacccgttttcctacccgtataaaaagctggattacggcaaatgggagctgtacatcccaccaaagcaaaacaaaagcgtcttagtaccgcatggttccaaactcaaggtcgtcattacgagcaaaagcggtgaaattctgtaccgcatctcaccatgggcgaagtacgttgtccgcgagggtgataatgtgaattatgactggatccactgggatccagaacattcctacgaattcaaacactccaggccaaagaagcctcgctccctgcggatctacgaatcccacgtgggaattagcagccacgagggcaaggttgcgagctataagcatttcacctgcaatgtgctgcccagaatcaaaggcctgggctacaactgtatccagctgatggctatcatggagcatgcatactatgcgtcttttggttaccaaataacctctttcttcgcggcttctagccgctacgggacccccgaagaactgcaggagctggtggatactgctcatagcatgggcattattgttctgctagacgttgtgcactcacacgcatctaagaactccgcagatgggctgaatatgttcgacggtaccgactcttgctatttccatagcggcccgcgcggaacccatgacctttgggatagccgcctgttcgcctatagcagctgggaaattctgcgctttctgctgagcaacattcgctggtggcttgaggagtaccgttttgacggtttccgtttcgacggtgtgacgtccatgctgtaccatcatcatggcgtgggccagggttttagcggcgattactcggaatatttcgggctgcaggtggacgaggacgcgctgacttacctcatgctggcaaatcacctagtacacaccctgtgcccggattctatcaccattgcggaggacgtgagcggaatgccggccctatgctctcctatctctcaaggcggtggaggtttcgattaccgccttgctatggcgataccagacaaatggatccagcttctaaaggagtttaaggatgaggattggaatatgggtgacatcgtgtacacgctgaccaaccgcaggtacctggaaaagtgtatcgcgtatgccgaatctcatgaccaggcactggttggtgacaagtccctggcgttctggctgatggacgcggagatgtacaccaatatgagcgtccttacccccttcacaccagttattgaccgtggtatccaactgcataagatgatacggctgatcactcatggcctgggtggtgaaggatacttgaatttcatggggaacgagtttggtcaccctgaatggcttgattttcctaggaaagggaataacgaaagctaccattatgccagacgtcaatttcatctcacagatgatgacctgcttcgctataaattcctcaataactttgaccgagacatgaatcgactggaggaaaggtacggctggttggctgcgccgcaggcgtacgtgtcagaaaaacatgagggcaacaaaattatcgcatttgaacgggccggcctgcttttcatcttcaattttcatccaagcaaaagctacacggactaccgcgtcggtactgcgctgccgggcaagttcaagatcgtgctcgattctgatgctgctgagtacggtggccaccaacgcttggatcattctacggatttcttcagcgaggcgttcgaacataatggccgcccatatagcctgttggtgtatataccgagcagggtcgctctgatacttcaaaacgtagatctgccgaac

SEQ ID NO: 12773 - DNA, 2106 bp, Artificial Sequence
  Description of Artificial Sequence: Synthetic coding sequence
atggccgccccaatgacaccagctgcccggcccgaagattacgaagcagcactcaatgctgcattagccgatgtgcctgaacttgcgcgactccttgaaatcgatccttatttaaaaccttatgccgtggatttccagagacgatataaacagttttctcagatactgaagaacatcggggaaaatgaaggagggattgataaattcagtagagggtatgagtcatttggagtgcataggtgcgctgatggagggctgtattgcaaggaatgggccccaggagccgagggagtgttccttacaggagatttcaacgggtggaaccctttttcctatccttacaaaaagctcgactacgggaagtgggagctatatattcctccaaaacagaacaaatctgtcttggtgcctcacgggtctaagctgaaagtcgtaatcacgtcaaaatccggggaaatattatataggatatccccatgggccaagtatgtagttcgggaaggggataacgtgaattatgattggatacattgggatccagagcatagttacgaatttaaacatagtcgccctaaaaaacctagatctctgaggatctacgaaagtcacgttggaatctcatctcatgaagggaaagtagcatcttacaaacattttacttgcaatgtgctcccacggatcaaagggctcgggtataattgtattcagttgatggctataatggagcacgcttactatgctagtttcggatatcagataacatctttttttgctgcctcttctcggtatggaacacctgaagagctgcaggaattagtagatacagctcactctatggggatcattgtactgcttgatgtggtgcattctcacgcctctaaaaacagtgcagatggactaaatatgttcgatgggactgatagttgttattttcactcggggccacggggaactcacgacttgtgggatagtcgtctgttcgcctactctagttgggaaatacttagattcctcctttctaatatccggtggtggctagaagaatatcggtttgatggattcaggttcgatggggtgacgtctatgctatatcatcatcacggggtagggcagggattctctggagattattctgaatactttgggttacaggtggatgaagacgccttaacatatctcatgctggctaatcatttggtccatactttatgtcccgattctattacaatagcagaagatgtaagtgggatgcctgccctatgttccccaatctctcagggagggggggggtttgactatcgcctggcgatggcaatacctgataaatggatccagcttcttaaagagtttaaagatgaggactggaacatgggagatatagtttatacattaacaaataggagatacctggaaaaatgcattgcctacgctgaatcgcatgatcaggctttagtaggggacaaatccctggcgttctggttaatggacgccgagatgtatactaacatgtctgtgctcacacctttcactcctgtgatcgatcgcgggatccagttgcacaaaatgattcgtctcattactcacggactaggaggggaagggtaccttaattttatgggaaacgaattcgggcatcccgaatggcttgatttcccacggaaaggaaataatgaatcctatcactacgcccgcagacagttccatctgacagatgatgatctcttgaggtacaagttcctcaacaactttgatagagatatgaataggttggaggaacgatacgggtggctcgctgcaccacaggcttatgtatccgaaaagcatgaggggaataaaattatcgcctttgagagggcaggactacttttcattttcaactttcatccctctaagtcctatactgattatcgcgttgggacggcccttccaggaaaattcaaaatagtccttgattcggacgctgccgaatatggggggcatcagaggcttgatcattccacagactttttttctgaagcctttgagcataatggaagaccgtacagtctgctggtatacataccttctagagtagccctcatccttcaaaatgtcgacctcccaaat

SEQ ID NO: 12774 - DNA, 2106 bp, Artificial Sequence
  Description of Artificial Sequence: Synthetic coding sequence
atggccgcccctatgactccagccgcgcggccggaggactacgaagcagcactgaacgctgccctggcggatgtgccggagctggcaagactcctggagatcgacccgtacctcaagccgtacgcagtggatttccaaagacgctataaacagtttagccaaatcctgaagaacatcggcgaaaacgaagggggaatcgataagttttcacggggatacgaatctttcggcgtccatcgctgcgcggacggaggactctactgtaaggaatgggcgccaggagctgagggagtttttctgaccggagatttcaacggttggaatccattctcctacccgtacaagaagctggactacggaaagtgggaattgtacattccgccaaaacagaacaagtcggtcctggtgcctcacggcagcaagctgaaagtggtgatcacctcaaagtcaggcgagatcctttacagaatcagcccttgggccaagtatgtggtgagggaaggagataatgtgaactacgattggatccactgggatccagagcattcttacgaattcaaacattcgcgcccgaagaaaccacgctcccttcggatctacgagagccacgtgggaatctcctcacacgaaggcaaagtggctagctacaaacacttcacctgcaatgtgctgccccggattaagggtctgggatacaactgtattcagctgatggcgattatggaacacgcatactacgcttccttcggctaccagatcacttccttcttcgcagcgtcgtccaggtacggtacccctgaagagcttcaagaactcgtcgacaccgcccactcaatgggcatcatcgtcctgctcgacgttgtgcactcgcacgcaagcaagaacagcgcggatggactcaatatgttcgacggaactgacagctgctacttccactcgggaccccggggaacccacgacctgtgggactcaagactttttgcctactcctcgtgggaaatcctgcgattcctgctgtccaacatcagatggtggctggaagaataccggtttgacggatttcggttcgacggcgtgacttctatgctgtaccaccatcacggagtggggcagggattctcgggcgactactctgaatacttcggcctgcaagtggacgaggatgcccttacgtacctgatgctcgcgaatcacctggtccacaccctgtgcccagattctattaccatcgccgaggacgtctcgggaatgcccgcactgtgttcgccaatttcgcagggcggaggaggtttcgattaccggctggcaatggccattccagacaagtggatccagctgctgaaggaattcaaagacgaagattggaacatgggagacattgtgtacaccttgactaacagacgctacttggaaaagtgcatcgcctacgccgaatcccacgaccaggccctggtcggggacaaatccctggccttttggttgatggacgcagaaatgtataccaatatgagcgtgctgacccctttcactcccgtgatcgataggggaattcagctccacaagatgatccggctgatcactcacggactggggggcgaggggtatctgaacttcatgggcaatgaattcggacacccggaatggttggactttccacgcaaggggaataatgaaagctaccattacgcgcgccggcagttccacctgaccgatgacgatctgctgcggtacaaattcctgaataacttcgaccgggatatgaaccgcctcgaggagcggtacgggtggctggctgctccacaggcgtacgtgtctgagaagcacgagggaaacaagatcatcgcgtttgagcgagcaggtttgctgttcatcttcaacttccacccatccaagtcgtacactgactaccgggtcggtaccgcgctgccgggcaagtttaagatcgtgctggactcagacgcggcggagtacggcggacatcagagactggaccactcaaccgacttcttcagcgaggccttcgaacataacggcagaccgtactcgttgttggtctacatcccctcgcgcgtggctcttatcctccaaaacgtggaccttccaaac

SEQ ID NO: 12775 - DNA, 2106 bp, Artificial Sequence
  Description of Artificial Sequence: Synthetic coding sequence
atggccgcgcccatgaccccggccgctcgaccagaagattacgaagcagccttgaacgctgccctggccgacgtgcccgagcttgcgcggttgttggagatcgacccttatcttaagccctatgcggttgattttcagcgcaggtataaacagttcagccagatcctgaagaacatcggagagaacgagggagggattgacaagttctcaagaggttatgagtctttcggcgttcatcgctgcgctgacggggggctctactgcaaggaatgggcgccgggcgccgagggcgttttcctgactggcgactttaacggttggaatcccttctcttacccatacaagaagctcgattacgggaagtgggagctatacatcccaccaaagcaaaataagtctgttctagtcccacatggaagtaagctcaaggtggtcataactagcaagtccggcgagatattgtaccgtatctctccctgggccaagtacgtcgtgagggagggggataacgtcaactatgattggatccactgggatccggaacactcatacgagtttaagcattccagaccaaaaaaaccaagatcattaaggatctacgagtcacatgtgggcatcagttcccacgagggaaaagtggcttcctataaacactttacctgtaacgtgcttccacgcatcaaaggacttggctataattgtattcagctaatggccattatggaacacgcctattacgcgtcattcggttatcagatcacgtcattcttcgcagcctcctctagatatggcacaccagaggagctgcaggagctcgtggataccgcgcactctatgggaattattgtgttactggatgtggtacattcccacgcttctaagaatagtgccgatggcctgaatatgttcgacggaaccgactcatgttatttccatagcgggccgcggggcactcatgacctctgggattcgagactctttgcttattccagctgggaaatacttcggtttctgctgtctaacattcgctggtggctggaggagtatcggttcgacggctttagattcgacggcgtcacgtctatgctctatcaccaccatggtgtggggcagggtttttcaggggactatagcgagtattttggactccaggttgacgaggacgctctgacctacctcatgctggctaatcacctggtgcacaccttgtgccctgattcaattacgatcgctgaggacgtaagcggaatgccggccttgtgttcccctatctcccagggaggaggcgggtttgattaccgcttggcaatggctattcctgataagtggatccaactcctgaaagagttcaaagacgaggattggaacatgggtgacatagtttacacgctgactaaccggaggtaccttgagaaatgtatagcatacgcggagtcccacgatcaggctctagtcggggataagagcttggccttctggctgatggatgcagaaatgtataccaatatgtcagtgctgaccccattcaccccagtaatcgacagggggattcaactgcacaagatgattcggctgatcacacatgggctgggcggagagggctatctgaattttatgggaaacgagtttggccatccggagtggctcgatttccctcggaagggaaataatgagagttatcattacgctagacggcagtttcatttgaccgacgatgacttgttacggtacaaattcctgaacaatttcgatcgcgatatgaatcggctggaggagcgttacgggtggctcgctgcaccacaggcttacgtctccgagaagcatgaggggaacaaaatcatcgctttcgaacgagcggggctgctgttcattttcaacttccatcctagcaagagttatactgactaccgtgtgggtaccgcactcccgggcaagttcaagatcgtcttggacagtgatgccgctgagtatggggggcaccagcgacttgaccattccactgactttttctctgaggcattcgaacataacggcagaccctattcactcctggtgtatattccctcccgggtcgcccttatcctgcagaacgtggacctgcccaac

SEQ ID NO: 12776 - DNA, 2106 bp, Artificial Sequence; identical to SEQ ID NO: 12754
  Description of Artificial Sequence: Synthetic coding sequence

SEQ ID NO: 12777 - DNA, 2106 bp, Artificial Sequence
  Description of Artificial Sequence: Synthetic coding sequence
atggccgcgccaatgacaccggcagctcgtccggaggactacgaggcggcactgaacgccgcattggccgatgtgccggagttagcgcgtctgctggaaattgatccatatttgaagccctacgccgttgacttccagagacgatacaaacagttttctcaaattctgaagaacataggtgagaacgagggtggtatcgataagttctcacgcggctatgaatcctttggagtgcatcggtgcgcagatggtggattgtactgcaaagagtgggcacccggcgccgaaggggtctttctcacgggagatttcaatggctggaaccccttctcgtatccgtacaagaagctagattacggcaagtgggagttgtacataccgccgaaacaaaacaagagtgtactcgtgcctcatgggtccaagctgaaggtcgtgatcacgtccaagtcgggggagatcctttaccggatatccccctgggcgaagtatgtggttcgggagggagacaacgtcaactacgactggattcactgggacccggaacactcctatgaattcaaacactcccgcccaaagaagcctagaagcctgaggatttatgagagtcacgttggcattagctcccacgagggcaaggtggcctcgtacaaacacttcacatgtaacgtgttgccccgcatcaagggccttggatacaactgcattcagctgatggcaatcatggagcatgcctactacgcgagcttcggctatcagatcacatcgttcttcgccgcatcatcccggtacggaaccccagaggagctgcaggaactggtcgatacggcccacagtatgggcatcatcgtcctgctggatgtcgtacactcacacgcttccaaaaattcagccgacggactgaatatgttcgacggcacggattcctgctacttccatagcggacccaggggaacacatgacctgtgggattcgaggctgttcgcctactcaagctgggaaatcctcaggtttctgcttagcaacattcgctggtggcttgaagaatatcggtttgacggcttccgttttgacggcgtgaccagcatgctgtatcaccatcacggtgtcgggcagggattctcaggagattactccgagtactttggtttgcaggtcgacgaggacgcgctcacgtatctcatgctcgccaatcatctagtacataccctgtgccccgacagcatcacgattgcggaagatgtgtccggcatgcctgcgttgtgttcgccaattagccaaggtggcggcggattcgattatcggttggcgatggctatcccagacaagtggatacagctcctgaaggagtttaaggatgaggactggaatatgggcgacattgtttacaccctgactaatcgaagatacttggagaagtgcattgcctacgctgagagccatgaccaagcattggtcggagacaaatccctggcattttggcttatggatgccgagatgtacaccaacatgagcgttctgaccccctttactccagttatcgatcgaggcatacaactgcataagatgatcagacttatcacgcatgggctgggcggggaaggatatttgaattttatgggcaacgaattcggtcacccagagtggctggacttcccacgtaagggaaataatgagtcctaccactacgccagacgacagtttcatcttacggatgacgatctacttcggtataagtttttgaacaactttgaccgtgatatgaatagactggaagagcgctatggctggctggccgcgccacaggcctatgtgagtgagaagcatgagggaaacaagattatagccttcgaacgagcgggattgttgtttatttttaattttcacccctcaaagagttacacggattatcgcgtgggcacagccctaccgggcaagttcaagattgtcctcgactcagacgcggccgagtacggcggacatcagaggttggatcattcgaccgatttcttttcagaggcgttcgaacataacggtcgcccgtacagcctccttgtgtacattccaagccgagtggccctgattctgcagaacgtagacttgcctaat

SEQ ID NO: 12778 - DNA, 2106 bp, Artificial Sequence
  Description of Artificial Sequence: Synthetic coding sequence
atggccgcgccaatgacccctgcggcgcgaccagaggactatgaagccgcactcaatgccgctctcgctgacgtgccagaacttgcaaggctccttgaaatcgatccataccttaagccctacgcagtggacttccaaaggcggtacaagcagttttcacagatactcaaaaacatcggcgagaacgaaggtggcatcgataagttttcgagagggtacgaatcatttggcgttcacagatgcgccgatggaggtttgtactgcaaagagtgggcccctggggcagagggtgttttcctgaccggagactttaacggatggaacccattttcatacccgtacaaaaagctggattacggcaagtgggagctttacattcccccgaagcaaaacaagtcggtcctcgtgcctcacggatcgaagctgaaggtcgtcataacctcgaagtccggggaaattctgtacaggatttcaccttgggccaagtacgtggtgagggaaggagataatgtgaattatgactggattcactgggaccctgagcactcctacgagtttaaacattcaagacccaagaagccccgttccctgcggatttacgaatcacatgtgggaatttcgagccacgagggaaaggttgccagctataagcattttacttgtaacgtgcttcccagaatcaagggactgggatacaactgtattcaactgatggcgatcatggaacatgcatactacgcatccttcgggtaccagatcacttcgttttttgcagcaagttcgcgatacggaactccggaggaactccaagaacttgttgatacggcgcactcgatgggtattatcgtgcttctggatgtcgtgcattcgcatgcgtcgaagaacagcgcagatggtttgaatatgttcgatggtaccgacagctgttacttccattcaggaccccggggaacccatgacctctgggactcaagactttttgcttactcctcgtgggagatcttgcgctttctgctgagcaacattcgatggtggttggaagaataccgatttgatggctttcggtttgacggcgtgacttccatgctgtaccatcaccatggagtcggacagggattctcaggcgattacagcgaatactttggactgcaggtggatgaagatgcactcacgtacctgatgcttgcaaatcatcttgtgcacaccctttgccctgatagcattactattgcagaggatgtgagtggaatgccagcactctgtagcccgattagccaaggtggcgggggttttgattacagacttgcaatggctatcccagacaagtggatccaactgcttaaggaattcaaggacgaagattggaatatgggagatattgtgtacaccctcaccaatcgccgctacctcgaaaagtgtatagcctatgcagagtcgcatgaccaagctctggtgggtgataagtcgctcgccttttggcttatggatgccgaaatgtacaccaacatgtcagtgctgaccccctttactccggttattgatcggggaatccaactgcataagatgattcgccttattactcatgggcttggaggtgaaggctacctcaatttcatgggtaatgagtttgggcaccctgagtggcttgactttccacggaaaggtaataacgagtcctatcattatgcaagacgccagttccacctgaccgatgatgatcttctccggtacaagtttctgaacaactttgatagggatatgaaccgcttggaggaacggtacggatggcttgccgcaccgcaggcatacgtcagcgaaaagcatgagggaaacaagatcattgcatttgaaagggcaggtttgcttttcattttcaatttccatcctagcaagtcctacactgactaccgagtggggactgcactgcccggcaagtttaagatcgtgctggactcggacgcagcagagtacggaggacaccagcgtcttgatcattcaactgactttttctcggaggcgttcgaacacaacggacgaccttactcgctgctggtgtacattccttcaagagtggccctgatcctccagaatgtcgacctccccaat

SEQ ID NO: 12779 - DNA, 2106 bp, Artificial Sequence
  Description of Artificial Sequence: Synthetic coding sequence
atggccgcccccatgacgccagcggccagacccgaggactacgaggccgctctgaatgctgctctggctgacgttcctgaacttgcccgcctcctggagatcgacccctatctgaaaccctatgctgtggactttcaaaggcgttacaagcaatttagccagatcctgaagaacattggtgagaacgaggggggaatcgataaattcagtaggggctatgagtccttcggagtccaccgttgtgccgacggcggcctgtattgcaaagaatgggcacccggcgccgagggcgtgtttctgacgggggatttcaatggatggaacccctttagttacccatacaagaagctggattacggaaaatgggagctgtatattccacctaagcagaataagagcgtgctggtaccccatggaagcaagctgaaggtagtgatcacatccaagagtggggaaattctctatcgtatctctccttgggctaagtatgttgtccgcgaaggcgacaacgtaaactatgactggatccattgggaccctgagcacagctatgagtttaaacacagtagaccaaagaagccgcgctctctgaggatctatgagagtcacgttggtattagctcccacgagggcaaggtggcctcgtacaaacacttcacctgcaatgtgctgcctcgaatcaaaggactgggttacaattgtattcagctgatggcaatcatggaacatgcgtattacgcatcatttggatatcagatcacctccttctttgccgctagttccaggtacggcacgcctgaagagctgcaggagctggtggatacagcccacagtatggggataattgtgctgctggacgtggtgcactcacatgctagcaagaattcagcagatggtctgaacatgttcgatgggacagactcttgttactttcattcaggcccccgaggcacacatgacctatgggactctcgactgttcgcctactctagctgggaaattctccgctttctgctgtctaatatcagatggtggcttgaggagtaccggttcgatggcttccgttttgacggggttacaagcatgttataccatcatcacggcgtgggacagggtttctcaggcgattactctgagtacttcggccttcaggtcgacgaagatgccttgacatacctgatgctggctaatcacttggtccacacattatgccccgactctatcaccattgcagaagacgtgtcaggcatgcccgcgctgtgcagccctatctcccagggaggcggaggctttgactacagattagcaatggcaatcccggacaaatggatccagctcttgaaggagtttaaggatgaggactggaatatgggagacatcgtttacaccctgacaaaccgccggtacctcgagaagtgtatcgcctacgccgagagtcatgaccaagcattggtgggcgacaaaagcctggccttttggctgatggatgcggagatgtacacaaacatgagtgtccttaccccgttcacaccggtaatcgatcgtgggatccaactgcataaaatgataagactgatcacacacgggttaggaggcgaaggttacttgaattttatgggaaacgagttcggccatcctgaatggctggactttcctcgcaaaggaaacaacgagtcatatcattacgctcggcggcagtttcacctgactgacgatgacctgctcagatacaaatttctaaacaattttgaccgagacatgaacagactcgaagagagatacgggtggttggccgcaccacaagcatacgtgtcagagaagcatgagggaaataaaataatagcctttgaacgtgccggattgctgtttatcttcaacttccatccctcgaagagctacacagattaccgggtgggtaccgcgctgcctggcaaattcaagattgttctcgattccgacgcagctgaatacggtggtcatcagcgtcttgaccatagcacagactttttctcagaggcattcgagcacaacgggaggccctactctctcctggtttatattccttcccgcgtcgctctgattctgcagaacgtggacctgccgaat

SEQ ID NO: 12780 - DNA, 2106 bp, Artificial Sequence
  Description of Artificial Sequence: Synthetic coding sequence
atggcagcacctatgactcctgcagcaagacctgaggactacgaagcagctctgaacgctgcactggccgacgtgcctgagctggcaagattgcttgaaattgatccatacctcaaaccttacgcagttgactttcaacgaaggtataaacagttctcacaaatcctgaagaacataggagagaacgaagggggaatcgacaaattctcccgcggatacgaatcatttggcgtgcatcgatgtgctgatggtgggttgtactgtaaggaatgggcgcctggtgcagaaggtgtgtttcttacgggagatttcaatggttggaatccattcagctacccttacaagaagctggattacggcaagtgggaactttacattccacctaaacaaaacaagtccgtgcttgtccctcatggaagcaagctcaaagtggtgataacgtcgaaaagcggagagattttgtaccgcatttcgccttgggcaaagtacgtggttcgagaaggtgataacgtgaattacgattggatacattgggaccctgagcactcatacgagtttaagcactcgcgcccaaaaaagcctagaagccttagaatttacgagtcccatgtcggaatatcaagccacgagggtaaagtggcctcatacaaacacttcacctgtaacgtgcttcctcgcatcaagggattgggatacaattgcatccagcttatggcaattatggaacatgcctactacgcgtccttcggataccagattacctcgttcttcgcggcatcatcacggtacgggacccccgaggagctgcaagaactcgtggatactgcacattcaatgggcattatcgtccttctggatgtggtgcactcccacgcatcgaagaactccgcggatggactcaatatgttcgatggcaccgattcgtgttactttcactcgggaccccgcgggactcatgatctgtgggattctcgcctgttcgcatactcgtcatgggagattttgagatttctgctttccaacattaggtggtggctggaagaataccggttcgatggatttagatttgacggagtgacttcaatgctgtaccaccatcacggggtcggacaaggtttctcgggcgattactctgagtacttcggacttcaggtcgacgaagatgcactgacctacttgatgctcgcaaaccatctggttcatactctctgtccagattcaatcaccattgccgaagatgtctcaggtatgcctgcactgtgttcgccaatttcacaaggtggcggggggttcgactacagactggcaatggccattcccgataagtggattcagcttctgaaggagtttaaagacgaggactggaatatgggcgatattgtctacaccctcactaataggagatacctcgaaaagtgtatcgcatacgccgaatcgcatgatcaggcactggtgggtgataaatcactggcattttggctgatggacgcagagatgtatactaacatgagcgtgctgaccccttttacccccgtcatagatagaggtattcaacttcataagatgatcagactgatcacccacggtcttggaggagaaggttacctcaactttatgggaaacgaattcggacatccagaatggttggattttcctcggaaagggaacaacgaatcgtaccattacgctaggaggcaatttcacctcaccgatgatgacctgctgcggtacaaatttctgaacaatttcgatagggacatgaatcgccttgaggaacgatacggctggctggccgccccgcaagcgtacgtgagcgagaaacatgaaggtaacaagattatcgcatttgagagagccggtctgcttttcatattcaattttcaccctagcaaatcatacacggattatcgtgtcggcactgcactccccggaaagttcaagattgtcctggatagcgatgccgcagaatatggggggcaccagcgtctggatcactcgacggactttttctctgaagcattcgaacacaatggtagaccttacagccttctggtgtacatccctagccgggtggcacttatcctgcagaacgtggacctgccaaac

SEQ ID NO: 12781 - DNA, 2106 bp, Artificial Sequence
  Description of Artificial Sequence: Synthetic coding sequence
atggcagccccgatgactcctgccgcaaggcctgaagattatgaggcggccttgaacgccgcactggcggacgtccctgagcttgcccgcctgctggagatcgacccatacctgaagccgtatgccgtggactttcagcggagatacaaacaattttcgcaaatcctcaagaacattggggaaaatgaagggggaatcgataagttctcacgaggttacgagtcgtttggcgtccacagatgtgccgacgggggactctattgcaaagagtgggctcccggtgctgagggagttttcctgactggagactttaacggttggaacccgttctcgtacccgtacaagaagctcgactacggcaagtgggagctttacatcccgccaaagcaaaacaagtccgtgctggtcccacatgggagcaagctgaaggtcgtgatcacttcgaagagcggagaaatcctctatagaatttcgccctgggctaagtacgttgtgcgagaaggtgacaacgtgaactacgattggatccattgggatcccgaacactcctacgaattcaaacatagccggcccaagaagccgcgcagcctccggatctacgagagccacgtcggaatttcctcgcacgaaggaaaagtggcgtcgtacaagcactttacctgcaacgtgctgccgcgcatcaagggcctcggttacaactgtatccagttgatggcaatcatggagcatgcctactatgcatcattcggctaccagattacttcctttttcgccgctagctcgcgctacggtactcctgaagagctgcaagaactggttgacaccgcccactcgatgggcattatcgtgctgctcgatgtggtccacagccatgcatcgaagaactcagcggacggactcaacatgtttgacggtaccgacagctgttactttcactcgggacctcgcggcacccacgatctgtgggacagccgccttttcgcatactcctcgtgggagattcttcgcttcttgctgtcgaacattcggtggtggctcgaagaataccggttcgacggatttcggttcgacggggttacctctatgctctaccatcaccacggggtgggccagggcttctcaggcgactacagcgaatacttcggactccaagtggatgaggacgcattgacgtacctgatgctggctaatcatctggtgcataccctctgcccggactccatcactatcgccgaggatgtcagcgggatgccggcactgtgttcgccgatctcgcagggtggcggtgggtttgattacagactggccatggcaattcccgacaagtggatccaactgctgaaagagttcaaggatgaagattggaatatgggagacatcgtctacactctgaccaatagacgctacctggaaaaatgtattgcgtacgccgaatcacatgaccaggctttggtcggggacaaatcactggcgttctggctgatggacgccgaaatgtacaccaacatgagcgtgctgactcctttcaccccagtgatcgaccgcggaatccaactgcacaaaatgatccgcctcatcacccatggattgggaggcgaaggatacttgaactttatgggcaatgaattcggacatccggagtggcttgacttcccgcggaagggcaacaatgaatcgtaccattacgccagacggcagttccacctgacggatgatgacctcctcaggtacaagttcctcaataacttcgacagggatatgaaccggctggaagaacggtacggatggctggcggctcctcaggcttacgtttcagaaaagcacgaaggtaacaagatcatcgctttcgaacgcgctgggctgctgttcattttcaactttcacccatcgaagtcttacactgattatcgggtgggaactgcgcttccggggaaattcaagatcgtcctcgactcagacgcggcagaatacggcggacaccagcgcctggatcattcgactgactttttcagcgaagcatttgagcacaacggacggccatactcgctcctggtgtacatcccatcgcgggttgcgctgatcctgcagaatgtcgaccttcctaat

SEQ ID NO: 12782 - DNA, 2106 bp, Artificial Sequence
  Description of Artificial Sequence: Synthetic coding sequence
atggcagcacctatgaccccggcagcgcggccagaggactacgaagcggcacttaacgccgccctcgcggatgtgcccgaactcgcgagactgctcgaaatagatccctatttgaaaccatatgcagtggatttccaaagacggtataaacaattttcgcagattctgaagaatatcggtgagaacgagggtggaattgataagttcagcaggggatacgagtcatttggagtgcatcgttgtgctgatggcggtctgtactgtaaggaatgggctcctggagcagagggtgtgttccttaccggtgatttcaatgggtggaacccgttttcatacccatacaaaaaacttgattacgggaagtgggagctctacatcccacctaagcaaaacaagtcagtccttgttccgcacggctccaagctgaaggtcgttattacttcgaagtcaggggaaattctttatcgcatctccccttgggccaagtacgtggtgagagaaggggacaatgtgaactacgattggatccactgggatccagaacattcctacgaattcaagcattcgcggccgaagaaacctaggtcgctgagaatatacgagtcccatgtgggcatctcctcgcacgaggggaaggttgcatcgtacaagcatttcacctgtaatgtgctgcctcggataaagggtctggggtacaactgcattcaactcatggcaataatggaacacgcctactatgcatcgtttggataccaaattaccagctttttcgcagcttcgtcgagatacggtaccccagaagagcttcaagaactggtcgacaccgcacattccatgggtatcatcgtgcttctcgacgtggttcattcacatgcctctaagaacagcgcggacggactgaatatgtttgatggaacggattcatgttactttcactcgggtccccggggaactcatgatctctgggacagcagactttttgcatactccagctgggagatacttagattcctgctttccaatattcggtggtggctcgaagagtaccgttttgatggattccgttttgacggagtgacctccatgctttaccatcaccatggagtcggccaaggattttcaggtgattattcggaatactttggccttcaggtggacgaagatgcactcacttacttgatgcttgccaatcacttggtgcataccctgtgtcctgattcgatcaccatcgccgaagatgtctccggaatgcctgcactctgttcccccatcagccaaggtggtggtggattcgattaccgacttgccatggcgattcccgataaatggatacagctgctcaaagaattcaaagacgaagattggaacatgggggatattgtctacaccttgactaatcgaaggtacctggaaaagtgcattgcatacgcagaatcccatgatcaagctctcgtgggagacaaatcacttgcattctggcttatggacgcagagatgtacaccaatatgagcgtgctgaccccgtttacccccgtgatcgaccgtggcattcaactgcataagatgatccgcctgattacgcatggcttgggtggtgagggttacttgaatttcatggggaatgaatttggacatccagaatggctggatttcccaagaaaggggaacaacgagtcataccactatgcacggcggcagtttcatcttactgacgacgaccttctgaggtacaaatttctgaataacttcgatcgggatatgaaccgcctggaagagaggtacggatggctggcagcacctcaggcatatgtgtccgagaaacacgagggaaacaagattatcgcatttgaaagggcaggacttcttttcattttcaacttccacccatccaagtcgtacactgactacagagtcggtactgcactgcctggaaagtttaagatcgtcctcgattcagatgcggcagaatacggaggtcatcagcgcctggaccacagcactgactttttcagcgaagccttcgaacataacggaaggccatactcgcttttggtgtacatacccagccgcgtggcgctgattctgcagaacgtggatctccctaac

SEQ ID NO: 12783 - DNA, 2106 bp, Artificial Sequence
  Description of Artificial Sequence: Synthetic coding sequence
atggcggcccctatgacgcctgctgcccgacctgaggactatgaggctgccctaaacgcagcacttgcagatgtgccagagctggcacggttgctagagatagatccatatctgaagccctacgctgttgacttccaaaggcggtataaacaattttcccaaatactgaaaaatattggagaaaatgagggtggcatcgataagttctccaggggctacgagtccttcggcgtccaccgctgcgccgatgggggactttactgcaaagagtgggctcctggtgctgaaggagtctttttgactggtgacttcaatggctggaatcctttttcatatccatacaaaaagctcgattacggaaagtgggagctgtatatcccacctaagcagaataagtctgtgctggttccccatggctcaaagctaaaagtcgtgatcaccagcaagagcggggagattctgtaccgcatatccccatgggccaaatacgtggtccgtgagggagacaatgtgaactatgactggattcactgggatccagaacattcctatgagtttaagcactcccggcctaaaaaaccgcgcagtctacggatctacgagtcccacgtgggaatctcaagccacgaagggaaagttgccagctataaacattttacgtgtaatgttttaccacgcataaaaggcctaggatataattgtattcagcttatggctatcatggaacacgcatactatgcctcattcggataccagataacctctttcttcgcagcctcttctcggtacggaacccctgaggaactgcaggagcttgtcgatacagctcactccatgggtatcattgtattactggatgtggtgcattcccatgcttccaaaaactccgctgatggccttaacatgttcgatggtacagacagctgttactttcactccgggccaagaggcacccatgacctctgggatagcaggctattcgcatatagctcctgggagatactccgctttctgctgtccaacatccgttggtggcttgaggagtatcggttcgacggattcagatttgatggcgtgacatccatgttatatcaccaccacggagttgggcagggcttttctggagattactccgaatattttggactgcaggtagacgaggatgccctgacgtatctgatgcttgcaaatcatctggtccatacgctgtgccctgacagcattacgatcgcagaggatgtttccggtatgcccgcattgtgcagccccattagtcagggcggagggggttttgattaccggttagcaatggccataccagataagtggatccagctgctgaaagagttcaaagacgaggattggaatatgggtgatatcgtttacactctgaccaataggcgctatctcgaaaaatgcattgcttatgcggaatcgcatgatcaagctctggtgggcgacaaaagcctggcattttggctgatggatgccgaaatgtataccaatatgagtgtcctgacaccattcaccccggttattgaccgcggaatccagctgcataaaatgattcgactgatcacacacggtcttgggggagaaggctacctcaacttcatgggcaatgagttcggccacccggaatggctggacttccccaggaaaggaaacaatgaatcctatcattacgcacgcaggcagttccacctgaccgatgatgacttgctgagatacaaatttctcaacaactttgaccgtgacatgaaccggctcgaggagcgctacggctggttggctgcaccccaagcgtacgtatctgaaaagcacgagggaaacaaaatcattgcctttgagagggctgggttgctcttcatattcaattttcatcctagcaaatcatataccgactaccgagtgggaacagccctgcctggcaagttcaaaatcgtcctggattcagatgcggctgagtatgggggccatcagcgtttggatcattccacagacttctttagtgaggccttcgagcacaacggacggccatattcgctgttggtgtatatcccgtctcgggtcgccctcatcctccagaatgtggacctacccaat

SEQ ID NO: 12784 - DNA, 2106 bp, Artificial Sequence
  Description of Artificial Sequence: Synthetic coding sequence
atggccgcccccatgactccagccgcccggcctgaggactacgaggccgctctcaatgcagctctggccgacgtgccagagctcgcccgattgttggagatagatccctacctgaagccttacgctgtggatttccagcggaggtacaagcaatttagccaaatactaaagaacattggggaaaacgaaggcgggattgacaagttcagccggggatatgagagctttggcgttcacagatgcgcagatggcggactgtactgcaaggagtgggcgccaggcgcagagggcgtattcctcacaggagatttcaacggctggaatcctttcagctacccgtataagaagctggactacggtaagtgggagctttatattcctccaaaacaaaacaagtcagtcctggttccacatggctcgaaattgaaggtggtcatcacctctaagtctggcgagattctgtatagaatctccccttgggccaagtatgtggttagggagggcgacaatgtgaattatgactggatccactgggaccccgaacactcttacgaatttaagcatagccgccccaagaaaccacgcagcttgagaatctacgaatctcatgtggggatcagctctcacgaaggcaaggtggccagctacaaacattttacttgcaacgtgctcccgagaattaagggcttgggttataactgcatccagctcatggccattatggagcatgcatactatgcctcttttggctatcagatcacctcgttcttcgcggcatcttccaggtacggtacacctgaagagctccaagagctggttgacaccgcacactctatgggaatcatcgtcctcctggatgtggttcacagtcacgctagcaagaattcggcagatgggctgaacatgtttgatggcaccgacagttgctacttccatagcggccctagaggaacacacgacctttgggattctaggctctttgcttactctagctgggaaatcctgcgattcctgctgagtaacattagatggtggctggaggaatacagattcgacgggtttcggtttgatggagttactagcatgctgtaccaccaccacggtgttggacagggctttagcggcgattacagcgaatatttcggtctgcaggttgacgaagacgctcttacatacctgatgctcgccaaccacctggtgcacactctgtgccctgacagtataaccattgctgaggatgttagtggcatgccggcgctgtgcagcccaatctctcaaggcggaggcgggttcgactacaggttggcaatggcaatccccgacaaatggattcagttattgaaggagttcaaagacgaagactggaacatgggagatatcgtttatactctgacaaatcgtagatacctggagaagtgtattgcctacgccgaaagccatgatcaagcccttgtgggcgataaatcactcgcattttggctgatggatgctgaaatgtacaccaatatgtctgtcctgacacctttcacccctgttatcgatcgtggtatccaactgcacaagatgataaggctgataactcacggcctcggaggcgaagggtaccttaactttatgggaaacgaattcggacacccagagtggctcgattttcctaggaaggggaacaacgaaagttaccactacgcgagacggcagttccatcttaccgacgatgatctcttgcgctacaagttcctgaacaatttcgatagggacatgaacaggctcgaagagaggtacggttggctcgctgcaccccaggcctatgtgagcgagaagcacgaaggcaacaagatcatcgcttttgaaagagccggtctgctgttcattttcaacttccacccttcaaaatcatacacagactacagggtcggcactgcattgcccggaaaatttaaaatcgtgctggattccgacgccgcagagtacggagggcaccagcgactggatcatagtacggactttttctccgaagcattcgagcataacggaagaccttacagtctgctcgtttacattcccagccgtgtcgcgcttatcctccagaatgtagatctccctaat

SEQ ID NO: 12785 - DNA, 2106 bp, Artificial Sequence
  Description of Artificial Sequence: Synthetic coding sequence
atggctgcccctatgaccccggccgcacggccggaagattacgaagccgccctcaatgcggcactcgcggatgtcccagaactggccagactgctggaaatcgacccctacttgaagccatatgctgtggactttcagcggcgctacaagcagttctcacaaattctgaagaacatcggagagaacgaaggaggaatcgacaagttctcacgcggatacgaatcgttcggagtgcaccgatgtgccgacggtggcctctactgcaaggagtgggctccaggagccgaaggagttttcctgactggggatttcaacggatggaacccgtttagctacccatacaagaagctcgattacggcaagtgggaattgtacatccctcctaaacaaaacaagagcgtcctggtgcctcacggatccaagctgaaggtggtcatcacctccaaaagcggtgaaatcctctaccggatctccccgtgggccaagtacgtcgtgagagaaggcgataacgtgaactatgactggatccactgggacccggagcactcgtacgaattcaaacactcaaggccgaagaagcctcgctctctcagaatctacgaatcacacgtgggaatctcgtcgcacgaaggaaaggtggcctcctacaagcacttcacttgcaacgtcctcccacgcattaaaggattgggatacaactgcatccagctcatggcgatcatggagcatgcatattacgcgagcttcggctaccagatcaccagcttctttgccgcgtcctccaggtacggaacgcctgaagagcttcaggaactggtggataccgctcatagcatgggaatcatcgtcctgctggacgtcgtgcactcgcatgcgtccaagaactcggcggacggattgaatatgttcgacggcactgactcatgttacttccactcgggaccgcgcggcacccacgacctctgggactcacgcctgttcgcctactcctcatgggagatcctccgctttttgctgtcgaacatcagatggtggcttgaagagtacagatttgacggcttccgcttcgacggagtgacctcgatgctgtaccaccatcatggggtgggccaagggttctcgggagattactcagaatacttcggactgcaggtcgatgaagatgctctgacctacctcatgctggccaaccacttggtgcacactctctgcccggacagcatcactatcgcggaggacgtcagcgggatgccagccctgtgctccccgatctcgcaaggcgggggcggtttcgactaccgattggctatggcgattcccgataaatggatccaactgctcaaggaattcaaggacgaggactggaacatgggagatatcgtgtataccctgactaatagacgctacctggaaaagtgcatcgcctacgccgagagccatgatcaggcccttgtcggggacaaatcgctggcattttggctcatggatgccgaaatgtacacgaacatgtccgtgctgactccgttcactccagtcatcgaccggggaatccagttgcacaagatgatcagactgattactcatggactcggaggagaaggttacctgaatttcatgggcaacgaattcgggcaccctgagtggctggactttccaaggaaaggcaacaacgaaagctaccattacgcccgccgccaattccacttgaccgacgacgacctcctgcgctacaagtttctgaacaatttcgacagggacatgaaccgcctggaagaacgctacggctggctggcagcgccgcaggcttacgtttcggaaaaacatgaaggaaataagataatcgccttcgagcgcgcgggactgctgttcatcttcaactttcacccgtccaaatcgtataccgactacagggtgggtacggccctgcctggaaaattcaaaatcgtgctggattctgacgccgcggagtacggaggccaccagagactcgaccactcgactgacttcttttcggaggcctttgaacataacggtcgcccgtattctctcctcgtctacatcccaagcagagtggcccttatcctgcagaatgtggatctgccgaac

SEQ ID NO: 12786 - DNA, 2106 bp, Artificial Sequence
  Description of Artificial Sequence: Synthetic coding sequence
atggcagctcctatgacccccgccgctaggcctgaggattacgaggccgccctcaacgcagccttggctgatgtgcctgagctcgcccggctgctcgagatcgacccgtatctgaagccttatgctgttgattttcaacgaagatataagcaattttcccagatcctcaaaaacattggagagaacgagggaggaatcgacaaattctctcgaggctatgaatcatttggggtgcataggtgtgctgacggcggactgtactgcaaggagtgggcccctggagcggaaggagtatttctgactggcgactttaacgggtggaatcccttctcctacccgtacaagaagctagattacgggaagtgggagctgtacattcccccaaagcaaaataagagcgtactggttccacacggaagcaagcttaaggtggtcataacatcaaaatctggtgaaattctctatcgtatcagcccctgggccaagtacgtggtgagggagggtgacaacgttaattacgattggatccactgggatccagaacattcgtacgagttcaagcatagcaggcccaagaaacccaggagcttgcgaatttacgagtctcacgttgggatcagctcccacgaggggaaggtcgcatcctacaagcattttacctgtaacgtgcttccccggattaagggcctcggctacaactgcattcaacttatggctatcatggagcatgcatactatgctagcttcggttaccaaattacttctttcttcgctgcttccagtaggtatggcacgccagaagagcttcaggagttggtagacactgcccatagtatgggaattatcgtgctgctggatgtggtccatagccacgcaagtaagaacagtgccgatgggctcaatatgttcgacggaactgactcctgttactttcatagtgggccccggggcactcatgatctatgggactctcgattgttcgcctattcaagctgggagattctgcgctttctgttaagcaatattaggtggtggttggaggaataccggttcgatggatttcgcttcgacggtgtgacttcaatgctgtaccatcatcacggcgttggacaaggtttcagcggtgactacagcgagtactttggtcttcaagtggacgaggacgccctgacttatttgatgctagcaaaccatctggtgcatactttgtgtcctgatagtatcaccatcgctgaggacgtgtcaggcatgccagcgctgtgttcgccaatcagccagggtggtggcgggttcgactacaggttagctatggccatccctgataagtggatacaactgctgaaggagtttaaggatgaagattggaacatgggcgatatcgtctacacactgactaaccgtcggtacctcgagaagtgtatcgcttatgcagagtcccatgatcaagccctggttggggacaagtcacttgctttttggttgatggatgcggagatgtatactaacatgtccgtactgacgcccttcactcccgtgattgacagagggatccagctccacaaaatgatccgcctcatcacccatggcctaggaggcgaggggtatcttaactttatgggcaacgagtttgggcatcccgagtggctcgatttccctcgcaagggtaacaatgagtcctaccattacgctaggaggcagttccatttgactgacgacgacctcctcagatataagttccttaataactttgaccgggatatgaaccgactcgaagaacgatatgggtggttggcagcaccacaagcctacgtgtccgagaaacacgagggaaacaagatcatagcgtttgaacgagctggcctgttatttatatttaattttcacccctccaagagctacactgactacagagtggggacggctcttcctggcaaattcaaaatcgttctggacagcgatgccgccgagtacggcgggcatcagagacttgaccattcaaccgatttcttcagcgaagcatttgagcataacggacgcccatatagtctgcttgtctatatcccaagtagggtcgcgctaattttgcaaaacgtggacttgccaaac

SEQ ID NO: 12787 - DNA, 2106 bp, Artificial Sequence
  Description of Artificial Sequence: Synthetic coding sequence
atggcagctcccatgaccccagcagcaagacctgaagattatgaggcagctctgaatgctgcactcgcagatgtgccagagcttgcaaggctcttggagattgatccatacctaaagccctatgcggtggactttcagcgtagatacaagcagttcagccaaatcctgaagaatatcggggaaaatgagggaggaattgacaagttttctcgcggctatgagtcctttggagtgcataggtgcgcggacggtggcttatactgtaaggagtgggcgcctggtgctgagggcgtgttcctgactggcgattttaacggctggaatcccttttcatatccttacaagaagcttgactatggtaagtgggagctatacatccctccaaagcagaacaaatcagttctcgtgccccatgggtcaaaattgaaagttgtgatcactagtaagtctggtgagatcctttaccggatcagcccgtgggctaagtacgtggtgagagagggagacaacgtgaactatgactggattcactgggatcccgaacactcatacgaatttaagcatagtcgacctaaaaaacccagaagcctacgaatctatgagtcacatgtgggcatctcctcacacgaaggtaaggttgcgtcctacaagcatttcacatgtaatgtactgccacgtataaagggcctcggctataattgcatccagctcatggccatcatggaacatgcctattatgcctcattcggttaccaaatcacttcttttttcgcggcgagctcacgttatggtactcctgaggagcttcaggagctcgtggataccgcacactctatgggcattatcgtgctgcttgacgttgtacacagccacgcaagtaagaatagcgccgacggactaaatatgtttgatggaacagactcatgttacttccattcgggaccccgcggaacgcatgatctgtgggattctcggttgttcgcgtacagttcatgggagatcctccgcttccttttatcaaatattcggtggtggctcgaagaatacagatttgacgggttcaggtttgacggagtgacgtctatgctgtaccatcatcacggagtggggcaggggttttcgggcgattactcagaatattttggccttcaggtggacgaggacgcactgacctacctgatgctcgcaaaccatcttgtgcatacactctgtcctgactcaatcaccatcgccgaagatgtgagtggcatgcctgcgctatgtagcccgatcagccagggcggaggcggctttgattataggctggcaatggccatccccgacaaatggatccaattgcttaaggagtttaaggatgaagactggaatatgggcgatatagtttacacactcacaaaccggagatatctggaaaaatgcatcgcttacgccgaatcccacgaccaggccctcgtcggcgataaaagccttgcattctggttgatggatgctgaaatgtataccaatatgtccgtactgacacctttcacaccagttatcgacaggggtatccagctgcacaaaatgatccggcttatcacccacggcttgggtggtgagggatacttgaatttcatgggaaacgagtttggtcacccggaatggctggacttcccacgcaagggtaataatgagtcgtatcactacgctcggcgccaatttcacctgaccgatgatgacctgttgaggtataaatttctgaataatttcgacagggacatgaatcggctcgaagagaggtatggctggctggctgctccccaggcttatgtctctgagaagcacgaggggaataagatcattgccttcgagagggcaggcttgctgttcatcttcaatttccacccttccaagtcctacacagattaccgagtgggaacggccctgcccggaaaattcaaaatagttctggatagcgacgctgccgagtacggcggacaccagcgcttggaccactccacagatttcttctctgaggcctttgaacacaacggtcgcccatattctttgcttgtgtacattcctagtcgggtcgctctcatactgcagaatgtggatctgccaaat

SEQ ID NO: 12788 - DNA, 2106 bp, Artificial Sequence
  Description of Artificial Sequence: Synthetic coding sequence
atggcagccccgatgactcccgccgccaggcccgaagactatgaggcagcgctgaatgccgcactggccgacgtcccggaactagcacgtctcctggagatcgatccatacctgaagccttacgctgtggactttcaacgccgttacaaacagttcagtcagattctgaagaacatcggagaaaacgaaggggggattgacaaattcagccgtggatatgaatcctttggcgtgcacagatgcgccgatggcgggctgtactgcaaggaatgggctcccggcgccgagggggttttcctcaccggcgactttaacgggtggaatcctttttcttatccctacaagaagcttgattatggaaagtgggagctctacattccccccaaacagaacaaaagcgtcctggtgccccacggatccaagctgaaagtggttataacctcgaaatcaggggagatcttgtaccgcatcagcccctgggccaaatacgtcgtgagagagggggataatgtgaattatgactggatacattgggatccggagcacagctatgaattcaagcattcccgccccaagaagccgcgttctcttcgcatctacgaaagccacgtgggaatctcttcccacgaaggtaaggtagcatcgtacaagcatttcacctgcaacgtgctgccacgtatcaagggtcttggttataattgtatacaattaatggccattatggaacatgcatactacgcgagctttggttaccaaatcaccagcttctttgccgcctcttctcgatatggcacacctgaagaactgcaggagctcgttgacacagctcatagcatggggatcatagttcttctggacgttgttcacagtcacgccagcaagaactcagccgatgggctgaacatgttcgatggcacggactcttgctacttccactcaggaccaagggggacccacgacttgtgggattcaagattgtttgcttacagttcgtgggagatccttaggtttctgctgtccaacatacgctggtggctggaagagtacagatttgatgggttcagattcgacggagtgacaagtatgctttatcaccaccatggagttggacaaggattttccggggactactcagagtattttggcctgcaggtcgatgaggatgccctcacttatctgatgctggccaaccacttggtgcatacattatgtcctgattctataaccattgctgaggacgtctcgggtatgcctgctctgtgtagccccatctcacaggggggcggcgggtttgattatagactcgcaatggcaattcctgacaaatggattcagctgcttaaggagttcaaagatgaggactggaatatgggggatatagtgtacacactgaccaatcgtaggtatctggaaaagtgcatcgcctacgccgaatcacatgatcaggctctggtcggtgataaatcattggctttttggcttatggacgccgaaatgtataccaacatgagcgtgctaacaccgttcacacctgtcatcgataggggaattcaactccacaagatgattcggctgatcacgcacggactcggcggcgagggttacctgaatttcatgggaaatgagtttgggcatcccgagtggctcgacttcccccgcaaagggaacaatgagagctatcattatgccagacgccagtttcaccttaccgacgatgatctgcttagatacaagtttctgaataactttgaccgcgatatgaacagactcgaggaacggtacgggtggctggccgctccccaggcttatgtctcggagaagcacgaggggaataaaatcatcgctttcgagagagctgggttactattcatctttaattttcatccaagcaagtcgtatacagactatagggtgggaactgctctgcccggtaaattcaagattgtgctggactcagatgcagctgaatatggtggccatcagcgcctggaccattcgacagatttttttagcgaagccttcgaacataatgggcgcccctacagtcttcttgtatacatcccaagtagggtagcactgatcctgcagaatgtggatcttcccaac

SEQ ID NO: 12789 - DNA, 2106 bp, Artificial Sequence
  Description of Artificial Sequence: Synthetic coding sequence
atggcggctccaatgactccagcagcccgcccggaggactatgaggcagcccttaacgccgcactggcagacgttccggaactcgcccgcttgctggagattgacccgtacttgaagccatacgcggtcgacttccaacgcagatataagcaattctcgcagatcctcaagaacatcggtgaaaacgaaggcggcatcgataagttctctcgcggatacgagtcattcggagtccacaggtgcgcggatgggggtctgtactgcaaggaatgggctcctggggcagagggtgtgttcctgaccggggacttcaatggatggaacccgttcagttacccgtacaaaaagttggattatggcaaatgggagttgtatatcccgcctaagcagaataagtcggtcctggttccccacggatcgaaattgaaagttgtgatcacgagcaagtcgggggaaatcctgtacagaatctcaccttgggcgaaatacgtggtgagagaaggggacaatgtcaactacgactggatccactgggaccctgagcattcgtacgagtttaaacatagccggccgaagaagccacggagcctccgcatctatgaatcacacgttggaatcagcagccacgaaggaaaggttgctagctataaacacttcacttgcaatgtcctcccgcgcatcaagggactcggatacaactgtatccagctgatggcaattatggagcacgcctactatgcttcgttcggatatcagatcaccagcttctttgccgcatcctcccgctacggaacccccgaagaacttcaggagctggtcgacactgcacatagcatgggtatcatcgtccttctggacgtggtgcatagccacgccagcaagaatagtgccgacgggctcaatatgtttgatggaaccgactcctgctactttcattcgggtcctagaggcactcacgatctgtgggactcccggctgttcgcgtactcaagttgggagatcctcagattccttctgagcaacatccggtggtggctcgaagagtaccggtttgacggatttcggttcgatggcgtgacttcgatgctctaccaccaccacggagtgggccagggattctcaggcgactactcagaatactttggactccaggtggacgaggacgcgctgacctacctgatgcttgctaatcacttggtgcatacgctctgtccagattcgatcaccatcgcggaggatgtgtcgggaatgcccgccctctgctctccgataagtcaggggggaggaggatttgactacagactcgctatggccatccctgacaagtggatccagctgctcaaggaattcaaggatgaagattggaacatgggagacatagtgtacaccctgaccaaccgacgctacctcgaaaagtgcattgcctacgccgaatcccacgatcaagcgttggtgggagataagtcactggcattctggctcatggatgcggagatgtacactaacatgtcggtgctgactccgttcactccggtgatcgacaggggaatccaactgcataagatgattaggctcatcacccatggcctcggaggggagggatacctgaatttcatgggaaatgaattcggacacccagagtggctcgatttcccaagaaagggaaacaatgaaagctaccattacgcccgccgtcaattccacctgacggatgatgatctgctgcgctacaaattcttgaacaactttgaccgggacatgaaccgcctggaagagaggtacggttggctcgcagccccgcaggcctacgtcagcgagaaacacgagggcaacaagattatcgcgtttgagcgggcgggcctgcttttcatcttcaactttcatccctccaagtcgtacaccgactaccgagtcgggactgccctgccgggtaaattcaaaatcgtgctggactcagacgcagcggaatacggtggacaccagcgcctcgaccattcaaccgactttttctccgaggcctttgaacacaacggacgcccatactcgctgttggtgtacattccttcacgggtcgccctcatcctgcagaacgtcgacctgccgaac

SEQ ID NO: 12790 - DNA, 2106 bp, Artificial Sequence
  Description of Artificial Sequence: Synthetic coding sequence
atggccgctcccatgacccctgcggcgcgtcctgaagattatgaagcagcgctcaatgccgccttggccgatgtacccgagctggcccggttactggagattgatccctatctgaagccatatgctgtcgactttcagaggagatacaaacagttcagtcagattctcaagaatattggcgagaatgagggaggaatcgacaagttttctcgcggatatgagtcattcggcgttcatcggtgtgccgacggggggctttattgcaaggagtgggctccgggagccgaaggtgtgtttcttacaggagactttaacggatggaatcccttcagttatccatataagaagttggattatggcaaatgggagttatacatccctcccaaacagaacaaatccgtcctggtgcctcatggttcaaaactcaaggtagtgattacatccaagtccggagagatactgtataggatttcgccgtgggccaaatatgtggtgcgcgagggagataacgtgaattatgactggattcactgggacccagagcatagctatgagtttaagcatagtcggcccaaaaagccacgcagcctgcggatttatgagtcccatgtaggcatttcttctcacgagggaaaggttgccagttacaagcacttcacgtgcaatgtgttgccccgaattaaggggctcggctataactgcattcagttgatggccataatggagcacgcctactatgcttccttcggctaccaaatcacgagtttctttgcggccagctccaggtacgggaccccagaggagctccaggagctggttgataccgcccactcgatgggcataatcgtgctcctcgatgtagtgcacagtcatgcttctaagaacagcgccgatgggctcaacatgtttgacggaactgattcatgctactttcactctgggcctcgaggaacgcatgacctgtgggactctaggttatttgcctactcttcttgggagatcttaagattccttctctccaatatcaggtggtggctggaggaataccgattcgacggattccgttttgacggtgtcacatctatgttgtatcaccatcacggcgtcggccaggggttctctggggactacagcgaatactttggccttcaggttgatgaagacgcactgacttaccttatgctagctaaccacctcgtgcacacgttgtgcccagactctattactattgcagaggacgttagtggaatgcccgcactgtgtagcccgatctcccagggggggggagggtttgattataggctggcaatggccatcccagataagtggatacagttacttaaggagttcaaggacgaagactggaacatgggtgatattgtctacaccctgacaaacagacgttacctcgagaaatgcatcgcctatgcagagagtcacgatcaagctctcgtaggagacaagtccctcgccttctggctaatggacgcagagatgtatactaatatgtccgtgctgaccccgttcacccctgtgatcgaccgcgggattcagttgcacaaaatgatccggctcattactcatgggttaggaggggaggggtatctgaacttcatggggaatgagttcggacaccccgaatggttagactttccccgaaaaggcaataatgaaagttatcattacgcgagacgccagttccacctgacagacgacgacctgctcaggtacaagttcctcaacaattttgaccgagacatgaaccgcctggaagagagatatgggtggttggcagcccctcaagcatatgtgtctgagaaacacgaaggcaataagattatcgccttcgaacgagctggcttgctgtttatatttaacttccaccccagcaagagctatacagactacagagtagggaccgctctacccggaaagttcaagattgttcttgattctgatgctgccgaatacggcggccaccagcggctggatcactccacggatttcttcagcgaggcgttcgaacataatggcagaccctactcactgcttgtgtacatcccctccagagtggccctaatcctgcagaacgtggatctgccaaat

SEQ ID NO: 12791 - DNA, 2106 bp, Artificial Sequence
  Description of Artificial Sequence: Synthetic coding sequence
atggcggcccccatgacacccgccgcccgccccgaggattacgaggccgccctgaacgctgcattggctgatgttccagagctggcacgcctgttggagatagatccatatctgaagccttacgctgtggatttccaacggagatacaaacaatttagtcagatcctcaagaatatcggcgagaacgaagggggaatagataaattttccaggggctacgaatctttcggcgtacatagatgcgcggacggaggcctctactgcaaggaatgggctcctggcgctgagggcgtatttttgaccggggattttaacggttggaaccccttctcttatccctataagaaactggattatggcaagtgggaactgtatatacctcccaagcagaataagagcgttctggtcccccacggcagcaagctcaaagtggttattacctccaagagtggggagatactctaccggatctctccgtgggccaaatacgtagtgcgcgagggcgataacgtaaattacgactggattcactgggatcccgagcacagctacgagttcaagcactctcgaccgaagaagcctagatcactccggatttatgagagtcacgtaggaatcagttctcatgagggaaaggttgcctcatacaaacactttacatgcaacgttctgccacggattaagggcctgggatacaactgtatccagctgatggccatcatggaacatgcctactacgcctcctttggttatcagataacctccttctttgccgccagtagtcgctacggcaccccagaagagttgcaagagctcgtcgatacagcccactccatgggaataattgtgctcctcgacgtggtgcactcacacgcgtccaagaattctgcggacggtcttaacatgtttgatggtacagatagctgctattttcacagcggacccaggggtacccatgatctgtgggattcaaggctgtttgcttacagttcctgggagattttgcgcttcttgttgagcaatatcaggtggtggctggaagagtataggtttgacgggtttaggttcgacggcgtcacatctatgctttaccatcatcacggcgtcggacagggctttagcggcgattacagcgaatactttggactccaggttgacgaggacgcactgacttaccttatgctggccaaccacctggtacacactctctgccccgactctataactatcgcagaggacgtgagtggaatgccagccctgtgtagcccgattagccaaggcggaggggggtttgattaccgcctcgcaatggcgatacccgataagtggatccagctgttgaaggaattcaaggatgaggattggaacatgggagacatcgtatacaccttgacgaacagaagatacctggaaaaatgtatcgcctatgcagaaagccacgaccaggccctcgtgggcgacaaaagccttgccttttggctcatggacgccgagatgtacaccaacatgtctgtcttgacgccgtttacgcctgtgatagatcgcggaattcaattgcataagatgatccggttgatcacgcatggactgggcggagaggggtacctcaactttatggggaatgagtttggtcatccagagtggctcgatttccccaggaagggcaataatgaaagctatcactatgcaaggagacagtttcacttgacagatgatgatctgctccgatacaagttcctgaacaattttgatagagatatgaaccgcctggaggagagatatgggtggctggccgcccctcaggcgtacgtgagcgaaaagcatgagggcaacaagataatagcctttgagagagcaggcctgctgtttattttcaacttccacccttctaaaagttacactgactatcgggtggggaccgccttgccgggtaaattcaagattgtgctggacagtgacgctgctgaatacggaggtcaccagcggctggatcattccactgacttctttagtgaagcatttgagcacaatgggaggccctattctctgctggtttacatacccagcagggtggcgttgattcttcaaaacgtggatctccccaac

SEQ ID NO: 12792 - DNA, 2106 bp, Artificial Sequence
  Description of Artificial Sequence: Synthetic coding sequence
atggccgctcccatgacacccgccgctcggcctgaagactacgaagccgcgcttaatgccgctctggctgacgtacctgaactggccagattgctcgagatcgacccgtacctaaaaccctacgcggtagattttcaaaggcgttataagcagttctcacagattctgaaaaacataggagagaacgagggagggattgacaaattttcccgggggtacgagtctttcggagtgcaccgctgcgccgatggcggcttatactgcaaggaatgggcccctggcgctgagggtgtgtttctgaccggcgatttcaatggttggaacccttttagctacccgtacaagaagctggactacggcaagtgggagctgtacattccccctaagcagaataagagtgtactagtccctcacgggtccaaacttaaggtcgtgattacctcaaaatcaggcgagatcctgtacagaatttccccctgggccaaatacgtagtccgagaaggggacaatgtcaactacgattggatacattgggaccctgagcatagctatgaatttaaacatagtaggcccaaaaagcctcgctctctcagaatctatgaaagccatgtaggtatctcttctcatgagggcaaagtggcgtcctataagcattttacatgtaatgtgctgccaagaatcaagggtctgggatataattgcatccagctgatggccatcatggaacatgcatattacgcctcctttgggtaccaaataacgtccttctttgcagcaagctcacggtatggcacacccgaggaactacaggaactagttgacactgcccatagtatgggtatcatcgtccttctggatgtggttcatagccacgccagtaagaactccgctgatgggcttaacatgtttgacggcactgactcttgttatttccatagtggccccaggggtactcacgacctgtgggacagtcgcctgttcgcctactcaagttgggagatcctccgtttcctgctatcaaacatccgctggtggctagaggagtatcgcttcgatggttttaggttcgatggggtcacatccatgctctatcatcaccacggggttggccaaggcttttccggcgactacagcgagtacttcggactccaagtcgacgaggatgccctaacgtacctcatgctcgccaaccacctggttcatacactgtgcccggatagcataacaatagcggaggacgtgtccgggatgcccgcgttgtgctcccctatctcccagggcggtgggggctttgactatcggctcgccatggctattcccgacaaatggatccagctacttaaagaatttaaggatgaagattggaacatgggtgacatcgtgtacacattgacaaacaggaggtatttggaaaagtgtatcgcatacgctgagagtcatgaccaggctctggtgggggacaagtctctggctttctggttaatggacgctgagatgtacacaaacatgtccgtgttgacacccttcacccccgtgattgaccggggcatccagttgcacaaaatgattaggttgattacgcacggtctgggcggcgagggctacctaaactttatgggcaatgagtttgggcatcccgagtggctcgattttcccagaaaaggcaataacgaatcctatcattacgcaagacgccagttccacctcacagacgacgacctcctgaggtacaagttcctgaacaacttcgatcgcgatatgaaccggctcgaagaacgatacggttggctggccgctccccaggcatatgtaagcgaaaagcacgaaggaaataaaattatcgccttcgagcgggctggccttctgtttatatttaatttccacccttccaagtcttacaccgattatcgagtaggaaccgcgctacccggcaagtttaaaatcgtgctcgactcagacgctgcagaatatgggggccaccaaagactcgaccattccactgattttttctcagaagcttttgagcataatggcagaccctactccttgttggtgtatatccccagtcgtgttgctctgatcttacagaatgtggatctgcccaac

SEQ ID NO: 12793 - DNA, 2106 bp, Artificial Sequence
  Description of Artificial Sequence: Synthetic coding sequence
atggccgccccaatgacacctgcagccaggcctgaagactacgaggccgccttaaacgcggccctcgcggacgtccccgagttggcaagacttctggagattgacccatacctgaagccatacgcagtcgattttcaacgccggtataagcagttttcccagattctgaagaatatcggagagaatgaagggggcatagacaagttctccaggggatacgagtccttcggggtgcaccggtgcgccgatggagggctgtactgcaaagaatgggcgcccggagctgagggagtcttcctcactggagattttaacggatggaacccttttagttatccgtacaagaaactggattatggcaagtgggaactgtacatccctcccaaacagaacaagtccgtccttgtgccccacggaagcaaactgaaggtggtcataacgagcaagtccggagagattctgtatcggatctctccttgggccaagtacgtggtgcgtgaaggcgacaacgtgaactatgactggatccactgggacccagaacacagttatgaatttaagcattccaggccaaaaaaaccccgcagcctgaggatctacgaatcacacgttgggatcagctcccatgaaggtaaggtggccagctacaaacactttacctgcaacgtcctgcctcggatcaagggtttgggttacaattgcatacagcttatggcaattatggagcacgcctattacgcatccttcggttaccaaatcacatcattctttgccgcttcctcacgctatggtactcccgaggagcttcaagagctggtagatacggctcattcaatgggcatcatcgtgttactggacgtggttcactcacatgctagcaaaaactcagccgatggccttaacatgtttgatggaactgatagctgttactttcactcaggcccccgcgggacacacgacctgtgggattctaggctgttcgcctatagcagttgggagatactgaggtttttgctgtcaaacatccggtggtggttagaggagtacagatttgacggtttccgctttgacggagtgacaagcatgctttatcatcatcatggggtgggtcagggattctctggggactacagcgaatatttcggcttgcaagtggacgaagacgctctgacctacttgatgctggctaaccacctggtgcacaccctgtgccctgactctatcaccattgcagaagacgtgtcaggaatgcccgcactctgttcacccatcagccaggggggaggcggctttgactacaggctggccatggccatacccgataaatggatacaactgctcaaagaatttaaagatgaggattggaacatgggggatatcgtctatactctgactaatagaagatacctggaaaagtgtattgcctacgctgaaagccacgaccaggcgctggtgggcgataaaagccttgccttttggttgatggacgctgagatgtacaccaacatgtcagtgctcaccccatttacccccgttatagaccggggcatccagcttcacaagatgatcagactcataactcatgggctgggaggtgaaggatatcttaattttatgggaaatgaattcggccacccagaatggctggattttcccaggaaaggaaataacgagtcctatcactacgctcggcgccagttccatctgaccgacgatgatctcctgagatacaaattcctgaataacttcgaccgagacatgaaccgtctggaagaaaggtacggctggctggctgccccccaggcctatgtgagtgaaaaacacgaaggaaacaagattattgcatttgaaagggctggcctcctctttatatttaacttccaccctagtaagagctacacagattacagagttggaaccgctctgcccggcaagtttaagatcgttctagattctgacgctgcggagtacgggggacaccagcgcctcgatcactctacagatttttttagcgaagcttttgagcacaacggacgaccctattccctgcttgtgtacatcccgtccagggtcgccctgatcctccagaacgtggacctccccaat

SEQ ID NO: 12794 - DNA, 2106 bp, Artificial Sequence
  Description of Artificial Sequence: Synthetic coding sequence
atggcggcaccaatgacacccgccgctcggcccgaagactacgaggccgctctcaacgcggccctggccgatgtgcctgagctcgcccgtctgctggagattgatccttatctaaaaccctacgccgtggactttcagcgacggtacaagcagttttcacagatcctgaagaacatcggcgaaaacgaaggcggaattgacaagttcagtagagggtacgagagcttcggcgtccatcgctgcgctgacgggggactctactgcaaggagtgggctccaggggccgaaggtgttttcctgacaggtgacttcaacggctggaatcccttctcctatccatataaaaagctcgactatggcaagtgggagctgtatatcccacctaaacagaataagagcgtgctcgtgcctcatgggtcaaagctgaaggtcgtaattacttccaagagcggcgagattctctatcgaatctccccctgggctaagtacgttgtcagggagggggacaacgtgaactatgactggattcattgggatccagagcactcgtacgagttcaagcattcgagacccaagaaaccccgctccctacgaatttacgaatcccacgtgggaatctctagccatgagggtaaggttgcttcctacaagcactttacgtgtaacgtgttaccccgaatcaagggcctgggctacaactgtattcagctcatggctatcatggagcacgcgtattacgcgtctttcgggtaccagatcacttcatttttcgcagcctcatcaagatatggtacgcccgaggaactacaagaactcgtcgataccgcacattcaatgggcattatcgtcctgttggacgtggtccactctcatgcttctaagaactctgccgacggtctcaacatgttcgacggcaccgattcttgctacttccatagcgggccgagagggactcacgacttgtgggattctagactgttcgcttattcgtcttgggaaattctgcggtttcttctaagcaacatacgatggtggcttgaagagtaccgttttgacggcttcaggttcgacggtgtgacgagcatgctatatcatcaccacggcgtgggccagggcttctccggcgattacagcgagtactttggtctgcaggtcgatgaggatgctcttacctacctcatgctggctaaccatcttgttcataccctgtgtccagatagtatcacaattgcagaggacgtgtctggaatgcctgccctttgctcccccatcagccaaggcggaggagggtttgactatagattagcaatggccatccccgacaagtggatacaacttttgaaagaattcaaagatgaagattggaacatgggtgacatcgtatacactctcactaatcgccgatacctcgaaaaatgcatagcatatgccgaatcgcacgatcaggccctagtaggggataaatccctggctttttggctcatggatgcagagatgtacaccaacatgtccgttctgaccccattcacacctgtcattgaccgagggatccagctccacaagatgatccgccttattacccatggacttggtggcgagggatacctcaattttatggggaatgaatttggtcacccagagtggttggactttccacggaaggggaataatgagtcctaccattacgcaaggcggcagttccacctaacagacgacgatctcctgaggtataaattcctgaacaacttcgatcgcgatatgaaccgcctggaagaacgctatggttggctcgcagcccctcaggcatacgtgtctgaaaagcacgagggcaacaagatcatcgcttttgagcgcgcggggctactgttcatcttcaatttccacccttctaagtcttacactgactaccgggtgggcacagccctaccggggaaatttaagattgttctggacagtgacgctgcggagtatggggggcaccagcggctggaccatagtactgactttttttctgaggcatttgagcataacggcagaccttattcattactggtatacataccctcccgcgtggccttgatcctccagaacgtggatcttcccaac

SEQ ID NO: 12795 - DNA, 2106 bp, Artificial Sequence
  Description of Artificial Sequence: Synthetic coding sequence
atggcggctcccatgacacccgcagccagaccggaagattatgaggcggcattaaacgccgctcttgctgacgtaccagagttggcccgactgcttgaaatagacccctacctgaaaccttacgccgtggatttccagaggagatataaacagttcagccagatcctcaagaacattggggagaacgagggcggtatcgacaagttttcccggggatatgaaagctttggcgttcacagatgtgccgatggcgggctgtactgcaaagagtgggcacccggcgcagagggtgtgtttctcaccggagactttaacggatggaaccccttttcctatccttacaaaaaactggattacgggaaatgggagctgtatattccacctaagcaaaataagagcgttctggtcccacacgggtcaaagctgaaggtagttatcacaagtaagagtggggagatcctatatcgcattagtccatgggccaaatacgtggttcgcgaaggcgacaacgttaattatgactggatacactgggaccctgagcattcctatgaattcaagcattcacgcccgaaaaaacctaggagcctgaggatttatgaaagccacgtgggaattagttcccacgagggaaaggtggcaagctataagcactttacatgcaatgttctccctcgcatcaagggacttggttacaactgtattcagctgatggctataatggaacacgcctactatgcatccttcggttatcaaataacttcgttctttgcagcaagcagtcgatacgggactcccgaggaactgcaggagctggtcgatacagctcactccatgggaatcatcgtgctgctcgacgttgttcactcacacgcctcgaagaacagcgcagatggactgaatatgtttgatgggaccgatagttgttactttcactccggtccaaggggcactcatgacctttgggatagccgactctttgcctatagtagctgggagattctccgattcctgctgtcgaatattcgttggtggcttgaagaataccgatttgatgggttcaggttcgatggtgtgaccagcatgctgtaccaccatcacggagtcgggcagggtttttccggtgactacagtgagtactttggcctgcaggtggacgaggacgccctgacatacctgatgttggcaaatcatttagtccacacgctttgccctgacagcatcaccatcgctgaagatgtctctggtatgccggccttgtgtagccctattagtcagggcggtgggggatttgattacagactggcgatggccatccccgataaatggatacagttgctgaaggaatttaaagacgaggattggaacatgggtgacattgtgtataccctcaccaacaggcgctacctagaaaagtgtattgcatatgccgagtcacacgaccaggcgctggtgggggataaatcgttagcattttggctgatggatgctgaaatgtacacaaatatgtctgttctcacccccttcactcctgtcatcgaccgcggtatccagctgcataagatgattcgactaatcacacacggactgggaggcgagggctacctgaactttatgggcaatgagttcggccatcctgagtggctagatttccctcggaagggaaataatgagtcctaccattatgccaggcgccagttccatctgaccgacgacgatctgctgaggtacaagttcttgaacaactttgaccgggatatgaatagattggaggagcgctatgggtggttggccgccccccaggcgtatgtctccgaaaagcacgaaggcaacaaaatcatagcttttgagagggcaggccttctgttcatatttaatttccacccatctaaaagctatactgattacagagtagggaccgccctccctggcaagtttaagatcgtgcttgattccgacgcagccgaatacggtgggcatcagcggttggaccacagtaccgacttcttttctgaggcctttgagcacaatgggcgcccttactccttactggtttacatcccctcacgagtagcgctaattctacagaatgttgacttgccaaac

SEQ ID NO: 12796 - DNA, 2106 bp, Artificial Sequence
  Description of Artificial Sequence: Synthetic coding sequence
atggcagccccaatgacgccggccgcacggcctgaggattacgaggcagccctcaatgccgcgctggctgacgtgcctgaattggcaagactgctcgaaatcgacccttacctgaagccttacgccgtcgacttccagcggcgttacaagcagttctcccagatcctcaagaacatcggagagaacgagggcggaatcgacaagttctccagaggatacgaatcgtttggagtgcaccgctgcgccgacggaggactgtactgtaaggaatgggcaccaggggcagagggggtctttcttaccggcgatttcaatggctggaacccattctcatatccttacaaaaaactcgactacggaaaatgggagctctacatcccgcccaagcaaaacaagtccgtcctggtcccacacgggagcaagttgaaggtggtgatcacttcaaaatcgggcgaaatcctctaccgcatctccccgtgggccaaatacgtcgtcagggagggagacaacgtgaactacgattggatccattgggacccagaacacagctacgaatttaagcattcgcggcccaaaaagccgcgctccctccggatttacgagtcccatgtgggaatctcgtcccatgaaggaaaggtggcgtcgtacaagcacttcacttgcaatgtgctgccgcggattaagggccttggatacaactgcatacagctgatggcgatcatggaacacgcctactacgcgtccttcggataccaaattacgtccttcttcgctgcgtcgtcacgctacggaactcctgaggagcttcaggagctggtggacaccgctcattcgatgggcattatcgtgcttctcgacgttgtccactcccacgccagcaaaaatagcgcggatggactcaacatgttcgatgggaccgacagctgctacttccatagtggaccgcgcgggacccacgacttgtgggacagcagactgttcgcttactcgtcgtgggaaatcctgcgcttcctgctctcaaacattcggtggtggctggaagagtaccgctttgacggttttagattcgacggagtgacgagcatgctgtaccaccatcatggcgttgggcaaggattttcgggcgactactccgaatatttcggactccaggtcgatgaggacgccttgacctatctgatgctggcgaatcaccttgtccatactttgtgcccggactccatcactatcgccgaagatgtgtcggggatgcccgctctctgctcacctatctcgcaaggaggcggaggtttcgactaccgcctggctatggcaatcccggataagtggatccagctgctgaaggagttcaaagacgaggactggaacatgggcgacatcgtgtataccctgaccaaccggcgatacctggaaaagtgtatcgcttacgctgaaagccacgatcaagccctggtgggagataaatcgctggcgttctggctgatggatgccgaaatgtacactaatatgtccgtactgaccccattcactcccgtgatcgaccgcgggatccaactccataaaatgatcagactgatcacccacggtctgggtggagaaggatacctcaatttcatgggaaatgagttcggccatccggagtggctcgattttccgagaaagggcaacaacgaatcataccactacgcccggaggcagttccacctgactgatgacgacctgctgagatacaagttcctgaataactttgatcgggatatgaatcggctcgaagaaaggtacggatggctcgccgcaccgcaggcctacgtgtcagaaaagcacgagggaaacaagatcattgccttcgaacgcgcgggcttgctgttcatcttcaactttcacccgagcaaatcatataccgactacagggtgggtaccgcccttccgggcaagttcaagatcgtcctggacagcgacgcggcggaatacgggggtcaccagcgcctcgatcactctactgattttttctccgaagcctttgagcataacggtcgcccgtacagcttgctcgtgtacattccatctcgagtggcactgatcctgcagaacgtggatcttccaaat

SEQ ID NO: 12797 - DNA, 2106 bp, Artificial Sequence
  Description of Artificial Sequence: Synthetic coding sequence
atggcggcacctatgacacccgctgcccgtccggaagactatgaagccgctttgaacgctgccctagctgatgtgcccgaactggcacgcctgttagaaatcgacccttatttgaaaccatacgcagtcgactttcagcgacggtacaagcagtttagccagattctcaaaaacatcggcgaaaacgaaggtggaatcgacaagttctctagaggctatgaaagttttggtgtgcacagatgtgccgacggcggattatattgtaaggaatgggccccaggagccgagggcgttttcctgaccggcgactttaacggatggaaccccttttcttacccctacaagaaactggattacggcaaatgggaactttacatcccaccaaagcagaataagagcgtgttggtaccacatggaagtaaactcaaagtcgtgatcacctctaaatctggcgagatcctctaccggatctccccttgggccaagtatgtggtccgagaaggtgataacgtcaactacgactggatccactgggaccccgagcacagctatgaattcaagcattccagaccaaagaaaccaagatcgctcagaatctacgagagccacgtcggaataagttcccatgagggcaaggtggctagctataagcactttacctgcaatgttcttcctcgcataaaggggctggggtacaactgcattcaactgatggctatcatggaacatgcctactatgcttcgttcgggtaccagatcactagcttcttcgctgcaagctcaagatacggcacccctgaagagctgcaggagctggtggataccgcgcacagcatgggcataatcgtactgctggatgtcgtgcactcccatgcaagcaagaattcagctgatgggctcaacatgttcgatgggaccgactcgtgctactttcatagcgggcctagaggaactcacgatttgtgggatagcagactgttcgcgtatagctcttgggagatcctgcggtttctcctcagtaacatacggtggtggcttgaggagtatagattcgacggtttcagatttgatggtgtcacgagcatgctgtaccatcatcacggcgtaggccagggcttcagcggagactactctgaatattttggcctccaggtggacgaagatgctctgacttacttgatgctcgctaatcacctggtccatacactatgcccggatagcatcactatcgccgaagacgtcagcggcatgcccgccctgtgcagtccgataagccagggaggaggaggattcgactatcggctcgccatggccatcccagataagtggatacaactcctaaaggagttcaaagacgaagactggaatatgggggacatcgtctacaccctgaccaaccgtaggtacctggagaaatgtatcgcatacgccgagagccacgaccaggctcttgttggagacaagagcctggccttttggctgatggacgccgaaatgtatacaaatatgtcagtactaaccccatttacaccagtcattgacagaggcatccaactccacaagatgatccggttgattacacacggtctgggtggggaagggtaccttaactttatggggaacgaattcggacatccggaatggttagactttccccgaaaaggaaacaacgagtcttaccactatgcaaggagacaatttcatcttaccgatgacgacctgctcaggtataagtttcttaacaactttgatagagatatgaatcggctagaagagcgctacggatggctcgcagcccctcaagcctatgtgtccgagaaacatgagggaaacaagataatcgctttcgagagggcaggactgctcttcatctttaactttcatccatcaaagtcctacacagattaccgcgtgggaaccgccctcccaggcaagttcaaaattgtgcttgactctgacgctgccgaatatgggggccaccagagactcgaccatagcaccgactttttctcagaggctttcgaacacaatggtcggccttactcactgctcgtctacatcccgagcagagtcgcactgatccttcagaacgtggatttgcccaat

SEQ ID NO: 12798 - DNA, 2106 bp, Artificial Sequence
  Description of Artificial Sequence: Synthetic coding sequence
atggcggccccgatgaccccagccgctcgccccgaggattacgaagctgcactgaacgccgctctcgcagatgtcccagaattggccagattgctcgagatagatccatacctgaagccctacgctgttgactttcagcgacgatacaaacagtttagccagatcctcaagaacataggcgagaatgagggtggcatcgacaagtttagcaggggctatgagtccttcggcgtccacagatgcgctgatggcgggctctactgtaaggagtgggccccaggagccgagggagtgttcctaactggagactttaatgggtggaatccatttagctacccatacaagaagctggactacgggaagtgggagctttacattcccccaaagcaaaacaaaagcgtcctcgtaccacacggctccaagctgaaggttgtgatcacgtcaaaatcgggcgagatcctctaccggatttccccttgggctaaatatgtggtacgcgaaggggacaacgtgaattatgattggatccactgggatccagagcatagctacgagtttaaacatagtcgccctaaaaagccccggtcattgcggatctatgagagtcatgtcggcatcagcagccacgagggcaaagtggcgtcctataagcacttcacctgcaacgtcctacccagaatcaaaggactggggtacaattgtatccaactgatggctatcatggaacacgcttattacgcctcctttgggtatcagatcacctcgtttttcgccgcttcttcccggtatggaactccagaggaactgcaggaattggtcgacaccgcccattccatggggatcatcgtgctcttggacgtcgtgcactctcacgccagtaagaactctgccgacggccttaatatgtttgacggaacggactcgtgctacttccacagtggtccccgagggacccacgatctgtgggacagccggcttttcgcctactctagctgggagatcctgcgttttctgctcagtaacatcagatggtggttagaggagtatagattcgacgggttccgctttgatggagtcacctcaatgttatatcaccatcacggtgtggggcagggattttcgggagattattcagagtacttcggattgcaggtcgatgaggacgccctgacttacctgatgctggcaaatcacctcgttcataccctgtgtcccgactctataacaatcgcagaagatgttagcggcatgcctgcgttgtgctccccgatctcacaggggggcggtgggtttgactacaggctagcaatggctatccccgacaagtggatccaattgctgaaggagtttaaagatgaagactggaacatgggcgacatcgtgtacacgttgacaaatcgtagatacctggagaagtgcatagcatatgcagaaagccacgatcaggctctggtcggcgacaagagcctagcattctggctgatggatgccgagatgtacacaaatatgagcgtgctcaccccctttaccccagtgatcgacagaggaattcagctccacaagatgattcgcctaatcactcacgggttgggcggagaaggctatctgaacttcatgggcaacgagtttggtcatccggaatggctcgacttccccagaaaagggaacaatgaatcttaccattacgcacgacggcagttccatctcacagatgacgatctgctgcgctacaaatttctcaacaatttcgaccgcgacatgaacaggctggaggaacggtacgggtggctcgcggctccacaggcctacgttagcgaaaagcatgaagggaataaaattatcgccttcgagagggcaggtttactgttcatttttaatttccaccccagcaagagctacacagactaccgcgttggaactgccctgccaggaaagttcaagattgtattggactcagatgctgccgaatatggggggcaccaaaggcttgaccactcgaccgacttcttctccgaagcttttgaacacaatgggcggccatattctctcctcgtgtatattccctctcgggttgcactgattctgcaaaacgtggaccttcccaat

SEQ ID NO: 12799 - DNA, 2106 bp, Artificial Sequence
  Description of Artificial Sequence: Synthetic coding sequence
atggcagcccccatgacccccgccgccaggcccgaggattacgaagccgcactcaacgcggcactggcagacgtacccgagctggcccgcctgctcgaaatcgacccttacctgaagccctatgctgtcgacttccagcggcggtataaacaattttcacagatcctgaagaacatcggcgagaacgaaggagggatcgataagttttccagaggctatgaaagcttcggagtgcatcggtgtgctgatggtgggctctactgtaaggagtgggccccaggcgccgagggcgtattcctgaccggcgacttcaatgggtggaaccctttctcttatccatataagaagctggattacgggaagtgggagctatatatcccccccaaacagaataaaagcgttctggtgccacacgggtcgaaactgaaggtggtcattacctcaaaatccggggagatcctataccgaatctccccgtgggccaaatatgtggtcagagagggtgataatgttaattacgactggatacactgggatccagagcattcttacgagtttaagcattccagacccaaaaagccacggtctttgcggatctatgagagtcacgtggggatctcctctcacgaaggaaaggtcgctagctataaacattttacgtgcaatgtgctgccccgtatcaagggactcggatacaactgcatccagctgatggctatcatggaacacgcctactatgcttcctttggataccagattacgtcattctttgctgcctcttccaggtacggtacaccggaggagttgcaggagctcgtcgacaccgctcactccatggggatcatagtgctattggacgttgtgcactcccacgccagcaagaactcggcagatggattaaatatgtttgacggcacagactcctgttactttcacagcggccctcgagggacccacgatttgtgggattcgcgtctgtttgcctattcttcttgggaaattctgaggtttctgctgagcaatattagatggtggcttgaggagtatcgtttcgacggattccgatttgatggagtgacatccatgctctatcatcaccacggggtaggccagggctttagtggagactattcggagtacttcggtttacaggtggacgaggacgccctgacgtacttgatgctggccaaccaccttgtacataccctgtgcccagacagcataaccattgccgaggatgtgtccggcatgcctgccctctgttccccgatttctcagggagggggcgggttcgattaccggctcgcaatggccatccctgacaagtggatccagctcctgaaagagttcaaggacgaggactggaacatgggcgacatcgtgtataccctcacaaatcgcagatatctcgaaaagtgtatcgcctacgccgagtcacatgaccaagccctcgttggagataaaagcctcgccttctggctgatggatgcagagatgtacaccaacatgagtgtgttgaccccgtttacccccgtcattgaccgaggcatccagctgcacaaaatgattcgcctcattacccatggcctagggggtgaaggatacctgaatttcatggggaatgagtttgggcaccccgaatggttggactttccaagaaagggcaacaacgagtcctatcactatgcacgccgacagtttcatctgaccgacgatgatctgctccggtataagttcttgaacaactttgatagagacatgaatcgactggaggagcgctacggatggctcgctgctccccaagcctacgtatctgaaaaacatgaaggtaacaaaattattgccttcgagagggcagggctgctttttatttttaattttcatcccagtaagagttacacagattacagggtgggcacagcactgcctggaaagtttaaaatagttctggatagcgatgccgccgagtatgggggccaccagcggctggatcattcgactgacttcttctccgaagccttcgagcacaatggccgaccctactccctgcttgtctatatacccagcagagttgccctgatcctgcaaaacgtggacctccctaac

SEQ ID NO: 12800 - DNA, 2106 bp, Artificial Sequence
  Description of Artificial Sequence: Synthetic coding sequence
atggctgccccaatgaccccagcagcacgcccggaggattacgaagccgccctgaatgcggctttggccgatgtgccggagctggcccgtttgctggagattgatccatatctgaagccttatgcagtcgattttcagcgccgctacaagcagttttctcaaattctcaagaatatcggcgagaacgaaggaggcatcgacaaatttagtcgcggatacgagagttttggcgttcataggtgtgccgatggcggcctctactgcaaggagtgggccccgggagcggagggagtctttctgaccggagattttaacggctggaatccgttcagctatccctataaaaagctggattacgggaaatgggagctgtatatccctccgaagcagaataaatcggtgttggtgccacacggatcaaagctcaaggtggtgattaccagtaagagcggggaaatcctgtataggatcagcccctgggccaagtatgtggttcgcgagggtgacaatgtcaactatgactggatacactgggacccagagcactcgtatgagtttaagcactccaggcccaagaaaccgcgaagtctgcgtatttacgagtcgcacgtcggcatttcgtcgcatgagggcaaggttgctagttacaaacatttcacctgtaacgtgctgccgaggattaagggattaggatataattgcattcagctaatggccataatggagcatgcctactacgcgtccttcggttatcaaatcacctcctttttcgccgcctcctctcgatacggtacgcccgaggaattgcaggagctggtcgacacagcgcacagtatgggcatcattgtattattggatgttgtacattctcacgcgagcaaaaatagcgcggatggtctaaacatgttcgacggcacggattcttgttacttccactcgggtccaaggggaacgcacgacttgtgggatagcaggctatttgcatactcctcctgggagatattgaggttcttgctctctaacatacgctggtggcttgaggaataccggttcgatggattccgctttgacggagtcacgtcgatgctgtatcatcatcacggagtgggccagggtttctcgggggattattcagagtatttcggccttcaggtggatgaagacgccctgacctatttgatgttggccaaccatctggtgcacaccctgtgcccggacagcatcactatagcagaggatgtcagtggcatgccagctctgtgcagccccatctcccaaggcgggggtgggttcgactatcgactagctatggctattccagataaatggatccagctgctcaaggagtttaaggatgaggactggaacatgggggatattgtttatacattaacaaaccgccgctaccttgagaaatgcatagcctatgcggagagccatgatcaggcactggttggagataaaagcctggcgttttggctgatggacgcagaaatgtacaccaacatgtccgttctcactccctttactccagttattgaccggggtatccagcttcacaaaatgatccgtctgataacccacggtctaggtggagagggatatctgaattttatgggaaacgagttcggccaccccgagtggttggatttcccccgcaagggcaataatgagtcctaccactacgcgcgtcgacagttccacttaactgacgatgatctgctcaggtacaagttcctgaataacttcgatcgcgatatgaacaggcttgaggagcgctacggttggctcgctgcaccgcaggcttacgtgtcggagaagcatgaaggtaacaagataattgcgtttgagcgagcgggtctgttgttcatcttcaattttcatccgtccaagtcgtacaccgattatcgtgtcgggaccgccctgcccggaaagttcaaaatcgtactagattccgatgccgctgaatatggaggccatcagcgcctggaccactccaccgatttcttctctgaggcctttgagcataatgggcggccctactcgctgctggtgtacatcccctcccgggtcgccttgatactgcagaatgtggacctgcctaat

SEQ ID NO: 12801 - DNA, 2106 bp, Artificial Sequence
  Description of Artificial Sequence: Synthetic coding sequence
atggcggctcctatgactccagctgcccgacccgaagactatgaggccgccctgaacgccgcgctggcggacgtacctgaattggcccggcttttggagattgacccctatctcaagccgtacgctgtcgacttccagagacgatataagcaattcagccagatcctgaaaaacattggagagaatgaaggtggcatcgataagttctcccggggatacgagtctttcggggtgcaccggtgtgctgatggcggcctatactgtaaagagtgggctccaggagcagagggcgtgtttcttacgggagattttaacggatggaaccccttcagttatccttataaaaaactggactacgggaaatgggagctgtacattccacctaaacagaacaaatcagtgcttgtgccccacggcagtaagttgaaagtggtgataaccagtaaaagcggtgagatactgtatcgcatcagcccgtgggctaaatatgttgtgcgagagggcgacaatgtgaattacgattggatacattgggacccagagcactcatacgagtttaagcatagcagacccaagaagccaagaagtctgcggatttacgagtcccatgtaggaatttcttcccacgagggcaaggtggcctcatacaagcactttacttgcaatgtgctgccacgaatcaaaggcctaggatataattgtatccagctgatggcaatcatggaacacgcctactacgcatcttttggatatcagataaccagtttcttcgcagcctcgtctaggtatggcacgccagaagagctgcaggaactcgtggacactgctcactccatgggaataatagtcctgttagacgttgtccattcgcacgccagcaaaaacagcgcggacggcctaaatatgttcgacggcaccgatagttgctatttccacagcggcccaagaggtacccacgatctgtgggatagtcggttgtttgcttactcctcttgggaaattttgcggttcctgctgtctaacatcagatggtggcttgaagagtatcgtttcgatggcttcaggttcgacggcgtcacaagcatgctgtatcaccatcacggcgtgggccagggcttcagtggggactattcagaatactttgggctgcaagtcgacgaagacgcactcacatatctcatgctggcgaaccatctggtgcatacactttgccccgactccattactatcgctgaggacgtcagtggcatgccagccctctgtagtcccatctctcagggcggaggcggttttgactatcgtctggcaatggctatccctgataagtggatacagctgcttaaagagttcaaggatgaggattggaacatgggcgacatcgtgtacacacttactaatagaaggtacctggagaagtgcattgcatatgccgagtcacatgaccaggcgctcgtgggcgacaagagtctggctttttggctgatggacgccgaaatgtacacaaacatgtccgtcctgactccatttacccctgtaatcgatcggggaattcaattacacaaaatgattcgcttgattacccacggccttggcggcgaagggtacctgaactttatgggtaatgaattcggccatccggaatggttagacttcccccgtaagggaaataacgagtcctatcactacgcccgcagacaattccatctgactgacgatgacctcctgagatataaattcctgaacaacttcgaccgggacatgaacaggttggaggagcggtatggatggctggctgcccctcaggcttacgtctcggaaaaacacgaggggaataaaatcattgcttttgaacgggcgggccttctgttcatttttaacttccacccttccaagtcttacactgactacagagtcggaaccgcccttccaggaaagtttaagatcgtgctggattccgacgccgccgagtatggcggacaccagcggctggaccactcaacagactttttttcagaggctttcgaacataacgggaggccgtactcattattggtatatatcccttcacgagttgccctgatattgcagaacgtggacctccccaat

SEQ ID NO: 12802 - DNA, 2106 bp, Artificial Sequence; identical to SEQ ID NO: 12794
  Description of Artificial Sequence: Synthetic coding sequence

SEQ ID NO: 12803 - DNA, 2106 bp, Artificial Sequence
  Description of Artificial Sequence: Synthetic coding sequence
atggcggctcccatgacgcccgcggcaaggccagaagactatgaagcagccctaaatgccgctctcgccgatgtgcctgagctggcccgcctcctggagattgatccgtatttgaagccatacgccgtcgacttccagaggcgatacaaacaattcagccagatcttgaaaaacatcggggaaaacgaagggggtatcgataagtttagtcgtggttacgagagttttggggtgcaccggtgtgcagacggaggactatactgtaaggagtgggctccgggagctgagggcgtatttttgacaggcgacttcaatgggtggaaccccttctcttatccttataaaaagctcgattacgggaagtgggaactgtacatccctcctaagcagaacaaaagtgtgcttgtaccccatggctctaagctgaaggtagtaatcactagtaaatccggggaaatactgtatagaatctccccctgggccaaatacgtggtgcgcgaaggggacaatgtcaattatgattggatccactgggaccccgagcattcttacgaatttaaacattcacgccctaagaaacccagaagtctgcggatctatgagtctcacgtgggaatttccagtcatgaaggcaaggtggcctcttacaagcacttcacttgcaacgtcttgcctcgcatcaaggggttaggatacaattgtatccagttgatggccatcatggagcatgcatactatgcttcattcggctaccagatcacttccttctttgctgcctcctcgagatatggtaccccagaggagctccaagaactggtcgatacagcacattcaatgggaatcatagtgctgctggatgtggtacactctcatgcctcaaagaacagcgccgacggcttaaacatgttcgacggaactgattcatgctatttccactctgggcctaggggcacccatgacttgtgggactcaaggctctttgcatacagttcttgggagatacttcgtttcctgctttcgaacatcagatggtggctggaggagtatagatttgacgggtttcggttcgatggggtcaccagtatgctgtatcatcatcatggcgtcggccaaggttttagtggggattattcagaatatttcggactgcaggtggatgaagatgctctgacgtacttgatgctggccaatcatttggtccacacgctttgtcccgactctatcacaatcgccgaggacgtgagtggtatgcccgcgctctgtagtccaatctctcagggcggtggaggttttgactaccgtctcgctatggctatcccagataaatggatacaactcctgaaagaattcaaggatgaagattggaacatgggcgatatcgtgtatacactcaccaatcggagatatttggaaaaatgcattgcctatgctgaaagccacgaccaagcactcgtgggcgataagtccctggcgttttggttaatggacgctgaaatgtataccaatatgagcgtgctgacaccttttacccctgtgatcgacaggggcatccagctccataagatgattagactcataacccacggccttggtggggaaggctatctgaactttatgggaaatgagtttggtcaccctgagtggttggatttccctcggaagggaaacaacgaatcgtatcactacgctcggcgtcagtttcacttgacagacgacgatcttctgcggtataagttcctcaacaatttcgaccgagacatgaaccgcctggaggaaaggtatggttggctggccgcgccgcaagcgtatgtaagcgagaaacacgaggggaacaagatcattgccttcgaaagagccggcctgttgttcatatttaactttcaccctagcaagtcatatacagactacagagtgggaacggcgctcccggggaagttcaaaatcgtactggactctgatgcagcggagtacggagggcaccagcgactagatcacagtactgacttcttttccgaggccttcgaacataacgggcgcccttactccctgcttgtgtatattccaagtagggtcgctctcatcctacagaatgtcgatctccctaac

SEQ ID NO: 12804 - DNA, 2106 bp, Artificial Sequence
  Description of Artificial Sequence: Synthetic coding sequence
atggctgcgccgatgaccccagccgcacgcccggaggattacgaggccgcgctgaacgcggctctggcggacgtgccggagctggcacgtctcctggagattgacccttaccttaagccatatgctgtagacttccagcgtcgctataaacagttctcccagatcctgaagaacatcggtgaaaacgaggggggcatcgataaattctcaaggggatatgagtcgtttggcgttcatcgctgcgcagacggcggcctgtactgtaaggagtgggccccgggggcagagggtgtgttcttgaccggcgatttcaatggttggaacccgtttagctacccgtataaaaagctggattacggcaaatgggagctttatatcccgcctaagcaaaataaaagcgtgctggtcccacatggaagtaagttaaaagtcgtgatcacttctaagagtggtgagatcctctaccgtatttcaccatgggccaaatatgtggttcgtgagggcgataatgtgaactacgattggatccactgggatccggagcacagctatgaatttaagcacagccgaccgaagaagccgaggagcctacgtatttacgaaagccatgttgggattagcagccacgaagggaaggtggcaagctataagcacttcacttgcaacgtactgcctcgaataaaaggtcttggttataactgcatccagctgatggcgattatggagcacgcgtattacgcttctttcgggtaccagatcaccagcttttttgccgcatcaagccgctacgggacgcccgaggagctgcaagagctggttgacaccgcccattcaatgggtattattgttctgttggatgttgtgcactcccacgcttctaaaaatagtgccgacggcctaaacatgttcgacgggactgattcctgctactttcattccggcccacgaggcacccatgacctgtgggattcacgcctctttgcctattcttcctgggagattctgcgcttcctgctgagcaacattagatggtggctggaagagtatcgcttcgatgggttccgcttcgacggagtaactagcatgctgtaccatcaccacggcgttggtcagggctttagcggtgattacagcgaatacttcggactgcaagtggatgaggacgcgctgacctatctgatgttggcgaaccatttagttcacaccctgtgtcctgattccatcaccatcgccgaagatgtgagtggtatgcccgcattgtgttcaccgatctcccagggtggtggtggttttgattatcggcttgcaatggcgattcctgacaagtggattcaacttctgaaagagttcaaggacgaggactggaacatgggcgacatcgtgtataccctgaccaaccgccgctatctggagaagtgtatcgcgtatgcggagtcacacgaccaagccctggtgggagacaagagcctggccttttggctgatggatgccgaaatgtacaccaacatgagcgtgctcaccccgtttaccccggtgatcgatcgaggcattcagcttcacaaaatgatccgtctgattacgcacggcctggggggagaaggttacctgaatttcatgggtaatgagtttgggcaccctgagtggctggacttcccccgtaagggcaacaatgagtcttatcactatgctcgccgccaatttcacctaacggatgatgacttgctgaggtataaattcttgaacaatttcgacagggatatgaataggctggaggaacgttacggctggctggccgcaccgcaggcttatgtgtctgaaaaacacgagggtaataaaattattgcattcgagcgcgctggtctgctgttcatcttcaatttccacccaagcaaaagctacacggactaccgcgtcggaaccgcactccctggcaaatttaaaattgtcctggattctgacgccgcggagtacggcggccaccagcgcctggatcacagcacggattttttttccgaagcttttgagcataatggacgcccgtacagcctgctggtgtatatcccaagccgcgttgctctgatccttcagaatgtggacctgccgaat

SEQ ID NO: 12805 - DNA, 2106 bp, Artificial Sequence
  Description of Artificial Sequence: Synthetic coding sequence
atggcagcaccaatgacaccagccgcccgccctgaggactatgaagcagccctgaatgccgctctcgcagatgtgccagagctggcccgtttgcttgagatagatccatacctgaagccgtatgccgttgattttcagagaaggtataaacagttctcccaaattctgaagaacatcggtgaaaatgagggcgggatcgataaattcagcagggggtacgagagttttggtgtgcatcggtgtgcagatggtggcctgtactgcaaggagtgggccccaggcgccgagggagtgtttctgaccggggattttaacgggtggaacccattcagttacccctacaaaaagctggactacggcaaatgggagttgtacattccccctaagcagaacaagtcggtcctggtccctcatgggtccaaactaaaagtggtcatcacaagcaaaagcggtgaaattctgtacagaatcagcccgtgggccaagtacgtggttagggaaggcgataacgtaaattatgactggattcattgggaccctgagcatagctatgagttcaagcactcgcgaccaaagaagccacggtctctacggatttacgagagccacgtgggaatctcctctcacgagggcaaggttgccagctacaagcactttacctgcaacgtgttacctcgtattaaggggcttggttataactgtatccagctcatggcgattatggaacacgcctactacgctagtttcggctatcaaatcacctcgttttttgccgcgagttctcggtacggaacaccggaagagctgcaggaactggtagacaccgcacactctatgggcatcatcgttttgctggacgtggtccattcgcatgcgtccaaaaatagcgccgacggtctgaatatgttcgacgggaccgactcgtgctacttccacagcggtccccgtgggacccacgacttgtgggacagccggctgttcgcctatagttcttgggaaattctgaggtttttgctctcaaacatcaggtggtggctggaggagtatcgcttcgatggtttccggttcgatggggtgacatccatgttgtatcatcaccacggcgtggggcaaggctttagcggcgactattcagagtacttcgggctgcaggtggatgaagacgccctcacatacctgatgctcgcgaatcacttagtacacactttgtgtcctgactcgatcaccatcgcagaggatgtgtctggtatgccggcactatgctcgcctattagtcagggaggcggcggcttcgactatcggctggcgatggccattcctgataaatggatccagcttctgaaggagtttaaggatgaagattggaacatgggagacattgtttacactctgacaaacagaaggtacctggaaaagtgcattgcgtatgcagagtcccacgatcaggcactggtcggggacaagtccctggcattctggctgatggatgccgaaatgtacacgaacatgagtgtcctgacaccattcaccccggtgatcgacaggggcatacagctgcataagatgattagattaatcacccacgggttaggcggtgagggttacctgaatttcatgggtaacgaattcggccaccctgaatggttagactttcccaggaaggggaataatgaaagttaccattatgcccgacggcagttccatctgactgatgacgacctcctgaggtacaaatttttgaataattttgaccgggacatgaaccggctggaagagagatacgggtggctggcggccccccaggcttacgtgtcggagaagcacgaagggaacaagataatcgctttcgagagagctggccttctgttcatctttaattttcaccctagtaagagctatactgattatcgcgtgggtaccgctctcccggggaagttcaaaatcgttctggactccgacgctgctgagtatggtgggcaccaaagactcgatcactccaccgacttcttttctgaggcgttcgagcacaacggacgtccttattccctgctcgtctacatcccgagtcgggtagcactgatcctgcagaatgtcgacttaccaaac

SEQ ID NO: 12806 - DNA, 2106 bp, Artificial Sequence
  Description of Artificial Sequence: Synthetic coding sequence
atggcagcaccgatgacccccgctgcccgtcccgaggattatgaggccgccttgaacgcagcgttggctgacgtgcccgagctggccagactcttggagatcgatccgtacctcaagccttatgccgtggactttcagagacggtataaacagttctcccagatcctcaaaaacattggggagaatgaaggcgggatcgacaagttctcacggggttacgaatcattcggtgtgcaccggtgtgctgacggaggcttgtactgcaaagaatgggcacccggcgcagaaggggtctttttaaccggagatttcaatggctggaatccattttcctacccgtataagaagctcgactacggcaagtgggagctctatatcccccctaagcagaacaaatcagtgctggttccacatggatccaaattgaaggtggtaatcacctccaagtccggcgagatcctgtaccgaatcagcccgtgggccaagtacgtggtgcgagagggggacaatgtgaactacgactggattcattgggaccccgagcactcctacgagtttaaacattcacggcctaagaaaccaaggtcgcttcgcatttatgagtctcacgtcggaatctcgtcccatgaaggaaaagtggcctcgtataagcatttcacatgtaacgtccttccccgtatcaaggggcttggctacaattgcatccagctgatggccatcatggagcacgcttactacgcgagcttcggatatcaaatcaccagcttcttcgcggcatcctccaggtacggcacgccggaggaattgcaggagctggtggacactgcccattctatgggtatcatagtactgttagacgtggtgcactctcatgcctcaaaaaatagtgcagacggcctcaatatgtttgatggaactgactcctgctatttccattccggtcctcgaggtacccacgacctctgggattcacgcctgttcgcatacagcagctgggagatccttagattcctgctttctaatatccgctggtggctggaggaatacaggttcgacgggttcagatttgatggtgtgaccagtatgttatatcatcaccacggggtggggcaggggttttcaggcgattatagcgaatactttgggctccaagttgacgaggacgcacttacctatctgatgctcgcaaatcacctagtgcacactttgtgcccagatagcatcaccatagccgaagacgtctccggaatgccagcactgtgtagccctatcagccagggcggcggcggctttgactaccgtttggctatggccattcctgacaagtggattcaattgctcaaagaattcaaagatgaagactggaacatgggggatatcgtttatacactgaccaaccggaggtacctagaaaagtgcatcgcctacgccgaaagtcacgaccaggcactagtgggggacaagtcacttgcattctggctcatggatgccgaaatgtacacaaatatgagcgtgctgaccccattcacacccgtgatcgatcgagggatccaacttcataaaatgatccggctaattacccatggcctcggtggtgagggctatcttaacttcatgggcaatgagttcggtcacccggaatggctcgattttccacgaaagggaaataatgagagttaccactatgctcgccgtcagttccaccttaccgatgacgacttgttacgctataagtttctgaacaattttgacagggatatgaatcgccttgaagagagatacggctggctcgcagccccacaggcatatgtgtctgaaaaacatgaggggaataaaattatcgcctttgagcgagcgggtcttctcttcatcttcaacttccatcccagcaagtcctatacagactaccgtgtaggtacggccctgcccgggaagtttaaaatcgtcctggacagcgatgccgccgagtatggtggacatcagagacttgatcacagcacagactttttctccgaggcctttgagcataatgggaggccgtatagcctactagtgtatatcccctctagagtggctctgattttacaaaatgtggaccttcctaat

SEQ ID NO: 12807 - DNA, 2106 bp, Artificial Sequence
  Description of Artificial Sequence: Synthetic coding sequence
atggctgcccctatgacacccgccgcacggcccgaagactatgaggcggctcttaacgctgctctcgcagatgtgcctgaattggcccggctactcgagatcgacccatatctcaaaccttatgcagttgatttccaacgccgatataaacagttttcccaaattttgaagaatatcggcgagaacgagggtggtatcgacaagttcagccggggctatgaatcgttcggagttcaccgatgcgccgacgggggattgtactgtaaagaatgggcgcctggcgctgaaggagtgtttttaacgggagacttcaatggctggaaccctttctcgtatccttacaaaaagctcgactacggaaagtgggaactctacatccccccgaaacagaacaagtctgtgctcgtgccgcacggctccaaacttaaggttgtgatcacttcaaagtcaggcgagatcctttaccgaatctcgccgtgggcaaagtatgttgtgagggagggcgataatgtgaattacgactggatccattgggaccctgaacattcatatgagttcaagcacagcagacccaaaaaacctcgatccctccgcatatacgaaagtcacgtcggtatatcgtcgcatgagggcaaagttgcttcttataagcatttcacatgtaatgtcttacctcgcataaagggattggggtacaattgtatacagttgatggccatcatggagcatgcgtattacgctagttttggataccagattacctcgttctttgctgcctcgagtcggtacgggacacccgaggagcttcaagagctggttgataccgcacattccatgggtatcattgtattgctcgatgtggtgcattcccatgctagcaagaactccgccgatggcctgaatatgtttgacggcacggattcatgttacttccatagtggcccccgtggtacccacgatttgtgggactctagactgttcgcctatagttcgtgggagatcctgcggtttcttctttccaatattagatggtggttagaggagtacaggttcgatggattccggttcgacggcgtgaccagcatgctataccaccatcatggggtcggccagggcttttcgggtgactacagcgaatacttcggtttacaggtcgatgaagacgcccttacatatctgatgctagcgaatcacttagtccataccctctgtcctgatagcattaccattgccgaagacgtcagcggcatgcccgctctctgctccccaatctcgcagggagggggggggttcgactatcggttggccatggcgatcccggataagtggatccagctcctcaaggagttcaaggatgaggactggaacatgggcgatatcgtttatacgcttaccaatcgtaggtatctagaaaagtgtatagcttacgcggaaagccacgaccaggccctcgtcggtgacaaaagtttagctttctggcttatggatgcagagatgtatactaatatgtcggtgctgactccattcactccggtgattgatcgcggcatccagctccataagatgatccggctgattacccacggtttggggggtgaaggttaccttaatttcatgggtaatgaattcggacatccggagtggttggattttccaaggaaaggaaacaacgagtcgtatcattacgctcgaaggcagtttcaccttactgacgatgacctgcttcgctataagtttctcaacaatttcgatcgtgacatgaaccgactcgaagaacgatacggctggttggcagcgccgcaggcctacgtgagtgagaagcatgagggtaacaagatcattgctttcgagagagctggtttgctattcattttcaatttccatccctcgaagtcttatacagactaccgcgttggcacggctctccccggcaagttcaagatcgtgctcgacagcgacgcggcagagtacggcggtcatcagcgcctggatcatagcacagattttttctcggaggcatttgaacacaacgggaggccttactcgcttctcgtgtacatcccttcccgtgttgcactcatcctgcagaatgtcgacctgccaaat

SEQ ID NO: 12808 - DNA, 2106 bp, Artificial Sequence
  Description of Artificial Sequence: Synthetic coding sequence
atggcagcgccaatgacccccgccgccagacctgaagattacgaagccgctctgaacgctgccctcgccgacgtgccagaattagcccggttactggagattgatccttacctgaaaccctacgcggtcgattttcagagacgttacaagcagttctcacaaatcctgaaaaacataggtgagaacgaggggggcattgacaaattttcccgcggttacgaatcattcggagtccatagatgcgcagatggaggtttgtactgtaaagaatgggctcccggagccgagggcgtgtttctgaccggcgatttcaacgggtggaacccattctcatacccgtataaaaagttagactatggaaaatgggagctgtacattcctccgaagcagaacaagagcgttctggtcccccacggctccaagctgaaagtcgtcataacctctaagtctggggagattctgtatcgcatcagtccctgggctaagtatgtcgtccgggagggcgacaacgtgaattacgattggatccattgggatcccgaacactcttatgagttcaagcattcccggcctaagaaaccccgttcattgcggatttacgagagtcatgtggggatttcctcacacgagggaaaagttgcctcttacaagcactttacatgtaacgtgctcccacgcattaaaggccttggctacaattgcatccagctgatggcgattatggagcatgcctattatgcaagcttcggataccagatcacatccttcttcgcagctagctcccggtatgggactccagaagaacttcaggaactggttgacacagcccattcgatgggtatcatcgtcctcttggatgtggtccactcccacgcctctaagaactctgccgacggactaaatatgtttgacggaacagatagttgctacttccattcagggcccaggggtactcacgacctgtgggatagccggctgtttgcctactcgtcctgggagattttgaggtttcttctgagtaatatcagatggtggctggaagagtacaggttcgatgggtttagatttgacggtgtaacatcgatgctgtaccatcaccacggcgtggggcagggctttagtggtgattattctgagtatttcggactgcaggtggacgaggacgccctcacctatctgatgctggcaaatcatttagtgcacacactctgccccgattcgattaccatcgctgaggacgtttctgggatgcctgctctctgctcgcccatctctcagggcgggggcggctttgattaccggctcgccatggcgattccggataagtggattcagctcctgaaagagttcaaggatgaagactggaatatgggcgatattgtatacactctcacaaatcgaaggtatctggagaagtgcatagcctacgccgagtctcacgatcaggcattagtgggagacaagagtctggccttctggctgatggacgccgagatgtacacaaacatgtctgttctcaccccattcacccccgtgatcgaccgcggcatacagcttcacaaaatgatccggctgatcacccacgggttgggaggagaagggtacttgaatttcatggggaacgagttcggtcacccagagtggctggacttcccccggaaagggaacaacgaatcttatcactacgcacgcaggcagtttcatctgactgatgacgatctcttgaggtataaatttctgaacaacttcgacagagatatgaacagactcgaagaacggtatggctggctggccgccccccaagcatacgtgtcagagaaacacgaaggcaacaagattattgctttcgaacgggccggcctgctgttcatctttaacttccacccaagtaaaagctacaccgattacagggtcgggactgctctcccaggcaagtttaaaattgtcctggactccgacgccgctgaatacggtgggcatcagagactcgatcattcaacagacttctttagcgaggccttcgagcataacggacggccatactcactgcttgtgtatattcctagtagagtggcattaattcttcagaatgtagacttacctaac

SEQ ID NO: 12809 - DNA, 2106 bp, Artificial Sequence
  Description of Artificial Sequence: Synthetic coding sequence
atggctgctcctatgacacccgctgcccgtcctgaggattatgaggccgccctgaatgccgcactggcggacgtacccgagctggccaggcttctggagattgacccctacttgaaaccatatgcagttgactttcagaggagatataagcagttctcgcagatcctcaagaatattggcgagaacgagggcggcattgacaaattttctcgaggatacgagtcgttcggagtgcacagatgtgctgatggggggttatactgcaaagaatgggctccaggagctgaaggcgtttttctaactggagatttcaatgggtggaatccattctcatatccctacaagaagctggattacgggaagtgggagttgtatatcccgcctaagcagaataaaagtgtcctcgtgccacatggttctaaactcaaggtggtgattacgtccaagagtggtgaaattctatatagaatttccccatgggcaaagtacgtagtgagagagggggacaacgtgaactatgactggatccactgggatcccgagcattcttatgagttcaagcactcccggcctaaaaaacccaggagcttacggatttacgaatcccacgtcgggatctcttcccacgaaggcaaagttgcctcttacaagcactttacttgtaacgtactcccaaggatcaaaggtctgggatacaactgcatccaactaatggcaattatggagcatgcatactacgcctcttttggctatcagatcactagctttttcgcggctagttctagatacggaacccccgaagagctccaagagctggtagacacggcccattccatgggaattatcgtgctgctggacgtggtgcattcccatgcatctaaaaactccgctgatggtttgaacatgttcgacggcacggatagctgttacttccattctggccccaggggcacacacgacctgtgggattcaagactgtttgcctacagctcctgggagatcctcagattcctgttgagtaacatccggtggtggctcgaggaataccggtttgacggattcagatttgacggcgtgactagcatgctctatcaccatcacggggtggggcaggggttttctggagattactccgagtatttcggcctgcaggtggacgaggatgccctcacctatctcatgttagcaaaccacctggtgcatactctctgtcctgacagcattacgatcgccgaagatgttagtggaatgccggccctctgttcacccatatcccaagggggcggaggcttcgactacagactggctatggccatccccgacaaatggatccaacttctgaaggaatttaaagacgaagactggaacatgggagacatcgtgtacacattgaccaatcgtcggtacctcgagaagtgcatcgcttacgccgaaagtcacgaccaggcactggtaggggataaatcccttgccttttggctgatggatgccgaaatgtataccaatatgtccgtcctcacacccttcactccagtgatagaccgcggtattcagttacataagatgattcgtctgatcacacatgggctgggcggtgagggctatctaaattttatggggaacgaattcgggcaccctgagtggctggacttccctcgaaaaggtaataacgagtcttatcattatgcccggcggcagtttcatctaacagacgacgatctgttgcgctacaagtttctgaataactttgaccgggacatgaaccgtttggaagaacgctatggatggctggcagccccacaggcctatgtcagtgagaagcatgaggggaacaagataatcgcctttgaaagggcaggactgctgtttatttttaactttcacccttccaaatcctataccgattatagggtaggaacggcgctgcccggaaaatttaagatcgtgctggattcggatgcagccgaatatggcggacatcagagactagatcacagcacggatttcttctctgaagctttcgagcataatgggcggccctactctctgctggtgtatattccatctcgcgtggctttgatcctccagaacgtagatctacccaac

SEQ ID NO: 12810 - DNA, 2106 bp, Artificial Sequence
  Description of Artificial Sequence: Synthetic coding sequence
atggcggcacctatgaccccagctgctagaccagaggattacgaagccgctctcaacgctgctcttgcagatgtgccagaattggctagactccttgagatcgacccttatctcaagccttacgcagttgactttcaaagacgctacaagcaattctctcagattctgaagaacattggcgaaaatgaagggggaatcgataaattttcgcgcggttacgaatcctttggagttcaccggtgcgctgacggagggctatattgcaaggaatgggcacccggagcagaaggagttttcttgacgggggatttcaacggctggaaccctttttcgtacccatataagaaacttgactacgggaaatgggaattgtacattccaccaaagcagaataagtctgttctggttccccatggttcaaagcttaaggtagttataacatcgaaatctggtgaaatcctgtaccgaatatccccttgggcaaagtatgtagtgagggaaggtgataacgtgaactatgattggatccattgggatccagaacatagttacgaattcaaacattcaaggcctaagaaacctagatcactcaggatctacgagtcccatgtcggtatcagttcgcacgagggcaaagttgcatcatataagcattttacctgtaacgttcttcctaggattaaggggcttggatacaactgcatacagttgatggcaatcatggaacatgcatattatgcttcattcggttatcaaataacaagcttctttgctgcatcaagtcgttatggcacccctgaggaactccaggaacttgttgataccgcacactcgatgggtattattgttttattggacgtcgtgcactcgcatgcatctaaaaactccgcagacggacttaatatgtttgatggtactgattcttgctacttccattcggggccgcgtggaacgcacgatctttgggattctagactgttcgcttactcctcgtgggagatcttgcgttttctgctaagtaatatcagatggtggctcgaagagtataggtttgatggtttcagattcgatggggttacttccatgctttatcatcatcacggtgtcggacaaggattctcaggtgactactcagaatacttcggattgcaagtagacgaagatgccctcacttatttaatgctcgctaatcatctggtgcatacactctgtccagattctatcacgatcgcagaggatgttagtggtatgcctgctttgtgcagtcctatttcccagggaggcggtggatttgattataggctagctatggccatccccgacaaatggatacaacttttgaaagagtttaaggatgaggattggaacatgggtgatattgtttacacgcttactaaccgtaggtacttagaaaagtgcattgcttacgccgaaagtcatgatcaggcgttagttggtgataagtcactggctttttggttgatggatgccgagatgtacactaacatgtccgttcttacaccatttacacctgttatagatcgcggaatacaattgcataagatgatcaggctcattacccatgggcttgggggcgagggctacttgaacttcatgggtaatgaatttggacacccagagtggcttgatttcccaaggaaagggaacaatgagtcttatcattacgcacggcgacaatttcacctgaccgacgatgatcttctcaggtataagtttttgaacaattttgatagggatatgaacaggctggaagaaaggtatggatggttggctgcacctcaagcctatgtatctgaaaaacacgaaggtaataagatcatcgcatttgagcgagccggtctactgtttatctttaatttccacccaagcaaatcatacacggactaccgtgtgggtactgctttaccaggtaaattcaaaattgtgctcgattcggatgcagcagagtacggtgggcatcaaaggcttgatcatagcactgattttttttcagaggcctttgagcacaacgggagaccatattcattgttggtgtatattcccagccgagttgctctgattcttcaaaatgttgatttgccaaat

SEQ ID NO: 12811 - DNA, 2106 bp, Artificial Sequence
  Description of Artificial Sequence: Synthetic coding sequence
atggctgcccctatgacacctgctgctaggcccgaagactacgaggcagctcttaacgctgcccttgccgacgtccccgagttggccagactcttggaaatcgacccttacctgaagccttatgccgtcgatttccagcgccgctacaagcagttttcacagatcctgaagaatattggcgagaacgagggtggtatcgacaagttttctcgcggttacgagtccttcggcgtgcaccgctgcgccgatggaggactgtattgtaaggagtgggctcctggtgccgaaggtgtcttcctgaccggtgattttaacggatggaatccttttagctacccctacaaaaaattggactatggcaaatgggagctgtacattcctccaaagcagaacaagtctgtattggtgccccacggcagtaagctcaaagtggtgatcacttccaaatccggcgagatactgtatagaatctctccctgggctaagtacgttgtccgcgagggtgacaacgttaactacgattggatccattgggaccctgaacattcttacgagttcaagcactcaagacctaaaaagcctcgcagccttagaatttatgagtcccatgtgggtatcagtagtcacgaaggcaaggtcgcctcttataaacatttcacttgtaacgtgctgcctaggatcaagggtctgggttacaattgcatccagctgatggccattatggagcatgcttattacgcttcattcggataccaaatcacctctttcttcgccgccagctcccgctacggcaccccagaggaactgcaggagctggtcgacactgcccacagtatgggaatcattgtcttgctcgacgttgtgcatagtcacgcttccaagaattctgctgacggcttgaacatgtttgacggtaccgattcttgttatttccactccggtcccagaggtacccacgacttgtgggacagccgccttttcgcttattcttcctgggagattcttcgtttccttctctcaaatatcaggtggtggctggaggaatacaggtttgacggatttcgttttgatggcgtaacctcaatgttgtaccatcatcacggtgtcggacaaggattcagtggcgactacagcgagtacttcggtctgcaggtggatgaggacgctctgacctacctgatgctcgccaaccacctggtccatactctttgtcctgacagtatcaccatcgccgaagatgtgagtggaatgccagctctgtgtagcccaatctcacagggtggcggcggattcgattatcgcctggccatggccatacccgataagtggattcagctgctgaaagagttcaaggatgaagattggaacatgggtgacattgtttacacattgaccaaccgtcgttatctggagaaatgcatcgcctatgctgagtcccacgatcaagctctcgtcggtgacaagagccttgcattctggctgatggacgcagaaatgtataccaacatgagcgtgttgaccccattcaccccagtcatagacagaggtatccagttgcacaaaatgatccgcttgatcacccacggactgggcggcgaaggatatctgaattttatgggtaacgagtttggtcaccccgaatggttggatttcccccgcaaaggtaataacgaatcctaccactacgcccgtcgtcagtttcacttgaccgacgatgaccttcttaggtataaatttttgaacaacttcgaccgcgacatgaaccgccttgaggagagatacggatggttggccgccccccaagcatacgtttccgaaaagcacgaaggcaacaaaatcattgcatttgagcgtgctggtctgctcttcatattcaacttccacccatccaagtcttataccgactatcgtgtaggaactgccctgcctggaaagttcaagatagttttggatagcgatgccgccgaatacggtggccaccaacgcctcgaccattctacagacttcttctcagaagcttttgagcacaatggaaggccctactcattgctggtgtacatcccatcacgtgtcgccctgatcttgcagaatgttgacctgcctaat

SEQ ID NO: 12812 - DNA, 2106 bp, Artificial Sequence
  Description of Artificial Sequence: Synthetic coding sequence
atggcagccccaatgacccccgccgcccgacccgaggattatgaggctgcactaaatgccgccctggccgacgtgccggagctggctagactgctggagatcgatccctatttgaagccatatgcagtggactttcagcggaggtacaaacaatttagccagatcctgaagaacataggggagaacgagggcggcatagataagttttccaggggatacgaatccttcggcgttcatcgatgtgccgacggaggtctgtactgcaaggagtgggcccccggtgctgagggagtgtttctgactggcgactttaacggttggaaccccttctcttatccctacaaaaagttagattatggaaagtgggagctgtacatacccccgaagcagaacaagtcagtacttgtgccccacggatcaaagctcaaggttgttattacaagcaagagcggggaaattctttacaggatttctccttgggctaagtacgtcgtcagagagggggacaacgtgaattacgactggatacattgggacccagagcactcatacgaattcaagcactcccgaccaaaaaaaccacggtccctcaggatttatgagagccacgtcggaatcagctctcacgaaggcaaagtcgcatcatataagcatttcacatgcaatgtgctgcctcgaatcaaggggctcggttataattgtatacaactcatggctataatggaacacgcctactatgcctcctttgggtaccagatcacatcattcttcgccgcatccagcaggtatggaacgccggaggaactgcaggaactggtggacaccgctcactctatggggatcatcgttctgctcgacgtggtgcattcccatgctagcaagaactccgccgatggactcaatatgttcgacggcacagactcctgctacttccatagcggacctagggggacccatgacttgtgggacagccgactgtttgcttacagttcttgggagattctgcgatttctactgtctaatattagatggtggcttgaggaatacaggtttgacggtttccggttcgatggtgtgacaagtatgctgtatcaccaccacggtgtgggtcagggtttctccggggactattccgaatactttggcttacaagttgacgaagatgccctgacgtatcttatgctcgcgaatcatttagtccacactttatgccctgacagcattacaatcgcggaagatgtatccggtatgcctgccctgtgtagtccgatatcacaggggggcggcggattcgattaccgacttgctatggctattccggataaatggattcagctactgaaggagttcaaggatgaagattggaacatgggcgacatcgtgtacaccctgactaacaggaggtacctggaaaaatgtattgcttatgctgagtctcatgaccaggctcttgtcggagacaaatccctggctttctggctgatggatgcagaaatgtataccaacatgagtgtgctaacaccttttacccctgtgatagaccgaggcatccagctgcataagatgattcgattgattacccacggattgggcggcgaagggtacctgaattttatgggaaatgagttcgggcatcctgaatggctggatttccccagaaaaggcaataatgagtcctatcactatgcgcgaagacagttccacctgactgatgacgatctgctacgatataaattcctgaataacttcgatagagacatgaatcgccttgaagagcgatacgggtggcttgcagcgccccaggcttatgttagtgagaagcacgaaggcaataaaatcatagcatttgaacgggctgggttgctctttatcttcaattttcatccttcgaaaagttacaccgactaccgagtggggacagccctcccgggtaagtttaagatcgtcctggattctgacgccgccgagtacggagggcatcagcgcctagaccattctacagattttttctcggaagcctttgagcataacgggaggccttatagtctgcttgtgtacataccttcacgtgtagctttgatcctgcaaaatgtggatctgcccaac

SEQ ID NO: 12813 - DNA, 2106 bp, Artificial Sequence
  Description of Artificial Sequence: Synthetic coding sequence
atggcggctcctatgacaccagcagctcggcccgaggattatgaggctgctctcaacgcagcgctcgccgatgtcccagagctggccagactcctcgagatcgacccttatctgaagccgtacgccgtagactttcagagaaggtataagcagttcagtcagatcctaaagaatatcggcgagaacgaaggagggatcgacaaatttagccgcggctatgagagctttggtgtccaccgatgtgctgacggaggcctgtactgcaaagaatgggcccctggcgctgagggtgtctttctcacaggggacttcaacggatggaacccctttagctatccctacaagaagctggactatgggaaatgggagttgtatatcccacctaaacagaataaaagtgtacttgtccctcacggaagcaagctgaaagtagtgatcacaagtaaatctggagaaatattgtacagaatcagcccttgggccaagtatgtggtacgcgagggcgacaacgtgaattatgattggatacactgggatcctgagcactcgtacgagtttaagcattcccgaccaaagaaacctcgcagcctaagaatctatgagtcacatgttggaatcagctcacacgagggcaaagtggcgtcctacaaacactttacttgcaacgtcctccctcgaattaaaggcctgggctataattgcatccaacttatggccataatggagcacgcctactacgcttcattcgggtaccagattacatcgttcttcgctgcctcttcaagatacggtacaccagaagagctccaggagcttgttgataccgcccacagcatgggaataattgtattgcttgacgtggtgcatagccacgccagcaagaattcagcggatggcctaaatatgttcgacggaaccgactcttgctatttccactctgggcccaggggtacacacgacctctgggattctcggttgtttgcctattctagttgggagatcctgaggtttctgctcagtaatataagatggtggcttgaggagtaccgttttgacgggttcagatttgacggggtgactagtatgttatatcaccatcacggggtggggcagggcttctccggggactacagtgaatactttggattacaagtggatgaggatgcactgacctacctaatgcttgccaatcacttagttcacacactgtgtccagattcaatcaccattgcagaggatgtgtcagggatgcccgccctgtgttcccctataagccaggggggcggcggttttgactatcgcttggccatggctattcccgataagtggatacagctcctgaaggagttcaaggacgaggattggaatatgggggacatcgtctacaccctcacaaaccggcgctacttagaaaagtgcattgcttatgcggaatcccacgatcaggcactcgtcggtgataagagcctggccttttggctaatggatgccgaaatgtatacaaacatgtctgtgttgactccctttaccccagtgatcgatagaggcattcaactgcacaagatgatccgtctgatcacacacggcctgggaggggaaggttacctgaattttatgggcaacgaatttggccatcctgagtggttggacttccctcgtaagggtaacaatgaaagctatcattacgcacgccggcaatttcacctcaccgacgacgatctgcttcggtacaaattcctgaataattttgatcgggatatgaacaggctagaggagcgctacggatggctggctgcaccccaggcttatgtgtccgaaaaacacgagggcaacaaaatcatcgccttcgaacgcgccggcctcctttttatctttaattttcacccaagtaagagttatacagattatcgcgttggtaccgcactacccggcaagtttaagattgtcctggactctgacgctgccgagtatggtggacaccagcgactcgaccactctactgacttcttcagcgaagcatttgagcacaatgggaggccgtactcgctcctggtctacattccatcaagagtggcgctcatactgcagaatgtcgatctcccgaac

SEQ ID NO: 12814 - DNA, 2106 bp, Artificial Sequence
  Description of Artificial Sequence: Synthetic coding sequence
atggcagcccctatgacccccgctgcccggcccgaggactatgaagctgccctcaatgccgccctggctgatgttcctgaactagcccgattactggaaatcgatccctacctgaagccctacgccgttgacttccagaggcgatacaaacagttttctcaaatactgaagaatattggagaaaacgagggcgggatcgacaaattttcccgaggctatgaatcctttggcgtgcacagatgcgctgacggcggactgtattgcaaggagtgggccccaggcgctgaaggcgtcttcctgaccggtgattttaatggctggaaccctttctcctacccatacaagaaattagactacggaaagtgggaactttatatacctcctaaacagaacaaatcagtcctggtgcctcacggaagcaagctgaaggtggtcattaccagtaaaagtggggaaatactgtatcgcatatctccatgggctaagtatgtcgtccgtgaaggagacaacgtaaactatgactggatccattgggacccagaacatagctatgaattcaaacactctcggcccaagaagcctaggagtctccggatctacgagtcccacgtgggcatcagcagccacgaagggaaagttgccagttataaacactttacatgtaatgtcctaccccgcataaagggtctgggctataactgcatccagttaatggccatcatggagcacgcatactatgcttcatttggctatcagattacttcctttttcgccgcatcctcccggtatggaacccctgaggagctacaggaactggttgataccgctcactcaatgggcatcattgtgctgctagacgtggttcatagccacgccagcaagaacagtgctgatggcctcaatatgtttgacggtacagactcttgttactttcactctgggccccgcgggacacatgatctgtgggattctcgcctgttcgcctattcaagttgggaaatcctgagattcctcctgtccaatattcgctggtggctcgaggaatatcgtttcgatggctttcggttcgacggggtgaccagcatgctctatcaccaccatggggttggccagggcttttccggcgactatagcgagtatttcggtctgcaagtggacgaagatgccttaacttatctaatgctggcaaatcatctggtgcacacactatgccctgactctataactatagccgaggatgtgagcggtatgcccgctttgtgtagcccaatcagccagggaggaggaggtttcgactaccgcctcgccatggctatccctgacaagtggattcaactgctgaaggaattcaaggacgaagattggaatatgggcgacatcgtctacactctgactaaccgcaggtacctggagaagtgtatcgcctatgcagaaagccacgatcaggccctggttggcgataagagcctggctttctggctaatggatgccgagatgtataccaacatgagtgtgctgaccccatttaccccagtgatagataggggtatccaactccataaaatgatcagacttataacacatgggctgggcggggaggggtacctaaatttcatgggtaatgagtttggccatcctgaatggcttgacttcccccgaaagggcaataacgaatcttaccactacgccaggcgccagtttcacctcactgatgacgatctgctaagatataagttcctcaataattttgacagggacatgaatcgcttagaagaacgttatggatggctagccgctccacaagcttatgtgagcgaaaagcatgagggcaataaaataattgcctttgagcgagctggtctgctgtttatcttcaatttccaccctagcaagtcctacactgactatcgtgtgggaaccgctttacccgggaagttcaaaatagttctggatagcgatgctgctgagtacggcggccaccagcggctggatcattcaaccgattttttctccgaggcatttgaacataatggtcggccatacagcctgctagtgtacattcctagtagagtggcattgatactgcagaacgtagacctaccaaat

SEQ ID NO: 12815 - DNA, 2106 bp, Artificial Sequence
  Description of Artificial Sequence: Synthetic coding sequence
atggcggctcctatgacacctgcggcgcggccggaagattacgaagctgctcttaacgccgcgttggcggatgttcctgaactagcaagacttcttgaaattgacccatatttgaagccatatgcggttgattttcagcgaaggtacaaacaattttctcaaatcctgaagaatatcggtgaaaatgaaggaggtattgataagttttctcgaggatatgaaagtttcggcgttcatcgctgcgcggatggcggactgtattgcaaagagtgggcccccggcgcggagggtgtgttcctgactggcgacttcaatggttggaatccattttcttatccatataaaaagcttgattatggcaagtgggaattatacattccgccgaagcagaacaaatcggtcctcgtgccgcacgggtcaaaactcaaagtcgtaattacatccaaatcgggggagatcttatatcgaatctcaccttgggcaaaatatgtagttcgtgaaggggataatgtcaattatgattggattcattgggacccggaacatagctatgaatttaaacactcgcggccaaagaaaccgagatccttacgcatttatgagtcgcatgttggaatctcttcccatgaaggaaaagtggcctcctataaacatttcacatgcaacgtgctgccgcgaatcaaaggcttaggctacaattgcattcaacttatggcaattatggagcatgcctactacgcttcttttggctaccagattacaagcttctttgccgctagctctagatacggcacaccagaagagttacaggaactggttgacactgctcacagcatgggcatcattgtgttacttgatgtcgtgcactcgcacgcaagtaaaaactctgcagatggcctgaacatgtttgacggaacggacagttgctactttcattcaggaccccgaggcacccacgatttgtgggattcacgtttatttgcttacagcagctgggaaattcttagatttctcttatcgaacatcaggtggtggttggaagagtaccgctttgacggattcaggttcgacggagttactagcatgctctaccatcaccatggagtcggtcagggttttagcggcgattattcagaatattttggccttcaggtggatgaggacgctcttacatatctgatgctggcaaaccatttggtacatacgttatgtccagattcgattactattgcagaagacgttagcggtatgcctgcattatgtagcccgatttcgcagggcggcggaggtttcgattaccgcctcgcgatggcgattcccgataaatggattcagttacttaaagagtttaaggacgaagattggaacatgggcgacatcgtatacacattaacgaatagaagatatctggaaaagtgcatagcgtatgcagagtcccacgaccaggctttggttggagacaaaagcctggctttttggcttatggatgcagagatgtacacaaacatgagcgtgcttacgccgtttacaccggtaatcgatcgcgggattcagttgcataagatgatccgcttaatcacacatggccttggcggggagggttacctaaactttatggggaatgaattcggtcacccggaatggcttgactttccgcgcaaggggaacaatgagagctaccattatgcccggcgccagtttcaccttaccgatgatgaccttttaagatacaaatttttgaacaatttcgaccgtgacatgaatcggctggaagagcgctatggatggcttgctgctcctcaggcctacgtttccgaaaaacatgaaggtaacaaaataattgcgtttgaaagagcaggccttcttttcatctttaatttccatccatctaaatcatacacggattaccgtgtcggcaccgcgttgcccggcaaattcaaaatcgtgctggacagtgacgcagccgaatacggcggacatcaacgcttggaccatagcacagattttttttctgaggcgttcgaacacaatggccgtccgtatagtctccttgtttatattccttccagagtagcgcttatccttcagaacgtggatctgccgaat

SEQ ID NO: 12816 - DNA, 2106 bp, Artificial Sequence
  Description of Artificial Sequence: Synthetic coding sequence
atggccgcccccatgactccagcggccagaccggaggattatgaagctgccctcaacgctgccctggctgacgtcccagaactggcaaggcttctggaaattgacccctatctgaaaccctacgcagtggactttcaaagaagatacaagcaattttctcagattcttaaaaacatcggagaaaatgagggaggcatagacaagttcagcagaggctacgaatcattcggcgtacataggtgcgccgacggcggattgtattgtaaggagtgggctcccggtgctgagggagtgttcttgacgggagatttcaacggctggaacccgttctcttacccctataagaagctggactacggcaagtgggaactgtatattccccccaagcaaaataaatcagtgctggtgccccacggttccaagcttaaggtcgtgatcacgtccaagtcaggcgaaatcctctacagaatcagcccctgggccaagtatgtagtccgcgaaggcgacaacgtcaattatgattggattcattgggaccctgagcattcctatgaattcaagcacagcaggccaaagaagcctaggtctctccgcatctacgagtctcacgttggcatcagcagccacgagggcaaagtcgctagttacaaacactttacgtgcaacgtgttgcctcgcattaagggcctgggctacaactgtatacagcttatggccattatggagcacgcctactacgcatcattcggatatcaaatcaccagcttttttgcggcatcatctaggtacggcactccagaggagttgcaagagctcgtcgataccgcgcactctatgggaatcattgttctccttgacgtggtgcatagccacgcaagcaaaaactctgccgacggtctcaacatgttcgacggtactgactcctgctactttcactccggcccccgcggaacacacgatttgtgggatagcagactgttcgcttactccagctgggagatcttgaggttcctcctcagtaacattcgctggtggcttgaagagtacagattcgacggctttaggttcgatggcgttacctctatgctgtatcatcatcacggcgtaggtcaaggattcagtggcgactatagtgagtactttggattgcaagtggacgaagatgcgctgacatacttgatgctggctaatcatctggttcataccctctgtcctgattcaatcaccattgcagaggatgtatccggaatgccagctttgtgcagcccaatctctcagggcggaggtggctttgactatagactggcgatggccattccagataaatggatccagctgcttaaggaatttaaggacgaggattggaacatgggagatatcgtgtacactcttacaaataggaggtacctggaaaaatgtatcgcttacgctgaatctcacgaccaggccttggtaggagacaagtcactcgccttctggctcatggacgccgaaatgtataccaacatgagtgtgttgactccctttacaccggtgatcgacaggggaattcagctccacaagatgatcaggctgataacccatggcctcggtggagaaggataccttaacttcatgggaaatgagttcggccacccggagtggctcgatttccctcgcaagggtaacaatgaatcctaccattacgcgcgccgccaatttcacctgactgacgacgatctgctgcgctacaagtttctcaacaactttgacagagatatgaacaggctcgaagagcgctacggctggctcgccgcaccccaggcatacgtgagcgagaagcacgagggcaacaaaattattgctttcgaacgcgctggcctccttttcatcttcaatttccatccgtccaaatcatataccgattaccgcgtaggcacggcgctcccaggcaagttcaagatcgtgctcgactctgacgcggccgagtatggaggccatcagagactcgatcatagcacagacttcttctccgaggccttcgagcacaacggcagaccctatagtctcttggtgtatatcccctctagagttgctctcatactgcaaaacgtggaccttcctaac

SEQ ID NO: 12817 - DNA, 2106 bp, Artificial Sequence
  Description of Artificial Sequence: Synthetic coding sequence
atggcagcgccaatgactccggctgctcgccctgaagattacgaggcggccctgaacgccgctcttgccgatgttcccgaactagctcgcctcctcgagatcgacccctacctgaaaccgtatgccgtggactttcagaggcgttataaacagttcagccagattctaaagaacatcggcgagaacgagggcggtatcgataagttcagccgaggctacgaatcctttggagtgcaccgctgcgctgatggagggctatattgcaaggagtgggcgccaggtgccgagggcgtgtttcttaccggtgacttcaatgggtggaatcccttcagttatccttataaaaagttggactacggtaagtgggaactgtatatcccccctaaacaaaataagtccgtgctagtgccccacggcagtaagttgaaggtggtcattacttctaaatcaggcgaaatcctgtacagaatatccccatgggccaagtacgtcgttcgagaaggcgataacgtaaattatgattggatccactgggaccccgaacattcttacgaattcaagcatagcagaccaaagaagccccgttctctccggatctacgagtcacacgtgggaatatcctcacatgaggggaaggtcgccagttacaagcacttcacctgcaatgttctgcccaggataaaggggctggggtataactgcatccagctcatggcaataatggagcacgcctactacgccagcttcggctaccagatcacttcgttcttcgctgcctcttccaggtatggtactcccgaggaactgcaggaactggtggatacggctcattcgatgggcattattgtgttgctggacgtggtgcattctcatgccagcaagaactccgctgatgggcttaacatgttcgacggcacagattcctgttattttcacagcggcccacgaggcactcacgacctatgggacagccgactgttcgcttattcgagctgggagatcctgcgatttctgcttagtaacatccgttggtggctcgaggaataccgctttgacggtttccgctttgacggcgtgacctcgatgctataccaccatcacggcgtggggcagggcttctccggagattactccgagtacttcggtctgcaagtggacgaggatgcattgacctacctgatgttagcaaaccacctcgtccacacgttatgccctgactcaattaccatcgctgaggatgtctcagggatgccagccctgtgttctcccatcagccagggaggaggaggttttgattacagactggccatggccattcccgataaatggattcaactcctcaaggagttcaaagacgaggattggaacatgggtgatattgtgtacactctgactaaccgcagatacttagagaaatgcattgcatatgcagaaagccatgatcaggctttagttggggacaaatctctggccttttggctcatggacgcggaaatgtacactaacatgtccgtactgactccattcacccccgtgatcgatcggggtatccagcttcacaagatgatcagactgatcacacacgggcttggtggcgaggggtacctgaatttcatgggaaacgagttcgggcatccagagtggctcgattttcctcgaaaagggaataatgaatcttatcattacgccagaagacaattccatttgacagacgacgatctgctaaggtataagtttctgaacaactttgaccgggatatgaatcgcctcgaggagaggtacgggtggctggctgctccccaggcttatgtaagtgagaagcatgagggcaataaaataatcgcctttgaaagggccgggcttcttttcatctttaacttccatccatctaaatcctacacggactacagggtgggcacggcattgccagggaagttcaagatcgtcctggattcagacgcagccgaatacggagggcatcaaaggctggaccactccacagacttcttttccgaagccttcgaacacaacgggcggccatacagtctgctggtttacattccttcgcgggtggcactgatcttgcagaatgtcgacctgccaaac

SEQ ID NO: 12818 - DNA, 2106 bp, Artificial Sequence
  Description of Artificial Sequence: Synthetic coding sequence
atggccgcccctatgactcccgccgcccgccctgaggattatgaggccgctctcaacgctgccctcgcagatgtgcctgaacttgcaaggctgctggaaattgacccctatctaaaaccttatgctgtggatttccagcggcggtataaacaattctctcaaatcctcaaaaatattggggaaaatgaaggagggatagacaaattctcacgcgggtatgaaagtttcggagttcatagatgcgctgacgggggactgtattgtaaagagtgggcccctggagcagaaggagtctttttgacaggggatttcaacgggtggaaccccttctcttacccctataaaaaactagattacgggaagtgggaactctatatcccgcccaaacagaacaagtccgttcttgtaccccacgggtcaaagctgaaagtcgtcattacatctaaaagtggagaaatcctttatcgcatatcaccctgggcaaaatacgttgtcagggaaggagataacgttaattatgattggatccactgggatcccgagcattcctacgaattcaaacattctcgccctaaaaaacctaggtcccttagaatctacgagagtcatgttgggatatctagtcatgaaggaaaagtagcttcctataaacactttacttgtaatgttctccctagaatcaaaggactcggatataactgtatccagttaatggccataatggaacatgcttactatgcttccttcgggtatcagatcacttccttctttgcagcctcaagtcggtatgggactcccgaagaactccaggaactggttgatacagcacatagtatgggaataattgtactcctcgatgtggtacattctcacgcaagtaaaaacagtgccgacgggcttaacatgtttgacggaacagattcttgttattttcactctgggccccgcgggactcatgatctgtgggattcacgcctcttcgcctactcttcatgggaaatattacgattcctactgtctaatatcaggtggtggctggaagaatacagattcgatggatttaggttcgatggagtaacatctatgttgtatcatcaccatggggtgggacagggattctcaggggattactccgaatacttcggactgcaggtcgatgaagatgcattaacatatctgatgctcgcaaatcatctggtgcacacactttgtccagattccatcactatagctgaagatgtgtctggaatgcccgcactgtgctctcccatttcgcaaggaggaggggggtttgactaccggcttgcaatggctataccagataaatggattcagctcctgaaagaatttaaagacgaagactggaatatgggggatatcgtttacacattgactaatcggagatatctggaaaagtgcatagcatacgctgagtctcatgatcaggcgctggtgggagataaatcactcgcattttggcttatggatgccgaaatgtacactaatatgtcggtgcttacaccctttactcccgtaatcgacagagggatacagttacataaaatgattcgcttaatcacacatgggctgggaggagaagggtatcttaatttcatggggaacgaatttgggcaccctgaatggctcgacttcccaagaaaagggaataatgaatcttatcattatgcacggagacagttccacctgacagatgatgacctgcttcggtacaagtttctcaataatttcgatcgagatatgaatcgactcgaagaacgttatgggtggctagcagctcctcaggcatacgtgtctgaaaaacacgaaggaaataaaatcatcgcttttgaacgggccgggctactcttcatattcaacttccatccctccaaatcttatactgattacagagtcggaacagctctaccgggaaaattcaaaatcgtgctagatagtgatgcagctgaatatggggggcatcagagactggaccacagtactgatttcttttcggaagcttttgaacacaacggaaggccatactcattgctcgtgtatatcccctcaagggtggcattaatcctgcagaacgtcgacctcccaaat

SEQ ID NO: 12819 - DNA, 2106 bp, Artificial Sequence
  Description of Artificial Sequence: Synthetic coding sequence
atggccgcccctatgaccccagctgcacgcccggaagactacgaagctgccttgaacgcagccctcgcggacgtacccgagctggcacggcttctggagattgatccttacctgaaaccgtatgccgtagactttcagcgccggtataagcagttttcccagatacttaagaacatcggagagaatgaggggggtatcgataaattctcaagagggtatgagtcattcggggtgcaccgctgtgccgacggggggctgtattgtaaggagtgggcgccaggcgcggaaggagtgtttctgacaggagatttcaatggatggaaccctttctcttatccgtacaagaagttggattatggcaagtgggagctgtatatcccccccaagcaaaacaaatctgtcttggtgccacatggatctaagcttaaggtggtgattacctccaaatcaggcgaaatcctctacagaataagtccttgggccaaatacgttgtgcgggagggggataatgtcaactacgattggatccattgggaccccgaacacagctatgagtttaaacacagcaggcctaagaaaccgcgctctttgcggatctacgagagtcatgtcggcatctcctcacacgagggcaaagtggcatcatacaagcattttacgtgtaatgtgctccctagaatcaagggcctgggttataactgcatccagttgatggcgatcatggagcatgcttattacgcttcattcggctaccagattaccagttttttcgcagcctcctcacggtacggaacacccgaggagcttcaggaactggtcgatacggctcacagtatgggcattatcgtgctgctggatgtagtccacagtcacgccagcaagaacagcgccgacggcctcaatatgttcgatggtactgacagctgttactttcatagtggcccacgcggaacccatgatttgtgggactcccgcctgttcgcatatagcagctgggaaatcctgagattcctgttgagtaacattaggtggtggctggaagagtaccgattcgacggattcaggtttgacggagtcaccagcatgctgtaccatcaccacggggtgggacagggtttctccggggactattctgaatattttgggctgcaggtcgatgaagatgccctgacttatctcatgctcgccaatcatttggtgcacacactctgccctgattcaattacaatcgccgaggacgtgtcaggcatgcccgccctgtgtagccccatcagtcagggcggtggaggatttgactaccgcctggcaatggctattcccgataaatggattcagttgctgaaagagttcaaagacgaggattggaatatgggcgatatcgtatatactctgacaaacagacgatatctggaaaagtgcatcgcgtacgccgaaagtcacgaccaggcgttggtaggcgataagagccttgcattttggctcatggatgccgaaatgtacactaacatgagtgtgttgactccatttactcctgtcatagataggggcattcagctgcataaaatgatccggctcatcacccacggcctgggaggcgagggttaccttaacttcatgggtaatgagttcgggcaccccgaatggttggacttcccacgcaaaggtaacaacgagtcatatcactacgcccggagacagtttcacctgaccgacgatgacttgcttagatataagtttctgaacaattttgaccgggatatgaacagattggaagagaggtacggttggctggcggccccccaggcttatgtgagcgagaaacatgagggaaataagatcatcgcatttgagagagctgggttgctctttatcttcaactttcatccatctaaatcttacaccgactatcgcgtggggacagcacttcctgggaagtttaagatcgtcctggacagtgatgccgcagagtacggaggccatcagcggttggaccactccacagatttctttagcgaagctttcgagcacaacggcaggccatatagcctgctcgtgtatattccgtctagggtggctctcatacttcagaacgtggacctccccaac

SEQ ID NO: 12820 - DNA, 2106 bp, Artificial Sequence
  Description of Artificial Sequence: Synthetic coding sequence
atggcagctccgatgacaccagccgcacgacctgaagactacgaggccgccctgaacgcagcgttagctgacgtgcccgagctggcacgtctgctcgagattgatccctatctcaaaccttacgcagtcgattttcagcgcagatataaacaattctcccagattctgaaaaatataggcgaaaatgaaggtggaatcgataagtttagcagagggtatgagtcttttggcgttcatcggtgtgcggatggtggcctctattgtaaagaatgggcccccggggcggaaggcgtatttctgaccggcgattttaacggttggaaccctttttcctacccatataaaaaattggattacgggaaatgggagctgtatattccaccaaaacaaaacaaaagtgttttggtgccacacggatctaagttgaaagtggtgataacttcaaaatcaggcgagatcctgtacagaataagtccatgggccaagtacgtggttcgcgagggggacaatgtcaattatgactggatccattgggatccagagcactcctatgaatttaagcacagcaggcccaagaagccacggagcctcagaatttatgagagtcacgttgggatctcttcgcatgaaggcaaggtcgcatcttacaaacacttcacgtgcaatgtgttgcctcgaattaagggcctgggctacaattgcatccagcttatggccataatggagcacgcttactacgcctctttcggataccagattaccagttttttcgctgcgagttcacggtacggcactcccgaagaacttcaggagctggtggacaccgcccattcaatgggcatcatcgtgctgttggatgtggtgcactcgcacgcttctaaaaactccgctgatggcctgaatatgttcgatggaaccgattcttgctactttcatagtgggccgagggggacccacgacctgtgggatagcaggctgtttgcctattctagctgggaaatcctgaggtttttgctttccaacattcggtggtggctcgaggagtatcggttcgatggcttcagatttgacggtgtcacgtccatgttgtatcaccaccacggggtggggcagggattcagtggcgattacagcgagtattttgggcttcaggtagacgaggatgccctgacatatctaatgctggctaatcatcttgtgcacacactttgcccagactccatcactatcgccgaagacgtgtcgggaatgcctgccctgtgctccccgatcagccagggcgggggcggttttgactacaggctggctatggcaatcccagacaagtggatacagctgctgaaagagttcaaggacgaggactggaatatgggtgatatcgtatatactctgactaatcgacgctatctggaaaagtgcattgcttacgcagagtcacacgatcaggctctcgtaggtgataaatctctggccttctggctcatggacgctgagatgtatactaatatgtccgtccttacgccattcacccccgtaatcgaccgtgggatccagttacataagatgatcagactcatcacccatggtctggggggcgagggctatctgaatttcatggggaatgagttcggccacccagagtggttggatttccccagaaaggggaacaacgagagttaccactacgcccgtcggcagttccacctcaccgatgatgatcttttaaggtataagtttcttaataattttgatagagacatgaatcggttggaggagcgctatggctggctggctgcaccccaggcgtacgtatcagagaaacacgagggaaacaaaatcatcgcctttgagcgcgctggcttgctgttcattttcaactttcacccctcgaagagctataccgactacagagtgggcactgccttacctggcaagtttaaaatcgttcttgatagtgatgccgccgagtacggtggccatcagcggctcgaccatagtactgacttcttttctgaggcctttgagcacaatggtagaccttactcactgttagtgtacattccatccagggtggcattgattctccaaaacgttgatctgccgaac

SEQ ID NO: 12821 - DNA, 2106 bp, Artificial Sequence
  Description of Artificial Sequence: Synthetic coding sequence
atggccgcacccatgactccggctgctcgacctgaggactacgaggccgccctgaacgctgccctggctgatgttccagagctggcccgcctgcttgagattgatccctacctgaagccttacgctgtggactttcagagacgctacaaacaattttctcagatcttgaagaatatcggagagaatgagggaggaatcgacaagttcagccgcggatacgagtctttcggtgtgcacaggtgtgcagatggcgggctgtactgcaaggagtgggccccgggtgctgagggtgtatttctgactggcgattttaacggatggaatcccttcagttacccatacaagaaactggattacggaaagtgggaactctatattccgcccaagcagaacaagtctgtgttggtgccacacggaagtaaattgaaggtggtgatcacatctaagagtggggaaatcctgtatcgcattagcccctgggctaagtacgtggtacgagaaggggacaacgtgaattacgattggatccattgggatccagaacacagctacgagttcaaacacagtcggcccaaaaagccccgctcactgcggatctacgaaagccatgtggggatctcaagtcatgaggggaaagtcgccagttacaaacattttacttgtaacgtactgccccggatcaaaggcttgggatacaattgcatccagttgatggctatcatggagcatgcctattacgcttcctttggctatcagattactagtttcttcgccgctagttccaggtacgggacccctgaggagctgcaagagttggtggatacggcccactctatgggaattatagtgctgctggatgtggtgcatagccacgcgtccaagaattcagccgacgggcttaacatgtttgatggcaccgatagctgctattttcatagcggcccgcgcgggacacatgatctctgggattctagactgtttgcctacagtagttgggagatcctcagatttctcctgagcaacattagatggtggctggaggagtacagatttgacggattcaggttcgatggggttacatccatgctttatcaccaccacggagtcggacaagggttctccggcgattacagcgagtattttgggctccaggtggacgaagacgctttgacatacctcatgctggctaaccacctggtccatactctttgtccagattccatcaccattgccgaagatgtgtccggcatgcccgctctctgttcacccatttcccagggcgggggcggctttgattacagactcgcaatggctattcctgacaaatggattcagctgctcaaggagtttaaagatgaagattggaatatgggagatattgtgtataccctgacaaacagacggtatctggagaagtgcatagcatatgccgagagccatgatcaggccttggtgggtgataagtccctggccttctggctcatggacgcagagatgtatacgaatatgagtgtgctgacacctttcacaccagtcatcgatagggggatccagctgcacaagatgataaggcttattacgcatggcttgggcggcgaggggtatttgaatttcatgggcaacgaattcgggcaccctgagtggctcgattttccccgaaagggaaataatgagtcataccactacgcccgcagacaattccatctgacagatgacgatctcctgcgatataagttccttaataatttcgaccgcgacatgaacaggctcgaggagcgctatggatggctggccgctccacaggcttatgtgtctgagaagcacgaaggcaacaagatcattgcatttgagagggcgggacttctttttatcttcaactttcatccgtcaaaatcttacactgattatagagtcggaaccgctcttccaggcaagtttaagatcgttcttgattccgatgcagccgagtatggcggacaccagcgactcgaccactctaccgatttcttcagcgaagccttcgagcacaacggacggccttactcactcttggtgtacattccttccagggtggctctcatcctgcaaaacgtggatctccccaat

SEQ ID NO: 12822 - DNA, 2106 bp, Artificial Sequence
  Description of Artificial Sequence: Synthetic coding sequence
atggccgcccctatgactccagccgccagacctgaagactacgaggcggccctgaatgcagctcttgccgacgtgccagagctcgcgcggctcctagaaattgatccatacctaaaaccctatgccgtggacttccaacgcagatacaaacagttctcccagatcctcaaaaatattggagagaatgagggcggaatagacaaattctccagagggtatgaatctttcggcgtgcatcgctgcgccgacggcgggctgtattgcaaggagtgggcacctggcgctgaaggagtgtttctgactggcgatttcaatggatggaatcctttttcctatccatacaagaaactggattatggaaaatgggagctgtatatcccaccaaaacagaataagtcagtgcttgtcccgcacggctccaagctgaaggtagtaataacaagtaaatcaggggagattttatatcgtatttcgccctgggctaaatacgtggtccgggagggcgataatgtaaattatgactggatacactgggatccagaacactcttacgaattcaaacactccagaccaaaaaagccacgatctttaaggatctacgagtcccatgtgggtattagctcgcacgaagggaaggtggcctcctataaacacttcacctgcaatgtgttaccccgcattaaaggactgggatataactgtatccagctgatggctatcatggaacacgcgtattatgcttcattcggataccagattacatctttctttgctgcttcaagcagatatgggacccctgaagaactgcaggagctggttgacactgcacactccatgggcattattgtgttgctcgacgtggtgcacagccatgcatccaagaactccgccgatgggctgaatatgtttgacgggaccgatagctgttactttcactccggaccacgcgggacacatgatctctgggattctcgtcttttcgcctactctagctgggagatcctgcggtttctgctcagcaacatacggtggtggctggaagagtaccggttcgatgggttccgctttgatggagtaacatcgatgctgtaccatcatcatggtgtgggacaaggtttcagcggcgactactcagaatatttcggactgcaggtggacgaggacgcacttacctaccttatgctggcaaatcatctcgtgcatacactgtgccctgattccatcacaattgctgaagacgtgtcgggtatgccagccctgtgcagtccaatatcccaaggcggtggcggttttgattaccgcctggccatggctattcctgacaaatggatccaactcttgaaggagttcaaagatgaagattggaacatgggcgatatcgtctacacgcttacaaacaggcggtacctagagaaatgtatagcttacgccgagtcccatgaccaggcccttgttggcgataaatcgctggcattctggctgatggacgccgaaatgtacacaaacatgagcgtcttgactccttttaccccagttattgatagaggcattcagcttcataagatgatcagactgatcactcatgggcttggcggggagggttacctgaatttcatgggaaacgaattcgggcacccagaatggctggactttccacggaagggtaacaacgagagctatcactatgccaggcggcagtttcatctgacagacgacgatcttctgaggtataaatttctcaacaacttcgatcgggacatgaatagacttgaagaacgatatgggtggctcgcagcgccccaagcatatgtaagcgagaagcacgaaggcaataaaatcattgcatttgaaagggccggattactatttatcttcaattttcacccctctaaatcctacacagattaccgcgtcggtactgcgctccctggaaagtttaagattgtgctcgatagcgacgctgccgagtacgggggtcatcagcgtctcgaccatagcacggacttcttctccgaggcttttgagcataatgggcggccctacagtttgttagtttacattccatcgcgagttgccctcatcctgcagaacgttgatttacccaat

SEQ ID NO: 12823 - DNA, 2106 bp, Artificial Sequence
  Description of Artificial Sequence: Synthetic coding sequence
atggccgcacctatgactccagccgcccggcctgaagattatgaggcagccctgaatgccgctctagcagacgttccagagttggctcgcttgcttgagatcgacccgtatttgaagccatacgccgtggacttccagcgccgatacaagcaattcagccagatcctgaagaacatcggcgagaatgaaggcggcatagataaattctcccgcggatatgaatcctttggagtccacaggtgtgctgacggtggcctgtactgtaaggagtgggccccaggagcggagggggtctttctgaccggcgattttaacggatggaatccctttagctacccctataaaaagttggattatggaaagtgggagctgtacattccccctaaacagaacaagtccgtcctggtgccacatggctctaagctgaaggtagtgattacatcaaagtctggagagattctttatcgcatttccccctgggctaaatacgtcgtgcgggaaggcgataacgtgaattatgactggatccattgggaccccgaacactcctacgaattcaagcatagcagacctaagaaaccccgcagcttgcgaatttacgaatcgcacgtgggcatttccagccacgaagggaaggtggccagttacaagcacttcacctgcaacgttcttcctcgcattaaagggttgggttacaactgcattcagctgatggccatcatggagcatgcctactacgcatcatttggctatcagattacctccttcttcgctgcaagctcccggtatggcacccctgaggaactgcaggaactggtggacaccgcccactcaatgggcattatcgtcctgctggacgtagtccactctcatgctagcaaaaacagcgcggacggcctcaacatgttcgatggcactgacagctgctactttcattcaggtccccggggcacgcacgacctgtgggattctagactgtttgcctatagctcatgggagattctgcggtttctgctatccaacatccgctggtggctggaagaataccgattcgatgggtttaggttcgacggggtgacttccatgctgtatcatcatcatggggtaggtcaagggttctccggtgactatagcgagtacttcggcttgcaagtggacgaagacgccctcacatacctgatgcttgccaaccacctggtgcataccctgtgtcctgactccattacgatagccgaggatgtgagtggaatgccagcactctgcagtccaatttctcagggcggaggcggctttgactatcggctcgccatggcaatccctgacaagtggatacagttgctcaaggaattcaaggacgaagattggaacatgggcgatatagtgtacaccttaaccaatcgcagatacttagaaaaatgcattgcctacgccgagagccatgatcaagctctcgttggggataagtctctggccttttggttaatggacgctgaaatgtataccaatatgagcgtacttacgcccttcacccccgtcatagatcgggggatccagcttcacaaaatgatcagactgataacccacggtttgggcggcgagggataccttaattttatgggtaacgagttcggtcacccggaatggcttgacttcccccggaaggggaataacgaaagttatcactacgcccgcaggcagtttcatctgaccgatgacgacctcctgcgctataagtttctcaataattttgatcgggatatgaaccggcttgaggagaggtacgggtggctggctgcaccgcaggcctacgtgagtgagaaacacgaaggcaataagatcattgcttttgaacgtgccggcttgctgtttattttcaatttccatccttccaaatcttataccgattacagagttggcactgctttacctggtaaatttaaaatcgtgctggacagtgacgccgcagagtacgggggacaccagaggttggaccactctacggatttcttctctgaggccttcgaacataacggcaggccctattcactacttgtgtatatccccagcagagttgccctcatactacagaatgtggatcttccaaac

SEQ ID NO: 12824 - DNA, 2106 bp, Artificial Sequence
  Description of Artificial Sequence: Synthetic coding sequence
atggccgctcccatgacccccgctgcaagaccggaagattatgaggcagccctgaacgctgccctcgctgacgtgcctgagttggcccgactgctcgagatcgatccctacctgaagccttatgcagtagactttcagaggcgctacaagcagttttcccagattttaaagaatatcggggaaaatgaaggaggaattgataaattttctcggggctacgaaagctttggtgtgcaccgttgcgctgacggaggcctctactgtaaggagtgggctccaggcgcagagggtgtgttccttaccggcgatttcaacggatggaatcccttctcttacccttacaagaagctggactacggcaagtgggaactttacatcccccctaaacagaacaaatcagtgttggtcccgcacggatccaaactgaaagtggtgattaccagcaaatcgggagagattctttacaggatctcgccttgggccaaatacgtcgtccgggagggggataacgtgaattatgactggatccactgggatcctgagcattcctacgaattcaagcatagccgccccaagaagccacggtccctgcggatctatgagagtcacgtagggatctcatcccacgagggcaaagtggctagctacaagcattttacctgcaacgtactgccccgaataaagggcttgggatacaattgtatccagctcatggcaattatggagcacgcctactacgcgagtttcggctatcagatcacgagcttttttgccgctagctcccgatatggcacccccgaagagttgcaggaattggttgataccgctcacagcatgggcattattgtgctactcgatgtcgtgcattctcatgcctctaaaaactctgcggacggactgaatatgttcgacggcactgatagctgttatttccattctggcccgagaggtacgcatgacctatgggacagcaggctctttgcctacagctcgtgggaaatattgcgttttcttctttctaacataaggtggtggctggaggaatataggtttgacggcttccgatttgatggggtgacttccatgctgtaccaccatcacggtgtgggtcaaggattctctggcgactatagcgagtatttcggcctacaggtcgatgaagatgcgttgacttatctcatgttggctaaccaccttgtccatactttatgtcccgacagcattacaatcgcagaggacgtgagcggaatgccggcgctttgttctccaatttcacaaggaggaggaggattcgactaccggctggccatggcaatcccagacaagtggatccagctgcttaaagaattcaaggacgaagattggaatatgggagatatagtatacacactgacgaacagaaggtaccttgaaaagtgtatagcttatgcagaatcccatgaccaggccttagttggcgataagagtctcgctttttggctcatggacgccgaaatgtataccaacatgtcggttttaactccctttactcccgttatcgatcgcggaatccagcttcacaaaatgatccggttaattactcatgggctgggcggtgagggttatctgaacttcatgggaaacgaattcgggcaccctgagtggcttgacttccctagaaaaggaaacaacgaaagctaccattatgctcggagacagtttcatttgactgacgatgacttgctgcggtataagttcctgaacaacttcgaccgcgatatgaacaggctggaggagaggtatgggtggctggccgcaccccaggcgtatgtcagcgagaagcatgagggcaacaagattattgcgtttgagcgtgccggcctgctgtttattttcaatttccacccttcgaagtcctacacagactaccgggttggcactgcgctgcctgggaagtttaagattgtcttagactccgatgcagcggagtatggagggcatcagcgcttggaccatagcactgatttcttctctgaggcctttgaacacaacggaaggccttacagcctgctggtgtatatccctagccgagtcgcactaattctccaaaatgtcgatttgcctaac

SEQ ID NO: 12825 - DNA, 2106 bp, Artificial Sequence
  Description of Artificial Sequence: Synthetic coding sequence
atggcggccccaatgactcctgccgcccgtcctgaggattacgaagctgcccttaacgccgcacttgccgacgttcccgagctggcaaggttgcttgagatcgatccttatttgaagccttatgccgtagatttccagagaagatataagcagttttcccagattctaaagaacattggagaaaatgagggaggcattgacaaattcagcagaggctatgagtcattcggtgtgcacaggtgtgccgatggcgggctctactgtaaagaatgggcgccaggagcagagggtgtattcttgaccggcgatttcaacggctggaaccctttctcgtatccatacaaaaagctggattacggtaagtgggaactttatattccacccaagcagaataagtccgtcctcgttcctcacgggagcaaattgaaagtcgtcattacttctaaaagcggcgagatactttatcgaataagtccatgggccaagtacgttgtccgagagggcgacaatgtcaattatgattggatacactgggaccctgaacattcttatgaatttaagcactcacgccccaaaaagccccgaagtctgaggatctacgagtcccatgtcggaatttcatcccacgaagggaaagtcgcctcttacaaacactttacctgcaacgttttaccaaggattaagggcctcggatataattgtatacagctcatggctatcatggagcacgcctactacgctagctttgggtaccaaataaccagtttctttgccgctagctctcgatacggcacacccgaagagctgcaagagctcgtggatacggcgcacagcatggggattatcgtgctgcttgacgtcgtgcatagccatgcttcgaaaaattcggcggatgggctgaacatgtttgacggcacagattcatgctattttcatagtggtcctaggggcactcatgatctgtgggactcaaggctttttgcatacagttcttgggaaatcctgcgttttctgctgtcaaacattagatggtggctcgaggagtataggtttgacggcttccgatttgatggcgtgaccagcatgctgtaccaccatcacggcgtcggccaaggatttagcggagactattccgaatacttcgggttacaagtagatgaggacgccctcacttatctcatgctggcgaaccacttagtgcacacattatgtcctgattcaataacaatcgctgaggacgtctctggtatgccagccctgtgctccccaataagccagggagggggcggttttgactacaggctggcaatggccatccctgacaagtggatacagcttctaaaagaatttaaggacgaagactggaatatgggagatattgtgtatacactgacaaaccgacgatatctggagaaatgcatagcttatgccgaaagccacgatcaggcgttagtaggcgacaagtctctggcattttggctgatggacgccgagatgtacacaaacatgtcagttcttactccattcacaccggtaattgatcgaggcatccaactgcacaagatgatccgactgattacccatggattggggggggagggctatctgaacttcatgggtaatgagttcgggcaccccgagtggctcgacttcccccgaaaagggaacaatgaatcataccactacgcacgaagacagttccacctgactgacgatgacctccttcgatataaatttctcaataactttgaccgagatatgaatcgtttagaagagaggtatggttggctggcggccccacaggcatacgtgtccgaaaagcatgaaggcaacaagatcatagccttcgagagagctggtttactatttatatttaattttcatccctccaaaagctacactgactaccgagtaggaacagcattgcctggaaagttcaaaatagtccttgattctgacgccgcagagtatggaggtcatcagcgactggatcatagcacagacttcttcagtgaagcatttgaacataacggccgcccttactctttgctggtttatatcccttctcgagttgccctcatcctgcagaacgtggatttaccgaac

SEQ ID NO: 12826 - DNA, 2106 bp, Artificial Sequence
  Description of Artificial Sequence: Synthetic coding sequence
atggcggcgccgatgacgccggcggcgcgaccggaagattatgaagcggcgttaaatgcggcgctagcggatgtaccggaattagcgcgattattagaaatagatccgtatttaaaaccgtatgcggtagattttcaacgacgttataaacaattttcgcaaatactaaaaaatataggtgaaaatgaaggtggtatagataaattttcgcgtggttatgaatcgtttggtgtacatcgttgtgcggatggtggtttatattgtaaagaatgggcgccgggtgcggaaggtgtatttttaacgggtgattttaatggttggaatccgttttcgtatccgtataaaaaactagattatggtaaatgggaactatatataccgccgaaacaaaataaatcggtattagttccgcatggttcgaaactaaaagtagtaataacgtcgaaatcgggtgaaatactatatcgtatatcgccgtgggcgaaatatgttgtacgagaaggtgataatgtaaattatgattggatacattgggatccggaacattcgtatgaatttaaacattcgcgaccgaaaaaaccgcgatcgttacgaatatatgaatcgcatgtaggtatatcgtcgcatgaaggtaaagttgcgtcgtataaacattttacgtgtaatgtactaccgcgaataaaaggtttaggttataattgtatacaactaatggcgataatggaacatgcgtattatgcgtcgtttggttatcaaataacgtcgttttttgcggcgtcgtcgcgttatggtacgccggaagaactacaagaactagttgatacggcgcattcgatgggtataatagtactattagatgtagtacattcgcatgcgtcgaaaaattcggcggatggtttaaatatgtttgatggtacggattcgtgttattttcattcgggtccgcgaggtacgcatgatctatgggattcgcgtctatttgcgtattcgtcgtgggaaatactacgttttctattatcgaatatacgttggtggttagaagaatatcgttttgatggttttcgatttgatggtgtaacgtcgatgctatatcatcatcatggtgtaggtcaaggtttttcgggtgattattcggaatattttggtttacaagttgatgaagatgcgttaacgtatctaatgctagcgaatcatctagtacatacgttatgtccggattcgataacgatagcggaagatgtttcgggtatgccggcgttatgttcgccgatatcgcaaggtggtggtggttttgattatcgactagcgatggcgataccggataaatggatacaactattaaaagaatttaaagatgaagattggaatatgggtgatatagtttatacgttaacgaatcgacgttatttagaaaaatgtatagcgtatgcggaatcgcatgatcaagcgttagtaggtgataaatcgttagcgttttggctaatggatgcggaaatgtatacgaatatgtcggttttaacgccgtttacgccggttatagatcgtggtatacaactacataaaatgatacgattaataacgcatggtctaggtggtgaaggttatctaaattttatgggtaatgaatttggtcatccggaatggctagattttccgcgaaaaggtaataatgaatcgtatcattatgcgcgtcgacaatttcatttaacggatgatgatctactacgttataaatttttaaataattttgatcgtgatatgaatcgactagaagaacgatatggttggctagcggcgccgcaagcgtatgtatcggaaaaacatgaaggtaataaaataatagcgtttgaacgtgcgggtttactatttatatttaattttcatccgtcgaaatcgtatacggattatcgtgttggtacggcgctaccgggtaaatttaaaatagttttagattcggatgcggcggaatatggtggtcatcaacgactagatcattcgacggattttttttcggaagcgtttgaacataatggtcgaccgtattcgctattagtatatataccgtcgcgtgtagcgttaatactacaaaatgtagatctaccgaat

SEQ ID NO: 12827 - DNA, 2106 bp, Artificial Sequence
  Description of Artificial Sequence: Synthetic coding sequence
atggccgccccaatgacccctgcagcccgccctgaggattatgaagccgccctaaacgcagccctggcagatgtccctgagctggcacgacttctagagattgacccatacctgaagccgtacgccgtggactttcagaggaggtacaaacagttctcccagattctgaagaacattggtgaaaatgagggaggaatcgacaagttcagtcgagggtatgaatcgttcggggtgcacaggtgtgctgacggcgggttgtattgtaaggaatgggcacctggcgccgagggagtgtttctgactggcgacttcaacgggtggaaccctttctcatacccgtataaaaagctcgactacgggaaatgggaactctacatcccccctaagcagaacaaatccgtgctcgtgccacacggctcgaagctcaaagtggtaatcacttccaaatcgggcgagattttgtatagaattagcccctgggctaaatatgtcgtacgtgagggtgataacgtgaactatgactggattcattgggatccagagcacagttacgaattcaaacattccagacctaaaaagccgaggtctctgcggatttacgagtctcacgtgggcatcagcagccacgagggcaaggtggcgagctataaacactttacttgtaacgtcttaccacgaatcaaaggcctcggatataactgcatccagcttatggccatcatggaacacgcatactacgctagcttcggataccagataacgagcttctttgccgccagctcccgctatggcaccccagaggagttgcaggagcttgtggatacagcacacagcatgggaatcatcgttctgctggatgtggtgcatagccatgcctctaaaaactctgcagatgggctgaacatgtttgatggcaccgactcatgctacttccactccggccctcgaggcactcacgacctgtgggatagccgactttttgcgtactcttcttgggaaattcttcgcttcctgctctcaaatatcagatggtggttggaagagtaccggttcgatggcttcagattcgatggagtcacctcgatgctttaccaccaccacggagtcggccaaggattctccggagactactccgagtacttcggcctccaagtagatgaggatgccctgacatacctgatgctagcaaatcacctcgtgcatactctctgtccagattcaattaccattgccgaggatgtgtcaggtatgccggctctttgctcccctatcagccagggtggtggaggttttgactatcgactcgcgatggccatcccagacaagtggattcagctgttgaaggaattcaaagacgaagattggaatatgggcgatatagtttacacattgacaaatcgcagatacctggagaaatgtatcgcttatgctgaatcccatgaccaggctctggtaggcgacaaatcactggccttttggttaatggacgccgaaatgtatacaaacatgtcggtcctgaccccctttaccccggtcatcgacagaggaatccagctgcacaaaatgatcaggttaataactcacggcctgggcggcgaaggctaccttaatttcatgggcaacgaattcggccatccggaatggctcgacttccccaggaaggggaataacgagagctaccactacgcccggagacagtttcatctcaccgatgacgatctgcttcgctataagttcctgaacaattttgacagggatatgaaccgcctggaagagagatatgggtggttggccgccccgcaggcttatgtgagcgagaagcacgaaggaaataagattattgcctttgagcgggcggggctgctgttcatctttaactttcatccctccaaaagttacacagactatagagtcggtacggccctgccaggaaagtttaaaattgtgttggactccgatgcagccgaatacggtgggcaccagaggctggaccatagcactgacttcttttcagaggcctttgagcacaatggccgaccctatagcctattggtgtacattccctctagagtcgcgcttatcctccaaaatgtggacttacccaat

SEQ ID NO: 12828 - DNA, 2106 bp, Artificial Sequence
  Description of Artificial Sequence: Synthetic coding sequence
atggcagcccctatgacccctgccgctcgcccagaggattatgaagccgccctaaacgcggctcttgccgacgtccccgaactggcaaggctcctggagattgatccctatctgaaaccttacgccgtggactttcaaaggaggtacaaacagttttctcaaattctaaaaaacatcggcgagaatgagggcggtatagacaaattttcacggggctatgagtccttcggtgtccataggtgcgccgatggcggcctgtactgtaaagaatgggcgcctggggcagagggcgtctttctgacaggggacttcaacggctggaatcccttttcatatccctacaagaaattagactacggtaagtgggagctgtatatacctcctaaacagaacaaaagtgtgctggtccctcatgggtccaagctaaaagtcgtgatcacgtctaagtcaggggaaatcctttataggatctctccttgggccaagtatgtcgtcagagagggagacaatgttaactacgattggatccactgggaccccgaacactcctacgagttcaaacattctcgtcccaagaaacccaggtcgttgagaatttatgaatcccacgtgggaatctcctctcacgagggaaaggttgctagctacaagcacttcacctgtaatgttctcccaaggatcaaaggccttggttataactgcattcagctgatggcgatcatggaacacgcttattatgcatcttttggataccagattacttcattcttcgcagcaagctctcgttacggaacacccgaagagttgcaggaactggtggataccgcgcattcaatgggtatcatcgtgctgctagacgtagtccattcgcatgcgtccaagaactctgctgacggactgaatatgttcgatgggacagactcctgctactttcattctggccccagagggacccatgatctgtgggatagcagactgttcgcctactcctcctgggagattcttaggtttttgctgagcaacattaggtggtggcttgaagaataccgttttgatgggtttaggtttgatggtgtgaccagcatgctttaccatcatcatggagtggggcaaggcttcagtggtgactattctgagtactttggcctgcaggtggatgaggatgccctgacgtatctcatgctggccaatcatctggtgcatacgctttgtcccgattcaattaccatagcagaagatgtgagtggcatgcctgccctctgcagtccaatcagccaggggggagggggctttgactaccgcctggccatggccatcccagataaatggatccaactcttgaaagagttcaaagacgaggattggaatatgggagatatcgtttataccctcactaatagaagatacctggaaaagtgtattgcgtacgctgaatcacatgaccaggcactggtaggagataagtcactagctttttggcttatggatgctgaaatgtacaccaacatgtctgtgctgacccctttcacgccagtcatcgaccgcggcatccaattgcataaaatgatccgccttatcacccacgggctaggcggcgaagggtacctcaactttatgggcaatgaatttggtcaccctgaatggctagactttcccaggaaggggaacaacgaaagttaccactacgccaggcggcagtttcatctgacagatgatgatttgttgcgttacaagtttctaaacaactttgatagggatatgaaccggctggaggagagatacggctggctcgccgcccctcaggcatacgtttcagagaaacacgagggcaacaagataatagcatttgagcgggctggactactgttcatcttcaatttccaccctagcaaatcatacacagattatcgagttgggaccgcacttcccggcaagttcaagatagttctggactccgacgcagctgaatacggtggccatcaacggctcgaccactcaacagacttcttctccgaggcatttgagcataatggacgcccctactccctgctggtgtatataccatcacgcgtcgctttgatactgcagaatgtagatttacccaac

SEQ ID NO: 12829 - DNA, 2106 bp, Artificial Sequence
  Description of Artificial Sequence: Synthetic coding sequence
atggcagcgcccatgacccccgctgcccgccctgaggactacgaggcagctcttaacgctgccttggcagatgtcccggaattagctagactattagagattgatccctatctgaagccctacgcggtggacttccagagacgctacaagcagttctcccagatactcaagaacatcggcgaaaatgagggaggcatagataagttctccagagggtatgaatcttttggcgttcatagatgcgcggatggcgggctgtattgcaaagagtgggctcccggagctgaaggcgtgtttctgacgggtgatttcaacggttggaatcccttcagctacccgtataagaagctggattatggtaagtgggaattgtatattccaccaaagcagaataagtcggtgctggtcccccacggcagcaagcttaaggtggtcattacatcaaaatccggagaaatcttgtatcggatcagtccatgggcaaaatatgtggtccgagaaggggacaacgtcaactacgactggattcactgggatcctgaacactcttacgaattcaagcactcacgccccaagaagccaagatcgctccgcatctacgagtcacatgtcgggatttcttcccacgaggggaaggtggcatcatacaaacactttacatgtaatgtgctccccagaatcaaaggactaggatataactgcatccaacttatggcgattatggagcacgcttattacgcatcattcgggtaccaaattacaagtttttttgccgcaagctcacgctacggcactcccgaagaactgcaggagttagtcgacacagcccattctatgggaatcatcgtgttacttgatgtggtccactctcacgcgagcaaaaatagtgccgatggactaaacatgtttgacgggacggactcctgctacttccatagtggtccacgcggaactcacgacttgtgggactctcggctcttcgcatactcaagttgggaaatcctcaggtttcttctctctaacatccgctggtggttggaggaatacaggttcgacggcttccgattcgacggggtcacctccatgctgtatcaccaccacggagttggacaggggttcagcggggactacagtgaatacttcggcctgcaggtcgatgaagacgccctcacctacttgatgcttgctaaccacctggtgcacactttatgccctgattctatcacgattgccgaggacgtttcgggtatgccagctctgtgtagtccgatttcccagggaggcggcggttttgactatcgtctagccatggccatccctgacaagtggattcagctgctgaaagaattcaaagatgaggattggaatatgggagacatcgtgtatacacttactaatagacgctatctggaaaaatgcatcgcctatgccgagagccacgaccaggccctcgttggagacaagagtcttgcattttggctgatggatgcagagatgtacacgaatatgagcgtcttgaccccattcacaccagttatcgataggggcatccagctgcataagatgatccgccttattactcatggcttaggcggagagggctaccttaacttcatgggcaatgagttcggacaccccgaatggttagatttcccacgaaagggaaacaacgagtcctatcattatgcacggagacagtttcacttaaccgatgacgacctcctgcgttacaaattcctcaacaacttcgacagagatatgaacaggttggaggagaggtacggctggctggctgctcctcaggcctacgtgtcagagaagcacgagggtaataaaattatcgccttcgaaagggctggtctgttgttcattttcaatttccatccctccaaatcttacacggattaccgtgttggcacggccttgcctggcaaatttaagatcgtgctcgacagtgacgccgctgaatacggagggcatcaaagactcgatcacagtacagacttcttttccgaggcattcgaacataatggcaggccctacagtctgctcgtttacataccctcccgggtagccctgattctgcagaatgtggacctccccaat

SEQ ID NO: 12830 - DNA, 2106 bp, Artificial Sequence
  Description of Artificial Sequence: Synthetic coding sequence
atggctgctccgatgactccggctgcaagacccgaggactacgaagcagcacttaatgccgccctggcagatgtgcccgagttggctcggttgctcgagatcgatccctacctgaagccatacgctgtggactttcagcgcagatacaagcaattcagtcaaatcctaaaaaacattggtgaaaacgaaggcggcatcgataagttttcccgtggctatgagagctttggcgtccaccggtgtgctgacggaggcttgtactgcaaggagtgggcacccggagctgagggcgtgttcctgactggtgatttcaacggctggaaccctttctcttacccttacaaaaagctggactatggcaagtgggaactttacatcccccctaagcaaaataagagtgtgttagtccctcacggaagtaagcttaaggtggtgatcacctcaaaaagcggggagatactatacaggatctctccgtgggctaagtacgtggtacgagagggggataatgtcaactacgactggatacactgggatcctgagcactcttacgaatttaagcacagccggccaaaaaaacctcggtcactgagaatctacgaatcccacgtagggatcagttctcacgaaggaaaagtggcttcatacaagcactttacctgcaacgttctgccacggatcaaaggcctggggtacaactgcattcagttaatggccatcatggaacacgcctattacgcctcttttggctaccaaataacttcattcttcgccgcaagttcccgatacggcacccctgaggagctgcaagagctcgtcgatactgcgcatagtatgggaatcattgttctgttggacgtagtgcactcccatgcatccaagaactctgcagacggcctcaatatgtttgacggcaccgactcctgttactttcacagcggtcctagaggtactcatgatctgtgggacagtcggctgtttgcttactcctcttgggagatcttgcgattcctgctgtctaatatcagatggtggcttgaggaatacaggttcgacggatttcgattcgatggcgtgactagtatgctctaccaccaccacggggtaggacaggggttttcgggcgactactctgaatactttggtttgcaggtggacgaagacgcactaacttacctgatgttagccaaccacctagtgcacacattatgcccagacagtattactatcgctgaggacgtgtccggaatgccggccctgtgttcccctatctcccagggtggcgggggctttgactatcgacttgccatggccatccccgataagtggatccaactgctgaaagagtttaaggatgaagactggaatatgggcgacatcgtctatacattgacaaatagaaggtaccttgaaaaatgcattgcttacgcggagagtcatgatcaggctctggtcggcgataagtctttagcattctggctgatggatgcagagatgtacactaatatgagcgtgcttacgccttttaccccagtgatagacagggggatacaactgcacaagatgattcgactgataactcatggtctaggcggagagggttatctaaatttcatgggcaacgagtttggccacccagaatggctagactttcctcgtaaaggaaacaatgagtcctaccactacgccaggcgacaatttcacctgacagacgacgatttgctgcggtataaatttctcaacaattttgaccgggatatgaatcgcctggaggagagatacggttggctggccgcaccgcaggcctacgtaagcgagaaacatgagggaaataagattatagccttcgagcgggcgggtctcctttttatcttcaactttcatcctagtaagagttacacagattacagggtgggcactgcgctcccaggcaagttcaagatcgtgctggacagtgacgccgccgaatacggcggacaccagagactggatcattctactgatttcttctccgaagcctttgagcataatggacgcccttatagtcttctggtatatatcccctcacgagtggccctcatactgcagaacgtggacctccctaac

SEQ ID NO: 12831 - DNA, 2106 bp, Artificial Sequence
  Description of Artificial Sequence: Synthetic coding sequence
atggctgcccctatgacccccgctgccagacccgaggattacgaggcagccctgaatgccgccctggccgatgtccccgagctggccaggctgcttgaaatcgatccgtacttgaaaccctatgcagtcgactttcaacggcgctacaagcagtttagccagatcctaaagaacatcggggaaaacgaagggggcattgacaagttctcacgcggatacgaaagttttggagttcatagatgcgccgatggtggactttattgcaaggagtgggcacctggcgcagaaggcgtatttctgacaggggattttaatggatggaatcccttctcatatccctataaaaagctggactatggcaaatgggaactgtatatcccccctaaacagaacaagtcagtgctcgtgccacacggctcaaaattaaaggtggtcatcacaagcaagtcgggagagatcctgtacagaatctcaccctgggcaaagtatgttgtccgggaaggagataacgtgaactatgattggatccactgggaccctgagcactcctacgagtttaagcacagcagacctaaaaagcctagaagtcttcggatctacgagtcacacgtgggaatctcgtctcatgagggaaaagtcgccagttacaaacatttcacttgtaacgtgcttccaaggataaaaggattaggttacaactgcatacagcttatggctatcatggaacacgcttattatgccagcttcgggtaccaaattacttccttttttgccgcctcttccaggtatgggactccagaggaactgcaggaattggttgacacagcccattccatgggcataatcgtgctgctcgacgttgtgcattcacacgcttccaaaaactccgcagacggacttaacatgttcgacgggactgacagctgttacttccactccggaccccgaggaacccatgacctgtgggactcccgcctctttgcttacagttcctgggaaattctccgattcttgctgtctaatatcagatggtggctggaggaatatcgctttgacggtttccgattcgacggggtgactagcatgctctatcaccaccacggcgtgggccagggtttcagcggagactactcggaatacttcgggcttcaggtcgatgaggacgccctgacctacctgatgttagccaaccacctggtgcacacactgtgtcctgacagtatcactatcgctgaggacgtctccggaatgcccgccctatgcagccccatctcccagggaggcggcgggtttgactaccgactggcaatggccatcccagacaagtggatccagctcctgaaggagtttaaagatgaggactggaatatgggagacatcgtgtatacactgaccaatcggcgctatctggagaagtgtatagcctatgccgaaagtcacgatcaggccctggtgggggacaaatctctggctttctggctgatggacgctgagatgtatacaaatatgagcgtcctgactcccttcacgcccgtaattgatcgagggatacagttgcacaagatgatacggctgattacccacgggttgggtggcgaaggctacctgaatttcatgggaaatgagttcggacatcctgaatggctggacttcccgagaaagggaaataatgaaagctaccactatgctcggagacaattccacctcacggacgatgatttacttaggtataaatttctaaacaacttcgacagagacatgaatagactggaggaacgatacggatggctggccgcaccacaggcgtatgtttcagagaagcacgaaggcaacaagatcattgccttcgagcgcgccggcctgcttttcatattcaacttccatccaagcaaatcttacacggactaccgggtgggcacagccctacctgggaagttcaagatcgtccttgactcagacgcagccgagtatggcggacaccagcgtctggaccattcgaccgatttcttttcagaggccttcgaacataacggacgcccttacagtctgcttgtctacattcctagtcgggtggccttaatcctgcaaaatgtggacctccctaac

SEQ ID NO: 12832 - DNA, 2106 bp, Artificial Sequence
  Description of Artificial Sequence: Synthetic coding sequence
atggccgcgcccatgacgccggctgccaggcctgaggactacgaggctgccctgaacgcagccttggctgatgtgcctgagctggcgcgtctgctggagatcgacccctatttgaagccctacgccgttgacttccagcgccggtacaagcagttcagccaaatcctcaagaacattggtgagaatgagggtggtattgataagttctcccggggctacgagtccttcggagtccaccgttgcgccgatggtggattgtactgtaaggagtgggccccaggtgctgagggtgtctttttgaccggtgactttaacggttggaaccccttctcgtatccttataagaaactcgactacggaaagtgggaactgtacattcctccgaagcagaataaaagcgtcttagtccctcacggatctaagctcaaggtcgtgataacctcaaaaagcggagagatcctctaccgcatttctccctgggcgaagtacgtggtacgcgaaggcgacaatgtgaactacgactggatccactgggacccagaacactcatatgagtttaagcattcccgacctaagaaaccgcgcagcctgagaatctacgagagccatgtcggtatctcctcccacgagggcaaggtcgccagttataagcacttcacctgcaacgtgcttccccggatcaaaggccttggatacaactgtattcagcttatggcgatcatggagcatgcgtactacgcttctttcggctaccagatcaccagcttcttcgctgcgtcaagccggtacggcacgcccgaggagttacaggagctcgtcgacacagctcacagtatggggatcattgtcctcctggatgttgttcactcccatgcctccaagaactccgccgacggcctgaacatgttcgatggcacggactcctgctatttccatagtggtccgcgcgggactcacgatctctgggattcccggctttttgcctacagttcctgggagatcctgcgtttcctgctgtccaatatccggtggtggttggaggagtacaggttcgacggcttccggtttgacggcgttacctctatgctctatcaccatcacggcgtgggtcagggtttctctggcgactattcggagtattttggacttcaggtggatgaggatgctctgacttacctcatgctggccaatcacctcgtccataccctgtgcccagatagcatcactatcgccgaggatgtttcaggcatgccggccctttgctccccgatcagccagggaggcggtggtttcgactaccgtcttgcgatggccattcccgacaagtggatccagctgctgaaggagttcaaggatgaggactggaacatgggtgacatcgtctacaccctcactaatagacgctatttggaaaagtgtatcgcttacgctgagtcccacgaccaggccctggtcggtgacaagtcccttgctttctggctgatggatgcagagatgtacaccaacatgtccgttctcactcctttcacccctgttattgatcgcggtattcagctgcataagatgatccgcctgatcacccacggccttggtggcgaaggttacctgaacttcatgggtaatgagttcggtcacccggaatggttggacttccctaggaagggtaacaacgaatcgtaccactacgctaggagacaattccaccttacggacgatgacttgttgcgttacaagtttctcaacaacttcgaccgcgacatgaaccgtctggaggaaaggtacggctggctcgccgccccccaggcctacgtgagcgaaaagcatgagggaaacaagatcatcgctttcgagcgagccggtttgctgttcattttcaacttccacccgtcgaagagttacacggattaccgcgtcgggaccgccttgcccggcaagttcaagatcgtcttggactccgacgccgccgagtatggtggacaccaacgcttggaccattccaccgacttcttcagtgaggctttcgaacataacggtcgcccgtactctttgttggtttatatcccctcgagagtggctctcattctccaaaacgtggacctacccaac

SEQ ID NO: 12833 - DNA, 2106 bp, Artificial Sequence
  Description of Artificial Sequence: Synthetic coding sequence
atggctgcacccatgactccagccgcccggcccgaggattacgaagctgctttgaatgcagctttggccgacgtgccggaactagcccggcttctcgagatcgacccatacctcaagccctacgccgttgattttcagcgccggtataagcagttctcccagattttgaaaaacattggagaaaacgagggaggaatagataaattcagtcgggggtacgaatccttcggtgtacatcgatgtgccgatggcgggctgtactgtaaggagtgggcgcctggcgcggagggagttttcctgacgggagacttcaacggttggaatccatttagctacccatacaaaaaactggattacggtaagtgggaactttacatcccccctaaacagaacaaaagtgtgttagttccacatgggagtaagcttaaggtggtcatcacatctaagtcaggcgagatcctatatcggatttctccatgggcgaaatacgtggttagagaaggcgacaacgttaactacgattggatccattgggacccagagcactcctatgagtttaagcattccagaccaaagaaacctcggtctctacggatatacgagtcccatgtggggattagctctcacgaaggaaaggtagcctcttacaagcattttacgtgtaacgtgcttccacgcatcaagggactcgggtacaattgtattcagttgatggctatcatggagcatgcctactacgccagttttgggtaccagatcacttctttctttgctgcgagcagtcgatacggaacacccgaagagctgcaggagctggtagacactgctcacagcatgggcatcatagtactcctcgatgttgttcacagtcacgcgagcaaaaatagcgccgatggcctcaacatgttcgatggcacagacagctgttattttcattcggggccgcgcgggacacacgatctctgggattcaaggctcttcgcctattcctcatgggagatccttagatttttactgagcaacattcgctggtggctcgaagagtaccgttttgatggctttagatttgatggtgtcacctctatgttgtatcaccatcacggcgtcggccaaggcttctcgggcgattattccgaatacttcggcttgcaggtcgacgaagacgctttgacctatttgatgttggcaaaccatcttgtgcacactttgtgtccagactcgattactatagcggaagatgtcagcgggatgcctgctctgtgttcgcctatatctcagggtgggggcggattcgattataggctggctatggctatccctgacaagtggatacagctgctaaaagagttcaaagacgaagactggaacatgggggacattgtgtacaccctgacgaataggcggtacctagagaagtgcattgcatatgcagaatcacatgatcaggctttagtgggggataagtccctggccttttggctgatggacgccgaaatgtatacgaatatgtcggtactgacacctttcactccagtgattgatcgtggcatacaactccacaagatgataaggttgattactcacgggctgggaggagaggggtatctgaatttcatggggaatgagttcggacatccagaatggctcgactttccgcggaaagggaataatgagtcctaccattacgctcgtagacagttccacctaactgacgatgatctgttgcgctacaaattcctcaacaactttgaccgtgatatgaatcgcctggaggagcggtatggatggctggcagccccccaggcatacgtgtcagagaaacacgaggggaataagataattgcattcgagcgtgccggtctgctcttcatttttaattttcatcccagcaagagttataccgactaccgcgtgggaaccgcactgcccggcaagtttaagatcgtccttgactcagacgccgctgaatacggagggcaccaacggctggatcactctactgattttttttccgaggcgttcgagcacaatgggaggccgtactctttgctcgtttatattccaagtcgcgtggctttaattctgcagaacgtcgatctgccaaac

SEQ ID NO: 12834 - DNA, 2106 bp, Artificial Sequence
  Description of Artificial Sequence: Synthetic coding sequence
atggccgcccctatgacccctgccgcccgccccgaggattatgaagctgcacttaatgctgctctggcagatgtccctgaactggctagactgctggagatcgacccctacctcaaaccttacgcagtggactttcagaggagatataagcagttttcacaaatactaaagaacataggggagaatgaagggggcatcgataaatttagcagggggtatgaatccttcggggtgcataggtgtgctgatggtggcctgtactgcaaggagtgggctccaggagccgagggggtatttctgaccggagacttcaacgggtggaaccctttctcctacccttataaaaaactggactatggcaagtgggaactctacattccacccaagcaaaacaaatcagttcttgtgccacacgggagcaagctcaaagtggtgatcacctccaaatctggcgaaatcttatataggatatcaccgtgggccaagtatgtcgtacgcgaaggagataacgtaaactacgactggatccactgggacccagaacatagctatgaattcaagcattcccgcccaaaaaagcccaggtcactgcggatttacgagtcacatgtcggcatctcaagccatgagggaaaagtggcatcttacaaacattttacctgcaacgtgctgccccggatcaagggtcttgggtacaactgcatacagcttatggcgataatggaacatgcctattatgcttctttcggctatcagatcaccagtttctttgcggcttcatcccggtatgggacccctgaagaacttcaggaactggtggatactgctcacagtatgggcatcatcgtgctgctcgacgtcgttcactcccacgccagtaagaactctgctgatggcttgaacatgtttgacgggactgattcatgttactttcacagcgggccccggggcacccacgatttgtgggacagtaggctctttgcgtatagctcatgggagatactgaggtttctgctaagcaacatccgctggtggctggaggagtataggtttgacggatttaggtttgacggcgtcacgagtatgttgtaccaccaccatggcgtggggcaaggtttctcgggagactatagcgaatactttgggctgcaagtagacgaggacgccctgacctacctgatgctggccaatcacctagtgcatacactgtgtccagattcaattaccatagccgaggacgtgagcggcatgccagctttgtgcagtccgatttcacagggcggaggtggctttgattaccgactagccatggctattcccgacaaatggatccagctcctcaaggagtttaaagacgaggactggaacatgggcgatattgtctacacactgaccaacagaaggtaccttgagaagtgtatcgcctacgccgaaagtcacgatcaggccctggtgggagacaaaagtctcgccttctggcttatggacgccgaaatgtatacgaacatgtctgttttgactcccttcacccccgtgattgaccggggcatccaactacacaaaatgattaggttaattacacatggattggggggggagggctacctgaatttcatggggaatgaattcgggcatccagagtggctcgatttccctagaaagggaaataatgagagctatcactatgctcgtaggcaatttcatctgacggacgatgatttgctccggtacaagtttctgaataatttcgaccgagacatgaaccgactggaagaacggtatggatggctggctgctccgcaagcctatgtgagcgagaagcacgaggggaacaaaattattgccttcgagcgcgcagggctactgttcatctttaattttcacccgtccaaatcatacacggattaccgggttgggactgccttgccaggaaagttcaagatcgtgcttgactccgatgccgctgaatacggcggccaccagcgattagaccattccacagattttttctccgaggctttcgaacataatggcagaccttatagtctacttgtatatattccttccagagtggcgcttatcttacaaaacgtggatttgcctaac

SEQ ID NO: 12835 - DNA, 2106 bp, Artificial Sequence
  Description of Artificial Sequence: Synthetic coding sequence
atggctgcgccaatgacacccgctgcccgacctgaggattatgaggctgccctcaacgctgcactcgccgacgtccccgaactggctagactgctagagatcgacccttaccttaagccatatgccgtcgatttccaacggagatacaagcagttcagtcagattctgaaaaacattggcgagaatgagggaggcatcgacaaattttcccggggttatgaatcttttggagtccatagatgtgcagatggcggactctactgtaaggagtgggcacccggcgcggagggcgtgttcctcactggggactttaatggatggaaccctttcagctatccttataaaaagctggattacgggaagtgggaactctatatcccaccaaagcaaaacaaatctgtacttgtgcctcatggctcaaagcttaaggttgtgattacgtccaagagcggtgaaattctgtatcgaatttccccttgggcgaagtatgtagtgcgagaaggggacaacgttaattatgactggatccactgggaccccgagcattcctacgaattcaaacattcacgcccaaagaaacctcggtcactccgaatctacgagagccacgtaggcatttcttcacacgagggtaaggtcgcaagctacaaacattttacttgtaacgtgctacctagaataaaaggactcggatacaattgcattcagttaatggctattatggagcacgcctattacgcttcctttggctaccagataacatctttcttcgccgcatcctcacggtatgggaccccagaagagctgcaggaactggtggatacagcccacagcatgggaatcatcgttctgttagatgtggtacactcacacgcttctaaaaattctgccgacggtctaaatatgttcgacgggaccgatagttgctattttcacagcggtccccgaggtacacacgacctgtgggactcaaggctatttgcctattcctcctgggagatactgcgattcctcctaagcaacatacggtggtggctcgaggaatatcgttttgatggcttccgttttgacggcgtcacaagcatgctatatcaccaccatggagttgggcagggcttcagtggagactactctgagtatttcgggctccaggtggatgaggacgccctgacctatctgatgctggccaaccacctcgtgcacaccctgtgtcccgacagcattaccatcgccgaggacgtctccggtatgcccgccctatgttccccgatctctcagggggggggtgggtttgattaccggctggcgatggccattccggataagtggattcaacttttaaaggaatttaaggatgaggactggaacatgggcgacatagtttataccctgaccaatcgaaggtatcttgagaagtgcattgcctatgctgagagccatgatcaggcattggtgggagataagagtttggccttctggcttatggatgcagaaatgtacacaaatatgtcagtccttactcccttcacgccggtcattgacaggggcatccagctgcacaagatgattcgcctcattactcacgggttaggaggagaaggttacctcaacttcatgggcaatgagtttggccatcctgagtggctcgattttccgagaaaaggaaataacgaaagttatcattatgcgaggaggcagttccatctgaccgacgacgacttgctccggtataagttcctcaataactttgaccgggatatgaataggctggaggagaggtacgggtggctcgctgcgccccaggcgtatgtgtcagagaagcatgaggggaataaaattatcgcatttgaacgggcaggcctgctgtttatttttaacttccacccaagcaagagctacactgattaccgggttgggactgcactgcccggtaagttcaagatagtcctcgactctgatgctgcagagtatggaggccatcagagactggaccatagcacggattttttttccgaggcctttgagcacaacgggagaccatactccctacttgtctacatcccttcacgggttgcgctcattttgcaaaacgttgatttacccaat

SEQ ID NO: 12836 - DNA, 2106 bp, Artificial Sequence
  Description of Artificial Sequence: Synthetic coding sequence
atggcagcaccgatgactcctgccgcgagacctgaagactacgaagcagcgctgaacgccgccctggcagatgtgcctgagctggcccggttgttggaaatagacccatatttgaagccctacgcagtcgattttcagagacgatacaaacagttctcccaaatcctgaagaacatcggggaaaacgaaggtggcatagataaattctctaggggttatgaaagcttcggcgtccatcgttgcgccgacggtggattgtactgcaaggaatgggctcctggagccgagggcgtgttcctgaccggggatttcaacggctggaatcccttcagctacccctacaagaaactggattatggtaagtgggagctatatattccacccaaacagaacaagagtgtgctcgtgcctcatggttctaagctcaaagtagtcatcactagcaagtcaggggaaatcctgtatcgtatcagcccctgggcgaaatacgtggttagggaaggcgataatgtcaattacgattggatccactgggaccccgagcatagctacgagtttaagcactctaggccgaagaagcctaggtccctccgcatttacgaatcacatgtgggcatttctagccacgaaggcaaggtcgcgtcatataaacatttcacatgcaatgttctgccacgaataaagggtctagggtacaactgtatccagttgatggccatcatggaacatgcttactatgcgtctttcgggtatcaaatcacaagcttctttgcggcatccagcagatacggaacgccagaagagctgcaggaacttgtcgacactgctcactcgatggggattatagtattacttgacgttgtgcactcacacgccagtaaaaacagtgcagatggcctgaatatgttcgatggtactgattcctgttacttccatagcggtcccagggggacccacgacctgtgggatagccgtctgtttgcttatagctcttgggagattctgagatttctgttaagtaacatccgctggtggctagaggagtacagatttgatggtttccgtttcgacggggtgacgagtatgctttatcaccatcatggggtgggccagggcttcagcggagactatagcgagtattttggacttcaggttgatgaagacgccctcacttatctcatgcttgccaaccatcttgtgcacactctgtgtccagattccattactatcgcagaggatgtctctggaatgcccgcactatgcagccccattagtcagggggggggtgggttcgactatagactggctatggccatacccgacaaatggatccagctgctgaaggaattcaaagatgaagactggaatatgggcgatatcgtatacacgctgacaaatagacgctatctggagaagtgcatcgcctacgcggaaagccatgatcaggcgctggtgggggacaaatctctggccttttggctgatggacgcagaaatgtatacaaacatgagtgtcctcacacccttcactcccgtcatagatagaggaattcagctgcacaaaatgattagattgatcacgcatggtttaggtggcgagggctacctgaatttcatgggcaacgagtttggccacccagagtggctggacttcccacgtaaagggaataacgaatcataccactacgccaggagacagttccatcttacagatgatgacctgctgagatataagttcctgaacaattttgatcgcgacatgaatcggctcgaggagagatacggttggctggcggctccccaagcttacgtgtcggagaaacacgaaggcaacaaaattatagcatttgagcgagccgggcttctgttcatcttcaacttccatcccagtaaaagctacacagattacagggtaggaactgctctgcccggaaagttcaaaatcgtcctagatagtgatgcagctgaatatgggggtcatcaaaggctggatcattccacagatttcttctcagaggcgtttgaacacaatgggaggccctacagcctccttgtttatatcccttctagagtggcacttatcctgcaaaatgtggatttgccaaac

SEQ ID NO: 12837 - DNA, 2106 bp, Artificial Sequence
  Description of Artificial Sequence: Synthetic coding sequence
atggcagctccaatgaccccagccgcccgccccgaggactatgaagcggccctcaacgctgctcttgcagatgtcccagaattggcccggcttttggaaattgatccttacctcaagccctatgccgttgactttcagagaagatataaacagtttagccagattctgaagaatatcggtgaaaatgagggcggcattgacaagttttctcgtggctacgagtcttttggagttcaccgctgtgcagacggcggcttgtattgcaaagaatgggcacccggggctgaaggcgtcttcctcacaggcgactttaatggctggaacccatttagctatccatataaaaagcttgactacgggaagtgggaactatacatcccacctaagcaaaacaagagcgtcctggtgccccacgggagtaaattgaaggtggtaatcacatcaaagtctggggagatcctttaccggatcagtccttgggccaagtacgtcgttcgagagggagacaacgtgaactacgattggatccactgggaccccgaacactcatacgaattcaaacacagcagaccaaaaaagccacggtctctgcggatttatgagtcccacgtgggaattagtagccacgaagggaaggtggcttcctataagcacttcacctgtaatgtcctaccacgcatcaaggggctcggatacaattgtatccagctcatggcaataatggagcacgcttactacgcctcatttggttaccagataactagtttctttgctgcttcttccaggtatggcacaccagaggaactccaggaactggtggatactgcccatagcatgggtatcattgttctgctggacgtcgtccacagccacgcatcaaagaactccgcagacgggctgaatatgttcgatggcactgattcatgctattttcatagcggtccacgaggtacccacgatctctgggatagccgattgttcgcatatagctcttgggagatactgaggtttttattgtccaatatccgttggtggctggaagagtatcgtttcgacggcttccgctttgatggagtgaccagcatgttgtatcatcatcatggcgtcggccagggctttagtggagattatagcgagtatttcgggctccaagtggatgaagacgccttgacctatctgatgttggccaatcacctcgtacacactctgtgtccggacagcattaccattgctgaggatgtaagcggtatgccagctctgtgttcccctatcagccagggggggggaggatttgactacaggctcgcaatggctatccccgataagtggatccaactactaaaagaattcaaggatgaagactggaacatgggtgatattgtgtacactctgactaacaggcggtatttggagaagtgtatcgcttacgcggagtcccatgaccaggcgttggttggagataaatcgctcgccttctggctgatggacgccgaaatgtacaccaatatgtccgtgcttacaccctttactcccgtgatcgatagaggaatccagctgcataaaatgatcaggctgataactcatgggttgggcggcgagggttacctgaacttcatgggaaatgagttcggacatccagagtggctcgacttcccccggaagggcaacaatgaatcctatcactatgcccggagacaattccacttgacggacgatgacctcttgcgctataaatttctgaataacttcgatcgggatatgaatcgactcgaggagcgatatggttggctagcagctccgcaggcgtatgtttcggagaagcatgaagggaataagataattgcatttgagcgggccggtctgctgtttatattcaatttccacccatcaaaatcgtacacagactacagggttggcaccgccttaccaggcaaatttaagatcgtgctggattctgacgctgccgagtatgggggccaccaaagactcgaccattccactgattttttctcggaggcgttcgagcataatggcaggccatatagcttgttggtgtatattcctagccgggtcgctctaatcctgcagaacgtggacctgccaaac

SEQ ID NO: 12838 - DNA, 2106 bp, Artificial Sequence
  Description of Artificial Sequence: Synthetic coding sequence
atggctgctcccatgacaccagcagccaggcctgaggattatgaagcggccttgaatgcggcactggctgacgttcctgaactcgcccggctacttgagatcgacccgtacctgaaaccgtacgctgtggactttcagaggagatataagcagttctcccagatcttaaagaacatcggagaaaacgagggtggaattgacaagttttcacgcggctacgagtcctttggggtccatcggtgtgctgacggcggtctgtactgcaaagaatgggccccaggcgctgagggtgtgtttctgacgggcgattttaacgggtggaacccattctcatatccatataagaaactcgactacggcaaatgggaactgtacatacctcctaaacagaacaagagtgtgttggttccacatggttctaagcttaaagtggtgattacatccaagtctggagagatcttgtaccgcatttcgccttgggccaagtacgtcgtccgtgaaggcgataacgtgaactacgactggatccactgggacccggaacattcttacgaattcaagcattctagaccgaagaaacctagatccctgcgcatatacgagtctcacgtgggtatcagtagccacgagggcaaagtggctagttacaagcacttcacctgtaacgtgctccctcgcatcaaaggcctgggctacaattgtatccaactcatggctatcatggagcatgcctactatgcctccttcggctatcaaatcaccagctttttcgctgcgtcaagtcgctatggtaccccggaagagctacaagagcttgtagacacagcacacagtatgggcatcattgtccttcttgacgttgtgcattcgcatgcatctaaaaactcagcggatggactgaacatgttcgatggaaccgattcctgttactttcactccggtccgcgcggaacgcatgacctctgggatagtcgcctcttcgcctacagttcttgggagatcttgcgcttccttctgtcaaatattcgctggtggcttgaggaataccgatttgacgggtttaggtttgatggcgttaccagcatgctttatcaccaccacggcgtggggcagggctttagcggcgattacagtgagtacttcggactccaggtggatgaggacgccctaacttacctgatgctagccaaccatcttgtgcacaccttgtgcccagactccataactattgctgaggatgtaagtggcatgccagccctatgcagccccatctcccagggaggcggcggattcgactaccgcttggctatggctatccccgacaaatggattcagttattgaaggagttcaaagatgaggattggaatatgggagacatcgtgtacacactgaccaatcggcggtatctggagaagtgcattgcatatgcagaatcccacgaccaggcattggtgggcgacaagtcgttggcattttggttgatggatgccgagatgtataccaacatgtccgtcctcacgcccttcacacctgtcatcgataggggcatccagctgcataagatgatcaggctcatcacccacggtttgggtggcgaaggttatctcaattttatggggaatgaatttgggcatcctgagtggctggactttcctcggaagggcaataacgaatcataccactacgcccggcgacagtttcatttgactgatgacgacttgctcagatataaatttcttaacaactttgaccgggatatgaatagactggaggagcgatatggctggttagcagcgcctcaggcctatgtctccgagaaacatgaaggtaacaaaattatagccttcgagcgcgctggcttgttgtttatctttaacttccacccgtccaagtcgtacaccgactaccgagtcggtaccgcactacctggaaagtttaaaatagtcctggactcggacgccgccgaatacgggggacaccagcgactggatcattcaaccgatttctttagtgaggcatttgaacacaacgggagaccctactctctactggtctatattcccagtagggtcgccctaattttacaaaatgtggatctgcccaac

SEQ ID NO: 12839 - DNA, 2106 bp, Artificial Sequence
  Description of Artificial Sequence: Synthetic coding sequence
atggctgctccaatgacacctgcagcaagaccagaagattatgaagctgctcttaatgctgcccttgctgatgtaccagaattagctagacttcttgaaattgatccttatttaaaaccatatgctgtagactttcaaagaagatataaacaattttctcaaattttaaaaaatataggagaaaatgaaggtggaatagataaattctcaagaggttatgaaagtttcggagtacacagatgtgcagatggaggtttatattgtaaagaatgggcacctggtgctgaaggagtttttttaacaggagattttaatggatggaatccattttcatatccatataaaaagcttgattatggaaaatgggaattatacattccaccaaagcaaaacaaatcagttttggttccacatgggtctaaattaaaggtagtaataacttctaaatcaggtgaaatattatatcgtattagtccttgggcaaaatatgttgtaagagaaggagataatgttaattatgattggattcattgggatccagaacatagttatgaatttaaacattcaagacctaaaaagccaagatctcttagaatatatgaaagtcacgttggaattagttctcatgaaggaaaagttgcttcatataagcatttcacatgtaatgttttaccaagaattaaaggtcttggatataattgtatacaattaatggccattatggaacatgcttattatgcttcttttggatatcaaattactagtttttttgcagcttcatcaagatatggaactccagaagaacttcaagaattggttgatacggctcactcaatgggaatcattgttttattagatgttgtccattcacatgcaagtaaaaattcggcagatggattaaatatgtttgatggaacagactcttgttatttccatagtggacctagagggactcatgatttgtgggactcaagacttttcgcttatagtagttgggaaattcttagatttcttctttctaatattagatggtggttagaagaatatagatttgatggatttagatttgatggagtaacttctatgctttatcaccatcatggagttggacaaggattttcaggagattattccgaatattttgggttacaagttgacgaagacgcattaacatatttgatgttggctaatcatttagttcatactttatgtcctgactctataacaattgctgaagacgtatcagggatgcctgcattatgttcaccaatttcacaaggagggggtggatttgattatagattagcaatggccattccagataaatggattcaattgttaaaggaatttaaggatgaagattggaatatgggagatattgtatatacattgactaatagaagatatttagaaaaatgtatagcatatgcagaaagtcatgatcaagctcttgttggagataaatcattagcattttggcttatggatgctgaaatgtacactaatatgagtgttcttacaccatttacaccagttattgatagaggaattcaattacataaaatgattagacttattactcatggattgggtggagaaggatatcttaatttcatgggaaatgaattcggacatcctgaatggttggatttcccacgaaaaggaaataatgaatcatatcattatgctagaagacaatttcatttaactgatgacgatttattaagatataaattcttaaataacttcgatagagatatgaatagattagaagaaagatatggatggttagctgctcctcaagcttatgtatctgaaaaacatgaaggaaataagattattgctttcgaacgtgcaggattattatttatattcaattttcatccaagtaaatcatacacagattatagagttggaacagcattaccaggaaaatttaagatagttctagattctgatgcagcagaatatggaggacatcaaagacttgatcattcaacagattttttttctgaagcatttgaacacaatggtagaccatattcacttttagtttatattccaagtcgtgtcgctcttatacttcaaaatgtagacttaccaaat

SEQ ID NO: 12840 - DNA, 2106 bp, Artificial Sequence
  Description of Artificial Sequence: Synthetic coding sequence
atggctgctcccatgacaccggcggctagacccgaggactatgaggcggccttaaatgctgcactggctgacgtgcctgaacttgcccgtttgctggaaatagatccttatcttaagccttacgctgttgacttccaacgccgatacaagcagttctctcaaattctgaagaacattggagagaacgagggcggtatagacaagttttctagaggatatgagtcatttggggtacacaggtgcgcagacggaggcctgtattgcaaagagtgggcacccggcgccgagggggtgttcttgaccggcgatttcaatggttggaacccattttcctacccctataagaaattggattatggaaagtgggaattgtacatccctccaaaacagaataagtccgttcttgtcccacatggatcaaagttaaaggtggtgatcacaagtaaaagtggggagatactgtatcggatcagtccatgggctaaatacgtggtacgagaaggcgacaatgtaaattacgactggattcactgggatcctgagcatagctacgaattcaagcattcgaggcccaagaaacccaggtctctccggatctacgagagtcacgtgggtatcagcagccacgaaggcaaggtagcctcttacaaacacttcacttgcaacgtgctaccacgtataaagggcctcgggtacaactgcatccagctgatggctattatggaacatgcctactatgccagctttgggtaccagatcactagctttttcgccgccagttcccgctacggaactccggaggaacttcaggagttagtcgacactgcacactccatgggcatcattgtcctcctggacgtagttcactctcacgcctctaagaatagtgccgatggtctgaacatgttcgacgggacagactcttgctattttcatagtggtcctagaggcacgcatgatctttgggactcccgtttgtttgcttattcttcatgggaaatattacgttttctactaagtaacatacgctggtggctggaggagtacagattcgatggattcaggtttgatggcgtcacatcgatgctgtatcaccaccacggtgtcggccaaggattttccggagattattccgagtacttcgggctgcaggtagacgaggatgcacttacctacctgatgctggctaaccatctcgtacatacactttgcccggatagtatcactattgcagaggacgtgtcaggtatgcctgctctatgttcgcctatcagtcagggaggagggggcttcgactatcgcttagccatggccattcctgacaaatggatccagctgctcaaagagtttaaagatgaagattggaatatgggtgacatcgtgtacactctgacaaaccgacggtacctagagaagtgtatcgcatacgcggaatcccacgaccaagctctggtgggcgacaaatcgctggcattttggctgatggatgcggagatgtacaccaatatgtcggtgctcaccccatttacccctgtcatcgatagggggatccagctgcataaaatgatccgcttgatcacccacggcctgggaggggaggggtatttaaattttatgggcaacgaattcgggcatcctgaatggcttgacttccctcgcaagggaaataacgaaagctaccattacgcgaggcgacaattccatcttactgacgatgacttgctgcgctacaagttccttaacaattttgatcgcgacatgaatcgtctggaggaaagatatgggtggttagctgcgccacaggcttatgtgagtgagaaacacgaggggaataagatcatcgctttcgagagagctggtttgctgtttatcttcaatttccacccatccaagagctacacagactacagggttggcaccgccctaccaggcaaatttaaaatcgtccttgacagcgatgcagccgaatatgggggacatcaaaggctggaccactcaacggacttttttagcgaggcgttcgagcacaatggccgcccatacagccttcttgtgtacattcctagccgggtagcccttattctgcaaaacgtcgatctcccaaac

SEQ ID NO: 12841 - DNA, 2106 bp, Artificial Sequence
  Description of Artificial Sequence: Synthetic coding sequence
atggccgcccccatgactcccgcagcccgaccagaagactacgaagccgcacttaacgccgctcttgccgatgtccccgaattggctcgcctcctagaaatagacccatatctaaaaccttatgccgtggatttccagcggaggtacaagcagttctcccagatactaaaaaacattggagagaacgaaggggggatcgataaattttcgagagggtatgaatcattcggggtgcatagatgtgcggatggaggattgtactgtaaggagtgggctcccggagccgagggggtatttctgactggggatttcaacgggtggaatccattctcttatccttataaaaaactagattatgggaaatgggaactatatataccacccaagcagaacaaatcagtcctcgtacctcatggatcaaaactcaaggtggttataacaagtaaatctggagagattctctatcgaatctccccatgggcaaagtatgttgtcagggagggagataacgtaaactatgattggattcattgggatcccgaacactcctatgagttcaaacactcgagacccaaaaaaccacggtccctcaggatctatgaatcacatgtgggaatttcctcccatgaaggaaaagtggcatcttacaaacattttacatgtaatgttctgccccggatcaaagggctcggatataattgcatccagttgatggcaattatggaacatgcatattatgcttctttcgggtatcagatcacatctttctttgctgcctcctctcggtatgggactcccgaggaacttcaggagctggtagatactgcccattctatggggatcattgttctgctcgacgttgtgcactcacatgcctctaaaaattccgccgacggactcaatatgttcgatgggacagattcatgctacttccactcggggccaaggggaacgcacgatctgtgggattctcggctttttgcctattcatcttgggagatcctccggttcctgctctctaatatcaggtggtggctcgaagagtatcgattcgatgggtttcggttcgatggggtaactagtatgttataccaccatcacggggtggggcaggggttcagtggagactattcggaatactttggattgcaagtagacgaggatgctctcacatatctgatgttagcaaatcacctagtacatacactctgtccagattctatcacaatagcggaagatgtgtccggaatgccagctctatgttcccccatttctcagggagggggagggtttgattataggctggctatggccataccagataaatggattcagctactaaaagaattcaaagacgaagattggaatatgggggatatcgtttatactctcacaaaccggaggtatttggaaaaatgtatagcctatgctgagtcccacgatcaggcactggtgggggataagtccctggctttctggttaatggacgccgaaatgtatactaatatgtcagtgcttactccgttcacacccgtaattgataggggaatccagttacacaaaatgataaggctgataacacacgggctaggaggagaaggatatctcaacttcatgggaaacgaatttggacaccccgaatggctcgatttcccccggaaagggaacaatgaatcctatcattatgcacggcgacagtttcatctcacggatgatgatctacttcgatataaattcctgaataatttcgatcgggatatgaacaggcttgaagagagatacgggtggttggctgcccctcaggcttatgtctctgaaaaacatgaagggaacaaaatcatcgccttcgaaagagccgggctactctttatctttaacttccatcccagtaaatcatatacagactatagggtggggactgcactgcccgggaaattcaagatagtgctcgattctgacgccgcggagtacggaggacaccagagactggatcattctactgatttcttctccgaagcttttgaacacaacggacgaccctatagtttgctggtgtatatcccttctagggtagctctcatcctgcaaaacgtagatctccccaat

SEQ ID NO: 12842 - DNA, 2106 bp, Artificial Sequence
  Description of Artificial Sequence: Synthetic coding sequence
atggcagcacctatgacaccagccgcaagaccggaagattacgaagctgctcttaatgctgctttggctgatgtgccagagcttgcacgtcttcttgaaattgatccttatcttaaaccgtatgccgtcgacttccaacggcgttataaacaattttcgcagatcttgaaaaacataggagaaaacgagggaggcatagataaattctcgcgtggatatgagtcattcggagtccatagatgtgcggatggaggattatattgcaaagaatgggcacctggagctgagggggtgttcttaactggcgacttcaatggatggaatcctttctcatatccatacaaaaagttggattacgggaaatgggaattgtatattcctccaaagcaaaacaaatctgtcctcgtcccacatggatctaagttgaaagttgtgattacctcaaaaagcggagagatattgtacagaatctctccctgggcaaagtatgttgttagggagggtgataatgttaattatgattggattcactgggaccctgagcattcatatgagttcaagcattctcgaccaaagaaaccaagaagtttgcgaatctatgaaagtcatgtcggaatctcttctcacgaggggaaagtagcctcatataaacattttacttgcaacgttttgccgagaattaaaggattaggatataattgcatccaactaatggctataatggaacacgcgtactacgcatctttcggatatcaaattacaagttttttcgcagctagctcgagatatggaaccccagaagagttgcaagaattagttgatacggcacatagtatgggaattatcgtacttctcgatgtggtgcatagccatgcatctaagaatagcgccgacggacttaacatgttcgacggtaccgattcgtgttacttccatagcggaccaagaggtactcacgatctttgggattctcgtttgtttgcttactcgtcatgggagattcttcgatttctgctgtcgaacattcgatggtggctcgaggagtatagattcgatggatttagattcgacggagttacttcaatgctctatcaccaccatggtgtcggacaaggattctctggtgactacagtgaatactttggtttgcaagttgatgaagatgctttaacatacctgatgttggctaatcacttggttcacacactttgcccagatagtattaccatagccgaagatgtttcaggaatgccggctttatgcagtcctataagccaaggaggaggtggttttgattacagacttgctatggctatcccagataaatggattcaattgttgaaagaatttaaagatgaggattggaatatgggagacattgtatacacactcacgaaccggcgttacttggaaaaatgcattgcatatgccgagtctcacgatcaagctttggtaggagataaatcattagcattctggttgatggatgcagagatgtataccaacatgtcggttttgactccgttcacaccggttatcgatagagggattcagctccataaaatgatccgactcatcacacacggtcttggaggagaaggatatctcaatttcatgggaaacgaatttggacatccagaatggctagattttccacgaaagggaaataatgaatcctaccattacgcccgtcgacaattccaccttaccgatgatgatcttttacgatataaattccttaataacttcgatcgggatatgaacaggctggaggaacgatatggatggctcgcggctccacaagcgtatgtatccgagaaacacgaaggaaacaaaatcatcgcatttgaacgcgcaggccttctcttcatattcaactttcacccatcaaagtcatacacggactaccgcgttggtactgcactgccaggcaaatttaagattgtattggattccgatgcagcagagtatggaggacatcagcgacttgatcattccacggatttctttagcgaggcttttgagcataatggccgaccatatagtttgcttgtatacatcccgtctcgtgttgctcttatactgcagaacgtagatcttcctaat

SEQ ID NO: 12843 - DNA, 1071 bp, Artificial Sequence
  Description of Artificial Sequence: Synthetic coding sequence
atggaggaaggaatgaatgtgctccacgattttgggatccaatccacccattacctccaggtgaattatcaggacagccaggattggttcatcctcgtctcggtgatcgcagacctccgcaatgccttctatgtcctgttcccgatttggtttcacctgcaggaggccgtggggatcaaacttctttgggtggcggtcatcggagattggttgaatctcgtgttcaagtggatcctgtttggacagcggccatactggtgggtgctcgacaccgactattactcgaacacttcagtgccactcatcaaacagttccccgtcacctgcgagacgggtccagggtcaccgtccggacatgcaatggggacggccggagtctactacgtgatggtgacctccactttgtcgatctttcagggaaagatcaagccgacgtaccgcttccggtgtctgaacgtaattctgtggttggggttttgggctgtgcaactgaacgtgtgcctgtcccgcatctacctggcggcccacttcccgcatcaagtggtcgctggagtcctgtccggaatcgcggtggcggagactttctcacacatccattcaatttacaacgcgtcccttaagaagtacttcctgattaccttctttctgttctccttcgcgattggattctacctgctcttgaaaggactgggagtggacctgttgtggactctggaaaaggctcagagatggtgcgagcaaccggaatgggttcatattgacactactcctttcgcgtccctcctgaaaaaccttggtactctgttcggactcgggctggctctgaattcatccatgtacagagagtcatgtaaaggaaaactgtcaaagtggctcccattccgattgtcgtccatcgtggcaagcctcgtgctcctccacgtgtttgactcactgaaacctccgtcccaggttgaactggtgttctacgtgttgtccttctgcaagtcggcggtggtgccgctggcctctgtgtcggtgattccgtactgcctcgctcaagtcctcggacaaccacacaagaaatcgctc

SEQ ID NO: 12844 - DNA, 1071 bp, Artificial Sequence
  Description of Artificial Sequence: Synthetic coding sequence
atggaggaaggaatgaatgtgctgcacgatttcggcatccagagcacacattatctgcaggtgaactaccaagattcccaagattggttcatcctggtgtcggtgattgcagatctgagaaatgcgttctacgtcctgttccctatctggtttcacctccaagaagccgtcggtattaaactgctctgggtggcagtgatcggagattggctgaatctagtctttaagtggatcctgtttggacagcgcccatattggtgggtgttggacactgattactactccaacacgtcagtcccacttatcaagcagtttccggtgacctgcgaaacaggcccaggatccccttctggacatgctatgggcaccgccggtgtctactatgtgatggtgacaagtaccttgagcattttccagggcaaaattaagcccacatatcgcttccggtgtcttaacgtgatactgtggctggggttctgggctgtccagctgaacgtgtgtctgtctcgcatctatctggctgctcatttcccgcaccaggtggtggccggtgtgctgtccggcatcgctgtagcagaaactttcagccacatccactctatatacaacgcaagcttgaagaagtatttccttatcacattttttttgttcagctttgccatcggcttctacctactgttgaaggggttaggtgtagaccttctgtggactctggagaaagctcagagatggtgtgagcagccagaatgggttcatatcgacaccacacctttcgctagtctcctcaagaacctgggtaccctgtttgggcttggcctggctctgaatagctccatgtacagagagtcctgtaagggtaagttgtcgaagtggctgccctttcggctgtcgtccattgtggcctccctagttttactccacgtgttcgacagtctaaagcccccaagtcaagtggagctcgtgttttacgtgctcagcttttgtaagtcagccgtggtcccattggcttccgtgtccgtcattccatactgcttagcacaagtcctgggtcagcctcataagaaaagtttg

SEQ ID NO: 12845 - DNA, 1071 bp, Artificial Sequence
  Description of Artificial Sequence: Synthetic coding sequence
atggaagaaggcatgaacgtgctgcatgacttcggaatccagtcgactcactaccttcaagtcaattatcaagatagccaagactggttcatcttggtgtcagtgatcgccgatttgagaaacgctttctacgtgctgtttccaatctggtttcatctgcaagaagctgtgggaattaagctgctttgggtcgcagttatcggagactggctgaacctcgtgtttaagtggatcctctttggacagcggccatactggtgggtcctggacactgattactactctaacacctccgtccctcttatcaagcaatttccggtgacgtgcgagactgggccgggttcgccatcgggtcacgcaatgggaactgcaggagtttactacgtgatggtcaccagcaccctgtcgatatttcaggggaagatcaagcccacctaccggttccgctgtcttaacgtgatcctgtggctcggattctgggcggtgcagctcaacgtgtgcttgtcccgcatctacctggcggcacatttcccccatcaagtggtcgcgggagtgctgtcggggatcgctgtcgcagaaaccttctcacacatccactcaatctacaatgccagcctcaaaaagtactttctgatcacctttttcctgttctctttcgcgatcggtttctacttgctgttgaagggcctcggggtggacttgctgtggacgctggaaaaagcccagcggtggtgcgaacagccggagtgggtgcacattgacaccacccctttcgcgtcgctgctcaaaaatctggggactctgttcggcctcgggctcgccctcaacagctcgatgtacagggagtcgtgcaagggcaagctgtccaagtggctgccattcaggcttagctcgattgtggcctcgcttgtgctgctccacgtctttgattctcttaagccgccgtcacaggtggagttggtgttctatgtcctgtcattctgtaaatcggcggtcgtgccgctggcttcagtctccgtcatcccctactgcttggctcaagttctcggtcagccgcacaagaagtccctt

SEQ ID NO: 12846 - DNA, 1071 bp, Artificial Sequence
  Description of Artificial Sequence: Synthetic coding sequence
atggaggaggggatgaatgtgcttcacgacttcggcatccaatccacccactacctgcaagttaactatcaggactcccaggattggttcattctggtcagcgtgatcgcggacctccggaacgccttctatgttctctttcccatatggttccatctgcaggaggctgtgggcattaagctgctctgggtggctgtgatcggcgattggcttaacctagtatttaagtggatcctgttcggacagcggccctactggtgggtgcttgacaccgattattactccaacacgtccgtgcctttgataaagcagtttccagttacttgcgagaccgggcctgggtcaccttccggacacgcaatgggaactgctggagtgtactacgtgatggtcaccagcactctttccatctttcaggggaagataaaacctacatatcgattccgctgcctgaatgtcatcctctggctggggttctgggctgtgcagctaaacgtttgtctgtcccgaatatacttggctgctcattttccacatcaggttgtggcaggggtcttaagcggaatcgccgtggctgaaaccttcagccatatccactcgatctataacgcaagtctgaaaaaatattttctgatcacttttttcctgttcagtttcgccattggattttatcttctcctcaaagggctcggggtggatctgctgtggaccctagagaaagcccagaggtggtgcgaacaacccgaatgggttcacatcgataccacaccctttgcatcgcttttgaaaaatctcggcaccctgttcggcctgggactggcactgaactcatctatgtatcgcgaaagctgcaaaggcaaactatctaaatggttgccatttaggctgtcatcgattgtcgcaagccttgttctgctgcacgtttttgattcgctgaagccaccatcgcaagtggagcttgtcttttacgtgctatcattttgcaagagtgccgtggtacctctcgcttcagtttccgtgattccttactgcctcgctcaggtcttggggcaacctcacaaaaagagcttg

SEQ ID NO: 12847 - DNA, 1071 bp, Artificial Sequence
  Description of Artificial Sequence: Synthetic coding sequence
atggaagaagggatgaacgtgctgcatgacttcggcatccagtcaacccattatctgcaagttaactaccaggactcacaagactggttcatccttgtgtcagtgattgcagatctccgtaacgctttttacgtgctctttcctatctggtttcatctgcaagaggctgtcggaattaagctcctttgggtggctgtgattggtgattggctcaatctcgtgttcaaatggattctgttcggccaaagaccatactggtgggtgctcgatacggactactactcgaatacttcggtgccactgattaagcaatttccagtcacgtgtgagactggacccgggagccctagcggacacgcaatggggacggcaggcgtgtactacgtcatggtgactagcactctttcgatatttcaaggcaagattaagccgacgtatcgctttaggtgtctgaacgtcatactgtggctgggtttctgggcagtgcaacttaatgtgtgcctttcaaggatttaccttgctgcccactttcctcaccaagttgtggcaggagtgctttcgggaattgcggtggcggaaacttttagccatatccattccatctacaacgcctcgctgaagaagtactttctcatcacttttttcctgttctcattcgcaattggtttctatctgctgctgaaaggtcttggggtggatctgctctggacccttgagaaggcgcaacggtggtgcgaacagcccgagtgggtgcatatagacaccaccccatttgcatcgctgctgaagaaccttgggacgctgttcggacttggtcttgcactgaactcgtcgatgtaccgggaatcttgtaagggaaagctgtcgaaatggcttcctttccgactctcgtccattgtggccagccttgtccttctccacgtgtttgattcccttaagcccccatcgcaggtcgaattggtgttttacgtcctttcgttttgtaagtccgcagttgtcccgcttgccagcgtgtcggtgattccttactgtctggcccaggtcctcggacagccacataagaaatcactg

SEQ ID NO: 12848 - DNA, 1071 bp, Artificial Sequence
  Description of Artificial Sequence: Synthetic coding sequence
atggaagagggcatgaacgttctccatgactttgggattcagtccacccactacttacaggtcaactaccaagatagccaggattggttcatattggtgagcgttattgcagaccttaggaacgctttctatgttctcttcccgatatggttccaccttcaagaggcagtcggtattaagctcctctgggtcgctgttatcggtgactggttgaatttagtcttcaaatggatcctgtttggtcaacgcccttattggtgggttctggatacagactactattcaaacacgtccgtgccgctgattaaacagtttcctgtgacctgcgaaacgggacccggatctccatcaggccacgccatggggacggccggcgtgtactatgtgatggtgacgagcactctctccatcttccagggtaaaatcaagcctacgtaccgcttccgatgcctgaatgtaatcttgtggcttggcttctgggcagtgcagctaaacgtctgcctaagtcggatttacctcgcggcgcacttcccccatcaagtggtggcaggggtgctctcaggaattgcggtggccgagaccttcagccacattcactccatctacaatgcctccctgaaaaaatatttcctgattaccttcttcctgttctcatttgccattgggttctatctactgctgaagggcctgggtgtggacctcctgtggaccttagaaaaggcgcagcggtggtgtgaacagcctgaatgggtccacatcgataccaccccttttgctagcctgctgaagaatctgggaactctcttcggcctgggtctggcgctgaattcctcgatgtatcgcgagtcctgcaagggaaagctgtcgaaatggctccctttcagactcagttcaatagtagcgtccctggtgctgctgcacgttttcgacagtcttaaaccgccctcacaagtggaactcgtgttctacgtgctgtccttctgtaagtcggccgtcgtacctctggcaagtgtttccgtgattccatattgtctggcccaagtgctgggccagccacataagaagtcattg

SEQ ID NO: 12849 - DNA, 1071 bp, Artificial Sequence
  Description of Artificial Sequence: Synthetic coding sequence
atggaggagggcatgaacgttttgcacgactttggaattcaatccacccactacctgcaggtgaactaccaggatagccaagattggtttatactggttagcgttattgcggatttgcgcaatgcgttctacgtgctcttccctatttggtttcatctgcaggaagcagtcggcattaagctcctttgggtcgcagtgatcggtgactggctgaacctcgtgtttaagtggatactgtttggtcagcgtccgtactggtgggtgctggatactgattactactccaatacttcggtgcccctcattaagcaatttccagtcacctgtgaaaccgggcccggatcacccagcggacatgccatgggtactgcaggagtgtactacgtgatggtgacctcgacgcttagcatatttcagggaaagatcaagcctacttatagatttcgctgtctgaatgtgatcctttggctgggattttgggccgtgcaactcaacgtgtgcctgtccagaatatacctcgccgcacattttccccaccaggtcgttgcaggcgtgctgtcgggcattgccgtggcagaaaccttttcacatattcattcaatctataacgcttcactgaaaaagtactttctgattacctttttccttttttcgtttgctattggattctaccttctgcttaagggactgggagtggacctgctgtggactctcgaaaaagcccagaggtggtgcgaacaacctgaatgggtacatatcgataccactcccttcgcatcgcttcttaagaacctcggtacgctttttggactgggactggcactgaactcatcaatgtaccgggagtcgtgtaagggaaagctcagcaagtggcttcctttcagacttagttcgattgtggctagcctcgtgctgcttcatgtgtttgattcgcttaaacctccatcgcaagtggaactggtgttctatgtgctgtccttttgtaagtccgcagtcgtgcctctcgcttcagtatcagtgatcccttactgtctggcacaggtcttgggtcaacctcataagaaatccttg

SEQ ID NO: 12850 - DNA, 1071 bp, Artificial Sequence
  Description of Artificial Sequence: Synthetic coding sequence
atggaggaaggaatgaatgtgctgcacgatttcggaatccagtcaacgcactacctccaggtgaactatcaggattcccaggactggttcattctcgtgtctgtcatcgccgatctgcggaatgcattttacgtgctgttccccatctggttccatctgcaggaagccgtgggaatcaaactgctgtgggtggcagtgatcggagattggctgaatctcgtgttcaagtggatcttgtttgggcagcggccatactggtgggtgctcgataccgactactactctaacaccagcgtgcctttgatcaaacagtttcctgtcacctgcgagacgggaccaggatccccgtccgggcacgctatgggtactgcaggtgtgtactacgtgatggtgacctcaaccttgagcatatttcaaggcaagatcaagccgacctacaggtttaggtgtctcaacgttatcctttggctggggttctgggccgtccaacttaatgtgtgcctgtcccggatctacctggcagcccacttccctcaccaggtggttgctggcgtgttgtcgggaatcgcggtggcggaaaccttttcacacatccacagcatttacaacgcatccctgaagaagtatttcctcattaccttcttcctgttttcctttgccatcggtttctatctgcttctcaaggggctgggcgtggacttgctgtggacccttgaaaaggcgcagcggtggtgcgaacagccagagtgggtgcatatcgatactaccccgttcgcctcgttgctgaagaacttgggaaccctgttcggacttgggcttgcgctgaactcatccatgtaccgcgaatcctgcaagggcaagctctccaagtggctgccatttagactgtcgtccatcgtcgcctcgctggtgctgctgcacgtgttcgactcgctgaagcctccttcccaggtggagctggttttctacgtgctgagcttctgcaaaagcgctgtggtgcccctggcttcagtgagcgtgatcccgtactgcttggcccaggtcctgggccaaccacacaaaaagagcctg

SEQ ID NO: 12851 - DNA, 1071 bp, Artificial Sequence
  Description of Artificial Sequence: Synthetic coding sequence
atggaggaaggcatgaatgtgcttcacgactttggaatccagtcaactcactacttgcaggttaattatcaggattcacaagactggttcatcctagttagcgtgattgcagacctccgcaacgctttttatgtgctgtttcctatatggttccatttacaggaggcggtcggtatcaaactgctatgggtggcagttatcggagattggttaaacttagtgtttaagtggattctatttggacaaaggccttactggtgggttttggacaccgactactattctaacacatcggtgccgctgataaaacagttcccggttacttgcgaaacgggccctggcagtccctctggtcacgcaatggggaccgccggtgtgtactatgtcatggttacaagtaccctgtcaattttccagggtaagatcaaaccaacctacagattccgttgcctcaacgtcattctctggttgggattctgggccgtccagctcaatgtttgtctcagccgaatctacctggctgcacacttcccccaccaggtcgtcgctggggtcctctcagggatcgcagtggccgaaaccttctctcacattcattccatctacaacgccagcttaaaaaagtattttctgataacttttttcctattctcgttcgctatcggcttctaccttttactaaagggcctgggggtggatctactttggacacttgaaaaagcacagcgttggtgtgagcagcccgaatgggtccatatcgataccactcccttcgctagccttctgaagaacctcgggactctgttcggtctgggcctcgccctgaactcctctatgtacagagaatcatgtaaggggaagctgtccaagtggcttcctttccggctgtcttccatcgtggcgagtctcgtgttgcttcacgtgtttgattcattgaagccaccgtctcaggtggagttagttttctacgttctctccttctgtaaatccgccgtggttcccctcgcttctgtttcagtcataccgtactgcctagcacaggtactgggccagccacataaaaagtctcta

SEQ ID NO: 12852 - DNA, 1071 bp, Artificial Sequence
  Description of Artificial Sequence: Synthetic coding sequence
atggaggagggcatgaacgtgttgcacgatttcggcatccaaagcacacattatctgcaggtgaactaccaggactcacaggactggttcatcctggtaagtgtgatagctgacctccgcaacgcattttatgtgctgttccctatctggtttcacctgcaggaggcagtgggcatcaaactgctgtgggtggctgtcatcggcgactggcttaaccttgtcttcaaatggatactgtttgggcagcgcccatactggtgggtgctggatacggactactacagtaacacctctgtgcctcttatcaaacagttccctgtgacatgtgaaaccggaccggggtccccatctggacatgctatgggaaccgccggcgtgtattatgtcatggtcactagtacactgtccatcttccaaggcaaaattaaaccaacctataggttccggtgcctgaacgtaatcttgtggctgggcttctgggcggtgcagttgaatgtctgcctgtctcgcatctacctggctgctcatttcccccatcaagtggtcgcgggcgtcctgtcagggatcgcagtggctgaaacattctctcacatacacagtatctacaacgcatctctgaagaaatattttttgattacttttttcctgtttagctttgccatcgggttctaccttctgctgaaaggcctgggagtggacctcctgtggacgcttgaaaaagctcaaaggtggtgcgagcagccagaatgggtccacatagacacaaccccgtttgcatcactgctgaaaaacctgggtaccctcttcggacttggcttggctttgaactctagcatgtacagggaatcctgcaagggcaaactttccaagtggctgccatttagactgtcaagtatcgtggcttcactcgttctgctgcacgtcttcgactctctgaagccgcctagccaggtggagcttgtcttctacgtcctgtccttttgtaagagcgctgtggtgcctctcgcctccgtgtctgttatcccctattgcctcgcccaggtgctgggtcagccacacaagaaatctctc

SEQ ID NO: 12853 - DNA, 1071 bp, Artificial Sequence
  Description of Artificial Sequence: Synthetic coding sequence
atggaagaaggaatgaacgtgctgcatgactttggcattcagtccactcattacctgcaagtcaactaccaagactcccaggattggtttatcctggtcagcgtgatcgcagacctcaggaacgccttctacgtgttgtttccgatctggttccatctccaagaggcagtcggaatcaagctgttgtgggtggcggtgatcggagattggctgaatttggtgttcaaatggatcctgttcggacagaggccatactggtgggtcctggacaccgattactattcgaatacctccgtcccgctgatcaaacaattcccggtgacttgcgaaaccggaccaggatccccctcgggacacgctatgggaactgcgggagtctactacgtgatggtgactagcaccctctcgatctttcagggcaagattaagccaacttaccgcttccggtgccttaatgtcattctctggctcggtttctgggccgttcaactgaatgtctgcttgtcgcggatctacctggcagcgcacttcccgcaccaggtggtcgccggagtcctctcaggcatcgcagttgcggaaacctttagccatatccatagcatctacaatgcttccctcaagaaatactttcttatcaccttcttcctcttctccttcgccatcggcttttacctgctgctgaaaggattgggcgtggatctgttgtggaccctggaaaaggcgcagaggtggtgcgagcagccggagtgggtgcatatcgacactacgccattcgcatcactgctcaagaatctgggcactctgttcggactcggcctggccctgaattcatcgatgtaccgcgagtcctgcaagggaaagctgtcgaagtggctgccgtttcggctgtcatccatcgtcgcgtcgctggtgctgctgcacgtgttcgactcccttaagcctccgtcgcaggtcgagctcgtgttctacgtgctctcattctgcaaatcggctgtggtgcctctcgcatccgtgtcggtgatcccgtactgtctggctcaggtcctgggacagccgcataagaaaagcctt

SEQ ID NO: 12854 - DNA, 1071 bp, Artificial Sequence
  Description of Artificial Sequence: Synthetic coding sequence
atggaggaaggaatgaacgtgctgcacgacttcggaattcagagcacgcattacctgcaagtgaattaccaggacagccaagattggtttatcctcgtctccgttatcgccgacttgcggaacgccttctacgtcttgttcccgatttggttccacctccaagaagcagtgggaatcaaactgctgtgggtcgccgtgatcggcgattggctgaatctcgttttcaagtggatactcttcggacagcgaccgtactggtgggtgctggacaccgattactattccaatacctccgtgcctctgatcaaacagtttccggtcacttgtgaaaccgggccgggctcgccatcggggcatgcgatgggcaccgctggtgtttactacgtcatggttacctccacccttagcatctttcagggaaagatcaagccgacttacagattccgctgcctgaatgtgatcctgtggctcggattctgggccgtgcagctgaacgtgtgcctgagccggatctaccttgcagctcacttcccccaccaagtggtggccggggtgctgagtggtatagctgtggccgaaaccttctcacatatccattccatctataacgcctcactgaagaagtacttcctgattactttcttcctgttttccttcgccattgggttctatctgctgctgaagggacttggagtcgatctcctctggactctggaaaaggcccaaaggtggtgcgaacagcctgagtgggtgcacatcgacactactccgttcgcgtccctcctgaagaacctcggcacgctgtttgggttgggattggctcttaactcctccatgtaccgagagtcgtgtaaaggaaaactctcaaagtggctcccgttccggctgtcatcaatcgtcgcaagtctcgtacttctgcatgtgttcgactccctgaaaccgccctcgcaggtggagcttgtcttttatgtcttgtcgttttgcaagtccgccgtggtgcctctcgcgtctgtctcggtcatcccgtactgcctcgcgcaggtgttgggccaacctcacaagaaatccctc

SEQ ID NO: 12855 - DNA, 1071 bp, Artificial Sequence
  Description of Artificial Sequence: Synthetic coding sequence
atggaggagggaatgaacgttctccatgattttgggattcaatccacccactacctgcaagtgaattatcaggactcgcaagattggtttattctcgtttccgttatcgccgatctcagaaacgccttctacgtcctgtttcctatttggtttcatcttcaggaagcagttggaataaagctgttgtgggtggcagtcattggtgattggcttaatcttgttttcaaatggattcttttcggacagcgcccttactggtgggtgcttgacaccgactattactcgaacacgtcggtccccctgataaagcaatttccagtgacttgcgaaacgggtcctggaagtccgagtggacatgcaatggggactgctggcgtgtactacgtgatggtcacttcgaccctctccatctttcaaggaaagataaaaccaacttaccgatttagatgtctcaacgtgattctctggcttgggttttgggctgtccaactgaacgtgtgcctgtcacggatttaccttgcagcccattttcctcaccaagtggtggcgggtgtgctcagcggaatcgcagtggcagaaaccttcagccacatacattcgatctacaacgcctcgcttaagaagtactttctgatcacgttttttctcttttcattcgcgatcggattctacttgctgttgaaggggctgggcgtggatctgctgtggactctcgagaaagctcagcggtggtgtgaacagcctgaatgggtgcatattgacacgaccccttttgcatctcttctgaaaaatctgggcaccttgtttggactcggtcttgcactgaattcctcgatgtacagagaatcctgtaaaggtaaactttcaaagtggcttccattccggctttcctccattgtcgcttccctggtgcttctgcatgtattcgattccctgaagcctccttcacaggtggagcttgtgttctacgtgctctccttttgtaagtctgcagttgtcccactggcatctgtgagtgtcatcccgtactgccttgcccaagtcctggggcagccacacaaaaagtcactt

SEQ ID NO: 12856 - DNA, 1071 bp, Artificial Sequence
  Description of Artificial Sequence: Synthetic coding sequence
atggaggagggcatgaacgtcctccacgattttggaatccagtcgacccactacctccaagttaactatcaagattcacaagattggtttatactcgtctcagttattgcagatttgagaaatgcattctatgtgctgttccctatatggtttcacctccaagaagcagtcggaatcaaacttctgtgggtggctgtgatcggagactggctcaatctcgtgttcaagtggattctctttgggcagcgaccttactggtgggtgcttgacactgactactattcaaatacgtctgtgcctctgattaagcagtttccagtcacttgcgaaactggtccgggctccccctcgggtcacgcaatgggaactgcaggggtgtactacgtgatggtcacgagcactctgtccatctttcaaggcaagatcaagcctacctacagattccggtgtcttaacgtgatcctgtggctggggttttgggctgttcagctcaacgtgtgtctgagccgcatttaccttgcggcgcacttcccacatcaagtggtcgcaggtgtcctttccggaatagcggtggccgaaacgttttcgcacattcactcaatttacaacgccagccttaagaaatactttctcataaccttcttcctcttttcctttgccattggattctacctcctgctgaaggggctcggagtggacttgctgtggacccttgaaaaagcccagcggtggtgtgaacaaccggaatgggttcatatcgatacgactcccttcgcgagccttctcaaaaacttgggaactttgtttggacttggtctggcacttaatagctcaatgtacagagagtcatgcaagggtaagctgtcgaaatggctgcctttccgtctgtcctcgatcgtcgcatcgctggtgcttcttcatgtgtttgattccttgaaacccccaagccaggtggagctcgtgttttacgttctctcattttgtaagtcagctgtggtgccactggcatcggtgagcgttatcccttactgccttgcacaagtgcttggacagccacataagaagtcgctg

SEQ ID NO: 12857 - DNA, 1071 bp, Artificial Sequence
  Description of Artificial Sequence: Synthetic coding sequence
atggaagaaggaatgaacgtgttgcacgacttcggcatccaatccacccactacctgcaggtgaattatcaggattcccaggactggttcatcctggtgtccgtgatcgccgaccttcgaaatgccttttacgtcctatttcccatttggtttcatttacaggaagcggtgggcatcaaactgttgtgggtcgctgttattggggactggcttaacctggtgtttaaatggattctcttcggccagaggccatactggtgggttctagacaccgattactactccaatacctcagtccctctaattaagcagttcccggtgacttgcgagacaggacccggcagcccgagcggtcatgccatgggtacagccggcgtatattacgtgatggtgacctccaccctttccatatttcaagggaaaatcaaacctacttatcgtttcagatgtcttaatgtgattctttggctgggattttgggcagtgcagttgaacgtctgtttatcccgaatatacctggcagcacactttccacatcaggtggtggcaggagtgctgagcggaattgccgtagcggaaaccttcagccatatccacagtatttacaacgccagtctgaaaaaatactttttaatcacgttctttctgttcagcttcgctattggcttttatctgctacttaagggcttgggggtggacctcctctggacacttgagaaggcacagaggtggtgcgaacaaccagagtgggtacacattgacacgaccccatttgctagcctcctcaagaatttaggaaccttgttcggcttgggactcgctctcaatagtagcatgtacagggaaagctgtaaagggaagctctccaagtggctgccttttcggttgtcctccattgtggcttcgttggtcctgctgcacgtctttgatagcctgaagccaccaagtcaggtggagctggttttctacgtgctgtccttttgtaaatctgctgttgttcccctggccagcgtgtccgtcattccgtactgtttggcccaggtgttggggcagccccacaaaaaaagtctg

SEQ ID NO: 12858 - DNA, 1071 bp, Artificial Sequence
  Description of Artificial Sequence: Synthetic coding sequence
atggaggaaggaatgaacgttctgcacgatttcggtattcagtcgacgcactaccttcaagttaattaccaggactcgcaagattggttcattctcgtgtcagtcatcgctgacctgcgtaacgccttctatgtgttattccccatttggttccatctgcaggaggctgtggggattaaactcctgtgggtggccgtgatcggagactggctcaacctagtgtttaaatggattctcttcggacagaggccttattggtgggttttggacacagactattactctaataccagcgtgcccctgatcaaacagttccctgtgacttgtgaaactgggcccggatctccaagtgggcacgcaatgggaacagccggtgtgtactacgttatggtgaccagcacgctttcgatatttcagggcaaaatcaaacccacctacagattccgctgtttgaacgtgatcttgtggttagggttttgggctgttcaactgaatgtgtgcctgagcagaatttatctggcggcacacttccctcaccaagtggtagccggtgtcctaagcgggatcgccgtcgcagaaacgttttcccacattcacagcatctataatgcgtccctgaagaagtacttcctgattacattcttcctcttttcatttgcgatcggcttctacctgttgctgaaaggcctgggagtggacttactgtggactctggaaaaggcacagagatggtgtgaacagcctgagtgggtgcacatagacactacccccttcgcctccctgctgaaaaatttggggacactgttcggcctcgggttggccctaaacagtagcatgtaccgggagagctgtaaaggcaagctgagtaagtggttacccttccgcctgtctagcatagtcgcttcgctcgtgctattacacgtctttgatagcttaaaaccgccctctcaggtcgagttggtattctacgtgctctcattttgcaaatcagcagtcgttccgcttgcaagtgtctccgtcatcccttactgcctagcgcaggtactcggccagcctcataagaagtccttg

SEQ ID NO: 12859 - DNA, 1071 bp, Artificial Sequence
  Description of Artificial Sequence: Synthetic coding sequence
atggaggaaggtatgaatgtactccatgactttggcattcagtccactcattacttgcaggtaaactatcaggatagtcaagattggtttattttagtatcagtaatagccgacttgcggaacgctttctacgttttattccccatttggttccatctgcaggaagcagtcggcataaagctcctctgggtggccgtgatcggagattggctgaacctcgtattcaagtggatacttttcggccaacgcccatactggtgggttctggatacagattactatagtaatacttccgtgcctctgatcaaacagtttcccgtgacctgtgaaactggcccaggaagcccttccggccatgccatgggaactgccggagtctactatgtgatggtcaccagcaccttgagtattttccagggtaagattaaaccaacctatcgcttcagatgcctgaatgtgatactgtggttagggttttgggctgtgcagttgaacgtgtgtttaagcaggatctaccttgctgcccacttcccgcaccaggtagtcgctggtgtactctctggcatcgctgtggccgagacctttagtcatatccactccatttataacgcgtcactaaaaaagtactttctcatcaccttcttcctttttagttttgcgattggcttctacctgctgctgaagggcttgggagtggacctcctgtggacgttggaaaaagcccagagatggtgcgagcagccagagtgggtgcacatcgataccacaccttttgcgagcctattgaagaacctgggcaccctttttggactcgggctggccctgaactctagtatgtatagggagtcatgcaaagggaagctttcgaaatggctccccttcagactctcctccattgtcgcgtcacttgtcctcttgcatgtgtttgattccctcaaacccccgtcgcaggtggagctggttttctacgtactctctttttgtaaatccgctgtggttcctttagccagcgtgagtgtgatcccctattgtctagcccaggtcttagggcagccacacaagaagagcctg

SEQ ID NO: 12860 - DNA, 1071 bp, Artificial Sequence
  Description of Artificial Sequence: Synthetic coding sequence
atggaagaggggatgaacgtgctacacgatttcggtatccagtctacacactacctgcaggtgaattatcaggattcccaggattggttcatattggtttctgtcatagcggacctaagaaacgcgttttacgtgctcttccctatatggtttcacttgcaggaagctgtgggtataaaactgctatgggtcgccgtaattggagattggttgaaccttgtgttcaaatggattctgtttggtcagcgcccatattggtgggtgctcgatactgattactattccaacacttccgttcctctgattaaacaattcccagtgacatgtgagactggacccggatccccatcaggccacgcaatgggcacagctggtgtttattatgtcatggtgacatcaacactatcaattttccagggaaaaataaagccgacctatagattccgctgtctcaatgtgattttgtggctgggattctgggccgtgcagttgaacgtgtgcctgtcacggatctacctggcagcgcatttcccccatcaggtggtagcgggtgtgctgtcgggaattgctgtagcagagactttcagtcatatccactccatctataatgctagccttaagaaatactttctgattacctttttcttgttcagctttgcaatcggattctacctgcttctgaaggggcttggcgtcgacctcctgtggaccctcgagaaggcgcagcgctggtgtgagcaaccagagtgggtgcacatagacactactcccttcgcctcactactgaaaaacttgggcactctgtttggccttggcctcgccctgaattcctccatgtatcgggaatcatgcaaaggcaagcttagcaaatggctcccattcaggctatcttcaatcgttgctagtctcgtgttactacatgtgtttgacagtctcaaacctccctcgcaggtggagctcgtgttttatgtgctgagcttctgcaagagcgccgtggttccccttgcgtctgtgagtgtgataccatactgcctggcacaggttttgggccaacctcacaagaaatcactg

SEQ ID NO: 12861 - DNA, 1071 bp, Artificial Sequence
  Description of Artificial Sequence: Synthetic coding sequence
atggaggagggcatgaatgtgctccatgactttgggatacagtccacacattatctgcaggtcaactatcaggactcacaggactggtttatcctggtgtcagttatcgccgatctgcggaacgcattctacgtgctgtttccgatatggttccacctccaggaggcagtgggaataaaactgctgtgggtggcagtcatcggggattggcttaacctcgtgttcaaatggattttattcggacagagaccctattggtgggtgttggacacggactattacagtaacacctctgtacccttaatcaaacagttccctgtaacatgcgagacgggacccggctctccatctgggcacgcaatgggtacggcaggggtgtactatgtaatggttaccagtacactaagcattttccagggcaagattaagccaacctatagattcagatgcctgaatgtcattctgtggctcggtttctgggcggttcagctgaacgtttgtctatccaggatctaccttgccgcacatttcccacaccaagtcgtggccggcgtgctcagcggcatagctgtggccgaaacattcagtcacatccattcaatttacaacgcgtctctgaaaaagtacttcctgattactttttttttgtttagctttgccattgggttctacctccttctcaaggggctgggtgtcgatctcctgtggacactcgaaaaggcccagcggtggtgcgaacagcctgaatgggttcacattgataccactccgtttgcgtctctgttaaagaacctaggcacgctgtttggcttagggctggcactgaactcctcgatgtatcgagagtcttgcaaggggaaactcagtaaatggcttccctttagactatcatcgattgtggccagcctggtgctgcttcacgtttttgactccctgaaacctccttcccaggtggaactcgtcttctacgtgttgtctttctgtaagagtgccgtcgtcccattggccagcgtctcagttatcccatattgtctcgcccaagttttgggacagccgcacaaaaagagtttg

SEQ ID NO: 12862 - DNA, 1071 bp, Artificial Sequence
  Description of Artificial Sequence: Synthetic coding sequence
atggaagaaggtatgaacgttcttcacgacttcggcatccagtcgactcattacttgcaggtgaattaccaagactcacaggattggtttattctggtgtcggtcattgccgatctgcgaaacgctttctacgtgctgtttcccatctggttccatcttcaggaagcagtggggatcaaacttctttgggtagcggtgatcggagattggttgaacctggtgttcaagtggatcttgtttggacagcgcccttactggtgggtcctggatactgattactactccaatactagcgtgccgttgataaagcaatttccagtgacctgtgaaaccggtcctggatcgccctccggtcacgccatgggaacggccggcgtatactacgtgatggtgaccagcacgctctcgattttccaaggcaagataaaacctacttacagatttcggtgcctcaacgtgattctttggctgggattttgggcagtgcaactcaatgtgtgtctcagccgcatttaccttgccgctcattttccacaccaagtcgtggccggagtcttgtctggtatcgcggtagcagagactttttcacacattcattccatttacaacgcgtcgcttaagaaatactttctgattacgttcttccttttctcttttgcaattggattttacttgcttcttaaaggtcttggagtcgatctgctgtggacccttgaaaaggcgcaaagatggtgtgaacagccggagtgggtccacattgacacgaccccttttgcatcccttcttaagaatctgggcactctctttgggcttgggttggctctcaacagctcaatgtaccgtgagtcgtgtaaaggaaagctgagcaagtggcttcctttcaggcttagttccattgtggcatcgctggtgctccttcatgtctttgactccctgaagcctccatcccaagtcgagctggtgttttatgtgctttcgttttgtaagtccgcagttgttcccctcgcatccgtcagcgtgataccctattgcctggcacaggtccttggacaaccacataagaagagcctc

SEQ ID NO: 12863 - DNA, 1071 bp, Artificial Sequence
  Description of Artificial Sequence: Synthetic coding sequence
atggaagaaggtatgaacgtcctccacgattttggaattcaatcgactcactatctgcaggtgaattatcaagattcgcaagattggttcatccttgtgagcgtcatagctgatctgcgaaacgctttttacgtgctgtttcctatttggtttcatcttcaggaagcagtcggtattaagctcctttgggtggcggtgatcggagattggctgaatttggtgttcaagtggatcctttttggacagcgcccatactggtgggtcctcgatactgactactactcgaacacttctgtgccactcataaaacaattcccagtcacgtgtgaaaccgggccgggttcaccatcaggtcacgcaatgggaactgccggagtgtactacgttatggtgacgtcgaccctgtccatctttcaaggcaagatcaagcccacctatcgttttagatgtctcaacgtgattctgtggcttggcttttgggcggtgcagctgaacgtgtgcctgtccagaatctacctggcggcacatttccctcatcaagtggtggcaggagtgctttcaggcatcgccgtggccgaaaccttttcgcatatacatagcatctacaacgcgtcgcttaagaaatactttctcataaccttttttctgttttcctttgcgattggtttttaccttctccttaagggtctgggtgtcgatctgctctggactctggaaaaggcacagaggtggtgtgagcagcccgagtgggtccatattgataccacgccatttgcatctcttttgaagaacctgggcactctgtttggactgggcctggctcttaattccagcatgtacagggagtcctgcaagggaaaactgtcgaaatggctcccttttagactttcatcgatcgtcgcttcgctggtcctgcttcatgtgttcgactccttgaaaccaccttcgcaggtggaacttgtgttttacgtgctctcgttctgcaagtcagcagtggtgcctctggcttctgtgtcggtgattccttactgcctggcccaagtccttggtcaaccacataagaaatcgttg

SEQ ID NO: 12864 - DNA, 1071 bp, Artificial Sequence
  Description of Artificial Sequence: Synthetic coding sequence
atggaggaaggaatgaatgtgctgcatgacttcggtatccagagtacccattacctccaagttaactaccaagactctcaagattggtttatcctggtatcagtgatcgctgatttgcgcaatgccttctacgtcctcttccccatctggtttcacctgcaggaggctgtaggaataaagttgctgtgggtggcagtaattggcgactggctgaacctcgtctttaagtggatcctcttcggtcagagaccctattggtgggtgctggataccgattactactctaatacttccgttcccttgataaagcagttcccagttacatgtgagacaggccccggaagtccctctggtcatgcaatgggtactgctggcgtttattacgtaatggtgacctctactttgagcatcttccaaggaaagatcaaacccacataccgttttcgctgcttgaacgtgatcctctggctgggtttctgggctgtgcagttgaatgtctgtttgagccgcatttacctggcagctcacttcccccaccaggtcgtggcaggtgttttgtccggaatcgctgtggctgagacattctcacacatacactccatatataacgcctcactgaaaaaatacttccttataaccttcttcctcttcagcttcgctattggcttctacctgttgctcaagggacttggtgttgatctgctgtggacactggaaaaggcccagcgctggtgcgaacagccagaatgggtgcatattgacactactcccttcgcctctctcttgaagaacctgggtactctttttggcctgggactggccctgaattcttccatgtacagggagagttgcaagggcaagctgtccaagtggttgccctttaggctctccagcatagtggcttctctggtcctgctccacgtatttgacagccttaagcctccctcccaagtcgaattggtcttttatgtgctctcattctgcaagtcagccgtggtgcccttggctagtgtctctgttatcccttactgcctggcccaggtgttgggacaaccccacaagaaatcactg

SEQ ID NO: 12865 - DNA, 1071 bp, Artificial Sequence
  Description of Artificial Sequence: Synthetic coding sequence
atggaagagggcatgaatgtcttgcacgatttcggcattcaaagcacccactacctgcaggttaactaccaggatagccaagattggtttatcctcgtgtctgtgatcgctgacctcaggaacgctttctacgtactgttcccgatatggtttcacctgcaggaggcggtgggtatcaagttgctgtgggtggccgtcatcggtgattggcttaacttggtctttaagtggatattatttgggcagcgcccgtactggtgggtactggacactgattactactctaacaccagcgtaccacttataaaacaattcccagtgacatgcgagaccggcccaggcagcccgtctggtcatgccatgggtaccgcaggtgtctattacgtgatggtgacctcaacactgtctattttccagggcaagatcaagcctacctatcgcttccgttgtctcaatgtgatcctgtggctgggtttctgggctgttcagcttaatgtttgcctgagcagaatttacttggcggcccacttccctcaccaagttgtggcgggtgtgctttctggcatcgcggtcgcggagactttcagccacatccacagcatctataatgcaagcctgaagaaatatttcctgattacttttttcctgttttctttcgctatcggtttttaccttctgttgaagggactgggcgtcgatctgctctggacgctggaaaaggcccagcgatggtgtgagcaaccagaatgggtccatatcgacactacgccatttgcgagcctgctgaagaatctgggaacgctgttcggcctgggcctggccctaaattctagtatgtaccgcgaaagctgcaagggcaagctgtcgaaatggctgccattccggctgtcttcgatcgttgcttcgctggtcttgctgcacgtgttcgattcccttaagcccccgagccaggtggaactggttttttacgtgctgagtttttgcaagagcgcggtggtgccgcttgccagcgtgtctgtcattccttactgtctggcgcaagtgttgggtcagccgcacaagaagtccctg

SEQ ID NO: 12866 - DNA, 1071 bp, Artificial Sequence
  Description of Artificial Sequence: Synthetic coding sequence
atggaagaaggcatgaacgtgctacatgactttggcatccaaagcacacactacctgcaagtaaattaccaggatagccaggactggtttattctcgtgtccgtcatcgctgacctgaggaatgctttctacgtactctttcctatttggttccacttgcaagaagccgtcggaataaagctgctgtgggtagccgtcattggtgattggttgaacttagtcttcaagtggatacttttcggccaacgaccttattggtgggtgcttgatacggattactacagtaacacgagtgtgccccttattaaacagttcccagtaacatgtgagaccggtcctgggagcccctccggccacgccatgggtactgcaggagtgtactatgtgatggttacttctactctgtcaatcttccaaggcaagattaagcccacatacagattccgttgtctcaatgtcatcttgtggctaggcttttgggccgtgcaactgaacgtctgtctttctaggatttatctggcagcacactttcctcaccaggtggtcgctggggtattgtctggaatcgccgtggccgagaccttttcgcacattcatagcatctacaacgcctccctgaagaaatatttcctgattacattctttcttttctcctttgcaattgggttttacctgcttctgaagggtctgggggtggatctgctgtggacactcgaaaaagcccagcgctggtgcgaacagcctgaatgggtgcacattgacacgacgccctttgcatccctgttaaagaatctgggtaccctgttcggattgggcttggcacttaactcatctatgtaccgggagagctgcaaggggaagctgtcaaaatggctgccctttagattgtctagcatcgttgctagcctcgtcctccttcatgtgtttgacagccttaagcctccttctcaggtagaactcgttttctacgtacttagcttttgtaagtcggcggtcgtccccttagcctcagtgtccgtaataccttactgcctggcccaagtgcttggccaaccccacaagaagtcatta

SEQ ID NO: 12867 - DNA, 1071 bp, Artificial Sequence
  Description of Artificial Sequence: Synthetic coding sequence
atggaggagggaatgaacgtgctccatgattttggcattcaatcgacccattacctgcaggttaactaccaagattcgcaggactggttcatcctcgtgtccgtgatcgccgatcttcgaaacgcattctacgtgctgtttccgatctggttccacctccaggaggcagtgggaataaagttgttgtgggtggcggtgattggcgactggctgaatttggtgttcaagtggatcctgtttggccaacggccgtactggtgggttctggacactgactactactcaaacacctcagtgccgctgatcaagcagttcccagtgacgtgcgagacgggaccaggatcccctagtggacacgccatggggacggctggagtgtactacgtcatggttaccagcactctctccatcttccaaggcaagatcaagcctacgtacagattccgctgtttgaatgtgatcctctggctgggcttttgggccgtgcagctcaacgtgtgcctttctcgcatctacttggcagctcactttcctcatcaggttgtggcgggagtcctgtcgggaatcgctgtcgcagaaaccttctcgcacattcactcaatttacaacgcctcccttaagaagtatttcctgatcaccttctttctcttcagcttcgccatcggcttctacctgttgctgaaggggttgggggtcgacctgctgtggaccctggaaaaggcccaacgttggtgcgaacagccggaatgggtgcacatcgataccaccccattcgcctcgctgttgaaaaatctcggtacgctgttcggcttgggactcgccttgaattcctccatgtaccgcgaaagctgcaaaggaaagctgagcaaatggctgccgttcaggctttcgtcaatcgtggcctcactggtcctgctccatgtgttcgacagcctcaagccgccatcacaagtcgaactcgttttctacgtgttgtcgttttgtaaatcagccgtggtgccactcgcaagcgtcagcgtcattccttactgcctggcgcaggtgctggggcagccgcataagaagtcactc

SEQ ID NO: 12868 - DNA, 1071 bp, Artificial Sequence
  Description of Artificial Sequence: Synthetic coding sequence
atggaagaaggcatgaatgttttgcatgacttcgggattcagtctacgcattacctgcaggtgaattatcaggatagccaagactggtttattctggtgagtgtgatcgcggatctgagaaacgctttttatgtcttgtttcctatctggtttcatttgcaagaggccgtaggcatcaagctgctctgggtcgcagtgatcggcgactggttgaacctggtgttcaaatggatcctgtttggacaacgaccctactggtgggtactggacactgattactactctaatacctccgttcctctgattaagcagtttcctgtcacttgtgaaacgggacccggttccccatccggtcatgccatgggcaccgctggagtgtactatgtgatggtgacctcaacccttagtatcttccaggggaaaataaagccgacatataggttccggtgcctgaacgttattttgtggctgggattctgggccgtacagctgaacgtttgcctgtccagaatctatctggccgcccattttccacatcaagtggtggccggcgtacttagcggcattgctgtggctgaaacgttttcacacatacattcaatttacaacgccagtctgaaaaagtatttcctcattactttcttcctcttctcctttgctatcggcttctacttgctgctgaagggtttgggtgtggacctgctttggaccctcgagaaggcccaacgatggtgcgaacagccagagtgggtgcacatcgacacgacaccattcgcgtcccttctgaagaatctcggaactctcttcgggcttggtcttgcactcaacagctcaatgtaccgcgagagttgtaaggggaagctcagcaagtggctgccgtttcggctcagttccattgtggcctccttggtgttgttgcatgtcttcgattccctgaagcccccctctcaggtggagcttgtgttttatgtgctgagcttttgtaaatccgccgtggtacctttggcatctgtgtcagttataccctattgtctggctcaggtcctgggtcagcctcacaagaaatctctc

SEQ ID NO: 12869 - DNA, 1071 bp, Artificial Sequence
  Description of Artificial Sequence: Synthetic coding sequence
atggaggagggcatgaacgtcttacacgactttggtattcagtctactcactatttacaggtgaactaccaggactcccaagactggttcatcctcgtgagcgtgattgccgacctccggaacgcattctacgtgctctttccaatatggtttcacttacaggaagcagtcggcatcaagcttctctgggtggccgtaatcggagattggctgaatctcgtgtttaagtggatcctgttcggacagcgcccctattggtgggtgctggacactgattactattcaaatacctccgttcctctgatcaagcagttccctgtgacgtgcgaaacaggcccaggctccccatctggccatgccatggggaccgctggtgtctattacgtcatggtcacgtcaaccctgtcaattttccaaggaaaaatcaagccgacctaccgcttccgctgtcttaacgtgatactgtggctcggattttgggccgtgcagctgaatgtgtgtctctctaggatatatctggccgcgcacttcccccaccaggtagtcgctggtgtcctgtccggcattgcagtagccgagactttttcccacatacacagcatttacaacgcatcactgaagaaatactttctaatcaccttttttctgttttcattcgctatcgggttctatcttttacttaaaggattgggcgtggatttactctggaccctggagaaagctcagcgctggtgcgaacagcccgagtgggttcatattgacacgacaccttttgcatctttgttgaaaaatctgggtaccctttttggcctgggcctggctctgaacagctccatgtatagggagagctgcaagggtaagctcagcaagtggttgcctttccgactatcatctattgtggccagtctggtcctgcttcacgtttttgattccctgaagccccctagccaggttgaactggtgttctacgtcctttcattctgtaagagcgctgtggtgccgcttgccagcgtatccgtaattccttattgcctcgcccaggtcttaggacagccacataaaaagagcctt

SEQ ID NO: 12870 - DNA, 1071 bp, Artificial Sequence
  Description of Artificial Sequence: Synthetic coding sequence
atggaagagggaatgaatgtgcttcatgattttggaatccagtctactcattatctgcaggtgaactatcaggattctcaggattggttcatactcgtatccgtgatcgctgatctgagaaatgccttttatgttttatttcccatctggttccatctccaggaagctgtgggaataaaactcctctgggtggctgtgataggagattggttaaaccttgttttcaaatggatattatttggacagagaccctactggtgggttctcgatacagattattattctaatacttccgtcccgctcataaaacagttccctgtcacatgcgaaacagggcctgggtcccccagtggacacgccatgggaacagccggggtatattacgttatggtaacttccacactctccatatttcaggggaaaataaaaccaacttatcgttttcggtgtctcaacgtgatactctggctcgggttttgggcagtccagctcaatgtgtgcctctcccggatctatctggcagcccattttcctcaccaggttgttgccggagtgctctctggaatagccgtagccgagacattttctcatatacactctatctacaacgcctcgctgaaaaaatacttcctcattacatttttcctctttagttttgccattggattttatctcctgctcaagggactgggagtagatctattatggacgctcgaaaaagcacagagatggtgcgagcagcctgaatgggtgcatatcgatacaactccttttgcatccttattaaaaaatctcgggactctatttgggttgggacttgctctgaacagttccatgtacagggagagttgtaaggggaaattatctaaatggctaccttttagactttctagtatagtggcttctctagttcttctccacgttttcgattcactcaaacccccttcacaggtggaattggtattttatgtgttgtctttctgtaaatctgccgtcgtcccactcgcatcagtgtccgtcattccctattgccttgcacaggttctgggacagccacataagaaatcgttg

SEQ ID NO: 12871 - DNA, 1071 bp, Artificial Sequence
  Description of Artificial Sequence: Synthetic coding sequence
atggaggagggaatgaatgtccttcatgactttggcatccaatcaactcactacttgcaggtgaactaccaggattcgcaagactggttcatcctggtatccgtgatcgccgacttgcgcaacgccttctacgtcctgttcccgatctggttccacttgcaggaggccgtgggtattaagctgctctgggtcgcagtcatcggagactggctgaacctggtgttcaaatggatcctgttcggccagcggccatactggtgggtcttggatacggactactactctaacacctcagtccccctgatcaagcagtttccggttacctgcgaaactgggcctggcagcccgagcggccatgcaatgggaactgctggggtgtactacgtgatggtgacctcaactttgtcgatcttccagggcaagattaagccgacctacaggtttagatgcctgaacgtgattttgtggctgggattctgggcagtgcaactcaacgtctgtctgtcgcggatctatctggcggctcacttcccgcaccaagtggtcgcgggagttctgtcgggaatcgcagtggcggagactttctcccatatccactccatttacaatgcctcgctcaagaagtactttctcatcaccttcttcctgttcagcttcgctatcggattctacctgctcctgaaggggctgggtgtggacctgctttggaccctggagaaagcccagcgatggtgtgaacaacctgaatgggttcatatcgataccacgccatttgcgtccctcctcaaaaatcttggtactctcttcggactcggactggctcttaattcttcaatgtacagagaatcgtgcaagggaaaactctccaagtggctcccattccgcctgtccagcatcgtggcgtcgctggtcctgcttcacgtctttgatagtctgaagcccccgtcccaggtggaactggtgttttatgtgctctcgttctgcaagagcgccgtggtgccactggcctcagtgtccgtgatcccttactgcctggcccaggtgctcggccaaccgcacaagaaaagcctc

SEQ ID NO: 12872 - DNA, 1071 bp, Artificial Sequence
  Description of Artificial Sequence: Synthetic coding sequence
atggaggagggcatgaacgtgctccacgacttcggaatccagtccacccattacttgcaagtcaactatcaggattctcaggactggtttatcctcgtctcggtcatagccgacctgcgaaacgctttctacgttttgttccccatctggttccacctccaggaggccgttggcattaaactgttatgggtcgccgtcatcggtgattggctcaacctagtctttaagtggatcctgttcggtcagagaccgtattggtgggtactcgacacagattactactctaacacgtccgttcctcttattaagcaatttccagtcacatgtgagacaggtccaggctccccctccggccatgcgatgggcacggccggagtctactatgtcatggtcacctcgacactgtccatcttccaggggaagatcaaacccacataccgattccgatgtctaaacgtgatcctctggctcggattctgggcagtacaactgaacgtctgtctgtctcgcatctacctcgcagcgcactttccccaccaggtcgtggccggtgtgcttagcggtatcgctgtcgcggaaactttcagccacatccattcgatttacaacgccagcctcaagaaatacttcctgatcaccttcttccttttcagcttcgccatcggcttttaccttcttctaaaggggctgggcgtcgatttactctggacacttgagaaagcccagcgctggtgcgaacagcccgaatgggtccacattgacactacgcccttcgcctcattgttgaagaatttgggcaccctctttggactcggtcttgcgctgaactcttctatgtaccgcgaatcatgtaaaggaaagttgtcgaagtggttgcccttccgccttagcagcatcgtagcctcgttggtcctgcttcacgtgttcgactccttgaagccacccagccaggtcgaactggtcttttacgtcttgagcttctgtaagtcggccgtcgtgcctcttgccagtgtcagcgtgatcccttactgtctggcacaagttttaggccagccacacaagaagtccctg

SEQ ID NO: 12873 - DNA, 1071 bp, Artificial Sequence
  Description of Artificial Sequence: Synthetic coding sequence
atggaagagggcatgaatgtgctccatgacttcggtattcagagtacgcactacttacaggtgaactaccaggattcacaggattggttcattttagtcagcgtgattgccgacttaaggaatgccttttacgtgttgtttcctatctggtttcacctccaagaggctgttgggatcaaacttctgtgggtggccgtgatcggggattggctcaatttggtcttcaaatggatactgttcgggcagaggccctattggtgggtcctggatactgactactactcgaatacgtcagtgcctctgatcaagcaatttccagtgacttgcgagacaggacctggcagcccgtctggacatgccatggggacagccggcgtgtactatgtcatggtaacaagtaccttgtcaatttttcagggaaaaataaaacctacctatagattcaggtgcttgaatgtaattctttggctcggattctgggccgtgcagctaaacgtgtgcctctcccggatctacctcgctgcacactttccacaccaggtggtcgcgggggtgctcagcggcattgcggtcgctgagactttcagccatattcacagcatctacaacgcttcgctgaagaaatatttccttattacatttttcctcttcagttttgctattggcttctacctgctacttaagggtctaggagtggatctcctctggacccttgaaaaggcacagagatggtgcgaacaacctgaatgggtccacatagacacaactccattcgcctcgctcctgaaaaacctggggactctcttcggattggggcttgctttaaatagcagcatgtatagagagtcttgcaaagggaaactcagtaaatggctgcctttccgtctgtcctcgatcgtagccagcttggttcttcttcacgtgtttgatagtttaaagccccctagtcaggtcgagctggtgttttacgtcctgagcttttgcaagtccgctgtcgtccctctggcgagtgttagcgtgataccttactgtctagcccaggtactcggacagccacacaaaaagtccctg

SEQ ID NO: 12874 - DNA, 1071 bp, Artificial Sequence
  Description of Artificial Sequence: Synthetic coding sequence
atggaagagggaatgaatgtgctgcacgattttgggattcaatccacccattacctgcaggtcaactaccaggatagtcaagactggttcattctggtcagtgttatcgccgacctgcggaacgcgttctatgtgctgttccccatctggttccacctgcaagaagctgtgggtatcaagctgctctgggtcgctgtgatcggcgattggctgaacctggtattcaagtggatcctgttcggccagcggccgtattggtgggtcctcgataccgactattactcgaatactagtgtgcctctgatcaaacagttcccggtcacttgtgaaaccgggccaggctcgccaagcgggcatgccatgggaacggccggagtgtactacgtgatggtgacctcaactctctcaattttccaaggcaagatcaaacccacttacagatttagatgcctcaacgtgatactgtggctggggttctgggccgtgcaactcaatgtgtgtctctcgcgcatatacctggcagcccatttccctcatcaagtcgtcgccggcgtgctttcgggcatcgctgttgccgaaactttttctcacattcactcgatttacaacgcgagcttgaagaaatactttctgatcactttcttcctgttttctttcgctattggattctaccttctgctgaagggactcggagtcgacctgctctggaccctggagaaggctcagcgctggtgcgaacagccggagtgggtgcacatcgacactacgccttttgcgtcactgctgaagaacctgggaacccttttcggactgggtttggcattgaattcctcgatgtacagggaatcctgcaagggaaagctgtcgaaatggctcccgttccgactgtcgtccatcgtcgcatccctggtgcttctgcatgtgtttgacagcctgaagccgccttcccaagtggaattggtgttctacgtgttgtcgttctgcaagtccgcagtcgtgccgctggcctcagtgtcagttattccatactgtctggcccaggtgctgggtcagccgcacaagaaaagcctc

SEQ ID NO: 12875 - DNA, 1071 bp, Artificial Sequence
  Description of Artificial Sequence: Synthetic coding sequence
atggaggagggcatgaacgtcctccatgacttcggcatccagtccacacactatttgcaagtgaattaccaagactctcaggattggtttatcctggtgagcgtgatcgctgacctgaggaacgctttttacgtcctcttcccgatctggtttcacctgcaggaagcagtcggaatcaaactgctttgggtcgctgtgattggtgactggcttaaccttgtatttaagtggatactttttggacagaggccttactggtgggtgctggataccgactactacagcaatacatctgttcccttgattaagcaatttcctgtcacctgtgagacagggcctgggagcccaagcgggcatgcaatgggaactgcgggagtttactacgttatggtgacgtcgaccctctctatctttcagggaaagatcaagccgacttacaggtttcgctgtttgaatgtgatattatggctgggcttctgggcagtccagcttaacgtgtgcctgtccagaatctacctggccgcccatttcccgcaccaggtggttgccggtgttttgagtggaatcgccgttgccgagacattttcccatatccatagcatctataatgcttcgcttaagaagtatttcttgattacattttttctgttttcctttgcaatcggattttacctactactgaaaggactcggggtcgatctcttgtggacgttggaaaaagctcagaggtggtgcgagcaaccagagtgggttcacatcgacactacacctttcgcaagcctcttgaagaatctcggaaccctctttggactcggactagcattgaactcatctatgtaccgggagagttgcaagggcaaactctccaagtggctgccttttagactgtctagtatcgtcgccagcctggtgctgcttcacgtttttgattctctgaaaccaccttctcaggtggaactggtgttctacgtcttgagtttctgcaaatctgccgtggttcctcttgcaagcgtcagtgtcatcccttactgcctggcccaggtcctgggccaacctcacaagaagtcgttg

SEQ ID NO: 12876 - DNA, 1071 bp, Artificial Sequence
  Description of Artificial Sequence: Synthetic coding sequence
atggaagagggaatgaatgtcctgcatgattttggtatacagtcaacacactacttgcaggtcaattaccaggactcacaagactggttcattttggtgagcgtgatcgcagaccttaggaatgctttctacgtgctgttccctatctggttccacctccaggaggccgtgggcattaagctactctgggtcgcagtgataggcgactggctgaatctggtgttcaaatggattctgttcggccagagaccctactggtgggtgctggatactgactactatagcaacacatccgtgccactgataaagcagtttccagtgacttgtgagactggtcctgggagcccatcaggtcatgctatgggtactgctggagtgtattacgttatggtgaccagtacactgagcatatttcaaggaaaaattaaaccaacctaccggttcaggtgcttgaatgtcatactgtggctgggcttctgggcagttcaattgaatgtgtgtctgagccggatatacctggccgctcattttcctcaccaggttgtcgcaggggtgttgtccgggatagcagttgcagagacattttctcacatccacagcatttataatgcctcacttaaaaagtactttctgattactttctttctgttctcctttgccattggcttttatctgctgctcaaaggattaggggtagatttgctttggacactggaaaaagcccagaggtggtgcgagcagccagaatgggtccatatcgatacgaccccctttgcatccctgctgaagaatctagggaccctctttgggttgggacttgcactgaacagtagtatgtaccgggagtcatgtaagggcaagctgtccaagtggctcccttttcggctgtcctcaattgtggcgtcactggtactgctgcacgtgttcgacagtttgaagccgccttcacaggtcgaactggttttttatgtgttatcattctgtaagagtgcagtagtgccattggcctccgtgtccgtcattccttattgcctggcacaggtgctcggccagccccataaaaaatctctg

SEQ ID NO: 12877 - DNA, 1071 bp, Artificial Sequence
  Description of Artificial Sequence: Synthetic coding sequence
atggaagaaggcatgaacgtgcttcatgactttgggatccaatccactcactatctccaggtcaactaccaggactctcaagattggtttattctggtcagtgtaattgccgatctgaggaatgccttctacgtcctgttcccaatatggttccacttgcaggaggcagtcggcattaagcttctttgggttgcagtgattggggattggcttaatttagtatttaagtggattctgtttgggcagcgcccctattggtgggtcctcgacacagactattatagtaacacgtcagtgcccctgatcaaacagtttcctgtcacgtgcgagacgggacccggcagtccgtctggccacgccatgggcacagcaggggtctattacgtgatggtgacctctaccctgagcatcttccagggaaagataaagcctacctacaggtttaggtgcttgaacgtgatcctttggctggggttctgggcagtccaattgaatgtctgcctatcccggatatatctggccgcacattttccacaccaggtggtcgcaggcgtgctgtctgggatcgctgtggcagaaactttcagccacatccactccatctataacgctagcctgaaaaaatacttcctgatcacttttttcttgtttagctttgctattggtttctatctgctgctcaaagggctgggggtggatctgctgtggacccttgagaaggcacaacgctggtgcgagcaaccagagtgggtgcatatcgacacaactccatttgccagcttgctcaaaaacctcgggaccctttttgggctcggattagctttgaatagctctatgtacagggaatcctgcaaggggaagctctccaagtggcttccctttagactgtccagtatcgttgcttctctggtattgttgcatgtatttgacagtttgaaacccccaagccaagttgagctcgttttctatgtccttagcttttgcaaatcggctgtggtgcctctggcgtccgtgtctgtgataccatactgcctggcccaggtgctgggccagccacataagaaatcactt

SEQ ID NO: 12878 - DNA, 1071 bp, Artificial Sequence
  Description of Artificial Sequence: Synthetic coding sequence
atggaagaaggcatgaatgtgctccatgattttggaattcagtccacccattacttgcaggtcaactatcaggattcccaagattggtttattctggtgtcggtcatcgctgatcttcggaacgccttctacgtgctgttccctatctggtttcacctgcaggaggccgtgggcatcaagctgctctgggtcgctgtcattggggactggctgaatctcgtgttcaagtggatcctgttcggccaaagaccctactggtgggtgctcgacactgattactactcgaacacttccgtccccctgataaagcagttccctgtcacctgcgaaaccggcccgggaagcccgtcgggccatgctatgggaactgcgggagtgtactacgtgatggttacttcgactctgtcgatctttcaaggaaagatcaagccgacctaccggtttaggtgtctcaatgtgatcctttggctcggattctgggctgtgcagcttaatgtgtgcctctcgcggatctacctggccgcccatttcccacaccaggtggtggcgggggtgctcagcggcatcgctgtcgcagagacgttcagccatattcacagcatttacaacgcctccctcaaaaagtactttctgataacgttctttcttttttccttcgccattggattctacctgctgctcaagggactcggagtggatctgctgtggactctggaaaaggcacagagatggtgcgaacagcctgagtgggtgcacatcgacaccaccccgttcgcctcgctgctgaaaaacctcggaaccctgttcggattgggactggcgctgaacagctcgatgtatagagaaagctgcaagggtaaactgtcaaagtggcttccctttcggctgtcctccattgtcgcttcgctggtgctcctgcacgtgttcgactccctcaagccgccgtcgcaagtggaattggtgttttacgtgctctctttctgtaaatcggcggtggtgcctctggcatcagtgtcggtgatcccatactgccttgcccaagtgttggggcagccccataagaagtcgctg

SEQ ID NO: 12879 - DNA, 1071 bp, Artificial Sequence
  Description of Artificial Sequence: Synthetic coding sequence
atggaagagggcatgaacgtgctccacgatttcggcatccaatcgactcattacctgcaggtgaactaccaagattcccaggattggtttatcctggtgtccgtcatcgcggacctgaggaatgccttctatgtgctgttccccatctggtttcatctgcaagaagcggtggggatcaaattgctctgggtggcagtgattggggactggctgaacctggtctttaagtggatcctgttcggacagcgtccttactggtgggtgttggacaccgattactactccaatacctcggtgccgctcatcaagcaattcccagtcacctgcgaaaccggaccgggctcgccttcaggtcacgcaatgggaaccgccggtgtgtactacgtgatggtgacttccaccctctccattttccaagggaagatcaagcccacttacagattccgctgcctgaatgtgatcctgtggctcgggttctgggcggtgcagttgaacgtctgcctgtcgagaatctacctggcagctcatttcccgcatcaggtcgtggccggtgtgcttagcggtatcgctgtggccgagactttctcacacatccactcgatctacaacgcctcgttgaagaaatacttcctgattaccttcttcctgttctcattcgcgatcgggttctacttgctcctgaagggtctgggagtggatctcctgtggacgctggagaaagcccagagatggtgcgagcagccagaatgggtccacatcgacaccaccccgttcgcgtcgctgcttaagaatctcggcactctgttcgggctgggactcgcgctcaacagctcgatgtaccgggagagctgtaagggcaagctgagcaagtggctcccgttccgcctttcatcaatcgtcgcctcgctggtcctgttgcacgtgtttgacagcctgaagccaccgtcgcaggtggaacttgtgttttacgtgctgtcgttttgcaaaagcgcagtggtgccgctcgccagtgtttcagtgatcccatattgcctggctcaagtcctgggccaaccacataagaaatccctg

SEQ ID NO: 12880 - DNA, 1071 bp, Artificial Sequence
  Description of Artificial Sequence: Synthetic coding sequence
atggaagaaggcatgaatgttttgcacgactttggaatccagtcgacccattacttgcaggtcaactaccaggattctcaggactggttcattctggtaagcgtgattgcagatcttcggaacgcattctacgtgctgtttcctatctggttccatttgcaggaagccgtcggtatcaaactcttgtgggtcgccgtgattggagactggctcaaccttgtctttaagtggattttgtttgggcagaggccatactggtgggtgctggatactgactactactcgaacacgagcgtgcctctcatcaaacagttccccgtgacctgtgaaaccggacccggttccccgagcgggcatgctatggggaccgcaggagtgtactacgtgatggtgactagcacgctctcaatctttcaaggcaagatcaagcctacctatcgcttcaggtgtcttaatgtgattctctggcttggattttgggcagtccagctgaacgtgtgcttgtcccgaatatacttggctgcacactttcctcaccaggtggtggcaggggtgctgagcggcatcgccgtggcagaaactttttcgcatatccattccatatacaatgcttcactcaaaaagtatttcctgattaccttttttctttttagctttgcaataggattctacctgcttcttaagggtctgggtgtggatttgctctggactcttgagaaagcgcaacggtggtgtgagcaacccgaatgggtccatatcgacaccaccccatttgcctcgctgctgaaaaatctcggcactctcttcggcctgggtttggccctcaattcatccatgtaccgcgaatcgtgcaaaggaaagctgtccaagtggcttccattcagacttagctcgattgtggcctcgctggtcctccttcatgtgttcgatagtctcaagcctccttcgcaagtcgagctggtgttttacgtgcttagcttttgcaagtcggcagtggtcccactggcatcggtgtcggtgataccttactgtctcgcgcaagtactgggccagccccacaagaagtcgctt

SEQ ID NO: 12881 - DNA, 1071 bp, Artificial Sequence
  Description of Artificial Sequence: Synthetic coding sequence
atggaagaaggtatgaatgttcttcatgattttggaatacaaagtacacattatttacaagtaaattatcaagattcacaagattggtttatccttgtttcagttattgcagatttaagaaatgctttctatgtactttttccaatttggtttcatcttcaagaagcagttggaattaaattattatgggttgcagttattggagattggctaaatttagtttttaagtggatattatttggacaaagaccatattggtgggttcttgatacagattattattcaaatacttcagttccattaattaaacaatttcctgtaacttgtgaaacaggtcctggatcaccaagtggacatgctatgggtactgcaggagtttactatgtaatggttacttcaacactttctatttttcaaggaaaaataaaaccaacttatagatttagatgtttaaatgttatactttggctaggattttgggctgtacaacttaatgtttgtttaagtcgtatttatttggctgcacattttccacatcaagttgttgctggagtgttatcaggtattgcagttgctgagacattcagtcatatacattctatttataatgctagtctaaaaaaatattttcttataactttttttcttttttcatttgctattggattttatcttttgcttaaaggattaggagttgatttactttggacacttgaaaaagctcaacgatggtgtgaacaacctgaatgggttcatatcgatacaactccatttgcatcattattaaaaaatttaggaactctttttggattaggacttgcactaaattcttctatgtatcgagaatcatgcaagggtaaattatcaaagtggttaccattcagactttcttctatagttgcatcattagttttattacatgtttttgattctttaaaacctccaagccaagttgaattagttttttatgttttatctttttgtaagtcagcagttgttccattagcaagtgtaagtgttattccatactgtcttgctcaagtattaggacaaccacataagaaatcatta

SEQ ID NO: 12882 - DNA, 1071 bp, Artificial Sequence
  Description of Artificial Sequence: Synthetic coding sequence
atggaggagggaatgaacgtgctgcacgattttggaatacagagcacacactatctgcaggtgaactatcaggacagtcaagattggttcattctcgtgtcggtcattgccgacttacggaacgctttctatgtgcttttccccatctggttccacctgcaggaggcggttggcatcaaactattatgggtcgccgtaattggtgattggctgaatttggtctttaagtggattctcttcggccaaagaccttattggtgggtgcttgacacagattattactcaaacacatctgtcccccttatcaagcagttcccagttacatgcgagaccggtccgggctctccgtccggccacgcaatgggtacagccggggtgtattacgttatggtgacttcaactttatccatcttccagggtaaaatcaagccaacgtaccgattcagatgcctgaacgtgatactgtggctgggattctgggcggtgcaattgaacgtatgcctctcgcgtatttacttagcggctcatttcccccatcaggtggtcgctggagttctatcgggaattgccgtcgctgaaaccttttcgcacatacactcgatatacaatgcgtcattgaaaaagtactttctgattactttcttcttgttcagtttcgctatcgggttttacctgctgttaaagggactgggcgtcgacttgttgtggactctggagaaggctcagcgttggtgcgaacaaccggagtgggtacatatcgacacaacaccgtttgcgtctctgctcaagaatcttggtacactgttcggcctgggattagccctgaactccagcatgtaccgagagtcgtgcaagggcaagctgtcgaagtggctgccattccgccttagctcaatcgtggcgagtcttgtgctgctgcacgtatttgatagcctgaagccaccgagccaggtagaattggttttttatgtcttgtcgttctgcaaatctgccgtggttccactcgcctcggtgagtgtcattccctactgcctggcccaggtcctgggacaaccccataagaaatcgctg

SEQ ID NO: 12883 - DNA, 1071 bp, Artificial Sequence
  Description of Artificial Sequence: Synthetic coding sequence
atggaggagggtatgaacgtactgcatgacttcggtattcagagcactcactacttgcaagtcaattaccaggactcacaggattggttcatcctggtgagtgtgattgccgaccttaggaatgcattttacgttctgttccccatttggtttcacttgcaggaagctgtgggtataaaactgttgtgggtggccgtaattggagactggctcaatctggtctttaaatggatcctgtttggacaacgaccgtactggtgggtgctggacactgactactattctaatacgtctgtgcccctaatcaaacaattccccgtaacctgtgagacaggcccggggtctccctccggacatgctatgggtactgccggggtctactacgtgatggtaacttccaccctaagtatttttcaaggtaagattaaacccacctacaggtttaggtgcttaaatgtcattctctggcttgggttttgggctgtgcagttaaatgtctgcttgagccgcatctacctggcagctcacttcccccaccaggtggtggcaggcgtgctgtctgggatcgcagtagcagaaacgttcagtcatatccacagtatatataacgcatcactcaagaaatactttttaatcacattctttctattctcttttgctattgggttttacctccttttgaaggggctgggagtggacctcctatggacactggaaaaggcgcagagatggtgtgaacaaccagaatgggtacatatagatacaacgcccttcgcaagcttgcttaagaacctggggaccttgttcggacttggactcgccctgaactcatcaatgtaccgcgaaagctgcaaagggaaactctccaaatggcttccctttcggctgagctctatcgtcgcatccctggtgctcctgcatgtgtttgacagtctcaaacctccttcacaagtggagttggtgttctacgttttgtcattctgtaaaagcgcagtcgttcccttggcaagcgtgtctgtgataccatactgcctcgcccaagtccttggccaacctcacaaaaaatccctg

SEQ ID NO: 12884 - DNA, 1071 bp, Artificial Sequence
  Description of Artificial Sequence: Synthetic coding sequence
atggaagaaggaatgaatgtcctccatgatttcggaattcagtcgacccattacttgcaagtcaactaccaagacagccaagactggtttattcttgtttcggtgattgcagatctccgtaacgcattttacgtgttgtttccaatctggtttcacctgcaagaagccgtgggtataaagctcctgtgggtggcagtgatcggagattggcttaatctggtctttaagtggattctttttggacagaggccctactggtgggtgttggataccgactactactcgaatacctccgtgccactgataaagcaatttcccgtcacttgcgagactgggcctggctcgccctcgggacacgcgatgggaaccgcgggtgtgtactacgtcatggtcacttccactcttagcatatttcagggaaagattaagcccacctaccgctttaggtgtctcaatgtgattctgtggctgggcttttgggcagtgcaacttaacgtgtgcctgtcgagaatttacctcgcagcccactttcctcatcaggtcgtggccggagtgctgtcaggtattgcagtggccgaaacttttagccacattcattcaatttacaatgcctccctgaaaaagtactttcttatcacttttttcctgttctcatttgcgataggattttaccttctgctgaaaggcctcggggtggacttgctttggaccctcgaaaaagcacagcggtggtgcgagcaacctgagtgggtgcacattgatactactccttttgcctcgctgcttaagaatcttggaacgctgtttggcttgggtcttgcattgaacagctcaatgtaccgtgaaagctgcaagggcaagctgtccaagtggcttcctttcagactgtcatccatcgttgcgagccttgtccttcttcacgtgttcgactctctcaagccaccatcacaagtcgagctggtgttttacgtgctgagcttttgtaagagcgctgtcgtgccgctcgcatccgtgtccgtgatcccatactgccttgcacaagtcctcggacagccacataagaagtcgctt

SEQ ID NO: 12885 - DNA, 1071 bp, Artificial Sequence
  Description of Artificial Sequence: Synthetic coding sequence
atggaggagggtatgaacgtactgcacgacttcggtatacagtcaacacactacctgcaggtgaactatcaagactcacaagattggttcattctggtcagtgtaattgccgacctgcggaatgccttctacgtgctgttccctatttggttccacctccaggaagccgtaggtatcaagcttctctgggtcgctgtgataggggactggctgaatctagtctttaaatggatactttttggacagaggccctattggtgggtcctggatacagactactatagcaacacgtccgtcccccttataaagcagttccctgtcacctgtgagaccgggcctggttcacctagcggccatgctatgggcacagcgggtgtctattacgtgatggtaacgtccacgctgtccatattccagggtaaaatcaagccaacttacagattccggtgtttgaatgtgatcctgtggctggggttttgggcagtgcagcttaacgtctgcttgtcaaggatctatttggcagcgcatttcccccaccaggtggtggcaggggtcctgagtgggatcgctgtagctgaaacattttcccatatacacagtatttacaatgcgagcctgaagaaatactttcttattacttttttcttgttctcattcgcaattgggttctacctgctgctgaaggggcttggggtcgacctgttgtggactctcgaaaaggcacagcgctggtgtgagcagcccgaatgggtgcatatcgataccactccgtttgccagtttactgaagaacctgggaacattattcggacttggtctagccttaaattcttctatgtatagggaatcatgcaaagggaaactcagtaagtggctaccgtttcgccttagctccatcgtagccagcctagtgctcctgcacgtatttgactcacttaagcccccatcgcaggtggagcttgttttctatgtcctgagtttctgcaaatcggcagttgtgccactggcttccgtcagcgtgatcccctattgtttggcgcaggtccttgggcagccgcataaaaagtcgctg

SEQ ID NO: 12886 - DNA, 1071 bp, Artificial Sequence
  Description of Artificial Sequence: Synthetic coding sequence
atggaggaaggtatgaacgttttgcacgattttgggatccaatctactcactacctgcaggtgaattaccaggactcccaggactggttcatcctggttagcgtcatcgcggacctccggaatgctttctacgttctgtttccgatttggtttcatctccaggaggccgtcggtatcaagctgctctgggttgcagtaatcggagattggcttaacctcgtgttcaagtggatccttttcggacaacgaccatactggtgggtgctggatactgactactactccaatacctctgtgccactgatcaagcagtttccggtgacttgtgaaaccggtccaggctcaccaagcggccacgccatgggaaccgcaggagtctactacgtcatggtcacctcaaccctgtcgattttccaagggaaaatcaagcccacctacaggttccggtgtctgaacgtgatcttgtggcttggtttctgggcggtccaactcaacgtttgcctgtcgagaatatacctggcggcccacttcccacatcaggtggtcgcgggagtgttgtcgggaatcgcggtcgccgaaacttttagccatatccactcaatctacaacgcctcactgaagaaatacttcctcattaccttttttctctttagcttcgcaatcggattctacctgctgctcaaagggctgggtgtggacctcctgtggactttggaaaaagcccaaaggtggtgcgaacaacccgaatgggtccatatcgatacgactccattcgcctccctgctgaaaaatctgggcactctgtttggcctgggactggccctcaactccagcatgtaccgggagtcgtgtaagggtaagctgtctaagtggttgccgttccggctgtcgtcgatcgtggcatcgctggtgctgctccacgtgttcgactcactcaagccgccttcccaggtggaactggtgttctacgtgctgagcttttgcaagtcggccgtggtgccgctcgcctcggtttcagtgattccgtattgcctggcccaagtgctcgggcagccacataagaagtccctt

SEQ ID NO: 12887 - DNA, 1071 bp, Artificial Sequence
  Description of Artificial Sequence: Synthetic coding sequence
atggaagaggggatgaatgtgctccacgattttggaatacagtcaacccattacctccaggtgaactaccaggactcccaagattggtttattctcgtatcggttatcgcagatttgaggaatgcattttacgtgttgttccctatctggttccacctgcaggaagccgtagggattaagctgctctgggtcgccgtcatcggagattggctgaatctggtcttcaagtggattctctttggacaaaggccttactggtgggtcctcgacacagactattattccaacacttccgtgccccttataaagcagttcccggtcacctgcgaaacaggaccgggaagccccagtggccacgcaatgggcaccgcaggagtttactatgtgatggtgacctccacactgtcaatcttccagggcaaaatcaagccaacatatcgctttcggtgtcttaatgtaatcctctggttggggttttgggccgtgcagttgaatgtgtgtttgtccaggatttatctggcagcccatttcccacatcaggttgtggccggcgttctttctgggatcgcagtagcagagactttttcacacattcacagtatctacaatgcatctcttaaaaaatacttcctgattacattcttcctcttcagtttcgctattggtttttatctgctgctcaagggtctaggtgtggatctgctttggacattggagaaagcacagcgatggtgcgagcaaccagagtgggtccacattgataccacccccttcgcctcgctgcttaagaacctgggtaccctgtttgggcttggcctggccctgaattccagtatgtaccgggagtcctgcaaagggaagttatctaaatggttgcctttcaggttgagctctatagttgctagcctggtcctcttgcacgtattcgactcgctgaagcccccttcccaggttgaactggtgttttacgtgctctctttttgtaagagtgctgttgtgcctcttgcctcggtgtctgtcattccatattgccttgcacaagtactcgggcagccccataaaaagagcctg

SEQ ID NO: 12888 - DNA, 1071 bp, Artificial Sequence
  Description of Artificial Sequence: Synthetic coding sequence
atggaggagggcatgaatgttctgcatgacttcggcatccagagcacacactatctccaagtgaattatcaggatagccaagactggttcatcctagtgagcgtcatcgcagatctgaggaacgccttctacgtgctctttcctatctggttccatctgcaagaagctgtaggaatcaagctgctttgggtcgccgtcatcggcgattggttgaacctggtctttaagtggatcctctttgggcagcgaccttattggtgggtgctggatactgactattattccaatacttctgtaccccttattaaacaattccccgtgacctgtgagacaggtccaggatccccttctggccatgccatgggaaccgcgggggtgtattatgttatggtcaccagcaccctttccatcttccaggggaagatcaagccaacatacaggttccggtgcctgaatgtgattctttggctgggcttctgggctgtccaactgaacgtttgtttgtcccgtatctatctcgcagcccatttcccccaccaggtggtggctggcgtcctaagcgggatcgccgtcgccgagaccttctcccatatccacagcatctataacgcatctttaaagaagtattttctgatcacattctttctgttttctttcgctatcggattctatctcctcctgaaaggactcggcgtcgatctgctgtggaccctggaaaaggcgcagcggtggtgcgagcaacccgagtgggtccatatagacaccacgccatttgcctcactgctcaaaaatcttgggacattgtttggactgggtctggctctgaactcttcaatgtaccgtgagtcctgcaaaggcaaactcagcaaatggctaccattccgcctgagcagcatcgtggcttccttagtgctgctccatgtgtttgattcactgaagcctccctcccaggtggagctggtgttctacgtcctgagcttctgcaaatcggcagtcgtccctttagcaagcgtgagcgtgattccgtactgcctggcccaggtcttggggcaaccccacaaaaaaagccta

SEQ ID NO: 12889 - DNA, 1071 bp, Artificial Sequence
  Description of Artificial Sequence: Synthetic coding sequence
atggaggaagggatgaacgtgctacatgactttgggattcagtctacacactatctgcaagtgaactatcaagatagccaggactggttcatactggtaagtgtgattgccgacctccgcaacgctttttacgtcctatttcctatctggttccacctgcaggaagctgtgggtattaaattactatgggttgcggtaatcggtgattggctcaaccttgttttcaagtggattttattcggacaaaggccttattggtgggttctggacacagactactattccaatacaagtgttcctctaattaaacagtttcccgtgacatgtgagacagggcctggctctccttctgggcacgctatgggaactgctggcgtgtattacgtgatggtgactagcacgcttagtattttccagggtaagatcaagccgacctaccgatttaggtgtttaaacgtcattctctggctcggattctgggcggtccagctaaacgtgtgtctttcccgcatttatctggctgctcacttcccccaccaggtagtcgccggcgttctgagtggcatcgccgtcgccgagacgtttagtcatatccactctatatacaacgcctcactaaaaaagtatttcctgatcaccttcttcctgttcagctttgctatcggattctacttgctgctcaagggcctcggtgtcgatcttctgtggaccctggagaaggcccagagatggtgcgagcagcctgaatgggttcatatcgatacaactcctttcgcttcgctgttaaagaacctcggcacactgtttggtctcggactggcactcaattcttccatgtaccgagaaagttgcaagggaaagctgagcaagtggctgccattccgcctgtcttcaatcgtggccagcctggtgctgctccacgtcttcgactcccttaagccaccctcccaggtagagctcgtattctacgtgctgagcttttgtaagagcgcagtggtgccactagcctccgtgagcgtgataccgtactgtctggcccaggtccttgggcagcctcataaaaagtcccta

SEQ ID NO: 12890 - DNA, 1071 bp, Artificial Sequence
  Description of Artificial Sequence: Synthetic coding sequence
atggaagaggggatgaacgttctccatgactttggcattcagtccacacattatctgcaggtaaactatcaggattcccaggattggtttatcctcgttagcgtcatcgctgatttgagaaacgccttctacgttctcttcccaatttggtttcatctgcaggaggctgtcgggattaagctgttatgggtagccgtaatcggagactggttaaatctggtcttcaagtggatcttgttcggccagagaccgtactggtgggtactagatactgattattacagtaacacctctgttcccctgatcaagcagtttccagttacatgcgaaaccggccctgggagccctagtggccacgccatggggacagctggcgtgtactatgtgatggtgacttcgacactgagcatttttcaagggaaaattaaacctacatacagatttaggtgcctcaatgtaatactttggctgggcttttgggccgttcagctcaatgtgtgtctctctcgaatttatctggccgctcacttccctcaccaggtcgtggctggggttctctctggaatagccgttgcagagactttttcccacatccatagtatctacaacgcttctctgaagaaatattttctgattacttttttcttgttttcattcgctattgggttctacctcttgctaaaaggcctgggtgtggacttgctgtggaccctggaaaaggcccagcggtggtgtgaacagcccgagtgggtacacatagataccacgccttttgccagtctcctgaagaatttaggcaccctgtttggtctcggactggctctaaacagctctatgtatcgggagtcctgtaagggaaagctttctaaatggctgcctttcaggttatctagcattgtggccagcttggtgctgcttcatgtgtttgacagcctgaaaccaccttcgcaggtcgagctggtgttctatgtgctctccttctgcaagtcagctgtagtccctctggcctccgtctcagtgattccttactgcctggcgcaggttttgggtcagccccacaagaaatcactg

SEQ ID NO: 12891 - DNA, 1071 bp, Artificial Sequence
  Description of Artificial Sequence: Synthetic coding sequence
atggaagagggtatgaatgtccttcacgacttcggcatccaaagcacccattatctccaagtcaactaccaggattcccaagactggttcatcctcgtctccgtgattgcggacctgcgtaatgcattctatgtcctcttcccgatctggttccatcttcaagaagccgtgggaatcaagctgctgtgggtggctgtcatcggggattggctcaatcttgtgttcaagtggatcctcttcggccagcggccgtactggtgggttctggacacggattactactccaacaccagcgtcccacttatcaagcagttcccggtgacgtgcgagactggtcctggatcgcccagcggccatgctatgggcaccgccggtgtgtactacgtgatggtgacctccaccttgagcatctttcaaggcaaaatcaagccgacctaccggttcaggtgcctcaacgtgatcctgtggctgggattctgggccgtccagctcaatgtctgtctgagccgaatttacctcgcggcccactttccacaccaggttgtggcaggagtgctctccggaattgcagtcgccgaaaccttctcacacatccattccatttacaacgcctccctcaaaaagtacttcctgatcactttctttctgttttcgtttgcaattgggttctacctcctgctgaagggactcggagtcgacctcctctggactcttgaaaaggctcagagatggtgtgaacaacctgagtgggtccacatcgacactactccgttcgcctcccttctcaagaaccttggtactctgttcggattgggactcgcgctcaactccagcatgtaccgggagtcatgcaaaggaaaactgtcgaagtggctccccttccggctttcgtcaatcgtggcgtcgctggtgttgctccatgtgttcgatagcctgaagccgccttcacaagtggaactggtcttttacgtgctgtcattctgcaagtccgcggtggtgccgctggcgtcagtgagcgtcattccatactgcctggctcaagtgctcggccagccacacaaaaagagcctg

SEQ ID NO: 12892 - DNA, 1071 bp, Artificial Sequence
  Description of Artificial Sequence: Synthetic coding sequence
atggaagagggaatgaacgtgctgcacgattttggcattcagagcacccactaccttcaggtcaactaccaggattcgcaagactggtttattcttgtgagcgtgatagcagaccttcgcaatgccttttacgttctcttccccatctggtttcatcttcaggaagccgtgggtattaagttgctgtgggtggcagtgattggcgactggctcaacctggtgttcaaatggattctgtttgggcagcgcccttactggtgggtccttgataccgactactatagcaacacttcagttcctttgatcaaacaatttcctgtcacttgcgaaaccgggccgggttccccttccggccacgctatggggaccgcaggcgtgtactacgtgatggtcacctcgaccctttcgatttttcaaggaaagatcaagccaacttaccgattcagatgtctcaacgtgattctctggctcggtttttgggctgtgcaactgaatgtctgtctcagcagaatatacttggcagctcatttcccccaccaagttgtcgcaggtgtgctgagcggcattgcagtggccgaaaccttttcgcacattcactcaatctacaacgcatccctgaaaaagtactttctgattaccttttttctgttctcgtttgcaattggattttaccttcttttgaagggacttggtgtggatcttctttggactctcgaaaaggcacagcggtggtgtgaacaacctgaatgggtgcatatcgataccacgccatttgccagccttcttaagaaccttggaaccctgtttggtctgggacttgccctgaactcatcaatgtacagagaatcatgcaaaggcaagctgagcaagtggcttccttttagactgtcatcaatagtggcatcacttgtattgttgcacgtgtttgattcgctcaagccgcccagccaagtggagctggtgttttacgtgctctcgttttgtaagtccgctgtcgtgccactcgcaagcgtgtcggtgattccttattgtctggcacaggtccttggtcaaccacacaaaaagtccctc

SEQ ID NO: 12893 - DNA, 1071 bp, Artificial Sequence
  Description of Artificial Sequence: Synthetic coding sequence
atggaggaagggatgaacgtgctccatgattttggtattcaatcgacccactacctgcaggtcaactaccaggattcccaagactggttcattctcgtgtccgtgattgctgacctcagaaatgcgttttacgtcctctttcctatatggttccatctgcaagaagcagtcggcataaagctgttgtgggtcgcagtcataggagattggctcaacctggtctttaagtggatcctctttgggcaaagaccttactggtgggtgctcgacactgattactactcgaatacttcggtccccctcattaagcaattccctgtcacttgtgaaaccggccccggttccccttcaggtcacgcaatgggtaccgcaggcgtgtactacgtcatggtgacttccactctgtcgatctttcaaggcaaaatcaagcctacttaccgcttccggtgtcttaatgtcatcctttggctgggtttctgggcagtgcagctgaacgtgtgcctgtcacggatttatctggcagcgcatttcccgcaccaagttgtggccggggtcctttccggtatcgccgtcgcagaaactttttcccatattcatagcatctacaacgcatccctgaagaagtacttccttattactttctttctgtttagcttcgcaattggtttctaccttcttctgaagggtctgggtgtggatctgctttggactctcgagaaggcacagaggtggtgcgaacaacctgaatgggtccatatagatactacccccttcgcatcgctcctgaagaatctgggaacgctctttggactcggacttgcgcttaattcgtcgatgtacagagaatcatgcaagggaaaacttagcaagtggttgcccttcagactttcctcaattgtagcgtcactcgtgctgctgcatgtgtttgatagcctgaagccaccatcacaagtggaactggtgttctacgtgcttagcttttgtaagagcgcagtggtgcctctggcatcggtcagtgtgattccctactgtctggctcaggtattgggccagccacacaaaaagtccctc

SEQ ID NO: 12894 - DNA, 1071 bp, Artificial Sequence
  Description of Artificial Sequence: Synthetic coding sequence
atggaggagggtatgaatgttttgcatgatttcggtattcaaagtacccattacttacaggtcaactaccaggatagccaagattggttcattctggtttccgttatcgcagatctcaggaatgccttctatgtcctgttccctatctggtttcacctgcaagaagcagtggggatcaagctgctgtgggtagctgttatcggagactggctaaatttggtgtttaaatggatcctctttggtcaaagaccctactggtgggtcttggatactgattactactctaacacaagtgtgcctctgataaagcagttccccgtgacctgtgaaaccggccctgggagccccagtggtcacgccatgggcaccgccggcgtatattatgttatggtgacgtccacgctttccatctttcagggaaagatcaagcctacataccgtttccggtgcctcaacgtaattttatggctggggttctgggccgtgcaacttaacgtttgtctgtcacgcatctatcttgctgctcacttcccccaccaggtagtagccggagtcctgtcaggtatcgccgtagccgaaacgttcagtcacatccactccatttacaacgcttccctcaagaagtacttcttgattaccttctttctgttcagctttgccatcgggttctacttactgctgaaagggctgggtgtggacctgctttggaccttggaaaaagcgcaacgatggtgcgagcagccggaatgggtgcacattgatactaccccattcgcttctctgctcaaaaatctcggaaccctctttgggctgggcctggccttaaactcaagcatgtaccgtgaatcgtgcaagggcaaactctcaaagtggctgccgttccgattatcctccatcgtggcaagcctggtgcttttgcacgttttcgactccctgaagcctccaagtcaagtggaattggttttttacgtgttgtccttttgcaagtccgctgtcgtccctctggcatccgtatccgtcatcccgtattgtctcgcccaggtgctgggtcagccacacaaaaagagtctt

SEQ ID NO: 12895 - DNA, 1071 bp, Artificial Sequence
  Description of Artificial Sequence: Synthetic coding sequence
atggaggaaggcatgaacgtgctgcacgactttggaattcagtcgacccactacctgcaagtcaactaccaagattcgcaagactggtttatacttgtgagcgtcatcgcggatctgagaaacgcgttctacgtgcttttcccgatctggttccatctccaagaggctgtgggcatcaaacttctgtgggttgccgtcatcggtgactggctgaaccttgtattcaaatggattctctttggacagcgcccgtactggtgggtgctcgataccgattactacagcaacaccagtgtgcctttgatcaagcaattccctgtgacgtgtgaaactggtccgggatctccatcgggacacgctatggggaccgccggcgtgtactatgtcatggtaacttccaccctctcgattttccagggcaagatcaagccgacctaccgttttcgctgcttgaacgtgatcctttggttgggattctgggccgttcagctcaatgtgtgcttgagccggatctatctggccgcgcatttccctcaccaggtcgtggctggtgtgctttcgggaatcgccgtggccgagactttttcacacatccattcaatctacaatgcttcactgaagaagtacttcctgattactttcttccttttctcctttgcaatcgggttctacctgctccttaagggactcggggtcgacctgctgtggacgctggagaaggctcagcggtggtgcgaacagcccgaatgggtgcacatcgacaccactccgttcgcgtcgctgttgaaaaatctgggtaccctttttggcctcggactcgcattgaattcgagcatgtaccgcgaatcgtgcaagggaaaactgagcaaatggctcccattcagactgagttctatcgtggcatccctcgtccttctgcacgtgttcgactcgctgaagccaccgtcccaagtggagttggtattctacgtgctctctttctgcaagtccgcagtggtcccactggcctcagtttccgttatcccatactgtctggcccaggttctcgggcagccccataagaagtcactg

SEQ ID NO: 12896 - DNA, 1071 bp, Artificial Sequence
  Description of Artificial Sequence: Synthetic coding sequence
atggaagaaggtatgaatgtattacatgattttggtatacaatcgacgcattatttacaagtaaattatcaagattcgcaagattggtttatattagtatcggtaatagcggatctacgaaatgcgttttatgttctatttccgatatggtttcatctacaagaagcggtaggtataaaattactatgggttgcggtaataggtgattggctaaatttagtttttaaatggatattatttggtcaacgtccgtattggtgggttttagatacggattattattcgaatacgtcggttccgctaataaaacaatttccggtaacgtgtgaaacgggtccgggttcgccgtcgggtcatgcgatgggtacggcgggtgtatattatgtaatggtaacgtcgacgttatcgatatttcaaggtaaaataaaaccgacgtatcgttttcgttgtctaaatgttatattatggttaggtttttgggcggtacaactaaatgtatgtttatcgcgtatatatctagcggcgcattttccgcatcaagtagtagcgggtgtattatcgggtatagcggtagcggaaacgttttcgcatatacattcgatatataatgcgtcgttaaaaaaatattttttaataacgttttttttattttcgtttgcgataggtttttatctattactaaaaggtttaggtgttgatttactatggacgttagaaaaagcgcaacgatggtgtgaacaaccggaatgggtacatatagatacgacgccgtttgcgtcgttattaaaaaatttaggtacgttatttggtttaggtttagcgctaaattcgtcgatgtatcgagaatcgtgtaaaggtaaactatcgaaatggttaccgtttcgtctatcgtcgatagtagcgtcgctagtactattacatgtatttgattcgctaaaaccgccgtcgcaagtagaactagtattttatgtactatcgttttgtaaatcggcggtagtaccgttagcgtcggtatcggtaataccgtattgtctagcgcaagtactaggtcaaccgcataaaaaatcgtta

SEQ ID NO: 12897 - DNA, 1071 bp, Artificial Sequence
  Description of Artificial Sequence: Synthetic coding sequence
atggaggagggtatgaacgttctgcacgacttcggcattcaatccactcattacttgcaagtgaactaccaggactcgcaggattggtttattcttgtgtccgtgatcgcagatcttagaaacgctttctacgtgctgtttcctatctggttccatcttcaagaagccgtgggtatcaagctcctttgggtggcagtcatcggagactggcttaacctggtgttcaaatggattcttttcggacagaggccttactggtgggtgctcgacacggactactattccaacacctcagtccctcttatcaagcaatttcctgtgacttgtgaaaccggacccggttcaccgtcgggacatgccatgggaaccgcgggggtgtattatgttatggtgacgtccacgctctcgatctttcaaggcaagattaagcctacttacaggtttcggtgccttaatgtcattttgtggctgggtttttgggcggttcaacttaacgtgtgtctgtcaagaatttaccttgctgcccacttcccacatcaagtggtggctggagtcctttcgggaatcgcagtggcagaaacctttagccatatacattccatctacaatgccagcctgaaaaagtactttcttattaccttcttcctgttttcgtttgcaattggattttacctgctgttgaaaggcctcggagttgacctgctgtggactttggaaaaagcccaacggtggtgtgaacaaccagaatgggtgcatatcgatactaccccgtttgcatcactgttgaaaaacttgggaaccctttttggtcttggactggcactcaactcgtccatgtaccgcgagtcctgtaaggggaagctcagcaaatggcttccatttcgtctgagctcgatcgtcgcgtcccttgtcctcctccatgtgtttgactcactgaaacctccttcgcaagtggagttggtcttttacgtcctgtcattctgtaaatccgcggtcgtgcccttggcgtcggtgagcgtgattccttactgtttggcacaggtgcttggtcagccacataagaagtccctg

SEQ ID NO: 12898 - DNA, 1071 bp, Artificial Sequence
  Description of Artificial Sequence: Synthetic coding sequence
atggaagaaggcatgaacgtgctccacgatttcggaatccaatcgacccactatctccaggtgaactaccaggacagccaagactggtttatcttggtgtcggtgatcgccgacctgcgcaacgccttctacgtgctcttcccaatctggttccacctccaggaagctgtgggcatcaagctcctgtgggttgcagtgatcggtgactggcttaacctggtgttcaagtggatccttttcggtcagcgcccgtactggtgggtgttggacactgactactacagcaatacttcagtcccgctcatcaagcaattcccggtcacgtgtgagactgggcctggatccccatcgggacatgccatgggcactgccggtgtctactatgtgatggtgactagcaccctgtccatctttcaagggaagattaagcctacttacaggtttcggtgcctgaatgtgatcttgtggctgggtttctgggcggtacaacttaatgtctgcctctcgcggatctacctggcagcacacttcccgcaccaggtcgtcgccggcgtgctcagcggtattgcagtggctgaaaccttctcccacatccacagcatctacaacgcctccctcaaaaagtactttctcatcacgttctttctgttctcgttcgccatcggtttctacctgctcctgaagggactgggcgtcgacctgctgtggaccctggagaaagcacagaggtggtgcgaacagcctgaatgggtgcatatcgacacgaccccgtttgcctcactgctcaagaacctggggactctctttggacttggacttgcgctcaattcgagcatgtaccgggaatcgtgcaaaggaaagctgtcaaagtggctgccgttccgcctctcgtccattgtcgcatcactcgtcctgctgcacgtgttcgactcgctcaagccaccatcgcaagtggagcttgtgttctatgtgctttccttctgcaagtccgctgtggtgccacttgcgtcggtgagcgtgatcccgtactgcctggcacaggttctgggacaaccacataagaagtccctg

SEQ ID NO: 12899 - DNA, 1071 bp, Artificial Sequence
  Description of Artificial Sequence: Synthetic coding sequence
atggaggagggaatgaatgttctccatgattttgggatacaatcgactcactatttgcaagttaactatcaagactcacaagattggttcattcttgtatctgtaattgcagatctcaggaatgccttctatgtcctgttcccaatttggttccacttacaggaggccgtcgggattaaacttttatgggttgctgttattggagattggctaaatttagttttcaagtggattcttttcggacagcgtccatattggtgggttctggatacggactactattcaaatacctccgttccactaattaagcaattcccagtgacatgcgagaccggacctggatccccatctggacacgctatgggtaccgctggtgtgtactatgtgatggtaactagcacattgtcaatcttccaaggtaaaatcaagccaacgtataggtttcgttgcctgaatgttatcctgtggttgggtttttgggcagtacagctcaatgtgtgcttatccagaatctaccttgctgctcatttccctcaccaggttgttgcaggtgttttgtctggtatcgcagtagctgaaacgttctctcatattcacagtatctataacgcttctttgaagaaatattttcttatcaccttctttctgttctcgttcgctatcggtttttatttactgctcaagggtttgggtgtggatttactgtggactcttgagaaagcacaacgttggtgtgagcagcctgagtgggtccatatagacactacaccgtttgcgtcactgctcaagaatcttggtacccttttcggtctggggcttgcattaaactcatcaatgtacagggagtcatgcaaaggaaagctgtcaaaatggcttcctttcaggttgtcgagcattgttgcttctctcgtacttctccatgtgtttgatagtctcaagccaccttctcaagtggaattggtcttttatgtgctctcgttttgcaagtctgctgttgttccgctggcatcagtgtctgttatcccttactgtttagcccaagttttgggacagcctcataagaagtctctg

SEQ ID NO: 12900 - DNA, 1071 bp, Artificial Sequence
  Description of Artificial Sequence: Synthetic coding sequence
atggaagaaggtatgaatgtcctgcacgattttggtatccagtctacacactaccttcaggtgaattaccaggactctcaggattggtttatcctggtttccgtgatcgccgatctgcggaatgctttctacgtgctattccctatttggttccatttacaggaagccgtgggcatcaaactactctgggtggcagtgattggcgactggttgaatcttgtgtttaagtggatattgttcggacaacgcccctactggtgggtgctggacactgactattattctaatacatctgtgccacttattaagcagttcccggtgacttgtgaaacagggccaggctccccgagcggacatgccatgggtactgccggcgtgtactacgtgatggtgacttctacgctctctatctttcagggtaagatcaagcccacctatcggtttagatgtctcaacgtcattttgtggctgggcttttgggccgttcagttgaatgtgtgtctatcccgtatatatttggcagctcacttccctcatcaagtcgtagccggtgtactgtctgggatagctgttgcggaaacattctcccacatacattccatttataacgcctcccttaagaagtacttcctcattaccttctttctcttctcctttgccatcggcttctaccttctcctgaaggggttgggcgtcgacctgctatggaccctggaaaaagcacagaggtggtgcgaacaaccggaatgggtgcatatcgacactaccccatttgcgtcccttctaaagaacttggggacactatttggcctgggcctggccctgaactcctcaatgtaccgtgaaagttgcaaaggaaagctttcaaagtggctgccttttagactctcctcaatcgtggctagtctggtgctgttgcatgtcttcgactctctgaagcccccttcacaagtggaactggtgttctatgtgctgtctttttgcaagagcgccgtggtccccctagccagcgtctccgtgattccttattgcttggctcaggtcctgggccaacctcacaagaaatccctc

SEQ ID NO: 12901 - DNA, 1071 bp, Artificial Sequence
  Description of Artificial Sequence: Synthetic coding sequence
atggaagaaggcatgaatgtcttacatgacttcggcatccagtcaacacattatcttcaagtaaactatcaggactctcaggattggtttattttagtatccgtcatagccgatctgagaaatgctttttacgtcttgttcccgatctggtttcatcttcaagaagctgtgggaattaagttgctgtgggtcgcggtaattggagattggctcaacctggtgtttaaatggattctctttggacaacgcccttactggtgggttctggatactgattactatagcaacacttctgtgccgttaataaagcaatttcctgtgacatgtgagacaggcccaggatctccgagcggccatgctatgggaacagcaggggtctactatgtgatggtgacatctacgctgtcaatctttcaaggtaaaatcaaaccgacttatcgttttcgttgcctgaatgtcatcttatggttaggcttttgggctgttcaacttaatgtgtgcctgtctcggatctacttggccgcgcattttccgcaccaggtcgtcgcgggagtcctgtcgggaattgcagttgctgagacattttctcacattcactccatttataacgcgtctctgaagaagtatttcttgattacgttttttttattcagcttcgccattgggttttatctgcttctgaaaggtttgggagttgacttattatggacgttggagaaggcccaaagatggtgtgaacagccggagtgggtgcacatcgatacaacaccttttgcatcgcttctgaaaaaccttgggacactctttggactaggcctggcccttaacagctccatgtatagggagtcttgcaaaggaaaactgtcaaaatggctgccattccgcttgtcaagtatcgttgcaagcttggtattattacatgtttttgactctttgaagccaccgtctcaggtggagttagttttttatgtgttatccttttgcaagtctgcagttgttccgctggcctccgtctcagttattccgtattgtctggcgcaggtgttgggacaaccgcacaaaaagtcactt

SEQ ID NO: 12902 - DNA, 1071 bp, Artificial Sequence
  Description of Artificial Sequence: Synthetic coding sequence
atggaggagggcatgaatgtcctgcacgactttggcatccaatccacgcactacctgcaggtgaactaccaggactctcaagattggtttatactggtgagcgtgatcgctgatctgcgcaatgctttctatgtactcttccctatatggttccaccttcaggaggctgtgggtatcaagctactctgggtggcagtgatcggcgactggctgaatctcgtattcaaatggattctctttggccagcgtccttactggtgggtgctggacacagactactatagtaataccagtgtgccactgatcaaacagttccctgtgacatgcgaaactggtcctgggagcccgagtggacacgctatggggacagcaggcgtgtactacgtgatggtgacatctacattaagtattttccagggcaaaataaagcccacgtacagatttcgatgtctcaacgtgatcctatggctcggcttctgggccgttcaacttaatgtgtgcctgtcacggatatacctagcagctcatttcccccaccaggtggtggctggtgtcctttcgggcatcgcagtggctgaaactttcagccatatccacagcatttataacgcatctttgaagaaatatttcttaatcaccttttttctgttctcattcgctatcggcttttatttgttgttgaaggggctgggggtggatctattatggacgcttgagaaggcgcaacggtggtgcgagcagcccgaatgggtgcatattgacaccactccgtttgcgtccctccttaagaacctgggaaccctattcgggttgggcttggctctaaacagctctatgtacagggaatcctgcaaggggaagctatccaaatggctaccattccggttaagtagcattgtggctagtctggtccttttacacgtgttcgatagcctaaagcctccaagtcaggtggagcttgtcttctacgtgctgagcttctgcaaatccgctgtcgtgcccctggcgagtgtctctgtgatcccgtactgcctggcacaggtcctgggccagccgcacaagaagtcccta

SEQ ID NO: 12903 - DNA, 1071 bp, Artificial Sequence
  Description of Artificial Sequence: Synthetic coding sequence
atggaggagggcatgaacgtgttacacgactttggaatacagtcaacacactacctgcaggtgaactatcaggactcacaggactggttcattctcgtgtcagtaatagccgatttacggaacgcattctatgtattattccctatctggtttcatcttcaggaagcggtggggatcaagctgttgtgggtggcggtgattggtgactggctgaatctggttttcaagtggattttgttcggtcagcgcccctattggtgggtgctggatactgactactattccaatacctcggtgccgctgattaagcagttcccagtcacatgcgagactgggccaggatcaccaagcgggcacgcgatgggtaccgctggtgtctattatgtgatggtaactagtacactttcaattttccagggaaagataaagccgacttacagattccgatgtctaaacgtgatactctggctcggcttttgggctgtgcagttaaatgtgtgtctgtcgcggatctacctcgctgcacactttcctcatcaggtggtggcgggcgttctgagtgggattgcggttgccgagacattcagccacatccattctatttacaatgcttctctgaagaaatatttcttgataacattcttcctgtttagcttcgctattggcttttatctcctgctgaagggactcggagtggacctgttgtggactctagaaaaggcccagaggtggtgtgaacagcccgagtgggtccacatcgacaccaccccattcgccagccttcttaaaaaccttgggaccctgttcgggttgggcctggcgctgaattcaagtatgtatcgcgaatcttgtaagggcaagctgtcaaaatggctgccattccggcttagtagcatcgtcgcatcactggtgcttctgcacgtgtttgactcgctcaagccaccttcgcaggtggaactggtgttctatgtcttatcattttgtaagtctgctgtcgtgcccctggcctccgtatccgtcatcccatattgtctggcccaagtgctgggccaaccacacaagaagagcctc

SEQ ID NO: 12904 - DNA, 1071 bp, Artificial Sequence
  Description of Artificial Sequence: Synthetic coding sequence
atggaggagggcatgaacgtattgcatgactttggaattcaatctactcattatctccaggtaaattatcaagactctcaggactggtttattctggtgtctgtcatcgctgacttgaggaacgccttttacgtcttgtttccgatttggttccacctgcaagaggcggtgggcattaagctgctgtgggtggccgttataggcgattggctcaatctcgtgtttaaatggatattgttcggccagcgcccttattggtgggttctggacacagactattactctaatacctctgtgcctctgatcaagcagttccctgtgacctgtgagacgggtccgggctctccctcaggacacgccatggggacagcaggcgtgtactatgttatggtgacctccactctgagcatctttcaggggaagatcaaaccaacctatcggttccggtgcctgaacgtgattctttggctgggcttctgggctgttcagctgaacgtttgcctgtcacgaatttacctggccgctcacttcccacatcaggtggttgctggggtcctgtctggcatcgccgtcgctgagacctttagtcacattcattccatttacaacgcttcactcaagaaatatttcctgattaccttctttctgttctcattcgcaattggtttttacctccttttgaaaggactgggggtagatctgctctggacactcgagaaggcacaaagatggtgtgagcagcccgagtgggtgcacattgacactaccccattcgccagtctgctgaagaacctgggcacactgtttggcctcggactcgcactcaacagctctatgtacagagaaagctgcaagggcaagcttagtaagtggctgccgttccgcctctctagcatcgtggcttctctggtcctcctccatgtgtttgacagtctcaagcctccaagccaggtggaacttgttttctacgtgctcagcttttgtaagagtgcagtcgtccccctggcctctgtttccgttatcccatactgccttgctcaggtgcttgggcagccgcataaaaaatccctt

SEQ ID NO: 12905 - DNA, 1071 bp, Artificial Sequence
  Description of Artificial Sequence: Synthetic coding sequence
atggaagagggaatgaacgtcctgcatgacttcggcatccagagcacccactacctccaagtcaattaccaggattctcaggactggttcatcttggtgtctgtgatcgcggacctcagaaatgcattttacgtgctgttcccaatctggttccatctccaggaggccgtcggcatcaaactgctctgggtggccgtaatcggagattggctgaatctcgtgttcaagtggattctcttcggacagcggccatactggtgggtgctggataccgactactattcaaacacctcggtgccactcattaagcagttcccggtgacctgcgaaactggaccgggaagcccatcgggccatgctatggggaccgcgggtgtctactacgtgatggtgacgagcaccctcagcatctttcaaggaaaaatcaagccgacttaccgcttccggtgtctcaacgtcatcttgtggctgggattctgggcagtccagctcaacgtgtgtctgagccgcatctacttggccgctcatttccctcaccaagttgtggccggggtgctgtcaggaatcgctgtggcggaaaccttttcccatatccactccatctacaatgcttcccttaagaagtacttccttatcacttttttcctgttctcctttgcaatcggcttctacctgctcctgaagggtctgggggtggacctgctgtggactctcgagaaggctcaacgctggtgtgagcaaccggaatgggtgcatatcgacaccaccccgtttgcatccctgctgaagaacctcggcactctgtttggcctcggccttgctcttaatagctcaatgtacagagagtcgtgtaagggaaagctctcgaaatggctgccgttccgcctgtcctccatcgtggcctcattggtgctgcttcacgtctttgactcactcaaacccccatcccaagtcgagctcgtgttctacgtgctctcattctgcaaatcggcggtggttcctctggcgtcagtgtccgtgataccgtactgtctggcacaggtgcttggacagccccacaagaaatcactg

SEQ ID NO: 12906 - DNA, 1071 bp, Artificial Sequence
  Description of Artificial Sequence: Synthetic coding sequence
atggaagaaggaatgaacgtcttgcacgattttggaattcaatccactcattaccttcaagtgaattaccaggattcacaggactggttcatccttgtctcggtgattgcggacctgcgaaacgcattctacgtcctgtttccaatttggtttcatctccaagaagcagtgggaattaagctgctgtgggtcgcagtgattggtgactggctgaacctcgtgtttaagtggatacttttcggccagaggccctactggtgggtgctggacactgattactactcgaacacctccgtcccactcattaaacagtttcctgtgacttgtgaaaccggtcctgggtccccttcaggtcacgcgatgggtaccgcaggcgtgtactacgtgatggtgacgtccaccctttccatttttcagggcaagattaaacctacctaccgatttagatgtctgaatgtgatactttggctggggttttgggccgtgcagcttaacgtctgcctttcgcggatttacctggcagctcatttccctcaccaggtcgtggcaggtgtcctctcgggaatagcagtcgcagaaaccttcagccacatccactcgatctacaacgcgagcctcaagaaatactttcttatcactttcttcttgttctcatttgcaataggtttttacctgctcctgaagggactgggagtggatcttctgtggaccctcgagaaagcacaacgctggtgtgagcaacctgaatgggtgcatatcgatactactccttttgcgtcactgctgaagaacctcggtacgctctttggactcggactggcccttaactcctcaatgtaccgagaatcatgcaagggcaagctgagcaagtggctgccttttaggctgtcatcgatcgtcgcatcgctcgtgcttctgcacgtttttgactccctgaagcctccatcgcaagtcgaactcgtgttttacgtgcttagcttttgtaagtcggcagtggtccccctggcaagcgtctcggtaattccctactgtcttgcgcaggtgctcggccagccacacaaaaagagtctt

SEQ ID NO: 12907 - DNA, 1071 bp, Artificial Sequence
  Description of Artificial Sequence: Synthetic coding sequence
atggaagagggcatgaatgtgctgcatgactttggaatccagtccactcattaccttcaagtgaactatcaggactcccaggactggttcatcctggtgtcagtgatcgcggacctccgcaacgccttctacgtgctgttcccgatctggttccatctccaggaggctgtgggaatcaagctgctctgggtcgcggtcattggggactggcttaatctggtgttcaagtggatcctgttcggacagcggccgtactggtgggtcctggatactgactactattcgaatacctccgtgccgctgattaagcaatttccggtgacctgcgaaaccgggcctggctcacctagcggccacgccatgggaaccgccggagtctactacgtgatggtgaccagcactctgagcatcttccaggggaagatcaaaccgacctaccggttcagatgcttgaacgtcatcctctggctggggttttgggctgtacaactcaatgtgtgcctgtcacgcatctaccttgctgcccacttcccacaccaagtggtggcgggagtcctgtcggggatcgcagtcgccgaaactttcagccatattcattcgatctacaacgcgagtctgaaaaagtacttccttatcacgttcttccttttcagctttgccatcggtttctacctgctcctgaagggcctgggcgtggatctgttgtggactctcgaaaaagcccagaggtggtgcgaacagccggaatgggtccacatcgacacgactccattcgcgagccttctgaagaatctgggaactctgtttggactgggccttgccctgaattcctcgatgtaccgcgagtcctgcaaggggaaactctccaagtggctgccattccggctctcgagcatcgtggccagcctcgtgctgttgcacgtgtttgactcgctgaagccaccgtcccaggtggagctggttttctacgtcctgtccttctgcaagtcggctgtggtcccgctcgcgtccgttagcgtcatcccttactgtctggcgcaggtgctgggacaaccacataagaagtcattg

SEQ ID NO: 12908 - DNA, 1071 bp, Artificial Sequence
  Description of Artificial Sequence: Synthetic coding sequence
atggaagaagggatgaatgtcctgcacgattttgggatccagtccactcactaccttcaggtaaactatcaagattcccaagattggtttatccttgtgagcgtcattgcggaccttcgtaacgcattttacgttctgtttcccatttggtttcatcttcaggaagcagtgggtattaagctgctttgggtggcagtgataggggactggttgaaccttgtgtttaagtggattctgtttggccaaagaccttactggtgggtccttgataccgattactattccaacaccagcgtacctctgatcaaacagttcccagttacttgtgaaaccgggccggggagtccttccggccatgcaatgggcaccgcaggtgtgtattacgtgatggtgaccagcacgctctccattttccagggaaagatcaaaccaacctaccgcttcaggtgccttaacgtgattctctggcttggcttttgggctgtgcaactgaacgtgtgtctctcgcgcatttacctggcggcacattttccacaccaggtcgtggcgggcgtgctttcgggtattgcagtggctgaaactttctcacatatccatagcatctacaacgcatccctgaagaagtacttccttattaccttctttctgttttccttcgcaattggattctacctcctgctgaaagggttgggagtcgatctcctttggactcttgagaaggcacaacgatggtgcgaacaaccagaatgggtgcatattgatactactcctttcgcaagtctgctgaaaaatcttggtaccttgtttggactgggcctggcccttaactcctcaatgtacagggagagctgtaagggaaagttgagcaagtggctcccttttagattgagctctatcgtggcgtcactggttttgcttcatgtgttcgattcgctcaagccaccatcgcaggtcgagctcgtgttttacgtgctttcgttttgtaaatccgcagtggtccctctggcgtcggtttcggtgataccctattgcctggctcaagtccttggtcaacctcacaagaaatcgctg

SEQ ID NO: 12909 - DNA, 1071 bp, Artificial Sequence
  Description of Artificial Sequence: Synthetic coding sequence
atggaagaaggtatgaatgtgctgcacgattttggaattcagagcacccattacctccaagtgaactaccaggattcacaagattggtttattctcgtgtccgtcatcgcagacttgcgtaacgccttctacgtcctcttccctatctggtttcatctgcaggaggcagtcgggatcaagctgctgtgggtggccgtcatcggcgactggttgaatttggtgttcaagtggatcttgttcggccagcgcccctattggtgggtgttggacactgactactactcgaacacctccgtccccttgatcaagcagtttccggtcacttgcgaaaccgggccgggatccccatccgggcacgcgatgggaaccgccggcgtctattacgtgatggtcacctcgaccttgtcgatttttcaaggaaaaatcaaaccaacgtacagattccggtgtctcaatgtgatcctgtggctcggcttctgggcggtacagctcaacgtgtgcctcagcagaatttacctggccgcgcatttcccgcaccaagtggtcgccggagttctctcggggatcgccgtggctgaaactttttcacatattcattccatatacaacgcgtcgctgaagaagtacttccttattactttctttctgttttcgtttgcaatcggattctacttgctgctcaagggcctcggcgtggatctgctctggactctggagaaggcccaaagatggtgcgaacagcccgagtgggtccacatcgatactacccccttcgcatcactgctgaagaatctgggcaccctgttcggactcggtcttgcgctgaacagcagcatgtaccgggagagctgcaaagggaagctgtcgaaatggctgccgtttagactctcgtcaatcgtggcatcacttgtgctcttgcacgtgtttgactcactgaagccgccgtcgcaagttgaacttgtgttctacgtgctgtccttctgtaagtctgccgtggtgccactggcatccgtctcggtgattccgtactgcctggcccaggtgctgggacaaccccacaagaaatcgctc

SEQ ID NO: 12910 - DNA, 1071 bp, Artificial Sequence
  Description of Artificial Sequence: Synthetic coding sequence
atggaggaaggaatgaacgttctgcatgacttcggaatccaatcgacccactacctgcaggttaactaccaggattcccaagactggtttatactggtgagcgttatcgctgatctccgcaacgccttttacgtgctgtttccgatctggtttcaccttcaggaggctgttggaattaagttgctgtgggtggcagtgattggagattggctcaatttggtgttcaaatggatactcttcggtcaaagaccttactggtgggtgcttgatacggattactacagtaataccagcgtgcctctcatcaaacagtttcctgtgacttgtgaaaccggtccagggtcccctagcggacatgcaatgggaaccgcaggtgtgtactacgtgatggtcacttccactttgagcatttttcaaggcaagattaaacctacgtacaggttccgctgccttaacgtcatactctggcttggattttgggcggtgcaacttaacgtgtgcctctcacgcatttatctggcagcacattttcctcatcaagtcgtggcgggtgtcctcagcgggatcgctgtcgcagaaacgttttcgcatatccactcgatatacaacgcatcacttaagaaatactttctgatcaccttttttcttttcagcttcgcaatcggcttctaccttctgctcaagggcctcggcgtcgacctgctgtggacgcttgagaaggcccagaggtggtgcgaacagcccgaatgggtccatatagataccactccatttgcatcgctgctgaagaacttgggaactctgttcggtcttgggttggcccttaactcgtcaatgtatcgggaatcgtgcaagggcaagctctccaagtggcttccattccggctctcgtcgatagtcgcctcccttgtcctgctgcatgtgttcgactctcttaaacctccttcccaggtcgagcttgtgttctacgtgctttcgttctgtaaatcagcagtcgttccccttgcaagcgtgtccgtgatcccttattgtctggcacaagtgttgggccagccacacaagaaatcactg

SEQ ID NO: 12911 - DNA, 1071 bp, Artificial Sequence; identical to SEQ ID NO: 12860
  Description of Artificial Sequence: Synthetic coding sequence

SEQ ID NO: 12912 - DNA, 1071 bp, Artificial Sequence
  Description of Artificial Sequence: Synthetic coding sequence
atggaggaaggcatgaatgtgctccatgattttgggatccagtcaacccactatctgcaggtcaactaccaagatagccaggattggtttattctcgtctccgtgatagctgatctgagaaatgcgttttacgtgctcttcccgatttggttccatctccaggaagccgtggggattaagctgctgtgggtggccgttattggggattggctgaatttggtcttcaaatggatcctgtttgggcaacgaccctactggtgggtcctggataccgactattacagtaacaccagcgttccgctgatcaagcagttccccgttacttgtgaaactggccccggatccccctccggtcacgcaatgggcactgcaggcgtctactacgtgatggtaacatctaccctgtctatcttccagggcaaaatcaagccaacctacagatttcgctgtcttaatgtcatactgtggcttgggttctgggccgtgcagttgaatgtctgcctgtccagaatttatctcgccgcgcacttccctcatcaggtggtagccggagtactatcaggaatagctgtggccgagactttctcacatattcacagtatctacaacgctagcctgaagaagtacttcctcatcacatttttcctgttttcttttgccattgggttctacctcttacttaaagggctaggagtcgaccttttgtggactctggagaaggcccagcgctggtgtgaacagcccgagtgggtacatattgataccaccccgttcgcatccctcctgaagaacctcgggaccttattcggcctcggattggccctgaattcaagtatgtacagagaatcctgtaaaggcaagctgtccaagtggctgcctttcaggctcagttcaattgtcgcatcactggtcctcctgcacgtcttcgatagtttgaagcccccctcacaggttgaactagtattctatgtattatctttttgcaagtcagctgttgtgcccctcgcgagtgtcagtgtgattccttattgtcttgcacaggtgctcggtcagcctcataagaagagtctt

SEQ ID NO: 12913 - DNA, 1071 bp, Artificial Sequence
  Description of Artificial Sequence: Synthetic coding sequence
atggaggaaggtatgaatgtgctacacgacttcggtattcaaagcactcactatctgcaggtaaattaccaggactcccaggactggttcattctggtctccgttatagcggacctgaggaacgcattctatgtgctcttcccaatatggtttcacctacaggaagccgtcggaataaagctgttatgggtggccgttatcggggactggcttaaccttgtctttaagtggattctattcgggcagcgaccctactggtgggttctggacacagattactactccaatacgtcagtcccccttatcaagcagtttcccgtaacatgtgaaactgggcctggctcacctagcgggcatgccatggggacggccggcgtgtactatgtgatggttacatcaacactgtccatctttcaaggaaagattaagccaacttaccggttcagatgtctgaacgtaattttgtggctgggcttctgggccgtgcagctgaatgtctgtttgtcccgaatatatctggcagcccatttcccccatcaagttgttgccggggtgctgtctgggatcgctgtggccgagaccttctctcatatccattccatttataatgctagcctcaagaaatatttcctaattacattcttcttgttcagtttcgcgattggcttttatctgttacttaagggcttgggcgtagatctgttatggaccctcgaaaaggcacaaaggtggtgtgaacaacctgaatgggtgcacattgacaccacaccttttgcatccttgttgaaaaacttaggaacgctatttggactaggactcgctctcaattccagcatgtatagggaaagctgtaaagggaagctgtctaaatggttaccgtttagattgtcttcaatcgtggcttcacttgtgcttttgcatgtgttcgattccttgaaacccccaagccaggtggagctcgtcttctacgtcttgtcattctgcaaaagtgcggtcgtgcccctggcatcagtatctgtgataccatactgcctcgcacaagtgttgggacagccccacaagaaatccctc

SEQ ID NO: 12914 - DNA, 1071 bp, Artificial Sequence
  Description of Artificial Sequence: Synthetic coding sequence
atggaggaaggaatgaacgtgttgcatgactttggaatacagtccacacactacctgcaggtaaactatcaggatagtcaggattggtttatactagtttccgtgatcgctgatctccggaacgctttctacgtcctgttccccatctggtttcacttgcaggaagccgtaggaatcaaattgctttgggtggcagttataggagattggctcaatcttgtgttcaaatggattctctttgggcagagaccctattggtgggtcctcgatacagattactattccaatacatcagttccactaatcaaacagtttcccgtcacatgtgaaacagggcctgggtccccttcagggcatgctatgggaactgcaggggtctattatgtaatggtaacaagtacactctctatattccaggggaagattaagcctacttataggtttcgctgccttaacgtgatcttatggctgggattctgggccgtacagctcaatgtatgcttaagtagaatctatcttgctgcccatttccctcatcaggtggtggccggggtattgtctggaatcgcagtggccgagactttttctcacatacatagtatatataatgcctccctcaaaaagtatttcctgattacatttttccttttttcattcgctatcggattttatttgttacttaaagggttgggagtggatctgctgtggacactcgaaaaagctcagcgatggtgcgaacaacctgaatgggttcatattgatacaactcccttcgcttccctcttaaaaaacctggggactttgttcgggctcgggctggctctgaactcatctatgtatcgagaatcatgtaagggaaaactctcaaagtggcttccctttagactttcttctatagttgcatctctggtactgcttcacgtttttgattcccttaaacctccttcccaggtcgaactagtgttctatgttctgagtttttgcaagtcggccgtggtgcctctggcgtccgtgtctgtgatcccttattgtctagctcaggtcctaggacagccacacaagaaatcacta

SEQ ID NO: 12915 - DNA, 1071 bp, Artificial Sequence
  Description of Artificial Sequence: Synthetic coding sequence
atggaagaaggaatgaatgttcttcacgacttcggtattcaaagcactcattatcttcaagttaactaccaagattcgcaagactggtttattttggtatcagtgattgcagacctgcggaatgctttctacgttcttttcccaatctggtttcacctccaagaggctgttggaatcaagctgctttgggttgctgtcattggagactggcttaacttagtgtttaaatggatcttatttggacaaaggccatattggtgggtcctcgacacagactactattctaatacatcagtaccattgatcaaacaattcccagtcacatgtgagacgggtccagggtccccatctggacacgcaatgggtacagcaggagtttattacgtcatggtgacttctactttgtcaatattccaaggaaagattaaaccaacttatcgtttcaggtgcctgaacgtgattctgtggcttggtttctgggctgtgcaattgaacgtatgtttatcgcgaatttacttggccgctcattttccgcaccaagttgttgctggcgtgttatcaggcatagctgtcgcagaaacattttctcacatccactctatttacaatgcttcactcaagaagtactttctgataactttctttttgttctcatttgctatcggcttttatcttttgcttaaaggcttgggagtagacctcctctggacattggaaaaggcacaaaggtggtgcgagcaaccagagtgggttcacatcgacacaacgccgttcgcttcactccttaagaatctgggaaccttgttcggactgggactcgcactcaactcgtccatgtatcgggaaagttgtaaaggcaagctttctaaatggcttccttttcgcttaagctcaattgttgcgtccctggttttgcttcatgtttttgactccctaaaacctcctagccaagtggagctggtcttctacgttttgtctttttgtaagtccgcggttgtcccactcgcttctgtaagcgtcattccatattgtctggcacaagttttgggccaaccacataagaagtctctc

SEQ ID NO: 12916 - DNA, 1071 bp, Artificial Sequence
  Description of Artificial Sequence: Synthetic coding sequence
atggaagagggaatgaacgttctccacgattttgggatccagagcacccactatttgcaggtgaactatcaggattcccaggactggttcatattggtgtccgttattgccgacctgcgtaatgcattctatgtcttgtttcccatctggttccatctgcaagaagcagtcggcattaagctgctgtgggtggctgtgatcggagattggttgaacctcgttttcaagtggatactgtttggccagcgtccttattggtgggtgcttgatacagactactactctaacacttctgtccccctgattaagcagtttcctgtcacctgtgaaaccgggccaggttctccttctgggcatgctatgggaactgctggagtctattatgtcatggtgactagcactctgtccatcttccaggggaagattaaacccacctatcgtttcagatgccttaacgttatcctgtggctgggtttctgggcagtgcagctgaacgtgtgtctgagcagaatctacctggccgctcattttccccatcaggtggtggcaggggttctgtctggcatagctgtcgccgagactttcagtcacatccactccatctataacgcctctctgaagaaatactttctcataacctttttcttgttttcattcgctatcggcttctacctgctgctcaaagggctcggagtggaccttctgtggactctggaaaaggcacaacgctggtgcgaacagccagaatgggtccacattgacaccaccccgttcgctagccttctgaagaacctgggcaccctgttcggcctcggactcgctctgaacagctctatgtatagagagagctgcaaggggaagctctctaagtggctcccctttcggttgagttctatcgttgctagcctcgttctgctgcatgtgttcgactcccttaagccaccaagtcaagtagagctggtgttttatgtcctgtcattttgtaaaagcgctgttgtccccctcgcttcagtgtccgtgatcccttattgcttggcccaagtgcttggacaacctcacaagaagagcctt

SEQ ID NO: 12917 - DNA, 1071 bp, Artificial Sequence
  Description of Artificial Sequence: Synthetic coding sequence
atggaggaagggatgaacgtactgcacgatttcggtatacaatccacacactacctgcaggtcaactaccaggattcgcaggactggtttatcttggtgagtgtgatcgccgatttgcgcaatgccttctatgttctgttccctatttggtttcacctccaagaggcagtcggtattaaacttctttgggtcgccgttataggtgactggctgaacctggtgttcaaatggatcttattcggacagaggccctactggtgggtactggacactgactattacagcaatacaagcgtgccattaatcaagcaatttcccgtgacatgcgagaccggacctgggtcaccctccggtcatgcaatgggcactgctggcgtgtattatgttatggtgaccagcaccctgagcatcttccaaggaaagattaagcctacctaccggtttcgctgtctgaatgtgattctttggctcggcttctgggctgtgcagttgaatgtttgcctctcaaggatctacttggctgcccatttcccacaccaggtcgtcgccggggtgctgagtgggatcgccgtcgccgagactttcagccatattcatagcatctacaatgccagcctgaagaaatacttcttaatcacattcttcttgttcagcttcgcaatcggtttctaccttcttctcaaagggctgggcgtggatctactttggaccctcgaaaaagctcagcggtggtgtgaacagccagagtgggtccacatcgatactacgccattcgcttctctgctcaaaaacctgggtaccctgttcggcttaggcctggctttaaacagcagcatgtaccgggaaagctgcaaaggcaagctgagcaaatggctgccatttcgcctgagcagtatcgtggcaagcctggttttgctacatgtcttcgacagcctgaaacctccaagtcaggtcgaacttgtattttatgtgctgagcttctgcaagtctgccgtggtgccactcgcgtctgtgtccgtgatcccctactgcctggctcaggtcctggggcagccccacaagaaatcactg

SEQ ID NO: 12918 - DNA, 1071 bp, Artificial Sequence
  Description of Artificial Sequence: Synthetic coding sequence
atggaagaaggtatgaacgtgctgcatgatttcggtattcagtcaactcactacctccaagtgaattaccaagacagccaggattggttcatcctcgtgagcgtcatcgcagatctgagaaacgcgttttatgtgctcttccctatttggtttcacctgcaggaggcagtcggcattaaactgctgtgggtggctgtgattggtgattggcttaacctggttttcaagtggatcctgttcggtcaaaggccctactggtgggtcctggatacggactactactcaaacactagcgtccctctgatcaaacagtttccagtcacttgtgaaaccggaccaggctcgcctagcggccatgccatgggtacggccggagtctactatgtgatggtgacctcgactttgtcgatatttcagggaaagatcaaacctacctaccgttttcgctgcctgaacgtgatactgtggcttgggttttgggcggtgcagctgaacgtgtgtctttcaagaatatacctggcagcgcactttccgcatcaagtggtcgcaggtgtgctttccggcattgccgttgccgaaacgttctcccatattcattcaatttacaacgcgtccttgaaaaagtacttccttataaccttctttttgtttagctttgcaataggattttaccttctgcttaaggggctcggcgtcgatcttctgtggactctggaaaaagctcagcgctggtgcgaacagcctgaatgggtccatattgacaccaccccatttgcaagcctgctgaagaatttggggactctgtttggacttggccttgcactgaactcgtcaatgtaccgtgaatcatgcaagggtaagttgtcaaaatggctcccgtttcggctttcatctatcgtggcatcacttgtgctgcttcatgtgtttgactcgctcaaacctccatcgcaggtcgagctggtgttctacgtcctgtcattttgcaagtcggcggtggtcccccttgcatccgtgtcagtgattccctactgtctggcccaggttctcggccaaccgcataagaagtcactc

SEQ ID NO: 12919 - DNA, 1071 bp, Artificial Sequence
  Description of Artificial Sequence: Synthetic coding sequence
atggaggagggcatgaacgtactccatgatttcggaatccagtcaacacactacctccaggtcaattatcaggattcccaggactggttcatactggtgagtgttatcgccgacttgcgaaatgcgttttatgtactgtttccaatttggttccaccttcaggaagcggtgggcataaagctcctctgggtggccgtcatcggcgactggctcaacctcgtttttaagtggatcctgtttggccaaaggccctactggtgggtgctagatactgattactactcgaacacatcagtgccactgattaagcagttccctgtgacgtgtgagaccgggcccggatcgccatcggggcacgctatgggtactgcaggcgtgtactatgtcatggtgacaagtacactctcgatattccaggggaaaattaagcctacatacaggtttagatgcttaaatgtaattctttggcttggattctgggcagtacagcttaacgtgtgtctgagccgcatataccttgctgcccacttcccccaccaggtggtggctggcgtgcttagcggtatcgccgtcgctgaaacttttagccacatccatagcatttacaatgcttccttgaaaaagtattttcttataactttttttctgttcagctttgccattggcttttacttgctgcttaagggtttaggggtggacctcctgtggactcttgagaaagcacagcgttggtgcgaacagccagagtgggtgcatatcgatacaacccctttcgcttccctgttgaagaatcttggcaccttgtttggtttggggctcgctctcaactccagcatgtacagggaatcttgtaagggcaaactgagcaaatggttgccgtttcgactcagctcaatagtggcgagcctggtgttactgcatgtgtttgactcactcaagccaccatctcaggtggagctcgtgttctacgttctgtcattttgtaaatcggcagtagttcccctggcctccgtctcggtgataccatattgcctggcccaagtcctcggacagcctcataagaaatctctc

SEQ ID NO: 12920 - DNA, 1071 bp, Artificial Sequence
  Description of Artificial Sequence: Synthetic coding sequence
atggaggagggaatgaacgttctgcatgactttggcatccagagtacacattacctgcaggtcaactaccaggactcccaggattggttcatcctggtgtctgtgattgcagacctcagaaacgctttctacgtcctgttccccatctggttccacttgcaagaggcagtgggaattaaactcctttgggtagctgtcatcggagactggctcaatctcgtgttcaagtggatcctctttggtcaacgcccctattggtgggtgctggatactgactactatagcaacacctcagtacccttgataaaacagttcccggtcacttgcgagacaggacctggctctccctctggtcatgccatgggaaccgccggtgtgtactacgtcatggtcacctccacactttccatttttcaaggaaaaatcaaacctacctaccgctttaggtgcctcaacgtcatcctgtggctgggtttttgggcggtgcaattgaatgtgtgtctgagtagaatctacctggctgctcacttccctcaccaggtggtggctggagtgctgtccggtatcgctgtagctgagaccttctcccacattcacagcatttataacgcctctctgaaaaaatacttcctgataacattttttctgttttccttcgccatcggtttttacttgctcctgaagggactgggcgtggacctcttgtggaccctggagaaggcccagcgctggtgtgagcaaccagagtgggtgcacatagacacgacgccttttgcaagcctgttgaaaaatctcggcacactgttcggcttgggcctggctctcaactccagtatgtatagggaaagctgtaaaggcaagctgtccaagtggctcccattccgcctctctagcatagtggcttccctcgtgcttctgcacgtttttgattctcttaagccaccttcccaggtggaattggtgttctatgttctgtccttctgcaagtctgcagtcgtgcctctggccagtgtatccgtgatcccttattgcttggcgcaggttctgggccaaccccacaagaaatctttg

SEQ ID NO: 12921 - DNA, 1071 bp, Artificial Sequence
  Description of Artificial Sequence: Synthetic coding sequence
atggaggagggtatgaacgtgttgcatgacttcggcattcagtccactcattacctccaggtgaactaccaggactcgcaagactggtttatcctcgtgagcgtcatcgccgatctccggaatgccttctacgtcctgttccctatctggtttcatctccaagaggcggtcggaatcaagctgctctgggtggcagtcattggcgattggctgaatttggtctttaagtggatactgtttggccagaggccgtactggtgggtccttgatactgattactacagcaatacctcagtgccgttgatcaaacaattcccagtgacgtgtgaaactggccccggcagcccgtcgggacatgctatgggcactgccggagtgtactacgtcatggtgaccagcaccctctcgatctttcagggaaagatcaagccgacctaccgcttccggtgcctgaatgtgatcctttggctcggattctgggccgtccagctcaacgtgtgcctctcgcgcatctacctggctgcccactttcctcaccaggtagtagccggagtcctgagcggtatcgccgtggccgagactttctcccacattcattcgatctacaatgcatcacttaagaagtacttcctgatcaccttcttcttgttcagcttcgccattggattctaccttctgctgaaggggctcggcgtggacctcctctggactctggagaaagcacagaggtggtgcgagcaaccagaatgggtgcatatcgatactaccccgttcgcgagcctcctgaagaacctcggaactttgtttggcctgggtctggccctcaactcgagcatgtatcgggaatcctgtaaggggaaactctcaaagtggctgcccttcagactgagctccattgtcgccagcctggtgctgctgcacgtgttcgattcactgaagcctccatcgcaggtggaacttgtgttttacgtcctctccttctgcaagagcgccgtggtgcccctggcgagcgtgtccgtgatcccgtactgcttggctcaggtgctggggcaaccacacaaaaagtcgttg

SEQ ID NO: 12922 - DNA, 1071 bp, Artificial Sequence
  Description of Artificial Sequence: Synthetic coding sequence
atggaagaaggaatgaacgtgcttcacgattttgggatccagagcactcattatctccaagtcaactatcaggacagtcaagattggtttatccttgtgtcggtgattgccgacctcagaaatgcgttctacgtccttttccctatctggtttcacctgcaggaggcggtgggcatcaaacttctttgggtggccgtgatcggggattggttgaacctcgtgttcaagtggattttgttcggccaaaggccatactggtgggtcctggacaccgactactactccaatacctcagttccgctgattaagcagtttccggtgacctgcgaaacgggaccgggatcgccatcgggtcacgccatgggcactgctggagtgtactacgtcatggtcaccagcacgctgagcatctttcagggtaaaatcaagcccacttaccggttccgctgtctgaatgtgatcctgtggctggggttctgggcagtgcaactcaacgtctgcctttcccggatctaccttgccgcacactttccccaccaggtagtggccggagtgctgtctggcatagccgtggccgaaaccttctcgcatattcattcaatctacaatgcgtcgcttaagaaatacttcctgatcacgtttttcctgttttcctttgcaatcgggttctacctcctgctcaagggattgggcgtcgacctgctctggactctggagaaggctcagagatggtgcgagcagccagaatgggtgcatatcgacactactccgttcgcatcgctgctgaagaacctcggcaccctcttcggactgggcctcgcgttgaactcctccatgtaccgcgaatcgtgtaagggcaagctgtcgaaatggttgccattccgcctttcctcgatcgtcgcctcactcgtcctcctgcacgtgttcgacagccttaagcccccgagccaggtggagctggtattctacgtgttgtcattctgcaagtccgcggtggtgcctctggcctcagtatcggttatcccttactgcctcgcccaagtgttgggtcagccgcacaagaaaagcctc

SEQ ID NO: 12923 - DNA, 1071 bp, Artificial Sequence
  Description of Artificial Sequence: Synthetic coding sequence
atggaagagggtatgaacgtcttgcacgactttggaatccagtccacgcattacctccaagtcaactaccaggattcgcaggactggttcatactggtgtcggtgattgctgatctgcggaacgcgttttacgtcctgtttccgatatggttccatctccaagaagcagtggggattaagctgctgtgggtcgccgtgataggagactggctgaaccttgtctttaagtggatacttttcggacaaagaccttactggtgggtgctcgatactgattactactccaatacctcagtgcccctgatcaagcaatttcctgtcacctgcgagactgggccaggatcaccttccgggcatgcaatgggaaccgcgggtgtgtactacgttatggtgacctctacgctctcaatattccaaggaaagattaagccaacttaccggtttcgctgcctgaacgtgatcctctggctgggtttttgggccgtgcaacttaacgtttgtctgtcccgaatctatcttgcagcacattttcctcatcaagtggtggcaggagtgctgtcgggtatagcagtggcagagacttttagccatatccactcaatttacaacgcttccctcaagaagtacttcctgattaccttcttcctcttttcattcgctattggattctatctgctcctgaaggggcttggggtggaccttctttggactcttgagaaggctcaaagatggtgtgagcagccagaatgggtccatattgatactaccccctttgcatccttgctcaagaatctgggtaccctttttgggcttggtcttgcattgaactcgtccatgtaccgtgagtcgtgtaaggggaagctgtcgaagtggcttccttttagacttagctccattgtggcgtcacttgtgctccttcatgtgtttgattcactcaagccgccatcccaggtagaactggtgttctacgtgctttccttttgtaaatcggcagtcgtgccactggcgtcagtgagcgtgattccctattgcctggcacaggtcctgggacaaccgcataagaagagcctc

SEQ ID NO: 12924 - DNA, 1071 bp, Artificial Sequence
  Description of Artificial Sequence: Synthetic coding sequence
atggaggagggcatgaacgtgctccacgacttcggaattcagagcactcattaccttcaagtcaactaccaggacagccaggactggttcattctcgtgtcagtaattgccgacctgaggaatgcattctatgtactcttccctatctggttccacctgcaggaagctgttgggattaaactgctgtgggttgccgtgatcggagactggctcaacctggtcttcaagtggattctcttcggacagcggccttactggtgggtgttagacactgattattattcgaatacctctgtacctttgataaagcagttccctgttacatgtgagactggccccggctccccatccggacacgccatggggacagcgggcgtatactacgtgatggtgaccagtaccctgtcaatatttcaggggaagattaagcccacctatcgctttagatgcttgaatgtgattttatggcttgggttttgggccgttcagctcaatgtttgcctttcccgaatttatctggctgcgcacttcccccatcaagtcgtcgccggagtgctttccgggattgctgtagcagagacattctcacacatccactccatatacaatgcttcactgaagaaatactttctgatcacgtttttcctgttctcctttgccataggcttttacctgttgctgaagggtcttggggtagatttgttgtggaccctcgaaaaggcgcagaggtggtgtgagcagcctgaatgggtacacatagataccaccccatttgctagtctgctcaagaatttaggtaccctctttgggctgggtctcgccctgaatagctccatgtacagagagtcatgtaagggcaaactctccaagtggttgccatttcggctaagctcaatagtcgcctccttggtattgctgcatgtctttgactccctgaaacccccgtcccaggtggaactcgtgttctacgttcttagcttctgtaagtctgctgtcgtccccttagccagtgtgagcgtcatcccgtattgcctggcccaggtgctaggacagccacacaaaaagagtttg

SEQ ID NO: 12925 - DNA, 1071 bp, Artificial Sequence
  Description of Artificial Sequence: Synthetic coding sequence
atggaagaaggaatgaatgtgctccatgattttggaatccagtcaacccactaccttcaggtgaattaccaggactcacaggattggttcatattggtatcggtcatcgcagatcttaggaacgcattttacgtgctctttcccatttggtttcacttgcaggaggccgtcggtataaagctgctctgggtggcggtaatcggcgattggctcaatctggttttcaaatggatactttttggacaaaggccttattggtgggtgctcgacacggactactactctaatacctccgtgccactgattaagcagttccctgtgacctgcgaaactggaccagggtccccctccgggcatgctatgggtactgcaggcgtgtattacgtgatggtgacctccactctttcgatttttcaggggaagattaagcctacctacagatttcgctgtctcaacgtgatcttgtggcttggtttttgggccgtccagcttaatgtgtgtctgtccagaatatacctcgcagcacattttccacatcaagtggtcgcaggagtgctctcgggaattgcagtggcagagacgttctcacacattcacagcatatacaatgcaagccttaagaaatacttcttgatcactttcttcctcttctcgtttgcgattggcttttaccttcttctcaagggactgggcgtggatctgctgtggactctggagaaggcccagcgctggtgtgaacagcctgaatgggtccatattgatacgaccccctttgcatcgctgttgaaaaatctgggaactctttttggcctgggtcttgcgctgaactcgagcatgtaccgtgaatcatgtaagggaaaactgtcgaaatggctcccctttcggctttcatcaattgtcgcgtcacttgtccttctgcatgtgtttgacagccttaagcccccatcgcaggttgaacttgtgttttatgttttgtcgttctgcaagagcgcagtggtgcctcttgcctccgtgtcggtgattccttactgtctcgcccaggtcctcggtcagccacacaagaagtcactc

SEQ ID NO: 12926 - DNA, 1071 bp, Artificial Sequence
  Description of Artificial Sequence: Synthetic coding sequence
atggaagagggaatgaatgtccttcatgatttcggaatacaatcgacgcattatctacaagttaactaccaagatagtcaggattggtttatccttgtgtctgtaattgcggacctccgaaacgccttctatgtacttttccctatttggttccatctgcaagaagccgtggggattaagttattgtgggttgctgtcattggagattggcttaatttagtcttcaaatggatattgttcgggcaacgaccttactggtgggtgcttgacacagactattacagcaacactagcgtgcctctgatcaaacaattccccgttacctgtgaaacagggcccggcagtccctcagggcacgcaatgggtacggccggtgtttactacgtcatggtaacatccacgcttagtattttccagggcaagatcaaaccgacttacagattccgttgtttgaacgttatactttggctcgggttttgggctgtccaactgaatgtttgtctctctcggatctatctcgccgctcacttcccccatcaagtcgttgcaggcgtgttatctggaatagcagtggcggaaacttttagccacatccatagtatatataacgctagtcttaagaagtactttctgatcaccttcttcctctttagtttcgctatcggcttctacttgttgttaaagggactgggagtggacttgctatggacgctcgagaaggctcagagatggtgtgagcagcccgaatgggtccatattgataccacgccattcgcgtctctgctaaagaatctggggactcttttcgggctgggtcttgccctcaattcgagcatgtaccgggagtcatgcaaaggtaagttatccaagtggttgccctttcgcctctcttcgatcgtggctagtcttgtcctgctccatgtattcgattcgcttaagcctcccagtcaagttgaattggtcttctatgtcctatccttttgcaagtcggccgtagtgccgctcgcttcagttagcgtcattccctactgtttggcgcaggtgctcggccagcctcataagaaatccctt

SEQ ID NO: 12927 - DNA, 1071 bp, Artificial Sequence
  Description of Artificial Sequence: Synthetic coding sequence
atggaggaaggaatgaatgttcttcacgactttggaatacagtctactcattatctccaggttaattaccaggacagtcaggactggttcatcctggtttcagtgattgctgatttaaggaatgctttctatgtgttatttcccatttggttccatctgcaggaggccgtgggcatcaaactgttatgggtagcggtaatcggtgattggctgaatctggtgtttaagtggattctgttcggacaacggccttactggtgggtcctcgacaccgactattacagcaatacaagcgtccctctaatcaagcagttccccgtcacatgcgagaccggaccaggctccccatctggacacgcgatgggtaccgccggggtgtactacgttatggtgacttcaacactcagcatcttccagggaaaaatcaagccaacttataggttccggtgtctcaatgtgattctgtggctgggattctgggcggtgcaactgaacgtgtgcctgtcgaggatctaccttgcagcacacttcccacaccaggtagtcgccggggtgctcagtgggattgctgtcgccgaaaccttcagtcatatacattctatatacaacgcctccctaaagaagtattttctcatcacctttttcttattctcgtttgctattggtttttatctgctcttgaaagggttgggggtagatttgctatggacactcgagaaggcacagcgatggtgcgagcagccagaatgggtccacatcgacacaaccccctttgcatctttgctgaaaaacctcgggacactattcggtctgggtttggccttaaactcctcaatgtatcgagaatcatgcaaagggaagctgtctaaatggcttccatttagattgtcctctatcgtggcctctttggtcctcctgcacgtgttcgattccttaaaaccaccgagccaggtggagctggttttctacgtgttgagtttctgcaaaagcgccgtggttcccctggccagcgtaagtgttattccttactgtctcgcgcaagtcttggggcaaccccacaaaaagtcactg

SEQ ID NO: 12928 - DNA, 1071 bp, Artificial Sequence
  Description of Artificial Sequence: Synthetic coding sequence
atggaagaaggcatgaatgtgctacacgattttggaatccagtcaactcattatctacaggtcaattaccaggattcccaggattggtttattctagtgagcgtcattgctgatctgaggaacgctttttacgtgctgttccctatctggttccacctgcaggaggccgtcggtatcaaactgctgtgggttgccgtcattggcgattggttgaatctggtgtttaagtggatactgttcggtcagcggccttactggtgggtcctggatactgattattacagtaatacatcagtccccctcataaaacagttccccgtaacctgcgagacaggtccaggatctccttcaggacatgccatgggcaccgccggagtgtactacgttatggtgacatccaccctgagcatattccagggtaagataaaacccacttaccgcttcaggtgcctcaacgtgatcctgtggctcggcttctgggctgtgcagctgaatgtttgtttgagtcgcatttacttagctgctcatttcccccaccaggtggtggccggggtcctgagtggcatagcagtggccgagacattcagccacatccattccatttataatgctagcctgaagaagtactttctgataaccttttttttattctccttcgcaatcggcttttatctgctactcaaaggcctgggcgttgatctcctgtggaccttagagaaggctcagcgctggtgtgagcagcctgagtgggtgcatatcgacaccacaccatttgctagtctgctgaaaaatcttggaactcttttcgggttaggcctcgcccttaatagcagtatgtaccgcgaatcatgcaaaggtaagctcagcaagtggctgccatttagattaagctctatagtggctagcctggttctcctgcatgtgttcgattctctgaagcctccatcccaagtggaactggtcttctatgtgctgtcattctgcaagagcgccgtggtccccctagcctccgttagcgtgattccatattgtctcgcccaggttcttggccagccacataaaaaaagtctg

SEQ ID NO: 12929 - DNA, 1071 bp, Artificial Sequence
  Description of Artificial Sequence: Synthetic coding sequence
atggaagaagggatgaacgtgctgcatgacttcggaatccagtctacgcactatctccaagtgaactaccaggatagccaggattggttcattctggtatccgtgatcgcggatctgcgcaatgcattctacgtgctgtttcctatctggttccatctgcaggaagcagtaggtattaagttactttgggtcgctgtgatcggagattggttgaatctggtgtttaaatggatcctgtttggacagcgtccctattggtgggtgctagacactgattattacagtaatacctcggtgcccctgattaaacagttcccagtaacctgcgagactggtcctgggagcccctccggacacgcaatgggcaccgccggggtatattatgtgatggtcacgagtaccctcagtattttccagggaaagatcaaacccacataccggttccgctgcttgaatgttatcttatggctcgggttctgggccgttcagcttaacgtctgtttgtcacggatctacctggcagcccatttccctcaccaggtcgtggcgggagtgctttctggtatcgctgtggccgaaaccttttctcacatacatagcatatataatgcctcgctcaaaaagtactttctgatcaccttctttttgttcagtttcgctatcggattctacctactattgaagggactgggagtggatctgttgtggacattagagaaagcccaaaggtggtgcgaacagcctgagtgggtgcacatagatactactcctttcgcctctctacttaagaatctgggcaccctattcggcctgggactagccttgaattcaagcatgtacagagagtcatgcaaagggaagctgagtaagtggttgccattccggttgagctccattgtcgcctctctggtgcttctgcacgtgtttgatagcttgaaacccccttcacaggtggaactggttttttatgtgctgtcgttctgcaagtccgctgtggtgcccctggcctctgtgtctgtgatcccctactgcttggcccaggtgttgggacagccccataaaaagagtcta

SEQ ID NO: 12930 - DNA, 1071 bp, Artificial Sequence
  Description of Artificial Sequence: Synthetic coding sequence
atggaggagggcatgaatgttttgcacgattttgggatccagtcgacccactatctacaggtcaactaccaagatagccaagactggttcatcttggtgtccgttattgcagaccttagaaatgcattttacgtcttatttcccatctggttccatctgcaggaggcagtcggcatcaaactcctgtgggtggccgtcataggagactggttaaatttagttttcaagtggatcttgtttggacagcggccatattggtgggtgctcgataccgactactactccaataccagcgtaccacttatcaagcagtttcctgtgacttgtgagactggcccaggttccccatccggacacgccatggggacagcgggcgtttactatgtcatggtcacttcgacgctttctatctttcagggaaagatcaagccgacgtataggtttcgttgtttaaatgtcatcttgtggctgggcttttgggcagtacaacttaatgtctgcctctcccgcatctacctggccgcccattttccacaccaagtggtggccggtgtactgtctgggattgcagtggcagagaccttcagccacatccactccatctataacgccagcctcaagaagtacttcctgataacctttttcctcttcagctttgcaattggtttctatctccttctcaaaggcttaggtgtagatctcttatggacactggaaaaagctcagcgctggtgcgagcagcccgaatgggttcacatagatacaactccttttgcctccctgttgaagaaccttggaacactgtttggcctggggctggctttgaattcgagcatgtatcgagagagctgcaagggcaagttatcaaagtggttaccattccggttgtcctcgatagttgcaagtctggtcttgctccacgtgtttgattcactaaagccaccatcccaggtggaactggtgttttacgtgctgagtttttgtaagtctgcggtggtcccactggcaagtgtttctgtaatcccgtattgcctggcccaggtgcttgggcagccccacaagaagagcctc

SEQ ID NO: 12931 - DNA, 1071 bp, Artificial Sequence
  Description of Artificial Sequence: Synthetic coding sequence
atggaggaggggatgaatgtactgcatgacttcggaattcaatctacacattacttgcaagtgaattatcaggacagtcaagattggtttatactcgttagcgtgatcgcagatctgaggaatgctttctacgtcttattcccaatctggttccatctgcaggaagccgtgggaattaagttgctctgggtcgcagtgattggcgactggctgaatctcgtattcaagtggattcttttcggacaaaggccatattggtgggttctggatacagactactactccaacacctcagtgcccctaattaagcagtttcctgttacgtgtgaaaccggaccgggaagcccaagcgggcacgctatgggcacagcaggagtttactatgtgatggtcacctctactcttagcatcttccagggaaagatcaaaccgacttatcggttccgctgtctgaacgtcatcttgtggttaggcttttgggctgttcagctgaacgtatgtctttcgaggatctatctcgcggcccatttcccacaccaagtggtggcaggagtgttgagcgggattgctgtggccgaaaccttttcacacattcattcaatttacaacgcaagcctaaaaaaatatttcctcattactttcttcctgtttagcttcgcaattggcttctacctactcctcaagggcctgggcgtggatctcctgtggactctggagaaggcacagaggtggtgcgagcagcctgagtgggtgcacatcgatactaccccttttgcctcattgctgaagaatttgggcacactttttggcttgggcctggccttgaacagctctatgtaccgcgagtcatgtaaagggaagctttccaagtggttgccattccgcctgtcaagtatcgtggcctctttggtgctgctccatgtcttcgattccctgaaaccaccctcccaggtggagttagttttctacgtcctgtcattctgcaagtccgccgtggtgccattggccagcgtgtccgtaatcccatattgtctggcgcaggtgctgggacagccccacaaaaaatctctc

SEQ ID NO: 12932 - DNA, 1071 bp, Artificial Sequence
  Description of Artificial Sequence: Synthetic coding sequence
atggaggaaggcatgaatgtgctgcatgacttcggaatacagtccacacactacctgcaggtcaactatcaagactctcaggactggtttattctggtgagcgtaatcgccgacttgagaaacgccttctacgtcctgtttcccatatggtttcacctccaagaggccgtgggaatcaagctgctgtgggtcgccgtgatcggcgattggcttaatctggtcttcaagtggattctgttcggtcagaggccctactggtgggttctggacactgattactactctaacactagtgtacccctcattaaacagtttcccgtgacctgcgaaactggccctggcagcccgagcggtcatgctatgggaaccgcaggcgtctactatgttatggtaaccagcacattgtctatcttccagggcaaaataaagccgacgtacaggttcaggtgtctcaacgtcattctttggttgggcttctgggctgtccagctgaatgtctgtctgtcccgcatttatctcgctgcacatttccctcaccaggtagtcgccggtgtcctctctggaattgccgtggccgagacttttagccatatacattcaatctataatgcttctcttaagaagtacttcctgataacattcttcctgttttcttttgcaataggtttctatctgctcctgaaaggcttgggagtagacctcctttggacgctggagaaggcacaaagatggtgcgaacaacccgaatgggttcacatcgacaccaccccattcgcctccctcttgaagaacctgggcaccctgtttggtctgggcctggcccttaattcttccatgtacagggaatcatgcaagggtaaattgtctaaatggctgccctttaggctctcctccattgtagcctccctcgtactgctccacgtttttgattcattgaagccgccctcccaggttgagcttgtgttctatgtgcttagcttctgcaagagcgctgtcgtcccacttgcctccgtgtccgtgatcccctattgcctggcgcaggttctcggacagccacataagaagtccctg

SEQ ID NO: 12933 - DNA, 1071 bp, Artificial Sequence
  Description of Artificial Sequence: Synthetic coding sequence
atggaagagggtatgaacgtcctacatgacttcgggatccagagtacccactacttgcaagttaactaccaggatagccaggattggtttatccttgtcagtgtcattgccgacttacgtaacgccttctacgtgttattccctatttggttccatcttcaggaggcggtcggtattaagttgctttgggtcgcagtgattggtgactggcttaatctggtattcaagtggatccttttcggtcagcggccatactggtgggtcctggatactgactactacagtaacacctctgtccctctcatcaaacagtttcctgttacgtgcgagacgggccccggctctcccagcggccacgctatgggcacggccggagtgtattatgtgatggttaccagcaccctgtcaattttccagggaaagattaaacccacttaccgttttagatgcctcaacgttatcctctggcttggtttctgggcggttcagctgaacgtctgtctgtcacgtatctacttggctgcacattttccgcatcaggtcgtggcgggtgttctttcgggtatcgccgtcgcggagacgttctcccacatccactccatctataatgctagccttaagaaatatttcttgatcacttttttcctattctcctttgctatcggcttctaccttctcctgaagggtctgggcgtggatctgttgtggaccctggagaaggcgcagcgctggtgcgaacagcctgagtgggtccacattgacaccacaccctttgcctcccttttgaagaaccttggcaccttgttcgggcttggcctcgcccttaattcctccatgtaccgcgaatcctgcaagggcaagctgtcgaagtggcttcctttccggctttcttcgattgtcgcttccctcgtcctgttgcatgtttttgatagcctaaagcctccttcgcaggttgagctcgtcttctacgtgttgtctttctgtaagtccgcagtggtgcctctcgctagcgtctcggttatcccctactgcctcgcccaggtgctcggtcagccccacaagaagtctctt

SEQ ID NO: 12934 - DNA, 1071 bp, Artificial Sequence
  Description of Artificial Sequence: Synthetic coding sequence
atggaggagggtatgaacgtgctgcacgatttcgggattcagtcaacccactacctgcaggtgaattatcaggattctcaggattggttcatcctggttagtgtgatcgccgacctccggaatgccttttacgtcctgttccccatttggttccacttgcaggaggccgtgggaattaaactactatgggtggcggttattggcgattggttaaatctggtgtttaagtggattttgtttggccagcggccatactggtgggtacttgataccgattactacagcaacacaagcgttccgctgatcaaacagttccccgtgacttgcgagacagggccagggagcccttccggacacgcaatgggcaccgctggggtatactatgtgatggttacctccaccctcagtatatttcagggcaaaatcaagccaacataccggttccgctgtttgaatgtgatattgtggctcgggttttgggcagtacagctgaacgtctgccttagccggatttatctggctgcccactttcctcatcaggtcgttgcaggagtcctcagcggcatcgccgtggctgagacattttctcatattcacagtatctataacgcctccctgaagaaatacttcctcatcaccttctttctgttcagctttgccatcggcttctaccttctcctcaagggactgggagtcgacctgctctggactctggagaaggcccaacggtggtgtgagcagcctgagtgggtgcatatcgatacaaccccttttgcatctctgttgaagaacctgggaactcttttcggcttaggcctcgctctcaatagtagtatgtatagggagagctgcaaaggcaagctcagcaaatggctgccatttcgtttgagtagcatcgttgcctctcttgttctgctgcacgtcttcgatagtctcaagccaccctcgcaggtggagctggtgttctacgtcctaagcttctgcaagagtgcagtggtccctcttgcctcagtatcggtcattccgtactgtttggcgcaggttttgggccagcctcataagaagagtctt

SEQ ID NO: 12935 - DNA, 1071 bp, Artificial Sequence
  Description of Artificial Sequence: Synthetic coding sequence
atggaggagggaatgaatgtcctgcatgacttcggcatccagtcgacccactatctccaagtgaactaccaagattctcaagactggtttatcttggtgtcagtgattgcagatctgcgcaatgccttctatgtgctgttccccatctggtttcacctgcaggaagccgttgggatcaagctgctgtgggtggccgtgatcggcgactggctgaatctggtgtttaaatggattctttttggccaacgcccctactggtgggtcctggatactgattactattcaaacaccagtgtgccccttataaagcagttcccagtgacctgtgaaacagggccaggcagcccctccgggcacgcgatgggcactgccggcgtgtactacgttatggtgacaagcacgctaagtatctttcagggtaaaatcaagcccacgtacaggttccgctgcctcaacgtgatcctctggctcgggttttgggcagtgcagctaaacgtgtgtctgagcaggatctatctggctgcacactttcctcatcaggtggtcgctggcgtcctcagcggaatcgccgtagccgagaccttctcccatatccactctatttataacgctagcctgaagaagtactttctgatcactttcttcttgttcagttttgcgataggattctatctgctgctcaagggacttggagtagacctgctgtggactctggagaaagctcagcggtggtgtgagcagccagagtgggtccatatcgataccaccccattcgctagtttacttaaaaacttggggacgctgtttggtctaggcttagcactgaattctagcatgtatagagagtcatgcaaaggcaagctatctaagtggctgccctttcgactgtcttctattgtcgcaagcctcgtgctgctgcatgtctttgactcgctcaagcctcctagtcaggtcgagcttgtcttctacgttctgagtttctgtaagtctgccgtggtgccactcgcctccgtgagtgtgatcccatattgcctggcccaagtcctgggccagccccataaaaagtccctg

SEQ ID NO: 12936 - DNA, 1071 bp, Artificial Sequence
  Description of Artificial Sequence: Synthetic coding sequence
atggaggaggggatgaatgtgctgcacgactttggcattcagtctactcattacctgcaggtgaactatcaagacagtcaagattggtttattttggtctctgttatagctgacctaaggaacgccttttacgtactgtttccaatctggtttcatctgcaggaagcggttggtatcaaactgctgtgggtcgctgttattggggattggctaaacttggtgtttaagtggatactgttcggtcaaaggccctattggtgggtgttagacactgactattattcaaacacgtcagtgccgcttatcaagcagttccccgtgacctgcgaaaccgggcccggttcaccgagtgggcacgctatgggcacggcaggagtctattacgtcatggtgacctctactctgagcatatttcaaggcaaaatcaaaccaacttataggtttcgctgtctgaacgtcattctttggctaggcttttgggctgttcagctgaacgtttgtctgtctagaatctatcttgcagctcacttcccacaccaagtggttgctggggtgttaagtggaatcgccgtagcggagacctttagccatatccactccatctataatgcctctctcaaaaaatacttcttgataacctttttcctattctcgttcgccatcggcttttacttactcctcaagggcctgggtgtggacttgctatggaccctagagaaagcccaacgatggtgtgaacagcccgagtgggttcatatcgacaccacaccgtttgccagtcttctcaagaacctgggtacgcttttcgggctcgggttggcactgaactcctcaatgtacagggaatcctgtaagggtaaactgagcaaatggttgccttttcgcctgtccagcatcgttgcttctctagtattgctccacgtgttcgatagtctgaaacccccaagccaggtagaattggtgttttacgttctgagtttctgcaaatcggctgttgttccactggcctctgtctctgtgataccttactgtctcgcacaggtgctgggccagccacataagaagtctctg

SEQ ID NO: 12937 - DNA, 1071 bp, Artificial Sequence
  Description of Artificial Sequence: Synthetic coding sequence
atggaagaaggcatgaatgttcttcatgattttggcattcaatctacacactatttgcaggttaattatcaagattcacaggattggtttattctggtatcagtgatcgcagatttgcgtaacgccttttacgttttgtttccgatctggtttcatttgcaggaagcagtcggcatcaaactcttgtgggtcgctgtcattggagattggctcaacctggtgtttaagtggatcctgtttggacaacgcccatactggtgggttcttgatacagattattattccaacacctctgttccgctgataaagcaatttcctgtcacttgcgaaacagggccgggcagtccgagtgggcatgcaatgggcaccgcgggtgtatactacgtcatggttacgagcacattatcgatctttcaaggcaagattaagcctacatatcgctttcgatgcttaaatgtgattttatggttaggattctgggcggtgcaattaaatgtctgtctttcaagaatttatttggcggctcacttcccgcaccaagtcgtagctggagtattatcgggtattgctgttgccgagacgtttagccatattcattctatctacaatgcctcgcttaaaaaatacttcctgattacattttttctcttttcctttgctattggtttttatcttttgctaaaaggtcttggtgttgacttattatggacacttgaaaaggctcagagatggtgtgaacagccggaatgggtgcacattgatacgacaccctttgcatctctccttaaaaatctgggtacactctttggattgggattagcgctgaattcaagcatgtatcgggaatcatgtaagggaaaattatccaaatggcttccgtttcggctatcatcaattgtagcctccttagtgctgttgcatgtatttgacagcctcaagccccctagtcaggtagaattggtcttttatgtgctttccttttgtaaatcagctgtcgttcccttggcttccgtgtccgtcattccttattgcctggcacaagttcttggtcagcctcataagaaatctttg

SEQ ID NO: 12938 - DNA, 1071 bp, Artificial Sequence
  Description of Artificial Sequence: Synthetic coding sequence
atggaagagggcatgaacgtcctccatgacttcggcatccagtcgacgcactatctccaggtgaattatcaggattcacaggattggttcatactcgtatccgtcattgccgatttgcgaaacgccttctacgttctgttccccatatggttccacctgcaggaggcagtaggtatcaagttattatgggtggcggtgatcggagactggctcaacctggtgtttaaatggatactctttggccaaagaccgtactggtgggttctggatactgattactattccaatacctctgtgcctttgattaagcagtttcccgtgacatgtgaaactggcccaggcagtcccagtgggcatgctatggggacggctggggtctactacgtgatggtcacaagcacactgagcattttccaaggaaaaataaaacccacctacaggtttagatgcttaaacgtaatcctgtggctggggttttgggctgtgcagctgaacgtgtgcctgtctcgtatctatttagccgcccactttcctcaccaggttgtggctggcgtgctatccgggattgcagtggccgagacctttagtcacatacactctatctataacgcatcacttaaaaagtatttccttatcactttcttcctgttttcttttgccattggtttttatcttttgctgaaaggattaggcgttgatttactgtggaccttggagaaagcccagagatggtgtgagcagcctgagtgggtgcacattgataccacccctttcgcttcacttttaaagaatctgggaacgctatttggactcggcctggctctgaactcgtcaatgtatcgtgaaagctgcaagggtaaattgtccaagtggctgccctttcggctcagctctattgttgcttcacttgttttgttacacgtgtttgatagcctcaagcccccgagtcaggtggagctggttttttacgtgctttctttttgtaagtccgctgtggtccccctcgcaagcgtttcagtaataccttactgccttgctcaggtcctgggacagccccataaaaaatccctt

SEQ ID NO: 12939 - DNA, 1071 bp, Artificial Sequence
  Description of Artificial Sequence: Synthetic coding sequence
atggaggagggaatgaacgttcttcatgacttcggaatccagtccacccattatcttcaggtgaactatcaggactctcaagattggtttatcctggtcagtgtcatcgccgatctcagaaatgcgttttatgtactgtttcccatctggttccatcttcaagaggcagtgggcattaagttgctttgggtcgcagtgatcggagactggctgaaccttgtctttaagtggatcctttttggtcagcgcccgtattggtgggtgctggataccgactactatagtaataccagcgttccattaatcaagcaattcccagtgacatgtgagaccggaccagggtcccctagcgggcacgccatgggcaccgccggcgtatactacgtgatggtgaccagcaccctgagtatctttcagggcaaaatcaaaccgacatatcgctttaggtgcttgaacgtcattctgtggctgggattttgggctgtgcagttaaacgtgtgcctcagcagaatctacctcgcagctcattttccacatcaggtcgtggcaggcgtgttgtcaggtattgcggtggccgagacatttagccatatccacagtatttataacgcctcgctgaagaaatatttcttgattaccttcttcctgttcagtttcgcaattggattttatttgctgttgaaaggactgggagtggatctcctatggacattggaaaaagctcagagatggtgcgagcagcctgaatgggtgcatatcgatactactccatttgcctctctgctgaaaaacctgggcacactgttcggcctgggcctggcgttaaactcaagcatgtatcgcgagtcttgcaaaggtaagcttagtaaatggctcccatttagactcagctcaattgttgcttccctggtcctgctgcacgtcttcgactctctcaagccacccagtcaggtggagctcgtgttttacgtgcttagcttctgcaagagcgccgttgtgccactcgcaagtgtctctgtcatcccctactgcttggcacaagtgcttggacagccccacaaaaaatcgctc

SEQ ID NO: 12940 - DNA, 1071 bp, Artificial Sequence
  Description of Artificial Sequence: Synthetic coding sequence
atggaggaaggaatgaatgttctgcatgatttcggaattcagtctactcactatctccaagtgaattaccaggatagccaggactggttcattctggtgtcagtgattgccgatctgcgtaatgctttctatgtgttattccccatttggttccatcttcaggaggccgtgggaatcaaactcctgtgggttgctgtaatcggtgactggttaaacctggtcttcaagtggatcctatttggccagcgcccatattggtgggtcctcgacacagattactattctaacacctccgtcccgctcattaagcagttccctgtgacttgtgagaccggccccggtagtccctcggggcacgctatgggaaccgcaggcgtttattacgtgatggtgaccagcaccctgtctatttttcagggaaagataaaacccacctaccgctttcgatgcctcaacgtgattctttggctgggcttctgggctgtacagcttaacgtgtgcctcagccgtatttacctggctgcgcactttcctcaccaagtggtggccggcgtcctctcaggaatcgcagttgccgagacgttttcccatatccattcaatttataatgcgtctcttaaaaagtatttcctgatcacattcttcctgttttcttttgccattggattttatcttttgcttaagggcttaggagtggacctgctgtggacactggaaaaggcccagcgttggtgtgaacagccggagtgggtgcatattgacacgacgccattcgcctctctcctcaaaaatctcgggactctgttcggcttaggcctggccctgaactcgtccatgtacagagagagttgtaagggaaaactgtccaagtggctccctttcagactgagctcgatcgtggccagtttagtcctcctccacgtgttcgacagtcttaagccacccagtcaggttgaactagtcttctacgtactctccttttgcaaatcagctgtagtgccacttgccagtgttagtgtgatcccatattgtttggcccaggtccttgggcagccccataaaaagtcactc

SEQ ID NO: 12941 - DNA, 1071 bp, Artificial Sequence
  Description of Artificial Sequence: Synthetic coding sequence
atggaagaaggcatgaatgtacttcacgattttggaatacagtccacacactacctgcaagtgaactatcaggatagccaagactggttcatattggtgtctgtgatcgcagacctccgaaatgctttttacgtcttgttccccatctggttccaccttcaagaggctgtagggatcaaactcctgtgggtcgcagtgattggtgattggctgaacttggtgtttaagtggatcctgttcggccaacggccgtattggtgggttcttgatactgactactacagcaacacctctgtaccgctgattaagcagtttcccgtcacctgtgaaactggccccggttccccatccggtcacgccatggggacggcaggggtgtattacgtgatggttacgtcaactttgagcattttccagggaaaaattaaacctacgtaccggttccggtgtcttaatgtgatcctttggctgggattctgggcggtacagttgaacgtgtgtctgagtaggatctaccttgctgcccatttcccgcatcaggtggttgctggcgtactctctgggatcgccgtggcggaaacattcagccacatccatagtatttataatgcctccctgaaaaagtacttcctcattaccttctttctgttctcatttgccattggcttctacctgcttctgaagggactcggcgttgacctcttgtggacgctcgagaaagcacagcggtggtgcgagcaaccagaatgggtccacatcgatacgaccccgtttgcctccttgttgaaaaacctggggactctctttggactgggactcgctttgaactcttccatgtatcgcgagagctgcaagggaaagctgagtaagtggctgcctttcagactcagtagtatcgtggcgagcctcgtcctcctccacgtcttcgactctctcaagccacctagccaagtggaattggtgttctatgtcctgtctttctgtaaatcagcagtggtgccactggcatccgtatccgttatcccgtattgtttggcccaggtccttggacagccccacaagaaatctctt

SEQ ID NO: 12942 - DNA, 1071 bp, Artificial Sequence
  Description of Artificial Sequence: Synthetic coding sequence
atggaggaaggcatgaacgtgctacacgattttggaatccagagcacacactatctccaggtaaattaccaggatagccaggattggtttatcttggtttccgtgatcgccgatctaaggaatgctttctatgttctgtttcctatctggttccacctgcaagaggccgtgggcataaagctgttgtgggtggccgtaatcggagactggttgaatttggtgttcaagtggatacttttcggacagaggccttactggtgggtgctcgacactgattattatagtaatacttctgttccactcatcaagcaatttcccgtgacatgcgaaactgggcccggtagccccagcggacatgctatgggcacagcgggagtgtattacgtaatggttacctccaccctgagtattttccagggtaagatcaagcctacttaccgattccggtgtctcaacgttattctttggttaggattttgggctgtccaactgaatgtttgcttgtctcgtatctatcttgcggctcacttccctcatcaggtcgttgctggagtgttgtccggaatagccgtggctgagacgttcagccacatccacagtatctataacgctagtctcaagaaatatttcctgattacattttttctctttagtttcgccatcgggttttacttattgctgaaagggttgggtgtggacctcttgtggactctcgaaaaggctcaacgatggtgtgagcaaccggagtgggtccacatcgatacaactccattcgcctctctgctcaaaaatttagggaccttgttcgggctgggactggctctaaacagtagtatgtatcgtgaatcatgcaaaggaaaattatctaagtggctgccttttcgtctcagtagcattgtggcatcacttgtgctcctccatgttttcgatagtctcaagcccccttcacaggtggaactggtattctacgttcttagcttctgtaagtcagccgtagtcccactagcatcagtgagcgtgattccttactgcctggctcaagttcttggccagcctcacaagaagagcttg

SEQ ID NO: 12943 - DNA, 1071 bp, Artificial Sequence
  Description of Artificial Sequence: Synthetic coding sequence
atggaggaaggaatgaacgttttacacgactttggaatccagtctacccactaccttcaagttaattatcaggacagccaggactggttcattctagtgagtgtcattgccgacctccgaaacgcgttctacgtcctgtttcctatctggtttcatttgcaagaggcagtaggcattaagttgctttgggtagccgtcataggcgactggctgaatctggtctttaaatggattctctttgggcagcgaccatattggtgggtcctggataccgattactattccaacacaagcgtgccactgattaaacaattccccgtaacctgtgagactgggcccggctctccttccggacacgcaatgggtacggcgggggtgtattacgtgatggtcacctcaactctgagtatctttcaagggaaaattaaacccacttatcgcttcagatgtctgaatgtcatcctctggttaggattctgggccgtccagctgaatgtctgtctgagccgcatctacctggcagcccacttccctcatcaggtagtcgctggtgtcctgtccggcatcgcagtagctgaaaccttctcacatatccactctatctacaatgcttccctcaaaaaatactttctgatcacgttttttctattctccttcgccatcggattttatttgcttcttaaggggctgggggttgatttgctgtggactctggaaaaggcccagaggtggtgcgagcaaccggaatgggtgcacatcgatactacaccctttgcttccctgttaaaaaacctggggacactgtttgggttgggcctggcgctgaatagcagcatgtacagagaatcgtgcaagggaaagttgtccaagtggcttccgttcagactgtcttcaatagtggccagcctggtcctgctgcatgttttcgattcactgaagccacccagccaagtggagctggttttttacgtgctatcattttgcaagagcgctgtggtgcctttggcatcggttagtgttatcccgtactgcctcgcccaggtgttaggacagccacacaaaaaatctctc

SEQ ID NO: 12944 - DNA, 1071 bp, Artificial Sequence
  Description of Artificial Sequence: Synthetic coding sequence
atggaggaagggatgaacgtcctgcatgatttcggtatacagtcaacacactacctccaagtgaattatcaagatagtcaggactggttcatcttggtttcagtgatcgctgacctccgcaatgccttttacgtgctgtttcccatttggtttcacctgcaggaggcagtggggataaagctgctgtgggtggctgtcatcggcgattggctcaacttagtgtttaagtggatactgtttgggcagaggccctactggtgggttctggacacagattactacagtaatacaagtgtgccacttatcaagcagttccctgtaacttgcgaaaccggccctggcagccctagcggtcacgctatggggactgccggcgtctattacgtgatggtgacctccaccctgtctatcttccagggtaaaatcaaaccaacctaccggtttcgttgccttaatgttattctgtggttgggattttgggcagtgcaattaaacgtatgtctgtcaagaatttacctggccgcacatttcccccatcaggtggttgccggtgtactgtcagggattgccgtggctgagacctttagtcacatacatagtatatataatgcaagcttaaaaaaatattttttaatcacattcttcctgttctcttttgccataggcttctatctgctgctcaagggcctcggggtggatctactgtggacactggaaaaagcccaacggtggtgtgaacaacctgagtgggttcacatagacaccactccattcgcttctctgctgaagaatctgggcaccctcttcggactgggcctggccctgaacagttctatgtaccgcgagtcctgcaagggcaagctctcaaaatggctgccatttcggttaagctctattgtggcttccctggtcctgttgcacgtgttcgatagcctgaaaccaccatctcaggtcgagctagtgttctatgtgctgtccttttgtaagtccgccgtcgtgcctttagctagtgtgagtgttatcccatattgcctggctcaggtgttaggccagccccataaaaaaagcctg

SEQ ID NO: 12945 - DNA, 1071 bp, Artificial Sequence
  Description of Artificial Sequence: Synthetic coding sequence
atggaggaggggatgaacgtcctgcatgattttgggatccagagtactcattacctccaggttaattaccaggattcccaggactggttcatattggtgtctgtgattgctgacctgcggaatgccttctatgttctcttccccatctggtttcacctgcaggaggctgttggaattaagctgttgtgggttgccgtcatcggcgattggcttaacctcgtgtttaaatggatccttttcggacagcgcccttattggtgggtactcgacaccgattactactccaacacctcagttcctttaatcaagcaatttccagtgacttgtgaaaccggtccaggcagtcctagtgggcacgcgatgggtaccgcaggcgtgtactacgtcatggtgacctctaccctgtccattttccaggggaagattaagcccacatataggttccgctgtttgaacgtgattttatggctggggttttgggcagttcagcttaacgtctgtttgagccgcatatatctcgccgcccactttccccaccaagtggtggctggcgtcctctctggtattgctgtggctgagactttcagccatatccattctatttataatgcgtctctcaagaagtacttccttataaccttcttcctgttctcattcgcaatcggcttctatttgttactcaagggattaggggtagaccttctgtggaccctggagaaggcccagcggtggtgcgaacagcctgagtgggttcacatcgatacgaccccattcgcatcactgctgaagaatctgggtacccttttcgggcttggattggctctcaactcctctatgtaccgtgaaagctgtaaaggtaaattatccaagtggctgccattcaggctgtccagcatagttgctagtttggtgttgcttcacgtgttcgatagcctcaagccacctagccaggtggagctggttttctatgttttgagcttctgtaagagtgcggtggttcctctagcctctgttagcgtcattccttattgcctggcgcaagtactgggacagcctcacaagaaaagtctt

SEQ ID NO: 12946 - DNA, 1071 bp, Artificial Sequence
  Description of Artificial Sequence: Synthetic coding sequence
atggaggagggaatgaacgtactgcacgacttcggaattcagtccacccactatcttcaagtcaattatcaggatagccaggattggttcatcttagtgtctgtgattgcggacctcagaaatgctttttatgtacttttccccatatggttccatctacaggaggctgttggcatcaaactgctgtgggtggccgtcatcggggactggctgaacttggtgtttaaatggatccttttcggacaaagaccctactggtgggtactggatactgattactactctaatacatctgtgccgctgatcaagcaattcccggtgacctgtgaaactgggcccggctcaccgtcaggccatgccatgggcaccgcaggcgtatattatgtgatggtgacgagtactctctcgatatttcaaggcaagataaagccaacttatagatttagatgtctcaacgtaatactgtggctcgggttttgggccgttcagctgaacgtatgtctgagccgaatttatctagccgcgcacttcccacaccaggtagttgccggggttttgagtgggatcgcagtggccgaaacattttctcacattcacagcatctacaatgctagcctcaagaagtactttctgatcacgttttttctattctcttttgccatcggattttatctgttgctcaaagggctaggggtggatttgctctggacactggagaaggctcagcgttggtgcgagcagcctgagtgggtacatattgataccaccccattcgcctctctactcaagaacctggggaccttattcggcctgggactggcgctcaatagctcgatgtaccgagaatcatgtaagggaaagctgtctaagtggttgcctttccgactaagttcaattgtcgccagcctggtcctgcttcacgtcttcgactctcttaagcccccatctcaagttgagttggtcttctacgtacttagcttttgtaagtccgctgtcgtccccctggccagtgtcagcgttattccctactgcctggctcaggtgctgggccagccccataagaagtctctg

SEQ ID NO: 12947 - DNA, 1071 bp, Artificial Sequence
  Description of Artificial Sequence: Synthetic coding sequence
atggaagagggaatgaatgttttacatgattttggaattcaatcaacacattatttacaagttaactatcaagattcacaagattggttcattttagtttctgttattgctgacttacgtaatgcattttatgtcctttttccaatatggtttcatttacaagaagcagttggaatcaaattactttgggtcgctgttataggagattggttaaacttagtttttaaatggatattatttggtcaaagaccatattggtgggttttagatacagattattattctaatacatcagtaccattaattaaacaatttcctgttacttgtgaaacaggaccaggatcaccttctggacatgctatgggtactgctggagtttactatgttatggtaacctctactttatcaatttttcaaggtaaaattaaaccaacttacagatttagatgtcttaatgttattctttggttaggattttgggcagttcaacttaatgtatgtttaagtagaatttatttggctgctcattttccacatcaggttgttgctggagtactttctggtattgctgtagcagaaaccttttctcatatccattcaatttataatgcttcactcaaaaagtattttttaattactttttttttattctcttttgcaattggattttatcttttattaaagggattaggggttgacttattatggactttagaaaaagctcaaagatggtgtgagcaaccagaatgggttcatattgatactactccatttgcatctcttttaaaaaatttagggacattgtttggattaggacttgctttaaatagtagtatgtatagagaatcttgtaaaggaaaattatctaaatggttaccttttcgtttatcatcaattgtagcatctttagttttattacatgtttttgattctttaaaaccaccatcacaagttgaattagtattttatgttttaagtttttgtaaatctgcagttgttccattagcttctgtttctgttattccatattgtcttgcacaggtcttaggtcaacctcataagaaatctctt

SEQ ID NO: 12948 - DNA, 1071 bp, Artificial Sequence
  Description of Artificial Sequence: Synthetic coding sequence
atggaagaaggcatgaatgtcctacatgattttggaatccaaagcacacattacttgcaggtaaactatcaagattcacaggattggttcatccttgtgtctgttatagcagatctgcggaacgctttctacgtgttgtttcctatctggttccatctgcaggaggccgttggaatcaaactgttgtgggtcgcagtgataggagattggcttaaccttgtcttcaaatggatccttttcggccagcggccttattggtgggtgctggacactgattactattctaacacttccgtgccgcttattaagcagtttccagtaacttgcgagacaggacccggcagcccatcagggcatgctatgggtacagccggtgtctactacgttatggtcacatctacactgagcatcttccaaggcaagataaaacctacatatagattccgttgcctcaacgtgattctgtggctcgggttctgggccgtacaactgaatgtctgcctgagccggatctaccttgccgcgcatttcccacaccaagttgttgctggagtgctgtccggaatagccgttgccgagaccttttcccatatacattccatttacaacgccagcctgaagaagtacttcttgataaccttcttcttattcagctttgcaataggattttacttgctgctgaaaggccttggagtggacctcctatggacactagagaaggcccagcgctggtgcgaacagcctgaatgggtccacattgacactacaccgttcgcaagcttactgaagaacctgggcaccctctttggactggggctcgccctaaacagcagtatgtaccgcgagtcgtgcaaaggaaaactctccaaatggctcccgtttagattgtcttcgattgtggccagtctcgtgctgcttcatgtgttcgacagtctaaaaccgcccagccaggtggagttggtattctacgtactcagcttttgcaagtctgctgtggtgccccttgcgtcggtatctgttattccctactgcctggcccaggtcctgggacaaccccacaaaaagtcactc

SEQ ID NO: 12949 - DNA, 1071 bp, Artificial Sequence
  Description of Artificial Sequence: Synthetic coding sequence
atggaggaagggatgaacgtgctccacgatttcgggatacagagtactcactacctgcaggtgaattatcaggatagtcaggattggtttattcttgtctcagtgattgcggatcttaggaacgctttctatgtcttattcccaatatggttccatttacaggaagctgtaggaatcaaactgctctgggtggccgtgattggagactggcttaacctagtgtttaaatggattctgttcgggcagagaccttattggtgggtcctggatacagactactactcaaacacttcggtgcccctgatcaaacagttcccagtaacttgtgaaactggacctggaagtccatctggacacgccatggggactgctggagtatattatgtgatggtgacttccacactgtccatctttcagggaaagattaagccaacttatcggttcagatgtctcaatgtgattctttggctcggattctgggccgttcagctgaacgtgtgtctgtcaaggatttatttagctgcccattttccacatcaggtcgtcgccggagttttgtcagggatcgccgtcgccgaaacattttctcatattcacagtatttataatgccagtctcaaaaaatattttctaatcacattttttttgttctcatttgctataggattttatcttctccttaaagggctcggagtggatctgctgtggacacttgagaaggctcagcggtggtgcgaacagcccgaatgggtacacattgatacaacaccattcgcttctctgttaaaaaatctcgggactctttttggattaggacttgctctgaattcttccatgtaccgcgaatcctgcaagggaaaattgtccaaatggctcccctttcgactctcttctatagtcgcttcactggtgctccttcatgtctttgactcccttaagcctccttcccaggtagaactcgtgttttacgtcctaagtttctgcaaatccgctgtggtacctctcgcttcggtttctgtcatcccttattgcttagcccaggttctagggcagccccataaaaaatcttta

SEQ ID NO: 12950 - DNA, 1071 bp, Artificial Sequence
  Description of Artificial Sequence: Synthetic coding sequence
atggaagagggcatgaacgtcctccacgatttcgggatacagagcacccattatcttcaagtcaactatcaggatagtcaagactggttcatcctggtttccgtgatagcagatctccgaaacgctttctacgtcctgttccccatttggttccacctgcaagaggcagttggtattaaacttctctgggtggccgtcatcggagactggctgaacctggtgtttaagtggatactcttcggacagaggccatactggtgggtgctcgacaccgactattattccaacacaagtgttcccctgatcaaacagttccctgtcacctgtgagacggggcctggttccccttcaggccacgccatgggcacagccggtgtgtattatgttatggtgacatctaccttgtccatatttcagggaaaaatcaagcctacctatcggtttcgctgcctcaatgtgattctctggctggggttctgggcagttcagcttaatgtttgtctttctcgcatttatctggccgcccacttcccacaccaggtggtcgccggagttctctctgggattgccgtcgctgaaaccttttcccatatccactctatctataatgctagcttgaaaaaatatttcctcatcaccttcttcctgttctcattcgccattggattttacctcctgctgaaaggcctcggcgttgacctcctgtggaccttggagaaggcccagcggtggtgcgagcagccagaatgggttcacattgacacaaccccttttgcttctctgctcaagaacctgggtaccctgtttggactggggctggcgctgaactcttctatgtacagggagtcctgcaaggggaaattgtccaaatggctgccgttcagactgtccagtatcgtggcttctctcgtcctgttgcatgtgttcgatagtctcaagcccccaagtcaggttgaacttgtattttatgtgcttagcttctgtaagtctgccgtggttcccttggctagcgtaagcgttatcccgtactgtctggcccaggtgctcgggcaacctcacaagaagtcactc

SEQ ID NO: 12951 - DNA, 1071 bp, Artificial Sequence
  Description of Artificial Sequence: Synthetic coding sequence
atggaagagggcatgaatgtactgcacgattttggcattcagtctacccactacctgcaggttaactaccaagatagccaggattggttcattttggtgtccgttattgcggacctgcgcaatgctttttatgtccttttcccaatctggttccatctgcaggaggcggtggggatcaaacttctgtgggtggccgtgataggagactggctgaacctggtgtttaagtggatcctcttcggtcagaggccttattggtgggtgctggacaccgactattactctaatacctcagtgcctcttataaagcagtttccggttacttgtgagaccggaccaggttctccctcgggccatgcgatgggaacggccggtgtgtactatgtcatggtcacaagcactctgtcaatcttccaaggcaagatcaagcccacttacagattccgctgtctcaacgtcatcttgtggctgggattttgggctgttcagttaaacgtgtgcctgtctaggatctaccttgctgcacacttcccgcatcaagtggtggccggcgtactctctgggattgccgtggccgaaaccttttcacatatccactcaatctataacgctagcctgaagaaatactttcttattacctttttccttttttccttcgccatcggtttttacttgttactaaaaggcctgggtgtggacctcctgtggaccctggaaaaggcacagaggtggtgcgagcagccggaatgggtccatatcgataccactccgtttgcttcattgctgaagaatttgggtacactgtttggactcgggcttgcattgaacagctcaatgtatcgggagtcttgtaaagggaaactttccaaatggctgccatttaggctctcgtccattgtggctagcttggtgttgctgcacgttttcgattctctgaaaccgccgtcgcaggtagagttagtcttttacgtgttgtcattttgcaagagcgctgtggttccactcgcaagtgtgagtgtcatcccctactgcttggctcaggtgctgggccagccccataagaagagcttg

SEQ ID NO: 12952 - DNA, 1071 bp, Artificial Sequence
  Description of Artificial Sequence: Synthetic coding sequence
atggaggaaggaatgaacgtcttgcacgacttcggaattcagagcactcactatctgcaagtgaattatcaggactctcaggattggttcatcctggtgtctgtgatagctgatttgcggaatgctttttacgtgttatttcccatctggttccacttgcaggaagcagtgggcattaagttactctgggtcgctgtgattggggattggctcaacctcgtttttaaatggatcttattcggacagcgcccctattggtgggtgctagataccgattattacagcaatacctcagtacctttgatcaaacagttcccagtgacgtgcgaaaccggtcccgggtcaccaagcggacatgccatgggcacagccggtgtgtactatgtgatggttactagcactttatctatcttccagggcaagatcaagccaacctataggtttagatgtcttaacgtcattctgtggctgggcttttgggcggttcagctgaacgtatgtctgtcaagaatttatctcgccgcccacttcccacatcaggtcgtcgctggcgtgctttccggtattgctgtagcagagaccttcagccacatacacagtatttacaacgcgtccttgaaaaagtatttcctgatcacgttttttctgtttagttttgccataggtttttaccttttgctgaaggggcttggggttgacctgctctggacactggaaaaagcccagaggtggtgtgagcagcctgaatgggtgcacatcgacaccacaccgttcgcgagcctcctcaagaacctaggaactttgttcggactgggcctggctctcaacagctcaatgtaccgagaatcatgcaagggcaagctgtctaagtggctcccgtttcgactgtcgtctattgtcgccagcctggtcttgctccacgttttcgattctttgaagcccccctcacaggtggagttggtgttttacgtactcagcttttgtaagagcgctgtggtccccctcgcttccgtgagtgtaataccctattgcctggcgcaggtcttgggacagcctcataagaaatctcta

SEQ ID NO: 12953 - DNA, 1071 bp, Artificial Sequence
  Description of Artificial Sequence: Synthetic coding sequence
atggaagaaggcatgaatgtgctacacgacttcggaattcagtctacccactatttgcaggttaactatcaggactctcaggactggtttatccttgtgtctgttattgctgacctgcggaacgccttctatgtcttgttcccgatctggttccacttgcaggaagccgttgggatcaagctactgtgggtggcagtgattggcgactggctgaacttggtgttcaagtggatcttgtttggccagcgaccgtattggtgggtgctggacaccgactactatagtaataccagtgtcccacttatcaagcagttcccggttacctgtgagacagggcctggaagcccgagcggccatgccatgggaactgctggtgtttactacgtgatggtaacatccacactgtcgatcttccagggcaaaataaagccaacataccgcttcagatgcctgaacgtcattctgtggttgggcttctgggctgttcagcttaatgtttgcttgtctaggatctacctggcggcacacttccctcaccaggtggttgcaggcgttttgtcaggtatagccgtggctgaaactttctctcacattcatagtatttataacgcctctctcaagaagtatttcttgatcaccttcttcctgttcagtttcgctatcgggttctacctccttcttaaaggactcggtgtggacctgctttggacactggagaaggcccagaggtggtgtgagcagcctgagtgggtccacatcgacaccacgccattcgcctctctgttaaagaatctgggcaccttatttgggctcggactggccctgaactcctccatgtaccgcgagtcatgtaagggaaagctttccaaatggctgccttttcggctgagttccattgtggcaagtcttgttcttctgcacgtgtttgactccctgaaaccgcccagtcaggtggaactcgttttctacgtcctgtcattctgcaagtccgccgtcgttcctctcgctagcgtctcagtgatcccctactgcctggcccaagtcctcggccagccgcataagaagagtttg

SEQ ID NO: 12954 - DNA, 1071 bp, Artificial Sequence
  Description of Artificial Sequence: Synthetic coding sequence
atggaagaagggatgaacgtccttcatgattttggaatccagtctacacactacctgcaggtaaattatcaagattctcaggattggtttatcctggtgtctgtgatagcagatctccggaacgctttttatgtcttgtttcccatatggttccacctccaggaggccgtggggatcaaacttctttgggtggcggtgataggggattggcttaacttggtgtttaaatggattctctttggacagcggccctattggtgggtactcgatacagattattactccaacacatcagtgccactcatcaaacagttccccgtaacttgcgaaactgggccaggatctccttccggacacgctatgggaacagccggggtgtattatgttatggttacatcaactctatccatcttccaggggaagataaaaccgacatataggtttaggtgtttaaacgtgatactctggctcgggttctgggccgtgcagctgaacgtatgcctctccagaatatacctcgctgcccactttccccaccaggtggttgccggagtgctgtctggaatcgcagttgctgagactttctcacatatccattctatctataatgcctcccttaaaaagtattttcttatcacgtttttcctgttcagttttgccataggattctatcttctcctcaaggggttaggggtagatctgctgtggacactcgaaaaagctcagcggtggtgcgagcagcctgaatgggtacacatcgatacgactcccttcgcctcacttctgaaaaacctggggacactctttggacttggactcgccctgaattcatccatgtaccgggaatcttgcaaaggaaaactctcgaaatggctaccattccggctgtcttctatagtcgcttcccttgtgctgctccacgtattcgatagtctgaaacccccttctcaggttgaactagtcttctatgttttgtccttctgcaaaagtgctgttgtccccttggcttctgtttctgtaataccatattgcctcgcccaggtccttggacagccccacaagaaatccctc

SEQ ID NO: 12955 - DNA, 1071 bp, Artificial Sequence
  Description of Artificial Sequence: Synthetic coding sequence
atggaggaagggatgaacgtccttcatgatttcgggatccaatctacccactacctgcaggtaaactaccaagattctcaggactggtttattctggtatcggttatcgcagacctcaggaacgcattttacgtgctgtttcccatttggttccaccttcaggaggctgttggaatcaagctactctgggttgccgtgattggagactggctaaatctagtttttaagtggatcttatttggccagcgaccttactggtgggtactggacacggactattattctaatacgtccgtccccttaatcaagcaattccccgtgacatgcgagacaggccccgggagcccatcaggacacgccatgggtaccgcgggcgtatattatgtcatggtcaccagtacactgagtatattccagggcaagattaagccgacctaccgatttcgctgtttgaacgttatactgtggctcgggttctgggccgtccagctaaacgtgtgcctcagccgcatctatttggcagctcacttcccgcatcaggtagtcgctggggtcttatctggcatcgctgtggccgaaacgttctctcacatccactcaatatacaatgcttccttgaagaaatactttctgatcacattctttttattttcctttgccatcggcttctacttgcttctgaaaggtctgggggtcgacctgttgtggacgctcgagaaggcacagcgttggtgtgagcagccagaatgggtccacattgatactacacccttcgcctctctattgaagaatctcggaaccctgttcggcctcggacttgcactcaatagctcaatgtaccgagagagctgcaaggggaaactgagcaaatggctccccttccggctttcctccatagttgcctcactggtactgctgcatgtttttgactcactgaaacctccctcccaggtcgaattagttttctacgtgctctcattctgcaagtcggctgtggtgccgctggcgtcggtgtccgttattccatattgcctggcccaggtgctcggccagccccacaaaaaatcatta

SEQ ID NO: 12956 - DNA, 1071 bp, Artificial Sequence
  Description of Artificial Sequence: Synthetic coding sequence
atggaagagggtatgaacgttctgcacgatttcggtattcagtcgacgcactatctccaagtcaattatcaggatagccaggactggttcatcttggtctcggttattgcggatttgaggaatgccttctacgtgctattcccaatctggttccatctgcaggaagcggtcggaataaagttgctctgggtggccgtgattggcgattggttgaatctcgtgttcaagtggatactgttcggacagagaccttattggtgggttttagacacagactattactctaacacgagtgttccgctgataaagcaattcccagtgacttgcgaaaccggcccgggcagtccctctggccacgccatgggcacggcaggagtgtactacgtgatggtgaccagtacgctgtccattttccagggaaaaataaagcccacctatcggttccgctgcctaaatgtgatcctgtggctcggcttttgggccgttcagttaaacgtctgcctgagcaggatctacttggctgctcacttcccccatcaggtggtggctggcgtcttgagcggtatcgcagtggccgagacattttcccacatccattcgatttacaatgcgtcactgaagaagtattttttgattacgttctttctcttttcgtttgccataggtttttacttgcttctcaagggactgggcgtggatctactgtggacgttagaaaaggcgcagcgatggtgtgagcagcccgagtgggttcatattgacacaaccccgtttgcgagtttgctgaagaatctggggacactcttcggacttggccttgccttgaacagtagcatgtaccgggaatcgtgtaagggcaagttgtccaaatggttgccgtttagactgagctcaattgtcgcctccctcgttctgctacacgtgttcgacagtctcaagcctccgtcccaagtcgaactggtcttctacgtgctaagcttttgtaaatccgcggtggtcccgttggcctcagtgtcggtcatcccgtactgcttggcccaagtgctaggccaaccccataagaaatccctc

SEQ ID NO: 12957 - DNA, 1071 bp, Artificial Sequence
  Description of Artificial Sequence: Synthetic coding sequence
atggaggagggtatgaacgtgctccatgatttcggaattcaatccactcactatctgcaggtgaactaccaggattcccaggactggttcatcttggtgagcgtgatcgcggacctgaggaacgcattttatgttcttttccctatctggttccatttgcaagaggccgtcggtattaagttgctctgggtcgcggtcatcggagactggctgaacttggtctttaagtggatcctcttcggacagcggccatactggtgggtgctggacactgattactactcgaatacttccgtgccgcttatcaagcagttcccagtcacctgcgaaactggacccggctcgccatcgggacacgcgatgggaaccgccggagtctactacgtgatggtgacctcgaccctgtcaatctttcaaggtaaaatcaagccgacgtaccgctttagatgccttaatgtcatcctctggctgggcttttgggctgtgcagttgaacgtgtgtctgtcacgcatctacctggccgcccatttcccacaccaagtcgtggccggggtgctgagcggcattgcggtcgctgaaaccttcagccacatccactcaatctacaacgcaagcctgaaaaagtacttcctcatcacgttctttctgttttccttcgctattggattctacctgctccttaagggcctgggcgtggatctcctgtggaccctggagaaggcacagagatggtgcgaacaacccgagtgggttcatatcgacaccactccgttcgcctccctcctgaagaatctggggactctcttcggcctcggactcgcgctgaatagctcgatgtaccgggaaagctgcaagggaaagctctcgaaatggctgccgttccgcctgtcctcgatcgtggccagtctggtgctgctccacgtgttcgactcactgaagcctccgtctcaggtggaactggtgttctacgtgctgtcattctgcaaatccgccgtggttccgttggcatcggtgtccgtcatcccttactgtcttgctcaggtgctcgggcaaccgcacaaaaagagcctg

SEQ ID NO: 12958 - DNA, 1071 bp, Artificial Sequence
  Description of Artificial Sequence: Synthetic coding sequence
atggaggagggcatgaacgtcctccatgattttggcattcaatccactcactatttgcaggtgaactaccaagatagtcaagactggtttatcctggtttctgtcattgccgatctgcgcaacgccttctatgtgctgttcccgatttggttccacctgcaggaagcggtcggcatcaagctgctgtgggttgctgtgattggcgactggctgaacctcgtgtttaaatggattctctttgggcagcgaccgtactggtgggtcctggacaccgattactacagcaacaccagcgttcctctgatcaagcagtttccagtgacgtgcgaaaccggccctggaagtccaagcggtcatgcaatgggcaccgctggcgtatattatgttatggttaccagcactctgtccattttccagggcaagattaaaccgacctatcgttttcggtgtcttaatgtgatcctgtggctgggcttctgggctgtgcaactgaacgtgtgtctgagccggatttatctagcagcccattttccgcatcaggtagtggcaggtgttctcagcggtatagcagttgcagaaacctttagccacattcactcaatctataatgcgagcctgaaaaagtacttcctgataaccttcttcttatttagctttgcaatcggtttttatctgttgttgaagggactgggtgtcgacctgctgtggaccctagagaaggcccaacgttggtgtgagcaaccagagtgggtccacatcgatactactccatttgcaagcctgctgaagaatctggggactctgttcggactaggcctggctctgaacagcagcatgtaccgggagagctgcaagggcaaactctcaaagtggctgccttttagattgtccagcatcgtggcctctctggtactgctccacgtgtttgacagcttgaagccgccgagccaggttgaacttgtgttctatgtgctgagcttttgcaaaagcgcggttgtccctctggctagcgtttccgttatcccgtactgtctcgcccaggttctgggtcagccacacaaaaaaagcctg

SEQ ID NO: 12959 - DNA, 1071 bp, Artificial Sequence
  Description of Artificial Sequence: Synthetic coding sequence
atggaagaagggatgaacgtgcttcacgactttgggatccagtccacccattacctccaggtgaactaccaggactcgcaggactggttcattctggtctctgtaatcgcggatctgaggaacgcgttctatgtgctgtttccgatctggttccatctgcaagaggccgtcgggatcaaactgctttgggtggctgtgatcggtgattggctgaatctcgtgttcaaatggatactgtttgggcaacggccatactggtgggttttggacactgattactattccaatactagtgttcctctaatcaaacagttcccagtaacttgcgagaccgggccagggtccccaagcggccacgccatggggactgcaggcgtctactatgtgatggttactagcactttgtctattttccagggcaaaatcaaaccgacatatagatttaggtgcctgaatgtgatactgtggctggggttctgggcagtgcagctgaacgtgtgcctatcccggatttacctggccgctcatttcccacaccaggttgtcgcaggcgtcctgtccggtatcgcggtggccgagactttctctcacatccactcgatctataacgcatccctcaagaagtattttctgatcacgtttttcttgttctcattcgccatcgggttttatctgctgctgaaaggcttaggggtggacctcctctggactttggagaaggctcagcgatggtgtgaacagcccgaatgggtgcacatcgacaccaccccctttgcaagcctgctgaagaacctgggtaccctattcggactgggcttagccttgaatagtagcatgtatagagaatcgtgcaagggcaaattgtctaagtggctgccattccgcttgagctctattgtggcatcactagtactgttgcacgtctttgatagcctcaagcccccaagtcaggtcgagcttgtattctatgtcctgtctttctgcaaatccgcagtcgtccccctcgctagtgtgtccgtcatcccttattgcctggcccaggtcctcggtcaaccccataagaagtctttg

SEQ ID NO: 12960 - DNA, 1071 bp, Artificial Sequence
  Description of Artificial Sequence: Synthetic coding sequence
atggaggaggggatgaatgtgctgcacgattttggaattcaatctacgcactacttgcaggtgaactaccaggactctcaggactggttcatcctggtctccgtgatcgcggatctgcgcaacgccttttacgtcctcttcccgatctggtttcacctccaagaagccgtgggcataaagctgctgtgggtcgccgttatcggggattggctgaatctcgtgtttaagtggattttgttcggccagcgcccttattggtgggttctggataccgattactattctaacacaagtgtccccctgatcaaacagttccctgtcacatgcgagacaggcccgggctcccccagtggacacgccatgggtaccgccggagtttactatgtgatggtgacctccaccctctctatctttcaaggaaagataaaacccacctacaggttccgctgtctgaatgtgatactttggctgggtttctgggctgttcagctcaatgtgtgcctgtcacggatttatttagccgcgcacttcccgcatcaggttgtggccggagtgttgtccggcatcgctgtggcagagactttttcacacattcactctatttacaacgcctccctgaaaaaatatttcctcatcaccttctttctctttagtttcgcaattgggttttacctgctgctgaaggggctgggcgtggacctcctgtggacactcgaaaaagcacagaggtggtgtgaacagcctgaatgggtacatattgacaccacacctttcgccagtttattgaaaaatctgggcacactgttcgggttgggcctggctttgaacagtagcatgtacagagagagctgtaaggggaagttgagtaaatggctccccttccgcctgagtagcatagtagcatctcttgtgctgctgcatgtgtttgatagcctcaagccgcccagccaggttgaacttgtattctacgtgctctctttttgcaagagtgcggtggtgccactggcatctgtctccgtgatcccctactgcctggctcaggtactcggacagcctcacaaaaagtcactt

SEQ ID NO: 12961 - DNA, 1071 bp, Artificial Sequence
  Description of Artificial Sequence: Synthetic coding sequence
atggaagaggggatgaatgtgttacatgattttggcatacagtcaacccattacctccaagttaattatcaggatagtcaggattggtttatcctagtaagtgttatcgccgatttgcgaaacgctttctatgtgctgtttccgatctggtttcacctgcaggaagctgttgggatcaagctcctgtgggtggcagtaattggcgactggctaaatttggtattcaagtggatactcttcggccagaggccttattggtgggttcttgacacagactattactccaacacgagcgttccgctgattaagcagttccctgtgacgtgcgagaccggccctgggtcccccagcgggcacgccatgggaacagccggagtatactacgtaatggtcacaagtaccctgtctatcttccagggcaaaatcaagcctacatacaggtttcggtgcctgaacgttatcctgtggctggggttctgggccgtacagctcaacgtgtgtctgtcccgcatctatctggcggcacacttcccacatcaggtcgtcgcgggcgttttaagtggtatcgcagtggctgagaccttctcccacatccactctatttacaacgcttctctcaaaaagtactttctgatcaccttctttctattcagcttcgcgatcggcttttacctcctcctgaaaggcctgggcgtggacctgctctggactctcgagaaggcgcaacgttggtgcgagcagcccgagtgggtccatattgataccaccccatttgcttccctgcttaaaaacctgggaactctcttcggactgggtctggcactcaattcctctatgtaccgagaatcttgcaaaggaaaactctcaaaatggctcccgtttagactgtcctccatcgttgccagtctggttctcttacatgtctttgatagcctgaaacctccctcgcaggtcgaactggttttctatgttttgagcttttgcaaatcggccgtggtgcccctggcatctgtcagcgttatcccctattgtctcgcccaggtcttgggacaacctcacaaaaagagtctg

SEQ ID NO: 12962 - DNA, 1071 bp, Artificial Sequence
  Description of Artificial Sequence: Synthetic coding sequence
atggaagaaggtatgaatgttctacatgattttggtatacaatcgacgcattatttacaagtaaattatcaagattcgcaagattggtttatattagtatcggtaatagcggatttacgaaatgcgttttatgttttatttccgatatggtttcatttacaagaagcggttggtataaaactactatgggtagcggttataggtgattggttaaatctagtatttaaatggatattatttggtcaacgtccgtattggtgggttctagatacggattattattcgaatacgtcggtaccgttaataaaacaatttccggttacgtgtgaaacgggtccgggttcgccgtcgggtcatgcgatgggtacggcgggtgtttattatgttatggttacgtcgacgttatcgatatttcaaggtaaaataaaaccgacgtatcgatttcgatgtctaaatgttatactatggctaggtttttgggcggtacaattaaatgtatgtttatcgcgtatatatttagcggcgcattttccgcatcaagttgtagcgggtgttttatcgggtatagcggtagcggaaacgttttcgcatatacattcgatatataatgcgtcgttaaaaaaatattttttaataacgttttttctattttcgtttgcgataggtttttatctactactaaaaggtctaggtgtagatttattatggacgttagaaaaagcgcaacgatggtgtgaacaaccggaatgggtacatatagatacgacgccgtttgcgtcgttactaaaaaatttaggtacgctatttggtttaggtttagcgttaaattcgtcgatgtatcgtgaatcgtgtaaaggtaaattatcgaaatggttaccgtttcgtctatcgtcgatagttgcgtcgttagtattattacatgtatttgattcgctaaaaccgccgtcgcaagttgaattagttttttatgtactatcgttttgtaaatcggcggtagttccgctagcgtcggtttcggtaataccgtattgtttagcgcaagtactaggtcaaccgcataaaaaatcgtta

SEQ ID NO: 12963 - DNA, 1071 bp, Artificial Sequence
  Description of Artificial Sequence: Synthetic coding sequence
atggaggaaggaatgaacgtccttcacgattttgggatacagtctacccactaccttcaggtgaactatcaggattcacaggattggtttatattagtttcagtaatagccgatctccggaatgctttttacgtgctcttccccatctggtttcacctgcaggaggcagtcggcataaagctcctgtgggtcgcagtgatcggagactggctgaatctggtcttcaagtggattttgttcgggcagcggccctattggtgggtattggatactgactactatagcaacaccagcgtgcccctgataaagcaattccctgtgacgtgcgagaccggacccgggagcccgtctggccatgccatgggtactgccggggtctactatgtgatggtaacatcaaccttgtcaatcttccaagggaagatcaagcctacttatcggttcaggtgtctgaacgtgattctctggctcggtttctgggccgtccagctgaatgtttgcctgtctcgtatttacctcgctgctcacttcccacatcaggtagtggccggggtgctgagtggaattgcagtagcggagactttctcccatatccacagcatctacaatgcaagcctcaaaaagtacttcctaatcaccttctttcttttcagcttcgccatcggattctatctgctgttgaagggtcttggcgtcgatctgttatggaccttggagaaagcccagagatggtgtgagcaacctgagtgggtacacatcgatactactccttttgcatcactactgaaaaatctgggcaccctattcggactggggctggccctcaatagcagcatgtaccgcgaaagttgcaaagggaaattgtctaaatggctaccattccgtctgagttccattgtggccagtctggtgttactgcacgtgtttgacagtcttaaaccccctagtcaggtggagcttgtattttatgtgttgtccttctgcaagtcggcagtggtgccactagcctccgtgtctgtgattccctactgcctcgcccaggtgctagggcagccacacaagaagtctttg

SEQ ID NO: 12964 - DNA, 1071 bp, Artificial Sequence
  Description of Artificial Sequence: Synthetic coding sequence
atggaggaggggatgaatgtgctgcacgattttgggatccaatcaacgcactatctgcaagttaactaccaagacagccaggattggttcatcctggtgtcagtcattgccgatctgagaaatgccttctacgtgctgtttcccatctggttccatttgcaggaggctgtcggaatcaagctcctctgggtggctgtcattggcgattggctcaacctcgtgttcaagtggattctgtttggccaacgcccatactggtgggttctggacactgactattattctaatacctctgtcccactcatcaaacaattccctgtcacttgcgagactgggccaggctcacctagcggtcacgcaatgggcactgccggggtgtactacgtaatggttactagtacgttgagcatcttccagggcaaaataaagcccacatatcggttcaggtgcctgaacgttattctctggctgggattttgggctgtgcagctgaacgtgtgcttatcgagaatctaccttgccgctcattttccccatcaggtggtggccggagtactttctggaattgctgtagccgaaactttcagtcatatacacagtatttacaacgcctccttaaagaaatacttccttatcaccttctttctcttcagtttcgccattggtttttacctgctgctgaaaggcttaggcgtcgatctactgtggacattggagaaggcccaaagatggtgcgaacagccggaatgggtacatatagatacaactcctttcgccagtctccttaaaaatctggggacactgttcggtctggggctggccctgaactccagcatgtaccgcgagagctgtaaaggaaaactgtccaagtggctgcccttccgcctgagtagcattgtcgcatccctcgtgctcttacacgtctttgattcgctgaagcccccgtcccaggttgagctagtgttttatgtgctgtccttctgcaagagcgccgtggttcctctggctagcgtctccgtgattccatactgccttgcacaagtactggggcaaccccacaagaaaagtctg

SEQ ID NO: 12965 - DNA, 1071 bp, Artificial Sequence
  Description of Artificial Sequence: Synthetic coding sequence
atggaagagggtatgaacgtcttgcacgacttcggcatccagtctacacactatctgcaggttaattaccaggacagccaggactggttcatcttggtgtctgtgattgccgacctacggaatgccttctatgtgcttttccctatttggtttcacctgcaggaggccgttggaattaaattgctctgggtcgctgtgattggcgattggcttaacttagtgttcaaatggatcctgtttgggcaaaggccctattggtgggtgctggatacggattattactccaacacttccgttcccctgattaagcaattccctgtgacatgtgaaacaggtccaggatcacctagcggccacgctatggggaccgccggagtttactatgtgatggtaacctctactctctcgatatttcagggcaagattaagccgacttacagattccgctgtctgaacgttatcctgtggctggggttctgggctgtgcagctgaacgtgtgcctctcccgaatttaccttgccgcgcatttcccacaccaggtcgtcgcaggtgttctgagcgggatcgccgtcgcagagactttctctcacatccattctatctataacgcctctctgaaaaaatactttctgatcacctttttcctattctccttcgcaataggcttttacctattgctgaagggtctcggggtcgatctgttgtggactctggagaaggcgcagagatggtgtgagcagcccgaatgggtgcacattgacaccactccatttgcttccctgctgaaaaatcttgggactttattcggcctgggtttagctcttaacagctccatgtatcgcgagagctgcaagggaaagcttagcaagtggttgccattcaggctgtcctctatagttgctagtctggtgctgctccacgtcttcgatagcttaaagcccccctctcaggtcgaactggtgttttatgttctgtccttctgcaaatccgcagtggttcctttagcctccgtgagtgtcataccgtactgccttgctcaagtcctgggccagccccacaagaagtccctg

SEQ ID NO: 12966 - DNA, 1071 bp, Artificial Sequence
  Description of Artificial Sequence: Synthetic coding sequence
atggaggaagggatgaacgttctgcatgactttggcattcaatctacccactatctgcaggttaactatcaggactcccaggactggttcatcttggtcagcgtgatagctgatctcagaaacgccttttatgtgctgttccctatctggtttcacttgcaggaggccgtaggcatcaaactgctttgggtcgcagttatcggggactggctcaatctcgtgttcaagtggattctgttcggccagagaccgtattggtgggtgctggacacagattattattctaatacatccgttcccctcataaagcagttcccagtcacatgcgagactggcccaggaagcccctccgggcatgcaatgggcaccgccggagtgtactacgtcatggtgaccagtaccctcagtattttccaaggaaagatcaagcctacctatcgcttcaggtgcctcaatgtaattttgtggctcggattttgggcagtccaactgaacgtttgtctctctaggatctacttggctgcacactttcctcaccaggttgtagctggtgtcttgtctggaatcgctgtggcggagacattcagccacatccattccatctataatgcttctttgaaaaagtactttctcattaccttcttcctgttctcattcgccattggtttctacctgctgctgaagggactgggggtcgacctgctgtggacactggaaaaagcccagaggtggtgcgagcagccggagtgggtgcacatcgacaccaccccattcgcctcattgctcaaaaacctcggaactcttttcggtttgggactggctttgaactctagcatgtaccgggagtcttgtaagggcaagctgtcaaagtggctcccctttcggttgtcaagcattgtcgcgtcacttgtgttgctccacgttttcgattctctcaagccgccaagccaggtggagctggtcttttacgtgctgtccttttgtaaatctgccgtcgtcccactcgcaagcgtttccgtcatcccatattgtttggcccaagtcctgggccaacctcataagaaaagtctg

SEQ ID NO: 12967 - DNA, 1071 bp, Artificial Sequence
  Description of Artificial Sequence: Synthetic coding sequence
atggaagaggggatgaatgtgttgcatgactttgggattcagtcgacccattatctccaggtgaactatcaggactcgcaggactggttcattctagtatccgtcattgccgatctgcggaatgcattttacgtactcttccccatctggttccacctgcaagaggcggttggtataaaactgctgtgggtggcggtgatcggggactggttgaatcttgtcttcaaatggatcctattcgggcagcgcccttattggtgggtgctggataccgactattactctaacacctctgtgcctcttattaagcagtttcctgtgacatgtgaaaccggtcctggcagtccttccggccacgccatgggaactgcaggcgtttattacgtcatggtgacaagcacactgagcatttttcagggaaaaatcaagccaacatatcgcttccgttgcttgaacgttatcctatggctcggcttctgggccgtccagctgaatgtgtgcttgtcacgaatctatctcgcagcgcatttcccacaccaagtggtcgctggtgtcttaagcggcatagccgtggctgagactttttcacacatccattccatctataacgcatctttaaaaaaatatttcctcatcacattctttttattttcctttgctattgggttctatctgctgctcaaggggctgggagttgacctgctttggacgctggagaaggcacagaggtggtgtgaacagccagagtgggtgcacattgataccacacctttcgcgtccttgttaaagaacctcggtactctgtttggcctgggactggcccttaattcaagtatgtatcgcgaatcctgcaagggcaagctatctaaatggcttcctttccggctgtccagcattgttgccagtctagttttactgcatgtctttgacagcctgaaaccccccagtcaagtggaattggtcttctatgttctctcattctgtaaatccgcggtggttccattggctagcgtgagtgtgattccctattgtcttgcccaggtgctgggccagcctcacaaaaaatctctt

SEQ ID NO: 12968 - DNA, 1071 bp, Artificial Sequence
  Description of Artificial Sequence: Synthetic coding sequence
atggaagagggaatgaacgttcttcacgacttcggtatccagagcacgcactaccttcaagtgaactaccaagactcacaggattggttcatcctggtgtctgtgattgctgacctgagaaacgcgttttatgttttgttcccaatctggtttcatcttcaggaggccgtgggaattaagctactgtgggtagctgtgatcggcgactggctcaacctggttttcaaatggatactcttcggacagcggccatattggtgggtattggacaccgactactacagcaatactagcgtgccactaattaagcagttcccggtgacatgcgagaccggaccaggctcgccctccggtcatgcaatggggacagcgggtgtttattatgtcatggtgacatctaccttgagcatttttcagggcaagattaagcctacttatcgctttcgatgcctcaatgtgatattgtggcttgggttttgggccgtccaattgaatgtgtgcctttctaggatttaccttgcggcccatttccctcaccaggtggttgcaggcgtgctctccgggattgcagtcgctgagactttcagtcatatacatagcatctacaacgctagcctcaagaaatatttcctgatcaccttttttctctttagttttgccattgggttctacctattactgaaaggcttgggcgttgaccttctctggacactcgagaaagctcagagatggtgcgagcaacccgagtgggtgcacatcgatactaccccattcgcctcccttctgaagaatctcggcacactgtttggcctggggcttgcactcaattcgtctatgtatcgggagtcgtgcaagggcaagttaagcaaatggttgccattccggctgagctcaattgtggcttccctcgttttgctccatgtttttgactccctgaagcctccctcccaggtggaattggttttctacgtgctgagcttctgtaaatccgcggtcgtgcctctggcatccgtgagtgttatcccctattgtcttgcccaggtcctaggtcagccccataaaaagagcctg

SEQ ID NO: 12969 - DNA, 1071 bp, Artificial Sequence
  Description of Artificial Sequence: Synthetic coding sequence
atggaagaggggatgaatgtattgcacgactttggaatccagagcacacactacctgcaggttaactatcaggacagccaggattggtttattcttgtgtcggtgatcgctgacctgagaaatgctttctatgtcttgtttcctatctggttccatctgcaagaggcggtgggcattaagctactttgggttgctgttatcggggattggctgaacctggttttcaaatggattctgtttggccaaaggccctactggtgggttttggacacagattactattctaacacgagcgtgccactgatcaagcaatttccagtaacatgcgaaaccggtcccgggtctccttctggccatgccatgggcactgcgggagtgtattatgtgatggtgaccagcaccctttcaatatttcagggaaagatcaaacctacctatcgatttcgctgcctgaacgtgatcttgtggctcggattctgggctgtccagctgaacgtgtgccttagtaggatatacctggctgctcacttcccccaccaggtagtcgccggggttttgagtggcattgcagtcgccgagactttttcccacatccactcaatttataatgcttctctgaagaagtactttcttatcacttttttcctattctcattcgccatcgggttctacctgttgctgaagggtctcggggttgatctgctttggacccttgagaaagcccaaaggtggtgtgaacagccggaatgggtgcatatcgatacaaccccgttcgcctcccttctgaagaacttgggcactcttttcggtctgggtcttgctctcaactcttcgatgtatcgagagagctgcaagggtaagttgtctaagtggctgcccttcaggctatctagtattgtggcatcattagtgctgttgcatgtcttcgatagcttgaaacctccaagccaggtggagctagtattttacgtactatcattttgcaagagcgccgtcgtacctttggctagcgtgtccgtcatcccctactgcctggcacaggttttagggcaaccccataagaagtcactg

SEQ ID NO: 12970 - DNA, 1071 bp, Artificial Sequence
  Description of Artificial Sequence: Synthetic coding sequence
atggaggaaggtatgaacgtcttgcacgactttggcatacagagcacacactacctgcaggtgaactaccaggatagtcaagactggtttatcttagtgagcgtgattgctgatctgcgcaacgctttctacgtcctctttcccatatggttccatctgcaggaggctgtcggcatcaagctactgtgggttgccgtcatcggcgactggctgaatctggttttcaaatggattctgtttggtcagagaccctactggtgggtcctggacacagattattactccaacacatctgtgcccctgatcaagcagtttccagtgacctgcgagactggaccgggcagtcccagcggccacgctatgggcactgctggagtatattacgtcatggtgactagcaccctgagcatcttccaaggcaagatcaagccgacatataggtttagatgtctgaatgttatactgtggcttggcttttgggccgtacaattaaacgtttgtctcagtaggatctaccttgccgcacacttcccacatcaagtggtggctggcgtgctttcaggaatcgcagtggctgagacattcagtcacatccatagcatctacaacgcaagcctcaaaaagtattttctgatcacctttttcttgttcagcttcgccatcggtttttatttgctcctgaagggactgggagtcgacttgctgtggacactcgagaaggcacaaaggtggtgtgagcagccagaatgggtgcacattgacaccactcctttcgccagcctgctgaaaaacctggggaccctttttggcttgggactcgcgttgaacagctcaatgtatcgggaatcttgcaaaggaaaactttcgaagtggttgccttttcggctgtcaagcattgttgccagcctcgttctgctacatgtctttgatagcttaaagcctcctagtcaagtagaactggtgttctacgttttaagtttttgcaagtctgcggttgtcccactggcctcagtgtctgtaatcccatactgcctcgcccaagtgttgggccagcctcacaaaaaatctctg

SEQ ID NO: 12971 - DNA, 1071 bp, Artificial Sequence
  Description of Artificial Sequence: Synthetic coding sequence
atggaggaaggcatgaatgtccttcacgatttcggtatccaatctacccattacttgcaggtgaactatcaggattctcaggactggttcatactcgtaagcgtgatcgctgatctccggaacgctttttatgtgctttttcccatttggtttcaccttcaggaggcggtgggcatcaaacttctatgggttgccgtgattggcgactggttaaatctggtcttcaaatggattttatttggccagcgaccctattggtgggtgcttgacacagattactactccaacacttctgtgcccctcatcaaacagttccccgtgacttgtgagaccgggccaggatccccaagcggtcacgccatgggaacagcaggagtttactatgtgatggtaacttctacgctgtctatattccaagggaaaattaagccaacatacaggtttcggtgcttgaacgttattctctggctgggcttttgggcagtccagctgaacgtgtgtttgtcaaggatctacctggcagctcactttcctcaccaagtcgttgcaggcgttttgagtgggattgccgttgccgagaccttttctcatattcactccatatacaacgcgtcccttaaaaaatatttcttgatcaccttttttctatttagctttgctatcggtttttacctcctcctgaaaggtctgggagtcgatctgctgtggactttagagaaagctcagcgctggtgcgagcagccggaatgggtgcacatagacacgacacctttcgcgtcactgctgaaaaatcttggtacattattcggtcttggcctggctctcaactcatctatgtatcgggagagctgtaaaggtaagctgtccaaatggcttccttttcgactgtcatcaattgtcgctagtctcgtgctgctgcatgtcttcgactcgcttaaaccccccagtcaggttgaactggtgttttatgtgttatcgttctgtaaaagcgcagttgtacctctggcatcagtttccgtcattccctattgtttggcccaggtgctgggccaaccacacaaaaaatccctc

SEQ ID NO: 12972 - DNA, 1071 bp, Artificial Sequence
  Description of Artificial Sequence: Synthetic coding sequence
atggaagagggcatgaacgtcttgcatgacttcggtattcagagtacccattatcttcaggtgaactaccaagattctcaggactggtttatcttagtgtctgttatcgccgatctgcgtaacgcattctacgtgctcttcccaatctggttccaccttcaggaggcggtggggatcaagttattgtgggttgcggtgatcggagattggcttaatctggtcttcaaatggattctgtttggacagcggccttactggtgggttctcgacacagactactatagcaacacatccgtaccgctgataaaacagttcccagtgacatgtgaaacagggccagggagcccctcaggccatgctatggggaccgctggcgtgtattatgtaatggtcacttctaccctgtcaatatttcaggggaaaattaaaccgacttatcggtttaggtgcctgaatgtgatcctgtggctcgggttttgggccgtgcaacttaatgtgtgtctgtcgcgcatttacctggcagcccacttcccccaccaggttgtcgccggcgtgttatccggtatcgccgtggcggaaacattcagccatatccattccatatataatgcatctttgaagaagtacttcctgattaccttttttctcttcagctttgctataggtttttatctgttgctgaaagggcttggagtggacctcctgtggaccctggagaaagcccagcgctggtgtgagcagccagagtgggttcacattgacactactccctttgcttcattgttgaagaacctcggtacgttgttcgggttgggcctggctttgaatagtagtatgtaccgggagtcatgtaagggaaagctctctaagtggctgccctttcggctgtccagtattgtagccagccttgtgctattgcatgtctttgactctcttaagcccccttcgcaggtggagttggtattttacgtgctatctttttgtaagagtgcagttgtgcctctcgcaagcgtctcggtgatcccctattgcctggctcaggtgctgggacagccacacaagaagtctctc

SEQ ID NO: 12973 - DNA, 1071 bp, Artificial Sequence
  Description of Artificial Sequence: Synthetic coding sequence
atggaggagggtatgaatgttctgcatgacttcggcattcaatcaacccactatttgcaggtgaactaccaggacagccaggattggttcatcctagtgagcgtcatcgctgacctgaggaacgccttttatgtattgtttccaatctggtttcacctccaggaggctgtgggtatcaaactgctgtgggtagcagtcattggtgactggcttaaccttgtatttaaatggattcttttcggccaacggccctattggtgggtactcgacacagactattattctaatacaagtgtgcccttgatcaagcagttccctgtcacatgtgagacggggccgggctcaccttctgggcatgccatgggaactgccggtgtgtactacgtcatggtgaccagtaccttgtctatctttcagggaaagattaaacccacatacaggttcagatgtctgaacgttattctctggctgggattttgggctgtgcagctgaatgtctgcctcagccggatatatcttgccgctcatttcccccatcaggttgtggcaggagtgctctcagggattgccgtcgctgagactttttcgcatattcactctatttacaacgcatcactcaaaaagtatttcctgattaccttttttctgtttagtttcgccatcggtttctatctcctgttaaaaggacttggcgttgacttactgtggactttggaaaaggctcagcgatggtgcgaacagccagagtgggttcatatcgacaccactccattcgcttccctcttgaaaaatttaggcaccctgtttggactggggctagctctgaacagttcaatgtaccgggaaagctgtaaaggcaaactgtctaagtggttaccgtttagactgtcatcaatcgtggcttcactggtactgctgcacgtcttcgatagcctgaagccccctagccaggtggagctcgtgttttacgttctgtcattttgtaagtccgcagtcgttccccttgcttccgtgtccgtgataccatattgcctggcgcaggtgctcggccagcctcacaagaaaagtttg

SEQ ID NO: 12974 - DNA, 1071 bp, Artificial Sequence
  Description of Artificial Sequence: Synthetic coding sequence
atggaagagggaatgaatgtgcttcacgattttgggattcagagcacgcactatctacaagtcaactaccaggattctcaggattggttcatcctagtaagcgtcatcgctgaccttcgaaatgccttttacgttctatttccaatctggttccatttgcaggaggcggtaggtattaaactcctttgggtcgcggtgataggagattggcttaacctcgtgtttaaatggattttgttcggacaacggccttactggtgggtccttgatacagactactattcgaatacctctgtcccactaatcaagcaatttccagtcacttgcgagacgggtcctggttctccctccgggcatgcaatgggcactgctggagtgtattacgtgatggttaccagtactctctctatctttcaagggaagattaagcctacctatcgattcagatgtctgaacgtcatactctggctggggttttgggctgtgcaattgaacgtctgtctctctcgcatttaccttgcagctcactttccacatcaagtcgttgcaggggtgttgtcagggatcgctgttgcagagactttctcacatattcattcaatttacaacgcgtcactgaagaagtatttcttgatcacattttttttgttctcgttcgctatcgggttttacctgctgctcaaaggtctgggagtagatcttctttggaccctcgagaaggctcaacgatggtgcgaacaaccagaatgggtccatattgacacaacgcccttcgcgtcattattaaagaacctcggaacgctgttcggcctgggtcttgccctcaattccagtatgtacagggaatcctgtaaggggaagttatctaaatggctaccatttaggctctcttctatagtcgcatctctcgtgttgcttcatgtgtttgactctttgaaacctccttctcaggtggaacttgtcttctatgttctttcgttctgtaagtccgccgtcgtccccttggcctcagtatctgtgattccgtattgtttagcgcaagtgctgggccagccccataaaaagtcgttg

SEQ ID NO: 12975 - DNA, 1071 bp, Artificial Sequence; identical to SEQ ID NO: 12965
  Description of Artificial Sequence: Synthetic coding sequence

SEQ ID NO: 12976 - DNA, 1071 bp, Artificial Sequence
  Description of Artificial Sequence: Synthetic coding sequence
atggaagaagggatgaacgtgttgcatgattttggtatacagtccacccactaccttcaggtaaattaccaggattcccaagactggtttatactcgtgtcagtgatcgcagacttaaggaatgctttctacgtgctgttcccgatttggtttcacttgcaagaggcagtggggatcaagttgctttgggtcgcagtgatcggggattggctgaacctagtgtttaaatggatcctgtttggccagagaccatactggtgggtgttggacactgattattactctaacacaagcgtgcccctcatcaagcagtttccagtcacttgtgaaactgggccaggatcaccctccggacatgctatgggcactgccggcgtgtactatgtcatggttacctctaccctaagcatcttccagggaaaaatcaagcccacgtaccggttcagatgcctcaatgtgattctttggctaggattctgggccgtgcagctgaacgtatgtctgagtagaatttacttggccgcccattttccgcaccaagtcgtggctggcgtgctgtcgggtatcgcagttgcggagacattctcacacatccactcaatctataatgcatctctcaaaaagtattttcttattacattctttctgttctcctttgccataggattctacttgctgctcaaaggcctcggagtcgacctgctctggacccttgagaaagctcagaggtggtgcgaacagcccgagtgggtgcacattgataccacgccgttcgcttcactgcttaagaatctcggtacactcttcgggttagggttagccttgaacagttctatgtatagggagagctgcaaaggcaagttaagtaaatggctcccttttaggctctcgagcattgtagccagcctggtgttgctacatgtcttcgacagcctaaaacccccatcacaggttgaactagtattctacgtcctctctttctgcaagtctgctgtggtgccgctggctagcgtttccgtcataccatactgcctggctcaggtgctcggccaaccacacaaaaaatccctc

SEQ ID NO: 12977 - DNA, 1071 bp, Artificial Sequence
  Description of Artificial Sequence: Synthetic coding sequence
atggaggagggcatgaacgtgcttcacgactttggaattcaatccactcactacctccaggttaattaccaggattcacaggattggttcatcctggtttcagtgatcgcagatctgaggaacgcattttatgtgctatttccaatctggttccacctgcaggaggctgtggggatcaagctcttgtgggtggctgtgattggcgactggttgaatctggtcttcaagtggatactattcggacagcggccgtactggtgggtgctggacaccgattattactccaataccagtgtgcctcttatcaagcagtttccggttacatgcgagaccggccccggctcccctagtggccacgccatgggaaccgcaggagtctattacgtcatggtgaccagtacactctcaatttttcaggggaaaatcaagccaacctatcggtttcggtgcctgaatgtgatattgtggctgggcttttgggctgtacagttgaacgtgtgtttgagccgaatctacctggccgcccatttcccccaccaggtcgtcgcaggcgtgctcagcggaatcgccgttgcagagactttcagccatatccattccatctacaacgccagccttaagaaatactttctgatcacctttttcctcttttcattcgcaattgggttctacctgctgctgaagggtcttggggtcgacctcctttggactctcgagaaggcacagcggtggtgtgaacaaccagagtgggtccatatcgacacaactccattcgccagcctgctgaagaatctgggtacgctctttggactaggcctcgccctgaactctagcatgtatagagaaagttgcaaaggtaaactgtccaaatggctgcctttcaggctcagtagcatagtggcttcactggtcctgctgcatgtgtttgactccctgaagcctccctcacaggtcgagctcgtcttctatgtgctatccttttgcaagagtgccgtggtgccattggcttctgtttcggtcataccatattgcctcgctcaagtcctgggacagccacataaaaaaagtttg

SEQ ID NO: 12978 - DNA, 1071 bp, Artificial Sequence
  Description of Artificial Sequence: Synthetic coding sequence
atggaagagggtatgaacgtcttgcatgactttggcatccagagcactcactatctccaggtgaattatcaggattctcaggattggttcatccttgtatccgtcatcgctgatctgcgcaatgctttctatgttttgttccctatatggttccatcttcaggaggccgtgggcatcaaactgctttgggtcgctgtgatcggcgattggctgaatctcgtcttcaagtggatcctgttcggacaaagaccctattggtgggtcttggatacagactattactcaaatacttctgtcccattgatcaagcagttccccgtgacctgcgagactggtccaggctctccctctggtcacgccatgggaaccgctggagtctactacgttatggtgactagtaccttgtctatcttccagggtaagatcaagcccacataccgtttccgctgcctcaacgtgatcctgtggctcggcttctgggccgtccagttgaacgtgtgcctgtcccgtatctatctggccgctcactttccacaccaggtcgtcgctggtgttctttctggaatagcagttgccgagacatttagtcatattcactccatatacaacgcttctttgaagaaatactttcttattacattcttcttgttttctttcgccatcggcttttacctgctgctgaagggtttgggagtggatcttctctggaccctggagaaagcccagcgctggtgtgagcagcccgagtgggtccacatcgatactacaccctttgcttcactgctcaaaaacctcggcaccctgttcggtctgggcttggccctcaactctagtatgtatagggagtcctgtaaaggtaagctgtctaagtggctgccttttcgtctgagctccattgttgcttcactcgtcctgctgcacgtcttcgattccttgaagcctccatcacaagttgagttggtgttctatgttttgagtttctgtaaatcagctgtagtaccactcgcctccgtaagcgttattccttattgtctcgcacaggtcctgggacagccccacaaaaagtccctc

SEQ ID NO: 12979 - DNA, 1071 bp, Artificial Sequence
  Description of Artificial Sequence: Synthetic coding sequence
atggaagaagggatgaacgtgttgcacgacttcggcattcaatccactcattacctccaggttaattaccaagattcacaagattggttcatactcgtttcagttattgcagatttaaggaacgctttctacgtgctgtttccgatttggtttcatcttcaagaagcagtgggaatcaagcttttatgggttgctgtcatcggtgattggctcaatctggtgtttaagtggatcttatttggtcagagaccttactggtgggtcctcgacacagattattactctaatacatcagttcccctaattaaacagtttccagtgacatgtgagaccggtcctggttctcccagtggccacgcaatgggcaccgcaggtgtgtattatgttatggtgacttcgactctgagcatcttccaaggtaagattaagcctacctatagatttcgctgtctgaacgtgattttgtggctgggcttttgggctgttcaacttaacgtttgtctttcaagaatttatcttgccgcacatttccctcatcaggtagttgccggagtcctctcgggcatagctgttgcagaaacatttagccatatacattccatttacaacgcctcactaaaaaaatatttcttgatcactttcttcctgttctcgtttgctatcggcttttatctgttacttaagggtttgggtgtggatcttttgtggacccttgagaaggctcagagatggtgtgagcagccagaatgggtgcacatagatacaactcctttcgcctctttattaaagaatcttgggactctattcgggcttggactcgctctgaatagtagcatgtaccgtgagagctgtaaaggtaaattgtctaagtggcttccattccgtttgtcttcgatcgtggcctcacttgtactactgcatgttttcgactccctcaagccaccttcccaagtagaattggtattctatgtgctttcattttgcaaatccgctgttgttcctttggcttcagtatcagtcatcccatattgtttggcacaggttcttggacaacctcataaaaagtccctg

SEQ ID NO: 12980 - DNA, 1071 bp, Artificial Sequence
  Description of Artificial Sequence: Synthetic coding sequence
atggaggaaggcatgaatgtcctgcacgactttgggatccagtccacccactatctgcaggtgaattaccaggatagccaggactggtttatattggtgtcagtgatcgccgacttgagaaatgcattttacgtcctcttccctatttggttccacctacaggaagccgtcggcattaagctgctgtgggtggccgtgatcggggactggctgaacctcgtctttaagtggatcctgttcgggcagagaccttactggtgggttctagataccgactactacagcaacacttcagtgcccctcataaaacagttccccgtcacctgcgagaccggtccaggaagccctagcggccatgctatgggcacggctggcgtttactatgtgatggtgacaagtactctgtccatcttccagggaaagatcaagcccacatacaggtttcgatgcctgaatgtgattttatggctgggattctgggccgtgcaattgaatgtgtgcctcagcagaatatacctcgctgcccactttcctcatcaggtcgtagctggcgtcttaagcggaattgccgttgcagagactttcagtcatatacactctatctataatgcttccctcaaaaagtatttcctcataacctttttccttttctccttcgccattggattctatcttttgctgaaggggctcggcgtggatctactttggacactcgagaaggcccagaggtggtgcgaacagccagagtgggttcacattgacacgacgcccttcgcatcacttctgaagaaccttggcaccctgttcggactggggctggctcttaacagctctatgtaccgcgaatcatgtaaaggtaagctctccaaatggctgcctttccgcttgtcaagtatcgtggcatctcttgtgttgctacacgtgtttgactcactcaagcccccctcccaagtggaattggtcttttacgtactgtccttctgtaaatctgcggtggtacccctggccagtgtttctgtgattccatactgcctggctcaagtactgggacagccacacaaaaagtccctc

SEQ ID NO: 12981 - DNA, 1071 bp, Artificial Sequence
  Description of Artificial Sequence: Synthetic coding sequence
atggaagaaggtatgaacgttttgcatgattttggaattcaatcgacgcactatctgcaagtgaattatcaagattctcaagattggtttattcttgtatcggttattgctgatctccgtaatgcgttttacgttctcttcccaatttggtttcaccttcaagaggcagttggtatcaagttattgtgggtagcagtcatcggagactggctgaatcttgtgttcaagtggattctcttcgggcaacgaccatactggtgggtgctcgacactgattattacagcaacacctcagtgccgctcattaaacaattcccagtgacttgtgaaacaggtccaggtagtccatctggacatgctatgggcacagcgggtgtttactatgtgatggttacttctacgctttcaatttttcagggcaaaattaaacctacgtatcgattccgctgtcttaatgtaatattatggcttggcttttgggctgttcagttaaatgtttgtttgagtagaatttatcttgcagcacattttcctcatcaggttgtcgctggagtcctttcaggcatcgcagtggccgaaacattcagccatattcattcaatttataatgcttcactgaaaaaatattttttgatcactttcttcttattctcatttgccattggattctatctgttactcaagggcctgggagttgatctgctctggacacttgaaaaggcacagagatggtgcgagcaaccagagtgggttcacatagatacgacaccgttcgcaagcctgctcaaaaacctcggaacacttttcggactcggattagccttgaactcctcaatgtaccgagaaagttgcaaaggaaaacttagcaagtggctcccgtttcgcttatctagcatagtagcgagcctggtgttgttacatgtctttgacagtttgaagccaccatcccaggtcgaacttgttttttatgtcctatctttttgtaagtcagctgtggtaccgcttgcaagcgtctccgttattccttattgtttggcgcaggtattgggacagccccataaaaagtcactt

SEQ ID NO: 12982 - DNA, 126 bp, Artificial Sequence
  Description of Artificial Sequence: Synthetic coding sequence
atgggagttagacacccaccttgtagccatcgcctgctggccgtctgcgccctggtgagtctggcaaccgcggccttattgcctcagaattctaagatcccaggccctacatttctcgatccccac

SEQ ID NO: 12983 - DNA, 126 bp, Artificial Sequence
  Description of Artificial Sequence: Synthetic coding sequence
atgggcgttagacatccgccatgttctcatcgcttgcttgccgtctgtgcgctcgtgagcttagctacagcggcactgctgccacagaacagtaaaattcccggaccgaccttcctggatccccat

SEQ ID NO: 12984 - DNA, 126 bp, Artificial Sequence
  Description of Artificial Sequence: Synthetic coding sequence
atgggtgtgcggcacccaccctgcagtcatcggttgctggctgtttgtgccttggtctcactcgccacggccgcattgctgccgcagaatagtaaaatacccggcccaacattcctagatccgcat

SEQ ID NO: 12985 - DNA, 126 bp, Artificial Sequence
  Description of Artificial Sequence: Synthetic coding sequence
atgggcgtgaggcaccccccgtgttcccatcgcctgcttgcagtgtgcgcgctcgtaagcctggctaccgcagcccttctgcctcagaatagcaaaatccccgggcccacattcctggatccacac

SEQ ID NO: 12986 - DNA, 126 bp, Artificial Sequence
  Description of Artificial Sequence: Synthetic coding sequence
atgggagtacgtcaccctccatgttctcatagactattagcagtatgtgctctggtaagtcttgctaccgctgcattgctcccacaaaattcgaaaataccaggaccaactttccttgatccgcat

SEQ ID NO: 12987 - DNA, 126 bp, Artificial Sequence
  Description of Artificial Sequence: Synthetic coding sequence
atgggtgtgcgccatccgccgtgttcgcacagactgctggcggtgtgcgcactcgtgtcgctcgcaaccgcggctttgctccctcagaactccaaaatcccgggacctactttcctcgatcctcac

SEQ ID NO: 12988 - DNA, 126 bp, Artificial Sequence
  Description of Artificial Sequence: Synthetic coding sequence
atgggagtaagacatcctccttgctcccatagacttcttgccgtgtgcgcactagtatccttagctactgccgcactgttgccacagaacagcaagatccccgggcctacctttctcgacccccat

SEQ ID NO: 12989 - DNA, 126 bp, Artificial Sequence
  Description of Artificial Sequence: Synthetic coding sequence
atgggcgttcgccaccccccctgtagccacaggctccttgcagtgtgcgccctggtatcactggccaccgcagcgttgctccctcagaactctaaaattcccggtcccacattcttggaccctcat

SEQ ID NO: 12990 - DNA, 126 bp, Artificial Sequence
  Description of Artificial Sequence: Synthetic coding sequence
atgggtgtgaggcaccctccctgcagccatagacttctggcagtgtgtgcccttgtgtccctggcgaccgctgcccttctgccccagaatagcaagatccccgggccaacttttctggatccacac

SEQ ID NO: 12991 - DNA, 126 bp, Artificial Sequence
  Description of Artificial Sequence: Synthetic coding sequence
atgggagtgcgtcacccaccttgttcccatcggctgctcgccgtgtgtgcgctcgtgtcactcgccaccgcggcattgcttccacagaatagcaagattccaggccccacctttctggatccgcat

SEQ ID NO: 12992 - DNA, 126 bp, Artificial Sequence
  Description of Artificial Sequence: Synthetic coding sequence
atgggcgttcgccaccctccatgcagccatcggcttcttgcagtctgtgccctcgtgtcactggcaaccgccgctctgttgcctcaaaactccaagattcccggtcctacttttctggatccacat

SEQ ID NO: 12993 - DNA, 126 bp, Artificial Sequence
  Description of Artificial Sequence: Synthetic coding sequence
atgggagttcgtcaccctccatgctcacacagattgttggctgtgtgcgccttggtttctttggctacagctgccctgctccctcaaaactcaaaaattccaggaccaacattccttgatcctcac

SEQ ID NO: 12994 - DNA, 126 bp, Artificial Sequence
  Description of Artificial Sequence: Synthetic coding sequence
atgggcgtccggcacccgccttgctcgcatcgcctgctggccgtgtgcgccctcgtgagcctggcgaccgctgccctgttgccacagaattccaagatacctggccctacgtttctcgatccacac

SEQ ID NO: 12995 - DNA, 126 bp, Artificial Sequence
  Description of Artificial Sequence: Synthetic coding sequence
atgggagtgcgacatccgccatgctcccaccgtctgcttgcagtctgtgccctcgtgtcgcttgcgacggctgcacttctgccccaaaactcaaagatccctggccctacctttttggatccgcat

SEQ ID NO: 12996 - DNA, 126 bp, Artificial Sequence
  Description of Artificial Sequence: Synthetic coding sequence
atgggcgtgagacatcctccttgttcgcataggctcctggcagtgtgtgctctcgtgtcacttgccactgcggcactgctcccacaaaattccaagattcctggacctacctttctcgatcctcat

SEQ ID NO: 12997 - DNA, 126 bp, Artificial Sequence
  Description of Artificial Sequence: Synthetic coding sequence
atgggagtccgccatccgccgtgcagccaccggctcctggccgtgtgcgcacttgtgtcgttggccactgctgcacttctgccgcagaactccaaaatccctgggccaaccttccttgatcctcac

SEQ ID NO: 12998 - DNA, 126 bp, Artificial Sequence
  Description of Artificial Sequence: Synthetic coding sequence
atgggtgttcgccaccccccctgttctcatcggttattggctgtatgcgcccttgtgtccctggcaactgcagcgctgttgccgcaaaatagcaagatccccggtccaacatttttagaccctcac

SEQ ID NO: 12999 - DNA, 126 bp, Artificial Sequence
  Description of Artificial Sequence: Synthetic coding sequence
atgggggtccgccatcctccttgcagccaccggttacttgccgtatgtgccctcgtctcactcgctacggcagctttgcttcctcaaaacagtaagatcccaggaccaacgttcctggacccgcac

SEQ ID NO: 13000 - DNA, 126 bp, Artificial Sequence
  Description of Artificial Sequence: Synthetic coding sequence
atgggcgtcagacacccgccctgcagtcaccgactcctcgccgtgtgcgcactggtctcgctcgccacagctgcgctgctgccccagaatagcaaaattcccggccctacatttctggatccgcac

SEQ ID NO: 13001 - DNA, 126 bp, Artificial Sequence
  Description of Artificial Sequence: Synthetic coding sequence
atgggggtgagacacccgccatgttctcataggcttcttgcagtctgcgctcttgtgagccttgcaactgcggcattgcttccgcaaaattcgaagattcctggacctacgtttttggatccgcat

SEQ ID NO: 13002 - DNA, 126 bp, Artificial Sequence
  Description of Artificial Sequence: Synthetic coding sequence
atgggtgtgagacacccaccatgttcgcacagactcctagctgtctgcgctctggtatcactggcaaccgccgctctgctacctcagaatagtaagattcctgggccgactttccttgatccccat

SEQ ID NO: 13003 - DNA, 126 bp, Artificial Sequence
  Description of Artificial Sequence: Synthetic coding sequence
atgggtgtacgtcatccgccgtgttcgcatcgactactagcggtatgtgcgttagtttcgctagcgacggcggcgttactaccgcaaaattcgaaaataccgggtccgacgtttttagatccgcat

SEQ ID NO: 13004 - DNA, 126 bp, Artificial Sequence
  Description of Artificial Sequence: Synthetic coding sequence
atgggagtgaggcacccgccttgcagccatagactcttggcagtctgtgccctggtgtccttggcgaccgctgccttgctgcctcaaaactcgaagatcccaggcccgacctttctcgacccgcat

SEQ ID NO: 13005 - DNA, 126 bp, Artificial Sequence
  Description of Artificial Sequence: Synthetic coding sequence
atgggagtgcgacatcccccatgctcacacagactgctcgccgtgtgcgctttggtctccctggctacagccgccttgcttccgcagaacagcaaaattcccggccccacctttcttgacccccac

SEQ ID NO: 13006 - DNA, 126 bp, Artificial Sequence
  Description of Artificial Sequence: Synthetic coding sequence
atgggagtgcggcaccctccttgttcacatcggttgctggcagtatgtgcactggtgtctctcgcaaccgcagccctgcttcctcagaatagtaaaatacccggaccgacttttctcgatccccac

SEQ ID NO: 13007 - DNA, 126 bp, Artificial Sequence
  Description of Artificial Sequence: Synthetic coding sequence
atgggagtccgacaccctccgtgttctcaccgactgctagccgtgtgcgccctggtcagtttagcaaccgccgccctgctaccacagaactcaaagatccctggaccaactttcctggatccacac

SEQ ID NO: 13008 - DNA, 126 bp, Artificial Sequence
  Description of Artificial Sequence: Synthetic coding sequence
atgggtgtcagacatcccccatgttcgcataggctgcttgcagtgtgtgcacttgtctccctggccactgctgcccttcttcctcagaactcgaaaatcccagggccaacctttctggaccctcac

SEQ ID NO: 13009 - DNA, 126 bp, Artificial Sequence
  Description of Artificial Sequence: Synthetic coding sequence
atgggagtgcgccacccaccgtgttcgcatcgattgctcgcagtctgcgcgctcgtgtccctcgccactgctgcattgctgccccagaactccaagatcccgggcccgaccttccttgaccctcac

SEQ ID NO: 13010 - DNA, 126 bp, Artificial Sequence
  Description of Artificial Sequence: Synthetic coding sequence
atgggagtacggcacccaccttgctcacataggctactagccgtatgtgccttagtctcattagctacagcggccctccttcctcagaactctaaaattcccggacctactttccttgacccccac

SEQ ID NO: 13011 - DNA, 126 bp, Artificial Sequence
  Description of Artificial Sequence: Synthetic coding sequence
atgggggtgcgccaccccccatgctctcaccgcctgttagccgtatgtgcactagtgagcttggcgaccgcggctctgctgccgcaaaactcaaagatccccggaccaacgttcctggatccgcat

SEQ ID NO: 13012 - DNA, 126 bp, Artificial Sequence
  Description of Artificial Sequence: Synthetic coding sequence
atgggagttcggcaccccccatgtagccatagactcctcgcagtgtgcgcgcttgtgtcgcttgccaccgctgcactgttgcctcaaaactccaagattccggggccgacttttctggatcctcat

SEQ ID NO: 13013 - DNA, 126 bp, Artificial Sequence
  Description of Artificial Sequence: Synthetic coding sequence
atgggcgtgcgccacccgccatgttctcaccgcctcctcgctgtttgtgccctggtgtccctggccactgcagctctgcttccccagaacagtaagattcctggtcccactttccttgacccacac

SEQ ID NO: 13014 - DNA, 126 bp, Artificial Sequence
  Description of Artificial Sequence: Synthetic coding sequence
atgggggtgaggcacccgccctgcagccacaggcttctcgcagtgtgtgccctggtcagcttagcaacagccgccctgctgcctcagaactctaaaattccagggccaacattcctagatccccac

SEQ ID NO: 13015 - DNA, 126 bp, Artificial Sequence
  Description of Artificial Sequence: Synthetic coding sequence
atgggcgtgcgacatccaccgtgctcgcatcgtctgctggcagtttgtgcattggtcagtcttgccactgcagcactgttaccacaaaattcaaagatcccaggccctacattcctggatcctcac

SEQ ID NO: 13016 - DNA, 126 bp, Artificial Sequence
  Description of Artificial Sequence: Synthetic coding sequence
atgggcgtgcgtcatccaccttgcagccacagacttttggcagtctgcgccttggtgagtctggcaaccgccgcattgcttcctcaaaactcaaagattccaggacctacctttctagacccacat

SEQ ID NO: 13017 - DNA, 126 bp, Artificial Sequence
  Description of Artificial Sequence: Synthetic coding sequence
atgggcgtgcggcatcctccttgttcacaccgcctgctggcggtgtgtgcgctggtgtcccttgccacggcagcactgcttccccaaaactcgaaaattcctggtcctactttcctcgatccccac

SEQ ID NO: 13018 - DNA, 126 bp, Artificial Sequence
  Description of Artificial Sequence: Synthetic coding sequence
atgggggtgcgtcatcccccttgtagccatagactgcttgcagtgtgcgcactggttagccttgccaccgcggcactccttcctcaaaactcaaaaatccccggtcctacctttctggacccacac

SEQ ID NO: 13019 - DNA, 126 bp, Artificial Sequence
  Description of Artificial Sequence: Synthetic coding sequence
atgggcgtgcgccacccaccgtgctcgcaccggctgctggcggtgtgtgccctcgtctccctcgcaactgccgctttgcttccgcagaacagcaagatccccggacctaccttcctggacccgcat

SEQ ID NO: 13020 - DNA, 126 bp, Artificial Sequence
  Description of Artificial Sequence: Synthetic coding sequence
atgggggtccgtcatcctccctgttcccaccgattgttggctgtgtgcgccctagttagcctggcaaccgcggccctgctgccacagaatagtaagatacccggcccgaccttcctggacccacat

SEQ ID NO: 13021 - DNA, 126 bp, Artificial Sequence
  Description of Artificial Sequence: Synthetic coding sequence
atgggagtcagacatccgccctgtagccatcggctgctcgcagtctgcgccctggtgagcctcgccactgcagccttgctccctcaaaactcaaagatcccggggccgactttcctggacccacac

SEQ ID NO: 13022 - DNA, 126 bp, Artificial Sequence
  Description of Artificial Sequence: Synthetic coding sequence
atgggtgtgcggcaccccccatgtagtcacagacttctggcagtatgtgctctggtgtctttagcaaccgcggccttgctccctcaaaactccaagatccctggacccacctttttagatcctcac

SEQ ID NO: 13023 - DNA, 126 bp, Artificial Sequence
  Description of Artificial Sequence: Synthetic coding sequence
atgggagtgcgccatccgccatgttcccacagacttcttgctgtgtgtgcactggttagccttgcgacagctgcactgttgccacagaatagtaagatccctggacccaccttccttgacccccat

SEQ ID NO: 13024 - DNA, 126 bp, Artificial Sequence
  Description of Artificial Sequence: Synthetic coding sequence
atgggagttaggcatcccccctgcagtcaccgactattggccgtgtgcgcattggtcagtctcgccaccgctgcactcctgccacaaaacagtaagatacctggccctactttcctggacccgcac

SEQ ID NO: 13025 - DNA, 126 bp, Artificial Sequence
  Description of Artificial Sequence: Synthetic coding sequence
atgggggtcagacacccaccgtgctcacataggctgctggctgtctgtgctcttgtgtcgctcgccaccgcggctcttctgccccagaactcgaagatcccaggaccgactttcctggatccgcat

SEQ ID NO: 13026 - DNA, 126 bp, Artificial Sequence
  Description of Artificial Sequence: Synthetic coding sequence
atgggagtcaggcatcccccatgcagccatagactcttagctgtttgcgctttagttagcttggctacagctgccttattgcctcaaaatagtaagatcccaggtcctaccttccttgaccctcat

SEQ ID NO: 13027 - DNA, 126 bp, Artificial Sequence
  Description of Artificial Sequence: Synthetic coding sequence
atgggggtgagacatccgccatgttcgcatcgcctactggctgtatgcgccctcgtgtcattggcgaccgccgcccttctgcctcaaaacagcaaaatacccggaccaacctttcttgacccccac

SEQ ID NO: 13028 - DNA, 126 bp, Artificial Sequence
  Description of Artificial Sequence: Synthetic coding sequence
atgggagtgaggcatcctccgtgctctcacaggctgctcgcggtttgtgcgcttgtgagtcttgctaccgctgcactccttcctcagaactctaaaatcccgggtcccacctttctggacccccac

SEQ ID NO: 13029 - DNA, 126 bp, Artificial Sequence
  Description of Artificial Sequence: Synthetic coding sequence
atgggagttaggcacccgccgtgttcccaccgtttactggccgtatgtgcattggtctctttggctactgccgcccttctgccccagaatagcaaaatccctgggcctacattcctggacccccat

SEQ ID NO: 13030 - DNA, 126 bp, Artificial Sequence
  Description of Artificial Sequence: Synthetic coding sequence
atgggagttcgacatccaccttgtagtcatcgattattagcagtttgcgcacttgtatcattagcaacagcagctttgttaccacaaaattctaagattcctggaccaacattcttagatccacat

SEQ ID NO: 13031 - DNA, 126 bp, Artificial Sequence
  Description of Artificial Sequence: Synthetic coding sequence
atgggagttagacatccgccatgttcacatcggctccttgcggtgtgtgcccttgtctcgctggccaccgccgcactgcttccacagaacagcaaaattcccggtcccacttttctggacccacac

SEQ ID NO: 13032 - DNA, 126 bp, Artificial Sequence
  Description of Artificial Sequence: Synthetic coding sequence
atgggagtcaggcatcctccttgctcgcatcggctgctggcggtgtgtgcccttgtttcactggcgactgctgctctcctcccacagaacagcaagattccggggccgaccttcctggacccacac

SEQ ID NO: 13033 - DNA, 126 bp, Artificial Sequence
  Description of Artificial Sequence: Synthetic coding sequence
atgggggtgaggcaccctccatgctctcaccggctgctggctgtgtgcgccctggtgagcttagcaactgctgcacttctgccacagaatagcaagattcccggccccacattcctggaccctcac

SEQ ID NO: 13034 - DNA, 126 bp, Artificial Sequence
  Description of Artificial Sequence: Synthetic coding sequence
atgggcgtccggcatccgccgtgcagccaccgcttgctggctgtgtgtgcattggtgtcgctcgccactgcggcccttctgcctcagaactcgaagatcccaggaccgacgttcctcgacccgcac

SEQ ID NO: 13035 - DNA, 126 bp, Artificial Sequence
  Description of Artificial Sequence: Synthetic coding sequence
atgggagtgcgtcacccgccttgttcccatcgcctgttggccgtgtgcgcgcttgtctcattggcaaccgcggctttgcttccacagaacagcaagatcccgggccccactttcctggacccccac

SEQ ID NO: 13036 - DNA, 126 bp, Artificial Sequence
  Description of Artificial Sequence: Synthetic coding sequence
atgggggtgcggcatccgccttgttcgcacaggctcctggcagtgtgtgcactcgtgtcccttgcaaccgcggccctgctgcctcaaaattctaagattccgggaccaacttttctggatccccac

SEQ ID NO: 13037 - DNA, 126 bp, Artificial Sequence
  Description of Artificial Sequence: Synthetic coding sequence
atgggcgttagacacccaccatgcagtcaccgcctgctggccgtctgtgctctggtatccctagctaccgccgctctgctgccccagaacagtaagatcccaggccctaccttcctggaccctcac

SEQ ID NO: 13038 - DNA, 126 bp, Artificial Sequence
  Description of Artificial Sequence: Synthetic coding sequence
atgggcgttcggcaccctccctgctcccatcggctgcttgccgtatgtgcgctagttagcctggctactgccgctttattgccacaaaacagcaagatccctggtcccaccttcttagacccacac

SEQ ID NO: 13039 - DNA, 126 bp, Artificial Sequence
  Description of Artificial Sequence: Synthetic coding sequence
atgggagttaggcaccctccttgtagccatagattgctcgcggtctgcgctttggttagcctcgccacagcggctctgctgccacaaaactcgaagatcccaggacctaccttcctcgaccctcac

SEQ ID NO: 13040 - DNA, 126 bp, Artificial Sequence
  Description of Artificial Sequence: Synthetic coding sequence
atgggcgtcagacaccctccgtgctctcataggctgctggcggtgtgtgcccttgtgagccttgctactgcggccctgctgcctcagaattccaagatcccaggaccgacgttcctcgatccgcat

SEQ ID NO: 13041 - DNA, 126 bp, Artificial Sequence; identical to SEQ ID NO: 13014
  Description of Artificial Sequence: Synthetic coding sequence

SEQ ID NO: 13042 - DNA, 126 bp, Artificial Sequence
  Description of Artificial Sequence: Synthetic coding sequence
atgggagtcagacacccaccctgttcccatcgcctgctggcagtgtgtgcattggtcagcctcgccactgcagcgttgctcccacaaaactcgaaaataccgggacctaccttcctggatccacat

SEQ ID NO: 13043 - DNA, 126 bp, Artificial Sequence
  Description of Artificial Sequence: Synthetic coding sequence
atgggagtcaggcacccaccatgctcacaccgcttgctcgctgtgtgtgcactcgtgtcgttggcaactgccgctctgcttccgcagaacagcaagattccgggccctacgttcctggacccgcat

SEQ ID NO: 13044 - DNA, 126 bp, Artificial Sequence
  Description of Artificial Sequence: Synthetic coding sequence
atgggcgtgcgccacccgccgtgtagccatcgactgctagccgtatgcgcgctcgttagccttgcgacagccgccctcctgccgcagaactcaaagattcccggcccgacgtttctggatccccac

SEQ ID NO: 13045 - DNA, 126 bp, Artificial Sequence
  Description of Artificial Sequence: Synthetic coding sequence
atgggcgtccgacacccgccctgtagccaccgcctgcttgctgtctgtgcacttgtgtcgttggccaccgctgctctcctgccccagaactccaagattcctggccccacctttttggatcctcac

SEQ ID NO: 13046 - DNA, 126 bp, Artificial Sequence
  Description of Artificial Sequence: Synthetic coding sequence
atgggcgtgcgacatccgccatgctcacacagactcctggcagtctgcgcgctggtgtccctggcgaccgccgcgctgctgccccagaattcgaagatcccgggaccgactttcctggatccgcat

SEQ ID NO: 13047 - DNA, 126 bp, Artificial Sequence
  Description of Artificial Sequence: Synthetic coding sequence
atgggagtccggcacccgccttgcagccaccgactcttggcggtgtgcgctctcgtgtccctggcaactgcggcactgttgcctcagaactcaaagatcccaggaccgactttcctggacccacat

SEQ ID NO: 13048 - DNA, 126 bp, Artificial Sequence
  Description of Artificial Sequence: Synthetic coding sequence
atgggtgtgagacatcccccctgctcccatcgcctgttggccgtgtgtgcactggtcagccttgccactgcagccctgctgccgcagaactccaagattcctgggccaactttcctggatcctcat

SEQ ID NO: 13049 - DNA, 126 bp, Artificial Sequence
  Description of Artificial Sequence: Synthetic coding sequence
atgggtgtcagacatccaccgtgctctcatcgccttctcgcggtttgcgccctcgtatcccttgccacagccgcattgctgccccagaactcaaaaatccccggcccaacttttttggatccgcat

SEQ ID NO: 13050 - DNA, 126 bp, Artificial Sequence
  Description of Artificial Sequence: Synthetic coding sequence
atgggagtgagacaccctccctgttcccatcgattgctggcagtgtgcgcgctggtgagtctggccaccgccgcactccttcctcagaatagcaaaatcccaggcccaacattcctcgatccacac

SEQ ID NO: 13051 - DNA, 126 bp, Artificial Sequence
  Description of Artificial Sequence: Synthetic coding sequence
atgggtgtccgtcatcccccctgctcacacaggctactggctgtgtgcgcgcttgtgagtttggccaccgcagcactcctgccacaaaattctaagatacccggacccacttttcttgatccacac

SEQ ID NO: 13052 - DNA, 126 bp, Artificial Sequence
  Description of Artificial Sequence: Synthetic coding sequence
atgggcgtgagacacccaccatgttctcatagactgctggcagtgtgtgctcttgtctctctagccacggccgcactgctgccacagaactccaaaatcccgggaccgacttttctggacccccat

SEQ ID NO: 13053 - DNA, 126 bp, Artificial Sequence
  Description of Artificial Sequence: Synthetic coding sequence
atgggagtgagacaccccccttgctcgcatagactgcttgcagtgtgtgcactggtcagcctggcaactgcagcactcctcccccaaaattcgaaaatccctggccctacctttcttgatcctcac

SEQ ID NO: 13054 - DNA, 126 bp, Artificial Sequence
  Description of Artificial Sequence: Synthetic coding sequence
atgggagtgaggcaccctccgtgcagccatcgactgctggccgtctgcgccctggtgtcgttggcgactgccgctctgttgccacagaactcgaaaatccccggaccgaccttcctggacccgcac

SEQ ID NO: 13055 - DNA, 126 bp, Artificial Sequence
  Description of Artificial Sequence: Synthetic coding sequence
atgggagtgcgtcatcctccttgctctcacaggctgcttgccgtgtgtgccctcgtatccctggccaccgcagcgttgttgccacagaatagcaagattcccggacccactttccttgaccctcac

SEQ ID NO: 13056 - DNA, 126 bp, Artificial Sequence
  Description of Artificial Sequence: Synthetic coding sequence
atgggggttcgccatcccccttgttcccaccgtctgcttgcggtgtgcgcgttggtatctctagctaccgctgctcttttacctcagaactctaagattcccggaccaacctttctggacccacat

SEQ ID NO: 13057 - DNA, 126 bp, Artificial Sequence
  Description of Artificial Sequence: Synthetic coding sequence
atgggagttcgccatcctccatgttcccaccggctgctggccgtatgtgccctagtgtccttggctacagccgctctgttgcctcagaatagcaaaatcccggggcctactttcctcgatccacat

SEQ ID NO: 13058 - DNA, 126 bp, Artificial Sequence
  Description of Artificial Sequence: Synthetic coding sequence
atgggtgtaaggcatcccccatgcagccaccgtctgctggcggtttgtgcgctggtgagcttagccaccgccgccctgttaccgcagaacagcaaaattcctgggccaacctttctggacccgcat

SEQ ID NO: 13059 - DNA, 126 bp, Artificial Sequence
  Description of Artificial Sequence: Synthetic coding sequence
atgggggtgaggcaccccccgtgctcccaccggcttctcgccgtgtgtgcacttgtctcgctggccactgcagcgctcctcccgcagaattccaagatcccaggaccgacttttctggacccgcac

SEQ ID NO: 13060 - DNA, 126 bp, Artificial Sequence
  Description of Artificial Sequence: Synthetic coding sequence
atgggagtgcgacatcctccgtgctctcatcgcctgctcgcggtctgtgctttggtgtctctagccacggctgccctcctgccccagaattcgaaaattcctgggccgacgttcctcgaccctcat

SEQ ID NO: 13061 - DNA, 126 bp, Artificial Sequence
  Description of Artificial Sequence: Synthetic coding sequence
atgggcgtgcggcaccctccttgctcgcatcgactgttggctgtttgcgcccttgtctcactcgcgaccgcagcacttcttcctcaaaacagcaaaattccaggacccaccttcctggatccgcac

SEQ ID NO: 13062 - DNA, 126 bp, Artificial Sequence
  Description of Artificial Sequence: Synthetic coding sequence
atgggtgtgagacatccaccatgctcccaccgcctgctggcagtgtgcgcgttggtgagcctcgcgaccgctgcccttcttcctcagaactctaagatcccgggccccacgttcttggacccgcat

SEQ ID NO: 13063 - DNA, 126 bp, Artificial Sequence
  Description of Artificial Sequence: Synthetic coding sequence
atgggtgtgaggcatcccccatgctcgcacagactcctcgccgtttgtgcactggtgtccttggctaccgcggcactccttcctcaaaattcaaagattcccggaccaacgtttttggatcctcac

SEQ ID NO: 13064 - DNA, 126 bp, Artificial Sequence
  Description of Artificial Sequence: Synthetic coding sequence
atgggagtcagacatccaccatgttctcatcgattgcttgccgtgtgcgcacttgtctcgcttgcgactgctgcgctccttccccaaaactccaagattccagggcctacctttcttgatccacac

SEQ ID NO: 13065 - DNA, 126 bp, Artificial Sequence
  Description of Artificial Sequence: Synthetic coding sequence
atgggagtgcgccacccaccatgctcgcaccgcttactcgcagtatgtgctctggtaagtctagccacagccgccttactaccccagaactcaaaaatacccgggcctacattcctggatccccac

SEQ ID NO: 13066 - DNA, 126 bp, Artificial Sequence
  Description of Artificial Sequence: Synthetic coding sequence
atgggagtcagacacccgccttgcagccatcgcctgctcgcagtgtgcgccctcgtgagcctggcaactgctgccttgctccctcagaattccaagatcccggggcctactttcctggacccgcac

SEQ ID NO: 13067 - DNA, 126 bp, Artificial Sequence
  Description of Artificial Sequence: Synthetic coding sequence
atgggggtgcggcacccgccttgctcccaccgcctccttgcggtctgtgcccttgtgtctctggcaaccgctgccctcttgccacagaactcaaaaatcccaggacccactttcctggacccacat

SEQ ID NO: 13068 - DNA, 126 bp, Artificial Sequence
  Description of Artificial Sequence: Synthetic coding sequence
atgggcgtccgacacccgccttgctcccacaggctgctggctgtttgcgctctggtctccttggcaacagctgccctgcttccacagaatagcaagatccccgggcctaccttcctcgaccctcac

SEQ ID NO: 13069 - DNA, 129 bp, Artificial Sequence
  Description of Artificial Sequence: Synthetic coding sequence
atgggcgtgcgccatccaccctgctcgcatcggctgctggctgtgtgcgctttggtcagccttgcaaccgccgcactgctggcaaataccccttgtggaccttacacgcatgattgtccagtgaaaagg

SEQ ID NO: 13070 - DNA, 129 bp, Artificial Sequence
  Description of Artificial Sequence: Synthetic coding sequence
atgggcgtacgacatcctccatgctctcaccggctgctcgcagtgtgtgcgctcgtgtcccttgcgacagctgcgctactggccaacaccccctgcggtccgtacacacacgactgtcccgtgaaacga

SEQ ID NO: 13071 - DNA, 129 bp, Artificial Sequence
  Description of Artificial Sequence: Synthetic coding sequence
atgggagtgcggcatccgccttgctctcaccgactgctcgctgtgtgtgccttggtttctttggctaccgcggcactcctggcaaacaccccatgcgggccctatactcatgactgccctgtcaaacgg

SEQ ID NO: 13072 - DNA, 129 bp, Artificial Sequence
  Description of Artificial Sequence: Synthetic coding sequence
atgggagtgcggcacccaccttgctcgcaccggttgctcgctgtgtgtgccttggtgtcgctggcaaccgctgccctcctggcgaacactccatgcggtccgtacacccatgactgccccgtgaagaga

SEQ ID NO: 13073 - DNA, 129 bp, Artificial Sequence
  Description of Artificial Sequence: Synthetic coding sequence
atgggagttagacatccgccgtgctcgcacagactgctggccgtgtgcgcgctcgtgagcctcgctaccgcggccttgctggcgaacactccgtgcggaccgtacactcacgactgtccagtgaagagg

SEQ ID NO: 13074 - DNA, 129 bp, Artificial Sequence
  Description of Artificial Sequence: Synthetic coding sequence
atgggggtcagacacccaccgtgtagtcacaggctgctggcggtttgtgccctggtgtctttggccacggccgcactgttggccaacaccccctgcggcccatatacacacgactgtcctgttaaaagg

SEQ ID NO: 13075 - DNA, 129 bp, Artificial Sequence
  Description of Artificial Sequence: Synthetic coding sequence
atgggggttaggcaccccccctgctcccaccgtctcctggccgtgtgcgctctcgtgtctctcgcaacagcagccctgctggctaacacgccatgcggcccatatacccatgactgtcctgtgaagcgg

SEQ ID NO: 13076 - DNA, 129 bp, Artificial Sequence
  Description of Artificial Sequence: Synthetic coding sequence
atgggtgtgagacatccgccttgctcccatagattattagctgtatgtgcgttggtatccctggctacagctgctttacttgcgaataccccttgcggtccatatacgcatgattgccctgtaaagcgc

SEQ ID NO: 13077 - DNA, 129 bp, Artificial Sequence
  Description of Artificial Sequence: Synthetic coding sequence
atgggagtgagacatcccccatgttcgcataggctcttggcagtctgtgctctagtttccctggccaccgccgcactgcttgcaaatactccatgtggaccatacacccacgactgccccgtgaagcgg

SEQ ID NO: 13078 - DNA, 129 bp, Artificial Sequence
  Description of Artificial Sequence: Synthetic coding sequence
atgggagtcagacatcctccatgctcgcatcggctgttggccgtgtgcgcacttgtgtcgctcgccaccgcggccctgttggcgaacaccccatgcggcccatacacgcacgactgcccggtgaagcgc

SEQ ID NO: 13079 - DNA, 129 bp, Artificial Sequence
  Description of Artificial Sequence: Synthetic coding sequence
atgggtgttcgccatccaccttgttcgcatcgtctgctggcagtctgtgcacttgtcagcctcgctaccgcagcacttctggcgaatactccgtgcgggccttacacgcacgattgtcctgtgaagcgc

SEQ ID NO: 13080 - DNA, 129 bp, Artificial Sequence
  Description of Artificial Sequence: Synthetic coding sequence
atgggcgtccgccacccaccttgcagccatcggctgctcgcagtgtgcgcactcgtgagcctggccactgcagcattgctcgccaatacaccttgcggtccgtacacccacgactgcccagttaaacgg

SEQ ID NO: 13081 - DNA, 129 bp, Artificial Sequence
  Description of Artificial Sequence: Synthetic coding sequence
atgggtgtacgtcatccgccgtgttcgcatcgtctattagcggtatgtgcgctagtatcgttagcgacggcggcgttattagcgaatacgccgtgtggtccgtatacgcatgattgtccggttaaacgt

SEQ ID NO: 13082 - DNA, 129 bp, Artificial Sequence
  Description of Artificial Sequence: Synthetic coding sequence
atgggcgtccggcatcccccgtgtagccaccgcttgctggccgtgtgcgcactggtctccctggccacagcagcactgcttgcaaatactccgtgtggcccttacacacacgattgtcccgtgaagaga

SEQ ID NO: 13083 - DNA, 129 bp, Artificial Sequence
  Description of Artificial Sequence: Synthetic coding sequence
atgggtgtcaggcaccctccatgttcccatcggcttctcgcggtttgcgccctggtgtcgctcgccactgctgcattgctggcaaacaccccttgtggaccatacacccacgattgtccggtgaagaga

SEQ ID NO: 13084 - DNA, 129 bp, Artificial Sequence
  Description of Artificial Sequence: Synthetic coding sequence
atgggggtacgacatcctccgtgcagccaccgacttctggccgtgtgtgctctggtgtctttggcgacagccgctttgctggctaatacaccctgcggaccttacacgcatgactgccctgtgaaacgc

SEQ ID NO: 13085 - DNA, 129 bp, Artificial Sequence
  Description of Artificial Sequence: Synthetic coding sequence
atgggggtgaggcatcccccttgctctcatcgcctgttggccgtgtgcgcccttgtgagcctggccaccgccgcattgctagccaacacaccctgcggcccctatacacatgactgccctgttaagagg

SEQ ID NO: 13086 - DNA, 129 bp, Artificial Sequence
  Description of Artificial Sequence: Synthetic coding sequence
atgggagtccgccatccaccttgctcgcaccggctgctggctgtctgcgccctggtgtccctcgcaaccgcggctctcctggccaatactccttgtggtccttacacgcatgattgtcccgtgaagagg

SEQ ID NO: 13087 - DNA, 129 bp, Artificial Sequence
  Description of Artificial Sequence: Synthetic coding sequence
atgggcgttcggcatccaccatgtagtcatagacttttggctgtgtgtgctcttgtctcccttgcgactgcagctctgttagcaaatactccttgcggcccatacacacatgattgcccggttaaacga

SEQ ID NO: 13088 - DNA, 129 bp, Artificial Sequence
  Description of Artificial Sequence: Synthetic coding sequence
atgggcgtccgacatcctccctgctcacatagactgcttgcagtctgtgcgcttgtgtcgctcgcaactgcagccctgcttgccaacaccccatgtgggccatacactcatgattgtccggtcaagcgc

SEQ ID NO: 13089 - DNA, 129 bp, Artificial Sequence
  Description of Artificial Sequence: Synthetic coding sequence
atgggggttcggcatccaccttgctcccatcggctgctggccgtgtgcgccttggtgtcgctagctacggcagctttgctggccaatacaccctgcggcccgtacacacacgactgtccagtcaagaga

SEQ ID NO: 13090 - DNA, 129 bp, Artificial Sequence
  Description of Artificial Sequence: Synthetic coding sequence
atgggcgtaagacaccccccatgctctcaccgactgctggctgtttgcgctctggtgagtctcgcaacagctgccctgctggcaaacacaccttgcggcccttatacccatgactgccctgtcaagcgc

SEQ ID NO: 13091 - DNA, 129 bp, Artificial Sequence
  Description of Artificial Sequence: Synthetic coding sequence
atgggcgttcgccatccgccctgcagccaccgcctgctggctgtgtgtgcgttggtgtcacttgccactgcggctttgctggccaacactccgtgcggaccctacacccacgattgcccagtcaagcgg

SEQ ID NO: 13092 - DNA, 129 bp, Artificial Sequence
  Description of Artificial Sequence: Synthetic coding sequence
atgggggtgcggcaccctccctgtagccataggctcttagctgtttgcgccctcgtttctcttgccacagcggccctgctggccaacactccctgtgggccttatacacacgactgcccagtgaagaga

SEQ ID NO: 13093 - DNA, 129 bp, Artificial Sequence
  Description of Artificial Sequence: Synthetic coding sequence
atgggcgtgagacaccctccttgcagccacagactcctggctgtttgcgcactggtgagcctggccacagccgctcttctcgcaaacacaccttgcggtccctacacccatgattgcccagtgaagaga

SEQ ID NO: 13094 - DNA, 129 bp, Artificial Sequence
  Description of Artificial Sequence: Synthetic coding sequence
atgggggttagacaccctccatgttcccatcggttgcttgcagtatgcgcactcgtcagcctggcgacggctgccttgcttgcaaataccccatgcggaccatacactcatgattgtcccgtgaagaga

SEQ ID NO: 13095 - DNA, 129 bp, Artificial Sequence
  Description of Artificial Sequence: Synthetic coding sequence
atgggcgtccgtcacccgccgtgttcccatcgcctgctggcggtctgcgccctggtgtcgctcgccactgccgcactgttggcgaacacgccatgcgggccttacacccatgactgccccgtgaagaga

SEQ ID NO: 13096 - DNA, 129 bp, Artificial Sequence
  Description of Artificial Sequence: Synthetic coding sequence
atgggtgtgaggcatcccccatgcagccaccggctcctggctgtatgtgccttggtgtccctggcaacagctgcccttcttgccaacacgccttgtggaccatatacccacgattgcccggtgaagagg

SEQ ID NO: 13097 - DNA, 129 bp, Artificial Sequence
  Description of Artificial Sequence: Synthetic coding sequence
atgggagttagacatccgccctgcagccaccggctgctggcagtctgcgcgctggtgtcgctggccaccgccgccctgcttgctaacactccgtgtggtccttacacccacgactgtccagtgaagagg

SEQ ID NO: 13098 - DNA, 129 bp, Artificial Sequence
  Description of Artificial Sequence: Synthetic coding sequence
atgggcgtccgtcatcctccttgctctcatcggctactagccgtgtgtgctttggtatctcttgccaccgctgcgctccttgccaataccccgtgtggaccgtatactcacgattgtcccgttaaacgc

SEQ ID NO: 13099 - DNA, 129 bp, Artificial Sequence
  Description of Artificial Sequence: Synthetic coding sequence
atgggggtgcgccaccctccttgctcccacagattactggctgtatgcgcgttggtatcgctggctaccgcagcactgctggcaaacaccccctgtggaccctacactcacgattgccccgtgaaacga

SEQ ID NO: 13100 - DNA, 129 bp, Artificial Sequence
  Description of Artificial Sequence: Synthetic coding sequence
atgggagtgagacatcctccctgctcgcaccgccttctcgcagtgtgcgcgctggtgtcgctcgccactgccgctcttctcgctaatactccatgcggaccgtacactcacgactgcccggtcaagcgc

SEQ ID NO: 13101 - DNA, 129 bp, Artificial Sequence
  Description of Artificial Sequence: Synthetic coding sequence
atgggcgtccgtcacccaccatgttcccacagacttctcgcagtctgtgctttggtcagtctcgccacagccgccttactggcaaatactccctgcgggccgtatacccacgactgtcccgtgaagcgg

SEQ ID NO: 13102 - DNA, 129 bp, Artificial Sequence
  Description of Artificial Sequence: Synthetic coding sequence
atgggcgtaaggcacccaccgtgctctcacaggttgctggcagtatgcgcactggtgagcctggcgacagctgctctcctcgcaaatacgccttgcggcccctatacccacgattgccccgtcaaacgg

SEQ ID NO: 13103 - DNA, 129 bp, Artificial Sequence
  Description of Artificial Sequence: Synthetic coding sequence
atgggggttaggcaccctccctgttcacataggcttctagcagtgtgcgctttggtcagtctagccacagcagcccttctagctaacactccatgtgggccctatacacacgattgccctgtgaaaaga

SEQ ID NO: 13104 - DNA, 129 bp, Artificial Sequence
  Description of Artificial Sequence: Synthetic coding sequence
atgggagtgcggcatcccccgtgctcgcacagactgctcgccgtgtgtgcattggtgtccctggccaccgcggctctcctggcgaacactccgtgcggcccttacacccacgactgcccagtcaagcgc

SEQ ID NO: 13105 - DNA, 129 bp, Artificial Sequence
  Description of Artificial Sequence: Synthetic coding sequence
atgggcgtcagacaccccccttgtagccatcgtctgttggccgtctgcgctctggtgtccctggccactgcagcgcttctggcaaataccccgtgtgggccatacactcatgactgtcctgtcaagaga

SEQ ID NO: 13106 - DNA, 129 bp, Artificial Sequence
  Description of Artificial Sequence: Synthetic coding sequence
atgggggttaggcacccaccttgttctcatcgactgcttgccgtgtgcgcacttgtgtctttagccactgctgctctactagctaatacaccctgtgggccttatacacatgactgtcccgtaaaacgg

SEQ ID NO: 13107 - DNA, 129 bp, Artificial Sequence
  Description of Artificial Sequence: Synthetic coding sequence
atgggagtccggcaccctccttgcagccacaggctccttgccgtctgtgcgttggtttctttagcaaccgctgccttacttgccaacactccctgtggtccatacacacatgactgtccagtgaaaaga

SEQ ID NO: 13108 - DNA, 129 bp, Artificial Sequence
  Description of Artificial Sequence: Synthetic coding sequence
atgggggtcaggcacccgccctgctcccatcggttgctggcggtgtgcgctctggtgtctctggccaccgccgcgctgttggccaacactccatgtggtccatacactcacgattgcccagtaaagcgc

SEQ ID NO: 13109 - DNA, 129 bp, Artificial Sequence
  Description of Artificial Sequence: Synthetic coding sequence
atgggagtgaggcacccgccgtgcagccaccgcctgctggccgtctgtgccctggtctcactggccacagccgctctgctggccaacactccttgcggcccttatacacacgattgccctgtgaagaga

SEQ ID NO: 13110 - DNA, 129 bp, Artificial Sequence
  Description of Artificial Sequence: Synthetic coding sequence
atgggagtgaggcatcccccttgttcccaccgcctgttggccgtgtgtgccctcgtctcgcttgccaccgctgcactgctcgccaacaccccatgtggtccttacacccatgactgtccagtgaaaaga

SEQ ID NO: 13111 - DNA, 129 bp, Artificial Sequence
  Description of Artificial Sequence: Synthetic coding sequence
atgggagtgcggcaccctccgtgctcgcataggctcctcgctgtttgcgccctggtgtcgctggcaactgccgcgctgttggcgaataccccgtgcggtccttacactcacgactgtccagtcaagcgg

SEQ ID NO: 13112 - DNA, 129 bp, Artificial Sequence
  Description of Artificial Sequence: Synthetic coding sequence
atgggagtaaggcacccgccgtgctcccaccggcttttggcggtttgtgctctcgtgtcgctcgccactgccgcgctgctggccaacacgccttgcgggccatacacccatgactgcccggtgaagcgc

SEQ ID NO: 13113 - DNA, 129 bp, Artificial Sequence
  Description of Artificial Sequence: Synthetic coding sequence
atgggagtgagacatccgccatgctcccatcgacttcttgcagtttgtgccttagttagcttggcaacggctgctctactcgcaaacacgccatgcggaccgtatacccatgattgccctgtgaagaga

SEQ ID NO: 13114 - DNA, 129 bp, Artificial Sequence
  Description of Artificial Sequence: Synthetic coding sequence
atgggtgtgcgccatcctccttgcagtcacaggctgcttgctgtctgcgctctcgtaagtctcgcaaccgccgcacttctcgcaaacactccttgtggtccctatacacacgactgccccgtgaagagg

SEQ ID NO: 13115 - DNA, 129 bp, Artificial Sequence
  Description of Artificial Sequence: Synthetic coding sequence
atgggagtgcgccacccgccctgttcgcatcgtttgcttgccgtttgcgccctggttagcctggctaccgctgcgctcctggctaacactccgtgtggcccctacacccacgattgcccggttaagcgc

SEQ ID NO: 13116 - DNA, 129 bp, Artificial Sequence
  Description of Artificial Sequence: Synthetic coding sequence
atgggcgtcagacaccctccatgttctcaccgccttctggcagtgtgcgccctggtaagcctcgcgacagcggccttgctagcaaacactccctgcgggccatatacccacgattgtcctgtaaagcgt

SEQ ID NO: 13117 - DNA, 129 bp, Artificial Sequence
  Description of Artificial Sequence: Synthetic coding sequence
atgggtgtccggcatccaccttgcagtcatcgtctgctagctgtgtgcgccctggtgtctctggcaaccgctgctctgcttgccaacaccccatgcggcccatacacacacgattgccctgtgaagcgg

SEQ ID NO: 13118 - DNA, 129 bp, Artificial Sequence
  Description of Artificial Sequence: Synthetic coding sequence
atgggggtgcggcatccaccgtgctcacataggctgcttgcagtgtgtgcactcgtctcgctcgcgacggcggcacttctcgccaacactccctgtggtccatacactcacgattgtcctgtgaagcgc

SEQ ID NO: 13119 - DNA, 129 bp, Artificial Sequence
  Description of Artificial Sequence: Synthetic coding sequence
atgggagtgagacatccaccctgctcacacaggctccttgcagtctgtgcccttgtgtcccttgcaaccgctgccctgttggcaaacactccttgtgggccgtacacccatgattgtcctgttaagcgt

SEQ ID NO: 13120 - DNA, 129 bp, Artificial Sequence
  Description of Artificial Sequence: Synthetic coding sequence
atgggcgtgcgccaccctccctgttctcatcggctgttggcggtctgcgcactggtcagtctggccaccgctgccctgttagccaacactccttgcggtccctatacacacgactgccctgtgaagagg

SEQ ID NO: 13121 - DNA, 129 bp, Artificial Sequence
  Description of Artificial Sequence: Synthetic coding sequence
atgggggttaggcacccaccctgctctcaccggctcctggcggtgtgcgcacttgtgagtctggctactgcagccctgctggcgaatactccttgcgggccatacacgcacgactgccccgttaaacgt

SEQ ID NO: 13122 - DNA, 129 bp, Artificial Sequence
  Description of Artificial Sequence: Synthetic coding sequence
atgggcgtgagacatcctccatgcagccacagactcctagccgtgtgcgccctggtgagcttagcaactgccgcactattggccaacacaccctgcgggccttacactcacgactgcccagtgaaaaga

SEQ ID NO: 13123 - DNA, 129 bp, Artificial Sequence
  Description of Artificial Sequence: Synthetic coding sequence
atgggtgtgcggcaccctccatgttcgcacaggctcttggccgtctgcgcactcgtgtctctcgcaaccgcagccctgcttgctaacaccccatgtggcccatacactcatgattgccctgttaagcgc

SEQ ID NO: 13124 - DNA, 129 bp, Artificial Sequence
  Description of Artificial Sequence: Synthetic coding sequence
atgggcgtgaggcaccctccgtgtagccataggcttctggcagtttgcgcactcgtttccctggctacagccgcactgttggcaaacaccccttgcggaccgtacacgcatgactgtcccgttaaaagg

SEQ ID NO: 13125 - DNA, 129 bp, Artificial Sequence
  Description of Artificial Sequence: Synthetic coding sequence
atgggagtgaggcacccaccctgctcgcatcgcctgctggcagtatgcgctctagtgagccttgcgaccgcggccctgctggcaaacactccatgtgggccatatacacacgactgcccggtgaaacgg

SEQ ID NO: 13126 - DNA, 129 bp, Artificial Sequence
  Description of Artificial Sequence: Synthetic coding sequence
atgggcgtccgtcacccaccctgtagtcataggttactggctgtgtgcgctttggtatcactggccacagctgcactgcttgcaaacacaccctgcggcccatacacgcacgattgtccagtgaagagg

SEQ ID NO: 13127 - DNA, 129 bp, Artificial Sequence
  Description of Artificial Sequence: Synthetic coding sequence
atgggcgtgcgtcatcccccctgtagccataggcttcttgccgtctgtgcactggtgtcgctggcaactgctgcactcctcgcgaacaccccttgtgggccgtacactcacgactgtccggtgaagaga

SEQ ID NO: 13128 - DNA, 129 bp, Artificial Sequence
  Description of Artificial Sequence: Synthetic coding sequence
atgggagtacgccaccccccctgctcccatagactgttggcagtgtgtgcactcgtgtcactggccacagctgcgctgctggcgaacaccccttgcggaccctacactcacgattgtcccgtgaagcgc

SEQ ID NO: 13129 - DNA, 129 bp, Artificial Sequence
  Description of Artificial Sequence: Synthetic coding sequence
atgggagtgcggcacccgccttgttcgcatcgcctgctggcagtgtgcgcgctcgtctcactcgcgaccgcagctctgctggccaacactccttgcggcccctacacccacgactgccccgttaaaaga

SEQ ID NO: 13130 - DNA, 129 bp, Artificial Sequence
  Description of Artificial Sequence: Synthetic coding sequence
atgggagtgcgccatcctccatgttcccaccgactgctcgctgtgtgcgcacttgtgtctctggccactgcagccctgctcgcaaacactccttgcggcccctacacacatgattgcccggtgaaaaga

SEQ ID NO: 13131 - DNA, 129 bp, Artificial Sequence
  Description of Artificial Sequence: Synthetic coding sequence
atgggcgttaggcatccaccttgtagccaccgcttgctcgccgtctgcgcacttgtgagtctggcaactgccgcactccttgcaaatactccatgtggtccctatacccacgattgtccggtgaagcga

SEQ ID NO: 13132 - DNA, 129 bp, Artificial Sequence
  Description of Artificial Sequence: Synthetic coding sequence
atgggcgtccgacaccccccgtgctcccaccgcctgcttgcggtgtgtgcactcgtgagtctggccacagcggccctgctggccaacactccttgtggtccttatacccacgactgccccgtgaaacgc

SEQ ID NO: 13133 - DNA, 129 bp, Artificial Sequence
  Description of Artificial Sequence: Synthetic coding sequence
atgggcgtccgccatcccccctgctcacaccggctgctcgcggtctgcgctctggtgagccttgccactgcagcgctgctggccaacaccccgtgtggcccttacacccatgattgcccagtgaaacga

SEQ ID NO: 13134 - DNA, 129 bp, Artificial Sequence
  Description of Artificial Sequence: Synthetic coding sequence
atgggagtgcggcacccaccctgttcgcatcggcttctcgcagtttgtgcactggtcagcctggccaccgcggctctcctggcgaataccccctgtggtccttacactcacgactgcccagtgaaacgc

SEQ ID NO: 13135 - DNA, 129 bp, Artificial Sequence
  Description of Artificial Sequence: Synthetic coding sequence
atgggcgtgaggcaccccccttgtagccatagactcctggccgtgtgtgctctcgtgtctttagccacagctgctcttttggctaacacaccatgtggaccatatactcacgactgccctgtcaagcgg

SEQ ID NO: 13136 - DNA, 129 bp, Artificial Sequence
  Description of Artificial Sequence: Synthetic coding sequence
atgggagtccggcatccgccatgcagccacagactgcttgcagtgtgtgccctcgtgtcgctggcgactgcggctctgctcgccaacaccccctgcggtccgtacactcacgattgtcctgtgaaacgg

SEQ ID NO: 13137 - DNA, 129 bp, Artificial Sequence
  Description of Artificial Sequence: Synthetic coding sequence
atgggagtgagacatcctccgtgttcgcatcggctcctggcggtgtgcgccttggtgtcactggccactgcagcccttcttgctaacaccccctgcggtccgtacacgcacgattgccccgttaagcgg

SEQ ID NO: 13138 - DNA, 129 bp, Artificial Sequence
  Description of Artificial Sequence: Synthetic coding sequence
atgggagtgcggcatcctccttgcagccataggctgctggctgtgtgtgccctagtgagtctggctactgcagcactgctggccaacaccccttgtggcccctacacacacgactgcccagtcaaacgc

SEQ ID NO: 13139 - DNA, 129 bp, Artificial Sequence
  Description of Artificial Sequence: Synthetic coding sequence
atgggcgtgagacacccgccgtgttcacataggctcctggcggtctgtgccctggtgagccttgcgaccgccgctttgctcgcaaacaccccatgcggaccgtacacccacgattgcccagtgaagcgg

SEQ ID NO: 13140 - DNA, 129 bp, Artificial Sequence
  Description of Artificial Sequence: Synthetic coding sequence
atgggcgtgcgccacccaccatgcagccatcggctcctcgcggtgtgcgcactcgtctcactggccaccgccgccctgctggcaaatacgccgtgcggaccgtacactcacgactgtccagttaaaagg

SEQ ID NO: 13141 - DNA, 129 bp, Artificial Sequence
  Description of Artificial Sequence: Synthetic coding sequence
atgggagtcagacatcctccatgttcccaccgccttctcgcagtgtgtgcactcgtgagtcttgcaactgcggcccttcttgctaacaccccgtgcggcccatacacgcatgattgtccagtgaagagg

SEQ ID NO: 13142 - DNA, 129 bp, Artificial Sequence
  Description of Artificial Sequence: Synthetic coding sequence
atgggagttcggcaccccccatgctcacatcgtttgctcgctgtatgtgccctcgtgagcctggccacggctgctctattggcaaatactccctgtggtccttacacccacgattgcccggttaaaagg

SEQ ID NO: 13143 - DNA, 129 bp, Artificial Sequence
  Description of Artificial Sequence: Synthetic coding sequence
atgggggtgcgccaccccccttgtagtcatcggctgttggctgtatgcgcactggtcagcctagcaaccgctgctctgttggccaataccccttgcggaccctatactcatgattgtcctgtgaaaagg

SEQ ID NO: 13144 - DNA, 129 bp, Artificial Sequence
  Description of Artificial Sequence: Synthetic coding sequence
atgggtgtgcgccaccccccttgctcgcatcgtctgctcgcagtgtgcgccctggtatccttggcaactgcggccctgctcgccaacaccccatgtgggccgtacacgcacgactgcccggtcaagaga

SEQ ID NO: 13145 - DNA, 129 bp, Artificial Sequence
  Description of Artificial Sequence: Synthetic coding sequence
atgggagtcaggcaccctccttgttcccaccgcttgttggcggtgtgcgcccttgtgagcctggccactgccgcactcctggccaacactccgtgtggcccctacactcacgattgcccggtgaagcgg

SEQ ID NO: 13146 - DNA, 129 bp, Artificial Sequence; identical to SEQ ID NO: 13116
  Description of Artificial Sequence: Synthetic coding sequence

SEQ ID NO: 13147 - DNA, 129 bp, Artificial Sequence
  Description of Artificial Sequence: Synthetic coding sequence
atgggcgtgcgacacccaccttgctcacatagactcctggcagtgtgtgcattggtgtccttggctactgccgctcttctggcgaacacgccttgtggaccatacacccatgattgccctgtgaagcgg

SEQ ID NO: 13148 - DNA, 129 bp, Artificial Sequence
  Description of Artificial Sequence: Synthetic coding sequence
atgggagtgcgccaccccccttgttcccatcggctgttggctgtgtgcgcgctggtgtcactggccactgccgccctgcttgccaacacaccctgtggcccttacacacacgattgccctgtgaagcgc

SEQ ID NO: 13149 - DNA, 129 bp, Artificial Sequence
  Description of Artificial Sequence: Synthetic coding sequence
atgggagtcagacacccaccgtgctcccatcgcctccttgcggtgtgtgcccttgtgtcactggctactgcggccttgctcgcaaacacgccgtgtggaccatacactcacgactgtcccgtgaagcgc

SEQ ID NO: 13150 - DNA, 129 bp, Artificial Sequence
  Description of Artificial Sequence: Synthetic coding sequence
atgggagtccgtcatccgccctgctcccacagactgctagccgtatgcgccctagtgagtttggctacggccgctttgctagcaaatactccttgcggaccatacacgcacgattgcccggtaaagcga

SEQ ID NO: 13151 - DNA, 129 bp, Artificial Sequence
  Description of Artificial Sequence: Synthetic coding sequence
atgggtgtcagacaccccccatgcagccatcgcctgttggccgtctgcgcccttgtgtctctggccacggcagccctcctcgcgaacaccccttgtggaccgtacacacacgactgcccagtgaaaaga

SEQ ID NO: 13152 - DNA, 129 bp, Artificial Sequence
  Description of Artificial Sequence: Synthetic coding sequence
atgggagttagacatccaccatgctcacatagactacttgcagtttgtgctcttgtttcattagcaactgcagctttattagcaaacacaccatgtgggccttatactcatgattgtccagttaaaaga

SEQ ID NO: 13153 - DNA, 129 bp, Artificial Sequence
  Description of Artificial Sequence: Synthetic coding sequence
atgggtgtccgccatccaccctgctcgcatcgtttgctggcagtgtgtgcgctggtgtcccttgcaaccgcagcacttctggcaaacactccttgcggcccatatactcatgattgtccagtgaagcgg

SEQ ID NO: 13154 - DNA, 129 bp, Artificial Sequence
  Description of Artificial Sequence: Synthetic coding sequence
atgggagtgcgccatcccccctgctcacatcggctccttgctgtgtgtgcgcttgtcagccttgcaaccgcagcacttctggccaacaccccttgcggaccttacactcacgattgcccggtgaaacgc

SEQ ID NO: 13155 - DNA, 129 bp, Artificial Sequence
  Description of Artificial Sequence: Synthetic coding sequence
atgggggtgaggcaccctccctgtagccatcgacttctggccgtgtgtgctctggtatcactggcgacggcagctctgttggccaacacaccttgtgggccgtacacgcatgattgccccgtgaagaga

SEQ ID NO: 13156 - DNA, 2109 bp, Artificial Sequence
  Description of Artificial Sequence: Synthetic coding sequence
atgctgcggggccgctccctgtcggttactagcttgggtggactgcctcaatgggaagtggaggagcttcctgtggaagagttgcttctgtttgaagtcgcatgggaggtgaccaacaaggtgggaggtatttacaccgtgatacaaaccaaggcaaagaccaccgcagatgaatggggtgagaattactttctgattggcccttactttgagcataacatgaaaacccaggtggagcagtgtgaacctgtgaatgatgcagtcagacgagccgtggatgcaatgaataaacatggttgccaggtgcattttggaaggtggcttatcgaaggttccccttacgtcgtcctgtttgacattgggtacagcgcatggaatctggatagatggaaaggggacctttgggaagcgtgttcagtgggcatcccataccacgatagagaggcgaatgacatgctgatctttggttcccttaccgcttggttcctgaaggaagtgactgaccatgcagatggaaagtatgtcgtggcccaatttcacgaatggcaggctggtatcgggcttattctttcgcgggcccggaagctgccgattgctaccattttcactacccacgcaacgctcctgggaagatacctctgtgcagccaatatcgatttctacaaccaccttgataagttcaacattgataaggaagcgggagaacgccagatatatcacaggtattgcatggagcgcgcgagcgtccattgcgcgcatgtctttactaccgtgtccgagattaccgcaattgaggccgaacacatgctcaaaaggaaacctgatgtggtcaccccaaacggactgaacgtgaagaagttttcagccgtccacgagtttcaaaatctgcacgctatgtacaaggcgcgaatacaagatttcgtccggggccatttctacggacatctcgatttcgacctggaaaagaccctgttcctctttatagcaggtaggtacgagttttcaaacaagggagcggacatatttctggagtcgctctcgagactgaactttctccttcgaatgcataagtcggacataactgtgatggtgtttttcattatgcccgcaaaaaccaacaatttcaacgtggaaacccttaaaggtcaagcagtgcggaagcagctgtgggatgtggcacattccgtcaaggagaagtttgggaaaaagttgtacgatgcacttctgagaggagagattcctgacctgaatgacatcctcgatagagatgatctgaccatcatgaagcgggccattttctcaactcaaaggcaaagcctgcctcccgtgaccacccataacatgattgacgattcaaccgaccctatcctcagtaccatccggcgcatcggactgttcaataacagaactgacagagtcaaggtgattctgcatcctgaattcctttcgtccacttcgcctctgcttccaatggattacgaggagttcgtccgcggctgtcatctcggagtgtttccgtcctactacgaaccatggggatacactcctgcagaatgtaccgttatgggcatcccttcggtgactactaatctgtcgggttttggatgttttatgcaagaacacgtcgcagaccctaccgcgtatggaatctacatcgtggatcggagattcagaagccccgatgattcctgcaaccagctcaccaagtttctgtacggattttgcaagcaaagcagaaggcagagaatcatccagcgtaaccgaaccgaacggctcagcgaccttctcgattggaggtaccttggccgatactaccaacatgcaagacacctcacgctttccagagcgttcccagacaaatttcacgtggagcttacttccccacctaccaccgagggcttcaagtaccctcgaccttccagcgtgccgccgtcaccatcaggaagccaagcaagctcacctcaatcatccgatgtggaagatgaggttgaagatgagcggtacgacgaagaagaggaagcagaacgggatcgcctgaacattaagtccccattttcactcagccacgtccctcatggtaagaagaagctgcatggagaatacaaaaat

SEQ ID NO: 13157 - DNA, 2109 bp, Artificial Sequence
  Description of Artificial Sequence: Synthetic coding sequence
atgttgcgagggagaagcttgtctgtgacgagcctgggaggcctgcctcagtgggaggtagaagagctccccgttgaagagctactactgttcgaggttgcctgggaggttactaacaaggtcggcggcatatatactgtaatacagaccaaggctaagactaccgcagacgagtggggcgaaaactacttcctgatcgggccgtatttcgagcataatatgaagacccaggtggagcagtgcgaacctgtgaatgatgcggtgcgccgagcagtggatgccatgaacaagcacggatgtcaggtccactttggccgttggctcatcgaggggagcccatacgttgtgctgttcgatatcggctatagcgcctggaatttggatcgttggaagggcgacctttgggaggcctgttccgtcggaatcccttaccacgatagggaggcgaatgatatgctaattttcggatcacttaccgcctggtttctgaaggaagtaaccgatcacgctgatggcaaatatgtggttgcgcagttccacgagtggcaggctgggataggtctcatactcagcagagcgagaaaactccccatagcaactattttcacgacccatgccaccttgctaggcaggtatctttgcgcagcaaatatagacttctataaccatctggacaaattcaacatagataaggaggctggtgagagacaaatttaccaccgatactgcatggaacgtgcttccgtgcactgtgctcatgtgtttacaaccgtctcagagataacagctatcgaagccgagcatatgcttaagcgaaagcccgatgtggtgacacccaacggcctaaatgtcaagaaatttagcgccgtgcatgagttccagaacctccatgcaatgtacaaagcccgaattcaggattttgtcagagggcacttttacgggcacttagattttgacctggagaagaccctattcctgttcatcgccggccgatacgaattctccaacaagggtgccgacatcttcttggaatccctttcacgactcaacttcctactacgaatgcacaaatctgatattactgtgatggtcttctttattatgccagccaagactaataacttcaatgtggagacgttgaaaggtcaggccgttaggaaacagctctgggatgtggcgcacagcgtgaaagagaagtttggcaagaagctgtacgacgcattgctgcgaggtgaaatccccgaccttaatgacatcctggatagagatgacctcactattatgaagcgtgctatttttagtacgcaacgtcagagtttgccccctgtgaccacacataatatgattgatgacagcacagatcccattcttagcaccataagaaggatcgggctgttcaataatcgtacagatagggttaaggtcatccttcaccctgaatttctttcttcgacttcccctctgctgcccatggactacgaggaattcgtgaggggatgccaccttggtgtgttcccgtcctattatgagccctgggggtatacccctgcagagtgcaccgtcatggggatcccttcggtgaccaccaatctatcaggcttcggatgtttcatgcaggaacacgttgcagaccccaccgcgtatggaatatatatcgtggataggagatttcgatctccagatgactcctgtaaccagctcacaaagttcctctatggtttttgcaagcagtctaggaggcagagaattattcagcgaaaccgtacagaaagactgtccgacctgctcgattggcggtatctgggtcgatactaccagcatgcacggcatctcacacttagcagggccttccccgataagtttcatgtggaacttacttctcctccgactactgaaggctttaaatatccgagaccttccagcgtgcctcctagcccaagtgggtcacaggcgagtagcccgcagtcaagtgatgtggaagacgaagtggaggacgaacgatacgacgaagaggaagaggctgaaagagaccgcttaaacatcaagtctccatttagcctgagtcatgtgcctcacggcaagaagaagctgcacggagagtacaaaaat

SEQ ID NO: 13158 - DNA, 2109 bp, Artificial Sequence
  Description of Artificial Sequence: Synthetic coding sequence
atgctgcggggaagatcactttccgtgacctcccttgggggacttcctcagtgggaagtcgaagagctgccggtggaagaactgctgctctttgaagtggcttgggaagtgactaacaaggtcggtggcatctacaccgtcatccagaccaaggcaaagaccactgccgatgagtggggtgagaattactttctgattggtccatactttgaacataacatgaaaactcaagttgagcaatgtgaaccagtcaacgatgcagtcagaagagcagtggacgctatgaataagcacggatgtcaggtgcattttggtaggtggctgattgagggttccccttacgtcgtgttgttcgacattgggtactcggcatggaaccttgacaggtggaaaggggatctctgggaagcctgctccgtcggaattccttaccatgaccgcgaggccaatgatatgcttatcttcgggtccttgaccgcttggtttctgaaggaagtgactgatcacgcagatgggaaatatgtcgtggcacaattccacgaatggcaagcaggaatcggccttatcctttccagagcacgtaaactccctatagcgaccatattcactacccatgcaacccttctcggacggtacctgtgtgccgccaacattgacttttacaatcacctggataagttcaacattgataaggaagcaggagagagacagatctaccatcggtactgtatggaaagggcgtcagtccactgtgcacatgtgtttacgaccgtcagcgaaattacggcaattgaagcagagcatatgctgaagagaaaacccgatgtggtgactcctaatggattgaatgtgaagaagttttcggccgtccacgaatttcagaacctgcatgccatgtacaaggcacgtatacaagattttgtgcgaggtcatttctatggacatctcgattttgatttggaaaagaccttgtttttgtttattgcaggccgctatgaattttccaataagggtgcagacatttttcttgagtcactgtcgagactgaacttcctccttcggatgcataagtcggatattactgtgatggtgtttttcatcatgcctgcaaagaccaacaactttaacgtggaaactttgaaggggcaagcagtccgcaagcaactctgggacgtggcgcattctgtcaaagagaagttcggtaaaaagctgtacgatgcactgcttcgaggtgaaatcccggaccttaatgacattctggatagggatgatctcaccatcatgaagagagctattttctcaactcaacgtcagtcgctgcctcctgtcactactcacaatatgatcgatgattccacggaccctatcctctcgaccataaggcgcatcggtttgtttaacaaccggactgacagggtcaaggtgatcctccatccagaattcctctcgtcaacgtcccccctgcttcccatggactacgaagaatttgtcaggggctgtcatctcggtgtgtttccttcctactacgagccctggggatacaccccagctgaatgtaccgtcatggggattccttcggtgacgactaacctttccggatttgggtgttttatgcaagaacacgtcgctgaccctaccgcatacggaatctacattgtggaccggagattcaggagcccagatgactcctgcaaccagctgaccaaatttctctatggattctgcaagcaatcaagacgacaaagaatcattcaacggaaccgcaccgagcgtctttcagatcttctggattggaggtacttggggagatactaccagcatgcgcgccatctcactttgagccgagccttccctgataagttccacgtagagttgacctcgcccccaactaccgaggggtttaagtacccacggccctccagcgtgccgccttctccgtcaggatcccaagcgtcctcaccacagtcatcggacgtggaggatgaagtggaggatgagaggtacgacgaggaggaagaagccgagagagatagactcaacatcaagtcgcccttctccctgtcgcatgtgcctcacgggaagaagaagctgcacggagagtacaaaaac

SEQ ID NO: 13159 - DNA, 2109 bp, Artificial Sequence
  Description of Artificial Sequence: Synthetic coding sequence
atgttaagaggaagatcattgtcagttacatcattgggaggtttaccacaatgggaagtagaggaattaccagtagaagaacttttgttattcgaagttgcatgggaagttactaataaagtaggaggaatttatacggttattcaaacaaaggctaaaactacagctgatgaatggggagaaaattattttttaattggaccatattttgaacataatatgaaaactcaagttgaacaatgtgaaccagttaatgatgcagttcgtagagctgttgatgctatgaataaacatggatgtcaagttcatttcggtagatggcttatcgaaggaagtccttatgttgttttatttgatattggatattctgcatggaatttagatagatggaaaggagacctttgggaagcatgttcagttggtattccttatcacgatagagaagcaaatgatatgttaatttttggatctcttactgcttggttcttgaaggaagtaactgatcatgcagatggaaaatacgttgttgctcagtttcatgaatggcaagccggaatcggtttaattctttcaagagctagaaaacttccaattgcaaccatttttacaactcacgctactttacttggtagatatttatgtgcagctaacattgatttttataatcacttagataagtttaatattgataaagaagctggtgaaagacaaatttatcatagatattgcatggaaagagcatctgttcattgcgctcatgtatttactacagttagtgaaataactgcaattgaagcagaacatatgttaaagagaaagccagatgtagtaactccaaatggattaaacgtgaaaaaatttagtgcagttcatgaattccaaaatttacatgccatgtataaagctaggatacaagatttcgttagaggacacttttatggacatcttgattttgatcttgaaaaaactttatttctttttatagccggtcgttacgaattctcaaacaaaggagcagatatttttttagaatcattaagtaggttaaatttccttttaagaatgcataaatcagacattactgtaatggttttttttattatgccagcaaaaactaataattttaatgttgaaacattaaaaggtcaagctgttagaaaacaactttgggacgttgctcattcagttaaagagaaattcggaaaaaaactttatgatgcacttttacgtggagaaattccagatcttaacgacatattagatagagatgatttaacaattatgaagagagcaatattttcaactcaaagacaatcacttccaccagttactactcataatatgattgatgactcaactgatccaatcctttctacaattagacgaattggactttttaataatagaacagacagagttaaagtaattcttcatcctgaatttctttcatctacatcaccacttttaccaatggattatgaagaatttgtaagaggatgtcatttaggagtgtttccaagttattatgaaccatggggatatacaccagctgaatgtacagttatgggaattccttcagttactactaatctttctggatttggatgtttcatgcaagaacatgtagctgatccaactgcttatggaatctatattgttgacagaagattcagatctccagacgattcatgtaatcaacttacaaaatttttatatggtttttgtaaacaaagccgtagacaaagaataattcaaagaaatagaactgaaagattgtcagatttattagattggagatatcttggtagatattatcaacatgctagacatcttactctttctagagcatttccagataaatttcatgtagaacttacaagtccaccaacaacagaaggatttaaatacccaagaccatcttctgttccaccttcaccaagcggatcacaagcatcttctccacaatcatcagatgttgaagacgaagttgaagatgaaagatatgatgaagaagaagaagcagaaagagatagattaaatattaaatctccttttagtttatctcatgtaccacatggaaaaaaaaagttacatggtgaatataaaaat

SEQ ID NO: 13160 - DNA, 2109 bp, Artificial Sequence
  Description of Artificial Sequence: Synthetic coding sequence
atgctgaggggcaggtctctatcggtgacgtcgctgggcggtttgccgcaatgggaggtggaggagctccctgtcgaggagcttctgctgtttgaggttgcctgggaggtaaccaataaggttggcggcatctataccgtcatccagactaaggccaagaccacagccgacgagtggggtgagaactactttctgataggtccgtattttgagcacaacatgaagacacaagtggagcagtgtgagcccgtcaacgatgccgtgcgtagagccgttgacgcaatgaacaagcacggttgccaggttcacttcggtcgctggctgattgagggctctccctacgtcgtcctgttcgacatcggctactcagcttggaacctcgatcgttggaaaggcgatctctgggaggcttgctctgttggtatcccttaccacgatcgtgaggccaacgacatgctgatcttcggttctctcactgcctggttccttaaggaggttactgaccacgcagatggcaagtacgtggtagcgcagttccacgagtggcaggccggtatcggtctcattctaagccgtgcccgcaagttacctatcgcaaccatattcaccactcatgcgactcttttgggacgctacttgtgcgccgcaaatattgatttttataaccatttggacaagttcaacattgataaggaagctggtgagagacagatctaccaccgttactgtatggagcgtgcctcggtccactgcgcccatgtcttcaccacggtgtcggagatcaccgccatcgaagccgaacacatgctgaagcggaaacctgacgtcgtgacccccaacggcctaaacgttaagaagttctctgctgtccatgagtttcaaaacctccatgccatgtacaaagcccgcatccaagacttcgtccgcggacacttctacggccacctcgatttcgatttggaaaagacactgtttctattcatcgcgggaagatacgaattctctaataagggagccgacattttcctggagtcgctctcccgtttgaacttccttctccggatgcataagtctgacatcaccgtcatggtgttcttcatcatgcctgccaagaccaacaacttcaacgtggagactctcaagggtcaggctgtgcgtaagcaactttgggatgttgcacactccgtcaaggagaagtttggtaagaagttatacgacgctcttcttcgtggcgagattcccgacctgaacgatatccttgatagggacgatcttaccattatgaagcgtgctatcttctcaacgcagcggcagtctctcccgcctgtaacgacgcataatatgattgacgattctacggacccaatccttagcacaatccgtaggatcggcttattcaacaacaggacggaccgcgtcaaggtgattctccaccccgagtttttgagtagtacgagcccattgctgcctatggattacgaggaatttgtgcggggttgccacctcggtgtcttcccttcctactatgagccgtggggctatacccccgccgagtgcactgtcatggggatcccttccgtcactacgaacctttccggttttggctgtttcatgcaagaacacgttgctgaccccaccgcctacggcatctacattgtagacaggcgctttcgcagccccgatgactcttgcaaccagttgaccaaattcctctacggtttctgcaaacaatctcgccggcaacgcatcattcagcgtaaccgcaccgaacgtctatccgatctcctcgactggcgctacctcgggaggtactaccagcatgcccgtcacctcacactttccagggcattcccggacaagttccacgtcgagctcacctctccccctacaacggagggttttaagtatccgcgcccaagctccgttcccccgtccccctcgggtagccaagcaagttcaccccagtcctcggacgttgaggacgaagtggaggacgagcgctacgatgaggaggaggaggccgagcgcgaccgtcttaacatcaaatctccgttttctctgtctcatgtaccccatggcaagaagaagctgcatggcgagtacaagaac

SEQ ID NO: 13161 - DNA, 2109 bp, Artificial Sequence
  Description of Artificial Sequence: Synthetic coding sequence
atgttgcgagggcgcagcctgtctgtgacaagtttggggggcctcccacagtgggaggtggaagagctgcctgtggaagaactgttgctgtttgaagtggcgtgggaggtgaccaacaaagtcggggggatatacacggtgatccagacaaaagcaaaaacaacagccgatgaatggggtgagaactatttccttataggcccttactttgaacataacatgaaaacccaggtggagcagtgcgagccagttaacgatgccgtgcgacgggcggtggacgcgatgaacaaacacggatgccaggttcatttcgggagatggcttatagagggttccccatacgttgtgctcttcgatataggctatagcgcgtggaatctggaccggtggaaaggcgatctctgggaggcttgttccgtcggcatcccgtatcacgatagagaggctaacgatatgctgattttcgggagcttgaccgcctggttcttgaaggaagtgaccgaccacgctgacggcaaatatgtcgttgcccagttccatgagtggcaggccggtattggtttgatactctctcgcgccaggaagcttcccatagctaccatcttcaccacccacgcaacccttttgggtaggtacttgtgcgcagctaatatcgacttttacaatcatctcgacaagtttaacatcgataaggaggctggggaaaggcagatataccatcgatattgtatggagagagcaagcgtccactgcgcccacgtgtttaccactgtttcagaaataaccgccatcgaggctgagcatatgttgaaacgtaagcctgatgtcgttacccccaacgggctgaacgtgaagaaattctcagccgtccacgagtttcagaacctccacgcgatgtataaggcccgaatacaggacttcgtacgcgggcatttttacgggcacctagactttgatctcgaaaagacactgtttctgtttattgctgggcggtacgagttttctaacaagggggcggatatcttcctcgaaagtcttagccgcctgaactttcttctcagaatgcataagtcagatattacagtaatggtcttctttataatgcctgcaaaaacgaataatttcaacgtggagaccctgaagggacaggccgtgagaaaacagttgtgggacgtggcccactctgtgaaagaaaagtttgggaagaagctttatgacgccctgctgagaggtgagattccagatttgaacgacatcctcgaccgggatgacctgacaataatgaaacgagccattttctcgacacagcgtcagagtctcccccccgtgacaacccacaatatgatcgacgactcaaccgacccaattttaagcactattagaaggattggattgttcaataaccgaacggatcgggtcaaggtgatcctgcacccggaattcttaagctccaccagcccacttctccccatggactatgaagaattcgtgaggggctgccatctcggtgtgtttcctagttattacgaaccttggggatatacccctgcggagtgtacggtgatgggcatcccttcagtcacgaccaacttaagtggttttgggtgtttcatgcaggagcatgtagccgaccccacggcctatgggatctacatagtggataggagatttcggtcacctgacgattcctgcaaccagttgacaaagtttctttatggtttctgcaaacagtcccgacggcagagaattatacaaaggaatcgcactgaaaggctttccgatctgctggactggagatatcttggtagatactaccaacacgcccgccacttgacactgagtcgcgccttccccgataagttccatgtagagctgaccagtcctcccaccacggagggctttaagtatccgagaccctccagtgtcccgccatccccctcggggtcgcaggcctcttccccccagtccagtgacgtggaggacgaggtggaggatgaaaggtacgacgaagaggaggaagctgaacgggatcgcttaaatattaagtcccccttctcactgagtcatgtgccccatgggaagaagaagctgcatggcgaatacaaaaac

SEQ ID NO: 13162 - DNA, 2109 bp, Artificial Sequence
  Description of Artificial Sequence: Synthetic coding sequence
atgcttcgcggacgctcgctttccgtaacttctcttggaggtctgccgcaatgggaagtggaagaactcccggtggaagaactattgttatttgaagttgcttgggaagtgacgaacaaagttggtggcatttataccgttattcagacaaaagcgaagactacggccgatgaatggggtgaaaactatttcctgattgggccgtattttgaacacaatatgaaaacacaagtagagcagtgcgagccggtgaacgatgctgttcgacgggccgtggacgctatgaataaacacggttgccaagtacactttggtcggtggttgatcgaaggtagcccttatgttgtcctctttgatattgggtactcggcctggaatttagatcgatggaaaggcgatctctgggaggcctgctctgttggcataccttaccatgatcgcgaagctaacgacatgttaatctttggatcacttacggcatggtttctgaaagaagtaacagatcatgcagatggaaagtatgtcgtagctcaattccacgaatggcaagccggaatcggcttaatccttagcagagctcgtaaacttccaatcgcaactatatttacgacgcatgctacactgctaggtagatacttatgcgcggcaaatattgatttttataatcatcttgacaaatttaatattgataaagaggcgggtgaacggcaaatttatcataggtactgtatggagcgcgcatccgttcactgtgcacatgtgttcacaacagtctcagaaatcacagcaatagaagcagaacatatgctgaagcggaaacctgatgtcgtcaccccaaatgggcttaatgtgaaaaaattcagcgctgtccatgagttccagaaccttcatgcaatgtacaaagctcgtatccaagattttgtacgcggccatttttacggtcacctggatttcgatctggaaaagacactgttcctgtttatcgctggccggtatgagttttcaaacaaaggtgcggatatctttttggaatctttgagccgcctcaatttcttacttaggatgcataaatcggatataacagttatggttttcttcatcatgccggctaaaacaaataattttaacgttgaaacattaaaaggacaagccgttcgtaaacaattgtgggacgtagcacatagtgtaaaggagaaattcggaaaaaaattatacgacgccttgctgcgtggcgaaatcccagatttaaatgacattttagatcgggacgaccttacgattatgaagagagcaatcttctcaacgcagagacaaagcctccctccggtaaccacacataatatgattgacgactctactgatccgatacttagcacaatacggcgtattggtctctttaataatcgtacagaccgagtgaaagtaatcttacaccctgagttccttagctctacgtcgccattattgcctatggattatgaagaattcgtccgaggatgccatcttggtgtgtttccgtcatattatgaaccatggggatacacgcctgcagagtgcacagttatgggtattccaagtgtgactacgaatctctctggcttcgggtgttttatgcaagaacatgtcgctgatccgacggcttacgggatttatatcgttgataggcggtttcggtcgccggacgattcatgcaaccaacttactaaatttctttatggattttgcaaacagtcacgtcggcagcggataattcagcggaatcgcaccgagcggctatcagacctccttgactggcgttatttaggtcgatattatcagcacgcccgacacctgacgctgtcgcgtgcttttcccgataaatttcacgttgaattgacttctccgcctacaacagagggatttaaatacccacgtccgagctccgttcctccgagtccgtcaggaagtcaggctagttcaccgcaaagttcagatgtcgaagacgaagtggaagacgaacggtatgacgaagaggaagaagccgagcgcgaccggctgaacatcaaatcaccttttagcttgagccatgtgcctcatggtaagaaaaaactgcatggcgaatataaaaac

SEQ ID NO: 13163 - DNA, 2109 bp, Artificial Sequence
  Description of Artificial Sequence: Synthetic coding sequence
atgctgagaggccgctccctgtccgtgacttccctgggcggactcccgcaatgggaggtggaagaacttccggtggaggaactgctgctgttcgaagtggcatgggaagtcactaataaggtgggaggaatctacaccgtcatccagactaaggccaagactaccgccgatgaatggggcgaaaactacttcctgatcggaccctactttgagcataacatgaaaacccaagtggaacagtgcgagccggtgaatgatgcggtgagacgggccgtggatgctatgaataaacacggttgccaggttcatttcggaagatggctcatcgaaggcagcccgtacgtggtgctgttcgacatcggctactccgcgtggaatctcgacagatggaagggcgacctgtgggaagcatgctcagtcggaattccttaccatgatagagaggcgaacgatatgttgatctttggatcgctcactgcctggtttcttaaggaggtgactgatcacgccgacggtaagtatgtagtggcacagtttcatgaatggcaagcgggcatcgggctgattctgtcgcgggccaggaagctgcccatagctaccattttcactactcatgcgactctgctcggcagatacctgtgtgcagccaacatcgacttttacaatcacctggacaaattcaatattgacaaggaggcgggagaaagacaaatctaccatcgctactgtatggaaagagcgtctgtgcactgcgcgcacgtgttcaccaccgtgtcggagatcactgccatcgaagcagaacacatgctgaagcggaaaccggacgtcgtgaccccgaatggcctgaatgtgaaaaagttttcggccgtccatgaattccagaacctgcacgcaatgtacaaagcgcggattcaggactttgttcggggacacttttacggacatctcgacttcgacctcgagaaaaccctgtttctgtttatcgccggacgttacgaattctcgaacaaaggggccgacatcttcctggaaagcctctcgaggctgaatttcctgctgcggatgcataaaagcgatatcaccgtgatggtgttcttcatcatgcctgctaagactaacaacttcaacgtcgaaactctgaagggtcaagcagtgcggaaacagctgtgggacgttgcgcactcggtgaaggagaagtttggtaagaagctgtacgacgcgttgctccgcggagaaatccctgatctgaatgatatcctggaccgggacgatctgaccatcatgaaacgggctatcttctcaactcagcgtcaaagcctcccgccagttaccacccacaacatgattgacgattcgaccgacccgatcctgtcgaccatcaggcgcattgggcttttcaacaacagaaccgaccgcgtgaaggtgatccttcacccagaattcttgtcatcgacctcccctcttctccccatggattacgaagaatttgtccgcggttgccaccttggtgtgttcccgtcctactacgaaccgtggggctacacgccggcagagtgcactgtcatgggaatcccttccgttacgaccaacctttctggattcgggtgcttcatgcaggaacatgtggccgaccccaccgcgtacggtatttacatcgtggaccgaagatttcgctccccagacgatagctgcaaccagctgactaagtttctgtacggattctgtaagcaatcacgccgccaacggatcattcagcggaacaggactgagagactttctgacctgctcgattggcgttacctcggaagatactaccagcacgcaagacacctgacgctttcccgcgcattcccggataagttccatgtcgaactgacctcgcctccgaccactgaggggttcaagtacccgaggccctcgtccgtgccaccatcgccctcgggatcacaggcctcatccccgcaatcctccgatgtggaggacgaggtcgaggatgaacgctacgacgaggaggaagaagcggagagggacagactgaacatcaagtcccccttttcactctcgcatgtgccgcatggcaaaaagaagctgcacggagagtacaagaac

SEQ ID NO: 13164 - DNA, 2109 bp, Artificial Sequence
  Description of Artificial Sequence: Synthetic coding sequence
atgctccgcgggcgatctctaagcgtaactagcctggggggcttacctcagtgggaagtagaggaactaccagtggaagagctgctgttgtttgaagtggcctgggaggtgacaaacaaagtgggcggcatctataccgtcatccagaccaaggccaagacgaccgcggacgagtggggcgaaaactactttctcatcggaccatacttcgaacacaacatgaagacacaggtggagcagtgtgagcccgtgaatgacgccgtacggcgtgcggtagatgcaatgaataaacacggctgccaggtgcattttggacgctggcttattgagggttcgccctatgtggtgcttttcgatattggttattccgcttggaatctagataggtggaaaggggatttatgggaggcttgctcggtcggaatcccctatcatgacagggaagccaatgacatgctgatctttggaagtcttaccgcatggtttttaaaagaagtgacagaccacgccgacgggaagtacgttgtggcgcaattccacgaatggcaagctgggatcggattgattctgtctagggcacgtaagctaccaatagcaaccatctttacgacgcatgcgacactcctgggacggtatctgtgcgccgccaatatcgatttttacaaccacctggataagtttaacatcgacaaggaagctggcgagcgccagatctatcataggtactgcatggaacgggctagtgttcattgtgctcacgtcttcaccacggtgtctgagattacagctatcgaagccgaacatatgcttaagcgtaagccagacgtggttacccctaacgggctgaatgtcaagaagtttagtgccgttcatgagtttcaaaatttgcacgctatgtataaagctagaattcaggactttgtgcggggacatttttacggtcacctggatttcgatctggagaagactttgttcctgttcatagctggacgttacgagttttccaataaaggcgcagacatttttctggaatccctgagccgcctgaacttcctgctccgaatgcataagtctgatattactgtgatggtgttttttatcatgcccgccaaaacgaataacttcaacgtggaaacgctgaagggccaggccgttagaaagcagctgtgggacgttgcccattcagttaaggaaaaattcggtaagaagctgtacgacgccctgctccggggggaaattccagacttaaacgacatcctggaccgggacgacctgacaatcatgaagcgtgcaatcttctcaacccagcggcaatccctgccccctgtgacaacccacaacatgatcgatgacagtacagacccaatcctgagcaccataaggcggattggcctgttcaacaaccgaaccgaccgagtaaaggttatccttcaccccgagttcctgtcttcaacttctcccctgcttcctatggactatgaagagttcgtcagagggtgccatctgggagtttttccttcctattatgaaccctggggttatactccagccgaatgtacggtgatgggaatcccaagtgtgactaccaatctgagtggatttggatgtttcatgcaggaacacgtggcagatccaaccgcatatggaatttatattgtggaccgtcgatttcgttcaccagatgacagctgcaatcaactgaccaagtttctgtatggattctgcaaacagtctcggagacagcggatcatacaaagaaacaggactgagagactgtcagacctgctcgactggaggtacctgggacggtattatcagcacgcgcgccacttaactctgagtagggcgttccctgataagtttcacgttgaattgacgtctccaccaaccaccgaggggttcaaatatcctcggccctcatcggtaccgccgtcgccctccggttcccaggcctcgtctccacagtcatccgatgtggaagacgaggtcgaggatgagcgctacgatgaagaggaagaggcggagcgggatcgtctgaacataaagagccctttttcattgtcccatgtgccgcatggaaagaaaaaacttcatggggaatacaagaac

SEQ ID NO: 13165 - DNA, 2109 bp, Artificial Sequence
  Description of Artificial Sequence: Synthetic coding sequence
atgctgcgcggaagaagcctgtccgttacttcactgggaggacttccgcaatgggaagtcgaagagctgccggtggaagaactgctgctgtttgaggtggcttgggaagtgactaataaggtgggtggaatctatactgtgatccagaccaaggccaagactaccgcggatgaatggggagaaaactacttccttatcgggccgtacttcgagcacaacatgaaaacccaagtggagcaatgtgagccagtcaacgacgccgtgaggcgcgccgtggatgctatgaacaagcatggatgccaggtgcactttggacgctggctcattgaaggatcgccgtacgtggtgctctttgatattggttactcagcgtggaacctggacagatggaagggtgatctgtgggaggcttgctctgtcggaattccctaccacgaccgggaggcaaacgacatgctgattttcgggtccctcactgcctggttcctcaaggaagtgactgaccacgctgatgggaagtacgtcgttgcgcagttccatgagtggcaagctggcatcgggctcatcctctcgcgggcccgcaagttgccgatcgccactatcttcaccactcacgcaactctgttgggacgctacctgtgcgccgctaacattgacttttacaaccacctcgacaagttcaatattgacaaggaagccggagaaagacaaatctaccacagatactgcatggagcgcgcctcggtgcactgcgcccacgtgttcaccaccgtgagcgaaatcactgccatcgaagccgagcacatgctgaagcgcaaaccggacgtggtcaccccaaacggcctcaatgtgaaaaagttctccgcggtgcacgaattccagaatctgcacgcaatgtacaaggcgcggattcaggactttgtgcgcggtcacttctatgggcatctggattttgacttggaaaagaccctgttcttgtttatcgccggacggtacgaattctcgaataagggcgctgacatctttcttgagtcgctctctcgcctcaacttcttgttgcggatgcacaagtcagatatcaccgtgatggttttctttatcatgccagcaaagacgaacaacttcaacgtggaaaccctgaagggacaggccgtccggaagcagctgtgggatgtggcccattcagtcaaggagaagttcgggaaaaaactctatgacgcgctccttcgcggagaaatccctgatctcaacgatatccttgacagggacgacctgaccattatgaagcgcgctatcttttctacccagcggcaatcgctcccgccggtcactacccacaacatgattgacgattccaccgacccgatcctgtcgactatcaggagaatcggattgttcaacaacaggaccgatcgggtcaaggtgatcctccaccctgaattcttgtccagcaccagcccgctcctgccgatggactacgaagagttcgtgcgggggtgccatctgggagttttcccttcctactacgaaccatggggttatactccggcggaatgtaccgtgatgggaatcccgagcgtcactacgaacctgtccggattcggctgcttcatgcaggaacacgtcgcggacccaacggcttatggcatctacatcgtggaccgccggtttcggtccccagatgattcgtgcaaccaactgaccaagttcttgtacggattctgcaaacaaagccgcagacaacgcattattcagaggaaccgcactgaacgcttgagcgatctgctggactggaggtaccttggacgctactaccaacacgccagacaccttactctgtcccgtgccttcccggacaaattccacgtggagctcactagcccaccgactaccgagggatttaagtacccgcgcccttcaagcgtgcccccttccccgagcggttcacaagcctcctcacctcagtcatcagatgtggaggatgaggtggaggacgaacggtacgacgaagaggaagaggccgagagggaccgtctgaacatcaagtccccgttctcccttagccatgtcccacatggtaaaaagaaactgcacggcgagtataagaac

SEQ ID NO: 13166 - DNA, 2109 bp, Artificial Sequence
  Description of Artificial Sequence: Synthetic coding sequence
atgttgcgaggtaggagtctctcagtgacgtcgctgggaggtcttcctcaatgggaagtagaggagctgccagtcgaagagttgctcctctttgaggtggcttgggaagttacaaataaggttggtggtatttatactgtgattcagactaaagcaaagaccactgccgacgaatggggcgagaattacttccttattgggccctattttgagcacaatatgaagacacaagttgagcaatgcgaaccagttaacgatgctgtcagaagagcggtggacgcgatgaacaaacatgggtgccaagtgcatttcggaagatggttaattgagggttcaccttatgttgttcttttcgatattgggtattctgcctggaaccttgatagatggaaaggagatctttgggaagcatgctcggtggggattccctaccacgatcgtgaagctaacgacatgctgatttttggaagtttgaccgcttggtttttgaaagaagttacggatcacgctgacggtaagtacgtcgttgctcaatttcatgaatggcaggcgggcatcggtctcatcttgtctagggctaggaagttgcctattgcaacaatttttactacacatgccacactcctgggtagatatctttgcgccgctaatattgacttctataatcacttggataagttcaacatcgataaggaagcaggggaacggcagatttatcacaggtattgcatggagcgggcttcggtccactgcgcccatgtttttactacggtttctgaaattacagctatcgaggcagaacacatgttgaaaaggaaaccagatgtcgtgacacctaacggtcttaacgtgaaaaagttctctgccgttcacgaatttcaaaacttacatgctatgtataaagcaagaattcaagattttgtcaggggacatttttatggacatctcgattttgacctcgaaaagactctctttcttttcattgctggccgttatgaatttagtaacaagggagccgacatctttttggagtccctctcgagattgaacttcctgctccgtatgcacaaaagtgatatcacagttatggttttttttataatgccagccaaaacgaacaatttcaacgtggaaacccttaagggccaagctgttcgaaagcaactttgggacgtggcacattccgtaaaagaaaagttcggtaaaaagctgtatgacgcgttgctacgcggtgagatccccgatttgaatgacattctcgaccgtgatgatcttactataatgaagagagcaattttcagcactcaacgtcagagccttcctccagttactacccataatatgatcgatgattccactgaccccatactttctactatccgaaggattggattgttcaataatcgtactgatagagttaaggtcattttgcatcctgaattcctgtcgtctacttcccctttactaccaatggattatgaagagttcgttcgaggctgtcatcttggtgtgtttccgagttattatgagccttgggggtacactccagctgagtgcacagttatgggtatcccctcagtaactaccaatctctccggatttggctgcttcatgcaagagcacgttgcagatcccacggcgtacggtatttacattgttgatagaagatttcggagccctgatgactcctgcaatcagcttactaagtttctctatggattctgtaagcaatcacgtagacaaagaattattcagcgaaacaggacggagcgtctttcggatctccttgattggcgttatcttggaagatactaccaacatgcacgacacctgaccctttcacgtgcttttcctgataagtttcacgttgaattgacaagccctccgactactgaagggttcaagtaccctaggccaagttccgtccctcctagcccttcgggttctcaagcctcctcgcctcaatcaagtgatgtggaggatgaggtggaggatgagaggtatgatgaagaggaagaagcagaacgggatcgccttaatatcaaatcccctttctctctgtcgcatgttccgcatggaaagaaaaagttacatggggagtataaaaat

SEQ ID NO: 13167 - DNA, 2109 bp, Artificial Sequence
  Description of Artificial Sequence: Synthetic coding sequence
atgctgaggggcagatccttgtccgtgacctccttgggaggtctgccccagtgggaggtggaggaactccctgttgaagagctgctcctctttgaagtggcatgggaggtgactaataaggtggggggaatctacacggtgatccagaccaaggccaagaccactgcagatgaatggggagagaactacttcttgattggtccgtacttcgaacataacatgaaaactcaggtggaacagtgcgagcctgtcaacgacgccgtgcggcgggccgtggatgccatgaacaagcacggctgtcaggtgcactttggacgctggctgatcgagggaagcccatacgtggttctgttcgacatcggatacagcgcttggaacctggatcgttggaaaggtgatctgtgggaagcctgttcagtgggaattccctaccatgaccgcgaggccaatgacatgctgatattcggatcgctgaccgcttggttcttgaaggaggtcactgaccacgcagatggaaagtatgtggtggcccagtttcatgaatggcaggcgggaataggactcatcctctcgagagcacgcaaactgccgattgcgactattttcaccactcacgcgacgctgctgggcaggtacctgtgcgcggccaatatcgacttttacaatcacctcgacaagttcaacatcgacaaagaagccggggaaagacagatctaccatcgctactgcatggagagagcgtcggtgcactgcgcgcacgtgttcactaccgtcagcgagatcaccgcgattgaggcagaacatatgctcaagcggaagccggacgtcgttactccgaatggcctcaacgtgaagaagttcagcgccgtgcacgagttccagaacctgcacgcaatgtacaaggccaggattcaagacttcgtgcgggggcacttctatggacacctggatttcgacctcgagaaaactctcttcctgttcatcgcgggaaggtatgagttttcgaataagggggcagatatctttctggaatccttgtcgcggctcaatttccttctgaggatgcataagtccgacatcaccgtgatggtgttctttatcatgcctgccaagaccaataacttcaacgtggagactctgaaagggcaagctgtcagaaaacaactgtgggatgtcgcacactctgtcaaagaaaagttcggaaagaagctgtacgacgcactgcttaggggcgagatccctgatctcaatgacatcctggaccgggacgatctgacgatcatgaagcgcgccatcttctccactcagaggcaaagcctgccgcccgtcactacgcataacatgatcgacgattccaccgatccgatcctctcaaccatcagaagaatcggcctcttcaataacaggactgaccgcgttaaagtgatcctgcacccggaatttctctcctccacttcccctctgctcccaatggattatgaggaattcgtgcggggctgccacctcggagtatttccaagctactacgagccgtgggggtacaccccagcagaatgtaccgtgatgggaatcccctcggtcaccaccaacctgagcggattcggatgcttcatgcaagagcatgtggcggatcctaccgcctacggcatctacattgtggaccggcggttcagatcgcctgacgattcatgtaaccagctgaccaagttcctgtacggcttctgtaagcagtccagaaggcagcgcatcatccagcgaaatcggactgagcggttgagcgacctgcttgactggagatacctgggaagatactatcaacacgcgcggcaccttactctgtccagggccttccccgacaaattccacgtagagcttacctcgccacccactaccgagggtttcaaatacccaaggccgagctcagtgccaccgtcgccgtcgggctctcaggcttccagcccgcaatcaagcgacgtcgaggacgaggtcgaggacgaacgctacgatgaggaagaggaggccgaacgcgatcgcctgaacatcaaatccccgttttcgctgtcgcatgtgccccatggcaaaaagaagctgcacggcgagtataagaac

SEQ ID NO: 13168 - DNA, 2109 bp, Artificial Sequence
  Description of Artificial Sequence: Synthetic coding sequence
atgctccgaggtcgcagcctttcagtgacttcgcttggcggtttgccacagtgggaggtggaggaactgcctgtcgaagagctcctcttgttcgaggtggcgtgggaagtgactaacaaagtcggaggaatctacactgtcatccaaaccaaagctaagactaccgccgatgaatggggagaaaactacttcctgatcggaccgtacttcgaacacaatatgaaaactcaggtcgaacagtgcgaaccggttaacgatgccgtgagaagagcggtggacgccatgaacaagcatggttgtcaggtgcacttcggccgctggctgatcgaaggatccccttacgtcgtacttttcgacatcggatatagcgcctggaatcttgataggtggaagggtgacctgtgggaggcgtgctcggtgggcattccataccacgacagagaggccaacgacatgctgatctttggctcactgaccgcttggttcctgaaggaggtcaccgaccacgctgatggaaagtacgtggtggcccagttccacgaatggcaggccggaatcgggctcatactgtccagggctcgcaagctgccaattgccactatcttcaccacccatgcgaccctgctcgggagatacctgtgcgccgctaacattgacttctataaccacctcgataaattcaatatcgataaagaagcgggagagcggcagatctaccatcggtactgcatggagcgcgcgagcgtgcactgtgcacatgtgttcaccactgtgtcagagatcactgcaatcgaagcggagcacatgctcaagcgcaagccagacgtggtcactcctaacggactcaatgtgaagaaattctcagctgtgcacgaattccaaaatctccacgcaatgtacaaggcacggattcaagacttcgtccgtggacatttttacggccatctggactttgatctcgaaaaaacgctgttcctgtttatcgcagggcggtacgagttcagcaataagggcgccgacatctttctggaatcattgtcgcggctcaacttccttctgcggatgcacaagtcggacatcaccgtgatggtcttttttatcatgccggccaaaaccaacaacttcaatgtggagactctcaagggccaagcagtgcgcaagcagttgtgggacgttgcacacagcgtgaaagaaaagtttggaaagaagctctacgacgcactccttcgcggcgaaatccctgacctcaacgatattctggacagggacgacctgactatcatgaagagagcgatcttttcaactcagagacaaagcctgccgcccgtcactacgcacaacatgatcgatgactcgactgatccgatcctgtccaccatccggcgcatcggactgttcaacaacaggaccgatagagtgaaggtgatcctgcatcccgaatttctgagctcgacctcacctttgctgccaatggactacgaggaatttgttcgcggatgtcatttgggagtgttcccatcatactacgaaccttgggggtacacccccgccgaatgcacggtcatgggcatcccgtccgtgaccacgaacctctccggtttcgggtgcttcatgcaggagcacgtggccgatccaactgcctacggcatttacatcgtcgaccgccgcttccggtccccggacgattcctgcaatcagctgaccaagttcctgtacggattctgcaagcaaagtcgacggcagagaatcattcagcggaatagaaccgaacggctctcggacttgctggattggcgctacctgggaaggtactaccaacacgctcgacacctgactctgtcgcgcgccttcccagataaattccatgtggaacttaccagccctccgaccacggaggggttcaaatacccgcggccctcgagcgtcccgccgtctccgagcggatcccaggcgtcgtcgccacaatcctccgatgtggaggacgaagttgaggatgaacgctacgacgaggaagaggaggccgagcgcgaccggctgaatatcaagtcgccgttctctctgtcccatgtgccgcatggtaagaagaagctccacggagaatataagaac

SEQ ID NO: 13169 - DNA, 2109 bp, Artificial Sequence
  Description of Artificial Sequence: Synthetic coding sequence
atgttgagaggacggtctcttagtgtgacatccctgggtggtctgccgcagtgggaggtggaagagttgcccgttgaggagctgctgctgttcgaggttgcttgggaggttacaaataaagtcggcggtatctacaccgttatccagacaaaagctaagactaccgctgacgagtggggcgagaactattttcttatcggaccctacttcgagcacaacatgaagacccaggtcgaacagtgtgagcccgtaaacgatgcggtgcgacgggctgtggacgcgatgaacaaacatggttgccaggtgcactttggaaggtggctcatcgaagggtccccgtatgttgtgttgttcgacattgggtacagtgcatggaatttggacaggtggaagggcgacctttgggaagcttgcagtgtaggtatcccctaccacgacagggaggcaaatgacatgcttatcttcggaagtctcaccgcttggtttctgaaagaggtaacagatcacgcggacggcaaatatgtggtagcgcagttccacgaatggcaggccggaattggtctcatcttgagccgcgccagaaagcttcccatagctaccatcttcacaacgcatgctactctgcttgggcgctatctctgcgcagcaaacatagacttctataaccacctggataaatttaacattgacaaggaagcgggggagcgccagatctatcataggtactgcatggagcgcgcctccgtgcactgcgcccatgtcttcaccaccgtgtctgagatcaccgcaatcgaagctgaacacatgctcaaaaggaaacccgatgtcgttacccctaacggactgaatgtcaaaaaatttagtgccgtgcacgaattccagaacctgcacgctatgtataaagctagaatccaggacttcgtgaggggccacttttatggacatttggacttcgatctggagaaaacactgtttctgtttattgccggtagatatgaattctctaacaaaggcgctgacatctttctcgaatctctctcacgactcaattttctcctgcgcatgcataaaagcgatattactgttatggtgttcttcataatgcccgctaaaacaaataacttcaacgttgaaactctcaaagggcaggcagtgcggaaacagttgtgggacgttgcccactcagtgaaagagaagttcgggaagaaactctacgacgccttgctgaggggtgagattcctgacctgaacgacatcttggatcgcgacgatctgacaattatgaagcgcgctatcttctcaactcagcggcagtccctcccgcccgtgacaacccataacatgatcgatgactcaactgatcctatcttgtccacaatacggcgaatcggattgttcaacaatcggactgatcgagtgaaagtcatcctgcacccagagtttttgtcttccaccagtcctctcctgccaatggactacgaggaatttgtgaggggatgccacctgggagtctttccaagttactatgagccgtggggttatactccagccgaatgtactgtcatgggtatcccctcagtgacaactaacctgtcaggctttggatgcttcatgcaggagcatgtggctgaccctactgcttacggcatctatattgtggaccgcagattcagatcacccgatgatagttgcaatcagctgacgaagttcctgtacggattttgcaaacagtcacggcggcagcggatcattcagcggaataggactgagcgcctgagtgatctcttggattggaggtatctgggcagatactaccagcatgcccgccacctcacactttctagagcattccccgataagttccacgtggagctgactagtccgcccacaactgaaggatttaaataccctcggccttctagcgttcctcctagcccgtccggcagccaggcctctagcccacagagttccgacgttgaggacgaagtggaggacgagcggtacgacgaggaggaagaggctgagagggacaggctgaatataaagagcccttttagcctgagccacgtgcctcacggaaagaagaagctgcacggtgagtacaagaat

SEQ ID NO: 13170 - DNA, 2109 bp, Artificial Sequence
  Description of Artificial Sequence: Synthetic coding sequence
atgctacgcggccggtctctctccgtgacatcccttggtgggctgccccagtgggaagtcgaagagctgcctgtggaggaactactactctttgaggtggcctgggaggtgactaacaaggttggaggtatttatacggtgattcaaacaaaggctaagactacggccgatgagtggggtgaaaattactttctgatcggaccctattttgagcataacatgaagacgcaagtcgagcaatgcgagccggtgaacgacgccgtcagaagggcggttgacgcgatgaacaaacacggctgtcaggtgcacttcggccgttggcttatagagggaagcccatacgtcgtcctgtttgacataggctactcagcttggaatctggataggtggaagggtgacctctgggaagcttgcagtgtgggcatcccttaccacgacagggaggcaaacgatatgttaatttttggctctctaaccgcctggttcctgaaggaggtgactgatcatgcagatgggaaatacgtggtagcccagttccacgagtggcaggctggtatcggcctgatcctatctcgggctaggaaactgcccatcgcaaccatatttacaactcatgccactctgctaggccgttatctatgcgctgccaacattgatttctacaaccatttggataaatttaacattgataaagaggccggggagagacaaatctatcacagatactgtatggagagagcctctgtccactgcgcccatgtgttcaccaccgtgagcgagattaccgctatcgaagctgaacatatgctgaagcggaagcctgatgtcgtgaccccaaatggtctcaatgttaaaaagttctctgccgtgcacgagtttcagaatctgcacgccatgtacaaggctaggatacaggacttcgtgaggggacacttttacggccatcttgatttcgatcttgagaaaacactgttcctgttcatcgcggggaggtacgagtttagtaacaagggagccgacatctttctcgagtctcttagcagactgaacttcttactgagaatgcacaaaagcgacataaccgtcatggtgttttttattatgcctgccaagacgaataacttcaatgtggagactctgaaaggccaggctgttaggaaacaattatgggacgtggcacactccgtcaaagaaaagttcggaaaaaagctctatgacgccctgctgaggggggagattcccgaccttaacgatattcttgatcgggatgatttgaccattatgaaacgagcaattttcagcacacagcgccaaagcttgccgcctgtgacaactcacaacatgatcgacgactctactgaccctatcctgtccacaatccgtaggatcggcctgttcaacaaccgcacagatagggtgaaagtcatcctccatccagagttcctgtcttccacgtctccactgttgcctatggattacgaagagttcgttcgagggtgccacctcggtgtatttccatcttactatgaaccctggggttacacacctgctgaatgcaccgtaatggggatcccatccgtgaccaccaacctgtccggattcggctgctttatgcaggagcatgtagcggacccaactgcatacggaatttatatcgtggatcggaggttccggtccccggacgattcatgcaaccagctcacaaaatttttatacggattctgcaaacagagtcgtagacaacgcattatacagaggaacagaactgagcgcttgagcgatctgctggattggcgatatctgggccgttactaccagcacgctcgccaccttacactcagcagggcttttccagacaagttccacgtggaattgacttctcccccaacaaccgaaggtttcaaataccccaggccttcctcagtgcctcccagcccatctggctctcaagcttccagcccacaatcctccgatgtggaagacgaagtcgaagatgaaagatacgacgaagaggaagaggctgaaagagacagactgaacattaagtctcccttctccctgagccacgtcccccatgggaaaaagaagcttcacggcgagtataagaat

SEQ ID NO: 13171 - DNA, 2109 bp, Artificial Sequence
  Description of Artificial Sequence: Synthetic coding sequence
atgctgcgcggacggtccctttctgtgacctctctgggggggttgccgcagtgggaagtcgaagaactgccagtggaggaactcctgcttttcgaagttgcctgggaggtgaccaacaaggtcggaggaatctacaccgtcattcaaaccaaagcaaagaccacagccgacgagtggggtgagaactatttcctgatcggaccttacttcgaacataacatgaaaacccaggttgagcaatgtgaaccggtcaacgatgctgtgcgccgggccgtggacgctatgaacaagcatggatgtcaagtccactttggacgatggttgatcgaggggtctccatacgtggttctctttgatatcggatatagcgcctggaatctcgaccgctggaagggcgacctttgggaggcctgctccgtgggcatcccctatcacgaccgcgaagcgaatgatatgctcatcttcgggagcctgaccgcatggtttctcaaggaagtcactgatcatgcagatggaaaatatgtagtggctcagtttcacgagtggcaggcaggaattggtttgatcctgtccagagctagaaagctgcccattgctaccatcttcactacacacgccacactcctgggacgctatctctgcgccgccaacattgacttctacaaccatctcgacaaatttaacatcgataaggaggctggtgaacgacagatttatcacagatattgcatggaacgggcgagtgttcactgcgctcatgtgtttactactgtgtcagagataactgcgatcgaagcggaacatatgcttaaaagaaaaccagacgtagtgactccgaacgggctgaatgtcaagaaattctctgcagtgcacgagttccagaacctgcacgccatgtacaaagctaggatccaagacttcgttaggggccacttctacggccatctggactttgacctcgagaagacgctctttctcttcatcgctgggcgctacgagtttagcaacaagggtgcggacatctttctggagtctctgagtagactcaacttcttgctgagaatgcacaagtccgacattactgtcatggtttttttcatcatgcccgcaaagacaaataatttcaatgtggagacactcaagggccaggcagtgaggaaacagctttgggatgtggctcactccgtgaaggagaaattcggtaagaaactctatgatgcccttctgagaggggagatccccgacctgaacgatatcctggaccgagatgacttgactatcatgaaacgcgcaatcttcagtacccaacgccagtctctcccaccagtgacaacgcacaatatgattgatgacagtaccgatcctatactttcaactatccggaggattggcctgtttaataacagaacagatagggtgaaagtaatactccatcccgaatttctgtcaagcacaagtcctcttctgccaatggactatgaagaatttgttagggggtgtcacctgggagtcttcccatcttactatgagccctggggttacacaccagctgagtgtactgtgatggggataccctcagtcacgacgaacctgtctggcttcggatgttttatgcaggagcatgtggcagacccaaccgcttacgggatttatatcgtggatagacgctttagaagcccggacgacagctgcaaccagctgacgaaattcttgtacggcttttgtaagcagagccggaggcagcgaataatccagcgcaaccggaccgagaggctgtcagacctgctggattggagatatctgggcaggtattatcagcacgcgcggcatctgacacttagcagggcctttcccgataagttccatgtggagttgacctctccgccgaccacagaaggctttaaatatccaaggccttcttctgtaccaccttctccaagcggtagccaagctagtagcccccagtcctctgacgtggaagatgaggtggaggatgagcggtatgacgaggaagaagaggccgaacgcgatagactcaatataaagtcaccgttctctctttctcacgtgccacacggaaagaaaaagttgcacggagagtataaaaac

SEQ ID NO: 13172 - DNA, 2109 bp, Artificial Sequence
  Description of Artificial Sequence: Synthetic coding sequence
atgttgcggggccgaagtctgagtgtgactagcctggggggcctgcctcagtgggaagttgaggagctgcctgtcgaggagctccttcttttcgaagttgcctgggaggtgaccaacaaggttggtggaatatacaccgtgatacagactaaggcaaagacaacagcagacgaatggggtgagaattactttctgataggaccctactttgagcacaatatgaagacccaggtggaacagtgtgagccagtaaatgacgctgtgaggcgcgccgtggatgccatgaacaagcacggctgccaagtgcacttcggacggtggctgattgagggctccccttacgtcgtgttgttcgacataggctattcagcgtggaatctggatcgctggaagggagacctgtgggaagcctgcagtgtgggaattccctaccacgacagagaagcaaacgacatgctcatcttcgggagtttaacggcttggtttctgaaagaggtaactgatcacgcggatgggaaatacgtcgtggcccagttccacgagtggcaagccgggatagggctgattctgtcccgagcgcggaagctgcctatcgccacaatttttactacccatgccactctattaggccgctacctgtgtgcggctaatattgatttctataaccatctggataaattcaacattgataaagaagccggggaacgccagatttaccatcggtactgcatggaacgagcctccgtgcattgtgcacacgtgttcacgaccgtgagtgagattaccgcaatcgaggccgagcacatgctgaagaggaaacccgatgtggtgacacccaacggcctgaatgtgaagaagttcagtgcagtgcatgaatttcagaatctgcacgcaatgtacaaggcaaggatccaggatttcgtgcgaggacacttttatgggcacctggacttcgacttggagaaaacactgttcctgttcatcgctggtaggtacgaattctcgaacaagggcgccgatattttccttgaaagcctgagcaggctgaattttctccttagaatgcacaaatctgatatcacagtgatggtgttctttattatgcctgcaaagacaaataacttcaatgtcgagacactcaagggccaagctgtgcgaaagcaactctgggatgtcgctcactcagtgaaggagaagtttggcaaaaagctgtacgatgctctgttgaggggagagattcctgacctcaacgatatccttgacagagatgatctcacaataatgaaacgtgcgatctttagcacacagaggcagtccctgccacctgtcaccactcacaacatgattgacgattctaccgacccgatcctgtcgaccatccgtcggatcggcctgtttaataatcgcactgaccgcgtcaaggtgatcctgcaccccgagttcctgagttcgacaagtccccttctgccaatggactatgaagaatttgtgcggggctgccacttaggcgtctttccaagctattacgagccatgggggtacacccccgcagagtgcactgtaatgggcattccctcggtgaccactaacctctccgggttcggatgttttatgcaggagcatgttgctgatccaacagcttatggaatatacattgtggacagaaggtttagaagtcctgacgacagttgcaaccagctgaccaagtttctatatgggttctgcaagcaatccagacggcagaggattatacagcggaacaggactgagcggctcagcgatctgctggattggcgctacttgggcaggtactaccagcatgcaagacacctgacgctctcaagggcattccctgataagtttcacgtagaactgacgtcccctcccactactgaggggttcaagtatccacggcccagctccgtacctccatctcccagcggctctcaggctagttccccacagtcctctgacgtagaggatgaggtggaagacgaacggtacgacgaggaggaagaggccgaacgtgatagactgaacatcaagagcccattctctctgagccacgtcccacatggaaaaaaaaagctccatggagagtataaaaac

SEQ ID NO: 13173 - DNA, 2109 bp, Artificial Sequence
  Description of Artificial Sequence: Synthetic coding sequence
atgctaaggggccgatcactgtccgtgaccagtctcggtggtcttccacagtgggaagtagaagaactacccgtggaagaattgctcctcttcgaagtggcttgggaggtgacgaacaaagtaggggggatctacactgttatacagacaaaggcaaagacaaccgccgatgagtggggtgagaactactttctgattggtccatattttgaacacaacatgaagacccaggtggaacagtgcgagccagtgaatgacgctgtgagaagggctgtggatgccatgaataaacacggatgtcaggtgcactttggtcgctggttgattgaggggtccccctacgtggttctgtttgacattgggtactcagcttggaatctggatcgatggaaaggagacctttgggaagcttgctcagtggggatcccctatcacgatcgagaagccaacgacatgctcatctttggttccttaacagcctggtttctgaaagaagttactgatcacgctgatgggaaatacgtggtggcccaatttcatgaatggcaggcaggcatcgggctgatactctctagagcgcgaaaactgccaattgcaacgatctttacgacacacgccacactgctcgggcgatatctgtgtgctgccaacatcgatttttataaccacctggataagttcaacatcgataaggaagccggggagcgacagatttaccacaggtactgcatggaaagagcaagcgtgcattgcgctcacgtttttaccaccgtcagcgaaataactgccatcgaggctgaacatatgctcaagaggaagccagatgtggtaaccccgaacgggctcaatgttaaaaaattctccgcagtgcacgagttccaaaacttacacgccatgtacaaagcgcgaatccaggacttcgtgaggggacacttttatgggcatctggatttcgatctggagaaaaccctgttcttatttattgccgggcgatatgagttcagtaataagggagccgacatcttccttgagtctctgagtaggttaaatttcctcctgaggatgcataaatctgacattacagttatggtgttcttcatcatgcctgctaagacaaacaactttaatgtcgaaacattgaaaggacaggccgtccgtaaacagctctgggacgtggcgcattcagtgaaggagaaatttgggaaaaaactgtacgatgctcttctacgaggggagataccggatctcaatgacatcttggatcgggatgatctcaccattatgaaaagggcgattttcagtacgcaaagacagtccctgcctccagtgaccacgcataatatgattgacgacagtactgatcccatcctaagtacaatccggagaatcggcctctttaataaccgaaccgatagggtgaaggtgatcttgcatcccgaattcctgagttctacctcccccttattgcccatggactacgaagaatttgttcgaggctgtcacttgggcgtgttcccgtcgtactacgaaccttggggctatactcctgctgagtgcactgtcatggggatcccttccgtaacaacaaatcttagtgggtttgggtgcttcatgcaggagcacgtcgcggatccaactgcctatggcatctacattgtcgataggcggttccggagccccgatgattcctgcaaccaactgaccaaatttctgtacgggttctgcaagcagtcaaggaggcaacggataatccagcgaaatcgaaccgagaggttgtcagacctgctggactggcggtaccttggcagatattatcaacacgcgcgtcatctcacactctctagagcatttcccgataaattccacgtcgagctgacttctccccccacaaccgaagggttcaagtacccccgcccatctagtgtcccccctagtcctagtggttcacaagccagctcgccacagtcctcggacgtagaggacgaggttgaggatgaaagatacgatgaagaggaagaggccgagagagatcgacttaatatcaagtcaccattcagtctatcccacgtccctcacgggaaaaagaaactgcatggggaatacaagaac

SEQ ID NO: 13174 - DNA, 2109 bp, Artificial Sequence
  Description of Artificial Sequence: Synthetic coding sequence
atgttgagaggacggtccctgtccgtgacatcgcttggcgggcttcctcaatgggaggttgaagagcttccagtggaggaactgcttctcttcgaggtggcctgggaagtaaccaacaaagtcggcggcatttacacggtcatccagaccaaagcaaaaaccaccgcagatgagtggggtgagaattacttcctcatcggaccttatttcgaacataatatgaagacccaggtggaacagtgtgagcccgtcaacgacgcagttaggcgagccgtcgatgctatgaataagcatggatgtcaagtgcacttcggtcgctggctcatcgagggtagcccttacgtagtgctcttcgatattggctattcggcttggaaccttgataggtggaagggcgatctctgggaggcgtgttccgttggaattccgtaccacgatagagaagccaatgacatgctgatattcggcagcctgacagcttggtttttgaaggaggtaacggatcacgcagacgggaagtacgtggtcgcgcaatttcatgaatggcaggctggaattggccttatcctgagtagagccaggaaattacctattgcgaccatatttactacccacgctactctacttggtcgctacctatgcgcggcaaacattgatttctacaatcatctggacaaatttaatatagataaggaggcaggcgaacggcagatctaccaccggtattgtatggagagggctagcgtgcactgtgctcatgtgttcacaactgtttcggaaatcacagctatagaggccgaacacatgttgaaacgtaagcccgacgtggttacccccaacgggctcaatgtaaagaaattctccgccgtgcatgaattccaaaaccttcatgccatgtataaggccagaatccaagacttcgttagaggacacttctacggccacctcgacttcgacttggagaagacgctgttcttgttcatcgcagggagatacgagttttcaaataagggcgcagatatattccttgaaagcctgagccggctgaacttcctgttacggatgcataagtccgacattaccgtgatggttttctttatcatgcctgctaaaaccaacaatttcaatgtcgaaaccctcaaaggccaggcggttaggaaacaactgtgggacgtagcacattcagtaaaggagaagtttggcaagaaattgtatgatgccttgctgcgaggagagattcctgacttgaacgatatactggatcgcgatgacttgacaatcatgaaaagagcgatctttagcactcagcgtcaatccctcccacccgtaaccacacataacatgatcgatgattctactgatcccatcctgtctactattcgcaggatcggcctgtttaacaaccgtactgatagagttaaagtgatcctccatcccgaatttctaagctcaacaagccctctactgcccatggactacgaggaatttgtgaggggatgccacctcggcgttttcccaagctattacgagccctgggggtatacgcccgccgaatgcactgtcatgggcattccgagcgtcacaaccaacttgtccggttttggatgcttcatgcaagagcacgtcgcagatccgacggcatacgggatttatattgttgataggcgcttccgcagccccgatgacagctgtaaccagctcaccaaattcctttatggcttctgcaaacagtcacggagacagcgaataatacagcgcaatagaacagagagactcagcgacctgttggattggcgttatttgggcagatactatcaacacgctcgccacctgaccctgtcacgagccttccctgataaattccatgtcgagcttacttccccacccacaacagaaggctttaagtacccacgccctagttctgtgcccccttccccttcaggcagccaggctagctccccccaatcctccgatgtggaggatgaagttgaggatgaacgctatgatgaggaggaggaagccgagcgtgaccgactcaacatcaagtctcctttcagcctttcacacgtgccgcacggcaagaagaaactgcatggggagtataagaac

SEQ ID NO: 13175 - DNA, 2109 bp, Artificial Sequence
  Description of Artificial Sequence: Synthetic coding sequence
atgttgcgaggaaggtcattgtcagtgaccagcctgggggggctcccccagtgggaagtcgaggagctgcctgtcgaagagctccttctattcgaggtggcttgggaggttactaacaaagtagggggaatttacacagttatacagacaaaggccaagaccacagccgatgaatggggggagaactattttctgataggcccctactttgagcacaatatgaagacacaagtcgagcagtgtgagcccgttaatgacgcggtcagacgcgctgtagatgcgatgaacaagcacgggtgtcaggtacactttggacgatggctgattgaagggtctccttatgtcgtcctcttcgatatcggttacagcgcttggaacctcgatagatggaaaggcgacctctgggaggcttgttctgtaggtatcccttaccatgatcgtgaagctaatgatatgttgatttttggctcactgacggcgtggttccttaaggaggttaccgatcatgctgacggaaagtatgtggtggcccagtttcacgaatggcaggccggtattggcctaatcctgtctagggctcggaaactccccatcgcaacaatatttactacacacgcgaccttgctagggcgctatctgtgtgctgcgaacattgatttctacaaccacttagataagttcaatatagacaaggaggcaggagaacggcagatttatcatcgctactgcatggaacgagcttcagtccattgcgcccacgttttcacaacagtttcagagatcacagctattgaggcggaacacatgctgaaacgaaaacctgatgtagtaacccccaatggattgaatgtcaagaagttctctgctgttcacgagttccagaacctgcacgcgatgtacaaggcacggatccaggattttgtccgcggtcacttttacggccatcttgatttcgaccttgaaaagaccctgttcttgtttattgcaggacgatacgagttttctaacaaaggggctgacatcttcctcgagtctcttagtcgacttaactttctcctcagaatgcacaagtcagatatcacagtcatggtgtttttcataatgcctgctaagaccaacaacttcaacgtcgagaccttaaagggacaagcggtccgtaaacaactgtgggacgttgcgcactccgtgaaagaaaaatttgggaagaagctctatgatgccttgctgcgcggggagatccctgaccttaatgacattctagatagagacgacctgactattatgaagagagcaatcttcagtacccaacgccagtccctgccgccagtgaccacacataatatgattgatgattccaccgatcccatcctgtccactatcagaaggatcggcctattcaacaatcgtaccgacagggtgaaggtcatcctgcatcccgagttcctgtctagtactagccccctcttgcctatggactacgaagagttcgttcggggttgccatctgggcgtgttccccagctattatgagccctggggctatacacccgctgagtgtacggtcatgggtatcccctccgtaactacaaatcttagtggattcggttgtttcatgcaggagcacgtcgcagacccaactgcctatggcatctacattgtcgatcggcgctttaggagccctgacgactcttgtaaccagttgacaaagttcctgtacggcttttgtaagcagagtagacgccagcggataatccagagaaataggaccgaaagactctccgatctgttagactggagatacctgggcaggtattaccagcacgcccgacacctaacactgtcacgcgcgttcccggataaattccacgtggagttaactagtccccctaccaccgaagggttcaaatatccgagaccgtcgtcagtgccgcccagtccctccggcagccaggcgtcctctccacagtccagtgatgtcgaagatgaggtggaggacgagaggtacgatgaggaggaggaagcagagcgtgaccggcttaacatcaagagcccattcagtttatcccacgtgcctcacgggaaaaagaagctgcatggcgaatacaagaac

SEQ ID NO: 13176 - DNA, 2109 bp, Artificial Sequence
  Description of Artificial Sequence: Synthetic coding sequence
atgcttagagggcggagcttgtcagtcacctctctcggaggtctgcctcagtgggaagttgaagaactccctgtggaagaactgttgctgtttgaggtagcatgggaggttacaaataaagtgggcgggatttacacagtaattcagaccaaagctaagactaccgctgacgaatggggagaaaactacttccttatcggaccgtattttgagcataacatgaagacacaggtcgagcagtgtgagcccgtcaacgacgcagtgcggcgagcagtggacgccatgaataaacacggatgtcaggtccactttggacgttggcttattgagggcagcccatacgtagtcctctttgacatcggttactcggcgtggaatttagatcgctggaaaggagacctttgggaggcttgttctgtgggcatcccataccacgatcgggaagccaacgatatgttgatcttcggctctctcacagcttggttcctgaaagaagtcacagatcatgcagatggaaaatatgtcgtagcccaattccatgaatggcaggccggaatcggactaatcctctctcgcgctcgaaagctcccgatcgccaccatcttcaccacccacgccaccctgctgggccgttatttgtgcgccgccaatatcgatttctataaccacttagataaatttaatatcgacaaggaggccggggagcgccagatttaccatcgctattgcatggagcgggcctccgttcactgcgcacatgtcttcaccaccgtaagtgaaattacagccatcgaggctgaacatatgctgaaaagaaaacccgacgtggtgactcccaacggcctaaacgttaagaagttcagcgctgtacacgagttccagaacctgcatgctatgtacaaggcgcgcatacaggatttcgtccgaggacatttctatggccacctggactttgatctagagaagacattattccttttcatagccggacggtacgagttctccaacaagggagccgatatctttttggaatccctatccagactgaactttctactgcgtatgcataagagcgatatcacagtcatggtctttttcatcatgcctgccaaaaccaacaacttcaacgttgagactcttaaggggcaggccgtgcgcaagcaattgtgggatgtggctcacagcgtaaaagaaaagttcggaaagaagctctacgacgcgctactgcgcggggagatacctgacctgaatgatatcttagaccgcgacgacctgacaatcatgaaacgggcgattttctctacacagcgccagagtcttcctcccgtaacaacccacaacatgattgacgatagcaccgaccctatcctcagcactattaggcggatagggttgtttaataataggactgacagagtcaaggtgatcctgcacccagaatttcttagctccacctctcccttgctcccaatggactacgaagaattcgtacggggatgccatttgggggtatttccatcatattacgagccatggggctacactcctgcagagtgcacagtgatggggatcccgtctgtgacgaccaacctgtctggcttcggatgcttcatgcaggagcatgtcgcggatcccaccgcatacggaatttacatcgtggaccgccggtttcgttccccggacgacagttgcaaccagctgaccaagtttctctatggcttttgcaagcagtcccgtcgtcagagaatcatccagcgaaatagaacggagcgcctctctgatctgcttgattggcggtacctcggtcgatactaccagcacgccagacatctcactctgtccagagccttcccagacaaattccacgtggaactgactagcccacctacaaccgaggggttcaaatatccacgtcccagtagtgtccctccatctcctagtggaagccaggcctccagtccacagtcttcagacgtcgaggacgaagttgaagatgagagatacgacgaagaagaggaagctgagcgggatcggcttaacatcaagtcccccttctctctgtcccacgttccacacggaaagaagaaattacacggcgaatacaagaat

SEQ ID NO: 13177 - DNA, 2109 bp, Artificial Sequence
  Description of Artificial Sequence: Synthetic coding sequence
atgttgcgtggaagaagtctctcggtgacatctctgggaggcctgccgcaatgggaagtagaggaacttccagttgaggaattgctattattcgaagtcgcttgggaagtcacaaataaagttggaggaatatatacagtaatccagacgaaagcaaagacaaccgcagatgagtggggagagaactatttcttgatcggtccttattttgaacataatatgaaaacgcaagttgagcaatgtgagcccgtcaatgatgctgtgcggcgcgctgtcgatgcaatgaataagcatggatgtcaagttcattttggccgttggctaatcgagggttccccgtatgtcgtcctattcgatattggatactctgcttggaatttggaccgctggaagggagatttgtgggaggcatgttctgttggcatcccatatcatgacagagaggcaaatgatatgctaatcttcggatccttgaccgcgtggtttttaaaggaagtgactgatcatgcagacggaaagtatgtggtcgctcaattccatgaatggcaagcggggatcgggttaatcctgtcgcgagcaaggaagttgccgatcgcaacaatcttcacaacccacgctactttgttgggaagatatctttgcgctgccaacatagatttttataatcacctggataaattcaacattgataaagaagcaggagagcgacagatttatcatcgttattgtatggagagagcttctgttcattgtgcacacgttttcacaaccgtgagcgaaatcaccgcaatagaggctgaacacatgttgaaaagaaaaccagatgtagttacaccgaacggattaaacgtcaagaaattctcggctgttcatgaattccagaatcttcatgccatgtataaggctagaatccaagacttcgttagaggtcatttctatggacatttggatttcgatttggagaaaacactgttcttgtttattgctggtcgatatgaattctcaaacaagggggctgatatttttcttgaatcactatcgagactgaatttcctactgcgaatgcataagagtgacattacggtgatggtgttttttattatgccagcaaaaactaataatttcaatgttgaaacattgaagggccaagcagttcgtaagcaattgtgggacgtcgcgcattcggtgaaggaaaaattcggaaaaaaactttacgatgctcttctccgtggtgaaataccagacctcaatgatattctcgatcgcgatgatctgacgattatgaaacgggcaattttttctacgcaaagacaatcactgccaccggttactacacataatatgattgatgattcaacagacccaatacttagtactatacgacgtattggactctttaataatcggacagatagggtaaaggttattctacaccctgagttcctgtcatcgacatctcctctactgccaatggattacgaagagtttgttagaggttgccatcttggggttttcccttcctattatgagccatggggatatacgccggccgaatgtaccgttatgggtatcccgtcagttaccacaaacctcagtggtttcggatgtttcatgcaagaacacgtggctgaccctacggcatacggtatttacatagtggatcgaaggtttcgatctccagacgattcctgcaatcagttgaccaaatttttgtatggattctgtaaacagtcaagacgccaacggattatccagcggaaccgaaccgaaagactttctgatttgttggattggaggtatctgggaagatactatcaacatgcgcgtcatttaactctttcaagagctttcccagacaaattccatgttgaattaacgtcgccgccaactacagaaggcttcaaatatcctcgcccaagttcagtgccaccatctccgtcaggatcccaagcatcttcaccacaatcttctgatgttgaagatgaggttgaagatgaacgatacgatgaggaagaggaagctgaaagagatcgtctgaatataaaaagccccttctcgctctcacatgttccgcatggaaaaaaaaagctccacggggagtacaaaaac

SEQ ID NO: 13178 - DNA, 2109 bp, Artificial Sequence
  Description of Artificial Sequence: Synthetic coding sequence
atgctccgtgggagaagtctgtccgtgacgtcattgggagggctcccccagtgggaagttgaagaactccccgtggaggagcttctgttgtttgaagttgcttgggaggttaccaataaagtgggcggaatctacacggtcatacagacaaaggcgaagacaactgctgatgaatggggagagaattattttctcatcgggccctactttgagcataacatgaaaacccaggtggagcaatgtgagccggttaacgacgccgtaaggcgggctgtggatgcaatgaacaagcacgggtgccaagtgcatttcggccgctggctgatcgaaggctccccctacgttgtgctgttcgacatcgggtactccgcatggaacctggatcgctggaagggcgacttatgggaggcttgctccgtaggcatcccctatcacgaccgcgaggctaatgatatgcttatctttggttctttgaccgcttggtttctcaaagaagtgaccgatcacgccgacgggaagtacgtggtagcccagttccacgaatggcaggctggcataggcctcattctgtctagagcacgaaagttgcctattgccacaatattcacaactcacgccacattactgggacgctacctttgcgctgcaaatattgacttttacaatcacctcgacaagttcaacatcgataaggaagccggagagcggcagatctaccatcgctactgtatggaaagggcctctgtgcattgcgcccacgtctttaccacagtcagtgaaataacagctatcgaagcggaacacatgctaaagcgcaaaccagacgtggttactccaaatggcctcaatgtgaaaaagttcagcgctgtgcatgagtttcaaaacctgcatgccatgtacaaggccagaattcaggactttgtacgaggccacttttacggacatcttgacttcgacctcgagaagaccctgtttctgttcatcgcaggacggtacgagttcagtaataagggggctgatatttttcttgagtcactcagcaggctcaacttcttgttgaggatgcataagagcgacatcacagtcatggtgtttttcattatgcccgctaaaacgaataattttaatgtggagacactgaagggccaggctgtccgtaagcagctgtgggatgttgcccactccgtcaaggaaaaatttggaaagaaactgtatgacgccctgcttcgcggggaaattccggatctgaacgacattcttgaccgagacgatcttacaattatgaaaagggccattttttccacgcagcgccagtcgctgccacctgtgacaacccacaatatgattgatgacagcactgacccgatactatccaccatccgcaggattggccttttcaacaaccgcaccgatcgggtgaaggtgatcctgcatcctgagttcttaagctctacatccccactgctccccatggattatgaagagttcgtacgcggatgtcacctaggtgtatttccaagttactatgaaccatggggatacactccagccgagtgcactgttatgggtattccgtccgtgaccacgaatctctcggggttcggctgtttcatgcaggaacatgttgccgacccaaccgcatatgggatctatatcgtggatcggcgcttcaggtcgcctgacgattcctgtaatcagttaacaaagtttctgtacggattttgtaaacagagtcgacggcagcgtatcattcagagaaaccgcactgagcgtttgtctgaccttttggattggcggtatctgggcagatattatcagcatgctcggcacttgaccctctctcgtgcttttcccgacaagttccatgtcgagctgacatcacctcctactacagaggggttcaagtatccgaggcctagtagcgtgcctccatcccccagtggatcccaggcaagcagtccgcagtcgtccgatgtggaagacgaggtggaggacgaaagatatgatgaggaagaggaggctgaacgtgaccggttgaacataaaatcaccatttagcctgtcacatgtgcctcatggtaagaagaaattacacggagagtataaaaat

SEQ ID NO: 13179 - DNA, 2109 bp, Artificial Sequence
  Description of Artificial Sequence: Synthetic coding sequence
atgctccgggggcgctctctttcggtgactagccttggcggactcccacagtgggaagtggaggaacttccagtcgaagaactgctgttgttcgaagtggcttgggaggtgactaacaaggtggggggaatctacactgtgattcagaccaaggcaaagaccaccgcggacgaatggggtgaaaactacttcttgatcggcccatactttgagcataacatgaaaactcaggtggagcagtgcgagccggtgaacgacgcggttagaagagcggtcgacgccatgaataaacatggttgtcaggtccacttcggccggtggctgatcgaaggatctccgtatgtcgtgctgttcgacataggatacagcgcctggaacctcgatcgctggaagggcgatctgtgggaggcctgctcagtgggcatcccctaccatgaccgggaggcaaatgacatgctgatttttggctctctcacggcatggttcctgaaggaggttaccgaccatgccgacggcaaatacgtggtggcacagttccatgaatggcaagcaggcatcggattgattctgagtagagcccgcaaactgccgatcgcgaccattttcaccactcacgcgacccttcttggacggtatctgtgtgctgctaatatcgacttctacaaccatttggataagttcaatattgacaaagaagccggagagcgccagatctaccacagatactgcatggaaagggctagcgtgcattgcgcacacgtgttcactaccgtgtccgaaatcacggccatcgaagctgaacatatgctgaagaggaagcccgatgttgtgactcctaatggcctgaacgttaagaagttttcggcggtgcacgaattccagaacctgcatgcgatgtacaaagccagaatccaggacttcgtgagaggccacttctacgggcatctcgacttcgacctcgaaaagactctttttcttttcatcgctggccgctacgagttctctaacaaaggcgccgatatctttttggaaagtctctcccgcctgaacttcctgctgaggatgcacaagagcgacatcaccgtcatggtgttcttcatcatgccggcaaagaccaacaatttcaatgtcgaaactctgaaaggtcaggcggtgagaaagcagctgtgggatgtggcacactccgtgaaggagaaattcggaaagaagctctacgacgcacttctgcggggggaaataccggatctcaatgatatcctggaccgtgacgatctgaccatcatgaagcgcgcgatcttttcgacccagagacagtcactccccccggttaccacccataacatgattgacgactccactgacccgattctgagcactattagacgcattggcctctttaacaatcgcaccgatcgggtcaaggtgatcctgcaccctgagttcctttcatccaccagcccgttgctgccgatggattacgaagaattcgtcaggggttgccacctgggagtgttcccatcgtactacgagccctggggctacactcctgccgaatgtactgtgatgggcatcccttccgtgaccactaatctgagcggttttggttgcttcatgcaagaacacgtggctgacccaacggcttacggaatctatatcgtggatagacggttccgatcaccggatgacagctgcaaccagctcaccaagtttctgtacgggttttgtaagcaatcgcggcgccaaagaatcatccagcgtaaccggaccgagcggctctccgatctgctggactggcggtacctcggacgctactaccaacatgcccgccacctgacgctcagccgcgccttcccggataagttccacgtggagctgacgtccccgccaaccactgagggtttcaaatacccgaggccttcttcagtgccaccttccccgtcaggatcgcaagctagctcaccccaatcctccgacgtggaagatgaggtggaagatgaacgctatgacgaggaggaagaagctgaaagggatcggttgaacatcaaaagccccttttcactgtcgcacgtcccccacggaaaaaagaagttgcacggagagtacaagaat

SEQ ID NO: 13180 - DNA, 2109 bp, Artificial Sequence
  Description of Artificial Sequence: Synthetic coding sequence
atgctccggggacgctccctgagcgtcacctcattgggaggactcccacagtgggaagtcgaagagctgccggtcgaagaactgcttctcttcgaggtggcctgggaagtcaccaataaggtcggaggcatctacacggtgatccaaactaaggccaagaccaccgcagacgagtggggagaaaactacttcctgatcggcccctactttgaacataacatgaaaacccaggtggagcagtgcgaaccggttaacgacgcagtgcgcagagcggtggatgctatgaacaagcatgggtgccaagtgcacttcggccgttggctgatcgaaggctcaccgtatgtggtcctctttgacattggatactccgcgtggaacctggatcggtggaagggagatctctgggaagcgtgctccgtgggaattccgtaccatgatcgggaggccaacgacatgctcatttttggaagcctgaccgcatggttcctcaaagaagtgaccgaccatgccgacggaaaatacgtggtcgctcagtttcacgaatggcaagccggtatcggcctgattttgtcgagggctcggaaattgccgatagcaaccatcttcaccacccacgcgactctgctgggacggtacctgtgcgccgccaacatcgacttctacaaccacctggataagttcaatatcgacaaggaggccggtgaacggcagatctaccaccgctattgcatggaacgcgcatcggtgcactgtgcacatgttttcaccactgtgtcagagatcaccgcgattgaggctgagcacatgctcaagcgcaagccagacgtcgtgactccgaatggactgaacgtgaagaagttcagcgcagtgcacgagttccagaacttgcacgcaatgtataaggcccggatccaagatttcgtgagaggacatttctacggacacttggatttcgacctcgagaaaacgctgttcctgtttatcgcgggccggtacgaattttcgaataaaggggccgatatcttcctcgaatccctgtcccggctgaacttcctccttcggatgcacaagtcagatatcaccgtgatggtgttctttatcatgccggccaagactaacaatttcaacgtcgagactctgaagggacaagcggtgcggaagcagctttgggacgtggcgcactccgtgaaggaaaagttcggaaagaagctgtacgatgctctcctccggggagaaatccccgatctcaacgacatccttgatcgcgacgacctgaccatcatgaagcgcgcgatcttctcgacccagcggcaaagcctcccaccggtgactacccataacatgatcgacgactccaccgacccgatcctgtcaaccatcaggaggatcggcctgttcaacaaccggaccgaccgcgtgaaagtgatcctgcatccggaattcctgagctccacctcgccgcttctgccgatggattacgaggagttcgtcagggggtgccacttgggggtgttcccatcctactacgagccatggggatacaccccggcagagtgcaccgtgatgggcattccgtccgtgactactaacctgtccggattcggctgtttcatgcaggagcacgtggccgaccctaccgcgtacggaatttacatcgtcgaccgccgcttccggagccctgatgactcgtgcaatcagttgactaagttcctgtacggcttctgtaaacaaagccgcaggcagcgcataatccagagaaaccggactgaaagactctcagacctcctggattggcgctacttgggcagatactatcagcacgccagacacttgactctcagtagggccttcccggacaagttccacgtggagttgacgtcgccgcctaccaccgagggtttcaagtacccacgcccaagctcggtccccccaagcccatcgggatcccaagcatcgtccccacagtccagcgatgtggaggacgaggttgaggacgaacgctacgacgaggaggaagaagcggagcgggaccgcctcaacatcaagagccccttttccctttcccacgtgccgcacgggaagaagaagctgcacggagaatacaaaaac

SEQ ID NO: 13181 - DNA, 2109 bp, Artificial Sequence
  Description of Artificial Sequence: Synthetic coding sequence
atgctcagggggcgatcgctttcagtgacgtcgcttggaggacttcctcagtgggaggtggaggaactgcctgtcgaggaactgcttctttttgaagtggcatgggaagtgaccaacaaagtgggcggaatctacaccgtcattcagactaaggccaagactaccgcggatgaatggggtgaaaactattttcttataggcccttactttgagcataacatgaaaacccaagtcgaacagtgcgaacctgtgaacgatgcagtgagacgtgccgtggacgcaatgaataaacacgggtgccaggtgcatttcggacgctggctgatcgagggatccccctacgtggtcctcttcgatatcggctattccgcatggaaccttgatagatggaaaggagacttgtgggaagcatgctccgtgggcattccataccatgatcgggaagcaaacgacatgctgatctttgggtccctcacggcgtggttccttaaagaggtgacggaccatgcagacggaaaatacgttgtggcacagtttcatgaatggcaagcgggaattggtcttattctgtcccgcgcaagaaagctgcctattgcgaccatctttactactcatgcaacccttctcggtaggtacctgtgcgcagccaatattgatttctacaatcacctcgataagtttaacatagataaagaagcaggagaacggcagatataccatcgttactgcatggaaagagcaagcgtgcactgtgcacatgtgtttaccactgtgagcgaaattacggcaatcgaagcagaacatatgcttaaaagaaaacctgacgtggtcaccccaaacggcctgaatgtgaagaagttttccgctgtgcatgaatttcagaaccttcatgctatgtacaaggcacggatccaggactttgtgcgcggacatttctacggtcatttggattttgacctggaaaagactcttttcctgtttattgcagggcgatacgaattcagcaataaaggtgcggatatctttttggaatcgctttcacgccttaactttttgctccggatgcacaagagcgatatcactgtcatggtgttcttcataatgcccgcaaagacgaacaactttaacgtggagactctcaagggtcaggcagtgcgcaagcaactgtgggacgtggcccattccgtgaaggagaagtttggaaagaagctgtacgatgctctgctccgcggagagatccctgacctgaacgatattctggatcgggatgatctgaccataatgaagagggcaatattcagcactcaaagacaatcgctgccccccgtcaccactcataacatgatcgatgattccaccgatcccattctgtccaccatcaggagaatcggtctgtttaacaatagaactgacagagttaaggtgatactgcatcctgaatttctttcatcgacgtccccgctgttgccaatggattacgaagaatttgtgaggggctgtcatcttggcgtttttccatcctactacgagccatgggggtacaccccagcagagtgcactgtgatgggaatcccctccgtgaccactaatctctccggttttggctgtttcatgcaggaacatgtggcagaccctaccgcatacgggatctatattgtcgacagacgcttccgcagcccagacgatagctgcaaccaacttactaagtttctgtacggcttctgtaaacaatcgcggaggcaacgaatcatccagagaaacagaaccgaacgattgtcggatcttctcgactggagataccttggaagatactaccaacatgcacggcatctcacgctgtcgcgggccttccctgacaaatttcacgtcgaacttacgtccccacctaccactgaaggttttaagtacccacggccttcctctgtgcccccatctcccagcggctcgcaggcgtcctccccgcaatcctcggatgtggaagatgaagtggaggacgaacgttatgacgaggaggaagaagccgaaagagatagacttaacattaagtcccctttctcactgtcccatgtcccccacggtaagaagaagctccatggagagtacaaaaac

SEQ ID NO: 13182 - DNA, 2109 bp, Artificial Sequence
  Description of Artificial Sequence: Synthetic coding sequence
atgttaagaggtaggagcctctctgtgacaagtctggggggccttcctcagtgggaagtggaggaactccctgtggaggagttgctgttgttcgaggttgcatgggaagtgacaaacaaggtgggtggcatatacaccgttattcagacgaaagccaagacaaccgctgatgaatggggggagaattattttctgattggcccttactttgagcacaacatgaaaacccaagtggaacagtgcgaacctgtgaacgacgcagtgcgtcgggcagtcgacgccatgaacaagcacgggtgccaggtccactttggacgctggttgatcgaggggagtccatacgtagtcctcttcgacatcggctactcagcctggaacctcgatcggtggaagggagacttgtgggaagcatgtagcgtcggcatcccgtaccacgatagggaggccaatgatatgctaatctttgggtcgcttactgcatggttcctgaaagaggtaacagatcatgccgatggcaagtacgttgtggctcagtttcatgagtggcaggcaggcatcggactaatcctgagccgcgcccgtaagctacccatcgcaaccatcttcactacccacgccacattgctggggaggtacctctgcgccgcaaatatcgatttttacaatcatctggacaagtttaacatagacaaagaagccggagagcgacagatctaccacaggtattgcatggagagggcatctgtgcattgtgcccatgtgttcacaactgtgtctgaaataaccgctattgaggccgagcacatgctgaagaggaaacctgacgtagtgactccaaacggcctgaacgtgaagaaattcagtgccgtgcacgagtttcagaatctccacgcaatgtacaaggcacgaatccaggactttgttagggggcacttctatgggcacctggattttgacctcgagaagacactgtttctcttcattgctggacggtatgaattttctaacaaaggcgcggatatatttttagaatccctgtcacggcttaactttcttctccggatgcacaaatcggacatcacagtgatggtattttttattatgcccgcgaagaccaataattttaacgtggaaactctgaaaggccaggcggtgagaaagcagctctgggacgtcgcccactccgtcaaggagaaatttggcaaaaagctgtacgatgcgcttcttcgcggggagattcccgatctgaatgatattctagaccgggatgatttgaccattatgaagcgagcaatttttagcacccagcgacagtctctgccccctgtgacaacccacaatatgatcgacgatagtacagaccccatcctctctaccatcaggagaattggactgtttaataaccgaaccgaccgtgtgaaggtgatcctgcatccagaatttttgagttcaacatcgcccctgcttcctatggactatgaggaatttgtgcggggatgccacctgggtgtctttccaagttattacgaaccgtggggatatactcccgctgagtgtactgtgatgggcataccctctgtgacaactaacctttctgggttcggctgcttcatgcaggaacatgtggcggatccaacagcctatggcatatatattgtggacaggcggtttaggagtcccgacgattcctgcaaccaactgaccaagtttctctacgggttttgtaagcagtccaggagacagcgcatcatacagcgaaatcggacagagcgcctgtcagacttgttggactggaggtacctaggacggtattatcagcacgcacggcatctcactctgtcccgagcattcccagacaagttccatgtcgagctcacatctccacccacaactgagggcttcaaatacccgcgtccctccagcgtaccaccatcaccgtctgggtcacaggcctcaagtccacaatccagcgacgtagaagatgaggtggaagacgagagatatgacgaagaggaagaggctgaaagagaccgcctgaatattaaatccccattctctttgtctcacgtgccgcacggtaagaagaagctccacggggaatataagaac

SEQ ID NO: 13183 - DNA, 2109 bp, Artificial Sequence
  Description of Artificial Sequence: Synthetic coding sequence
atgctccgagggcggtctctcagtgtgacatccctcggagggctccctcagtgggaagtggaagaactcccagtcgaagaattactgctgttcgaagtagcttgggaagtgacaaataaagttgggggaatttatactgtcattcagacaaaagcaaaaacaacggccgatgaatggggggaaaattacttcctgatcggaccctatttcgaacataatatgaaaactcaggtggaacagtgtgaacccgtgaatgatgctgtcagaagggctgtagatgctatgaacaaacacgggtgtcaggtacattttggaaggtggctaattgaaggatcaccttatgttgtgctgttcgatatcgggtatagtgcatggaaccttgatcggtggaagggagatctctgggaagcttgtagtgtcggaatcccctatcacgatcgggaagctaatgatatgctcattttcggatcccttactgcttggttcttaaaagaagtgactgatcacgcagatgggaagtatgtcgtggcccagttccatgaatggcaggccggaataggacttattcttagtcgggctaggaaacttcccatcgccactatcttcactactcatgccactctcctgggaagatatctgtgtgccgccaacatagacttttataatcacttagacaaatttaatattgacaaagaagctggagagcgccagatatatcaccggtattgtatggaacgggccagtgtgcactgtgctcatgtgttcacaacagtgagtgaaatcacagctattgaagccgaacatatgcttaaaaggaaaccagatgtggtaactcccaatggattgaatgtgaaaaaattctcggctgtgcacgaatttcagaacctccatgcgatgtacaaagcccggattcaggatttcgtgaggggacatttttacggacatctagattttgatctagaaaaaacactgtttctattcatcgctgggagatacgaattttctaacaaaggggcagatatatttctagaatctctcagtaggctaaatttcctcctgcggatgcataagtctgatataacagtcatggttttttttattatgccagccaaaacaaacaactttaacgttgaaacacttaaagggcaggctgttagaaaacagctgtgggatgtggcacactctgttaaagagaagtttgggaaaaaactatatgatgccctccttagaggggagattccagatctcaacgatatattggatagagatgatcttactatcatgaaaagggctatcttctcaactcaaagacagtccctcccacccgttactacacacaatatgatcgatgactctacagatccaatacttagtacaatccgacggatagggctctttaacaaccgcactgacagggtcaaagttatcctgcatcctgaatttctcagttctacttcccctctgttgcctatggattatgaagaatttgtgagggggtgccacctcggggtatttccctcatactatgaaccttgggggtatacacccgccgaatgtactgtcatgggaatcccctccgtcacaactaatctatctgggtttgggtgcttcatgcaggaacatgttgccgatcctacagcttatggaatttatatcgttgataggaggttcagaagtcctgacgattcttgtaatcagctgacaaaatttctctacggattctgcaagcagagtcgcaggcagcggatcatccagagaaatcggactgaacgattgtcggatctcctggattggcgatacctaggaagatattaccagcacgccaggcacctcacactcagtagggccttccccgataaatttcacgttgaactcacttctccccccacaacagaagggttcaagtatcctcggcctagtagtgtgcctcccagtccatctgggtctcaggcatctagtcctcagtcttctgatgttgaagacgaagtggaagatgaacgctatgatgaagaagaagaagctgagagagatcgcctgaatatcaaatctcccttctcgctctcgcatgtaccccacggaaaaaagaaattgcacggggaatataagaat

SEQ ID NO: 13184 - DNA, 2109 bp, Artificial Sequence
  Description of Artificial Sequence: Synthetic coding sequence
atgctaaggggccgctccctgagcgtaactagcctcggagggctgccacaatgggaagtggaggagctccctgtggaagaactcctgttatttgaggtagcttgggaagtgacaaataaggtgggcgggatttacacagtgatccaaacaaaagcgaagaccaccgcagatgaatggggggaaaattatttcctcattggcccctactttgaacataatatgaaaacgcaggtggagcagtgtgagcctgtcaatgacgcggtacgtagggcagttgatgcaatgaataagcacgggtgccaggtgcattttgggaggtggctgatagagggcagtccttatgtcgtcttgttcgatatcgggtacagtgcttggaatctcgatcggtggaagggagacctgtgggaagcttgttctgtggggattccatatcatgatcgggaggccaacgacatgctgatctttggctccctcaccgcctggtttttgaaggaagtcaccgaccatgccgatggcaagtatgtcgtggcacagttccatgagtggcaggccggcatcgggctgatattgtcccgggcaagaaaactcccaatcgccaccatcttcaccacccacgctacgctccttgggcggtatctctgcgccgcaaacatcgatttttacaaccatctggataaatttaatatcgataaggaggccggagaaagacagatataccatcgctattgcatggagcgcgcatctgtgcattgtgcacacgtgttcacaacagtaagtgagataacagcgatcgaagctgaacatatgcttaaacgtaagcccgacgtggttacacctaatggcctgaacgtgaaaaagttctccgcggttcatgagttccaaaacctccacgcgatgtacaaagccagaattcaggattttgtaagagggcacttctatgggcacctcgactttgacttggagaaaactctatttctatttattgccgggagatatgagttctcaaataaaggcgcagacatcttccttgagagtctcagccggcttaattttcttctgagaatgcacaagtcagacatcacagtcatggtcttctttattatgcccgccaagaccaacaattttaatgtggagacattgaagggccaggcagtgagaaagcaactttgggacgtggctcacagcgtgaaagagaaattcggaaagaaactgtacgatgcccttctacgcggtgaaatcccggacctgaatgacatactggatagagacgacctaacaatcatgaagcgcgcgattttcagcacccagcgacaatcgctccctccagtgactacccataacatgatcgacgatagcactgaccccatactctccactatacgtagaataggcttgtttaataaccggacagatagggtcaaagtgattctccatcctgagttcctctcttccacttcccctctgctccccatggattatgaagaatttgtgcgcgggtgtcatctcggcgtctttccaagttactatgaaccttgggggtacacgcccgccgaatgtactgtgatgggcatacctagtgtaaccactaatttaagtggctttggatgcttcatgcaagagcacgtagccgatccaaccgcctacggaatttatatagttgaccggaggttccggtctcccgatgactcgtgtaatcagctgactaagtttctttatggattctgcaaacagtcacgaaggcaacgtattattcaacgtaaccgcacagaaagactgtcagacctcttggattggcggtatctcggcaggtattaccagcatgcccgccatcttactttaagtcgagctttcccagacaagttccatgtggagttaacaagccctccgactaccgagggttttaagtatcctcggccatcctcagtgccaccttccccttccgggagtcaggcatctagcccacagtccagcgacgtcgaggatgaagtggaggacgagcgatatgatgaggaagaagaggccgaaagagataggttaaatatcaaaagccccttttcacttagccacgtcccccatggtaagaaaaagctccacggagagtacaagaat

SEQ ID NO: 13185 - DNA, 2109 bp, Artificial Sequence
  Description of Artificial Sequence: Synthetic coding sequence
atgctcagaggacggtccctctcggtcaccagtctcggaggtctgccacagtgggaagtcgaagaactgccggttgaggaactgctcctgtttgaagtggcgtgggaagtaactaataaggtgggcggcatctacactgtcatccaaaccaaagctaaaaccactgcggacgaatggggggagaactatttcctgattggaccatacttcgaacacaatatgaaaacccaggtcgagcagtgtgagccggtgaatgatgcagtgaggcgcgccgtcgacgcgatgaataagcacggatgtcaggtccatttcggaagatggttgatcgaaggatcgccatacgtggtgctgtttgatatcgggtacagtgcctggaacctcgaccgctggaagggggatctgtgggaggcttgctccgtgggaatcccttaccacgaccgcgaagcaaacgacatgctgattttcggatcgcttactgcgtggttcctcaaggaagtgaccgatcacgcagacggcaagtacgtcgtagcgcaattccacgaatggcaagctgggattggtctgattctctcccgagcccgtaagctgcctatcgcgactatctttactacgcatgcgaccctcctcgggcggtacctgtgcgccgctaacatcgacttctacaaccacttggacaagttcaatattgacaaagaagctggggagcggcagatctaccaccgctactgcatggagcgcgccagcgtccattgcgcccatgtgttcactaccgtgtccgagatcaccgccatcgaagcagagcatatgttgaagcggaagccggacgtggtgactcccaacggactcaatgtcaagaagttctcggcagtgcacgaatttcagaacctgcacgccatgtataaggctcgtatccaggactttgttcggggccacttttacggacatcttgacttcgacctcgagaaaacccttttcttgttcatcgcaggtcgctatgaattctcaaacaagggagcagacattttcctggaatcactttcccgcctgaacttcctgctccggatgcacaaatcggatatcactgtcatggtgttctttatcatgcctgccaaaactaacaactttaacgtggaaactctgaagggacaggctgtgcggaagcagttgtgggacgtggcccactctgttaaggaaaagttcggaaaaaagctgtacgacgcgctgttgagaggcgagattccagatctgaatgacatcttggaccgggacgatctcaccatcatgaagagagcgatcttctccacccagcggcaatctctcccgccagtcactactcacaacatgatcgacgattcaaccgaccctatcctgtcgactataaggagaattggcctcttcaacaacaggacggatagagttaaagtgatcctccaccccgaatttctgagcagcacctcaccgcttctgcctatggattacgaagaattcgtgcgagggtgtcacctgggagtgttcccatcgtactacgagccgtggggatacacccccgcagaatgcaccgtcatgggaatcccgtcagtgactacgaatctgtccggcttcggatgcttcatgcaggagcatgttgctgatcctaccgcctacggcatctacatcgtcgacagacgctttcgctcaccagacgattcgtgcaatcagctcaccaagtttctctacggtttctgcaaacagtcacggcgccaaagaatcatccaaagaaaccgcactgagcggctgtccgacctcttggactggagatacctgggcagatattaccaacatgcccggcatctgacgctgtcgcgcgccttcccggataagttccatgttgaacttacctcgcccccaaccaccgaaggattcaagtacccgcgccctagttctgtgccgccgtcgccatccggcagtcaagcatcctccccgcagtcgtcggatgtggaggatgaggtggaggatgaacggtacgatgaggaggaggaagcagaacgcgaccgactgaatatcaagtcccccttctcactgtcccacgtgccgcatggaaagaagaagttgcacggagaatacaaaaac

SEQ ID NO: 13186 - DNA, 2109 bp, Artificial Sequence
  Description of Artificial Sequence: Synthetic coding sequence
atgctgcggggaagaagtctgagtgtcacctcactgggaggactgcctcagtgggaagtggaggagctgcccgtggaagagctgttgctgttcgaggtcgcctgggaggtcacaaataaagtggggggaatctataccgttattcagaccaaagccaagaccacggcagacgagtggggggagaattatttcctgatcgggccctattttgaacacaacatgaagacccaagtcgagcaatgcgagcctgtgaacgacgccgtgaggcgggccgtggatgccatgaataagcatgggtgtcaggtccactttggaaggtggctcattgagggctccccttacgttgtgctgttcgacattggctattccgcctggaatctggataggtggaagggagatctttgggaggcatgttcagtgggcatcccctatcacgatcgagaagccaacgatatgctgattttcggcagcttgacagcatggttcctcaaggaggtcaccgatcacgctgatggaaagtatgtggtggcacagtttcatgaatggcaggcagggatcggattgattctgtctagagctaggaaattgcccatcgccaccatatttaccacgcatgccacgttgctgggcaggtacctctgtgccgccaacatagatttctataatcaccttgacaaattcaatatcgacaaagaggccggtgagcggcaaatctatcaccggtactgcatggaacgcgccagcgttcactgcgctcacgtttttactactgttagtgagatcaccgctatcgaggccgaacacatgctgaaacgcaaacccgacgtcgtgacaccgaatggactgaacgtaaagaagttttccgctgttcacgaattccagaacctgcacgctatgtataaagctcgcatccaagactttgttcgaggacacttttacggacacttggatttcgacttggagaaaaccctgttcctgttcattgcaggcaggtatgagtttagtaataagggagcagatatttttctggagtccctgagtcgactgaacttccttctgcggatgcacaagtcagatatcaccgtgatggtgttctttatcatgcccgctaagacaaacaattttaatgtggagacgcttaagggacaggccgtgcggaagcagctgtgggatgtggcgcattcagtaaaagagaagttcggaaaaaagctgtacgatgcactcctgcgaggcgagatccccgatctgaatgacattctggacagggacgacctcaccataatgaagcgcgcgatattctcaactcagagacagtctttgccaccggtgacgacccacaacatgatcgacgactctaccgacccaattctgagcaccatccgcagaattggcttgtttaataaccggactgaccgggtaaaagtgatcctgcacccagagttcctctcaagcacctctccactgctgcctatggactacgaggagtttgtgcgggggtgccacctgggagtgtttccttcctactacgagccctggggctacactcctgccgaatgcaccgtcatgggaatcccctcagtcaccactaacctgtctgggttcggctgctttatgcaggaacacgtggcggatcctaccgcatatggaatctacatcgtggacaggcgctttcgcagccccgatgattcctgcaatcagttgacgaagttcttgtacgggttttgcaagcagtccagacggcagcgcatcatccagaggaaccgcacagagcggctgtcagatctgctcgattggcggtacctggggcggtattatcagcacgctcggcacctgacactgtctcgggccttcccagacaagttccatgtggaactgacctctccccccaccaccgagggctttaagtacccacggcccagttcagtgcccccgtcaccaagcggttcacaagccagctccccacagagcagtgatgttgaggacgaggtcgaagacgagaggtacgacgaggaagaagaagctgaacgcgacagactgaacatcaagagtcccttctcattgagtcatgtgcctcacggtaaaaaaaagctgcacggggaatacaaaaat

SEQ ID NO: 13187 - DNA, 2109 bp, Artificial Sequence
  Description of Artificial Sequence: Synthetic coding sequence
atgctgaggggacgctcactctccgtgacttcgctgggcggactgcctcaatgggaggtggaagagttgcctgtggaggaactgctgctctttgaagtggcatgggaagtcaccaacaaggtcggaggcatctacaccgttatccagacgaaagctaaaaccactgctgacgagtggggcgagaactacttcctgatcgggccatacttcgaacacaatatgaaaacccaagtcgaacagtgcgagccggtgaacgatgcggtgagaagagccgtggatgctatgaataagcatggctgccaggtgcacttcggaaggtggcttatcgaaggatccccatacgtggtcctgtttgatatcgggtactccgcatggaacctcgaccgctggaagggcgacctgtgggaggcatgctcggtcggcattccatatcacgaccgggaggccaatgatatgcttatctttggctcacttactgcgtggttcctcaaggaagtgaccgatcatgccgacggaaaatacgtcgtggcccagttccacgagtggcaggcgggaatcggactgattctgagcagagcccgcaagttgccgattgctactatcttcactacccacgctacccttctgggtcggtacctctgcgctgcaaatatcgacttttacaaccacctggacaaattcaacatcgacaaagaggctggcgagaggcaaatctaccaccgctactgcatggaacgcgcctcggtccactgcgcccacgtgttcaccaccgtgtccgaaatcacggcaattgaggcagagcacatgctgaaacggaaaccggacgtggtgaccccaaacggactcaatgtcaaaaagttcagcgcggtccacgaatttcagaacctgcatgccatgtacaaggcccgcattcaagacttcgtgcgcggccacttctacggccacctggatttcgatctcgaaaagaccctgttcctgttcatcgccggacgctacgagttctcgaacaaaggagcggatatcttcctggagagccttagccggctcaattttctgcttcgcatgcataagtcagacatcaccgtcatggtctttttcatcatgccggccaagaccaataacttcaatgtggaaaccctgaaggggcaagcagtccggaagcagctgtgggatgtggcccactcagtgaaggagaagttcggcaagaagctgtacgatgcactgctgcggggcgaaatccctgacctcaacgacatcctggaccgcgatgatctcaccatcatgaaacgggcgatcttctcaacccagcggcagtcactgccgccggtgaccacccataacatgatcgatgattcaactgacccaatcctgtcgactatccgccgcatcggactgttcaacaatcgcaccgacagggttaaggtgatcctgcacccggaatttctctcatcgacctcgccgcttctgcccatggactatgaggagtttgtcagaggatgtcatctgggggtctttccatcatactacgagccatggggatacacccctgccgagtgtaccgtaatggggatcccgtcagtgaccactaacctgtcggggttcggatgcttcatgcaggaacacgtggccgatccgactgcgtacgggatctacattgtggaccggagatttaggtcccctgatgattcgtgcaatcagctgactaagttcctttacggattttgcaaacagagcaggaggcaacggattatccaacgaaaccgcaccgaacgcctctctgatctgctggattggcgctacttgggacggtactaccagcatgctagacatctgactttgagcagagcgttcccagataagttccatgtcgaactgacgtccccgcctacgaccgaaggattcaaatacccgcgcccgagctccgtgccacctagcccgtcgggatcgcaagcgtcgtcaccacaatcctccgatgtggaagatgaggtggaggacgagcgctacgacgaagaggaagaggccgaacgtgaccgcctgaatatcaagtcacctttcagcctgagccacgtgccgcacgggaagaagaagctccacggcgaatacaagaat

SEQ ID NO: 13188 - DNA, 2109 bp, Artificial Sequence
  Description of Artificial Sequence: Synthetic coding sequence
atgctgaggggcaggtccctcagcgtcacctccctcggaggacttcctcaatgggaagtggaggaacttcctgtggaggagttgctgctgtttgaggtcgcctgggaggtcactaataaggtgggtggaatctacaccgtcatacaaaccaaggcaaagactaccgcagatgaatggggtgagaattactttctgataggaccttactttgaacataacatgaaaactcaagtggaacagtgcgagccagtgaacgatgcagtgagacgcgccgtggatgctatgaataaacacgggtgtcaggtccacttcggaaggtggctgatcgaaggatcaccatacgtcgtgctcttcgacatcgggtactcagcatggaatctggataggtggaagggggatctgtgggaggcctgttccgtgggaatcccataccatgacagagaggcaaacgatatgctgatttttggatcgcttactgcttggtttttgaaggaagtaactgatcacgcagatggtaagtacgtggttgcacagttccatgaatggcaggcaggtatcggactcatcctctcccgagcgagaaagctcccgattgcaactatctttaccacccatgctactctccttgggcgttacctgtgtgcagcaaacattgacttttacaaccatttggataagttcaacatagataaggaagcgggtgaaagacagatctaccatagatattgcatggaacgagcatcggtgcactgtgcccatgtttttaccaccgtgtcggaaattaccgccattgaagcagaacatatgctgaaacgcaaacctgatgtggtcacccctaacggacttaacgtcaaaaagttctccgccgtgcacgagttccagaacctgcacgcaatgtacaaggcacggatccaggactttgtgagaggacacttttacggccacctggacttcgatctcgaaaagaccctgtttcttttcatagccggaaggtatgaattttccaacaagggcgcagatatctttttggaaagcctttcgcgtctgaattttctcctcagaatgcataaaagcgatataaccgtgatggttttcttcataatgcctgcaaaaaccaacaacttcaacgtggaaacgctcaagggacaggcagtgaggaagcaactctgggacgtcgcacacagcgtgaaggaaaagtttgggaagaagctgtacgacgccctccttagaggggagattcccgatctcaacgacattctggaccgggacgatcttactattatgaaacgcgcaatctttagcactcagcgtcaatcgctgcccccggtcactacccacaacatgattgacgactcaaccgatccaattcttagcacgatccgacgcattggtcttttcaacaacagaactgatagagtgaaggtcattctccatcccgagtttttgtcctctaccagcccgctcctgccaatggattacgaggaatttgtccggggatgtcatctgggagtctttccttcgtactacgaaccttggggatacaccccagccgaatgcactgtgatggggataccgagcgtgacgactaatctgagtggttttgggtgttttatgcaggagcatgtggcagatccgaccgcatacggcatttacattgtggaccggagattcagatcacctgacgattcatgcaatcaacttacgaaatttctgtacggtttctgtaagcaaagccgccgccaacgcattattcaaagaaatagaactgaacggctgtctgacctcctggactggcggtacctgggaagatactaccaacacgccagacatctcactcttagccgggcatttcctgataagttccacgtggagcttacttcgccacccaccaccgaggggttcaagtacccgcggccaagctcagtccccccatcaccatccggttcgcaagccagctcaccccaatcgagcgacgtggaggatgaagtggaggacgaacgatacgacgaagaggaagaagcggaacgggaccggctcaatatcaagagccccttctcccttagccacgtgccccatggtaagaaaaagctgcacggagaatacaagaac

SEQ ID NO: 13189 - DNA, 2109 bp, Artificial Sequence
  Description of Artificial Sequence: Synthetic coding sequence
atgctccggggccgttccctttccgtgacctcacttggtggcctgcctcagtgggaggtagaagaactcccggtcgaagaactgcttctgtttgaagtcgcatgggaagtcaccaacaaagtgggtggtatttacactgtgattcagaccaaggctaaaactaccgccgacgaatggggagagaattacttcctgattggaccttactttgaacacaatatgaaaacccaggtcgagcaatgtgaacctgtgaatgatgcagtgcggcgggccgtggatgcaatgaacaagcacggatgccaggtgcattttggaaggtggctcatagaaggttccccctacgtggtccttttcgacattgggtacagcgcctggaacctcgatcggtggaagggagatttgtgggaggcatgcagcgtggggattccctaccacgatagagaggctaatgatatgcttatcttcgggtccctgactgcatggttccttaaagaagtgaccgaccatgcagatggtaagtacgttgtggctcagtttcatgaatggcaagcaggaattggacttattctcagccgcgcacggaagctccccattgcaactatctttaccacccacgcgacccttcttggacgatacctgtgcgcagcgaatattgacttctataatcatcttgataagttcaatatcgataaggaagcgggagaaagacagatttatcatagatactgcatggaacgcgcctcagtgcattgtgcgcatgtctttactaccgtgtcagaaataaccgccatcgaagccgaacatatgctcaagcgcaagccagacgtggtcactcccaacggactcaacgtgaaaaagttttcggccgtgcatgaatttcaaaatctgcatgcaatgtacaaggcacgaatacaagactttgtcaggggacatttctacggacatcttgattttgatctggaaaagactctgtttctcttcatcgcaggtcgttacgaatttagcaacaagggagccgacatttttcttgaatcccttagcagacttaacttcctgctccgcatgcataagagtgacataactgtgatggtctttttcataatgccagccaaaaccaataacttcaatgtggaaacccttaaaggacaagcagtgaggaaacaactttgggacgtggcgcactcggtaaaggaaaagttcggcaaaaaactttacgacgcacttcttcgcggtgagattcctgaccttaacgacattctggatagagatgatcttaccattatgaagcgcgcaatcttttcgactcaaagacaatcgctgccccctgtcaccactcataacatgattgatgattcaaccgatccaattctgagcaccatacggagaatcggattgtttaacaatcgtactgaccgcgtgaaggtcatccttcatcccgaatttctttcatctacctcccctctgttgcctatggactatgaagagttcgtccgcggttgtcacctgggagtctttccatcatactacgaaccatggggttacactcccgccgaatgcactgtgatgggaataccctcggtgacgacgaacctctcagggtttggatgcttcatgcaagagcatgtggcggaccccactgcgtacggtatctacatagtggacaggaggttccgatccccagacgactcctgtaaccagctgactaaattcctgtacggcttttgtaagcaatcgcgacggcaaaggattattcagcgtaatagaaccgaacggctcagcgacctgcttgactggcggtacctggggagatactaccaacatgctcgacatctcactctcagtagagcatttcctgacaagttccatgtggagcttacttcgccccccaccaccgagggcttcaagtaccctcgcccgtcctcagtgccaccctccccatcggggtcacaagcatcctcgcctcagagctccgatgtcgaagatgaagtggaagatgagcgctacgatgaagaggaggaggcggaaagagataggttgaatatcaagtcgcctttttccctgagccatgtgccacacggaaagaaaaagctgcatggagaatacaagaac

SEQ ID NO: 13190 - DNA, 2109 bp, Artificial Sequence
  Description of Artificial Sequence: Synthetic coding sequence
atgctgcgggggcgaagcttaagcgtgacctctttgggcggtctgccacagtgggaggttgaagagctgcccgtggaggaactgttgttatttgaagtcgcttgggaagtgaccaataaggtgggcggcatctacacagtgattcaaaccaaggctaagacgacagcggacgagtggggggagaattatttcttgattggtccctactttgagcataacatgaaaactcaagtggagcagtgtgagccagttaacgacgcagtccggcgcgctgtagatgcgatgaataagcacggatgccaggtgcacttcggacgatggctgatcgagggtagtccttatgtagttctgttcgatatcggctacagcgcctggaacctagaccgctggaagggggacctgtgggaggcctgtagtgtgggaatcccttatcacgaccgcgaagctaacgatatgctgatctttggctctctcaccgcctggtttctgaaagaagtcacggaccacgctgacggaaagtatgtggtggcacagtttcacgagtggcaggcaggcatcggtctgatcttgagcagggcaagaaaattgcctattgctacaatcttcaccacccatgccacattactcggtaggtacctgtgcgcggcgaacattgacttttataaccatctcgacaagtttaatatcgacaaggaagctggtgaacgccaaatctatcataggtactgtatggagcgagcatccgttcattgtgcccacgtattcacaactgtgagcgagattacagccatcgaagcggagcacatgttgaaacggaaaccggatgttgtcactcctaacggcctgaacgtgaaaaaattcagtgccgtccacgagtttcagaacttgcacgctatgtacaaggcaaggattcaagactttgtccgcggccacttctacgggcacttggattttgaccttgagaaaacgctgttccttttcatagctggacggtatgaattctccaacaagggggcggatatctttctggagtccctatcgcgcctcaactttcttcttcggatgcataagagcgatatcaccgttatggtcttctttatcatgcctgcgaagacaaacaattttaacgtggaaactctgaaaggccaggcggttcggaagcagctgtgggatgtcgcccactctgtcaaggagaaattcggaaagaagttgtatgatgcactgctccgcggcgaaatcccggatctcaacgatattctggacagagacgacctcacaatcatgaaacgtgccatattttctacccagagacagtcgcttcccccggtgacaacccataatatgatcgacgactctactgatcctattctatcaacgattcgcagaatcggtctgtttaacaaccgcaccgaccgcgtgaaggttatccttcatccagagttcctgagcagcaccagcccattactgcccatggactacgaggagtttgtccgagggtgtcacctgggggttttcccatcatattacgagccatggggatatactcccgcagaatgcaccgtgatgggaattcctagtgtgaccactaatctgtccggctttgggtgtttcatgcaggagcacgtggctgatcctaccgcgtacgggatatatatcgtggatagacgatttcgctcacccgatgatagctgcaaccagctgaccaagttcctttatggattttgtaagcagtcacgccggcagcgcattatccagcggaacagaaccgaacggctgtcagatctgcttgattggcgttacctggggcgctactaccagcatgcccgccacctaacgctgtcccgagccttccccgacaagttccacgtggaactgactagtccccctaccaccgaaggctttaagtacccacggccatcctctgtgcctccaagtcccagcggctcccaagcttcctcacctcagagcagtgatgtcgaggacgaggtggaggatgagcggtatgacgaggaagaggaagccgagcgcgaccgacttaatatcaaatccccattttctttgtcccatgtacctcacgggaagaaaaagttgcacggggagtataagaat

SEQ ID NO: 13191 - DNA, 2109 bp, Artificial Sequence
  Description of Artificial Sequence: Synthetic coding sequence
atgcttcgcggaaggtccttgtccgtcacctctctcggaggactgccccagtgggaggtcgaggagctcccagtggaggaactccttctgttcgaagtcgcctgggaggtgacgaacaaagtaggcggcatctacaccgtgattcaaaccaaagccaagaccaccgctgacgagtggggagaaaactatttcctgattggtccgtacttcgagcacaacatgaagacacaagtggaacagtgtgaacctgtgaacgatgccgtgcgccgggctgtggatgccatgaataaacatgggtgtcaggtgcacttcggtcgctggctaattgaggggtcaccctatgtggtgctcttcgatattggttactccgcatggaacctcgaccggtggaaaggagatttgtgggaagcctgttcagtggggattccttatcacgatagagaagccaacgatatgctgatatttggctccctgacagcatggtttcttaaggaggtcactgaccacgcggacggcaagtacgtggtggctcagttccatgaatggcaagccgggataggcctgattctgtccagagctcgaaaactgccaatcgctaccatctttaccacccatgcaacactgctgggacggtatctgtgtgcagccaatattgatttctataaccacctcgataagttcaatatagataaggaggcgggcgagcgacagatatatcatagatattgtatggaaagggcttctgtgcactgtgcacatgtatttacgacggtttccgagataaccgctatcgaggccgagcacatgttaaagcgaaagccagacgtggttaccccaaatggtctaaacgtgaagaaattttctgctgtccacgagtttcagaatttgcacgcgatgtacaaagctaggattcaggatttcgttagagggcacttctatgggcacctagattttgacctcgagaagaccttgttccttttcatcgccggaaggtatgagttctctaataaaggggctgatatcttcttggaaagcctctctagactgaatttcctgctccgcatgcacaagtccgatattacagtgatggtatttttcatcatgccagcaaagactaacaatttcaatgtggagactttaaagggacaggctgtgcgcaagcaactatgggatgtcgcacactccgtcaaggagaaatttggtaagaagctttatgatgcacttttgcggggagagatcccagacctcaatgacatcctggaccgggatgacctgacaattatgaagagagccatatttagcactcaacgacagagccttccgccagtgacaacacacaacatgatcgacgacagcaccgaccccatcctaagcaccatccggagaattgggctctttaataaccggacagacagggttaaggttatactgcacccggagtttttgagcagtacaagtccgctgttacccatggattatgaagaattcgttagggggtgccacctgggcgtattcccgtcgtattacgagccgtgggggtacacacccgccgagtgtaccgtgatgggcatacctagcgtgaccacaaacctgagcgggtttggatgcttcatgcaagagcatgtcgctgatcctacagcatacggcatttatatcgtggatagaaggttccgctctccagacgattcatgtaatcagttgacaaagtttttgtatggattttgcaaacagtccagaagacagcgcattatacagcgcaaccggactgagaggttgtccgatctgttagactggcggtatcttggtcgatattaccagcacgcccggcacctgactctttccagggcctttccagacaaattccacgttgagctgaccagcccgcccactactgagggctttaaatacccacggccctcttctgtacctccatcgccttcaggatcacaggcttcctcgcctcaaagtagcgatgttgaagatgaggtggaagatgaacggtatgacgaagaagaggaggctgaacgggacagattgaacattaagtcccccttttccctgtcgcatgtgccacacgggaaaaagaagctgcatggtgagtacaagaat

SEQ ID NO: 13192 - DNA, 2109 bp, Artificial Sequence
  Description of Artificial Sequence: Synthetic coding sequence
atgctgcggggacgctcgttgtcggtgactagcctcggcgggttgccccagtgggaggtcgaggaactgccagtggaggaattgctgctgttcgaggtggcttgggaggttaccaacaaggtgggaggtatctacactgttatacaaacgaaggctaagaccaccgccgatgaatggggcgagaactactttctgatcggcccgtatttcgagcataacatgaaaacccaagttgaacagtgcgagccggtcaatgatgccgtgcgccgcgcggtcgacgccatgaacaaacacggttgccaagtgcatttcggcagatggctgattgaagggtccccgtacgtcgtgctttttgatattggatactccgcatggaatctggaccgctggaaaggagatctctgggaagcatgttcggtgggtatcccctaccatgacagagaggcgaacgatatgcttatcttcgggtcccttaccgcttggttcctgaaagaagtcactgatcacgccgatggaaagtacgtggtcgcccaattccacgaatggcaggcgggaatcggtctgattttgtcccgggctcgcaagctccctatcgcgactatcttcactactcacgccaccctcctgggacgctacctctgcgccgctaatatcgacttctacaatcacctggataagtttaacatcgataaggaagccggcgagcggcaaatctaccatcggtactgcatggaacgcgcttcggtccattgcgcccatgtgttcaccactgttagcgaaattaccgcgattgaagcggaacacatgcttaagcgcaagccagatgtggtgactccgaatgggctgaacgtgaagaagttttcggccgtgcacgagttccagaacctgcatgccatgtacaaggcccgcatccaggatttcgtgcgggggcatttctacggacacttggatttcgacctggaaaagacgctgttcctcttcatcgcgggccgctacgagttttccaataagggcgccgacatctttttggagtcgctctctcggctcaactttctgctgagaatgcacaagtcagacattaccgtgatggtgtttttcatcatgccagcgaaaactaacaatttcaacgtggaaaccctgaaagggcaggcggtacggaagcaactgtgggatgtggcgcattcggtcaaggaaaagttcggaaagaaactttacgacgcgttgctccgcggagaaatccctgacctgaacgatattctcgaccgcgatgatctcactatcatgaaacgtgcaattttctccacccagcgccagtcactgccaccggtgacgacccacaatatgatagacgactccactgacccgatcctgtcgactatcaggagaattggcctgttcaataacaggacggatcgcgtgaaagtcatcctgcatccagaatttctgtcatcaacctccccacttctgccgatggactacgaggagttcgtgcgcggctgccatctgggtgtctttccgagctactacgaaccatggggatacaccccggccgaatgtacggttatgggcatcccgtcagtgactactaacctcagcgggttcggttgtttcatgcaggaacatgtcgctgaccctactgcctatggcatctatatcgtggaccggcggtttagatccccggatgattcgtgcaatcaactcactaagttcctttacggcttttgtaagcaatccagacgccagagaatcatccagcgcaacagaaccgaacgcctgtccgacctcctggactggagatacctgggtcggtactaccagcatgcccggcatctgacgctttcgcgcgccttcccggataagttccacgtggagcttacttcgcccccgaccacggaaggatttaagtatcctagaccgtcctcggtgccgccgagcccgtccggaagccaggcctcgtccccgcagtcatccgacgtggaggacgaagtggaggacgagcggtacgacgaggaagaagaggccgaacgcgatcggttgaacatcaagtcgccattctcgctctcgcacgtgcctcatgggaagaagaaacttcacggagaatacaagaac

SEQ ID NO: 13193 - DNA, 2109 bp, Artificial Sequence
  Description of Artificial Sequence: Synthetic coding sequence
atgctacggggaagaagcctttcggtgactagcttgggcgggctcccccagtgggaagtcgaagaactgccagttgaagaactgcttcttttcgaggtagcgtgggaagtgacaaataaggtaggcgggatttacaccgtaattcagacaaaagcgaagactactgccgacgagtggggtgaaaactactttctaatcggcccctactttgaacacaacatgaagacacaagtggaacaatgtgagccagtcaatgacgcagtgcggcgggcagtggacgcaatgaacaagcatggctgccaggtgcacttcggacggtggttaatagagggcagtccttacgtcgtgctgtttgatatcggttacagcgcgtggaacttggacagatggaaaggcgatctgtgggaggcctgtagcgtaggtatcccgtaccacgatagggaagctaacgatatgctcatatttggcagcctaactgcatggttcctgaaagaggtcactgatcatgctgatggaaagtatgtcgtagcccagtttcatgaatggcaagctgggatcggattaatcctctcgagggctcgcaagttacccattgcgaccattttcacaactcatgccacactgctgggacgatatctgtgcgccgccaacatagatttctacaaccacctcgacaagttcaacatagacaaggaagcgggggaacggcagatctaccacaggtattgcatggagcgcgcgtctgtccactgtgcccacgtgttcactaccgtgtctgagataactgctatagaggctgagcatatgctgaagcgaaagccagatgtggttacaccaaatggcttgaacgtaaaaaagttttccgccgtccatgaatttcagaacctgcatgctatgtataaggcaaggatccaggactttgtgcgggggcatttttacggccacttggattttgatttggagaaaactttatttctctttattgccgggcggtatgagttctcaaataagggggctgatatctttctcgaaagcctgagtcggctcaacttcctcctgagaatgcacaagtctgatattactgtgatggtgttcttcataatgccagctaaaaccaataacttcaacgtggagacacttaaggggcaggcggttcggaaacagttgtgggatgtggctcattctgtcaaggaaaagtttggtaagaagttgtatgacgctctcctccgcggcgagattcccgacctgaacgacatccttgatagggacgacctgacaatcatgaagcgggccatttttagtacccagagacagtccctcccaccggttaccacccataacatgattgatgactccacggaccctatcttgtcaaccattaggcggattggcctgttcaacaaccggaccgatagagtgaaagtcatcctccaccccgaattcctttcttcgaccagcccactcttgcctatggattacgaggaattcgttagagggtgccatcttggtgtgtttccgagttattatgaaccctggggctacactccagcagagtgcaccgtgatggggataccgtctgttaccacaaacttgagcggcttcggttgcttcatgcaggaacacgttgctgatcccaccgcatatggtatttatatcgtcgatagacgctttaggagcccagacgattcatgtaatcagctgaccaagttcctgtacggattttgtaaacagagtaggaggcaacgcatcatccagcgtaaccggaccgagcgtttgagtgatctactcgactggcggtaccttggccgatattaccaacatgcccgacatctaacactgtcgcgagctttccccgataaattccatgtggaactgacgagccctccaacaacagagggtttcaagtaccctagaccgtctagcgtgccaccttccccgtctggctcccaagcttcttccccccagagcagcgatgttgaggatgaggttgaagatgagcgctatgacgaagaggaggaagcagaacgagataggttgaatattaaatcaccattttccttatctcatgtgccacatggtaagaaaaagctccacggggagtacaagaac

SEQ ID NO: 13194 - DNA, 2109 bp, Artificial Sequence
  Description of Artificial Sequence: Synthetic coding sequence
atgctgcggggcagatccctttccgtcacttcactgggtggactcccccaatgggaggtggaagaactgcctgtcgaagagctgctcctgtttgaagtcgcctgggaagttaccaataaagtcggcggcatatacaccgtgatccaaacgaaagccaagactacggcggacgagtggggggaaaactacttccttattggaccttactttgaacacaatatgaaaacccaggtggaacagtgcgagccagtgaatgatgcagtgcgtcgcgcggtggatgcaatgaataaacacgggtgtcaggtgcacttcggtaggtggctgatcgagggatcaccctacgtcgtgcttttcgacattggatactcggcttggaaccttgatcggtggaagggcgatctttgggaggcatgctcggtgggaataccctatcatgaccgggaagcgaacgatatgttgatattcggcagccttaccgcatggtttctcaaggaagtcaccgatcatgccgacggcaagtacgtggtcgcacagtttcatgaatggcaggcaggaataggtcttattctctcccgcgcaaggaaactgcccatcgctaccattttcaccacccatgcaaccctgcttgggcgctacttgtgcgcagcgaatatcgacttttacaaccatctggataagttcaacattgacaaggaagctggagaaaggcagatataccatcgatactgtatggaacgagcatccgtccattgcgcacacgtttttaccacggttagcgagattacggccatcgaagccgaacacatgctgaagaggaagcccgacgtggtcacccccaatgggcttaacgtgaaaaagttttccgccgtgcatgaatttcaaaatctccatgcgatgtacaaggcaagaatacaagatttcgtgagaggccatttctacggtcacctggatttcgaccttgaaaagaccctctttttgtttatagccggtagatacgagttttccaacaaaggggcagacatttttcttgaatcactttcccgtctgaattttcttctgcgtatgcataaaagcgacatcacggtcatggtgtttttcatcatgccagccaagacgaataactttaacgtggagactctgaagggccaggcggtgagaaagcagctttgggatgttgcgcacagcgtaaaggaaaagttcgggaagaagttgtatgacgcactcctcaggggagagatcccagatcttaacgatatcctggatcgggatgatttgactattatgaagagagcaattttctcgacccaaaggcaatcactgccgcctgtgaccacccataacatgattgacgactccactgatcctattcttagcaccattcgaaggattgggctgtttaacaatcgcaccgacagggttaaggtgattcttcaccctgaatttctgagctccacttccccactgctgcctatggattatgaagaatttgtccgcggatgtcacctcggagtgttcccgtcatactacgaaccgtggggatacactccagccgagtgcacggtgatggggattccgtcggtcaccactaacctgtcgggatttggatgtttcatgcaggagcacgtggcagaccctaccgcttacgggatctacatcgtcgatcgtagatttagatcacctgatgattcatgtaatcagctgacgaagtttctctacggtttctgtaaacaatcccgcagacagcgcatcattcagcgaaaccggactgaaaggctttccgatctgctggactggcgctaccttggacgatactaccaacatgccagacaccttaccctctccagggctttccctgacaaatttcatgtcgaactcacctcaccaccaaccactgagggattcaagtacccaagaccaagttcagtaccaccgtcgccatcgggcagccaggcgagttcaccccaatcctctgacgtcgaagatgaggtggaggacgaacggtacgatgaagaagaagaagcagagcgcgaccgtcttaacataaagagccctttctcgctgagccacgtcccgcatggcaaaaagaagctccatggagaatacaagaac

SEQ ID NO: 13195 - DNA, 2109 bp, Artificial Sequence
  Description of Artificial Sequence: Synthetic coding sequence
atgctgagaggtcggtcgctgtccgtgacttcgctcggtggtttgccacagtgggaagtcgaagagttgcctgttgaggaacttcttctgttcgaagtggcgtgggaagtcaccaacaaggtcggtggtatatacactgttattcagaccaaggcaaaaaccactgcagatgaatggggggagaattactttcttatcgggccttactttgagcataacatgaaaacccaggtggaacagtgtgaaccagtcaatgatgcggtgaggcgcgcagtcgatgccatgaataagcatgggtgccaagtgcatttcgggagatggctgattgagggaagcccttacgtggtcctgtttgacattggatactcggcatggaacctcgacagatggaaaggagatctgtgggaagcatgctcggtgggaatcccataccatgaccgcgaagcgaacgatatgttgattttcggctcgcttactgcatggttcctcaaggaagtgacggaccacgcagatggaaagtacgtggttgctcaatttcatgaatggcaagccggaatcggacttattctctcacgcgcgcgaaaactgccaatcgcaactatctttaccacccatgcaacgctcctgggtcgctacctttgcgcagctaacatagatttctacaatcacctggataagtttaacatcgataaggaggcaggtgagagacaaatctatcacagatattgtatggaacgcgcgtccgtgcactgtgcacacgtgtttaccactgtgtcagagatcaccgcaattgaagctgagcacatgcttaagagaaagccggatgtggtcaccccaaatggcttgaacgttaagaaattctccgccgtgcatgaatttcaaaacttgcatgcaatgtacaaagcaagaatacaagacttcgtccgaggccacttttatggacacctggactttgatctggagaaaactctttttctgttcatcgcgggaagatacgaattctcgaacaaaggcgcggatatctttctggagtcattgtcacgactgaactttcttcttcgtatgcataaatccgatattaccgtgatggtgttctttatcatgccggcaaagaccaacaactttaacgtggaaactctcaagggacaagcggtccggaagcagctgtgggatgtcgcccattccgtgaaggagaaattcgggaagaagctgtatgacgctctgcttcgtggcgagattcccgacctcaacgacatactggatagagatgaccttacgattatgaagcgcgctatcttctccactcagagacagtcgcttccccctgtgaccactcataacatgatcgacgattcaactgaccctattctgtcaactattcgccgcataggactctttaacaatcggactgaccgagttaaggtgatacttcacccagagtttcttagctcaacgtccccactgctgccaatggattacgaagagtttgtgagaggttgccatctgggtgtgtttccaagctactacgaaccgtggggttacacccctgccgaatgtacggtcatggggatcccgagcgtgaccactaaccttagcggctttggatgtttcatgcaagaacatgtcgcggatcctactgcctacggcatttacatagtcgatcgtaggttcagatcccccgatgactcctgtaatcagctgacgaagtttctgtacggattttgtaagcagagcaggcgccaacgaatcattcagcgaaataggactgaacggctttcggatttgttggattggcgatacctgggacgctactaccaacacgcgcgacacctcacgctctccagagcatttcctgataagtttcacgtggaactgaccagccctccaaccaccgagggattcaagtacccccgtccttcgtcggtgcctccttcgccatctggatctcaagcatccagcccacaatcgtcggatgtcgaagatgaagttgaggacgaacggtacgacgaggaagaagaagcagaacgcgaccgtctgaacatcaaaagccctttctccctgagccatgtgccccacggtaagaaaaaacttcacggagaatacaagaat

SEQ ID NO: 13196 - DNA, 2109 bp, Artificial Sequence
  Description of Artificial Sequence: Synthetic coding sequence
atgttgcgaggccgaagtctgagcgtgacgtccctgggcggacttccacagtgggaggtggaagaactgcccgtggaagagctgctcctcttcgaggtggcatgggaggtaacaaataaagtaggcggcatctacacagtcattcaaaccaaagctaagaccacagcggacgaatggggggaaaattacttcctaatcgggccttatttcgagcacaatatgaaaacccaggttgaacaatgcgaacccgtcaatgacgccgtgcgcagagcagtggatgctatgaacaaacatggctgtcaggtacactttggacggtggctgattgaggggtcaccatacgtggtcctgttcgacataggatattcagcttggaatttggaccgatggaagggcgacctgtgggaagcctgttctgtgggcattccttaccacgacagggaggccaacgacatgctgatcttcgggtccctcactgcatggtttcttaaggaagtgaccgatcatgctgacggtaaatacgtcgttgcacagttccatgagtggcaggcaggtataggcttgatcctcagtcgagctaggaagctcccaattgccactatattcactactcacgcgacgctgctgggacgatacctgtgcgccgccaatatagatttttacaatcacctcgacaaatttaacatcgacaaagaagcaggcgaacggcagatttatcataggtactgtatggaaagagccagcgtccattgtgctcatgtgttcacaactgtcagtgagatcacagcaattgaggctgagcacatgttgaagcgcaagcctgacgttgtcacaccaaacgggctgaacgtgaaaaaattcagtgccgtacacgaattccagaacttgcacgccatgtacaaggcaagaatccaggactttgtgcgaggtcacttctacggtcatctggatttcgatttagagaagacgctgtttctgttcatcgcaggtcggtatgagttcagcaacaagggcgctgacatctttttggaatccctaagcagactcaactttttgctccgcatgcacaagtcagatattaccgtgatggtcttctttattatgcctgcaaagacgaataacttcaacgtggaaaccctgaagggtcaggcagtgcgaaagcagctgtgggacgtagcccactctgtaaaagagaagtttgggaagaaattatatgacgccttgttgagaggagaaatcccggacctaaacgatattctggatcgggacgatctgacaatcatgaaacgggctattttttccacacaaaggcagtcattgccaccggttaccacacataatatgatcgacgactccacggaccccatactgagtacaataaggcgcataggactgtttaacaatagaacagatcgcgtgaaggtaattttgcaccctgagttcctgtcgtccacaagcccccttctccccatggactatgaagaattcgtacgcggatgccaccttggtgtttttccctcttactatgaaccctggggctacactcccgcagagtgtacagtcatgggaatcccctcagtgaccacaaatctctcaggcttcggatgctttatgcaagagcatgttgctgatcccaccgcttatggtatctacatcgttgaccggcgcttccggagtcctgatgattcttgcaaccaactgacgaagttcttatatggtttttgtaaacagtctaggcggcagcgaatcatacaacgcaatcggacggaacggctttccgacctattggattggcgatacctcggccggtattaccaacacgctaggcacctcacattgagccgggccttccccgacaagtttcatgtggaactgacctctcctcccactaccgaggggttcaagtacccgcgcccatccagcgtcccaccttcacctagcggatcgcaagcgtcttcaccacagtcgtcagacgtggaagacgaagttgaagacgaacggtacgatgaggaggaagaagcagaaagggaccgcctgaacattaagtccccattttctctatcccacgtgcctcacggtaaaaaaaagcttcacggggagtacaagaac

SEQ ID NO: 13197 - DNA, 2109 bp, Artificial Sequence
  Description of Artificial Sequence: Synthetic coding sequence
atgctgcggggtcgcagtctgtccgtaactagccttggcggcctcccacagtgggaggttgaggagctgcccgtcgaagagttgcttctgtttgaagtcgcttgggaagtcacgaataaggtcggcggtatatataccgtgattcaaacaaaggcgaagaccacagccgatgagtggggcgagaattacttccttatcggcccctatttcgagcataacatgaagactcaagttgaacaatgcgaaccggtgaacgacgctgtgagaagggcggtggacgctatgaataagcacggctgccaagtgcatttcggcaggtggttgatcgagggaagtccatacgtagtgctgtttgacatcgggtacagcgcctggaatttagatcggtggaagggagacctttgggaggcttgcagcgtgggtataccatatcatgaccgggaggccaatgatatgttaattttcgggagcttaacagcctggtttctgaaagaagtcaccgaccatgcagatggaaaatacgtggtggctcagttccacgagtggcaggcgggtatcggcctcatcctgtcccgcgcccgtaaactcccaatagctaccatcttcactactcacgccacccttctgggtagatatctttgtgccgctaacatcgacttctacaaccatttggataagttcaatattgacaaggaggcaggtgaaagacagatataccaccgctattgcatggagagggcttccgtgcactgcgctcatgtattcaccaccgttagtgagatcacggctattgaagcggagcatatgctgaaacgaaaaccggacgttgtgactccaaacggtctgaacgtcaaaaagttcagcgccgtgcatgaattccagaacctgcatgccatgtacaaagcgcgcatccaggactttgtccgcggccatttctacgggcatctcgactttgacctagagaagactctgttcctattcatcgccggccgatatgagtttagcaacaaaggcgcagatatcttcctcgagagtctgagccggcttaacttcttgctcagaatgcataagtccgacattaccgtcatggtctttttcattatgccagcaaagacaaacaatttcaatgtcgagacccttaaggggcaggctgtgcgtaaacagctgtgggacgtggcccatagcgtcaaagagaaatttgggaagaaactgtacgacgctctcttgaggggggagattcccgatctgaatgacatcctagacagggacgatctgaccataatgaaacgggcgatcttctccacccaacggcagtccttgccccccgtgacgacccacaatatgattgacgattctaccgatcccattctgagcactatccggcgaatcggactttttaacaacaggacggatagagtgaaggttattctccatcccgaattcctcagttcaacatccccactcttgcctatggattacgaagaattcgtgcggggatgtcatctgggggtcttccctagttactacgagccatggggctacacacctgccgagtgcaccgtgatgggaatcccctccgtcaccaccaacctctcgggattcggatgcttcatgcaggagcacgtggctgatcccacagcctacggaatttacattgtggatcggagattccgctcacctgacgactcttgtaaccagctgacgaaattcctctacggtttctgcaaacaatcccgccggcaaagaatcatacaacggaaccgcaccgaaaggctgagcgatctgcttgactggcggtacttgggcaggtattaccagcatgctaggcaccttaccctgtcccgcgcctttcctgacaagtttcacgttgaactgaccagccctcccactacagaggggttcaagtacccaagacctagctcggtgccaccgtcgccctcaggctcccaggcttcctccccccagtcatcggatgtcgaggatgaggtggaggatgaaagatacgacgaggaggaggaggcggaaagagaccgcctgaacattaagtcccccttctccctgagtcacgtcccacacggtaaaaagaagctgcacggggagtataagaac

SEQ ID NO: 13198 - DNA, 2109 bp, Artificial Sequence
  Description of Artificial Sequence: Synthetic coding sequence
atgctgagagggcggtcactgagcgtgacctccctcggcggtttgcctcagtgggaggtcgaggaactgccagtggaagaactccttctcttcgaagtcgcgtgggaggtgaccaacaaggtcggcggaatctacaccgtgatccagactaaagccaagaccaccgcagacgaatggggggaaaactactttctcattggaccatactttgaacacaatatgaaaactcaggtcgagcagtgcgaaccggtgaacgatgctgtgcgccgggcggtggatgcgatgaacaagcatggatgccaggtgcatttcggaagatggctgattgagggatcgccgtatgtcgtgctgtttgacatcggatactccgcgtggaaccttgatcgctggaagggagatctctgggaggcgtgctcggtgggaatcccatatcacgaccgcgaagcgaatgacatgctgatattcgggagccttaccgcatggtttctgaaggaggtgactgaccatgccgacggcaaatacgtcgtcgcgcaattccacgagtggcaagcgggaattggccttatcctgtcaagagccaggaagctgcctatcgccactatctttactacccacgctactcttctgggacggtacctgtgtgccgcgaacatcgacttttacaaccacttggacaagttcaacatcgacaaggaggccggcgaacgccagatctaccatcgctactgcatggagcgggccagcgtgcactgtgctcatgtgttcactaccgtctccgagatcactgcgatcgaagccgaacatatgctgaagcgcaagcctgacgtcgtgaccccaaatggcctcaacgtgaaaaagttctcggcggtgcacgagtttcaaaacctgcacgccatgtacaaggcccggatccaagatttcgtgagggggcatttctacggacatctggactttgacctcgaaaagaccctgttcctgttcatcgcaggacgctacgaattcagcaataagggagcggacatcttcctggagtcgctgtcaagactcaactttctgctcagaatgcacaagtccgatattaccgtgatggtgttctttatcatgccggcaaagaccaacaacttcaatgtggaaaccctcaaaggacaggccgtgaggaagcaactgtgggacgtggcccatagcgttaaggaaaagtttggtaagaagctgtacgatgccctgctccgcggcgagatcccagatctgaacgacatcctggacagagacgacctcacgatcatgaagcgcgcgatcttctccacccagaggcagtcgctccccccggtgacgacgcacaatatgatcgacgattcgactgatccaatcctcagcactatccgacgcatcggattgttcaacaaccggaccgatcgagtgaaggtcatcctgcacccggagttcttgagctcaacctcgccgttgctcccgatggattacgaagagttcgtgaggggatgccatctcggagtgttcccgtcatactacgagccgtggggatacaccccggcggaatgcacggtgatgggaattcctagcgtgactactaatttgtcgggattcggttgcttcatgcaggagcatgtggcagacccgactgcatatggtatttacatcgtggacagacggttcagaagcccggacgattcttgcaatcaattgaccaaatttctgtacgggttctgtaagcagtccaggcgccagaggatcatccaaagaaatcggaccgagcgactgtccgatctcctggattggcgatacctcggacgctactaccagcatgctcgccatctgactctgagcagagcatttcccgataagttccacgtcgaattgaccagccccccgactaccgagggattcaagtacccgcgcccttcctcggtgccgccttcgccatcgggatcgcaagcaagctcgccccaaagctcagatgtggaggacgaagtggaagatgaaagatacgatgaggaagaagaagccgagagggaccgcttgaacattaagtccccgttctcgctgtcacatgtgccacacggtaagaaaaagctccacggcgaatacaaaaat

SEQ ID NO: 13199 - DNA, 2109 bp, Artificial Sequence
  Description of Artificial Sequence: Synthetic coding sequence
atgcttaggggtagaagcctctctgtcacgagcctggggggactgccacaatgggaagtagaggaactgccagtggaggagcttctgctgtttgaggtcgcgtgggaggtcacgaataaggtgggaggaatttacaccgtgatccagacgaaggctaagacaactgcagacgaatggggagaaaactactttctaatcggaccatatttcgagcacaatatgaagacgcaggtagagcagtgtgaacccgttaacgatgccgttagaagggccgtcgatgccatgaacaaacacggctgccaggtgcatttcggaaggtggttaattgagggctctccctatgttgtgctattcgacattggttattcagcgtggaatttagacagatggaagggggacctctgggaagcttgctctgtgggtatcccttatcacgatcgcgaggccaacgacatgctgatttttgggagtcttacagcgtggtttctaaaagaagtgaccgatcacgcagacggaaaatacgtggtcgcccagtttcacgagtggcaggccggcatcgggttgatcctttctagggccaggaagctccccattgccacaatctttacgacccatgccactctgctgggcaggtatctgtgcgcagctaacattgacttttataaccacttagataaattcaatattgacaaagaggctggcgagagacagatttatcacaggtattgtatggagagggcaagcgttcactgtgctcatgttttcacaaccgttagcgagattacagctatagaagctgaacacatgcttaagagaaaacccgatgttgtcacaccgaatgggcttaacgtgaaaaaattcagtgccgtgcatgaattccagaacctgcacgctatgtacaaggcaaggatccaggacttcgtgagagggcatttttatgggcacttagattttgacctcgaaaaaactttattcctgtttatcgccggacggtatgaattctccaacaagggcgcggacatctttctcgaatctctctcccggctcaattttctcttgcgaatgcacaagtccgatatcaccgtgatggtattcttcatcatgcctgccaagaccaacaactttaatgtggagaccctcaaagggcaagccgtgcggaagcagctgtgggatgtcgcccacagcgtcaaggaaaaattcgggaagaagttatatgatgcgctacttaggggcgagataccagacctgaacgatatacttgatagggacgacctgacaatcatgaagcgggccatttttagtactcagagacagtcattacctcccgtgaccacccataatatgatcgatgattccaccgaccccatcctgtcgacgatccggaggatcggtctgtttaacaaccgcactgacagggttaaggtcattctgcatccagaattcttatccagcacgagtcccttgctgcccatggattatgaggagtttgttcggggctgccatctgggggtgttcccttcctattacgaaccttggggatatactcccgccgagtgtacggtgatgggcataccttccgttaccacaaatttatcgggctttggctgctttatgcaggagcacgttgccgatccaaccgcctacgggatttacatcgtggacaggagattcaggtcaccagacgatagttgtaatcaattaactaaatttctttatgggttctgcaagcagagcaggaggcagcggatcatacaacggaacaggacagagcgcctgtcagacctgttggactggaggtatctcggtagatactatcagcatgctagacacctgaccctgagtcgtgctttccccgacaaattccatgtggagctcacaagtccacctaccaccgagggttttaaatatcctaggccctcttctgttcctccgtcccccagcggttcacaggcatccagtcctcagagctcagatgtagaggacgaggttgaggacgaacgctatgatgaagaagaggaggcagaacgggataggctaaatattaagtctccattcagcctaagccatgtgccccacgggaaaaaaaagctgcacggggaatataagaat

SEQ ID NO: 13200 - DNA, 2109 bp, Artificial Sequence
  Description of Artificial Sequence: Synthetic coding sequence
atgttgagaggacgctccctttcggttacttcactcgggggtctgccccaatgggaagtggaggaactccccgtggaagaactccttttgttcgaagttgcttgggaagttaccaacaaagtgggaggtatctacacggtgattcaaactaaggccaagactaccgcagacgaatggggagaaaactattttctgattggaccctacttcgaacacaacatgaaaacccaggtggagcagtgcgaaccggtcaacgatgctgtgcggcgggccgtcgatgctatgaataagcatggctgtcaggtgcactttggccgctggcttattgaaggttcgccttacgtcgtcctgtttgacatcggctactcggcgtggaacctcgacaggtggaaaggtgacttgtgggaagcatgttccgtgggaattccttaccacgaccgagaagccaacgatatgttgatttttgggagccttactgcatggtttctgaaggaggtgacggatcatgctgatggtaaatacgtggtcgcacaattccacgagtggcaagcaggtataggacttatactgtcgagagcgcgcaagctgccaattgccaccatctttaccacccatgcaacgcttcttggaagatatctgtgtgcagctaacatcgacttctacaaccacctggacaagtttaacattgataaagaagccggagagagacaaatctaccatagatactgcatggaacgagcatccgttcactgtgcgcacgtctttaccaccgtctccgagatcactgcgattgaagcggaacacatgcttaagcggaagccagatgtggtgactcccaatggattgaacgtgaagaaattcagcgcagtgcatgagttccaaaatctgcatgcaatgtacaaggcccggatccaagattttgtgcgcgggcacttttacggtcatcttgacttcgaccttgaaaaaaccctgttccttttcatcgcaggacgctacgaattctcgaacaagggagcagatatctttctggagagcctgtcaaggctgaactttctgctgcgcatgcacaagtcggacattaccgtgatggtgtttttcattatgccagcaaagaccaataacttcaatgtcgaaaccctgaagggccaagcagttcggaaacagctttgggacgtggcgcattctgtcaaggaaaagtttggtaaaaagttgtacgatgcacttcttagaggcgaaattccagatctgaatgatatccttgaccgcgacgacctcactatcatgaaacgcgcgatcttttcgacccaacgacaatcgctgccgcctgttactacccataacatgatcgacgactccactgacccaattctttcgacgatacgaaggattggacttttcaataacagaacggatagggtcaaagtgattttgcatccggaatttctttcgtcgaccagccctctcctgccaatggattacgaggagtttgtccgcggatgtcatctcggcgtctttccctcgtactatgagccgtgggggtacacccctgcagaatgcaccgtcatgggaataccaagtgtgaccacgaacctgagcggatttggttgttttatgcaggaacatgtggccgatcccaccgcatacggcatatacattgtggacagacgctttagaagccccgacgattcctgcaaccaacttaccaaattcttgtacggattttgtaaacagtccagacgtcaacggatcattcaacggaacagaaccgaaagactgagtgacctcctcgattggcgctacctcggaagatactaccagcatgcccggcacctgactctcagccgagcatttcctgataagtttcatgttgaactcacctcacctccaaccaccgaggggttcaaataccctcgcccatcgtcggtgcctccttcgccctccggcagccaagcaagctcccctcagtcctcggatgtcgaggatgaagtcgaagatgagcgttacgacgaagaagaagaagcagaaagagacaggctcaatatcaaaagcccattctcgctgtcccacgtgcctcatggcaaaaagaagctgcacggtgaatacaagaac

SEQ ID NO: 13201 - DNA, 2109 bp, Artificial Sequence
  Description of Artificial Sequence: Synthetic coding sequence
atgcttcgcgggcggagcctctccgtgacttcgctgggaggactgccacaatgggaggtggaggagctgccggtcgaggaactcctgctttttgaagttgcatgggaagtgaccaataaggtgggagggatatacaccgtcattcagactaaagctaaaaccacggcggacgaatggggagagaactacttccttatcggaccctactttgagcataacatgaaaacgcaggtggaacaatgtgagccggttaatgacgctgtccgccgtgccgtggatgctatgaacaagcacggctgccaagtgcatttcggacggtggctgatcgaaggatccccatatgtggtgttgttcgatatcggatactcagcctggaacctcgacagatggaagggcgacttgtgggaagcgtgttcagtcgggatcccgtaccatgaccgcgaggccaatgacatgctgatcttcgggtcgttgactgcctggtttctcaaggaagtgactgatcacgcagacggaaagtacgtggtggcacagttccacgaatggcaggcaggaattggcctgatcctctcgcgcgcccggaaactgccgatcgccactatcttcacgactcatgccaccctgttgggaagatacctgtgcgcggcgaatattgatttctacaaccacctggataagtttaacattgataaggaggctggtgagcgtcaaatctatcatagatactgcatggagagagcgtcggtgcactgcgcgcacgtgttcacgactgtgtcggaaatcaccgctatcgaagccgaacatatgctgaagaggaaaccagacgtggtcactcctaatgggctgaacgtcaagaagttttcagcagtgcacgagttccaaaatctccacgccatgtataaggcgcggatccaagattttgtccggggacatttctacggacacctggacttcgacctcgagaaaacgttgttccttttcatcgccgggcgctacgaattcagcaacaagggagcggatatcttcctggagtccctctccagattgaattttctccttcggatgcataagagcgatataaccgtgatggtctttttcatcatgccggctaagaccaacaatttcaacgtggaaaccttgaagggccaagccgtgagaaagcagctctgggacgtggcacactccgtgaaggagaagttcggtaagaagttgtatgacgcgctgttgcggggagaaatccctgacttgaatgacattctggatcgcgatgaccttaccattatgaaacgcgccatcttctccactcagaggcagtcgctccctccggtgactactcacaacatgatcgacgacagcaccgaccctatcctgtcgaccatcagacggatcgggttgttcaacaaccgcactgacagggtcaaggtcatcctgcatccggaatttctctcgtcgaccagcccgctgcttccgatggattacgaagaatttgtgcggggctgccacctcggagttttcccctcatactacgaaccctggggttacacgccggctgaatgtactgttatgggtatcccgagcgtgacgaccaacctgtccggcttcggttgctttatgcaggagcacgtggccgacccaaccgcatacggaatctacatcgtggatcgcagatttcgttcccccgacgattcctgcaaccagctgactaaattcctgtacggattctgcaagcaatctcgtcgccagaggatcatccagaggaatcgcaccgagcggctgtcggacctccttgattggcggtacctcggccgctattaccaacacgcgcgacacctgaccctctcacgagccttcccggacaagttccacgtggagctcactagcccgccaactactgaaggattcaagtacccacggccatcctccgtccctccgtcgccgtcgggatcacaggcctccagcccgcagtcgtccgacgtggaagatgaagtggaggatgaaagatacgatgaagaagaggaggcggagcgagatcgcctgaacatcaaatctccgttctcgctctcgcacgtccctcatgggaaaaagaagctccacggagaatacaaaaat

SEQ ID NO: 13202 - DNA, 2109 bp, Artificial Sequence
  Description of Artificial Sequence: Synthetic coding sequence
atgttgaggggccgctctctcagcgtaacttcactgggaggccttccacaatgggaggtggaggagcttccagtcgaagaactgctattgttcgaggtagcatgggaagttaccaataaagtcggcggaatttatactgttatccaaacaaaggcaaaaaccaccgccgatgagtggggtgaaaactattttctgatcggcccttattttgaacataacatgaagacccaagtcgagcagtgtgaacctgtgaacgacgcagtgaggcgagcagtcgacgcaatgaacaagcacggttgccaggtgcattttgggaggtggttgatcgagggatccccatatgtcgtccttttcgatattggctactccgcatggaaccttgaccgttggaagggagatctgtgggaagcatgtagcgtaggaatcccttaccatgatagagaggctaacgatatgcttatctttggcagtttgactgcttggtttctcaaagaggtgaccgatcacgctgacggtaaatacgtggtagcgcagtttcacgagtggcaggcaggaatcggattgatcctgagccgcgcacgtaaactgccaatcgcaacgatcttcaccactcatgctactctgttgggtcgctacttatgtgctgccaatattgacttctacaaccatctggataagttcaatatcgacaaagaggccggagagcgccagatttaccacagatactgcatggaacgcgctagcgttcattgtgctcatgtgttcaccaccgtgagcgagatcactgccatcgaggccgaacatatgttgaaacgcaaacctgatgttgtcaccccaaacgggctgaacgtgaaaaagttcagcgcagtgcacgaattccaaaacctgcatgccatgtataaagccagaatccaggatttcgttaggggccatttctacggccacctggactttgacctcgagaagacgctgttcctgttcattgccggacgatacgaattctccaacaaaggcgcggatatcttcttggaatctctgtctaggttgaatttccttcttcgcatgcacaaaagtgatattaccgtcatggtgttcttcatcatgcccgctaagacgaacaattttaatgtcgaaacccttaaaggccaggccgtgcggaaacaactttgggatgtggctcattcagttaaggaaaaatttgggaagaagttgtatgacgcactccttcggggtgaaattcccgacctcaacgatatactggacagagacgatctgactatcatgaaaagggctatcttcagcacccagaggcagagcctgccacccgtgacaacacacaacatgatcgacgacagtaccgatcctatcttgtctacaatccgcagaatcggacttttcaacaatagaaccgaccgcgtcaaagtgatcttgcatccagagttcctgagctccacaagcccactgcttccaatggactacgaagagttcgttagaggatgccacttaggggtgttccctagctactatgagccttggggatatacaccagccgaatgtacggtaatgggcatcccaagcgtgaccaccaacctttccggcttcggatgctttatgcaggagcacgtggccgaccctactgcttacggtatttatatagtggataggagattcaggtctccagacgattcttgtaaccagctcactaagtttctttacggattttgcaaacagagtagaaggcagaggatcattcagaggaacaggacagaacggctcagtgacctgctggattggaggtatctggggaggtattaccagcacgccagacatctgacactcagtcgggccttcccggacaagtttcatgtcgaactgacatccccacccactacagagggttttaaatacccccgcccaagctccgtccctcctagcccctctggcagccaagccagctctccacaaagctctgacgtggaggatgaagtagaagatgaacggtatgatgaagaggaagaggcagagagggatcgattgaacataaagagcccatttagcctgagccatgtcccccatgggaagaagaaactgcatggcgagtataaaaac

SEQ ID NO: 13203 - DNA, 2109 bp, Artificial Sequence
  Description of Artificial Sequence: Synthetic coding sequence
atgctgcgtggtcgatctctatcggttacttcactgggtggcctcccccagtgggaggtcgaggaactgcccgtcgaagagctgctgctctttgaagtagcatgggaagttaccaacaaggtgggtggtatttatacagtgattcagactaaggctaaaacaaccgcagacgaatggggcgagaattatttcctaattgggccatactttgaacacaatatgaaaacacaggtagaacagtgcgaacctgttaacgatgccgtgcggcgggccgttgatgccatgaataagcacggttgtcaagttcattttggccgctggttaattgagggatcaccttacgtcgtactgtttgatattggctacagcgcctggaatttggatcgctggaaaggcgacttgtgggaggcttgctctgtcggaatcccataccacgacagagaggctaacgatatgctgatcttcggctcacttaccgcatggtttttaaaagaggtcaccgatcacgccgacgggaaatacgtcgtagcccagttccacgagtggcaagccgggattggtctgatcttaagtcgggctcggaagttgcccatcgcaacaatttttacaacccatgcaacgttactaggacgatatctctgcgccgctaatatcgatttttacaaccacttggataagttcaacatcgacaaagaagccggcgaaaggcagatctaccaccgttattgtatggagcgggcttccgtccactgtgctcacgtttttaccactgtgtcagaaattaccgccatagaagccgaacacatgcttaaacgaaaacctgacgtcgtgactcctaatggcctaaacgtaaaaaaattctctgccgtgcatgagtttcagaatctgcacgctatgtataaggcccgaattcaggattttgtacggggccacttttacggccatctcgatttcgacctcgagaagacactattcctgttcatcgccgggagatatgagtttagcaataaaggcgcagatatcttcctcgagtccctctcgcgtctcaacttccttctccggatgcataagtccgatataaccgtgatggttttttttataatgccagccaaaactaataacttcaacgtcgagactttaaaaggccaggctgtacggaagcagctttgggacgttgctcacagcgtcaaggagaagttcggcaagaagctatacgatgctctgctgaggggagaaattcctgacctaaacgacattctggacagggatgaccttactatcatgaagcgggctatttttagcacacagaggcagtcgcttcctcccgtgactacacacaatatgatagatgactctaccgatcccattctttcaactatccgcaggattggcctgttcaacaatcgtactgaccgggttaaagtgattctgcaccccgaattcctctcctcgacttctcctcttttacccatggactatgaggagttcgtacgcggctgtcatctcggagtgtttcccagttactatgagccctgggggtatacccccgccgagtgtacagtgatggggatcccaagcgtgaccaccaatttgtccgggttcgggtgtttcatgcaggagcacgttgctgaccccacagcctatggaatctatatcgtcgatcggcgtttcagatctcccgatgacagttgcaatcagctgacgaagtttctctacgggttttgtaaacagtcaaggaggcaacgcatcatccagcgaaatcgcacagagcgactaagcgacctccttgattggcgatacctgggcaggtattaccagcatgctaggcatctaacgctgagcagggcctttcctgacaaatttcatgtggagctgactagcccgccgaccaccgaagggttcaagtacccccgccccagctccgtgccccccagccccagcggatcccaggctagcagcccccagtcctctgacgtggaagatgaggtggaggacgagagatatgatgaggaagaagaagccgagcgagacagactgaacatcaaatctcccttcagcttgagtcatgtgcctcatggcaaaaagaaactccatggagagtacaaaaac

SEQ ID NO: 13204 - DNA, 2109 bp, Artificial Sequence
  Description of Artificial Sequence: Synthetic coding sequence
atgctacggggcagatccctgtctgtaactagcctgggcggtttgccgcagtgggaggtggaggaactacctgtggaagaacttctgctgttcgaagtggcttgggaggtaacaaataaagtgggtggtatatataccgttatacaaaccaaggcgaaaactaccgcggatgagtggggcgagaactactttttgatcggcccgtacttcgagcacaatatgaagacccaggtcgagcagtgcgaaccagtcaacgacgccgtacgcagagccgttgacgccatgaataaacacggctgtcaggtccattttgggagatggctgattgagggaagtccatacgtggtcctctttgatattggatatagcgcctggaacctggataggtggaagggcgacttgtgggaagcctgcagcgtaggcataccgtaccatgatagggaggctaacgatatgctgatattcggatcactgactgcatggtttcttaaggaggtaaccgatcacgccgacggcaaatatgtggtggcacagtttcacgagtggcaagcagggataggcctgatactctctagagcaaggaagctccctatcgcaactatcttcaccacccatgccacgctgctggggaggtatctgtgtgctgccaacattgatttctacaatcacctcgacaaatttaacatagacaaagaagcaggagaacgacagatctatcatcgctattgtatggagagagcctcagttcattgtgcccacgtctttactaccgttagcgaaatcaccgctatcgaagcggagcacatgctaaagcgcaaacccgacgtggtgacgccaaatgggctgaacgtgaaaaagttttctgccgtgcatgaattccagaacttgcacgctatgtataaagcccgcattcaagatttcgtgcggggccacttttacggccacctggattttgacttggagaagactttgtttttattcattgcaggccgctatgagttcagtaacaagggcgcggatatctttctggaatcgctgagcaggctgaattttctgcttaggatgcataaatctgacatcaccgtgatggtctttttcatcatgccagcaaagacgaacaacttcaatgtcgagaccctcaaaggtcaggcagtcaggaagcagctttgggatgtcgctcacagcgttaaagagaaatttggcaagaaactctacgatgccctgctgcggggcgaaattcccgacttgaatgacatactggatcgggatgatttgacaatcatgaagcgtgctatcttctctacacagcgccagtcattgccccctgttaccactcataatatgatcgacgatagcacagatcctatcctgagcacaattaggcggatcggcttgtttaacaataggactgaccgcgtcaaggtcatactgcaccctgagtttctctctagcacgtcgccgctgttgccaatggattacgaagagttcgttaggggatgtcacctcggcgtgttcccttcatactacgaaccttggggatacacccctgccgaatgtaccgttatgggcattccgtccgtcactacaaatctttccgggttcgggtgcttcatgcaggagcacgtagctgacccaactgcatacggaatctacatcgtggacaggagattccgatcccctgatgactcgtgcaatcagctgactaaatttctgtatggattctgcaaacagtcaagaaggcagcgtattatacagcgcaaccggacagagcgcttgagtgacctcctggattggcgttacctgggccggtactaccaacacgctcggcacttaaccctttccagggcgtttcccgataagttccatgtggagttgacaagcccacccacgaccgaagggtttaaatatccaaggccgagcagcgtccctcctagtccatccggatcccaggccagctcgcctcaatcatcagatgtggaagacgaggttgaggatgagcgctacgacgaggaggaagaagcagagcgggacaggctcaacataaaaagcccattcagcctttctcacgtcccgcacggcaagaagaagctccatggggagtataaaaac

SEQ ID NO: 13205 - DNA, 2109 bp, Artificial Sequence
  Description of Artificial Sequence: Synthetic coding sequence
atgctcagggggaggtctcttagcgtgacctccctaggcggattgccccagtgggaggtggaggagctgcctgtagaagaactattgctgttcgaagtcgcttgggaggtcaccaataaggtcggggggatatatactgttattcaaaccaaggcaaaaacaacagccgacgaatggggcgagaactatttcttgatagggccatacttcgagcataatatgaagacgcaagtggagcagtgcgagcccgtgaacgacgcagtgcgtcgagctgtggacgccatgaataaacacggctgccaagtgcacttcgggcgttggctcattgaagggtctccttatgtagtactcttcgatataggctattctgcatggaacctggatcggtggaagggagatctgtgggaggcctgctcagtaggcatcccatatcacgacagggaggctaatgacatgctgatatttggttctctgaccgcttggtttctcaaagaggtcacagaccatgcagacggcaaatatgtggtggctcaatttcacgaatggcaggccggaataggcttgattctttcaagagcccggaaattgccgatcgcaacgatctttaccacccatgcaacactgcttggacggtatctgtgcgctgcgaacatcgatttctataaccacttggacaaattcaatatagataaagaagccggtgagcgccagatttatcacaggtactgtatggaaagggccagcgttcactgtgcgcatgtctttactaccgtctccgaaattacagccatagaagccgaacacatgttgaaacgcaagcccgatgtcgtgacccctaatggactgaacgtgaaaaaattttctgcagttcacgaatttcaaaacttacatgccatgtacaaagcacgcatccaggactttgtcaggggacatttttacgggcatctggacttcgatttggagaagacactctttttatttattgcagggaggtatgaattctccaacaaaggagctgatattttcctggaaagcctgtccaggcttaactttcttctccggatgcataaatccgatatcacagttatggtctttttcattatgcccgcgaaaactaacaactttaacgtagagacgctgaaaggccaggccgtgaggaagcagttatgggatgtggcacactctgttaaagagaagttcggcaagaaactgtacgacgcactgctgcggggtgaaatccctgaccttaacgatatcctggaccgggatgacctgaccataatgaaacgggcgatcttttctacacagaggcaaagcctgccaccggtgacaacccataacatgattgatgactcaaccgatcctattcttagcaccattcgccggatcggcctgttcaataaccgtactgatcgtgtcaaagttatcctgcacccggagttcctgtcatctacctcccctctgctgcccatggactacgaagagtttgtgcgaggttgccatttaggagttttcccatcctattacgagccatgggggtacacgcccgctgagtgcactgtgatgggaattccttcagtcaccaccaatctctccggcttcggctgctttatgcaggagcatgtggctgaccctactgcctatggcatctatatagtggatcggcgctttcggtctcccgacgattcatgtaaccaattgaccaagttcctgtatggcttttgtaaacagtcccggaggcagaggatcattcaacgcaaccgcacagagagactttccgatcttctagactggagatacctgggacgatactaccagcatgcgcgccacttaacacttagcagggcctttcctgataagttccacgttgaactgaccagtcctcctacgactgaggggttcaaatatcctagaccctcatccgtcccgccgagtccctccgggagtcaggccagttctccacagtccagcgatgtagaagatgaagtggaagatgagcgctacgacgaggaagaggaagccgaacgcgatcgtttaaatataaaaagccctttcagccttagccacgtgccacatggcaagaaaaagctccacggtgagtacaagaat

SEQ ID NO: 13206 - DNA, 2109 bp, Artificial Sequence
  Description of Artificial Sequence: Synthetic coding sequence
atgctcagaggcagatccctgtccgtgacctcactcggaggtctgccgcagtgggaagtcgaagaactcccagtggaggagctcctgcttttcgaagtggcatgggaggtgactaacaaggtcggcggaatctacactgtgatccagaccaaggctaagactaccgcggacgagtggggcgagaactactttctgatcggaccgtacttcgaacacaacatgaaaactcaggtggaacagtgcgaaccagtgaatgatgcagtcagacgtgctgtcgacgcaatgaacaagcacgggtgccaggtccatttcggacgctggctgatcgagggatcaccgtacgtcgtcctgttcgacatcggatactcagcctggaacctggatcgctggaagggtgacctgtgggaagcgtgcagcgtggggatcccgtatcacgaccgcgaagccaatgacatgctgattttcggctcgctgactgcttggttcttgaaagaagtgactgaccatgctgatggcaagtacgtggttgcgcaatttcatgaatggcaagccggaatcggattgatcctgtcccgcgcccgcaagctgcctatcgcaactattttcactactcatgcgaccctcctgggacgctacctgtgtgccgccaatatcgacttttacaatcacctggataagtttaacatcgacaaagaggctggggagcggcagatctaccaccgctactgtatggagcgcgcctccgtgcactgcgcccacgtgtttaccactgtctcagaaatcaccgcgattgaggctgaacatatgctgaaacgcaagcccgacgtggtgaccccgaatggacttaatgtgaagaagttctcggcggtgcacgagtttcaaaacttgcatgctatgtacaaagcaagaatccaggatttcgtcagggggcacttctacggccatctggacttcgacctcgaaaagaccctgttcctgttcatcgcgggacggtatgagttctcgaataaaggagctgatatctttctggaatcgctgtcccggctgaacttcctgcttagaatgcataagtcggatatcactgttatggtgttctttatcatgccggcgaaaactaacaactttaacgtggagacgctcaagggacaagccgtccggaagcaactgtgggatgtggctcactcagtcaaagaaaagttcggaaagaagctgtacgacgcgctgttgagaggagagatcccggacctcaacgacatcctggatcgggatgacctcaccatcatgaagcgggccatattctctacccaaaggcaatcactgccacctgtgactacccacaatatgatcgatgattccactgatccgattctgtcgactattaggcggatcggattgttcaacaaccgcaccgaccgcgtgaaagtgatcctccatccggaattcctttcgtcgacctccccgctgctgccaatggattacgaagagttcgtgcggggctgccatctgggcgtctttccgtcgtactacgagccttggggttatacgccagcggaatgcaccgtgatgggcatcccttctgtgaccactaacctgtctggattcgggtgcttcatgcaggaacatgtggccgatccgactgcctacggaatttacatcgtggaccgccgcttcagatcgcctgacgactcatgtaatcagctcacgaagttcctctacggattctgcaagcagtcacgacggcaacggatcatccagcggaaccgcactgaacggctctccgacctgctggactggcgatacctgggcaggtattatcagcacgcgcggcatctcactctgtcgagggcctttcctgataagtttcatgtggaactgacctccccgcctaccactgaaggatttaagtacccccggccgtcgagcgtccccccgagcccctcgggatcgcaggccagctcgcctcagtcctcggatgtcgaagatgaagtggaggacgaacggtacgatgaagaagaggaggcagagagagacagactgaacatcaaaagcccgttctcgttgtcacacgtgccacatggaaagaagaaactccacggcgaatacaagaac

SEQ ID NO: 13207 - DNA, 2109 bp, Artificial Sequence
  Description of Artificial Sequence: Synthetic coding sequence
atgctgcgaggacgctcgttgagcgtgacttcccttggagggcttccacaatgggaagtggaagaacttccggtcgaagagctgctgcttttcgaggtcgcgtgggaggtcaccaataaggtgggaggtatctacaccgtgattcagaccaaagccaagactaccgcagatgaatggggggagaactactttctgattggaccatacttcgaacacaatatgaaaacccaggtcgaacagtgcgaacctgtgaatgatgcagtgagacgcgccgtggatgcaatgaataagcatgggtgtcaagtgcatttcggcagatggctgattgaaggcagcccctacgtggtgctctttgatatcggctacagcgcgtggaatttggatcgttggaagggtgatctgtgggaggcatgtagcgtcggcatcccctaccacgatagagaggcaaacgacatgctgatatttggttcacttactgcatggtttctgaaggaagtgactgatcacgcggacggcaagtacgtggtcgcccaattccacgaatggcaggcaggaatagggctgattctctcgagagcccgaaaactgcctattgcaaccatctttaccacccacgcgactcttctgggaagatacctctgcgccgctaatatcgacttctataatcacctggacaagttcaatattgataaggaagccggtgagagacagatataccacaggtactgtatggaaagagcatcggtgcactgtgcacacgtctttaccactgtgtcagagattactgcaatcgaagcagagcatatgctgaaacggaagcctgatgtggtgactcctaacggcctgaacgtgaagaagtttagcgccgtgcatgaattccaaaacctgcatgctatgtacaaggcaaggattcaagattttgtaaggggtcatttctacggacatctggactttgatcttgaaaaaactctttttctctttattgcagggcgttacgaattttctaacaagggggcagacatatttcttgaatccctgtcccgcctgaacttcctgcttcggatgcacaaatcggatatcaccgtcatggtgtttttcattatgcccgcaaaaaccaacaactttaatgtggaaactttgaagggacaagcagtgcgtaaacagctttgggatgtcgcacattcggtcaaggaaaagtttgggaagaaactttacgacgcgctgcttagaggagagataccagaccttaacgatattctcgatcgtgatgatttgactattatgaaaagggcgattttcagtactcagcgtcagtcgctccctcctgtgaccacccacaacatgattgatgattccaccgaccccatcctctcgacgattcgccgaattggactgttcaacaaccggactgatcgggtcaaagtgattctccatccggaatttctgagctccactagccctcttctgcctatggattacgaggaatttgtcagaggatgccaccttggtgtctttccttcgtactatgaaccttggggatacaccccagctgaatgtactgtgatgggaattccgtcagtcaccactaatctcagcggattcgggtgtttcatgcaggaacatgtggcagatcctacggcatacggtatctacatagtggataggagatttcgttcccccgacgatagctgcaaccagctgactaagtttctttatggattttgcaagcaaagcaggcgccaaaggattattcagcgcaatcgcaccgaacggcttagcgatcttctggattggagatacctcggacgctactaccaacacgcacgccacctcacgctgtcgcgagcatttcctgacaagttccacgtggagctcacttcgccccccactaccgaggggtttaagtacccgcgtcctagctcggtgcctccttcgccctccggaagccaagcaagcagcccacaatccagcgatgttgaggacgaagtggaagatgaaaggtacgatgaagaggaagaagcagagcgcgaccgcctcaacattaagtcgcctttcagcctgtcgcatgtgcctcatggtaagaagaaacttcatggcgagtacaagaac

SEQ ID NO: 13208 - DNA, 2109 bp, Artificial Sequence
  Description of Artificial Sequence: Synthetic coding sequence
atgctgcgtggcagaagtctcagcgtcacttctctgggcggacttccccagtgggaggtggaagagttgcctgtcgaggagctgctcctgttcgaggttgcttgggaggtcactaacaaggtaggtggcatatacacagttatacagaccaaggctaagacaactgcagatgaatggggtgaaaactacttcctcatcggcccttatttcgagcataatatgaagactcaggtcgagcagtgcgagcctgtaaacgacgccgtcagaagggcagtggatgctatgaataagcacggctgtcaagtccatttcggtaggtggcttatcgagggcagcccctacgtggtgctgttcgatatcggttactctgcctggaatctcgacagatggaagggtgatctgtgggaagcctgttccgtgggtatcccataccacgaccgtgaggccaatgatatgctgattttcggaagcctgacagcatggttcctcaaagaggtcactgatcatgccgacggaaaatacgttgttgcccagttccatgagtggcaggctggcattggtctcatcctgtctcgcgcaaggaaactgcctatagccactatctttaccactcacgccactctcttgggtcgttatctctgtgcagcaaatattgacttttataaccacttggataagttcaatattgacaaggaggctggagagagacagatttaccaccgctactgcatggaaagagcttcagtacactgcgctcatgtttttaccacagtcagtgagattacagctatcgaggctgagcacatgctgaagcgtaaacccgacgtggtgactcccaacggcctgaatgtgaagaagtttagcgccgtgcacgagttccagaacttgcacgcaatgtataaagcaaggatccaagacttcgtccgtggacacttttacggacatctggacttcgacttggagaagaccctgttcttgttcatcgccggccgctacgagttcagcaacaaaggtgccgatatatttttggagtctttgagccgtctgaacttcctcctgaggatgcacaagtccgatatcaccgtaatggtcttctttatcatgcctgccaagacaaataactttaacgtagagactctgaagggccaggcagtgagaaagcagttgtgggatgtcgcccacagcgtcaaggaaaagttcggcaaaaagttgtacgacgctttgctgaggggtgaaatcccagatttgaacgacattctggaccgtgatgatttgactattatgaagcgtgctatcttctcaactcagcgtcaatctctgccccctgtgactacccacaacatgatagatgattccacagaccccatccttagcactatcagacgcattggtttgttcaataatagaacagatcgcgtcaaagtgatccttcacccagaatttctgagttccaccagtccattgttgccaatggattatgaggagtttgtccgtggctgtcaccttggtgtgtttcctagttattatgaaccatggggttacacccctgccgagtgcacagtgatgggcattccatctgtcactaccaacctgtccggcttcggctgttttatgcaagagcatgtggcagatccaaccgcctacggcatctacatcgtagataggcgttttaggagccccgacgacagctgtaatcagctcaccaaattcctttacggattctgcaaacagtcaaggcgccaaaggataattcagagaaatcgtaccgagagattgagtgatctcctggattggaggtacctgggccgctactaccagcacgctagacacttgactctgagtcgtgcttttcctgataagtttcacgtggagcttacatccccaccaactactgaaggcttcaagtacccaaggcccagcagcgtgcctccaagcccatctggtagccaggcatcctccccacagagttcagatgtggaagacgaggtagaggatgagaggtacgatgaggaggaagaagccgagcgcgacaggctcaacatcaagagccctttttctctgtcccatgtcccacatggaaaaaagaagttgcatggtgagtataagaat

SEQ ID NO: 13209 - DNA, 2109 bp, Artificial Sequence
  Description of Artificial Sequence: Synthetic coding sequence
atgttgcggggtagaagcctcagcgtcacctcgctgggaggactgccgcagtgggaggtcgaggaactgccggtggaggaactgctgctctttgaggtggcatgggaagtgactaacaaggtcgggggcatctacaccgtgatccaaacgaaagcaaagaccactgcggacgagtggggagagaactacttcctgatcggaccgtacttcgaacataacatgaaaactcaggtggagcagtgcgagccggtcaacgacgccgttcgccgggcagtcgatgccatgaacaagcacggctgccaagtgcactttggccggtggctcatcgaaggaagcccgtacgtggtgcttttcgacattggatattccgcttggaacctcgacagatggaagggtgacctctgggaagcatgctccgtaggcatcccttatcacgatcgggaggcgaatgatatgctcatcttcggctccctgactgcctggttcctgaaggaagttaccgaccacgccgacggaaagtacgtggtcgcccaatttcacgagtggcaagcgggcatcggactcatccttagccgagcccggaagctgcccatcgcgaccatcttcaccactcatgcgacgctgctgggccgctacctgtgcgccgccaacatcgacttctacaatcacctggataagttcaatatcgacaaggaagcgggagaacggcaaatctaccaccgctactgtatggaacgggcgagcgtgcactgtgcccacgtgtttactaccgtctcggaaatcactgccatcgaagctgaacatatgcttaaacggaagccagacgtcgtcactccaaacggactgaatgtgaagaagttcagtgcagttcatgaattccaaaacctgcatgctatgtacaaggccagaatacaggactttgtgaggggacatttctacgggcatcttgacttcgacctggaaaagactctgtttcttttcatcgcggggagatacgaattctccaataagggcgcagacatttttctggaaagtctttcaagactgaacttcctgctgcgcatgcacaagtccgatatcactgtgatggtgttcttcatcatgccggcaaagaccaacaatttcaatgtggaaactctgaagggtcaggccgtgaggaagcaactgtgggacgtcgcacactcggtgaaagagaagttcggcaagaaactgtacgacgcactgctccgcggtgagattccggacctgaacgatatcctggaccgagatgacctgactataatgaaaagagcaatcttttcaactcaaagacagtcactgcccccagtgacgactcacaatatgatcgacgacagtaccgacccaatcctttcaaccattcggcgcatcggactgttcaacaacagaaccgacagggtgaaggtcatcctgcatccggagtttctgtccagcacttcaccgctgctccctatggactacgaggaattcgtccgcggatgccatctgggggtgttcccgtcttactacgagccatggggctacaccccagccgaatgcaccgtgatgggtatcccgtccgtgaccaccaacttgtcgggattcggttgctttatgcaggaacacgtagccgatcccaccgcttatggaatctacatcgtggaccgccggttccgctcgccagacgattcctgcaatcagctgaccaagttcctttacggattctgcaagcagtcacgccggcagcggattatccagagaaaccgtaccgagagactctcggacctgctcgactggcggtacctcggaaggtactaccagcatgcacggcatctgactctctcccgggcgttccctgacaagttccatgtggagctcacttccccgcccaccactgaagggttcaagtacccgcggccttcgtccgtcccgccaagcccaagcggctcgcaggcctcctcgccgcagagctcggatgtggaggacgaagtcgaggacgagagatacgatgaagaagaggaggcggaaagagatcgcctgaacatcaaatcgccgtttagcctgtcgcatgtgccacacggcaagaagaaactgcacggagagtacaagaat

SEQ ID NO: 13210 - DNA, 2109 bp, Artificial Sequence
  Description of Artificial Sequence: Synthetic coding sequence
atgcttcgtgggcggtcacttagcgtgactagcctcggaggcctcccacagtgggaagtcgaagagctgccggtcgaagaacttctgctttttgaggtggcctgggaagtgactaacaaggtcggtggaatatacactgtcattcaaactaaggcgaaaaccaccgcagacgaatggggcgagaactactttctcattggcccatacttcgaacacaatatgaaaactcaagtggaacaatgcgaaccagtgaacgatgctgtccgaagagcagtggatgcaatgaacaagcatggatgtcaggtgcattttggccgatggcttatagagggttcgccgtatgtagtgctgtttgacattggctactccgcatggaatctggacaggtggaaaggcgacctgtgggaagcatgctctgtggggatcccttaccacgatagagaggcaaacgatatgctgatatttggatcacttactgcatggttcctgaaggaagtcactgatcacgccgatggtaagtacgtggtcgcacaatttcatgaatggcaggcgggaatcggtcttattctgtccagagctaggaaattgccaatagcaactatctttaccacccacgcaaccctgctgggacggtacctttgcgctgcaaacattgatttctacaaccacctggacaagttcaatatagataaggaggctggtgaaaggcaaatctaccacagatactgtatggaaagagcatcagtgcattgtgctcatgtgtttaccactgtgtccgaaatcaccgcaattgaagcagaacatatgctgaagagaaagcctgatgtggtgactcctaatggactcaacgtcaagaagttttcggcagtgcacgagttccagaaccttcatgccatgtacaaggcgagaatccaagactttgtgcgtggacacttttacggacatctggactttgatcttgaaaagaccttgttcttgttcatagccggaaggtacgaattctcaaataagggggcagacattttcctggaatcgctgtcccgtctgaattttctgcttaggatgcataagtccgatattaccgtgatggtgttcttcatcatgccggccaagaccaataactttaatgtggaaaccttgaaaggtcaagcggtgaggaagcaactctgggatgtggcacacagcgtcaaagagaaattcggtaagaaactttatgatgcattgctgagaggagagattccagatctgaacgacattctggaccgcgacgatttgaccattatgaaacgcgcgatcttttccactcaacgccagtcccttcctccggtcactacgcataacatgattgacgattcgaccgaccctatcctcagcaccatccggcgcattggactctttaacaacaggactgatcgggtcaaggtgattcttcatccggagtttttgagctctacttctccactgctccctatggactacgaagaatttgtgagaggttgtcatcttggtgtctttccatcatactacgagccatggggctacaccccagcagagtgcaccgtgatgggaatcccatcggttaccacgaacctgtctggatttgggtgttttatgcaagagcatgtggcagacccaaccgcgtacggcatttacattgtcgataggagatttcgatcccctgacgattcctgtaatcaactgacgaaatttctctacggtttctgtaagcagagccgcagacaacgcatcatccaacgaaatcgtacggaacggctttccgatctgcttgattggagataccttggacggtactaccagcatgccagacacctgaccctgtcaagggcatttccagataagtttcacgtggagcttacttctcccccaactacggaaggatttaagtaccctcgcccttcatccgtccccccatcaccttccggaagccaggcctcctcccctcagtcctcagatgtagaggatgaagttgaggatgaacgctacgatgaggaagaagaagcagaaagggataggctcaacatcaagtcgcctttctctctctcgcatgtcccgcatggaaagaaaaagctccatggagaatacaaaaat

SEQ ID NO: 13211 - DNA, 2109 bp, Artificial Sequence
  Description of Artificial Sequence: Synthetic coding sequence
atgttgcggggacgcagcctcagcgtgacttcgctgggaggactcccgcagtgggaggtcgaggagctgcccgtcgaagaactgctgctcttcgaggtggcatgggaagtcactaacaaagtgggaggaatctacacggtgatccagactaaagcgaaaaccacggcagacgaatggggagagaactactttctgatcggaccttactttgaacataacatgaaaactcaagtggaacagtgcgaaccggtcaacgacgctgtgcgccgggcggtcgacgcgatgaataaacacggatgtcaggtgcatttcgggcgctggctgatcgaagggtcgccttacgtggtcctgtttgacatcggctactccgcttggaacctcgacagatggaagggcgacctgtgggaggcttgttccgtgggaatcccataccacgatagagaagccaacgacatgctgatcttcgggtcactcaccgcctggttcctgaaggaggtcactgaccacgccgatggaaagtatgtggtcgcacagttccatgagtggcaggccgggatcggactgatcctttcgcgggccaggaagttgccgatcgcaactatcttcactacccacgccaccctcctgggccggtacctgtgcgcagctaacatcgacttctacaaccacctggacaaattcaacatcgacaaggaggctggagaacgccaaatctaccatcgctactgcatggagagggcatcagtgcactgtgcgcacgtgttcacgacggtcagcgagatcactgccatcgaagcggaacacatgctgaaacggaaacccgacgtggtcactccgaacggcctcaatgtgaagaaattctcggctgtccacgaattccagaatcttcacgctatgtacaaggcccggatccaggacttcgtgagaggacacttctacggacaccttgatttcgacctggaaaagactctgttcctgttcattgctggcaggtacgagttttccaacaagggcgccgacatcttccttgagtccctgtcgagactgaatttcctgctccgcatgcataagtctgacattaccgtcatggtgttcttcatcatgcctgccaagactaataactttaacgtggaaaccctgaaggggcaggcagttcggaagcagctgtgggacgtcgcccactccgtcaaagaaaagttcggaaaaaagctctacgatgccctcctgcggggtgaaatacccgacctcaacgatattctggatcgggatgatctgactatcatgaagagagccattttctccacccagcggcagtcactgcctcctgtcactacccataacatgatcgacgactccaccgatcctatcttgtcaaccatcagacgcatcgggctcttcaataaccgaaccgatagagtcaaggtgatccttcaccctgaattcttgtcatccacttcgccgctgctgcctatggactacgaggaattcgtccgcggatgtcatcttggcgtgttcccgagctattacgaaccctggggctacacccctgccgagtgcacggtgatgggaatcccttcagtgactactaacctgtcaggctttggatgtttcatgcaagagcatgtggcagacccaacggcctacggcatttacattgtggaccggcggttccgctcgccggacgattcgtgcaaccaactgactaagttcctttacggattctgtaaacaatcgcgccggcagcggatcatccagcgcaacaggactgaaagactctcggacctgttggattggagatacctgggacggtactaccagcacgcccgccatctgacgctgagccgcgccttcccggataagtttcatgtggagcttaccagcccaccgactactgaggggttcaaatacccgcgtccgtcatcggtgccgccctccccaagcggaagccaagcctcatccccgcagtcgtcagacgtggaggacgaagtggaagatgagagatacgatgaggaagaagaagcggaaagagacagactgaacatcaagagcccgttttcgctcagccatgtgccccatggcaagaagaaactccacggagaatacaagaac

SEQ ID NO: 13212 - DNA, 2109 bp, Artificial Sequence
  Description of Artificial Sequence: Synthetic coding sequence
atgcttaggggcaggtcgcttagcgtgacctccttggggggcctgcctcagtgggaagtggaagaacttccagtggaagagcttcttctttttgaggtggcatgggaagtcactaacaaggtcggtggcatctacactgttatacaaactaaagcaaaaactaccgccgatgagtggggtgagaactactttctcataggtccttactttgaacataacatgaaaacccaagtggaacagtgtgagccggtcaacgacgcggtgcgcagggctgtcgacgcaatgaacaaacatggatgtcaagtgcactttggccgatggcttatagagggatcgccttacgtggtcctttttgatatcggttactccgcatggaatctggatagatggaagggagatctgtgggaggcatgctcggtgggaatcccataccacgatcgagaagcaaacgatatgctgatttttggatccctgaccgcctggtttctgaaggaagttaccgatcatgcagacggtaagtacgtcgtggcccaatttcatgagtggcaagcaggtatagggcttattctgtcgagggcgcgaaaactgcctatcgcgaccattttcaccactcatgcaactcttttgggacggtacctttgtgcggcgaacatcgatttctacaatcatctggataagtttaacatcgataaggaggcaggagaaagacagatttaccacaggtactgcatggaacgcgctagcgtgcactgcgcccatgtgttcaccactgtgtcagagatcaccgccattgaagcagaacatatgttgaagagaaagcctgatgtggtgaccccgaatggtctgaacgttaagaaattctccgcagtgcatgagtttcaaaatctccatgccatgtacaaggcacggattcaagatttcgttcgaggccatttctacggacatctggattttgatctggaaaaaactctttttctctttatcgcagggaggtacgagttttcgaacaaaggagccgacatattcctggaatccctttcccggctcaatttcttgcttcgtatgcataagtcagatattaccgtgatggtgttcttcattatgcccgcgaaaaccaacaatttcaacgtggaaaccctgaaagggcaagccgtgagaaagcaactgtgggatgtggctcattcagtgaaggagaaatttggtaaaaagctgtacgatgcgttgcttagaggtgagattcccgacctgaatgatatacttgatcgcgatgatttgaccattatgaagagagcaattttctcgactcaaagacagtcacttccacctgtgactacccataacatgattgatgattcaaccgatcctatcctttcaaccattaggagaattggactgttcaataacagaaccgatagagtcaaggtgattcttcacccagaattcctttcgtcaacgtccccccttttgcctatggactacgaggaattcgtccgcggatgccatctcggtgtctttccgtcttactacgaaccctgggggtacactcccgcagaatgtactgtgatggggataccttccgtcaccacgaacctgagcggatttggctgtttcatgcaagaacatgtggcggatccaactgcatacggaatttacattgtggaccgtagatttcggtccccagacgattcctgtaaccagcttaccaagtttttgtacggtttttgtaagcaaagcagacgccaaagaattatccaacgcaatcgaaccgagcggctctcagatctgttggattggcggtatctgggtcggtattaccaacatgcccgccatttgacccttagcagagcttttcccgataagtttcacgtggaactcacctcccctcctaccactgagggatttaagtacccgcgtccctcgtcagtgccgccttcaccttcaggatcacaggcatcgagtccacaatcctcggacgtagaagatgaggtcgaagatgagcggtacgatgaagaggaggaagcggaacgggatcgcctgaacattaagagccctttctccctctcacacgtgccacacgggaagaaaaagctgcatggtgaatacaagaat

SEQ ID NO: 13213 - DNA, 2109 bp, Artificial Sequence
  Description of Artificial Sequence: Synthetic coding sequence
atgttgcggggacgcagtctgtcagtgacttctctcggagggcttccccagtgggaggtggaagaactccctgtagaagaacttcttcttttcgaagttgcctgggaagtgacaaataaagtggggggaatctatactgtgattcagacaaaggccaagacaactgcagacgagtggggggaaaattatttcctcatcggaccttactttgaacataatatgaaaacacaggtggagcagtgtgaacctgtgaatgatgctgtgcggcgagcagttgatgctatgaacaagcacggatgtcaggtgcactttggaagatggcttattgaaggatctccttatgtagtgctgttcgacatcgggtattctgcttggaatcttgatcgctggaaaggagacctgtgggaagcttgttccgtcgggataccatatcatgatagggaagctaatgatatgttaatcttcgggtctcttacagcctggtttttgaaagaagtaacagatcacgctgatggaaaatacgtggtggcacagtttcatgaatggcaggccgggataggacttattctgtcacgggccaggaaattgcctattgcaacaatttttactacacacgccactcttcttggaagatatctgtgtgccgctaacatagatttttacaatcacctagataaattcaacatcgacaaagaagccggggaaagacagatctatcatcggtattgtatggaaagggcatctgtgcactgtgcacatgtgttcactactgtctctgaaatcacagctatagaggctgaacatatgttgaaacgcaaacccgatgttgtgacaccaaacggactcaatgtgaaaaaattctcagccgtgcatgaattccagaaccttcacgctatgtacaaagcgagaatccaggattttgtgagagggcatttttatggacacctcgacttcgatttggaaaaaacattatttctgtttatagctgggaggtacgaattctccaataaaggggcagacatatttctggaatctctctcaagattgaacttcctccttcgaatgcacaaaagtgacatcacagtgatggtattctttatcatgcccgctaaaacaaacaacttcaacgtggaaacactcaaaggacaggcagtgagaaaacagctatgggatgtggcccatagtgtgaaggaaaaattcgggaaaaaactatacgatgccctcctcagaggggaaatcccagatctcaacgacatactcgatcgggacgatctgacaatcatgaaaagagccatatttagtacgcaaaggcagtcactaccccccgtgacaacacacaacatgatcgatgatagtacagatcctatcctttctacaattaggaggatcggattgtttaataacaggactgatcgagtgaaggtgattctgcatcccgaatttctgtcatctacatcacccctgttgcctatggattatgaagagtttgtacgcgggtgtcacctaggggtgttcccttcttactatgaaccatggggatacactccagcagaatgtactgtgatgggaatcccaagtgttacaacaaacctttccggattcggatgcttcatgcaggaacacgtggccgatcccactgcatatggaatctatatcgtagatcgccgattccggtcccctgatgatagttgtaatcagctcactaaattcctctatgggttttgtaaacagtcccgacggcagcgcataatccagagaaaccggacagaaaggctctctgatctactcgattggagatacctggggcggtattatcagcacgcaaggcacctaacactctccagagcattccccgataagtttcacgtagaactcacatcaccacccacaactgaaggatttaaatatccaaggcccagttccgtgccaccttccccatcagggtctcaggcatcttctcctcagagttccgacgtcgaggatgaggtggaagatgaaagatacgatgaagaagaagaagcagaacgggatcgactcaatataaagtctccctttagtctgagtcacgtacctcatggaaaaaaaaagctgcatggagaatataaaaac

SEQ ID NO: 13214 - DNA, 2109 bp, Artificial Sequence
  Description of Artificial Sequence: Synthetic coding sequence
atgctccgaggccgtagcctgagtgttacttctctaggagggctaccccagtgggaggtggaagaactccctgttgaagaattgctgctgttcgaggtcgcgtgggaagtcactaacaaagtcggtggaatatatacagtgatccagaccaaggccaaaactacagccgatgaatggggcgagaattacttcctcatcggaccatacttcgaacacaatatgaaaacgcaggttgaacagtgtgagcctgtgaacgatgcggtgcgtcgggccgtggatgcgatgaacaagcacggctgtcaggtccatttcggccggtggttgatagaaggatccccatacgtagtgttattcgacattggttatagcgcttggaatctggaccggtggaaaggcgacttgtgggaagcttgttcagtgggaataccctatcatgatcgggaagcaaacgacatgctaatattcggctcccttaccgcctggttcctaaaagaggtcactgaccacgccgacgggaaatacgtggtggcccagtttcacgaatggcaggcgggcattggattgatcctgagtcgagctcggaagctgcccattgctactatttttactacgcacgcaaccttgttgggcaggtacctgtgcgcagccaacatagacttctacaaccatctggacaaattcaacatcgacaaagaggcaggggaaagacagatttatcaccgctattgtatggagcgtgcctcagttcattgcgcccacgtctttacaaccgtgtcagaaatcactgccatcgaggcagagcacatgttgaaacggaaaccagacgtggtcactccaaacggtctgaacgtcaaaaaattctctgccgtccatgaatttcagaatctgcacgcgatgtataaggcgcgaatccaggactttgtgcgtggccatttctatggccatttggacttcgacctggagaagacattatttctgtttatcgcaggccgatatgagtttagtaacaaaggagctgatatcttcctagaatcattatctcgattgaactttcttcttcgtatgcacaagtcggatatcaccgtgatggtattcttcataatgcccgcgaagacaaataatttcaatgttgagaccctgaagggtcaagctgtaaggaagcagctgtgggacgtcgcccactccgtaaaggagaagttcggaaaaaagctgtacgacgcccttttgcgcggagaaataccagatctgaatgatatattagatcgcgatgatcttaccatcatgaagcgggcgattttctcgacgcagcggcagagcctgcctcctgtcactacacataatatgattgacgacagcaccgaccctattctttctaccattcggaggattggccttttcaacaatcggacagacagagtgaaggtcattctccatccagaattcctttcaagtacatctccgctcttgccaatggactacgaggagttcgtaaggggatgtcatttaggcgtgtttccatcctactacgagccatgggggtacactccggcagaatgtaccgtaatggggataccatccgtcaccaccaatctatccgggttcggttgcttcatgcaagagcacgtcgcagatccaaccgcatacggcatctacattgtcgatagacgtttcagaagccccgatgactcatgtaaccagctgaccaaattcttgtacggattttgtaaacaatcccgtcgccaacgtatcatacaaagaaatcgtactgaacgcctgagcgatcttctggattggagatatctggggaggtattatcagcacgcgcggcatctgactttgagcagggcttttccagacaaattccatgtcgagctgacgagtccccccaccacagagggattcaagtacccccggcctagctctgtgcccccctcaccaagcggttcacaggcttcatccccacagagctccgacgtagaggacgaggtagaagatgagcgctatgacgaggaggaggaggctgagcgagataggcttaatatcaagtcccccttcagccttagtcacgtgcctcacggtaaaaaaaagctgcatggtgagtataaaaat

SEQ ID NO: 13215 - DNA, 2109 bp, Artificial Sequence
  Description of Artificial Sequence: Synthetic coding sequence
atgctgcgtggtcgttctctgtccgttacctctctgggtggtctgccccaatgggaggttgaggagttgcctgtggaggaactgctgctgttcgaagttgcatgggaagtcaccaataaagtgggtgggatttacacggttatccaaaccaaggcgaagacgacggcagacgagtggggcgagaactactttctgattggtccctattttgagcacaatatgaagactcaagtcgaacagtgtgagccggttaatgatgcagtgcgacgggccgtggatgctatgaacaaacatggttgccaggttcatttcggacgctggctgattgaaggcagcccgtacgtggttctgtttgacattggctactcggcgtggaacctggatagatggaagggcgacctgtgggaagcttgctctgtgggtattccgtaccacgatcgtgaggctaacgatatgttgattttcggtagcttgacggcttggtttctcaaagaggtcaccgatcacgcggacggtaagtatgttgtcgcgcagttccatgagtggcaggcggggattggtctgatcctgtcccgcgcgcggaaattgccgatcgcgactatcttcacaacgcatgccactctgcttggacgttacctgtgtgcagcgaatattgacttctacaatcatctggacaagtttaacattgacaaggaagcgggtgagcgtcagatctaccaccgctactgtatggagcgcgcgagcgtacactgcgcgcatgtcttcaccacggtgtccgagatcaccgctattgaggccgagcacatgctgaagcgtaaacctgacgttgtgacccctaacggacttaacgtgaagaagttctccgctgtgcacgagttccagaatctccacgcgatgtacaaggcacgcattcaggactttgtgagagggcacttttatgggcacctggatttcgatttagaaaaaacactctttctgttcatagcgggccggtacgagttcagcaataagggcgccgacatctttcttgagtctctgagcagactcaacttcctgcttcgcatgcacaaaagtgatattaccgtgatggtgttttttataatgccagccaagactaataactttaacgtggaaacactgaaaggtcaggccgttaggaagcagctgtgggatgttgcacacagcgttaaggagaagttcggcaagaagttgtacgatgctttgctgcgaggagagatccctgatctgaacgacatactggaccgggacgatctgaccattatgaagcgtgctatttttagcacccagagacagtctctgccaccggtcactactcataacatgatcgatgatagcactgatcctattctctccactattagacgtatcgggcttttcaataatcgaacggatcgagttaaggttattttgcacccggagttcctgagcagcactagcccgctgttgccaatggactacgaggaatttgtgcgcggatgtcatttgggcgtcttcccgtcctactatgagccttggggttatacccccgcagagtgtaccgtcatgggcatcccgagcgttacaacaaacttgagcggtttcgggtgctttatgcaggagcacgttgctgatccaaccgcttatggaatttatatcgtggatcgtcggttccgtagccctgacgacagctgcaaccaactcactaagttcctgtatggtttctgtaagcagtcccgccgtcaacgcataatccaacgtaacagaacagagcgcctgtcagatctgctggattggcgctacctgggcaggtactaccaacatgctagacacctcaccttgagccgcgcgttccctgacaagttccatgtggaattgacttctcctccaaccacggaagggtttaagtatccaaggccaagcagtgttccgcccagtccatctgggtcccaggcaagcagcccacagtctagcgacgtcgaagacgaagtcgaagacgagagatatgatgaagaagaagaggctgagcgcgaccgtctgaacatcaaaagccctttctcgctgtcccacgtcccgcacggcaaaaaaaaactgcacggcgaatacaagaac

SEQ ID NO: 13216 - DNA, 2109 bp, Artificial Sequence
  Description of Artificial Sequence: Synthetic coding sequence
atgctgagggggagatcgctatccgtgacctccttgggcggattgccacagtgggaggtggaagaactgcccgttgaggaacttctacttttcgaggtggcttgggaagtgaccaacaaggttggtggcatttacacagtcatccagacgaaagctaaaactacggccgacgagtggggcgaaaattacttcctcattggcccatatttcgagcataatatgaaaacgcaggtagagcagtgcgaaccggtgaatgatgccgtgcgcagggcagtagacgccatgaacaaacacgggtgccaggtccacttcggccgttggctaatcgaggggtcaccctacgttgtcctgttcgatatcggttacagcgcttggaacctggataggtggaaaggcgacctgtgggaggcatgttccgttggcatcccttatcacgatagggaggctaatgacatgctcatcttcggctctctgacagcctggttcttaaaagaagtcactgatcatgcagatggcaagtatgtggtagcacagttccatgaatggcaggcggggatcggcctgatcctgtcacgcgcacgcaagttgcctatagccaccatttttactacgcacgccacactgctgggacgctacttatgcgctgccaacattgacttttataatcacctggataagttcaacatcgataaggaagcaggtgaacggcagatctatcaccgctactgtatggaaagagcaagcgtgcattgcgctcacgtctttaccaccgtcagcgagatcaccgcgatagaagccgagcacatgctgaaacgcaagcccgacgttgtcaccccaaatggactgaatgtgaaaaagttttcagccgtccatgagttccagaacttacatgcgatgtataaagccaggatccaggattttgtgcgcggtcacttttacggacacctggattttgatttagagaagactctgttcttattcatcgccgggaggtacgagttcagtaataagggggcagacattttcctggagtcactctctagactgaattttctactgaggatgcacaagtccgatatcaccgtgatggtcttctttatcatgcccgcgaaaactaataactttaacgtggagacactcaagggacaggccgtcaggaagcagctgtgggatgtcgcccacagtgtcaaagagaagttcggaaaaaagttgtatgacgcactgcttcgtggtgagatccccgacctgaatgacatactagatcgagatgatctgacaattatgaaacgtgctatcttttccacccagcggcagtccctgcctccagtgacgacccataatatgatagatgatagtaccgaccccattttaagtaccatccgacgcataggcttgtttaacaatcgtaccgaccgggtgaaggtcatacttcaccccgaatttctgtcctctacctctcctttgctgccaatggattatgaggagttcgtcaggggttgccatcttggagtgtttccctcgtattatgagccctggggctatactcccgcagagtgcactgtaatgggaatcccgagtgtgacaacaaacctgagtggctttggctgtttcatgcaagaacacgtggccgatcccactgcctacggcatttatatcgttgatcgcagattcagatcacctgacgatagttgcaaccaactgactaaattcctctacggcttttgcaagcaatctaggcgccagcggatcatccagagaaatagaaccgagagactgtcggacctgcttgactggagatatctgggaaggtattaccaacacgcacgacacctcaccttgtccagggcttttcccgataagtttcatgtggaattgacgagccccccgacgacagagggttttaaataccctcgccccagctctgtgccaccttcccccagcggatcacaggcttcctccccacagtcatccgacgtggaagatgaggtggaggacgagagatatgatgaggaagaagaggcggagagagacagactcaacatcaagtcaccgttctccctgtcgcacgtcccccatggaaaaaagaagctccacggggagtacaaaaat

SEQ ID NO: 13217 - DNA, 2109 bp, Artificial Sequence
  Description of Artificial Sequence: Synthetic coding sequence
atgctgcgcgggaggtccctgtccgtgacgagcttaggtggtctgccacaatgggaggttgaagagctacctgtggaggaactattgttatttgaggtggcctgggaggtcaccaacaaagttggggggatctacaccgtgattcagacgaaggctaagacaacagcagatgagtggggcgaaaattactttcttatcggcccctactttgaacataatatgaagacccaggttgagcagtgcgaacctgtgaacgacgccgtgcggcgggccgtggacgccatgaacaaacacggttgtcaggttcattttggccgatggctcattgaaggttccccgtacgtggtcctattcgacataggctactctgcctggaatctggacaggtggaagggcgacctctgggaagcctgttctgtcggtatcccctaccatgaccgggaagctaacgacatgcttatatttgggagcctgaccgcatggtttttgaaagaggtcactgatcatgccgacggcaagtatgtggtcgcccagtttcatgagtggcaagctggaattggcttgatcctatctcgggcccgtaaattgcccatcgctacaatcttcactacacatgctacactgctcggcaggtacctgtgtgctgctaatattgacttttataatcacttagataaattcaacatcgataaagaggcaggcgaaagacagatctaccatcgatactgcatggaaagggcctccgtacattgcgcccacgtgtttaccacagtgtcagagattacggcgattgaggccgagcacatgttgaagcgcaaaccagatgtagtaactcccaatggtcttaacgttaagaagtttagtgcggtgcacgagttccagaacttacatgctatgtacaaggcccgaatacaagacttcgtaagaggacacttttacggtcacctggatttcgatctcgagaagactttatttttgtttatagctggccggtatgagttctctaataagggcgcggatattttccttgaaagcctctcccgtttaaacttccttcttaggatgcataaatcagatatcaccgttatggtgttttttatcatgccagcaaagactaataacttcaacgtggagactctgaaagggcaggcagtccgcaaacagctctgggacgtggcccacagcgtgaaggaaaagttcggcaagaaactctatgacgcactgctcagaggcgagattcctgacctcaatgacatcctcgaccgggacgatctcactatcatgaaacgtgcaatctttagcacacaacgacagagcttgccccctgtgaccactcacaatatgatcgatgatagcactgacccaattctatccactatccgcaggataggcctctttaacaaccgaactgacagggtcaaggtcatcctgcaccctgagtttctgtcctctacatccccgctccttcccatggactacgaagagtttgtgcggggctgccacttgggcgtcttcccttcttactatgagccctggggctacacaccagctgaatgcacagtcatggggattccctccgtcaccactaatttgtctggcttcgggtgcttcatgcaagagcacgttgccgaccccacagcctatggaatctacatcgtcgaccgacggtttcgctctccggatgactcgtgcaaccaactcactaagtttctttatggtttctgtaagcagtctaggaggcagagaatcattcaacggaacagaaccgagcgcctctccgatctgcttgattggaggtacctggggcgatactaccaacatgcacgacatttgacactgagcagagcatttccagacaaattccatgtagaattgacaagccctcccaccactgaggggttcaaatatcctagaccctcatctgttcccccaagcccctcgggctctcaggcttccagtccccagtcatccgatgtagaggatgaagtggaggatgagagatacgacgaggaggaggaagccgaacgggataggctgaacattaagtccccattctccctgagccacgttccccatgggaaaaaaaagttacacggagagtataaaaac

SEQ ID NO: 13218 - DNA, 2109 bp, Artificial Sequence
  Description of Artificial Sequence: Synthetic coding sequence
atgctccgtggaagatcgctgagtgtgacgtcgctgggtggattaccacagtgggaagtggaggagttgcctgtcgaagagctgctcctgtttgaagtcgcctgggaagtcactaataaagtcggtgggatctacaccgtgatccagactaaggcaaagacaacagctgatgagtggggcgaaaattacttccttatcggcccttatttcgagcacaatatgaaaacccaggtggaacagtgcgagcccgtgaacgatgctgtgcgacgcgctgtcgatgccatgaataagcatggatgccaggtgcactttggacgctggttgatcgaagggtccccatatgtggtgctgttcgatattggctactcagcctggaacctcgaccgctggaagggcgacctatgggaggcttgttctgtggggatcccttaccatgaccgcgaggcgaacgacatgctaatcttcggctcactgactgcctggtttctcaaagaagtgacagaccacgctgatgggaagtacgtcgtggctcagtttcacgagtggcaggccggtatcggtctgattctgagcagggctcggaagctaccaatagctaccatctttacaactcatgctacattgctgggccgctacctgtgcgccgcgaacattgatttttataaccatctggacaagtttaatatagacaaagaagctggggaacgacagatttatcaccgatactgcatggagagggctagcgtccattgcgcgcacgtgtttactaccgtgtccgaaatcacggcgattgaagctgagcacatgctgaagcggaagccagacgttgtcacacccaacgggttgaatgtcaagaagttctccgccgtccacgaattccagaacctccatgccatgtataaagccagaattcaggacttcgtgagggggcacttttatgggcacctcgattttgatctggagaagactctcttcttgttcatcgcgggaaggtatgagttttccaacaaaggtgctgacatttttctggaaagcctttcgagactcaacttcctactgcggatgcacaaatccgatattaccgtgatggtattcttcattatgccggcaaagacgaacaatttcaacgttgagacactgaagggacaagccgttaggaaacagttgtgggacgtcgcccacagcgtgaaggagaagtttgggaaaaagttgtatgatgctttgctcagaggcgagatacctgatcttaacgatatccttgacagggacgatcttaccatcatgaaaagggctatttttagcacccagcggcagagtctgccgccggtgaccacacacaacatgatcgatgatagcaccgatcctatcctgtcaactataagacgcattggcctttttaataaccgaacagatcgcgtgaaagtgatactgcacccggaatttctctcttctaccagccccctgttacctatggactatgaagaattcgtgagagggtgccacctcggcgtcttcccgtcatattatgaaccctggggctacacccctgctgagtgcacagttatgggaatcccctccgtcacaaccaacctgagcggattcggatgctttatgcaggagcacgtcgccgatccgactgcatacggcatctacattgtcgaccgaagattcagatctcctgatgattcttgtaaccagttaactaagttcctgtacggcttttgcaaacagagtcggcgccagcggatcatccagagaaaccggaccgagcgcttatcagatctgctggattggcggtatctgggacgatactatcagcacgcaaggcacttaacattgagcagagcttttcccgacaaattccatgtggaattgaccagtccccccacaaccgaggggttcaagtatccgaggcctagctccgtgcccccctctccctctggatcacaggcaagttcgccacaatcctccgatgttgaggacgaggttgaggatgagcggtacgatgaggaggaggaagcagagagggacagactcaacattaagagtcccttctctctatcccacgtgccccatggtaaaaagaagctccacggcgagtacaagaat

SEQ ID NO: 13219 - DNA, 2109 bp, Artificial Sequence
  Description of Artificial Sequence: Synthetic coding sequence
atgctgcggggacgctcgcttagcgtgacgtcattgggtggactgccgcagtgggaagtagaagagctgccagtcgaggagctgctcctcttcgaagtggcctgggaggtcactaataaggtgggtgggatttacaccgtgatccagaccaaggccaagaccactgccgatgaatggggtgagaactactttctgattggcccatacttcgaacacaacatgaaaacccaagtcgaacagtgcgagccggtcaatgacgcagtgcggcgggctgtcgatgcaatgaataagcacggttgccaagtgcatttcggacggtggctgattgagggtagcccgtacgtggtgctgttcgacatcggatactcggcctggaatttggacagatggaagggtgacctgtgggaggcgtgctcagtgggaatcccttaccacgatcgggaggcgaatgatatgctgattttcggatcgctgaccgcctggtttctgaaagaagtcaccgaccacgccgacggcaagtacgtggtcgcccagttccacgaatggcaggccggaatcgggttgatcctctcccgcgcccgcaagctgccaattgccaccatcttcaccactcatgcgacgttgctgggtcggtacctctgcgccgctaacatcgacttttacaatcacctcgacaagttcaacattgataaggaagcgggcgaacgccaaatctaccacagatactgtatggagcgcgctagcgtccattgcgctcacgtgttcacgaccgtgtccgaaatcactgccattgaagccgaacatatgttgaagagaaaaccggacgtggtgaccccgaacggactgaatgtgaagaagttttcagcagtccacgagttccaaaatctccacgccatgtataaggcccgaatccaagacttcgtgagaggacacttttacgggcacctggatttcgacctcgagaaaacgctgttccttttcatcgcaggacgctacgaattctccaataaaggagccgacatcttcctggaatcgctctcccgcctgaacttcctgctcagaatgcataaatcagatatcactgtgatggttttcttcatcatgcctgctaagactaataacttcaatgtggaaactctgaagggccaggctgtgagaaagcagctgtgggacgtcgcccattccgtgaaggaaaagtttggcaaaaaactttacgatgcactgctgcggggcgagatccccgacctcaatgatatccttgaccgcgatgacctgacgattatgaagcgggcgatcttctcgacccaaaggcagtcactcccaccggtgactactcacaacatgattgacgattcgaccgatccaatcctgtcgacgatcagaaggatcggacttttcaataacaggactgatcgggtgaaagtcatcctgcaccccgaatttctttctagcactagcccactgctcccgatggattacgaagaatttgtgcgcggatgccacctcggagtgttcccgtcgtactatgaaccttggggatacactcctgcggaatgcactgtcatgggtatcccttcagtgacgacgaacctgagcggattcgggtgctttatgcaggagcacgtggcagaccccactgcgtacggtatctacatcgtggaccgcagattcagatctccggatgattcgtgtaaccagctcaccaagttcctgtacggattctgcaaacaaagcaggcggcagcggatcatccaacggaacaggactgagcgcctcagcgacctgcttgactggagatacctcggccggtactatcagcatgcgcggcatctcactctgtcgcgggcattcccggacaagtttcacgtcgaactcacctcgccgccgactactgaaggatttaagtacccccggccgtcaagcgtgccgccgtcaccgtcaggatctcaggcctcgtccccacaatcctcggatgtggaagatgaagtggaggacgagcggtacgacgaggaagaggaagccgaacgcgaccggctgaatatcaagtctccgttctcgctgtcgcacgtgccgcacgggaagaaaaagctgcacggagagtataagaat

SEQ ID NO: 13220 - DNA, 2109 bp, Artificial Sequence
  Description of Artificial Sequence: Synthetic coding sequence
atgttgcgaggcaggtcgctttcggtcacttcccttggaggtctgccacagtgggaggtcgaagagctgcccgtggaggaactgctcctgtttgaggtggcatgggaagtgaccaacaaggtgggtggtatttacaccgtgattcaaaccaaggcaaagaccactgcagatgagtggggcgagaattacttcctgatcggtccatactttgaacataacatgaaaacccaagttgagcagtgtgagccagtgaatgacgcagtgagaagggcagtggatgccatgaacaagcatgggtgtcaggtccattttggacggtggcttatcgaaggatcaccttacgtcgtgcttttcgatattggatactccgcatggaacctggataggtggaaaggagatctttgggaagcatgttcggtgggtattccttaccacgatcgggaagcaaacgatatgcttatctttggttcactcaccgcatggttcctcaaagaagtgactgatcatgccgacggaaaatacgtcgttgcgcaattccatgagtggcaggcaggaattggccttattctgtcaagagcccggaagctgcctatagcaacgatctttactacccatgcaaccctgctggggcgttacctctgtgcggcaaacatcgacttttacaaccatcttgacaagtttaacatcgacaaggaggccggtgaaagacaaatctaccatcggtactgcatggaacgggccagcgtgcattgtgcccacgtgtttaccactgtctcagagatcaccgcgatcgaggcagaacacatgcttaagcgcaagccagacgtggtgacccccaacggactgaacgtcaagaagttttcggcagtccacgaattccagaacctgcacgcaatgtacaaggcgcggatccaagactttgtgcggggccacttttatgggcatctcgacttcgatcttgaaaaaacccttttccttttcatagccggccggtatgaattttcaaataagggtgctgacattttcctggagtccctttcccgtctgaatttcctgcttagaatgcataagtccgatataactgttatggtctttttcataatgccagcaaagactaacaactttaacgtggaaaccctcaaagggcaggcagtgagaaagcaattgtgggacgtcgctcactcggtcaaggaaaagttcggaaaaaagctctacgatgcacttcttagaggcgaaattccagatctgaacgatatccttgatcgcgatgatctgaccattatgaaacgggcaatctttagcactcagaggcagagccttccccctgtgaccacgcacaatatgattgatgattccacggaccccattttgagcaccattagaaggatcggtctgttcaataaccgcaccgaccgcgtgaaggtgattctccaccccgagtttctttcatccacgtcgccccttcttcctatggattacgaagaattcgtcaggggctgtcatctcggcgtgttcccttcgtactacgagccctggggatacacgcctgcagaatgcaccgtgatgggtatcccttcggtgactaccaacctgtcaggttttggttgtttcatgcaagaacatgtggcagatcctactgcgtacgggatctacattgtggatcgtagatttcggtcgccggatgattcgtgcaaccaacttacgaagtttctttatggattttgtaaacaaagcaggaggcagcgcatcattcaaagaaatagaactgagcgcctctccgacctgcttgattggcgctatctcggcagatactaccagcacgcacgtcacctgactctgagccgagcatttcctgataagttccatgtggaactgacttcgccccccactactgaagggtttaagtaccctcggccaagctccgtcccaccctcaccaagtggatcccaggcatcgtcccctcagtcgtccgatgtggaggacgaagtggaggatgaacgttacgatgaagaagaggaggccgagagagatcgtctgaacattaagtcacccttctcactctcccacgtgcctcacggaaagaagaagctccatggtgagtacaagaac

SEQ ID NO: 13221 - DNA, 2109 bp, Artificial Sequence
  Description of Artificial Sequence: Synthetic coding sequence
atgctgcggggtcggtcgcttagcgttacttccctaggcggcttaccccaatgggaagtggaagagcttccggtggaggagcttcttctctttgaggtggcatgggaggtgaccaataaggtggggggaatctatactgttattcagacgaaagcaaagaccactgcagacgagtggggggagaactactttctgattgggccatacttcgagcacaatatgaagacacaggtcgaacagtgcgagcctgttaatgacgcagtccgccgtgccgtagacgccatgaacaagcacggttgtcaagtccacttcgggaggtggctcattgaagggagtccatacgtggttctcttcgatatcggttactctgcgtggaatctggatcgttggaagggggatctctgggaggcgtgctcagtcggcataccatatcatgacagagaagccaacgacatgctcatcttcggtagtctgacagcctggtttttgaaggaagtaaccgaccatgccgacggcaagtacgtggttgcacaatttcatgaatggcaagccggtattgggctcatactaagcagggcgcgaaagttgcccattgctacgatcttcacaacgcacgcgacattgttggggcgctacctgtgtgcagctaatattgatttttacaatcaccttgacaagtttaatatcgacaaggaagctggcgaacgtcagatctaccatagatactgtatggaacgagcctcggtccactgcgcccacgtctttactacagtttccgagatcacggctattgaggcagagcatatgttaaagcgtaagcccgatgtcgtcacgcccaatggtttgaatgtgaagaaattctcggccgtccatgaattccagaatctccacgcaatgtacaaggctaggatccaagactttgtgcgaggtcacttctacggacatcttgacttcgatctagagaagacgctcttcctcttcatcgcaggacggtatgaattctccaataaaggtgccgatatatttttggaaagcttgtcccgcctcaacttcctcctgcgtatgcacaagtccgacatcactgtcatggtgttttttattatgcctgctaagacaaataattttaacgtggagacccttaaaggtcaggcagtccgcaagcaactctgggatgttgctcattctgtcaaagagaagttcgggaaaaagctttacgatgcattgttacgtggggagatccctgacctaaacgatattctagaccgtgatgatctgacgataatgaagcgggcgatattctccacacaacgtcaatcactgccacctgtgactacacacaatatgattgatgactcaacagatcctatcctctccacgattcggaggattggactctttaataaccgaaccgacagggtcaaggtcatccttcaccctgagttcttgtccagtacgtcaccattattgccgatggattacgaagagttcgtacgcggttgccatctaggtgtattcccgtcctactacgagccttggggatatacgccagccgagtgcacggttatgggcatcccatctgtaaccacaaatctctctgggttcgggtgcttcatgcaagaacacgtggcagatcccacggcgtatggtatatatattgtcgatcgtcgttttcgatcacctgatgattcatgcaaccaattgaccaagttcctgtacggattctgcaagcagagccgaaggcaacgcattatccagcggaaccgaacagagcgccttagcgatctgttggattggcgctacttgggccgttactaccagcacgctcgccatctgacactatcacgggcatttccagataaattccatgtcgaactgacatcccctcccaccaccgaggggttcaagtatcctcgtccctcatccgtgccaccgtcaccgagtggctcacaggctagctcacctcaatcatctgacgttgaagatgaggtcgaagacgagaggtatgatgaagaagaggaagcagagcgcgacaggcttaacatcaagtcccctttttctttgagccacgtaccccatggaaagaaaaaattacacggcgagtacaagaat

SEQ ID NO: 13222 - DNA, 2109 bp, Artificial Sequence
  Description of Artificial Sequence: Synthetic coding sequence
atgctgcgcggacgcagcctgtccgtgacgtcactgggtggcttgccacaatgggaggtggaagaactgccggtggaggaacttcttctgtttgaggtggcgtgggaagttactaataaggtcggaggaatttacacggtgatccagaccaaggctaagactacggccgatgaatggggcgaaaactatttcctgatcggcccttactttgagcataacatgaaaacgcaggtggaacaatgcgaacctgtcaacgacgctgtgcgtagagccgtggatgccatgaacaaacacggatgtcaggtgcattttgggagatggctcatcgaagggtcgccatacgtcgtcctgttcgatattgggtactcggcatggaacctggatagatggaaaggtgacctttgggaagcctgttccgtgggaatcccctatcacgatcgggaggcaaatgacatgctcatttttggcagccttactgcttggtttctcaaggaagtgacggaccacgcagacggaaagtatgtcgtcgcgcaatttcatgaatggcaagcaggcattggtcttattctttcaagggctcgcaaactgccaatcgccacgatcttcaccactcatgcgaccctgctgggtagatacctgtgtgctgcaaacattgacttttacaatcacctcgataagtttaacatcgacaaggaggcaggagaacggcagatatatcatcggtactgcatggaaagagccagcgtccattgtgcccatgtgttcactaccgtgtcagaaataaccgcaattgaagcagagcacatgctcaagcgtaaacctgatgtggtgacgcctaacgggttgaacgtgaagaagttttcggcagtgcatgaatttcaaaatcttcacgcgatgtacaaggcacgtattcaggactttgtgaggggtcatttctacggtcatcttgatttcgatctggagaaaactctgtttttgtttatcgcaggtcgctatgaattctcgaacaagggagcagacatctttctggaatcgcttagcagactcaacttcctgctgcggatgcataaatccgacattactgtgatggtgtttttcataatgcccgcaaaaactaacaacttcaacgtggaaactctgaaaggtcaagctgtgagaaagcagttgtgggatgtcgcacattccgtgaaagagaagtttggaaaaaagttgtacgatgcgctgctgcgaggcgagattcctgacctgaatgacatcctggatagagatgatctgactatcatgaagagagcaatattctcaactcagcggcaatctttgcctcctgtgaccacccacaatatgattgatgattcaaccgacccaattctttcgactatccgcagaattgggctgttcaataaccgcaccgatcgtgtcaaggtcatacttcatccggagttcctttcatcgacttccccccttcttccaatggactacgaggagttcgtgaggggttgtcacctgggcgtctttccttcgtactacgaaccttggggttacactcctgccgaatgcaccgtgatgggaataccgtccgtcaccactaaccttagcggtttcggatgctttatgcaggagcatgtcgcagatcctaccgcgtacggaatctacattgtcgataggagatttcggtcaccggacgactcgtgtaaccaactgaccaagttcctttacgggttctgtaaacaaagcagaaggcagcgcattattcaacgcaatagaaccgaaaggctttcagacctgctcgattggagataccttgggagatactatcaacatgcacgccacctgaccttgtcacgggcgttcccagataagtttcatgtggagcttacctcgcctccaaccaccgaagggttcaaatacccacggccctcatcggtgcctcctagcccgtccggtagccaagcatcctcccctcaatcgtctgacgtcgaggatgaagtcgaagatgaacgttacgatgaagaggaagaagcagaacgggatcgcctcaacattaagtcccccttttcgttgtcacacgtcccacacggtaagaagaagttgcatggcgagtacaagaat

SEQ ID NO: 13223 - DNA, 2109 bp, Artificial Sequence
  Description of Artificial Sequence: Synthetic coding sequence
atgctccgcggacggtcactgtcagtcacctcgctgggtggccttccccaatgggaagtggaggagctgcctgtggaagagttgctcctgttcgaggtggcttgggaagtgactaataaggtgggaggtatctacaccgtcatccagaccaaggcgaaaacgaccgcagacgagtggggagagaattacttcctcatcggtccgtacttcgaacacaacatgaaaacgcaggtggaacagtgtgagcctgtaaacgacgctgtgcgccgggccgtggatgcaatgaacaagcacggctgccaggtccacttcggccgctggctgatcgaaggctccccatacgtcgtcctcttcgacattggatactcagcctggaatctggatcgctggaaaggagatttgtgggaagcctgctccgtgggaatcccgtaccatgatcgcgaggcgaacgatatgctgatctttgggagtctgactgcgtggtttcttaaggaagtgaccgaccacgcagacggcaagtacgtggtggcgcaattccatgaatggcaggccggtattggcctgattctgtcgagggctcggaagctcccgatcgccactatcttcactacccatgcgacccttctcgggagatacctgtgcgccgcaaatatcgacttctacaatcatctcgacaagtttaacatcgacaaggaagctggagagcggcagatctaccaccgctactgtatggagcgggcatcggtccattgcgcccatgtgttcaccaccgtttccgaaattactgcgattgaggccgaacatatgctgaagcggaaacctgatgtggtcacccctaacggcctcaacgtcaagaagtttagcgccgtccacgaatttcaaaacctgcatgccatgtacaaggcgcgcatacaagatttcgtgagaggacatttctatggacacctggactttgatctcgaaaagactctgttcctcttcatcgcgggaaggtacgagttctccaacaagggggctgacatcttccttgaatccctgagcagactcaacttcctgctcaggatgcacaagtcggacattactgtcatggtgttcttcatcatgcctgccaagaccaacaactttaacgtcgagactctcaagggacaggccgtgcgaaagcagctctgggatgtggctcactcagtgaaggagaaattcggaaaaaagctctacgacgctctgttgcggggagaaatcccagacctcaacgatatccttgaccgggatgacctcaccatcatgaagcgggcgatcttcagcactcaacgccaaagtttgccaccggtcaccactcacaacatgattgacgactccaccgacccaatcctgtcgactatcagacgcatcggtttgttcaataaccgcactgaccgcgtcaaagtcatattgcaccccgagtttttgtccagcacgtccccactgttgcctatggattatgaggagtttgtccgcggatgccacttgggagtgttcccatcctactatgagccttggggttacaccccagcggaatgcaccgtaatgggaatcccaagcgtgactaccaatctgagcggctttggatgtttcatgcaggaacatgtcgccgatccgaccgcttacggcatctacatagtggacaggcggtttagatctcctgacgattcctgcaatcaactgactaaattcctgtacggattctgcaaacaatcgagacggcagcgcatcatccagagaaacagaactgagaggctgtcagatctgttggactggcgctacttgggacggtactaccagcacgcccgtcacctgacgctctcgcgcgcgttcccggacaagttccatgtcgaacttacctcgccgcctactaccgaaggattcaaatacccacgcccgtcatcagttcctccaagcccctccggcagccaggcctccagcccgcaaagttccgacgtcgaagatgaggtggaggacgaacggtatgacgaagaggaagaagcggaaagggatagactgaacatcaaatcgcccttctcactgtcccacgtcccgcacggtaagaagaaactccacggggaatacaaaaac

SEQ ID NO: 13224 - DNA, 2109 bp, Artificial Sequence
  Description of Artificial Sequence: Synthetic coding sequence
atgctccgcgggcggagcctgtccgtgactagcctgggcggtctgccacagtgggaggtggaagaacttccagtcgaagagcttctcctctttgaagtggcgtgggaagtcaccaataaggtgggtggcatttacactgtgatccagaccaaagcgaaaaccaccgcagatgaatggggtgaaaactactttctcattggtccgtattttgagcataacatgaaaactcaagtggagcagtgtgaacctgtgaatgacgctgtgcgtagggcggtcgatgccatgaacaagcatggctgtcaagtccactttggacgctggctgattgaaggaagcccatatgttgtgctgttcgatattggctacagcgcctggaatcttgatcgctggaagggcgatttgtgggaagcctgctccgtaggaattccataccatgacagggaggcaaacgacatgctcattttcggtagcctgaccgcctggtttctcaaagaagtgaccgatcatgcagacggtaagtacgtggtcgcgcagtttcacgagtggcaggccgggattggacttatcctgagccgcgcgcggaaacttccaatcgcaaccatctttactactcatgcgacccttttgggccggtatttgtgtgcagctaatatcgatttctacaatcacttggacaagtttaacattgataaggaagctggagagcggcagatttatcatcggtactgtatggaaagggcatcagtgcactgtgcacatgtgtttaccaccgtgtcagaaatcaccgccattgaagccgagcatatgttgaaacgaaagccagatgtcgtgaccccaaatggtctgaacgtcaagaaattctccgcagtgcatgaattccagaacttgcatgccatgtacaaggcacggatccaggatttcgtcaggggccatttctacggtcacctggattttgacctggaaaagactctcttccttttcattgccgggagatacgaattttcaaacaaaggagccgatatcttccttgaatcgctttcccgactgaattttctgctcagaatgcataagtcagatattaccgtgatggtctttttcatcatgcccgctaaaaccaacaactttaatgtggaaacgcttaagggacaggcagtccgtaaacagctttgggacgtggcacactccgtcaaggagaaatttggcaagaagctctacgatgctctgttgcgcggagagatccctgaccttaacgatatccttgatcgagatgatctgactataatgaaacgtgccatcttttcgactcaaagacaaagcctgcctccagtgaccacccataacatgatcgacgactccactgatccaatcctgtccaccattaggagaattggattgtttaacaatagaactgaccgagttaaggtgatcctgcatcccgaattcctctcatccacttcgcctctccttcccatggattacgaagagtttgtgagaggctgccatctcggggtgttcccctcctattatgaaccttggggctacactcctgcagaatgcacggtcatggggataccttcggtgacgaccaacctgagcggtttcggatgctttatgcaagagcatgtggctgatccgactgcatacggaatttacatcgtggatcggagattcaggtccccggacgattcgtgcaaccaactgacgaagtttctgtacggcttctgtaaacaatccagacgacaacgaattatccagagaaaccggactgaacgtctttcggatctgctggattggcggtaccttggccggtactaccagcacgcaaggcacctgaccctgagccgggcattcccagataagttccatgtggaacttacctcgccaccgaccaccgaaggtttcaaataccctagaccctcctccgtccccccatcgcccagcggtagtcaggcatcctccccgcaaagctcggatgtggaggatgaagtcgaggacgaaaggtacgatgaagaagaagaagcagagcgagacagactgaacattaagagcccattctcactgagccacgtgccgcatggaaagaagaagctgcatggagaatacaagaac

SEQ ID NO: 13225 - DNA, 2109 bp, Artificial Sequence
  Description of Artificial Sequence: Synthetic coding sequence
atgttacgaggccgatccttgtccgtgacttctctgggcggcttgcctcagtgggaagttgaagagctgccggtcgaggagctcctgctgtttgaggtcgcctgggaggtcaccaataaggtaggaggcatatacacagtgatacagaccaaggcaaagacgaccgctgacgagtggggcgaaaactactttttgatcggtccctacttcgaacacaatatgaagacgcaggtggagcagtgcgaaccagttaacgatgccgttcgccgggcggtagatgctatgaataagcatggatgccaagttcactttggtcgatggctcatagagggtagtccctacgtggtgctatttgacatcggctatagcgcgtggaacctggaccgttggaagggtgacctgtgggaggcttgctctgtcggtattccgtaccatgaccgcgaggccaatgacatgctaatttttggttctcttaccgcgtggtttcttaaggaagttaccgaccacgcagacgggaagtacgtggtcgcccagtttcacgagtggcaggcgggtatcgggctgatcctgtcccgagcccggaagctgccgatcgcaactatttttactacccacgccaccctcctcggccggtacctgtgtgctgctaacatcgatttttacaatcatctggacaagtttaacatcgacaaggaagccggggagcgtcagatctatcaccgctactgcatggagagagcctccgtgcattgcgcacacgtgttcaccacggtgtccgagatcacggcgattgaagctgaacacatgttgaaacgtaagcccgatgtcgtgacccccaacggcctgaacgtcaagaaattttctgcggtccatgagttccaaaatctccacgcgatgtataaggcaagaatccaggactttgtacgaggtcatttttatggccacctcgacttcgatttggagaagacgttatttctgttcatagctggcaggtacgagttctcgaacaaaggagccgatatttttttggagtcgttgtcccgtctgaacttcctgttgcgaatgcacaagtcggacattacggtcatggtgtttttcattatgccggcaaagacgaacaattttaacgtggaaacgctgaagggacaggctgtgcgcaaacagctgtgggacgtcgcccattccgtcaaagagaaattcggtaagaaattgtacgacgccctgctgcgcggagagatcccggaccttaacgacatcttggatcgtgacgatctgacaatcatgaaaagagccatattcagtacgcagcggcaaagcctgccacccgtgactactcataatatgatcgatgatagcaccgaccccattctgtcaacaatacgcagaatcggattattcaataaccggacagaccgcgtgaaggtcatcttacatcccgagtttttgtcctcaacaagtcccctgctgccaatggactacgaggagttcgttcgcggttgtcacctgggagtcttcccctcctattacgagccctggggctacactcccgcagagtgcacggttatgggcataccgtctgttacaactaacctctcggggttcggctgctttatgcaagagcacgtcgcagaccccactgcctacggaatctacatagtcgaccgtcgcttccgctctccagatgactcctgcaatcaactgacgaagttcctgtatggcttctgcaagcagtcacgccgacagcgcataatccaacgcaaccgcactgagcgcctgtctgacctactggactggcggtatttgggccgttactatcagcacgctcgccatttgactctgtctcgtgccttcccagacaaattccacgtcgaattgaccagcccgcctaccaccgagggattcaagtatccacgcccgtcgtcagtgccaccgagcccgagtggatcgcaggcctcctctccgcagagcagcgacgtggaagatgaggtcgaagatgagcgttacgacgaggaagaagaggcggagcgcgatagactaaatataaagagtccgttcagccttagtcatgtgccgcatggaaagaaaaagctacacggagaatataagaat

SEQ ID NO: 13226 - DNA, 2109 bp, Artificial Sequence
  Description of Artificial Sequence: Synthetic coding sequence
atgctccgcggaaggagcctgtctgttacatctctgggcggtctcccacagtgggaggtggaggagctgcccgtggaggaattgctcctttttgaggtagcctgggaggtgactaacaaggtgggtggaatatatacagtcatccaaaccaaagctaaaactaccgcagacgaatggggtgagaattattttctcattggtccctattttgaacataatatgaagacccaggttgagcaatgcgagccagtcaacgacgccgttcgccgcgctgtggacgctatgaataaacacggatgtcaagtgcactttggcaggtggctgatcgaaggctcaccctacgtagtcctgttcgacataggatactctgcttggaacctggatagatggaagggcgacctgtgggaagcgtgcagcgtgggtatcccctaccacgatagggaagctaacgatatgcttattttcggctccttgaccgcctggttcctcaaggaggttacagaccacgccgatggcaagtacgtcgttgctcagtttcacgagtggcaggccggtatcggtctgatacttagtagggcaaggaagctccctatcgccaccatcttcacaacccatgccacgctgctgggtagatacctttgcgccgccaatattgatttctacaaccacctcgataagtttaacattgataaagaagccggcgagaggcagatttaccacaggtactgtatggagagggccagcgtccactgtgctcacgtgtttacgaccgtgtcagaaatcaccgctatcgaggccgagcatatgcttaaaagaaaacccgacgtcgttacccccaatggactcaacgttaagaaattttctgccgtccatgagtttcagaacctgcacgcgatgtacaaggccagaatccaggactttgtcagaggacatttttacggccacctcgattttgatttggagaagaccctgttcttgttcattgccggcaggtacgagttctcaaataagggcgctgacattttcctggagtccctttctagactgaacttcctcctccgcatgcataagagcgacatcacagtcatggtcttcttcataatgcccgcaaagactaacaactttaatgtcgagactctgaagggtcaggcggtaagaaagcaattgtgggacgtagctcattccgtgaaggaaaaatttggcaagaaattgtacgacgcgctcctcaggggtgagatacccgatttgaatgacatcctggacagggacgaccttacgatcatgaagcgcgccatcttctctacacagcgccagagcctccctccggtgactacacacaacatgattgacgacagtaccgaccccattttgtctaccattcgcaggatcggactgttcaataaccgcaccgatagggtcaaggtgatcctgcaccccgagttcctgtcctctacaagtccgttgctgcccatggactacgaggagtttgtaagaggttgccacctgggagtcttcccctcctactacgagccgtggggatacactcctgctgagtgcaccgtgatgggaatccctagcgtgacaactaacttgagtggatttggatgcttcatgcaagaacatgtggctgaccctactgcctacggcatctacatcgtcgacagaaggttcaggtcacctgatgactcctgtaaccaactcacaaagtttctgtacggtttctgtaaacagtcccgcaggcagaggatcattcaaaggaacaggaccgagagactctccgacctgctcgactggaggtatctcggaaggtattaccagcacgcgcgccatctcactctttcaagggccttccccgataaatttcacgtggaactgacatctccacctacgactgagggattcaagtacccgcgcccttcctccgttccgcccagtccctctggctctcaggctagcagtccccagagctccgatgtcgaagatgaagtcgaagatgagaggtacgacgaggaggaagaagccgaaagggaccgcctcaatattaagtcaccgttttcactgtcccacgtgccccatggaaagaagaaattgcacggagagtacaaaaat

SEQ ID NO: 13227 - DNA, 2109 bp, Artificial Sequence
  Description of Artificial Sequence: Synthetic coding sequence
atgcttcgggggagatccctttccgtgacgtccctggggggacttccacagtgggaggttgaggaattgcccgtggaggagctcttactgttcgaggtggcttgggaagtcaccaacaaagtaggcggcatttacaccgtgatacagactaaagccaagaccaccgcagatgaatggggggagaattattttctgataggcccttactttgagcacaatatgaagacccaggttgaacagtgtgagccagttaacgacgcagttagaagggcagtggatgcgatgaacaaacacggctgtcaggtccatttcggtcgctggctaattgagggcagcccttacgtcgttttatttgatattggctactctgcgtggaacctagaccgttggaaaggtgacctctgggaagcttgttcagtaggaatcccctatcatgacagggaagccaatgacatgctaatctttggctcactgacagcttggtttctgaaggaggtcacggatcacgcagatggcaaatatgtggtggctcagttccacgagtggcaagcaggaatcggactcattttgtctcgcgcacgcaaacttcctatcgcaacgatctttacaacacacgctaccttgctcggtcgctacctgtgtgccgctaatattgacttctacaaccatctcgacaaattcaacattgacaaagaagcaggtgagcggcagatctaccaccgatactgtatggagcgcgcatccgtgcactgtgcgcacgtctttacaacagttagcgagattactgccatagaggcggaacatatgctgaagcgcaaacccgatgtcgttacaccaaacgggttgaacgtcaagaaattcagtgccgtacatgagttccagaatctgcatgctatgtacaaagcccgaattcaagacttcgtgagaggtcacttctacgggcatctggacttcgacctcgagaaaactttgttcctgttcatcgcaggaaggtatgagtttagcaataaaggagcggacattttcctggaatccctgagccggctcaattttctgctccgcatgcataagtccgatattactgtgatggtttttttcataatgccagctaagacaaacaatttcaatgtggagactcttaaaggacaggccgtacggaagcagctttgggacgtcgcccacagtgtgaaagagaagttcggtaagaagctttatgatgctctcctgaggggtgagattcctgatttgaacgacatcctagaccgtgatgatctgacaattatgaagcgtgcaatattttccactcaacgccaaagtctgcccccagtgactactcataatatgatcgatgacagtactgaccccatcctgagcaccataagacggattggcctgtttaacaaccggactgaccgcgtgaaagttatactgcatcccgaattcttgtcatcaacaagccccctgttgcctatggactacgaagagtttgtgcgggggtgccatctgggagtgtttccttcctattatgagccgtggggctacacaccagcagagtgcactgtgatgggaattcctagcgtcaccacaaaccttagtggattcgggtgcttcatgcaggagcacgtagccgatccgaccgcatatggtatctatatagtggacaggcggttccgctctccggatgacagttgtaaccagctgacaaagtttctgtatggtttttgcaagcaaagtcgaaggcagcgcatcatccagcgcaatcgcacagagaggttgagcgacttactggattggcgatacttgggtcgttactatcagcacgcaagacatctaactctatccagagcctttcccgacaaattccatgtggaacttacctcccccccaaccactgagggattcaagtacccacgccctagctcagttcccccctcaccatccggctcccaggcatcttcacctcagtcatccgacgtggaagacgaggtagaagacgaaaggtacgacgaagaagaagaggccgaacgggataggttgaatataaagtccccattttcgctgagtcacgtgccccacggcaaaaagaaactccacggagagtataaaaat

SEQ ID NO: 13228 - DNA, 2109 bp, Artificial Sequence
  Description of Artificial Sequence: Synthetic coding sequence
atgttacggggacgctcactaagtgtcacctccctgggcggattgccccaatgggaagtggaggaactcccggtggaggagcttctcctgtttgaggtggcatgggaagtgacaaacaaggtaggcggtatatatacagtgatacaaacaaaggctaaaaccaccgcagacgagtggggtgagaattattttctcatcggcccttacttcgaacataatatgaagacacaggtcgagcagtgcgaacctgttaacgatgcagtcaggcgggccgtcgacgccatgaataaacacggttgccaggtgcatttcgggaggtggctgatcgaggggtcaccctacgtcgtcctatttgacatcggttatagcgcatggaacctagaccgctggaagggagacctgtgggaagcctgttccgtcggcatcccctatcacgatcgagaggctaatgacatgctgatttttgggtccctgacagcctggtttcttaaggaggtgacagaccatgccgacggaaagtacgtggtggcacaatttcacgagtggcaggctgggataggactcattctaagccgcgcgagaaagctcccaattgccaccatattcactacccatgccactctgctcggtcgctacctctgcgccgctaacatagacttctataatcaccttgataaattcaacattgataaggaagctggggaacgccagatctaccataggtactgcatggagagagcttccgtgcattgcgcgcacgtcttcactaccgttagcgaaatcacggcaatagaggccgagcacatgctgaagcgaaagcctgacgttgtgacacccaatggactgaacgtgaagaaatttagcgctgttcatgaattccagaacctccacgctatgtataaagcgcgaatccaggacttcgtgcgaggtcatttctacggacacctggatttcgatctggaaaaaacactgtttctgtttatcgcggggaggtacgaattctcgaacaagggcgctgacatcttccttgagagtttgtctaggttgaactttctgcttaggatgcataaatcagacatcaccgtcatggtattcttcattatgcccgccaagacgaacaactttaacgtggagaccctgaagggtcaggctgtgcggaagcagctgtgggatgtagcccactcagtcaaggaaaagtttgggaaaaagctgtacgacgcgctcctacgaggcgaaatccccgacctgaacgacattctggaccgcgacgatctaaccattatgaaacgtgccattttttccactcagagacagtccttgcctccggtcaccactcataacatgattgatgattccacagaccccatcctgagtaccatccggcgcatcggccttttcaacaataggactgaccgggtgaaggttattcttcacccagaattcctgagttccacaagccctctgttgccaatggattacgaagagttcgttcgaggatgccacttgggtgttttccctagttactatgagccttggggctacacacctgccgagtgcacggtgatgggaattccatccgttaccacaaatctcagcggctttgggtgcttcatgcaggaacatgtggcagaccccacagcctacgggatttacattgtcgaccggcgcttccggagccctgatgactcatgcaatcagctgacgaagttcctgtacggattctgcaagcaatcacgaaggcagcggattatccagagaaacaggactgagagacttagtgacctactcgattggcgctatctcgggagatactaccagcacgccaggcaccttacgcttagtcgcgcctttcccgacaagttccacgtcgaactgacctctccccctacaactgagggcttcaagtacccgcgcccatcatccgtgcccccgtctccgtccggcagtcaagcctcgtctccacaatctagtgatgtggaggacgaggtggaggatgaacgctatgatgaggaggaggaagcggagcgggacaggttgaatatcaagagccccttctcgctgtcgcatgttcctcatggaaaaaagaagctgcacggagagtacaagaat

SEQ ID NO: 13229 - DNA, 2109 bp, Artificial Sequence
  Description of Artificial Sequence: Synthetic coding sequence
atgttaaggggtagatccctgtctgttactagtttaggagggttgccccagtgggaggtagaggaactacctgtggaagaactgctattatttgaggttgcatgggaggtgacaaacaaggtaggcggcatatacacagttattcagactaaggctaagaccaccgcagatgaatggggagaaaactacttcttgataggcccatatttcgaacacaatatgaaaactcaggtggagcagtgcgagcctgtcaatgatgcagtgagaagggccgtggacgctatgaataagcacgggtgccaggtccactttggcagatggctgattgaaggaagcccttatgtggttctgttcgatatcgggtatagtgcctggaacctggaccgctggaagggggacttgtgggaagcatgctccgtgggaataccctaccatgatcgcgaggctaatgacatgctgatttttgggtcactgacagcctggtttctgaaagaagttaccgatcatgctgacggcaaatatgtggtggcccagttccatgagtggcaggccgggattggattaatcctgagccgggctagaaaattgcccattgcaacaatctttacaacacatgctacactactcgggcgctatctctgtgcagccaacatagatttttacaatcatctggataaatttaacattgacaaagaagccggagaacgtcagatctaccaccggtactgtatggagagagcctctgtccattgcgctcacgtttttaccaccgtcagcgagattactgccatcgaagcagagcatatgctaaaaaggaaaccagacgttgtcacccccaacgggctcaatgttaaaaagttctcagctgtgcacgagttccagaatctgcatgctatgtacaaagctcgcatccaggactttgtcaggggccacttctatgggcacttagacttcgatctggaaaagaccttatttctgttcatcgctggcagatacgaatttagcaacaaaggagccgatatcttcctggagtctctgtcccggctaaatttcctgctacgaatgcataaatcagatatcaccgtaatggtgttcttcatcatgcccgccaagacaaataacttcaatgttgagaccctgaagggccaagctgtcaggaagcagctgtgggacgttgctcatagcgtgaaagaaaagtttggcaagaagctgtatgatgctctgctgcggggcgaaattccagatctgaatgacatcctggacagagacgacctaacaataatgaaaagagctattttctccacccagcgccagtcccttccacccgtcacaacacacaacatgattgatgacagcactgaccccatactttctaccatcagaagaattggcctgtttaacaataggacagacagagtgaaggtcatcctgcatccggaattcctttcctccacctcccccttactgccaatggattatgaggaattcgtgcgaggctgccatttaggggtttttcccagttattatgagccctgggggtacaccccagccgaatgtaccgttatgggcattcctagtgttactaccaacctgtccggctttggctgcttcatgcaagagcacgtggctgatccaacagcctatggcatttacattgtggaccggcgattccggtcacctgatgacagctgtaatcagctgacaaaattcttgtatggattttgtaagcagtcccgcaggcagcgcatcatacagcgcaatcggactgagagactgtccgacctgttagattggcgctatctcggcaggtattaccagcacgctagacacctgacacttagcagagcctttcctgataagtttcatgtggaactgacctcccctcccacaaccgaggggttcaaatatcctagaccatctagcgtgcctccatctccatctgggtctcaggcctcctctccccagagtagtgacgtggaagatgaggttgaagacgaacgctacgatgaggaggaggaggctgagcgggacaggctgaatatcaagtctcccttcagcttgagtcacgtgcctcatggaaaaaaaaagctgcatggcgaatacaaaaat

SEQ ID NO: 13230 - DNA, 2109 bp, Artificial Sequence
  Description of Artificial Sequence: Synthetic coding sequence
atgcttagagggcgaagcctgagcgtgacgtcgctcgggggacttccgcagtgggaggtcgaagagcttccagtggaggaactgctccttttcgaggtggcttgggaagtgactaacaaggtgggcggaatttacaccgtcatacaaactaaagcaaaaacgaccgcagatgaatggggagaaaactactttcttattgggccatacttcgaacacaacatgaaaacgcaggtcgaacaatgtgagcccgtgaatgatgcggtgcgaagagcagtggatgcaatgaacaagcatggatgtcaagtgcatttcggtcggtggctgattgaaggctcaccatacgtcgtgctttttgatataggatatagcgcctggaatctcgatagatggaagggagatctttgggaagcatgttcggtgggtatcccttaccatgaccgggaggcaaacgatatgctgatatttggatcccttaccgcgtggttcctgaaggaggtgaccgatcatgcagacggtaaatacgtggtcgcgcagttccatgaatggcaggccggtattgggcttatccttagcagagcacggaaacttcctattgcaactatcttcactacccacgcaaccctgctcggtaggtacctctgcgcagccaacattgatttctataaccatctggacaaattcaacatcgataaagaagctggagaacgccagatttaccatcgctactgcatggagcgggcctccgtgcattgtgcccatgtctttactaccgtttcggaaataaccgcgatagaggcagaacacatgctgaagcggaagcctgacgtcgttacccccaacggtctgaacgtgaagaagttttccgccgttcacgaattccagaacctccacgcaatgtataaggcacgaattcaggatttcgtgcgaggccacttttacggccatcttgactttgaccttgaaaaaaccctttttctgtttatcgccgggcgctacgaattcagcaacaagggagcggacatttttcttgagtcattgagcagactgaacttccttctcagaatgcataagtcggatattacggtgatggtgttctttatcatgccagcaaagactaacaactttaacgtggagactctgaagggccaggcagttaggaagcagctttgggatgtggcacacagcgtgaaggaaaagtttgggaagaagctgtacgatgccctcctgagaggagaaatccccgatctcaatgatatactcgatcgcgatgacctcaccattatgaagagggcaatcttttcgacccaacgtcagagccttccacctgtcaccacccataacatgattgatgattcgaccgatcctattctttcaactattcgcagaattggtcttttcaacaataggaccgatagagtcaaggtgattctgcaccccgaattcctgtcatcgacgagccctctgcttccaatggactacgaagagttcgttcgtggctgccatcttggagtgtttccttcctactacgaaccttggggttatactcccgccgaatgtaccgtcatgggaattccaagcgttaccactaacctctccggttttggatgctttatgcaagaacatgtcgcagatccgactgcatacggaatttacattgtcgatcgcagatttcgctcgcccgatgattcgtgtaaccaacttaccaaattcttgtacgggttttgtaagcagtcacggcggcaacgtatcatccaacgtaatcgaaccgagcggctgagcgatctcctggattggcgttacttgggaagatactaccagcacgcacgacatctcactctgtcccgcgcatttccagacaaatttcacgtcgaactcacttcgcctccaactaccgaagggtttaagtaccctcgcccctcatcggtccctccttctccttccggatcccaggcatcgtcaccacaatcctccgatgtggaggacgaggtcgaggatgagaggtacgacgaagaagaagaagccgagagagatcgtcttaacattaagtcgccattctcgctttcgcacgtgccgcacggaaagaaaaaactccacggcgaatacaaaaat

SEQ ID NO: 13231 - DNA, 2109 bp, Artificial Sequence
  Description of Artificial Sequence: Synthetic coding sequence
atgctgagagggcggtcgctgtccgtcacttccctcggcggcctgccgcaatgggaagtagaggagctgcccgtggaagagcttttgctgtttgaagtggcatgggaagtcaccaataaggtgggtggaatctatactgtcatacagactaaggcaaagaccaccgcagatgagtggggcgaaaactatttccttatcggtccctactttgagcacaacatgaaaacgcaagtcgaacagtgtgaaccggtgaatgatgccgttcggagggcagtcgatgccatgaacaagcacggatgccaggtccattttggtaggtggcttatcgagggatcgccttacgtggtgctgtttgatattggctacagcgcctggaatctcgacagatggaagggagatctgtgggaagcgtgctctgtcggcataccataccatgatcgtgaggccaacgacatgctgatcttcgggtccctgactgcatggttcctgaaggaagtcaccgaccatgcagatggaaaatacgtcgtggcccagtttcatgaatggcaagccggaatcggactgattctttcacgcgcgcggaagctccctatcgcaaccatctttaccacgcatgcaactctgttgggtcgctacttgtgcgcagcgaacattgatttctacaatcatctcgacaagtttaacattgacaaagaagcaggcgaacgccaaatctatcataggtattgtatggaacgcgcttcagtgcactgtgcccatgtgttcaccacggtgtcggaaattaccgcaattgaagccgaacatatgctgaaaagaaaaccagatgtcgtgactcctaacggactgaacgtcaaaaagtttagcgcagtgcatgaattccagaatcttcacgcaatgtataaagcacggatccaagacttcgtcaggggacacttttacggacatcttgattttgaccttgaaaagacgctgtttcttttcattgcaggaagatacgagttcagcaataaaggggcggacattttccttgaatccctgagccggctgaattttctgcttagaatgcacaagtccgatatcaccgtgatggtgtttttcataatgcccgcaaagactaataacttcaatgtggaaaccctgaagggtcaggcagttcggaaacagctttgggatgtggctcattccgtgaaggagaagttcggtaaaaagctgtacgatgcactcctgcggggagagattcctgatcttaacgacatccttgatagagacgatttgaccatcatgaaaagagccattttctcgacccaaagacaatccctcccgcctgtgaccactcacaatatgatcgatgattcgactgaccctatcctgtcgacgatccgcaggattggccttttcaataacagaactgatagagtcaaggtcatactgcatccagaatttctctcctcgacctcgcctttgctgccgatggactacgaggaatttgtgcgagggtgccatctcggagtgtttcctagttactacgagccctggggatatacccctgcagaatgtactgttatggggattccatcggtgaccactaatctctcaggatttggatgttttatgcaagagcatgtggccgatcccaccgcatacggcatttacattgtcgatagaaggttcaggtccccggatgattcatgtaaccaactgactaagtttctttatggcttctgtaagcaatcaagaaggcagcgcataattcaacggaatagaaccgaacggctttcggacttgcttgattggagataccttggacggtactaccaacacgcacgccatcttacgctttcccgcgcatttccggacaagtttcatgtggagctgacttcacctccaactaccgagggatttaagtaccctcggccttcatcggtccctccatccccctcgggctcgcaggcctcatccccccagtcctcagacgtggaagatgaagtggaggacgagcgatacgacgaggaagaagaggcagaaagggatagacttaacataaagagccctttctcgctttcgcatgtcccacatggaaaaaagaaactgcatggcgaatacaagaat

SEQ ID NO: 13232 - DNA, 2109 bp, Artificial Sequence
  Description of Artificial Sequence: Synthetic coding sequence
atgctccgcggccggagcctttcggtgacttcgttgggtggactgccccagtgggaggtcgaggaactgcctgtggaagaactgttgctgttcgaggtggcttgggaggtgactaacaaggttggaggaatctacactgtgatccagaccaaagcgaagaccaccgcagacgagtggggcgaaaactacttcctgattggcccgtatttcgagcataacatgaaaacccaggtggaacaatgcgaacccgtcaacgatgcggtgagacgcgcagtcgacgcgatgaataagcacggatgtcaagtgcattttggacgctggctgatcgagggatcaccttacgtggtgctcttcgacatcggctactccgcgtggaacctcgaccggtggaagggcgacctgtgggaagcctgctcagtgggcattccttaccatgatagagaggctaacgacatgctgatcttcggctcgcttacggcctggtttcttaaagaagtgaccgatcacgccgatggcaagtacgtcgtcgcccagttccacgaatggcaagccggaatcggacttatcttgtcgcgggctcgcaaactgccaatcgcaacgatatttaccacccatgccactctccttggtcgctacctctgcgcggcgaacatcgatttttacaaccatctcgataaattcaatatcgacaaagaggcgggcgagcggcagatctaccatcgctactgcatggagagagcatcggtccactgcgcccacgtcttcacgactgtgagcgaaattacggctatcgaggcagaacacatgctgaagaggaagcccgacgtggtgacccctaacggactgaatgtgaaaaagttctcggcggtgcacgaatttcagaatctgcatgcaatgtacaaggccagaatccaagatttcgtcagagggcatttttacggacacctcgacttcgacctggagaaaaccctcttcctcttcatcgcaggtcgctatgagttttctaacaagggagcggatatcttccttgaaagcctgagccgattgaacttcctgctgaggatgcataaaagcgatatcactgtgatggtgttcttcatcatgccagctaaaactaataactttaatgtggaaaccctgaaaggacaagccgtgcggaagcagctgtgggatgtggcacactctgttaaagaaaaattcggtaagaaactgtatgacgcactccttcggggagagattccagacctgaacgacatcttggaccgggacgacctgaccatcatgaagcgcgcaattttcagcacccagcggcagtcgctgccgccggtgacgacccacaacatgatagacgactcaaccgatcctatcctgtcgaccattcggaggatcggactgtttaacaatagaactgacagggtgaaggtcatcctccatccagaattcttgagcagcacttcgccgctcctgccaatggactacgaggaatttgtccgcggctgccatctcggggtgttcccgagctactacgaaccgtggggatacaccccggcagagtgcacggtgatggggatcccgtcagtgactactaacctttcaggattcggatgtttcatgcaggaacatgtggcggatcctactgcatatggcatctacatcgtggaccggagattccgctcaccggacgactcgtgcaaccagcttaccaagtttctgtacggtttttgcaagcagtcgcggcggcaacgtattatccagcgcaaccgaaccgaacgcttgtcggacctcctggactggcgctacctgggccgctactaccagcatgcgagacacctgactttgtcaagagcatttcccgacaaattccacgtcgaacttactagcccgcctaccacggagggatttaagtacccgcgcccttcatcggtgccgccgtccccatccgggtcacaagcctcgagcccgcaatccagcgatgtggaagatgaagtcgaagacgagcgctacgacgaagaagaagaggcggaaagagatcgactcaacatcaaatcgccgttctccctttcccacgtgccccatggcaagaagaaactgcatggtgaatacaaaaac

SEQ ID NO: 13233 - DNA, 2109 bp, Artificial Sequence
  Description of Artificial Sequence: Synthetic coding sequence
atgttgcggggacgcagcctctccgtcacaagtctgggaggacttccacaatgggaagtggaagaactgcctgtggaggaactccttctgttcgaggttgcgtgggaagtcacgaacaaggtcggcggcatctacacggttattcagaccaaggcgaagactacagcagatgaatggggcgagaattacttcctaattggcccctactttgaacacaacatgaaaacccaagtcgagcagtgtgaacccgtcaacgacgcagttcggcgggcagtggacgcaatgaacaaacatgggtgtcaggttcatttcgggaggtggctgatcgaggggtcaccatatgtggtgctttttgatataggctacagcgcctggaatcttgatcgatggaagggagatttgtgggaagcctgctccgtaggtattccctatcatgatcgcgaagccaacgacatgctcatttttggttctctgaccgcctggttcctcaaggaagtcacagaccacgctgacgggaagtatgtggtcgctcagttccatgagtggcaggccggcatagggctcatactgtcacgcgctagaaaactgcccatcgccacgatatttactactcacgcgactctcctaggacggtacctttgtgctgctaatatcgacttctataatcatctagacaagttcaacatagataaagaagccggagagcgacaaatctatcatcggtactgcatggaacgagccagcgtgcactgtgcgcatgtgttcaccactgtgtcagagattacggccatagaggcagagcatatgctaaagaggaaaccagacgtggtaaccccaaacggactaaatgtcaagaagttctccgctgtacacgaatttcagaatctgcacgctatgtataaggcgaggatccaagactttgtccgggggcacttctacggccacctagatttcgacctcgagaagaccctcttcctgttcatcgctggcaggtacgaattcagcaataagggtgcggatatctttctggagagtcttagtcgcttaaacttcctcctccgcatgcacaagtccgacattacagtgatggtgttctttatcatgcctgccaagactaacaacttcaacgtcgaaaccctgaagggccaggcagtgcgaaaacagctttgggacgtagcgcacagcgtgaaagagaaattcggcaagaagctgtacgacgccctgctgcgaggggaaataccggatttgaacgacatcctggatcgggacgacctgacgattatgaagcgcgcaatcttcagcacgcagcgtcagtcgctaccacccgtcaccacccacaacatgatagacgacagcaccgaccctatcctgagcaccattcggagaattggactatttaacaacagaaccgatcgggttaaagtgatcctgcatcccgagttcctttcctctacgagcccactgttacccatggactacgaagaatttgtgcgggggtgccacttaggcgtgttcccgtcctattacgagccttgggggtatacgcccgccgaatgcaccgtgatggggataccttcggtgaccaccaacctttcgggttttgggtgcttcatgcaggagcatgttgctgatcctactgcctacggaatatatatcgtggaccggaggttccgctcaccagacgatagttgcaatcagctcaccaaatttttatacggattttgtaagcagtcccgaaggcagagaatcatacagcgtaaccgaaccgaacgcctatctgacctcctggattggcggtacctggggagatactatcagcacgctagacatcttactctttctagggccttcccagacaaattccacgtcgaattaaccagtcccccaactaccgagggcttcaagtatcctaggccgagctctgtgcccccaagcccttctggctcccaggcctccagtcctcagtcttctgacgtcgaagatgaggtggaggatgagaggtatgatgaggaagaagaggccgagagagatcgcctgaatattaagagccctttctccctcagccatgtgccccatggtaagaagaagctccacggtgaatacaagaat

SEQ ID NO: 13234 - DNA, 2109 bp, Artificial Sequence
  Description of Artificial Sequence: Synthetic coding sequence
atgttacgtggtcgttcgctatcggtaacgtcgttaggtggtttaccgcaatgggaagtagaagaactaccggttgaagaattattattatttgaagtagcgtgggaagtaacgaataaagttggtggtatatatacggttatacaaacgaaagcgaaaacgacggcggatgaatggggtgaaaattattttctaataggtccgtattttgaacataatatgaaaacgcaagttgaacaatgtgaaccggtaaatgatgcggtacgtcgagcggtagatgcgatgaataaacatggttgtcaagttcattttggtcgttggttaatagaaggttcgccgtatgttgtattatttgatataggttattcggcgtggaatctagatcgttggaaaggtgatttatgggaagcgtgttcggtaggtataccgtatcatgatcgtgaagcgaatgatatgttaatatttggttcgctaacggcgtggtttttaaaagaagtaacggatcatgcggatggtaaatatgtagttgcgcaatttcatgaatggcaagcgggtataggtctaatactatcgcgagcgcgaaaactaccgatagcgacgatatttacgacgcatgcgacgctactaggtcgatatttatgtgcggcgaatatagatttttataatcatttagataaatttaatatagataaagaagcgggtgaacgtcaaatatatcatcgttattgtatggaacgtgcgtcggtacattgtgcgcatgtttttacgacggtttcggaaataacggcgatagaagcggaacatatgctaaaacgtaaaccggatgttgtaacgccgaatggtctaaatgtaaaaaaattttcggcggtacatgaatttcaaaatttacatgcgatgtataaagcgcgaatacaagattttgtacgtggtcatttttatggtcatttagattttgatttagaaaaaacgctatttctatttatagcgggtcgttatgaattttcgaataaaggtgcggatatatttttagaatcgttatcgcgtttaaattttctattacgtatgcataaatcggatataacggtaatggttttttttataatgccggcgaaaacgaataattttaatgttgaaacgctaaaaggtcaagcggtacgtaaacaactatgggatgttgcgcattcggttaaagaaaaatttggtaaaaaattatatgatgcgctactacgtggtgaaataccggatctaaatgatatactagatcgtgatgatttaacgataatgaaacgtgcgatattttcgacgcaacgtcaatcgttaccgccggttacgacgcataatatgatagatgattcgacggatccgatactatcgacgatacgacgaataggtctatttaataatcgtacggatcgagttaaagtaatactacatccggaatttctatcgtcgacgtcgccgttattaccgatggattatgaagaatttgtacgaggttgtcatctaggtgtttttccgtcgtattatgaaccgtggggttatacgccggcggaatgtacggttatgggtataccgtcggtaacgacgaatttatcgggttttggttgttttatgcaagaacatgtagcggatccgacggcgtatggtatatatatagtagatcgtcgttttcgttcgccggatgattcgtgtaatcaactaacgaaatttttatatggtttttgtaaacaatcgcgacgacaacgtataatacaacgtaatcgaacggaacgtttatcggatctattagattggcgttatttaggtcgttattatcaacatgcgcgacatctaacgttatcgcgagcgtttccggataaatttcatgtagaattaacgtcgccgccgacgacggaaggttttaaatatccgcgtccgtcgtcggtaccgccgtcgccgtcgggttcgcaagcgtcgtcgccgcaatcgtcggatgttgaagatgaagtagaagatgaacgttatgatgaagaagaagaagcggaacgtgatcgtttaaatataaaatcgccgttttcgctatcgcatgtaccgcatggtaaaaaaaaactacatggtgaatataaaaat

SEQ ID NO: 13235 - DNA, 2109 bp, Artificial Sequence
  Description of Artificial Sequence: Synthetic coding sequence
atgctgagaggacgctccctctcagttactagcctggggggactgccacaatgggaggtggaagaactcccagtggaggagctgctgctgttcgaagtggcctgggaggtgacgaacaaagttggagggatttacaccgtgatccagactaaggccaagaccaccgccgacgagtggggcgaaaactacttccttatcggaccatactttgagcataacatgaaaacccaggtcgagcaatgcgaaccggtgaacgatgcggtgagacgcgctgtggacgccatgaacaagcacggatgccaagtgcatttcggccgttggctgatcgaaggatcgccgtacgtggtgctctttgatatcggatactctgcctggaacctggaccgctggaaaggggatctgtgggaggcttgctcggtggggatcccataccacgacagagaggccaatgatatgctgattttcggctcgcttactgcctggttcctgaaagaagtgactgaccacgcagacggcaagtacgtggtggcccaattccatgaatggcaggcgggtatcggcctcatcttgagccgcgcccgcaagctcccgatcgctaccatctttaccactcacgcgaccctgctgggaagatacctctgcgcggcgaatattgacttctacaatcatctggacaagttcaatattgacaaggaagccggagagagacagatctaccaccggtactgtatggagagagcgtccgtccactgcgcacacgtgttcactactgtgtcagaaataaccgctatcgaagccgagcacatgctgaagagaaagcctgacgtggtgactccgaacggacttaatgtgaagaagttttccgccgtgcacgaattccagaatctgcacgccatgtataaagcacgaatccaagacttcgtgcggggacatttctacggccacctggattttgaccttgagaaaactctcttcctgtttatcgccggacgctacgagttctccaacaagggggcggacattttcctggagtccctgtcgcgcctgaattttctgttgcggatgcacaaaagcgacataaccgtcatggtgttctttatcatgccggctaagactaacaatttcaacgtggaaaccctgaagggacaagcagtgcggaagcagctgtgggacgtggcccatagcgtcaaggagaagttcggaaagaaactttacgacgcactgctgcgcggagaaatcccggacctgaatgatatccttgaccgggatgacctgaccatcatgaagagggccatcttctcaactcagcggcagtcgctcccgccggtgactacgcacaatatgatcgacgactcaacggatccaattctttctaccatcagaaggatcggcctgtttaacaatcggaccgacagagttaaagtcatcctgcacccggagttcctgtcgtcgacttccccacttctgccaatggactacgaagagttcgtccgcggatgccaccttggggtttttcccagctactacgaaccgtggggttacacccctgccgagtgcacggtgatgggaatcccctctgtgactactaacctgtcgggattcggatgttttatgcaagagcacgtggccgatccgactgcgtacggcatctacattgtcgatcgcagattccgctctccggacgacagctgtaaccagctcaccaaattcttgtacggtttttgcaaacaatcgagacgccagaggatcattcagaggaaccggaccgaaaggttgtccgatttgctggactggcgctacctgggcagatactaccagcacgcgcgccacctgactttgtctcgcgcattccccgacaagttccatgtcgagctcactagcccgcctaccaccgagggcttcaagtacccacgcccgtcaagcgtgccgccttcgccatcaggttcccaggcctcgtcacctcaatcctccgacgtggaggacgaagtggaagatgaaaggtatgatgaggaagaggaagcggagcgcgatcggttgaacatcaaatcgccgtttagcctgtcccatgtgccgcacggcaagaagaagctgcacggagaatacaagaac

SEQ ID NO: 13236 - DNA, 2109 bp, Artificial Sequence
  Description of Artificial Sequence: Synthetic coding sequence
atgttgagaggtcggtctctgtcggtgacttctcttggagggttgccgcagtgggaagtggaggagctgccagtcgaagaactgctgctgtttgaagtggcctgggaggtcactaataaggttggtggcatttacacagtcatccagacgaaagccaagaccacagccgacgagtggggggagaattactttctgattgggccatactttgagcacaatatgaaaacccaggtcgaacagtgcgagccggttaacgacgcggtccgcagggcggtggacgccatgaacaagcacgggtgtcaagtgcacttcggacggtggctgatcgagggctccccctacgtggttctgtttgacattggctacagcgcctggaatctcgacagatggaagggggacctgtgggaagcctgctccgttggtatcccataccatgaccgcgaagctaatgacatgctcatctttggcagcctcacagcctggtttctgaaggaagttactgatcacgctgacggcaagtatgtggttgcacaatttcacgagtggcaggccggaattggcttgatcttgtcccgggcccgtaaacttcccatcgctacgatctttacaacccatgctactctgctcggacgctatctgtgcgctgctaatattgatttctataaccatctcgacaagtttaacatagacaaggaggccggagagagacagatctaccatcgatactgtatggaacgagcgtctgtacactgtgcacacgtcttcacaaccgtctccgagatcacagcaattgaggctgaacatatgcttaagcgcaagcctgatgttgtcacacctaacggcctcaacgtgaagaaatttagcgccgtgcacgaattccagaacttacacgctatgtacaaagcacgtatacaggatttcgtccgtggtcatttctatggacatcttgactttgacttagagaaaaccttattcctcttcatagcgggccgttatgagttcagtaataagggcgccgatatcttcctggagtctctgagtaggctgaacttcctattgagaatgcacaagagtgacataaccgtcatggtgttcttcataatgccagctaagacaaacaattttaatgtggagactctgaagggccaggctgttcgaaaacagttgtgggacgttgctcactctgtgaaggaaaaatttgggaagaaactctacgacgccctgctccggggggaaataccggatctgaacgatatactagaccgggacgatctgactatcatgaaacgggccattttcagcacgcagcgacaaagccttcctccagtaacaacacacaatatgatcgatgactccacagatcccatcctcagtacgattcggcggataggcttgttcaacaataggaccgatcgtgttaaagttatcctccacccagagtttctatcttcaaccagccccttgctgccgatggactacgaggagttcgtacgcgggtgccatctgggcgtgtttccgtcatactacgagccatgggggtacacccctgctgaatgtaccgtgatgggcatcccaagtgtgactacgaacctgtcgggttttggttgctttatgcaagaacacgttgccgaccctactgcctacggcatctatatcgtggataggagattccgttctcccgatgactcatgcaaccagctgaccaaattcctttacggcttttgcaaacagagccggcggcagcgaataattcagagaaatcgaacagagagattgtctgatctcctggattggagatatctgggcagatattaccagcacgcacgccacctgacactcagccgtgccttcccagataagtttcacgtagagcttacatcgcctcctactactgaggggttcaaatacccgaggccaagcagcgtgcccccatccccctctggaagccaggcctcatccccccagtcctccgacgtagaagatgaggtggaggatgaaagatacgatgaggaggaagaggccgagcgagacaggctgaacatcaagtcacctttctccctaagccacgtaccccatgggaaaaaaaaactgcacggggaatacaaaaat

SEQ ID NO: 13237 - DNA, 2109 bp, Artificial Sequence; identical to SEQ ID NO: 13175
  Description of Artificial Sequence: Synthetic coding sequence

SEQ ID NO: 13238 - DNA, 2109 bp, Artificial Sequence
  Description of Artificial Sequence: Synthetic coding sequence
atgctccgggggcgtagcctcagcgtcacgtcgctcggaggcctcccacaatgggaagtcgaggaactgccagtggaagaactgctgctcttcgaagtggcgtgggaggtgaccaacaaagtcggagggatttacaccgtgatccaaaccaaggccaaaactacggccgacgagtggggagagaactacttcttgatcggaccgtactttgaacacaatatgaaaacgcaagtcgagcagtgtgaaccggtgaacgatgcagtgcggagagccgtggacgcgatgaataagcatgggtgtcaggttcacttcggcaggtggctgatcgagggatctccgtatgtcgtgctgttcgacatcggttacagcgcgtggaatctcgaccggtggaaaggtgacctctgggaggcgtgctccgtgggaatcccttaccacgaccgcgaggcaaatgatatgctcatcttcggatcccttaccgcctggttcctcaaagaagtgacggaccatgctgacggaaaatacgtcgtggcccaattccatgaatggcaggccgggatcggcctgattctgtcaagagcgcgcaagctgccgatcgcgacgatcttcactactcacgccactttgctcggtcgatacctgtgtgccgctaatatcgatttctacaatcatctcgacaagtttaacatcgataaggaggccggagagcggcagatttaccatcggtactgcatggagcgggcgagcgtgcattgcgcccatgtgttcactaccgtgtccgagatcactgcaatcgaggcggaacacatgctcaagcgcaagccggacgttgtgactccaaacggcctgaatgtgaagaagttctccgcggtgcatgaattccagaacctgcacgcgatgtacaaggcgcggatccaagacttcgtccgcggccacttttacggacacctggacttcgatctggaaaagactctgttcctgttcatcgcgggacgatatgagttctcaaataagggcgctgacatcttcctcgagtctctctccagactgaatttcctgctgcggatgcacaagtccgacattaccgtgatggtctttttcatcatgcctgcgaaaaccaacaacttcaatgtggaaactctgaagggccaggccgtgaggaaacagctttgggacgtcgcgcattcggtaaaggaaaagttcgggaagaaattgtatgatgcgctcctccgcggagagattcccgatctgaacgatatcctcgacagagatgacctcaccatcatgaagcgcgcgatcttctcaactcaaaggcagtcactgccgccagtgactacccacaatatgatcgatgactccaccgaccctatcctgtcgactattagacggattggcctgttcaacaacagaactgaccgcgttaaggtgatcctgcatccagagtttctgtcatcaactagccctctgcttccgatggactacgaggagttcgtccggggctgtcatcttggagtgtttccgtcttactacgagccgtggggatacactccagccgaatgcactgtgatgggaatcccatcggtgactactaacctgtcgggattcggatgcttcatgcaggaacacgtggccgatccgactgcgtacgggatatacatcgtggatcggcggttccgctccccggacgactcctgcaaccagctcacgaaattcctgtacggattctgcaagcagtcgaggcgccaacgcatcatccagcggaatcgaaccgagaggctctccgacctgctggattggcggtacctgggacggtactaccagcacgcccggcacctcactctgtccagagcattcccagacaagttccacgtcgaattgaccagcccgccaactaccgaaggcttcaagtaccctcgcccatccagcgtccctccatccccctccggctcccaagcatcgagtcctcaatcaagcgatgtcgaggatgaagtcgaggatgagcgctacgatgaggaagaagaagccgagagagatcgcctcaacatcaaatcgccgttctcgctgtcccatgtgccgcatggaaagaaaaaactccatggagagtacaagaac

SEQ ID NO: 13239 - DNA, 2109 bp, Artificial Sequence
  Description of Artificial Sequence: Synthetic coding sequence
atgcttagaggccgcagcctcagcgtcaccagcctgggaggactgccacaatgggaggtggaggagctccccgtggaagagctgttgctgttcgaagttgcttgggaagtcaccaacaaggttggcggtatttacacagtgattcagaccaaagctaagaccaccgcggatgagtggggtgaaaattattttcttatcggtccctacttcgagcacaacatgaagacccaggttgaacaatgtgaacctgtcaacgatgcagtcaggagggccgtcgatgctatgaacaagcacggatgtcaggtgcattttggaaggtggcttatagaaggctctccttacgtcgttttattcgacatcggatactcagcctggaaccttgacaggtggaagggcgacctctgggaggcttgcagcgtgggcatcccataccacgatcgcgaagctaatgatatgttgattttcgggagccttacagcttggtttttaaaagaggtgacagatcatgccgatgggaaatatgtggttgcacaattccacgaatggcaggccggcatcggactgatcctgagtcgtgcacgcaaactgccgatcgccactatttttactacacatgccacgttgctgggcaggtacctgtgcgcggcaaatatcgacttttacaaccatctggacaaattcaacatagacaaagaggccggcgagagacagatctatcaccggtattgcatggagagggcctcggtgcactgtgcacatgtctttaccaccgtatctgagatcaccgcaatcgaggccgaacacatgcttaagcggaaaccagatgtcgtgacacctaacggcctgaacgtcaagaagttcagcgcggtgcatgagtttcagaacctgcatgcaatgtacaaagcaagaattcaggacttcgttagaggtcatttttatggtcatttggattttgatctggagaaaacccttttcctttttatcgcgggaaggtacgagttctccaacaagggggccgatatctttctagagagtctcagcaggctgaattttttgttgcgtatgcataaaagcgatattacggtgatggtatttttcattatgcccgctaaaaccaacaactttaacgtagaaaccctgaaggggcaagcggtgaggaaacagttgtgggacgtcgcccatagcgttaaagagaaattcgggaagaagctgtacgatgccctcctgcgaggtgagatccccgacctcaacgacatcctggacagggatgacctgacgatcatgaagagagctatcttctctacccaaaggcagagtctcccccctgtgaccactcacaatatgatcgacgatagcacagacccaatactctctaccatcaggaggatcggattgttcaataacaggaccgacagggtcaaagtgatcctccaccctgagttcctcagctcaacctcaccactgctgcctatggactatgaggaattcgtgaggggatgccacctgggggtgtttccttcttactacgagccatggggctacactcctgcagaatgcaccgtgatgggcattccaagcgtgaccacaaacctgagcggttttggttgcttcatgcaggaacacgttgccgaccccacagcttacggaatctacatcgttgataggagattcagatcacccgatgactcctgcaaccaactgaccaaattcctgtacggcttctgcaaacaatctcgccggcaacgcatcattcaaagaaatcgtactgagcgcctctcagacctcctggattggaggtacctgggcagatactaccagcatgctcgtcacctcaccctgagccgtgcatttccggacaagtttcatgttgaacttacttctcctcctaccacagaagggtttaaataccctcggccctccagtgtgcccccgtctccgagcggctcccaagccagttctcctcaaagctctgacgttgaggacgaggtagaagacgagagatatgacgaagaagaagaagcagaaagagatagacttaacatcaagtctcccttctccctgagccacgtgccacatgggaaaaaaaagctgcacggggagtacaagaac

SEQ ID NO: 13240 - DNA, 2109 bp, Artificial Sequence
  Description of Artificial Sequence: Synthetic coding sequence
atgttacgcggtcgatcactgtcagtgacttctctcggggggctgccccagtgggaggtggaggaacttccagtggaggagctattgctgttcgaagttgcatgggaggtcacaaataaagtcgggggaatttacaccgttatccagacaaaggctaaaacaactgctgatgaatggggggagaattatttcctaattggcccttacttcgaacacaatatgaaaacccaagttgaacagtgtgagccagtgaatgatgctgtgcgccgggccgtagatgccatgaataaacacgggtgccaagtgcactttgggagatggctgatagagggaagcccttatgtggtactctttgacatagggtattccgcctggaacttggacaggtggaagggggatctgtgggaggcgtgcagcgtggggatcccctatcacgatcgcgaagctaacgacatgctaatatttggcagcctaactgcctggttcttgaaggaggtgaccgatcatgctgatgggaaatatgtggtagcccaattccatgagtggcaggccgggatcgggctcattctgagccgagctagaaaattgccaatcgcgaccatattcaccacccacgctacgctgctcgggagatacctgtgcgcagccaatattgacttttacaaccatcttgacaagttcaacattgacaaagaggccggcgaacgacagatttaccacaggtattgtatggagcgggcatcagtccactgcgcccatgtgttcactacggtgtccgagataacagccattgaggctgaacatatgcttaaaagaaagccagacgtggtgacacctaacggcctgaacgttaaaaaattttccgcagtccacgaatttcaaaatctgcatgctatgtacaaggcccggattcaggattttgttagaggtcacttctacggccatctggactttgaccttgagaagaccctgttcctctttatcgccggtaggtatgaattttctaataaaggcgcggatatcttcctggaaagtttgagccggttaaattttctgctgaggatgcacaagtctgacatcacggtgatggtgttctttatcatgccagccaaaaccaacaactttaacgtcgaaacattaaagggccaggccgttaggaaacagctctgggacgtggcacattctgtcaaggagaaattcggtaaaaaactttatgacgctctgctgcgaggtgagatcccggatctcaacgacattcttgatcgggatgatctcaccatcatgaaaagagccatcttctccactcagcggcaaagtttgccacccgtaaccacacacaatatgatcgatgatagcacagatcctatcctaagcaccatccgccgcattggtctgtttaataatagaactgatagggtgaaagtgatcttgcatccagaatttttgtcgagtactagtcccttgcttcccatggattacgaggagtttgtgcggggatgccacctgggtgtcttcccaagttactacgaaccatggggttatacaccagccgaatgtacagtgatgggtataccctcagtcactaccaatttatctggcttcggatgctttatgcaggagcacgtggcggacccaaccgcctacggaatctatatcgtggatcgccgcttcaggtctccagatgacagctgcaaccagctgaccaagttcctttacgggttctgtaaacaatctcgccgccaaagaataatccaaagaaacaggaccgagagactgtctgacctactcgactggagatacctggggcgctactatcagcacgcccgacatctgactctgtcccgggctttccccgacaaattccacgtcgaactgacttcccccccaaccaccgagggctttaagtatccaaggccctcatctgtgcccccatcacccagtggctctcaggcttcatcgcctcagagtagcgatgtggaggatgaggttgaggacgagagatatgacgaagaagaggaagccgagcgcgatcggcttaatatcaaatctcccttttcccttagccacgtgccacacggcaaaaagaaactgcacggggagtacaagaac

SEQ ID NO: 13241 - DNA, 2109 bp, Artificial Sequence
  Description of Artificial Sequence: Synthetic coding sequence
atgttgcgtggaagatcattgtccgttacatcattgggtggactaccacagtgggaggtcgaagaactgccagttgaggagctactgctttttgaggttgcatgggaagtgaccaataaggtcggcggcatttataccgtcatccaaactaaggcaaagactaccgccgacgaatggggcgagaattatttcctgattggaccatacttcgaacacaatatgaaaacacaggtagagcaatgcgaacctgtgaatgatgctgtcagacgagctgtagacgccatgaacaaacatggctgtcaggttcatttcggaagatggctgattgaaggctcaccgtacgtcgtgttatttgatataggatatagcgcttggaacctggaccggtggaaaggggatttatgggaggcttgttcagtcgggatcccgtaccacgaccgggaggcaaacgacatgctgatcttcggatcactaactgcttggttcctgaaggaggttactgatcacgccgacggtaagtacgtggtcgcacagttccacgagtggcaggcaggtattgggctcattttgtctagggctaggaaactgccaatagctaccatttttactacccacgcaactctcctcggccggtatctttgcgctgcgaacatagacttctacaaccacctagataaattcaacatcgacaaggaggcgggcgaacgtcagatctaccatagatattgtatggaaagagcaagtgtgcactgtgcccatgtgtttactacagtctcggaaatcaccgccatcgaagcagaacacatgcttaagcgcaagcctgatgttgtaactcctaatggcttgaacgtaaagaaattctcagccgttcacgagtttcagaacctccacgcaatgtataaggcgaggattcaggattttgtccgagggcacttctacggccacttggactttgacctggagaagactctctttctcttcatcgccggtaggtatgaattcagcaataaaggggctgacatcttcctggagtccctctctagactgaacttcttgttgagaatgcacaagagcgacataacagtcatggtgtttttcatcatgccagccaagactaataacttcaatgttgagacactgaagggacaagccgtgcgtaagcagctctgggacgtggctcattctgtcaaggagaagtttggcaagaagttgtacgacgctctgctccgcggagagattccggatctgaatgatattctcgatcgggacgatctcaccataatgaagcgggctatctttagcacccagcggcagagcctgcctccagtaaccactcataatatgatcgatgactcgaccgatcccattctttcaaccattcgacgtattggactgttcaataatcgcacagacagggtgaaagtcatcctccaccccgagtttctgtcatcgacatctcccctgctgccaatggattacgaggagttcgtgagagggtgccacctgggagtttttccttcgtattacgaaccctggggatatacccccgctgaatgcaccgtaatgggaatcccatccgtcacaaccaacctctcaggatttggatgctttatgcaggagcacgtggctgaccccacggcttacggcatatatatcgtcgaccggcggtttagatcacccgacgactcatgtaaccaactgactaaattcctgtacggcttctgcaagcagagtaggcgtcagcggattattcaaagaaaccggacggagcggctttccgatctgctcgactggcgctacttaggacggtactatcagcatgcgaggcatttgacactgagtagagccttccccgacaaatttcacgtcgaattgacgagtccgccaacaactgagggattcaagtaccctcgccccagcagcgtgcccccctcaccgagcggtagccaggcctccagcccacagtcttcggacgtggaggatgaagtggaagatgaaaggtatgatgaagaggaagaggctgagagagataggttgaacataaagagtcccttcagcctgtcacacgtgccccacgggaagaagaaactccatggtgagtacaagaat

SEQ ID NO: 13242 - DNA, 2109 bp, Artificial Sequence
  Description of Artificial Sequence: Synthetic coding sequence
atgcttagaggtcgatcactctcagtcacctcacttggcggactccctcagtgggaagttgaagagctgcccgtcgaagagcttttgctctttgaagtcgcctgggaggtcactaataaggtcggcgggatttacaccgtgattcagaccaaggcgaaaactactgcagacgagtggggagagaattacttcctgattggcccatactttgagcacaacatgaaaacccaggtggaacaatgcgaaccggtcaacgatgcagtccggcgcgctgtggacgcgatgaataagcacgggtgtcaagtgcacttcggaaggtggctgattgagggctcaccttacgtggtgctttttgacattgggtactcggcatggaacctggatagatggaagggagatctttgggaagcctgttccgtgggaattccttatcacgaccgggaagcaaacgacatgctgattttcggatccctcaccgcctggttcctgaaagaggtcacggatcatgccgatggaaagtacgtggtggcccagtttcatgaatggcaggccgggataggacttatcctgtcccgggcaagaaaacttcctattgcgaccattttcaccacccacgcaactctgctcggccggtacctgtgtgcagcaaacattgacttttacaatcacctggataagtttaacatcgacaaggaggcaggtgagcgtcaaatctaccatagatactgcatggaacgcgcatcagtgcattgtgcacacgtgtttacgactgtgtcggaaattaccgcgattgaagccgagcatatgctgaagcgcaagccagatgtcgtgaccccgaatggtcttaatgtgaaaaagttctcggcagtccatgaattccaaaaccttcatgcaatgtacaaggcaagaatccaagactttgtgcgcggacacttttatggacatctggattttgatctcgaaaagaccctgtttctgtttattgccggtagatacgaattttcaaacaaaggtgcggacatttttctggaaagcctgtcacgtctgaactttctgctgagaatgcacaagagcgatattacggtcatggtgttctttatcatgcctgccaagaccaacaactttaatgtggaaaccctgaagggacaagctgtccggaagcaactgtgggatgtggcacattcggtgaaggaaaagtttggtaagaagctgtacgatgcacttctcaggggagaaattcctgatctgaacgacattctcgatagagacgacctcactattatgaaaagagctattttctcaacgcaacggcagtccctgcctcccgtgactactcataacatgattgatgactccaccgatcctattttgtccactattcgtagaatcggccttttcaataaccggaccgacagagtcaaagtgatccttcatccggaattcctgtcctcgacctcgccccttctcccaatggactacgaagagttcgtgaggggttgtcacctgggcgtgttccctagctactacgaaccatggggttacactcctgccgaatgcacggtgatgggcataccttcagtcaccactaatctgtcgggattcggttgttttatgcaggaacacgtcgcagatccaactgcgtacggtatatacatcgtggacagacggtttcgatcccctgatgattcgtgcaatcaactgaccaagttcctttacggattctgcaaacagtcaagacggcagcgcatcatccagagaaaccgtaccgaacgactcagcgacctgctcgactggcggtacctgggaagatactaccagcacgcacggcacctcactctgtcaagggcatttccagataagtttcacgtggaattgacctcgccaccaactaccgaagggtttaagtacccacgtccgagctcagtgcctccttccccctcgggaagccaggcctcgtctccgcaatcctccgacgtcgaagatgaggtggaagatgaaaggtacgatgaagaagaagaagcagaacgtgaccgcttgaacattaagtcgcctttctcgctttcgcatgtcccacacggtaagaagaagttgcatggcgaatacaagaat

SEQ ID NO: 13243 - DNA, 348 bp, Artificial Sequence
  Description of Artificial Sequence: Synthetic coding sequence
atggactactaccggaagtacgcggcaatctttcttgtgactctttcagtctttctccatgtgctccattccgccccagatgtgcaggattgtccagaatgtactcttcaagagaacccattcttttcacagccaggcgcacctattcttcaatgcatgggatgttgtttttcacgtgcctaccccacgcctctgcgcagcaaaaagactatgctggtgcaaaagaacgtcacctcggaatctacttgttgtgttgcgaaatcatacaacagggtgactgtgatgggcggattcaaagtggagaatcacactgcttgccattgttctacctgctactaccacaagtcc

SEQ ID NO: 13244 - DNA, 348 bp, Artificial Sequence
  Description of Artificial Sequence: Synthetic coding sequence
atggattactacagaaagtacgccgccatctttctcgtgacgctgtccgtcttcctacatgtactgcattccgcacccgacgtgcaagattgccctgagtgcacgctgcaggaaaatcccttctttagtcagccgggagcccctatactgcaatgtatgggatgctgtttctctcgcgcctatccgaccccactaaggtctaagaagaccatgctggtgcagaagaacgtcacctcagaaagcacctgctgcgtcgccaaaagctataatcgggttaccgtgatgggtggttttaaggtggagaatcacaccgcctgccactgttccacctgttactaccataagtct

SEQ ID NO: 13245 - DNA, 348 bp, Artificial Sequence
  Description of Artificial Sequence: Synthetic coding sequence
atggactattatcgaaaatatgcggcaatatttctggttaccttatctgttttcctgcacgtactgcatagtgccccggacgtgcaagattgtccagaatgtacactgcaggagaatccatttttttctcaacccggtgctcccatcctccagtgtatggggtgttgcttttctcgtgcttacccgaccccacttagaagtaagaagactatgcttgtgcaaaagaatgtgactagcgagtcaacctgctgcgtggcaaagagctacaatcgagtgacagtgatgggcgggtttaaggtggaaaatcacactgcttgccattgttccacatgttactatcataagtcg

SEQ ID NO: 13246 - DNA, 348 bp, Artificial Sequence
  Description of Artificial Sequence: Synthetic coding sequence
atggattactaccggaagtatgctgcgatcttcctcgtgaccctgagcgtgttcctccacgtgcttcacagcgccccagacgtgcaagactgccctgaatgcaccctccaagaaaacccgttcttctcgcagcctggagcaccaattctgcaatgtatgggatgctgcttctccagagcctaccccaccccactgcggtcaaaaaagacgatgctggtgcagaaaaacgtcacttcggaatcaacttgttgcgttgctaagtcctacaatcgcgttaccgtcatgggaggattcaaagtggagaaccacaccgcgtgccattgctcaacctgctactaccacaagagc

SEQ ID NO: 13247 - DNA, 348 bp, Artificial Sequence
  Description of Artificial Sequence: Synthetic coding sequence
atggactactatcgtaaatacgctgctatattcttggttacccttagcgtttttctccatgtgttacattctgctccagatgttcaagattgcccggagtgtacactacaagagaacccttttttctctcaacctggggccccaattttgcaatgcatgggctgttgtttttcaagagcttacccaacgccattaaggtccaagaaaacaatgcttgtccaaaaaaatgtaacttctgaatctacctgctgcgtcgctaaatcctacaaccgtgttactgttatgggaggttttaaggtagaaaaccacaccgcgtgtcattgttccacgtgctattaccataaatct

SEQ ID NO: 13248 - DNA, 348 bp, Artificial Sequence
  Description of Artificial Sequence: Synthetic coding sequence
atggactactataggaaatacgctgccatattcctggtgacactgtctgtgtttctgcatgtgctccatagtgccccagatgtgcaagattgccccgagtgcactctacaggaaaatccattcttttcccagccaggggcccctatcctccagtgcatggggtgctgcttcagccgggcctacccgacgccactccggtctaagaagaccatgctggtgcagaaaaacgtgacatctgaatcgacatgctgtgtggccaagtcatacaatcgcgtaacagtaatgggagggtttaaagtagagaatcacacggcctgccactgttctacctgttattaccataagagc

SEQ ID NO: 13249 - DNA, 348 bp, Artificial Sequence
  Description of Artificial Sequence: Synthetic coding sequence
atggattactacagaaagtacgcagcgattttcctggtgactctctccgtgttcctgcacgtgctccactcggcgcctgacgtgcaggactgcccagaatgtacgctccaagagaacccgttcttcagccaaccaggcgcgccgatcctccagtgcatgggatgctgcttctcgcgggcatacccaaccccactccggtccaaaaagaccatgctggtgcaaaagaatgtcacgtccgagtcaacctgctgcgtcgccaagtcgtacaacagagtgaccgtcatgggtggatttaaggtggagaaccataccgcctgccactgctcaacctgttattaccataaatct

SEQ ID NO: 13250 - DNA, 348 bp, Artificial Sequence
  Description of Artificial Sequence: Synthetic coding sequence
atggattactaccggaagtacgcagccattttcctcgtgaccctgtccgtgttcctgcacgtgcttcactccgcacccgacgtgcaagattgcccggaatgcaccctgcaggaaaacccattcttttcgcagccgggggcaccgattctgcaatgcatgggttgctgctttagcagggcgtacccaactcctttgcgtagcaagaaaaccatgctcgtccagaagaatgtcacctccgaatctacttgttgcgtggccaaaagctacaaccgggtgaccgtcatgggaggatttaaggtggaaaaccatactgcatgtcattgctcaacgtgttactaccataagagc

SEQ ID NO: 13251 - DNA, 348 bp, Artificial Sequence
  Description of Artificial Sequence: Synthetic coding sequence
atggattactataggaagtacgccgctatatttctggtgacactaagtgtgttcctacacgtcttacacagcgcccccgacgttcaggattgtccagagtgcaccctgcaggaaaacccattctttagtcaaccgggcgcacccatcttgcagtgcatggggtgttgtttctcacgcgcatatcccactccactgaggtccaagaagaccatgctggttcaaaaaaacgtgacttctgagtccacttgctgcgtcgccaagagctataacagggttactgtgatgggcgggtttaaggtggagaatcacactgcttgccactgctctacttgctactaccacaaatcc

SEQ ID NO: 13252 - DNA, 348 bp, Artificial Sequence
  Description of Artificial Sequence: Synthetic coding sequence
atggattattaccgaaaatatgctgccattttcctcgtgacactgagcgtgtttctccacgtgctgcacagcgcccctgatgtccaagactgtccggaatgtacactgcaggagaacccctttttttcccagccgggagctcccatcctgcagtgtatgggctgctgcttttctcgggcgtatccgacaccactgaggtcaaaaaaaaccatgctggtgcagaaaaacgtcacgagtgagtccacatgctgcgttgcaaagtcctacaatcgagtaaccgtcatgggtggatttaaagtcgagaaccatacggcttgccactgttctacttgttattaccacaaaagt

SEQ ID NO: 13253 - DNA, 348 bp, Artificial Sequence
  Description of Artificial Sequence: Synthetic coding sequence
atggattactaccgcaagtacgcagcgattttccttgtcacgttgtctgtgtttctccacgtgctgcatagcgctcctgatgtgcaggactgccccgaatgcactttgcaagaaaatccgtttttcagccagcctggagctcccatcctgcaatgtatgggttgttgctttagtagagcatatcccacccctctgcggtccaaaaagaccatgctcgtgcagaagaacgtgacttcggaaagcacctgctgtgtcgcaaaatcttacaacagggtgacggtgatgggtggatttaaggtcgagaatcatactgcatgtcattgctcaacctgttattaccataaatcc

SEQ ID NO: 13254 - DNA, 348 bp, Artificial Sequence
  Description of Artificial Sequence: Synthetic coding sequence
atggactactatcgcaagtacgcagctatcttcctggtgaccctctcagtgttcctgcacgtcctgcactccgcccctgatgtgcaagactgtccggagtgcaccctccaagaaaatccgttcttcagccagcctggagcaccgatccttcagtgtatgggttgctgcttttcgcgggcataccctacgccgttgcggtcaaaaaagaccatgctggtgcagaagaacgtgacttccgaatcaacctgttgcgtggcgaaatcatataacagagtgactgtgatgggaggtttcaaggtggagaatcacaccgcttgccattgcagcacttgctactaccacaaatca

SEQ ID NO: 13255 - DNA, 348 bp, Artificial Sequence
  Description of Artificial Sequence: Synthetic coding sequence
atggactattacagaaagtacgcagcgatcttcctggtgactctgagcgtgttcttgcacgtgctccactcggccccagatgtccaagactgccctgagtgcactctgcaagagaacccattcttctcccagcccggggcgccgattctgcagtgtatgggatgctgcttctctcgcgcctacccgaccccactccggagcaaaaagaccatgctggtgcaaaagaatgtgactagcgagtccacttgctgcgtggcgaaatcgtacaatcgcgtcaccgtgatgggtggatttaaggtggaaaaccataccgcgtgccactgctcaacctgctactaccataagtcg

SEQ ID NO: 13256 - DNA, 348 bp, Artificial Sequence
  Description of Artificial Sequence: Synthetic coding sequence
atggactactaccgcaagtacgcagcgatctttttggtgaccctttccgtgttcctgcatgtgctgcattcggctccggatgtgcaggattgcccagaatgtacgctgcaagaaaatccgttcttctcgcagccgggagccccaattctgcagtgtatgggctgctgcttctcaagggcctaccctaccccacttagaagcaaaaagaccatgctcgtccagaagaacgtcacttcggagtctacctgctgtgtggccaaatcgtataacagggttaccgtgatggggggattcaaggtcgagaaccacactgcttgccactgtagcacctgttactaccacaagtcc

SEQ ID NO: 13257 - DNA, 348 bp, Artificial Sequence
  Description of Artificial Sequence: Synthetic coding sequence
atggactactaccggaagtacgccgccatctttctggtgaccctgtcagtgttcctgcacgtgctgcactcggccccagacgtgcaagactgtccggagtgtaccctgcaggagaacccgttcttctcccaacctggcgcgcccattctccagtgcatgggctgctgcttcagccgggcctacccgactccattgcggagcaagaaaaccatgctcgtccagaaaaatgtgactagcgaaagcacctgctgcgtggccaagagctacaacagagtgaccgtgatgggcggatttaaggtggaaaaccacactgcgtgccactgctcaacttgttactaccacaagtcc

SEQ ID NO: 13258 - DNA, 348 bp, Artificial Sequence
  Description of Artificial Sequence: Synthetic coding sequence
atggattactataggaagtacgcagccatttttctggtcaccctgtccgtgttccttcacgtactgcacagcgctcctgacgtgcaggattgtcccgaatgcaccctgcaggaaaaccctttttttagtcagccaggagcgcctatattgcagtgcatgggatgctgttttagcagggcatacccaacacccttgcggtctaagaagaccatgctggttcagaagaacgtgacgagtgagtctacctgctgcgtggctaaaagctacaaccgagttaccgtaatgggcggttttaaagttgaaaaccacacggcctgtcactgcagcacatgctattatcataaatct

SEQ ID NO: 13259 - DNA, 348 bp, Artificial Sequence
  Description of Artificial Sequence: Synthetic coding sequence
atggattactatcgcaagtatgcggcaatattcttggtgaccttgtcggtattcctacatgtgctccattccgccccagatgtgcaggactgtccagagtgcaccttgcaggagaacccattcttctcccaaccaggggccccaatactgcagtgcatgggctgctgcttcagccgtgcttatcccacgcctctgagaagcaagaaaactatgttggttcagaagaatgtgacttcggaatctacctgctgcgtggcaaagtcatacaatagggtgacggtcatgggtggttttaaggtcgaaaatcacaccgcttgccattgctcaacatgttactaccataagtcg

SEQ ID NO: 13260 - DNA, 348 bp, Artificial Sequence
  Description of Artificial Sequence: Synthetic coding sequence
atggactactatcgcaaatacgcggccattttccttgtcacgttatcagtctttctgcatgtgctgcacagtgctcccgacgttcaggactgtcctgagtgtacactgcaggagaatcctttcttcagtcaaccaggagcgcctatcttgcagtgtatgggctgctgtttctcccgcgcctaccccacgccactgcgtagcaagaaaactatgctagtccagaaaaacgtgactagcgagtcaacatgttgcgtcgccaaaagctacaatagagtgactgtgatggggggcttcaaggtggagaaccatactgcctgtcattgttctacctgctactaccacaagtcg

SEQ ID NO: 13261 - DNA, 348 bp, Artificial Sequence
  Description of Artificial Sequence: Synthetic coding sequence
atggattattacagaaaatatgctgctatcttcttagtgacactgtcagtatttcttcatgtgctccatagcgctcccgacgttcaagattgccccgagtgtaccctccaagaaaacccattttttagtcagcccggcgctcccatcttgcaatgtatgggatgttgtttctctcgcgcctaccctacgcctctcaggtccaagaagactatgcttgttcagaagaacgtgacatcagagagcacatgctgcgtggccaagagctacaatcgggttacggtgatggggggattcaaggttgagaatcatacagcttgccattgttctacctgttattaccacaaaagt

SEQ ID NO: 13262 - DNA, 348 bp, Artificial Sequence
  Description of Artificial Sequence: Synthetic coding sequence
atggactactaccgaaaatacgccgctatctttctggtgactttgagcgtgttcctgcacgtgcttcactctgcaccggatgtccaagattgcccggagtgtactcttcaggaaaatccttttttcagccagcctggcgcaccgatactccaatgcatgggctgttgtttttccagagcttaccccactccactgagatccaagaaaacgatgctcgtgcaaaagaacgttacttcggaatcgacctgttgcgtggcaaagtcatacaaccgtgtcaccgttatggggggttttaaggtggagaaccataccgcatgtcattgttcaacgtgctattaccacaagtca

SEQ ID NO: 13263 - DNA, 348 bp, Artificial Sequence
  Description of Artificial Sequence: Synthetic coding sequence
atggactactacaggaagtacgctgcaatctttctggtgaccctgtccgtgttcctccacgtgcttcattccgccccggacgtgcaagattgtcctgagtgtacgctccaagagaacccgttcttttcacagccaggagcaccaattctccaatgtatgggatgctgtttttcccgagcataccctacgcctctccggagcaagaaaaccatgctggtccagaagaacgtgacctcagaatcgacttgttgtgtcgcaaagtcttacaacagggtgactgtgatgggaggtttcaaggtggaaaaccatactgcatgtcactgttcgacctgttactaccataagtcg

SEQ ID NO: 13264 - DNA, 348 bp, Artificial Sequence
  Description of Artificial Sequence: Synthetic coding sequence
atggactactaccgcaagtatgcagccatcttcctcgtcactctgtccgtctttctccacgtccttcactcagcacccgatgtgcaggattgtcctgaatgcactctccaagaaaaccccttcttcagccaaccgggtgcgccaatattgcaatgcatgggatgttgcttttcaagagcataccctacgcctctcaggtcaaaaaagactatgctggtgcagaagaatgtgacctccgaatccacttgctgcgttgcgaaatcgtacaaccgggtcaccgtcatgggtggttttaaggtcgaaaaccacaccgcatgtcattgcagcacttgttactaccacaagtca

SEQ ID NO: 13265 - DNA, 348 bp, Artificial Sequence
  Description of Artificial Sequence: Synthetic coding sequence
atggattactatcggaaatacgcagcaatcttcttggtgaccctgtcggtgttcctccacgtgctgcattccgcaccggacgttcaagactgcccggaatgcactctgcaagagaaccctttcttctctcaaccaggggcgcctatcctccagtgtatgggatgctgtttctccagagcctacccgacgccactgcgctcgaaaaagactatgctggtgcagaaaaatgtgacttccgagagcacttgctgcgtggcgaagtcgtacaatcgagtgactgtgatgggaggatttaaggtcgaaaatcataccgcttgccattgcagcacttgctactaccataaaagc

SEQ ID NO: 13266 - DNA, 348 bp, Artificial Sequence
  Description of Artificial Sequence: Synthetic coding sequence
atggactactatcggaaatacgcagccatcttcctggtgacccttagcgtctttcttcatgtgcttcattcggccccagatgtacaggattgtcccgagtgtaccctccaagaaaatccctttttctcgcagccaggggcgccgattctgcaatgcatgggatgctgtttttccagagcctaccctactccgcttagatcaaagaaaaccatgctcgtgcaaaagaacgtaaccagcgaatccacttgctgtgtcgcaaagagttacaatagggtgaccgtcatgggcgggtttaaagtggaaaaccacaccgcatgccattgctcgacttgttactaccacaagtcg

SEQ ID NO: 13267 - DNA, 348 bp, Artificial Sequence
  Description of Artificial Sequence: Synthetic coding sequence
atggactactatcgcaagtacgccgcaatcttcctggtgaccctgagcgtgtttttgcacgtgttgcatagtgcgcctgatgttcaggattgccccgagtgtactcttcaagaaaacccatttttctcgcaacctggtgcccctattcttcagtgtatgggttgctgtttctctcgagcatatccaacccccctgaggtctaagaaaaccatgctcgtccaaaagaacgtgacgtccgaatctacgtgttgcgtggcaaagtcatacaatcgggtaactgtgatgggaggctttaaagtcgaaaaccataccgcatgccattgttcgacttgttactaccacaagtcc

SEQ ID NO: 13268 - DNA, 348 bp, Artificial Sequence
  Description of Artificial Sequence: Synthetic coding sequence
atggattattatcggaaatacgctgctattttcctggtgacactatcggtgtttctccacgttctccacagcgcaccagatgtgcaggactgccctgagtgtacattgcaggaaaacccattcttctcccagccaggcgcccccatactccaatgcatggggtgctgtttctcaagagcctacccaacacctctgcgctccaagaaaaccatgctggtccagaaaaacgtcacctcagagtccacctgttgtgtagctaaatcttataaccgagttacggtcatgggcgggtttaaggttgaaaaccacaccgcttgccactgcagcacctgctattaccataagagc

SEQ ID NO: 13269 - DNA, 348 bp, Artificial Sequence
  Description of Artificial Sequence: Synthetic coding sequence
atggactactacagaaagtacgccgcgatcttcctggtcaccctgtcagtgtttcttcacgttctgcactcagcaccagatgtgcaggattgtcctgaatgcacgctgcaggaaaaccccttcttttcgcagccgggagcacctattctgcagtgtatgggctgttgcttttcgagagcttacccgacgcccttgcgctccaagaaaacgatgcttgtgcaaaagaatgtcacttctgagtccacttgctgtgtcgcaaagagctacaacagagtgaccgtgatggggggctttaaggtggaaaatcatacggcatgccattgttccacctgttactaccacaaatca

SEQ ID NO: 13270 - DNA, 348 bp, Artificial Sequence
  Description of Artificial Sequence: Synthetic coding sequence
atggattattaccgtaagtacgcggcaatctttctggtgactctctccgtattcctccatgttttgcatagcgcaccagacgtgcaggattgtcctgagtgtacacttcaagagaacccgtttttcagccagccgggagccccgatcctgcagtgtatggggtgctgctttagccgcgcctaccctacccccttgcgctcaaaaaagaccatgttagtgcagaaaaacgtgacttcagaatctacgtgctgcgtggcgaaatcctataatcgggtgactgtcatgggggggtttaaagttgaaaatcacaccgcctgtcactgctccacgtgttattatcacaagagt

SEQ ID NO: 13271 - DNA, 348 bp, Artificial Sequence
  Description of Artificial Sequence: Synthetic coding sequence
atggattactaccgaaagtatgccgcgattttcctggtgactctttctgtattcctgcatgtactgcattcagctccagacgtccaggactgccccgaatgtacccttcaggaaaaccctttcttctcccagcccggggcgcccatcctgcagtgtatgggctgctgcttcagtagggcctatcccactcccttgagaagcaagaagactatgctggtgcagaagaatgttacctccgaatctacctgctgcgtggctaaatcttataatagggtgacggtgatgggaggatttaaggtagagaatcataccgcatgccactgttctacgtgctactaccataagagt

SEQ ID NO: 13272 - DNA, 348 bp, Artificial Sequence
  Description of Artificial Sequence: Synthetic coding sequence
atggactactaccggaagtacgccgctatcttcctggtgaccctgtccgtctttctgcatgtgttgcactcggcgccggacgtgcaggactgtccggaatgcaccctgcaggagaaccctttcttttcacagccgggcgcaccgatcctccagtgcatgggttgctgctttagccgggcctaccccactcctcttcggtccaagaaaaccatgctcgtccagaagaatgttacttccgaaagcacttgctgcgtggccaaaagctataacagggtcactgtgatgggaggattcaaggtggaaaaccataccgcctgccattgctcgacttgttactatcataagtcc

SEQ ID NO: 13273 - DNA, 348 bp, Artificial Sequence
  Description of Artificial Sequence: Synthetic coding sequence
atggactactacaggaaatacgctgcaatatttctggtgacgctttcagtgttcctccatgtgcttcatagtgcccctgatgtccaggattgccccgagtgtaccctgcaggagaatcccttcttctcccagccaggggcaccgattcttcagtgtatgggctgttgcttttcaagagcatatcctacaccgcttcgatcaaagaagacaatgttggtgcagaagaatgtaacaagcgaatccacgtgctgtgtggctaagagctacaaccgggtgactgtaatgggcgggtttaaagtggaaaaccacactgcctgccactgtagtacctgctactaccacaagagc

SEQ ID NO: 13274 - DNA, 348 bp, Artificial Sequence
  Description of Artificial Sequence: Synthetic coding sequence
atggactattaccggaaatacgccgctatcttcctcgtcactttgtccgtgtttctgcatgtccttcattcggccccggacgtgcaagattgtcctgagtgcaccctccaggaaaacccattcttcagccagcccggagcgccaatcctgcaatgcatgggatgttgcttctcgcgcgcgtacccgaccccgctgagaagcaaaaagaccatgctggtgcagaagaatgtgacctcagaatcgacgtgctgcgttgccaagtcttacaacagggtgactgtgatggggggctttaaggtcgagaaccacactgcatgccactgttcaacttgctactaccacaagtcc

SEQ ID NO: 13275 - DNA, 348 bp, Artificial Sequence
  Description of Artificial Sequence: Synthetic coding sequence
atggattattacaggaagtacgccgctattttcctggtcaccttgagcgtgtttctgcatgtgctgcactccgctccggacgttcaggactgccccgaatgcacactacaggagaatccattcttctcccagcccggcgcacccatactccagtgtatgggctgttgtttctctcgcgcatacccaactcctctcagatctaaaaagacaatgttggtccaaaaaaacgttacttctgagtccacatgctgcgtagctaagagctataaccgggttacagtgatgggagggttcaaagtggaaaatcacacggcatgtcactgtagtacttgctattaccataagagt

SEQ ID NO: 13276 - DNA, 348 bp, Artificial Sequence
  Description of Artificial Sequence: Synthetic coding sequence
atggactattacagaaagtacgccgcgatctttctcgtgaccctgtcggtgttcttgcatgtgctgcattcagcccccgacgtgcaagattgcccggaatgcacccttcaggaaaatccgttcttctcacagccgggtgccccaatcctgcaatgcatgggctgctgttttagccgcgcctaccctactccactccgcagcaaaaagaccatgctcgtacagaaaaatgtgacctccgagtccacctgttgtgtggcgaagtcctacaaccgcgtcacggtgatgggcgggttcaaagtcgagaaccacactgcgtgccattgctcaacttgttactaccacaagtcc

SEQ ID NO: 13277 - DNA, 348 bp, Artificial Sequence
  Description of Artificial Sequence: Synthetic coding sequence
atggattattaccgcaaatacgcagctatcttcctggtgaccctctctgtgtttctccacgttctccactcagcgcccgatgtgcaagactgtcctgagtgtaccttgcaggagaatccatttttctctcagcccggagctccgattctccagtgtatgggatgttgttttagtagagcatatcccaccccactccggtccaagaagaccatgcttgtgcagaagaacgtcacctccgaatctacctgctgcgttgcaaagtcctataatagggtgaccgtgatgggcggattcaaagtggaaaatcacactgcatgtcactgcagtacgtgttactatcataagagc

SEQ ID NO: 13278 - DNA, 348 bp, Artificial Sequence
  Description of Artificial Sequence: Synthetic coding sequence
atggattactacagaaagtatgctgcaatcttcctcgttactctgtccgtgttcttgcacgtcctgcactcggcaccggacgtccaggattgtccggagtgtaccctccaggaaaaccctttctttagccagcctggggccccgatactgcagtgtatgggttgctgcttctcccgcgcctacccaacccctctccggtcaaaaaagaccatgttggtgcagaaaaatgtcacgtccgagtctacctgctgcgtcgcaaagtcgtacaaccgggtgactgtgatggggggattcaaggtggaaaatcacactgcctgtcattgctctacttgctactaccataagagc

SEQ ID NO: 13279 - DNA, 348 bp, Artificial Sequence
  Description of Artificial Sequence: Synthetic coding sequence
atggactattaccgaaagtacgcggctatcttcctcgtcaccttgtccgtctttctgcacgtactgcactccgcgccggatgtccaagactgtccggagtgtactctgcaagaaaatcccttcttctcccagccgggcgcgccaatcctgcagtgcatgggttgctgcttttcacgcgcctatccgaccccactcagatctaaaaagactatgctcgtacagaaaaacgtcactagcgaatcgacttgctgcgtggccaagtcgtacaacagggtgaccgtgatgggaggattcaaagttgagaatcataccgcctgccactgcagcacttgctactaccataagtcg

SEQ ID NO: 13280 - DNA, 348 bp, Artificial Sequence
  Description of Artificial Sequence: Synthetic coding sequence
atggattattatcgtaaatatgctgcaatttttttagttacattgtctgtatttcttcatgttcttcatagtgctcctgatgtacaagattgtccagaatgtacgcttcaagagaatccattcttttcacaaccaggtgctcctattttacaatgtatgggatgttgtttttcaagggcttatccaacaccattgcgatcaaaaaaaacaatgctcgttcaaaaaaatgttacttcagaatctacatgttgtgtagccaaatcatataatagagtaactgttatgggaggatttaaggtagaaaatcatacagcctgtcattgttctacatgttattatcataagtcc

SEQ ID NO: 13281 - DNA, 348 bp, Artificial Sequence
  Description of Artificial Sequence: Synthetic coding sequence
atggactactaccgcaagtacgcagccattttccttgtgacgttgagcgtgtttctccacgtcttgcattcggccccagatgtgcaggattgccctgaatgcactctgcaagaaaacccgtttttcagccagccgggtgctccgatcctgcagtgtatgggctgttgtttcagccgggcttatccgacgccgctgaggtcgaaaaagactatgctggtgcagaaaaacgtcacctcggagtcgacctgttgcgtggcaaagagctacaaccgcgtgactgtgatgggcggattcaaggtggaaaatcacaccgcgtgccactgttcgacttgttactaccataagtca

SEQ ID NO: 13282 - DNA, 348 bp, Artificial Sequence
  Description of Artificial Sequence: Synthetic coding sequence
atggattactaccgtaaatacgcagcaatcttcctggtgaccctttctgtgtttctccacgttctgcactccgcacctgacgtgcaggattgcccagagtgtaccctgcaagagaatccgttcttttcccaacctggtgcacctattctccaatgtatgggctgttgtttttcgagagcatacccaactcctcttagatcgaagaaaaccatgctggtgcaaaagaatgtgacttcagagtccacctgctgtgtcgcaaagtcctacaatcgggtgactgtgatgggtggatttaaggtggagaaccataccgcatgccattgtagcacttgttactatcataagagc

SEQ ID NO: 13283 - DNA, 348 bp, Artificial Sequence
  Description of Artificial Sequence: Synthetic coding sequence
atggattattatcgaaaatatgcagccatctttcttgtaacattgagtgtctttttacacgtgcttcattcagctccagacgtacaagattgtcctgaatgtacactacaggaaaatccgtttttctctcaaccgggagcacctatcttgcaatgtatggggtgctgcttctctcgggcttaccctacccccttacgttctaagaaaacaatgctcgtgcagaaaaatgtcacaagcgaatccacgtgttgtgttgctaagtcatacaacagagtaacagtgatgggagggttcaaagtagaaaaccatacggcatgccattgctctacgtgttattaccacaagtca

SEQ ID NO: 13284 - DNA, 348 bp, Artificial Sequence
  Description of Artificial Sequence: Synthetic coding sequence
atggactattacaggaagtacgctgctatctttctggtgaccctctccgtgttcctgcatgtcctccactctgcccccgatgtgcaggactgccctgaatgtaccctgcaagaaaaccccttcttctcacagcctggagccccaatactgcagtgcatgggttgctgcttttcacgggcgtaccccacccctctaagaagtaagaaaaccatgttggtccagaagaatgtgacttccgagtctacatgctgtgtagcaaaatcctataatagagtgaccgtgatgggagggtttaaggttgagaaccacactgcctgtcactgttcaacatgttattaccataagtct

SEQ ID NO: 13285 - DNA, 348 bp, Artificial Sequence
  Description of Artificial Sequence: Synthetic coding sequence
atggattactaccgcaagtacgctgctatattcttggtgactctcagcgtgttcctgcatgtcctccatagcgcacccgacgtgcaagattgtcccgagtgcacactgcaagagaatccattcttcagccaaccaggcgctcccatcttgcaatgcatgggatgctgtttctcgcgcgcctaccctaccccattgcgttcaaagaagaccatgctggtccagaagaacgtgacgtctgagtcgacatgttgcgtggcgaaatcttataaccgcgttacagtaatgggtggttttaaggtcgagaatcacaccgcctgccattgttctacatgctattatcataagtcc

SEQ ID NO: 13286 - DNA, 348 bp, Artificial Sequence; identical to SEQ ID NO: 13277
  Description of Artificial Sequence: Synthetic coding sequence

SEQ ID NO: 13287 - DNA, 348 bp, Artificial Sequence
  Description of Artificial Sequence: Synthetic coding sequence
atggactattatcgcaaatacgcagccatcttcttggttacactatctgtgtttctccatgtgctccactccgcccctgacgtgcaggactgtcccgagtgtacgctccaggaaaacccattcttctcccaacccggcgccccgatcctgcagtgtatgggatgttgcttttcccgggcgtatccaacacccctgaggtctaaaaaaaccatgcttgtgcagaaaaatgtgactagcgagtccacttgctgcgtcgccaaaagctataatagggtaaccgttatgggtggatttaaggttgagaaccatactgcctgtcactgttctacatgctactaccacaagtcc

SEQ ID NO: 13288 - DNA, 348 bp, Artificial Sequence
  Description of Artificial Sequence: Synthetic coding sequence
atggattactacaggaaatacgccgccatattcctggtgaccctgagcgtgtttctgcacgtgctccacagcgcacccgacgttcaagactgtccagagtgtacactgcaggagaatccctttttcagtcagccgggggccccaatcctgcaatgtatggggtgctgcttctcaagagcataccccactccactccgatcaaagaagactatgctcgtccagaagaacgtcacctctgagagcacttgctgcgtggccaagtcctacaatagggttacagttatgggagggttcaaagtggaaaatcatactgcctgtcattgtagcacctgctactatcataagagc

SEQ ID NO: 13289 - DNA, 348 bp, Artificial Sequence
  Description of Artificial Sequence: Synthetic coding sequence
atggattattaccgcaagtatgcagcgattttcctggtgaccctgagcgtcttcctgcatgtgctgcattccgctccagacgtgcaggattgccctgaatgcacgctgcaagagaatcctttttttagccagccaggcgccccaattctgcagtgtatgggttgctgtttctcccgcgcatatccaaccccactaagaagcaagaagactatgctggtgcaaaaaaacgtgaccagcgagagtacctgctgtgtggccaagagctacaaccgcgttacggtcatgggtggttttaaggtggaaaatcacacggcatgccattgttccacttgttactaccacaaaagc

SEQ ID NO: 13290 - DNA, 348 bp, Artificial Sequence
  Description of Artificial Sequence: Synthetic coding sequence
atggactattacagaaagtacgctgcgatcttcctggttactcttagtgtgttccttcacgtcctgcacagcgccccagacgtgcaagattgccctgagtgtaccctgcaggagaatccattctttagtcaaccgggagcccccatcttgcagtgtatggggtgctgcttctcgcgggcctaccccaccccactccgcagcaagaaaacgatgctggtccagaagaacgtgaccagcgaatccacgtgttgcgtcgcgaaatcatacaaccgcgtgacggtcatgggaggctttaaggtggaaaatcacactgcatgccattgctccacttgttactaccataaatcg

SEQ ID NO: 13291 - DNA, 348 bp, Artificial Sequence
  Description of Artificial Sequence: Synthetic coding sequence
atggactattataggaagtatgctgctattttcctcgtaactttatccgtctttttgcacgtgctccactctgcccctgacgtacaggattgtcccgagtgtacactgcaggaaaatcctttttttagtcagccaggagcccccattctacaatgtatgggatgctgcttttccagagcctaccccactccactgcgctccaagaagaccatgctcgtgcagaagaacgtgacctccgagtcaacttgctgtgtcgccaaatcatacaaccgggtcaccgttatgggtggatttaaagttgagaaccacaccgcctgccactgctccacatgctactaccataaaagt

SEQ ID NO: 13292 - DNA, 348 bp, Artificial Sequence
  Description of Artificial Sequence: Synthetic coding sequence
atggactactatcgtaagtacgcagctatttttcttgtgacactgtccgtgttcctgcatgtgttgcattccgctcccgacgtgcaagattgtcctgaatgtaccttgcaggagaaccctttcttctcacaaccaggcgctccaatcttgcagtgtatgggctgctgcttcagcagggcatatccaactccactcaggtcaaagaagaccatgctcgtgcaaaaaaacgtaacttccgaatccacctgttgcgtagccaagtcatacaaccgtgtgaccgtcatgggaggctttaaggtcgagaaccataccgcatgtcactgcagtacctgctactaccacaagtcc

SEQ ID NO: 13293 - DNA, 348 bp, Artificial Sequence
  Description of Artificial Sequence: Synthetic coding sequence
atggattactacaggaaatacgcagccattttcctcgtcactctctcagtgttcctccacgtgcttcacagcgcaccagacgtgcaagattgtccagaatgcactctgcaagagaatccttttttctcgcagccaggtgccccaatactgcaatgcatgggatgttgtttttcgagggcatacccaaccccacttcgctccaaaaagacgatgcttgtgcagaaaaacgttacttccgaatcgacctgttgcgtggcaaagtcatacaatagagtgaccgtgatgggaggatttaaggtggagaatcataccgcgtgtcattgctccacttgttactaccacaagtca

SEQ ID NO: 13294 - DNA, 348 bp, Artificial Sequence
  Description of Artificial Sequence: Synthetic coding sequence
atggactattatagaaagtacgctgctatcttcctcgtgaccctctccgtattcctgcacgtgctccatagtgccccagatgttcaggactgcccggaatgtacgttacaggagaatccgttctttagccagccaggtgctccgatactgcagtgtatggggtgctgcttttctcgggcttacccgaccccattaaggtcaaagaaaaccatgctcgttcaaaaaaacgtgacttctgagagcacatgctgtgtggcaaagagttacaaccgggtgacagtgatgggtgggttcaaggtggaaaatcacactgcctgccactgcagcacatgttattaccataagtcc

SEQ ID NO: 13295 - DNA, 348 bp, Artificial Sequence
  Description of Artificial Sequence: Synthetic coding sequence
atggattattacagaaagtatgcggcaatattcctagtaactctgtcggttttccttcatgtgcttcatagtgctccagatgtgcaggattgccctgagtgcactctgcaggaaaaccctttcttttcccagcctggagcccccatactacagtgcatgggatgttgcttcagtcgggcgtatcccacacctctgcgctcaaaaaaaacaatgctcgtgcagaaaaatgtgacatccgaatctacatgttgtgtggcaaagagttataacagggtgacagtgatggggggattcaaagtcgaaaaccacacagcgtgtcactgttcgacttgttattatcataaatct

SEQ ID NO: 13296 - DNA, 348 bp, Artificial Sequence
  Description of Artificial Sequence: Synthetic coding sequence
atggattactacaggaagtacgcagcaatattccttgtgacgttgtcagtgtttctccacgtactgcactccgcacctgacgtgcaagactgtcccgagtgcaccctgcaagaaaatcccttctttagccagcctggtgcccctattttgcagtgtatgggatgttgcttctcacgtgcgtaccctacccctctccgaagcaaaaagactatgcttgtccagaagaacgtgacttcagagtcgacctgctgtgtggccaagagctataatcgcgtcactgtgatgggcgggttcaaggtggaaaaccataccgcttgtcattgctcgacctgttactaccataagtca

SEQ ID NO: 13297 - DNA, 348 bp, Artificial Sequence
  Description of Artificial Sequence: Synthetic coding sequence
atggactattatcggaagtatgccgccatcttcctagttactttgtcggtgttcctgcacgtgctgcattcggctcccgacgttcaggattgcccagagtgtaccctccaagaaaatcccttcttcagccagcccggagctcctatcttgcaatgcatggggtgttgtttctctcgagcctatcctaccccactgcgctccaaaaagactatgctcgtacaaaaaaatgtgacctcagaaagcacttgttgcgtggctaaatcttacaaccgtgtgacagtgatgggtgggttcaaagtcgagaaccataccgcatgtcattgctccacctgttattaccacaagtcc

SEQ ID NO: 13298 - DNA, 348 bp, Artificial Sequence
  Description of Artificial Sequence: Synthetic coding sequence
atggattactaccgaaagtacgcagcaattttcctggtcactctttccgtgtttctgcatgtgctgcactccgccccagatgtccaagactgcccagaatgcaccctgcaagaaaatccttttttctcccagcccggcgcgcctatccttcaatgtatgggttgttgtttctccagggcatacccgactccgctcaggagcaagaaaacgatgcttgtgcagaagaacgtgacttctgagtccacctgctgcgttgcaaagtcatacaatcgagtcactgtgatgggcggttttaaggtggagaaccacaccgcctgccattgttcaacctgttactatcacaagagc

SEQ ID NO: 13299 - DNA, 348 bp, Artificial Sequence
  Description of Artificial Sequence: Synthetic coding sequence
atggactactaccgaaaatacgctgcaatcttcctagtcaccctgagcgtgttcttacacgtgttgcactcagctccggatgtccaggactgtcccgaatgtactctgcaggaaaaccctttcttttcacagcccggcgctcctatcctccagtgtatgggatgttgctttagcagagcttaccccacgcccttgcgatctaagaagactatgttggtgcaaaagaatgtgacgtctgagagtacctgttgtgtggcgaagtcctacaaccgagttaccgtcatgggcggcttcaaggttgaaaaccacaccgcttgccactgcagcacctgttactatcataaatca

SEQ ID NO: 13300 - DNA, 348 bp, Artificial Sequence
  Description of Artificial Sequence: Synthetic coding sequence
atggactactacaggaagtacgcggccattttcctagtcaccctgagtgttttcctccacgttctgcactccgctccagatgttcaagactgtcctgaatgcactctacaggagaacccattcttctcccaaccaggcgctcctatccttcagtgcatgggctgttgcttttcccgggcatacccaacaccgcttcgtagcaagaagaccatgctagtccagaaaaatgtcacttccgaatcaacatgctgtgtggctaaaagctataatcgtgtaaccgttatgggaggttttaaggtggagaatcatactgcctgccactgctccacgtgctattatcacaaaagc

SEQ ID NO: 13301 - DNA, 348 bp, Artificial Sequence
  Description of Artificial Sequence: Synthetic coding sequence
atggactattatcgcaaatatgctgccatattcttggtgaccttaagcgtgtttttgcacgtcctacacagtgctccggatgttcaggactgccccgagtgtacactccaggagaatccattcttttcccagccaggggcacccatactacagtgtatgggctgctgtttcagcagagcctacccgacaccattgaggagcaagaagaccatgctcgtgcaaaaaaatgtcaccagcgaatcaacctgctgtgtagcaaagagctataaccgcgtcactgtaatgggtgggtttaaggttgagaaccacacagcttgccactgctccacctgttattatcataagtca

SEQ ID NO: 13302 - DNA, 348 bp, Artificial Sequence
  Description of Artificial Sequence: Synthetic coding sequence
atggactactaccggaagtacgctgcaatcttcctcgtgactctctcggtctttcttcatgtgctgcattccgccccagatgtgcaagattgtcctgagtgtactctgcaagagaatcccttcttttctcagcctggcgcgccgatcctgcaatgtatggggtgctgttttagccgcgcctatccaacgccgcttagatcgaagaaaactatgctggtccagaagaatgtgacgtcggaatctacctgttgtgtcgcaaagtcctacaacagagtgaccgtgatggggggatttaaggtcgagaaccatactgcatgccactgcagcacctgctactaccataagtct

SEQ ID NO: 13303 - DNA, 348 bp, Artificial Sequence
  Description of Artificial Sequence: Synthetic coding sequence
atggactactacagaaagtatgccgccatcttcttggtaaccctcagcgtattccttcatgtgcttcacagcgcccctgatgtccaggactgccccgagtgtacccttcaggagaacccgtttttttcgcagccgggcgctccgattcttcaatgcatgggctgttgtttttcccgcgcctaccccacacccttacgctccaagaagaccatgttggtccagaagaacgtcacttccgagtcaacctgctgtgtcgccaagagctacaaccgcgtgacggttatgggcggtttcaaggtcgagaaccacacggcctgccactgctctacgtgctactaccacaaaagt

SEQ ID NO: 13304 - DNA, 348 bp, Artificial Sequence
  Description of Artificial Sequence: Synthetic coding sequence
atggattactatcgtaagtatgctgccatattcctcgtaaccctgagcgtgtttctgcacgttctacactctgcaccagacgtgcaggattgcccagagtgtactctgcaggaaaatccctttttctcacagccgggagcacccattctgcagtgcatgggttgttgcttctcccgggcctacccaacacctctgaggagtaaaaaaactatgttggtccagaaaaatgtgaccagcgagagcacgtgctgtgtggctaaatcttacaaccgtgtgaccgttatggggggctttaaggtagagaatcacacggcttgccactgcagtacctgttattaccacaaatca

SEQ ID NO: 13305 - DNA, 348 bp, Artificial Sequence
  Description of Artificial Sequence: Synthetic coding sequence
atggactactaccggaagtatgcagctatttttctagtaaccttgtccgtgttcctgcacgttctccatagtgcccccgatgtgcaggactgtccggagtgcacgctgcaagagaatccattctttagccagcctggcgctccaattctccagtgtatggggtgttgcttttccagggcctaccctactcccctcagatctaagaagaccatgctggtgcagaagaacgttactagcgaaagcacctgttgcgtagctaagagctacaatagagttaccgtgatgggggggtttaaggtggaaaatcatacagcttgtcattgttctacctgctactatcacaagtcc

SEQ ID NO: 13306 - DNA, 348 bp, Artificial Sequence
  Description of Artificial Sequence: Synthetic coding sequence
atggattattatcgcaaatatgctgctatattccttgtcacccttagcgtttttctgcacgtgttacatagtgcaccagatgtacaggattgcccggaatgcacacttcaagaaaacccattttttagccagccaggagcaccaatcctgcagtgcatgggatgttgtttttcgcgagcttatccaacaccccttcgatctaagaaaactatgcttgttcaaaaaaatgtgacgtcggagtccacatgttgtgtggcgaagagctataaccgggttacggttatgggaggctttaaggttgaaaaccacacagcgtgtcattgcagtacatgttattaccataaatcg

SEQ ID NO: 13307 - DNA, 348 bp, Artificial Sequence
  Description of Artificial Sequence: Synthetic coding sequence
atggactactacagaaaatacgccgccatcttcctcgttacattgagcgtctttctccatgtcctccatagtgcgcctgatgtacaagattgccctgagtgcactctgcaggaaaatccctttttttctcagccaggcgcacccatcttacagtgcatgggatgttgcttctcccgggcctacccaacccccctgcgatccaagaagaccatgctggtgcagaagaacgttacatccgagagcacctgttgcgtagcaaaatcctacaacagggttacggtaatggggggcttcaaggtggagaatcataccgcctgccattgcagtacttgttattatcacaaatcc

SEQ ID NO: 13308 - DNA, 348 bp, Artificial Sequence
  Description of Artificial Sequence: Synthetic coding sequence
atggactattacaggaagtatgcagccatcttccttgtaacattatctgtcttcttgcacgtcttgcacagtgcgccagacgtccaggattgcccggaatgcactttacaggaaaacccgttcttctcacaaccaggggctcctatactgcagtgcatgggctgctgcttttcccgggcttaccctacccctctgcgctctaaaaagaccatgctggtgcaaaagaatgtcacgtctgagagcacttgctgtgtggctaagagctacaatcgtgtcacagtcatgggtggtttcaaggtggaaaatcataccgcctgtcattgcagcacttgctactatcataaaagc

SEQ ID NO: 13309 - DNA, 348 bp, Artificial Sequence
  Description of Artificial Sequence: Synthetic coding sequence
atggattactaccgcaagtacgccgcaattttcctggtgaccctgtcagtgtttttgcatgtcctccatagcgccccagacgtccaggactgccctgaatgcaccctgcaggaaaacccgtttttctctcagccgggagccccgatcctccagtgtatgggatgttgcttctccagagcttaccccactccgctgcgcagcaaaaagactatgctggtgcaaaagaacgtgacctccgagtcgacttgttgcgtggccaagtcgtacaacagggtcactgtcatgggaggattcaaggtcgaaaaccacaccgcatgtcactgcagcacgtgttactatcacaagtcg

SEQ ID NO: 13310 - DNA, 348 bp, Artificial Sequence
  Description of Artificial Sequence: Synthetic coding sequence
atggactactatagaaagtacgcagccatctttctggtgaccctttctgttttcctccatgtcctgcattcggcaccagatgtgcaagactgtcctgaatgtacgctccaggagaacccgttcttttcccaaccaggagctcctattcttcaatgtatgggatgttgcttctcccgcgcgtaccccaccccactgcgttcaaaaaagactatgcttgtgcagaagaacgtgacttccgaatctacttgctgtgtggcaaagagctacaatagagtcaccgtcatgggtggcttcaaggtggaaaaccatactgcctgtcactgctccacttgttactatcacaaatcc

SEQ ID NO: 13311 - DNA, 348 bp, Artificial Sequence
  Description of Artificial Sequence: Synthetic coding sequence
atggattattatcgtaaatatgcggcgatatttctagttacgctatcggtatttttacatgttctacattcggcgccggatgtacaagattgtccggaatgtacgctacaagaaaatccgtttttttcgcaaccgggtgcgccgatattacaatgtatgggttgttgtttttcgcgtgcgtatccgacgccgttacgatcgaaaaaaacgatgttagtacaaaaaaatgtaacgtcggaatcgacgtgttgtgtagcgaaatcgtataatcgagttacggtaatgggtggttttaaagtagaaaatcatacggcgtgtcattgttcgacgtgttattatcataaatcg

SEQ ID NO: 13312 - DNA, 348 bp, Artificial Sequence
  Description of Artificial Sequence: Synthetic coding sequence
atggactattatcgtaagtatgccgctatattcctcgttactctgtctgtgttcctgcatgtgctgcactctgctcctgacgtgcaggattgtccagagtgtaccctacaggagaatccattcttcagtcagcctggggcacccatactgcaatgcatggggtgttgcttttccagggcctatcctactcccctgcgatctaaaaagaccatgctggtgcaaaagaatgtgacttcggagtcaacttgctgtgttgccaagagctacaaccgggtaacggtgatggggggtttcaaggtcgagaatcataccgcatgccactgtagtacatgctattaccacaaatct

SEQ ID NO: 13313 - DNA, 348 bp, Artificial Sequence
  Description of Artificial Sequence: Synthetic coding sequence
atggattattatcggaaatatgcagccattttcctggtgactcttagcgtctttttgcacgtacttcattccgcccctgatgtgcaggactgccccgagtgtaccctacaggaaaacccattcttcagtcaacccggcgctccaatcctgcagtgtatgggctgctgtttcagtagggcatatccgactcccctgcgtagcaagaagacaatgttggtccagaaaaatgtgacatccgaatccacatgctgtgtggctaagtcatacaacagggtcacagtgatgggcggtttcaaagtcgaaaatcacactgcctgtcattgttctacatgttattaccataagtcc

SEQ ID NO: 13314 - DNA, 348 bp, Artificial Sequence
  Description of Artificial Sequence: Synthetic coding sequence
atggattactacaggaaatatgcagcgattttcctggttacattgtctgtcttcctgcatgtgctccactcggccccggacgtgcaggattgtcccgaatgcacacttcaagagaatccttttttttctcaaccgggggctcctatcctacagtgcatgggctgctgtttctctagggcataccctacgccccttaggtccaaaaagactatgctggtccagaagaatgtaacctcagagagcacatgctgtgtggcgaaatcatacaacagagtgacagtgatgggcggattcaaggtcgagaaccatactgcttgtcactgctctacttgttactaccacaagagc

SEQ ID NO: 13315 - DNA, 348 bp, Artificial Sequence
  Description of Artificial Sequence: Synthetic coding sequence
atggactactatcggaaatacgcagcgatctttctggtaactctgagcgtgttccttcatgttctccattcagcgccggatgtgcaagactgcccagaatgtaccctgcaagaaaaccccttcttctctcagccgggagcgccgatcctgcagtgtatggggtgttgcttttcgagagcctacccaactcccttgaggtccaagaaaactatgctggttcagaagaatgtcacctcggagtcgacctgctgcgtcgccaaaagctacaatagagtgactgtcatggggggtttcaaggtggagaaccacaccgcctgccattgctccacctgctattaccacaagagc

SEQ ID NO: 13316 - DNA, 348 bp, Artificial Sequence
  Description of Artificial Sequence: Synthetic coding sequence
atggactattacagaaagtacgcagccatcttcctcgttactctttcagtgttcctgcacgtgctgcatagcgcgcctgacgtccaagactgtccagaatgcaccctgcaagaaaacccattcttctcccagccaggagcccccattttgcagtgtatgggatgctgcttcagccgggcatacccgaccccgttgcgttccaagaaaactatgctcgttcagaagaacgtgaccagcgagtcaacctgttgcgtggcgaaatcgtacaaccgagtgacggtgatggggggatttaaggtggagaatcatactgcgtgccactgttccacctgttactaccacaaaagc

SEQ ID NO: 13317 - DNA, 348 bp, Artificial Sequence
  Description of Artificial Sequence: Synthetic coding sequence
atggactactatcggaagtacgcagccatctttctagtgactctgtccgtcttcctacacgttctgcacagtgctcccgacgtacaggattgcccagagtgtaccctgcaagaaaaccccttttttagccagccaggagctcccatccttcagtgcatgggctgttgcttctcacgtgcttaccccacacccttacggtctaagaagaccatgttagtacagaagaacgttactagcgagtctacttgctgcgtagccaagtcttacaatcgggtgaccgtcatggggggcttcaaggtggagaatcataccgcatgccactgcagtacttgctattatcacaaatca

SEQ ID NO: 13318 - DNA, 348 bp, Artificial Sequence
  Description of Artificial Sequence: Synthetic coding sequence
atggattactatcgcaagtacgcagcgatatttctggtgaccctgtccgtttttcttcatgtgcttcattcagcacctgacgtgcaagactgtcctgaatgcaccctccaggaaaacccatttttctcccaacctggagcgcctatcctgcaatgtatgggatgttgtttcagcagggcctaccccactcctctgcgatccaagaaaaccatgcttgtgcaaaagaacgtgacctcagagagcacgtgttgtgtggcaaagtcttacaatagagtcaccgtcatgggtgggtttaaggtggagaaccacactgcatgtcactgcagcacctgctactaccacaagagc

SEQ ID NO: 13319 - DNA, 348 bp, Artificial Sequence
  Description of Artificial Sequence: Synthetic coding sequence
atggactactataggaagtacgccgctatcttcctagtgacgctgtccgtctttctgcacgtcttgcacagcgccccagatgtgcaagactgtccagagtgcacattgcaggagaatccattttttagccaacctggggctcccatcctccagtgcatgggatgttgcttcagccgagcgtatcccactccactccgatccaaaaaaacaatgctggtacagaaaaatgtgacatcagaaagcacatgttgtgtagctaagtcgtacaaccgggttacggtgatgggggggttcaaagtcgaaaatcatactgcctgccactgctctacttgctactatcataagagt

SEQ ID NO: 13320 - DNA, 348 bp, Artificial Sequence
  Description of Artificial Sequence: Synthetic coding sequence
atggattattacaggaaatacgcggctatatttctggtcactctctctgtcttcctccatgtgctgcacagcgctcctgacgttcaggactgtccagaatgtaccctccaggagaatcctttcttttctcagcccggagcacctatccttcagtgtatgggatgttgcttttctcgggcttaccctacccccctcagatccaaaaagactatgctcgtacagaagaatgtaaccagcgagtcaacctgctgtgtcgctaaaagctacaaccgagtgaccgtcatgggggggttcaaggtggagaatcacactgcctgccactgcagtacctgctactatcacaagagt

SEQ ID NO: 13321 - DNA, 348 bp, Artificial Sequence
  Description of Artificial Sequence: Synthetic coding sequence
atggactactatagaaaatacgcagcaatcttcctggtgaccctctccgtgtttctccacgtcctccacagcgccccagacgtgcaagattgtcccgaatgcacgctgcaggaaaacccgttcttctcgcagccgggcgctccgattttgcaatgcatgggatgctgtttttcgcgggcctacccaactcctctccgttcgaagaagactatgctggtacagaagaacgttaccagcgagtccacctgctgcgtggccaagtcatacaatcgcgtgactgttatgggagggttcaaggtggagaatcataccgcgtgtcactgctccacttgctactaccacaaaagc

SEQ ID NO: 13322 - DNA, 348 bp, Artificial Sequence
  Description of Artificial Sequence: Synthetic coding sequence
atggattactatcgcaaatatgcggctatattcctggttaccctgtcggtcttcttgcatgtactgcactctgccccagacgttcaggactgtcctgagtgcacactgcaggaaaatccttttttcagccagcctggtgcacccattctacaatgcatgggctgctgttttagccgcgcttatcctacccccctaaggtccaagaagactatgctggttcagaaaaacgtgacatcagaaagcacttgctgcgtggctaagtcgtacaacagagtcacagttatgggcgggtttaaggtcgagaatcacacagcgtgccattgtagtacatgttactaccataaaagt

SEQ ID NO: 13323 - DNA, 348 bp, Artificial Sequence
  Description of Artificial Sequence: Synthetic coding sequence
atggactactacaggaagtacgcagccattttcctggtgactctgtcggtgtttctccatgtcctgcactcggccccagatgtacaggattgtccggaatgcacgttgcaagagaacccgttcttctcacagcccggagccccgatcctccaatgcatgggctgttgtttcagtagagcctatccaacccccctgcggtcgaagaaaaccatgcttgtgcagaaaaatgtgacctcagagagcacttgctgtgtagcgaagtcttacaaccgcgttaccgtcatgggagggtttaaggtggaaaaccacactgcatgccactgctccacttgctactaccacaagtca

SEQ ID NO: 13324 - DNA, 348 bp, Artificial Sequence
  Description of Artificial Sequence: Synthetic coding sequence
atggattactacagaaaatatgcggccatcttcctggtgacactgagcgtgtttctgcacgtgcttcattctgctcctgatgtgcaggattgcccagagtgcaccctccaggagaatccattttttagccagcctggcgcccccatcttgcagtgcatggggtgttgcttcagcagagcttaccccacgcccctcagatccaaaaagacgatgctagttcagaaaaatgtcacctccgagagtacatgttgcgtcgccaagagctacaatcgcgtcactgtgatgggcggcttcaaagtcgagaaccacacggcctgtcattgcagtacctgttactatcacaagtct

SEQ ID NO: 13325 - DNA, 348 bp, Artificial Sequence
  Description of Artificial Sequence: Synthetic coding sequence
atggactactatcgaaagtatgcagccatctttctggtaactctgtctgttttcctgcacgtcctgcattcagctcccgatgttcaggattgcccagagtgtaccttacaggagaacccattcttttcacagcccggcgctcccattctgcaatgtatgggatgctgtttttcaagggcgtaccccacgcccctgaggagcaagaaaaccatgctggtccagaagaacgtaacctcagagagcacctgttgtgtggccaagagttacaatcgagtcaccgtgatgggggggttcaaggttgaaaaccacacggcatgtcactgctccacttgttattaccataagtcc

SEQ ID NO: 13326 - DNA, 348 bp, Artificial Sequence
  Description of Artificial Sequence: Synthetic coding sequence
atggactactacagaaaatatgccgccatcttcttggttaccctgagtgttttcctccacgtcttgcacagtgcccctgacgtgcaggattgtccagagtgtactcttcaggaaaatccgttttttagccaacctggagcacctattttgcagtgcatgggctgctgtttttccagggcctacccgaccccgctgcggagcaagaaaaccatgctcgtccagaaaaacgtgaccagtgaatccacctgctgcgtggcaaagtcgtataaccgggtgaccgtcatgggcggcttcaaggttgaaaatcacacagcttgtcactgttctacatgctactatcacaaatca

SEQ ID NO: 13327 - DNA, 348 bp, Artificial Sequence
  Description of Artificial Sequence: Synthetic coding sequence
atggactactatcggaaatacgcggcgatctttcttgtcactctgtccgtgtttcttcatgtgctccattcagccccagatgtgcaggattgtcctgagtgtacgcttcaggaaaacccatttttcagccaacccggggccccaattttgcaatgtatgggatgttgcttttccagagcctaccctacccctctgcgtagcaaaaagacgatgctggtgcaaaagaacgtcacctcagaatcgacttgctgtgtcgcaaaatcgtacaacagagtcactgtgatggggggattcaaggtcgaaaatcacactgcatgccattgttctacctgctactaccacaagtcc

SEQ ID NO: 13328 - DNA, 348 bp, Artificial Sequence
  Description of Artificial Sequence: Synthetic coding sequence
atggattattatagaaaatatgctgcgatttttctcgtaactttatcagtattcctccatgtgctccattctgcccccgatgtccaggattgcccagaatgcacgctccaggagaatccttttttttcacagccaggggcacccatactacagtgtatgggatgttgcttttcacgggcatatcctactccactcagatccaaaaagacgatgttagtacagaaaaatgtcacttcggaatctacttgctgcgtggcaaaaagttataaccgagttacagtaatgggaggattcaaagtggaaaatcatacagcatgccattgtagtacttgttattatcataaatct

SEQ ID NO: 13329 - DNA, 348 bp, Artificial Sequence
  Description of Artificial Sequence: Synthetic coding sequence
atggactactacaggaaatacgccgccattttcctggttaccttgagtgtgttcctgcatgtactccactccgcacccgacgttcaggactgccccgaatgtactctgcaggaaaaccccttcttttcccagcccggtgcgccaattctgcagtgcatgggctgttgcttcagccgcgcttaccccacaccattgaggtccaaaaaaaccatgctggtccagaaaaatgtcacatcagaatctacttgttgcgtcgccaagtcctacaacagagtcactgtgatgggcggtttcaaagtggaaaaccacaccgcctgccattgctctacctgctactaccataagtcc

SEQ ID NO: 13330 - DNA, 651 bp, Artificial Sequence
  Description of Artificial Sequence: Synthetic coding sequence
atggcgaccgggagccggacctcgctgctgctggccttcggactgctgtgcctcccatggctgcaagaggggtcggcattccctaccatccctctgtcccggctcttcgacaacgccatgctccgggcccatcggctgcaccaactggcctttgatacctaccaagaattcgaggaggcgtacatcccaaaagaacagaagtactcgttcctgcagaatccgcagacctcactgtgcttttctgagtcgattccaaccccgtcgaacagagaggaaacccagcagaagtcaaacctcgaactgctccggatctcactcttgcttatccaatcttggctcgaaccggtgcagtttttgagatcagtctttgccaacagcctggtgtacggagcgtcggactccaacgtgtacgatctgcttaaggacctggaagaaggaatccagactctcatgggtcggctggaagatggctcaccgcgcactggacagatcttcaaacagacctactccaaatttgatacgaactcccacaacgacgacgccctgttgaagaattatggactgctgtactgcttcaggaaggacatggataaggtggaaactttccttcggattgttcaatgccgcagcgtggaaggatcgtgtggcttc

SEQ ID NO: 13331 - DNA, 651 bp, Artificial Sequence
  Description of Artificial Sequence: Synthetic coding sequence
atggcaaccggcagcagaacttcactcctcctcgcgtttggcctcctttgcctgccctggctgcaggagggatcggcgttccctaccatccctctgtcgagactgtttgataacgctatgcttagggctcaccgattgcatcagctcgcctttgacacctaccaggagttcgaagaagcctacatccccaaagaacaaaagtattcgttccttcagaacccgcagaccagcctgtgctttagcgaatcgatcccgactccgtccaaccgcgaagaaactcagcagaagtcaaacctcgagctgctgcggatttcgctgctgctgatccaatcgtggctggaaccagtgcaattccttcggtccgtgttcgccaattcactcgtctacggcgcctcagactctaatgtttacgatcttttgaaggacttggaggaaggaatccaaaccctcatgggtcgcctcgaagatggatctccgcgtacgggtcagatcttcaaacagacttactcgaaattcgacacgaactctcacaatgacgatgccctgcttaagaactacggactgctgtactgtttccgcaaggacatggacaaggtggagactttcttgcgtattgtgcaatgccggagcgtcgaggggtcctgcggcttc

SEQ ID NO: 13332 - DNA, 651 bp, Artificial Sequence
  Description of Artificial Sequence: Synthetic coding sequence
atggctaccggatcccggacttcattactcctggcattcgggctactgtgtctcccgtggcttcaggagggaagtgctttccctaccattcccctctctcggctgtttgacaacgccatgctccgcgctcaccgattgcaccagttggctttcgacacatatcaggagttcgaggaagcctacataccaaaggagcagaagtatagttttttgcaaaatccacagacctcattgtgcttctccgagtcgatccctacccctagtaacagagaagagactcagcagaagtcaaacctggaattgctcagaatctcactgctgcttatccagagctggctggaacctgtccagtttctgaggtccgtgttcgcgaactccttagtgtatggcgccagcgactctaacgtctacgaccttctgaaggacctggaagagggtatccaaacgctcatgggcaggttggaggacggatcacccaggactgggcagatttttaaacagacgtatagcaagtttgatactaattctcacaacgacgatgccttgctcaaaaattatggcctactgtactgtttcagaaaagatatggataaggtggaaacctttctacgcatcgtgcagtgtagatcagtagagggaagttgcggcttc

SEQ ID NO: 13333 - DNA, 651 bp, Artificial Sequence
  Description of Artificial Sequence: Synthetic coding sequence
atggcaaccgggtcccggaccagtttgttattagcattcggtctattatgtctcccctggctgcaggaaggatctgctttccctaccatccctctaagtcgtctgttcgacaacgcaatgcttcgtgcacacaggctacatcaactggccttcgatacataccaggaattcgaagaagcttacattccaaaagaacagaagtatagctttttgcagaacccccagaccagcctgtgtttctctgagtctatacccaccccctctaaccgggaagagacacagcagaagagcaacctggaactactgagaattagtttactactgatacagtcttggttggaacccgttcagttcctacggagcgttttcgccaatagtctggtgtatggcgcaagcgactccaacgtgtatgacctcttgaaagacctagaggaggggatccaaaccctgatgggcagactcgaggatggctctccacgaactggacagatcttcaagcaaacatacagcaaatttgatactaacagccataacgacgacgctctcctgaagaattacgggctcctatactgttttcgcaaggacatggataaggtggaaactttcctgcgcattgtgcaatgtcggtctgtggagggatcctgcggcttt

SEQ ID NO: 13334 - DNA, 651 bp, Artificial Sequence
  Description of Artificial Sequence: Synthetic coding sequence
atggcaaccgggtctagaacctctctgttactggcttttggcctcctgtgtcttccttggcttcaggaagggagtgcctttcccaccatccccctctctaggctttttgacaacgccatgctgagggcacacagactacaccagttggcctttgacacgtatcaagagttcgaagaggcctatattccgaaggaacagaaatacagtttcctacagaacccccaaacctctctgtgcttctctgaatcgatcccaacccctagtaatcgcgaagagacacagcagaaatctaaccttgagcttctgagaatttctctgctgctaatccagtcctggctggagcccgtgcagtttcttaggtccgttttcgccaactccctggtttatggcgcctcggactctaacgtgtacgatctgttgaaggacctggaggaggggatccagactctaatggggcggctggaggatgggtcacctaggaccgggcagatatttaagcagacttactccaaatttgatacgaactcgcataatgatgatgcgctgctgaagaattatggcctcctgtattgttttaggaaggacatggacaaagtggaaactttcctccgcattgttcaatgcagatccgtggaggggtcctgcggcttt

SEQ ID NO: 13335 - DNA, 651 bp, Artificial Sequence
  Description of Artificial Sequence: Synthetic coding sequence
atggccacagggagccgcactagtctccttttggccttcggacttctgtgtctcccatggctccaagagggatcagcattccctactatccctctgagtcgcctgtttgacaacgctatgctacgagctcaccggctgcaccagctagccttcgacacatatcaggaattcgaggaggcatacatcccaaaagagcagaaatatagttttttgcaaaacccacaaacctccctgtgcttctcagaaagcatacccacaccaagcaatcgagaagagacccagcaaaagtcgaacctcgaattactgaggatctccctgttactcatccagtcttggttggagcccgtgcagttcctgcgctcagtctttgccaattccctggtgtacggcgcctcagattccaatgtctacgacctactgaaggatcttgaagagggcatacagacactcatggggcgcctagaggatggatcccccaggacgggccagatcttcaagcagacatactccaagttcgacactaacagccacaatgatgacgcgttgttgaaaaactacggtctgctgtattgctttcggaaggacatggataaggtcgagacattcctgcgaattgttcagtgccgctcggtagaaggttcgtgcgggttc

SEQ ID NO: 13336 - DNA, 651 bp, Artificial Sequence
  Description of Artificial Sequence: Synthetic coding sequence
atggctacaggctcgcgtaccagtctgctattggcatttggtctcctctgtcttccctggttgcaagaagggtcagcattcccgactatcccactatctcgtctattcgacaatgctatgttgcgtgcccaccggctacatcagctggctttcgatacttaccaggaattcgaggaagcttatatccctaaggagcaaaagtactcatttctacagaacccacaaacttcactctgtttttctgaatctatacctacaccaagtaaccgcgaggagactcagcagaaaagcaaccttgaacttttgaggatctccttgctgctaattcagagttggctagaaccggtgcagttcctgcggtctgttttcgcaaacagcctggtctacggtgcctcggattctaacgtttacgatttgttaaaagatcttgaggagggcattcaaacattgatgggtaggctagaggacggatcccctcgcaccggacagattttcaaacagacgtactctaaattcgatacaaactcccataatgacgatgctctgctgaagaattatggcttgctttactgttttcgtaaggacatggataaggtcgaaacttttctccgaattgtccagtgtagatccgttgagggctcctgtggtttt

SEQ ID NO: 13337 - DNA, 651 bp, Artificial Sequence
  Description of Artificial Sequence: Synthetic coding sequence
atggctaccggttcccggacctcattgctcctcgccttcggtctgctgtgtctgccgtggctgcaagagggatcagcattccccactatcccactgtccagacttttcgataacgccatgctccgcgcccatcggctgcaccagctcgctttcgacacgtaccaggagttcgaagaggcgtacattcctaaggagcagaaatactccttcctgcagaacccacaaacctccctgtgctttagcgagtcgatccctaccccctcaaaccgggaagagactcagcagaagagcaacctggagttgctgaggatctctttgctcctgattcaatcttggctggagccagtccagttcctgcggtccgtgttcgccaactccctggtgtatggagcgtcggatagcaacgtgtacgatcttctcaaagacctcgaagaaggaattcaaaccctcatgggacgcctggaggacggcagcccgcgcactggacagatcttcaaacaaacctactccaaattcgacacgaactcccacaatgatgacgcgcttctgaaaaactacggcctgttgtactgctttaggaaagatatggacaaggtggaaactttcctgcggattgttcagtgcagatcggtcgagggaagctgcggattt

SEQ ID NO: 13338 - DNA, 651 bp, Artificial Sequence
  Description of Artificial Sequence: Synthetic coding sequence
atggccactggttcgaggacctctctgcttttggcattcggcctcctgtgccttccctggctgcaagaaggctccgcattccctacgattccactttcgagactgttcgataacgccatgttgcgtgcacaccgacttcatcaactggcatttgacacctaccaggagtttgaagaagcgtacatcccgaaggagcaaaagtacagttttctgcaaaatccccagaccagcctctgctttagcgaatccatcccaactcctagcaatcgagaagagacgcaacagaagtcgaacctggagcttcttcgaatatcactcctgcttattcagtcatggttggaacctgttcaatttctccggtctgtatttgcaaactcactggtctacggtgcgtcggattcgaacgtgtatgacctcctgaaggacctcgaggaagggattcagacccttatgggacgcctggaggacgggagcccacgaaccggtcaaatctttaaacagacctactcgaagttcgatacgaattcccataatgatgatgcgctcctgaagaactacgggcttctctactgttttagaaaggatatggacaaagtggagactttcctgagaatcgtgcagtgtaggtcagtggaaggctcctgtggtttt

SEQ ID NO: 13339 - DNA, 651 bp, Artificial Sequence
  Description of Artificial Sequence: Synthetic coding sequence
atggcaactggatccagaacctccctcctcctggcttttgggctcctgtgtctgccatggctgcaagagggaagcgccttcccgactattccgctctcacggctctttgacaacgccatgttgcgggcacacaggcttcaccaacttgccttcgatacttaccaggagttcgaagaagcatacatcccgaaggaacagaagtactccttcctccaaaatccgcaaacctcactttgcttctcggagtcgattccgaccccatccaaccgggaagaaactcagcaaaagagcaatctggaactgttgcgtatctcactgctgcttatccagtcgtggctggaacctgtgcaattcctgcgctctgtattcgcgaactcgctggtctatggagctagcgatagcaatgtctacgatctgctgaaggatctcgaggaaggcatccagaccctgatggggaggctggaggacggaagcccgagaactggacagatcttcaagcagacctactccaaattcgacactaactcccataatgacgacgcccttctgaagaactacggactgttgtactgcttcagaaaagacatggataaggtggagacttttctccgcattgtgcagtgccgctctgtggagggatcctgtggcttc

SEQ ID NO: 13340 - DNA, 651 bp, Artificial Sequence
  Description of Artificial Sequence: Synthetic coding sequence
atggccaccggcagccgtacctctctgctgcttgccttcggcctgttgtgcctcccatggctgcaggagggaagcgccttccctacaatccctctctcccggttgtttgacaacgccatgctaagggcccatcgcctgcatcagctcgctttcgacacatatcaggagtttgaagaggcatacatccctaaggagcaaaagtactccttcctgcaaaacccacagacgagcctctgtttttcggaaagcatccctacaccttccaaccgggaagagacacagcagaagagcaacctcgagctcctaaggatctctttgctgctaattcagtcttggctggagcctgtgcagttcctgcgctccgtgtttgctaacagtttagtctatggagctagcgattcaaacgtgtacgacctgctgaaggatttagaggagggcatccagacgctgatgggacgacttgaggatggctcccctcggaccggccagattttcaagcagacttatagtaagtttgacaccaactctcacaacgacgatgccttgctgaagaattatggactgctgtattgttttagaaaggacatggataaggttgaaacctttctcaggattgttcagtgcaggagcgtggagggcagttgcgggttt

SEQ ID NO: 13341 - DNA, 651 bp, Artificial Sequence
  Description of Artificial Sequence: Synthetic coding sequence
atggcaactggctcccggacatcgctcctgctcgccttcggattactgtgtctgccctggctgcaggagggaagcgcctttccaacaataccactgtccaggctcttcgacaatgccatgcttcgggctcaccgccttcaccaactagctttcgacacctaccaggagtttgaagaggcttacattccaaaagaacagaaatactcctttctgcagaatcctcaaaccagtctgtgtttttcggagtcgattcccacaccatctaatcgggaggagacacaacagaagagcaacctcgagctgctgagaatctcattgctgttgatccaatcatggcttgaaccggtccaattcctgcgatccgtcttcgccaattcacttgtgtacggggcaagcgatagtaacgtctatgatctgctgaaagatctcgaggaagggatacagaccttaatgggtagactggaagatggctcaccccgcaccgggcagattttcaagcagacctattctaagttcgataccaattcccacaatgacgatgccctgctcaaaaactacgggctgctgtattgctttaggaaagacatggataaagtagaaacctttctccgaatcgtgcagtgtaggagcgttgaggggtcttgcgggttt

SEQ ID NO: 13342 - DNA, 651 bp, Artificial Sequence
  Description of Artificial Sequence: Synthetic coding sequence
atggccactgggtctcggacatcactgctcttggcattcggtctcctgtgcttgccctggctccaagaaggatccgcgttccccacgatacccttgagcaggctttttgataacgctatgctaagagctcaccgtctccaccagctggcctttgacacttatcaagaatttgaggaggcgtacataccaaaagaacagaagtacagttttctccagaacccgcaaacgagcttgtgcttttcggagagcatccctacccccagcaatcgcgaggaaactcaacagaagtctaatctggagctcctgcgcatcagtctactcctgatccaaagctggcttgaaccagtgcagtttttgcgcagtgtgtttgccaattccctagtgtacggggcctcagatagcaacgtatatgatctgcttaaggatctggaggagggcattcagaccttaatgggtaggctagaggacggtagcccacgaactggccaaatctttaagcagacgtactcaaagttcgacaccaactctcacaacgatgacgctctgctgaagaattacggtctgctatattgtttcagaaaggacatggacaaggtagagacatttctacggattgtgcagtgtcgaagcgtcgaagggtcctgcggattt

SEQ ID NO: 13343 - DNA, 651 bp, Artificial Sequence
  Description of Artificial Sequence: Synthetic coding sequence
atggccactgggtcaagaacaagtcttctactggccttcgggctcctatgtttaccctggctgcaggaaggatcagcctttcccactatccccctctctcgactattcgacaacgccatgctgagagcccaccgccttcaccagcttgcattcgatacatatcaggaattcgaagaggcctatatcccaaaagagcaaaaatactcattccttcagaacccccagacaagtttatgcttctcagagagtattcctacaccaagtaaccgagaagaaacacagcagaaatccaatctcgaactgttaagaattagtctgctcctcatacagtcctggctggaacctgtgcagttcctgcgaagtgtttttgcaaattccctggtttatggggcctccgatagtaatgtctatgatcttctcaaagatctcgaagagggaatccagactttaatgggaagactcgaagacggatctcctaggactggacagatttttaaacagacttatagtaaatttgatacaaactctcataatgacgatgctcttctgaagaattatgggctcctctattgtttccgaaaagatatggataaggttgaaactttcctcaggattgtgcagtgcaggtccgttgaaggatcttgtgggttc

SEQ ID NO: 13344 - DNA, 651 bp, Artificial Sequence
  Description of Artificial Sequence: Synthetic coding sequence
atggcgacggggagcaggaccagcctccttctggcttttggactcctctgtctgccatggctccaggaaggatcagccttccctactatcccactctctcggctgttcgataacgcgatgctccgcgcccaccgcctgcatcaattggcattcgacacgtaccaagagttcgaagaagcatacattccgaaagaacagaagtactcatttctgcaaaacccacagacctcgctctgcttctccgagagcattccgactccgtccaacagggaagaaacccaacagaaaagcaacctggaattgctgcgcatcagcctgctgttgatccagtcatggcttgagccggtgcagttccttcgatccgtgttcgccaactcgctcgtgtatggagctagcgactccaatgtgtatgatctgcttaaggaccttgaggaaggcattcaaactcttatgggacgtctggaggatggatcaccgcggactggacagatctttaagcagacttactccaagtttgataccaactcccacaatgatgatgccctgctgaagaactacggcctcctttactgcttcagaaaagacatggacaaagttgagacgttcctgagaatcgtccagtgcaggtcggtggaaggctcctgtgggttt

SEQ ID NO: 13345 - DNA, 651 bp, Artificial Sequence
  Description of Artificial Sequence: Synthetic coding sequence
atggccacgggttcgagaaccagcctgctgctggctttcgggctgctgtgccttccctggttgcaggagggatccgcgtttccgactatccccttgtcgcggctctttgacaatgccatgcttagagcgcatagattgcatcagctggcgtttgatacctaccaagagttcgaggaagcatatatccccaaagaacaaaagtactcattcctccagaacccgcagacttcgctctgcttctccgaatcgatccctaccccttccaatagggaagaaacccagcagaaatcgaacctcgaactcctgcggatctctctgcttctcatccaatcatggctggagccggtccagtttctgagatctgtgttcgctaattcactggtctacggcgcgagcgactccaacgtgtacgacctgctgaaagacttggaagaaggcatccaaaccttgatgggtcgcctggaggacggctcacctcggactggccagatcttcaagcaaacctacagcaaattcgacaccaattcgcataacgacgacgcactgctcaagaattacggcctcctgtactgcttcagaaaggatatggacaaggtggaaactttccttcgcatcgtgcagtgtcggagcgtcgaaggaagctgtggcttc

SEQ ID NO: 13346 - DNA, 651 bp, Artificial Sequence
  Description of Artificial Sequence: Synthetic coding sequence
atggcgactgggtcccgcacgtcgctgctgctggcatttggactgctgtgcctgccctggctgcaggaaggatcagccttcccgaccattccgctgtctcggctgttcgacaacgccatgctcagagcccatcgcctgcatcagctggcctttgacacctaccaggaattcgaggaggcgtacatcccaaaggagcagaagtacagtttcctgcagaacccacaaacttcgctgtgtttttccgagtcaatcccgaccccttcaaaccgggaagaaacccaacaaaagtccaatctggaactgctccggatttcccttcttctgatccaatcgtggctggagcccgtgcagtttctgaggagcgtctttgccaattccctcgtgtatggagcatccgactcaaacgtgtacgatctcctgaaggatctggaggagggaatccagacccttatgggcagactcgaggatgggtcgccgcgcaccggacagatcttcaaacagacttacagcaagttcgatactaactcccacaacgacgacgccttgttgaagaactacggattgctgtattgcttccggaaagatatggataaggtcgagactttcctgcgcatcgtacagtgcagaagcgtggagggctcgtgtggtttc

SEQ ID NO: 13347 - DNA, 651 bp, Artificial Sequence
  Description of Artificial Sequence: Synthetic coding sequence
atggctactggatctcgcactagtcttctcctcgcttttggactgttgtgcctcccttggcttcaagaaggatccgcatttcctaccattcctcttagccgcctctttgataatgcaatgcttcgggctcacaggctgcaccaactggcatttgacacataccaagagttcgaggaagcctacattccaaaggaacagaagtacagctttttacagaacccccagacttccctatgcttcagtgagagcattccaacaccatccaatcgcgaggagacccagcagaaaagtaatctagaactgctgaggatcagcctgctgctcatccagtcttggctggaacccgtgcagtttctgaggagcgttttcgcgaactcattagtttacggcgcctctgattccaatgtttacgaccttctgaaagatttggaggaagggattcagacactgatgggccgtctggaggacggcagtcccaggacaggacaaatctttaagcaaacttatagtaagttcgacaccaattcacacaacgatgatgctctgctgaaaaattatggactcttgtactgctttagaaaggatatggataaagtcgagactttcctccgcatcgtgcagtgtaggagcgtggaagggagctgcgggttc

SEQ ID NO: 13348 - DNA, 651 bp, Artificial Sequence
  Description of Artificial Sequence: Synthetic coding sequence
atggcgaccggcagtaggactagcctgttgcttgccttcggccttctctgcctcccctggctgcaggagggctccgcgtttccaaccatccctctgtctcggctgttcgacaatgctatgcttcgcgcacacagacttcaccagttggcttttgatacctatcaggagttcgaagaagcctacataccaaaggagcagaaatattccttcctgcagaatccacagactagcctctgtttcagtgaaagcattccaactccctctaatcgtgaggaaactcagcagaagtccaatctagagcttctccgcattagcctgctcctgatccaatcttggctggaaccggtgcagtttctgcgcagtgtattcgcgaacagtctggtctacggggcttcagacagtaacgtctatgacctgctgaaagatctggaggagggcatacaaacattgatggggcgattagaggatgggagcccacgtactggccaaatctttaaacagacttattccaaatttgatactaacagccacaatgatgatgccctactcaagaactatggactgctgtactgctttcggaaggacatggataaggtcgagacttttctaaggatcgtgcagtgtcgctcagtggaaggttcttgtgggttc

SEQ ID NO: 13349 - DNA, 651 bp, Artificial Sequence
  Description of Artificial Sequence: Synthetic coding sequence
atggcaacagggagcagaacttctctcctcctggcttttggcttgctctgcttaccttggctgcaggaaggcagtgcttttcctacgattcctctgtcacgcttattcgacaatgccatgctaagagcgcacagactccaccaactcgcattcgacacctatcaggagttcgaggaggcatacataccaaaagagcagaagtactcttttctacaaaacccccagacatctctttgcttttcggagtcgattccaaccccctctaaccgggaagaaacccagcagaaaagcaacctggaactgctgcggatctcactactcttgatccagtcttggctagaaccggtgcagttcttgaggtcggtttttgcaaattctttagtttacggggcctcagactcaaatgtatacgatctcctgaaagatcttgaagaagggatccagaccctgatgggcagattggaggatgggtctcctcgaaccggacaaatttttaagcagacatatagcaagtttgacactaattcacacaatgacgacgctctgctgaagaattacggactactctattgctttcggaaagacatggacaaagttgagacattcctgaggattgttcagtgtcgcagcgtggaaggatcctgcggcttc

SEQ ID NO: 13350 - DNA, 651 bp, Artificial Sequence
  Description of Artificial Sequence: Synthetic coding sequence
atggcgacgggctcgcgcacttccctcctccttgccttcggtctgctgtgccttccttggctgcaggaggggtcggcgttccccactatcccactgagcaggttgttcgataacgcgatgctcagggcacacaggttgcatcaactggccttcgacacctaccaagagttcgaagaggcttacatcccgaaagagcaaaagtacagctttctgcagaacccccaaacctccctgtgtttctccgaatccatcccaactccctctaaccgggaggaaactcagcagaagtcgaacctggaactgcttcgcatcagcctgctcctcatccagtcgtggctggagccggtgcagtttcttcggtcagtttttgcaaacagccttgtctacggggcctccgactcgaacgtctacgatctcctcaaggacctggaagaaggcatccagactctgatgggaaggcttgaggacgggtccccccgcaccggacagattttcaagcagacctacagcaagtttgacactaattcccacaacgacgacgcccttctcaagaattacggactgctgtactgcttccgcaaagacatggacaaggtggaaactttcctccgcatcgtgcaatgcagatcggtggaaggttcctgcggcttc

SEQ ID NO: 13351 - DNA, 651 bp, Artificial Sequence
  Description of Artificial Sequence: Synthetic coding sequence
atggctactggctcccggactagccttctcctcgcgttcgggcttttgtgtctgccatggcttcaggagggatccgccttccccacgattcctctgtcgaggttgttcgataacgctatgctgcgggcacatcggctgcaccaactggcattcgacacataccaggagttcgaggaggcttacattcctaaggaacagaagtacagttttctgcaaaatccgcagacctcactctgcttcagcgaatctattccgaccccctctaatagggaggagacacagcagaagagcaacctcgagctcctgcgaatctccctcctgttgattcagtcatggctcgaaccggtccagtttcttcggtccgttttcgccaacagcctggtctacggagcctccgattccaatgtgtatgatctcctaaaggatttggaggaaggaattcagaccctcatgggcaggctcgaggacgggagccctcggactgggcagatttttaaacagacatattcaaaattcgatactaattcccacaatgacgacgcgctgctcaagaactacggcctcttatattgcttcaggaaagatatggacaaagtggagactttccttaggattgtccagtgcaggtctgtggagggctcgtgcggcttc

SEQ ID NO: 13352 - DNA, 651 bp, Artificial Sequence
  Description of Artificial Sequence: Synthetic coding sequence
atggctaccgggtcgcgcacctctctgttgctcgccttcgggctcctgtgcctgccgtggctccaagagggatcggccttccctactattccgttgagcaggctgttcgataatgctatgctccgggcgcaccggctgcatcagttggcgtttgacacctaccaggaattcgaagaggcctacatcccgaaggaacaaaagtactccttcctccagaaccctcaaacctccctgtgcttttctgaaagcatacctaccccatccaaccgcgaggaaactcaacagaagtcgaatctggaattgctgagaatctccctgcttctcatccagagctggctcgagccggtgcaatttctccgctcagtgttcgcgaactcgctggtgtacggagcatcggacagcaacgtgtatgaccttctcaaggacttggaagaaggaatccagactctgatgggtcggctcgaggacggctcaccaagaaccggccagatcttcaaacagacttactctaagttcgacactaattcacacaacgatgatgccttgctgaaaaactacggccttctgtactgctttcgcaaggacatggataaagtcgaaacgttcctcagaatcgttcagtgtagatccgtcgagggttcttgtggcttt

SEQ ID NO: 13353 - DNA, 651 bp, Artificial Sequence
  Description of Artificial Sequence: Synthetic coding sequence
atggccacgggctcccgcactagccttttgctggccttcgggctgctatgcttgccctggctgcaggaagggagcgccttccccacaatccctttgagcaggctttttgataacgcgatgttgagggcacacagattgcaccagttggcatttgatacgtatcaagagtttgaggaggcctacattcccaaggagcaaaaatattcatttctccagaatcctcagacctccttgtgcttctctgagtccattccgacccctagcaatagggaagaaacccaacagaagtcaaaccttgagttgctccgtatatctcttctgctcatccagtcttggctcgaaccagtgcagtttctgcggtccgttttcgccaatagcctcgtgtatggcgcgtccgacagcaacgtgtatgaccttctaaaggatcttgaagagggaatccagacgttaatgggccgcctagaagacgggagtccacgaactggtcaaatcttcaaacagacttatagcaagtttgatacaaacagtcataatgatgacgcccttctcaagaactacggactactgtactgctttaggaaggatatggataaggtagagaccttcctacgcatcgttcaatgccgctctgtggaagggtcctgcggcttt

SEQ ID NO: 13354 - DNA, 651 bp, Artificial Sequence
  Description of Artificial Sequence: Synthetic coding sequence
atggccactggatccaggacctcactgctgctggcctttggtctgctttgcctgccatggctgcaagagggttcggcgtttccaaccattcctctctcacgcctgtttgacaacgcaatgttgcgcgcgcatcggctgcatcagctggcgtttgacacgtatcaagagttcgaagaagcctacattccaaaggaacaaaagtacagctttctgcaaaaccctcaaacttccctttgtttttctgaatcgataccgactccctcaaacagggaagagacgcagcagaaatcgaaccttgaacttcttcgtatctcgctgctcttgatccaatcctggctcgaaccagtccaattcctcagatccgtgtttgcgaactcacttgtctacggagcctccgattcaaacgtgtacgatctccttaaagacttggaagagggtattcagactcttatgggacgccttgaggatggttcacctaggaccgggcagatctttaagcaaacctacagcaagttcgacactaactcccataacgacgatgcactgctgaagaattacggacttctgtactgctttagaaaggatatggataaagtggaaacgttcctcaggatcgtccagtgtagatcagtcgaaggttcgtgtgggttt

SEQ ID NO: 13355 - DNA, 651 bp, Artificial Sequence
  Description of Artificial Sequence: Synthetic coding sequence
atggctaccggaagcaggacctctctgctcctggcatttgggcttctttgtttgccttggcttcaagagggttccgcatttcctaccattccgcttagccgcttgttcgataacgcgatgcttcgagctcatcgactccatcaactggcattcgacacctaccaagaatttgaagaagcatacattccaaaggaacagaagtactcatttctccaaaatccacagacttcactgtgtttttcagagagcatcccaactccctcgaacagggaggaaactcagcaaaaatcaaatctcgagctgcttaggatttccctccttcttatccaatcctggctggaacctgtgcagttccttcggtctgtgtttgcaaactcgctggtctacggagcgtcggactctaacgtgtacgatctgctcaaggatctggaagaagggattcaaactctcatgggacgattggaagatgggtccccgcggaccggacaaatcttcaagcagacgtactcgaaattcgacaccaattcccacaatgatgatgcccttcttaagaactacggcctcctgtattgttttcgcaaggatatggacaaagtggagacttttctcagaatcgttcaatgccgctcggtcgagggaagctgcggcttt

SEQ ID NO: 13356 - DNA, 651 bp, Artificial Sequence
  Description of Artificial Sequence: Synthetic coding sequence
atggcgacgggttcgcgtacctccctcctcctggccttcggccttctgtgcctgccatggctccaggagggatcggcattcccgaccattccactctcgcggctgttcgacaatgccatgctccgcgctcaccgcctgcaccagctggccttcgatacttaccaagaattcgaggaggcctacatccctaaggaacagaaatacagcttcctccagaatccccaaacctcactgtgtttctcagagagcattccaacgccttcgaaccgcgaggagactcaacagaagtcaaacttggagctgttgcggatctcgctgctgctcatccaatcgtggctcgaaccagtgcaattcctgcggtccgtgttcgcgaactccctggtgtacggagcatcagattccaatgtgtacgacctccttaaagacttggaggaaggtatccagacccttatgggaagattggaggacggcagcccgcgcactggacagatattcaagcagacctacagcaaattcgataccaattcgcacaatgatgacgcgctgctgaaaaactacggactgctgtactgtttccgaaaagatatggacaaggtcgaaaccttcctgaggattgtccagtgcagatcagtggagggatcctgcggcttc

SEQ ID NO: 13357 - DNA, 651 bp, Artificial Sequence
  Description of Artificial Sequence: Synthetic coding sequence
atggctaccggcagtagaaccagcctgctcctcgccttcgggctgctctgtctgccttggctccaagaaggttccgcatttcctactatcccgcttagtagactgttcgataatgctatgttacgggctcatagattgcatcagttggcatttgacacgtatcaggaatttgaagaggcttacatcccgaaagagcagaagtactcatttctgcagaacccacagaccagtttgtgcttcagcgagtcaatccccacaccctccaaccgcgaggagacgcagcagaaaagcaacctggagcttcttagaatttcgctcctgctgattcagagctggctggagcctgtacaattccttagatctgtgttcgccaacagtctggtgtacggcgcttctgattccaacgtatatgatcttctaaaagacctggaggaggggattcagacgctgatgggtcggctcgaggatggttccccacggaccggtcagatctttaagcagacatacagcaagttcgacactaacagccataacgatgatgctttactgaagaattacggactgctctattgctttaggaaggatatggacaaagtggaaacctttctcaggatcgtgcagtgtagaagcgtggaagggtcctgtggattc

SEQ ID NO: 13358 - DNA, 651 bp, Artificial Sequence
  Description of Artificial Sequence: Synthetic coding sequence
atggcaaccggatctcgcacttcattgttgctggctttcgggctcctctgcctgccctggcttcaagaaggatctgcattccctaccattcccttgtcccgtcttttcgataatgccatgctgcgagcacaccgactgcaccagctggcttttgatacctaccaggagtttgaggaggcgtatatcccaaaggagcagaagtacagtttcttacaaaatcctcagacctcgttgtgtttctctgaatcaataccaaccccaagcaacagggaggagacacagcagaagtccaatcttgaacttctgcggatatccctcctgctgatccaaagctggctggaaccagtgcaatttctgagatctgtgttcgctaacagtcttgtttatggagcctccgacagcaacgtttacgacctgctgaaggacctggaagaggggatccagacgttaatgggaaggcttgaggatggatcccctcgaacaggccaaatttttaagcaaacttactctaagtttgataccaactctcacaatgatgacgctctcctgaagaattatggtttgctgtattgcttcagaaaagacatggataaagtggagacatttttgcgcattgtgcagtgccggagcgtggagggaagctgtggattc

SEQ ID NO: 13359 - DNA, 651 bp, Artificial Sequence
  Description of Artificial Sequence: Synthetic coding sequence
atggccactggcagcagaacttcactattgcttgctttcgggctgctttgtttgccctggcttcaagagggctctgcgtttcccacaatccctctcagcagattgtttgataacgccatgctgagagcccaccgtcttcaccagttggcattcgacacgtaccaggagttcgaggaggcttacatccctaaagagcaaaaatacagcttcctgcagaatcctcaaacaagcctgtgcttttcagaaagtatcccaacacccagtaatagagaagagactcagcagaagtctaacctagaactgctgagaataagcctgctcctcatccagtcttggctggaaccagttcagttcctgaggtctgtgttcgccaactccctagtctatggggcatcagacagcaatgtgtatgaccttctgaaggatttggaggagggcattcagactttaatggggcggttggaggatggcagtccaagaacaggacagattttcaagcaaacttactcgaaatttgacacgaacagtcataacgatgacgctctgttgaagaattacgggctgctgtattgctttcggaaagatatggataaggtggagactttcctgcggatcgtccaatgtcgcagcgtcgaaggcagttgcggcttc

SEQ ID NO: 13360 - DNA, 651 bp, Artificial Sequence
  Description of Artificial Sequence: Synthetic coding sequence
atggctactggatctagaacgagtttacttttggcatttggacttttatgtttaccatggcttcaagaaggatctgcttttccaacgataccattatcaagacttttcgacaatgctatgcttagagcacatagattgcatcaacttgcatttgatacatatcaagaatttgaagaagcttatattcctaaagaacaaaaatatagttttttacaaaacccacaaacatctctttgtttctcagaatctattcctacaccatcaaacagagaagagactcaacaaaaatctaatcttgaattacttagaatttctcttttattaattcaatcatggttagaacctgttcaatttcttagaagcgtcttcgcaaatagtttagtatatggagcaagtgattctaatgtttatgatttacttaaggaccttgaagagggtattcaaactttaatgggacgattagaagatggaagtccaagaacaggacaaatttttaaacaaacatatagtaaatttgatactaactctcataatgatgatgcattgttaaaaaactatggattactttattgtttcagaaaagatatggataaagttgaaacatttcttagaattgttcaatgtagatctgttgagggtagttgcggattc

SEQ ID NO: 13361 - DNA, 651 bp, Artificial Sequence
  Description of Artificial Sequence: Synthetic coding sequence
atggctacgggctcccgtacgagtctgctactggcgtttggtttgttgtgtctgccctggttgcaggaaggctcggccttcccaacgatccctctctcccgactgttcgataatgccatgctgcgcgcccaccgccttcaccaacttgccttcgacacatatcaggagttcgaggaggcctacatccctaaggaacagaagtactccttccttcaaaacccccagacttccctgtgctttagcgagtctatccccactccgagtaaccgtgaggagacccagcagaaatcgaacctagaactcctccgcatcagcctcttgttgattcagagctggctggagcccgtccagtttctgcgctccgtcttcgcgaattcgttggtctacggagccagcgactcgaacgtgtacgacctcctgaaggacttggaggagggcattcaaacactcatgggacgtttggaggatggatccccccgcaccggccaaatctttaaacagacctacagcaagtttgataccaactcccataatgacgatgccttgctgaaaaactacggccttctatattgctttagaaaggacatggataaagtggagaccttccttcgtatcgtccagtgccgttctgtagagggttcatgtggcttc

SEQ ID NO: 13362 - DNA, 651 bp, Artificial Sequence
  Description of Artificial Sequence: Synthetic coding sequence
atggccaccggttcccggacgagcctcttgttggcattcggacttctctgcctgccgtggctgcaggagggatcagcctttcctaccatcccattgtcacggctgttcgataatgccatgctccgcgcacatagactgcatcaactggctttcgacacgtaccaggaattcgaggaggcctacatcccgaaggaacagaagtactccttcctccagaatccccagacctccctgtgtttctcagagtccatcccgactccatcgaatagagaggaaactcagcaaaaatccaacttggaactcctccggatctcccttctgctcatccagtcctggttggaaccggtgcaattcctgcggagcgttttcgcgaattcgctggtgtacggggcttcggacagcaacgtctatgacctgctcaaggacctcgaggaaggcattcaaactctgatgggtcgcctggaagatggaagccctcggaccggtcagatcttcaagcagacttattctaagttcgacaccaactcgcataacgatgatgctctgcttaagaattacggactgctgtactgcttccgcaaggatatggataaggtcgaaactttcttgcgcatcgtccagtgccgctcagttgagggatcctgcggattt

SEQ ID NO: 13363 - DNA, 651 bp, Artificial Sequence
  Description of Artificial Sequence: Synthetic coding sequence
atggccaccggctcacgtacctcgttgctcctggctttcggactgttgtgtttgccgtggctacaagaagggtctgcttttccgaccattcccctgagtaggctgtttgataacgcaatgttgcgggcgcatagattgcatcagcttgcctttgacacctatcaagagtttgaggaagcatacatccctaaggaacaaaagtattcatttctacaaaatcctcaaacaagcttatgcttttccgaaagtattcctacaccgtccaacagagaagaaacccagcaaaagtctaatctggaattattaagaatttctctgttactgatccaatcctggcttgaaccggtgcagttcttaagatctgtgttcgcgaattcgctcgtttatggagcttcggattccaatgtttacgatcttttgaaagacctggaagaaggcattcagacgcttatgggccgtctcgaagatggaagcccgcgaacgggccagatctttaaacaaacttacagcaagtttgacacgaattcacataacgatgatgcgctacttaaaaattacggtttgttgtattgctttaggaaagatatggacaaagttgaaacgtttctccgtatcgtacagtgcagatcggtggaaggaagttgcggattt

SEQ ID NO: 13364 - DNA, 651 bp, Artificial Sequence
  Description of Artificial Sequence: Synthetic coding sequence
atggcaaccggatcaagaacctctcttctcctggcatttggactcctgtgtctgccctggctgcaagagggcagcgccttcccgaccattccactttccaggctgtttgacaatgccatgctgcgcgcacatagacttcatcaactcgccttcgatacctaccaggagtttgaggaagcgtacattccaaaggagcaaaagtactcatttcttcagaacccacagacctcactgtgttttagcgaaagcatcccaactcctagcaatcgggaggaaactcaacaaaagtcgaatctggagctcttgcggattagcctgcttttgattcaatcctggttggaacccgtgcagttcctgcggagcgtctttgcgaactcgttggtgtacggagcatcggactccaacgtctacgacctgcttaaagatctggaagagggcatacagaccttgatggggcgtctggaagatgggtcgcccaggaccggtcagattttcaaacagacctacagcaaatttgacaccaactcgcataatgatgatgcacttcttaagaactacggacttctctactgcttccggaaagacatggataaggtggaaacttttctgcggattgtgcagtgtcgcagcgtggaaggttcttgcgggttt

SEQ ID NO: 13365 - DNA, 651 bp, Artificial Sequence
  Description of Artificial Sequence: Synthetic coding sequence
atggccacaggtagtcgaacttccctgctactggcgttcggtctgctgtgtctcccttggctgcaagagggtagcgccttcccgaccataccgctctcgcggctcttcgataatgccatgttgagagcacaccgactccaccagcttgcatttgacacgtaccaagagttcgaagaggcgtacatcccgaaggagcagaaatattcgttccttcaaaatccccagacctctctctgtttctccgagagtatccccaccccgtcaaatcgtgaggaaacgcagcagaagagcaatctcgagctcttgcgaatcagcctgctactgatccagagttggttggagccagtccagttcctgagatctgtattcgcaaattcgttggtctatggcgcctcagacagcaatgtgtacgatcttctcaaggatctggaggagggcatccagacactcatgggcaggctcgaggatggctccccgcggacaggacagattttcaagcaaacttacagcaaattcgacaccaactcgcacaatgatgacgctcttttgaagaattatggcctgctatactgttttcggaaagacatggacaaggtagaaaccttcctgaggattgtgcaatgccgctcggtggagggctcctgcggtttc

SEQ ID NO: 13366 - DNA, 651 bp, Artificial Sequence
  Description of Artificial Sequence: Synthetic coding sequence
atggcgaccggcagccggacctcgctgctgctggccttcggactcttgtgccttccctggttgcaagaaggatcagcatttcctaccatcccactgagccgactgttcgacaatgcaatgcttagggcacatcggcttcaccaattggccttcgacacctaccaagagtttgaggaggcgtacatccctaaagagcaaaagtattcctttctgcagaacccccagacgtcactttgtttttcggagagcattcctactccttccaatcgtgaagaaactcaacagaagagcaacctggagctgttgcggattagcctcctgctgatccagtcctggcttgaaccagtccagtttctgcgatccgtgtttgcaaattcgctggtgtacggagcatccgatagcaacgtctacgatctgctcaaggacctggaagaaggaattcagaccctgatgggcagactcgaagatggatcacctagaacgggccagatcttcaaacaaacttactccaagtttgataccaactcccataatgatgatgccctgcttaagaattacggcctcctctactgtttccgcaaggacatggataaggtggagacgtttctccgcattgtccagtgccggtcggtggaaggatcatgtggtttt

SEQ ID NO: 13367 - DNA, 651 bp, Artificial Sequence
  Description of Artificial Sequence: Synthetic coding sequence
atggccaccggctcccgaacgtccttgttgcttgcctttggccttctttgccttccgtggcttcaggaaggttcagcgtttcctaccatcccactttcacgtctctttgacaatgcaatgcttcgcgcacatcgactccatcaactcgcgttcgacacttaccaagagtttgaggaagcatacattccaaaggagcaaaagtacagctttctgcaaaacccacaaacctcactttgtttttccgaatcaattccgacgccttcaaacagagaagaaactcagcagaaaagcaatctggaactgctgcgtatttccttgcttttgattcagtcgtggttggaacctgtccaattcttgcggagcgtgtttgcgaactcgttggtgtatggtgcctcggactcgaacgtgtacgatctcctgaaagatctggaagaagggattcaaactctgatgggaaggctggaggatggctcgccgcgtaccggacaaatcttcaagcagacctacagcaaattcgatacgaactcccacaacgatgacgcactgctgaagaattacggattgctctactgttttagaaaggatatggataaggtcgaaacttttctgcgaatcgtgcaatgcagaagcgtcgaagggtcgtgtggattt

SEQ ID NO: 13368 - DNA, 651 bp, Artificial Sequence
  Description of Artificial Sequence: Synthetic coding sequence
atggccactggctccagaacaagcctgttgttggcattcggcctgctatgcctgccttggttacaagaaggaagtgccttccctacaatccccctttcgcggttgtttgacaacgctatgcttcgcgcacacaggttacaccagctggcgttcgacacctatcaggagtttgaggaggcctacatccccaaggagcagaagtactctttcctgcagaaccctcagaccagcctgtgtttcagcgagagcatccccactccttctaatcgagaggaaacacaacaaaagtccaatcttgaactgctcagaatctctctactcttgatccaaagctggctggagcctgttcagtttctccgatcagtcttcgccaattcactcgtttatggggccagtgactctaacgtttatgatctgcttaaggatctcgaagagggcattcagactctgatgggaaggctggaggacggaagcccccgaacaggtcagatattcaagcaaacctactctaagtttgatactaactctcacaatgatgacgccctcctcaaaaactacgggctgctgtactgcttccgcaaggatatggataaagtggaaacatttctcagaatagtgcagtgtagaagcgtggagggcagttgtggtttc

SEQ ID NO: 13369 - DNA, 651 bp, Artificial Sequence
  Description of Artificial Sequence: Synthetic coding sequence
atggctactgggagcagaacaagcctactgcttgcttttggattgctgtgtctgccatggctccaggagggctcagcctttccaacgatccctctttctagactgttcgataatgccatgctgagagcgcatagactgcatcagctggcatttgacacctaccaagagtttgaggaggcatacatccctaaagagcaaaagtatagctttctccagaacccacagacatccctctgcttttctgaatccatcccgactcctagcaacagggaggaaacccagcagaagagtaacttagaactccttagaataagtctactcctgattcagagctggctggagcccgtccagtttctcaggtctgtttttgccaacagcctggtgtatggagctagcgatagcaatgtgtatgacctcctgaaggatctcgaagaggggatccagaccctcatgggaaggctggaggacggcagcccaagaacaggccagatatttaagcagacttactcaaaattcgacacgaatagccacaacgacgatgcgcttttaaagaactacggactactctactgcttcagaaaagatatggacaaggtcgagacttttttacggatagtgcagtgtaggagcgtggaaggcagttgcggtttt

SEQ ID NO: 13370 - DNA, 651 bp, Artificial Sequence
  Description of Artificial Sequence: Synthetic coding sequence
atggcaaccgggagccggactagcctacttctcgcatttgggttattatgcttgccttggctgcaggagggtagtgctttccctacaattcccctgagccgtcttttcgataatgctatgcttagggcacatcggctccatcagttggcctttgatacctatcaggaatttgaagaagcatatatccctaaggaacagaagtatagttttctgcagaaccctcagacctctctgtgcttttcagaatccataccaaccccaagcaaccgagaagaaacacagcagaaaagcaatctggagctcctgaggatctctctcctgctgatacagagctggcttgagcccgttcagttcctgcggagcgtgtttgccaacagcctggtttacggcgcctccgattccaatgtatatgacctgttgaaagacctggaggagggcatacaaacactgatgggaagactggaagatggaagcccgcggacgggacaaatttttaaacaaacttactccaagttcgacactaattctcataatgacgatgcgctcctgaagaactacggactgctatattgtttcaggaaggatatggataaagtagagacctttttaagaatcgtccagtgccgcagcgtcgaagggtcatgtggattt

SEQ ID NO: 13371 - DNA, 651 bp, Artificial Sequence
  Description of Artificial Sequence: Synthetic coding sequence
atggccactgggtcccgaacctctttactattggctttcgggttgctgtgcctgccgtggctccaggagggatctgcatttcctaccattcccctctccaggttgtttgataatgcaatgctcagagcccacaggctgcatcaattggcgttcgacacttaccaggaatttgaggaagcttacataccaaaggagcaaaaatattcatttttacaaaaccctcaaacttctttgtgttttagcgaatcaattccgacaccttctaatcgggaagagacacagcagaagagcaacctggaactcctccgcatctcactgctcctgatccagtcctggctggaaccagttcagttcctcaggagcgtgtttgccaactcactcgtttatggggcctcagattccaatgtctacgatcttcttaaagacctggaggaggggatacaaaccctaatgggaagactggaagacggctcaccaagaacgggacagatcttcaaacagacgtatagcaagtttgacacaaacagccacaatgatgacgctctgttaaaaaattatgggctcctgtattgttttaggaaagatatggataaggtggagacttttctgcgaatcgtacagtgtcgaagtgttgagggctcttgtgggttt

SEQ ID NO: 13372 - DNA, 651 bp, Artificial Sequence
  Description of Artificial Sequence: Synthetic coding sequence
atggccaccggctctaggacttcattgctactggcattcggactgctgtgtttgccttggctgcaggagggtagcgcatttcccacgatcccgctgagcagactgttcgacaatgctatgctgagggcacacaggttacaccagctggcattcgatacctaccaagaattcgaggaggcttacatacctaaagaacaaaagtactcattcctgcagaatccgcagacaagcctttgcttttctgagtcaattccgaccccctcaaatcgtgaggagacccagcagaaaagcaatctggaacttctgcggataagcctgctgctgattcagagttggttggagcctgtgcagttcctgcgcagcgtctttgcaaatagtctggtgtatggcgctagtgattcaaacgtgtacgacttactgaaagacctggaggaagggatccagaccctgatgggccgtctggaggacggctccccaagaactggtcagatctttaaacaaacctactctaagttcgataccaactcacacaacgacgacgccttgctcaagaattacggactcctgtactgctttaggaaggatatggataaggtggagacttttctgcggatagtccagtgcaggagcgttgagggatcatgcgggttt

SEQ ID NO: 13373 - DNA, 651 bp, Artificial Sequence
  Description of Artificial Sequence: Synthetic coding sequence
atggcaaccggttcacgaacctcattgcttctcgcctttggactgctgtgccttccatggctgcaagaaggaagcgcatttccaaccatccctctttcgcggttgtttgataacgcaatgctgcgtgctcatagactccatcagctcgcatttgacacttaccaggaatttgaagaggcgtacattccaaaagaacagaagtactctttcctgcaaaatcctcagacctccctgtgcttctcggaatcaatccccactcccagcaaccgggaggagactcaacaaaaatcaaacctcgaacttctgcgtatctccctgctccttatacaatcctggttggaaccagtgcaatttcttcggtcggtgtttgccaactcgctggtgtacggcgcgagcgactcaaacgtttacgatcttcttaaggatctcgaagaaggtattcagactctgatgggtaggctcgaggatggttcaccaagaaccggtcagatattcaaacaaacttactcgaaatttgataccaattcccataatgatgacgcacttttgaaaaactacggccttctctactgttttcgcaaggacatggataaagtggagacttttctgcgaatcgtccagtgccgctcggtcgagggctcgtgtggattt

SEQ ID NO: 13374 - DNA, 651 bp, Artificial Sequence
  Description of Artificial Sequence: Synthetic coding sequence
atggcaaccggatcgagaacgtcgctgctgcttgcatttggtctgctctgccttccttggctccaagaaggtagcgcatttcctaccattcccctgtcaagactgtttgacaatgccatgctccgagcccaccgcctgcatcaacttgcatttgatacctaccaggaatttgaagaagcgtacattcctaaagagcagaagtactcatttctccaaaatccacagacttccttgtgtttttcagaaagcataccaaccccttctaatagggaagaaactcagcagaagtcgaacctggagttgctccggatctcgctgcttctgatccagtcatggcttgagcccgtgcaatttctgcggtcggtctttgcaaattcactggtgtacggggcctcggatagcaacgtgtacgatctgctgaaggatttggaagaaggaatacaaacgctcatgggccgtctggaagatggctcgcctagaaccggtcaaatcttcaagcagacttactctaagtttgacactaattcacataacgatgatgccctcttgaagaactacggactgctctattgtttccgaaaagatatggataaggtggaaacttttctgcgcattgttcagtgtcgatccgtcgaggggtcctgtggcttc

SEQ ID NO: 13375 - DNA, 651 bp, Artificial Sequence
  Description of Artificial Sequence: Synthetic coding sequence
atggccaccggtagccggacgtcgttgctgctcgcatttgggctgttgtgtctgccctggcttcaggagggatcggccttccctaccatcccactctcgagacttttcgacaacgccatgctgcgagcacataggttgcatcagcttgcattcgatacttaccaagaatttgaagaagcctacataccaaaggagcaaaagtactcgtttctgcaaaaccctcagacctccctgtgttttagcgagagcattcccaccccctccaacagggaggagactcaacaaaagagcaacttggaactcctccgcatttccctcctgcttattcagtcatggctggaacccgtccaatttcttaggtcagtatttgccaattcgttggtgtacggcgcaagcgactccaacgtgtacgatctgcttaaagacttggaggaagggattcaaactcttatgggacgacttgaagatgggagcccgcgcaccggacagatattcaagcagacctactcaaagtttgatactaattcgcacaatgatgatgcactccttaagaactacggcctgctgtattgcttcagaaaagacatggataaagttgaaacgtttcttcgcatcgtgcaatgccggtccgtggagggttcatgtggtttt

SEQ ID NO: 13376 - DNA, 651 bp, Artificial Sequence
  Description of Artificial Sequence: Synthetic coding sequence
atggctactggaagtaggacatctctcctcctggcctttggtctgctctgcttgccctggttgcaggaaggatctgcattcccaactatcccgctgagcaggcttttcgataacgcaatgctgagggcccacaggctgcatcagctggcgtttgatacctaccaagagttcgaggaggcctacatccccaaagagcagaagtactcttttctccaaaaccctcagacaagcttgtgtttctcagagagtatcccgaccccatccaacagagaggaaactcaacagaagagcaacttggagctgctcagaatatcactgttgttgatccagtcatggttggaacccgtccagtttttgaggtcagtgttcgcgaatagtctggtgtacggcgcctctgattctaacgtgtacgatctgctgaaggacttggaagagggcatccaaacactcatgggccgccttgaggacggctcacctagaacaggtcagatcttcaaacagacctacagcaaatttgacaccaacagccacaacgatgacgcactccttaaaaactacggactgttgtattgctttcgcaaggatatggataaagtagagaccttcctcaggatcgtacagtgccgctccgtggagggtagctgtggtttc

SEQ ID NO: 13377 - DNA, 651 bp, Artificial Sequence
  Description of Artificial Sequence: Synthetic coding sequence
atggctactggttccagaacctctctgttgctggccttcggcctgctttgcctcccgtggctccaggagggctcagctttcccgaccatcccgctttcacgtcttttcgacaatgcaatgctccgcgcacacagattgcaccagctcgcgttcgacacctatcaagaattcgaagaggcctacatccctaaggaacaaaagtactcgttcctccagaacccacagaccagcctgtgcttctccgaaagcatccccaccccatcgaaccgcgaggaaactcaacaaaaatccaacctggagctgctgcggattagtttgctgcttatccaatcctggctggagccagttcaattccttcggagcgtgtttgctaacagtctggtctacggggccagcgattcgaacgtgtacgacttgctgaaggatctcgaggagggaatccagaccctcatgggacgtctggaagatggttcaccgaggactggacaaatctttaagcagacgtactcgaaatttgacactaattcgcataatgacgatgcgctcctcaagaactacgggctgctgtactgcttccgcaaggacatggacaaagtcgaaactttcctcaggatagtgcagtgccgatcagtggaaggatcctgtggcttt

SEQ ID NO: 13378 - DNA, 651 bp, Artificial Sequence
  Description of Artificial Sequence: Synthetic coding sequence
atggccaccggaagccgcacatccctgcttttggcctttggacttctgtgcctcccctggctacaggaaggaagcgcgttccctaccattcctctttcccgtttgtttgataatgccatgctacgcgcccatcgactccaccaacttgccttcgacacataccaagaatttgaggaggcatacatccctaaggagcagaagtattccttcctgcagaatccccagacttcactgtgcttttctgaatcaatccccacacccagtaatcgggaggaaactcaacagaaatccaacttggagctgctgaggatctccctcctgctgatccaaagttggttggagccagtccaatttttgcggtctgtgtttgctaactccctggtgtatggggcttcagactcgaatgtatatgatctactgaaagatctggaggagggaattcaaaccctgatgggtagattggaggatgggagccctagaactgggcaaatcttcaagcagacatactccaaatttgacaccaactcacataatgatgatgcccttcttaagaactacgggcttctgtattgtttccggaaggatatggataaggtggagacattcttaagaatagttcagtgtaggtccgtggagggcagttgcgggttt

SEQ ID NO: 13379 - DNA, 651 bp, Artificial Sequence
  Description of Artificial Sequence: Synthetic coding sequence
atggcaacaggcagtaggactagtctgctgctcgccttcgggctcctctgtcttccgtggttacaggagggcagtgcgttccccactattccactctctcggctgttcgacaatgccatgcttagggcccatcgattgcaccagctggctttcgacacctatcaggagtttgaagaggcttatattcctaaggagcagaagtattccttcctgcagaatccacagacaagtttatgcttttcagagagtatccctacacctagcaaccgggaagagactcagcaaaaatccaacttggagctgctgcgcattagcctgctgcttatacaaagctggttagaacccgtacagttcctgcgctcagtgtttgccaactcccttgtgtacggcgctagcgactctaatgtgtacgatcttctgaaagacttggaggaggggattcaaaccctgatgggccgcctggaggacggtagccctaggacagggcaaattttcaagcagacttacagcaaatttgacactaactctcacaacgacgacgcactcctcaagaattacggtctactttactgttttagaaaggatatggataaggtggagaccttcctgcgtatcgttcagtgtaggagcgtggagggcagttgcggattt

SEQ ID NO: 13380 - DNA, 651 bp, Artificial Sequence
  Description of Artificial Sequence: Synthetic coding sequence
atggccactggaagcagaacctccctgctcctcgcgtttggactgttgtgtctgccatggctccaagagggttcagcatttccaacgattcctctgtcccggctctttgacaatgcaatgcttcgagcacatagactgcatcaactcgcatttgatacttaccaggaatttgaagaggcatacattcctaaagagcaaaagtactcctttctgcagaacccacaaacttcactttgtttctcggagtcaattcccaccccttcgaaccgggaagaaacccaacaaaagtctaacctggagctgctgaggatttccctcctcctcatacagtcgtggctggagcccgtgcagtttcttcgaagcgtgttcgcaaactcgctcgtgtacggagcgtccgattcgaacgtgtacgaccttcttaaagatttggaggaaggaatacaaaccctgatgggtagactcgaagatgggtcaccaagaactggtcagattttcaagcagacctactcgaagtttgatactaactcccataacgatgacgcacttttgaaaaactacggactgctctactgtttcaggaaggacatggacaaggtggagacttttctgagaattgtgcaatgtaggtcggtggagggtagctgcggcttt

SEQ ID NO: 13381 - DNA, 651 bp, Artificial Sequence
  Description of Artificial Sequence: Synthetic coding sequence
atggccacagggagcagaacctcgctgctactcgcttttggactactatgcctcccttggcttcaggagggaagtgcgttccctacaattcctctgagccggctatttgataatgctatgctgcgggctcacagactgcaccaactggctttcgacacctaccaggaatttgaggaagcgtacattcctaaggaacaaaaatattcatttctgcagaaccctcagacgtccttatgcttcagtgagtcaatacccacaccgtctaacagggaggagacccagcagaagtctaatctggaactactgagaatttcactgctactcatccagagttggctcgagcctgtgcaattcctgagatccgtgtttgccaattccttggtttatggggcctctgattcaaacgtatacgatctcctgaaagacctagaggaaggcatccagacacttatgggcagactcgaggatgggtcccctaggaccggacaaatctttaaacagacttatagcaagttcgatacaaactcgcataatgatgacgctctccttaagaactatggattgttgtactgtttcaggaaggatatggataaagttgagaccttcttgcgcattgtgcagtgtagatcagtggaagggtcttgtggcttc

SEQ ID NO: 13382 - DNA, 651 bp, Artificial Sequence
  Description of Artificial Sequence: Synthetic coding sequence
atggccaccggcagccgcacatctttgctgctcgccttcggactgctgtgcctgccctggttgcaggaaggcagtgcgtttccgacaattcctctctcccgcctgtttgataacgccatgcttcgcgctcaccgactccaccagttggcgtttgatacttaccaggaattcgaggaggcatatattccaaaggaacaaaaatactcctttcttcagaatccacagacctccctgtgcttctccgagagcatccccaccccttcaaaccgcgaggaaacccaacaaaaatctaacctggaactgttgcgcatcagcttgttgctcattcaaagttggttggaacccgtccagtttctgcggtctgtgtttgcgaactccttggtgtatggcgccagcgacagcaatgtgtacgacctgctgaaggacttggaggagggcattcagactctgatggggcgccttgaggacggaagtccaaggaccggccagattttcaaacagacatacagtaaattcgacactaattcacacaatgatgacgctctcttgaaaaactacggacttttgtactgctttagaaaggatatggacaaggtggagacgtttctgagaatagtgcagtgcaggtcagtcgaaggctcctgcgggttt

SEQ ID NO: 13383 - DNA, 651 bp, Artificial Sequence
  Description of Artificial Sequence: Synthetic coding sequence
atggccactggtagcaggacttctctgctcctcgccttcggcttgctgtgcctgccttggcttcaagaaggatcagcattcccaaccattccactgtctcgtttgttcgacaacgctatgctgcgtgcacatcgcctgcaccagttggctttcgacacttaccaagaatttgaggaggcttacatcccaaaagagcagaagtactcttttctgcaaaatccccagacctctctgtgcttttctgaatcaatcccaactccctccaacagggaagaaactcaacaaaaaagtaacctggaattgctcaggatatctctcctgctgattcaaagctggctcgagccagtacaattcctccgctccgttttcgccaatagtctggtctatggcgcatccgacagcaacgtgtatgaccttttgaaggatctcgaagagggcattcaaaccctgatgggccgccttgaggacggatctccaaggacaggtcagatctttaagcaaacttattccaagttcgacaccaacagccataacgacgatgccctcctcaagaactacggactgctgtattgtttccgtaaagatatggacaaagttgagacattccttcgcatcgtacaatgtaggtcagtggagggcagctgcggtttt

SEQ ID NO: 13384 - DNA, 651 bp, Artificial Sequence
  Description of Artificial Sequence: Synthetic coding sequence
atggccaccgggagccgcacctcgttactgctagcattcggccttctgtgcctgccttggctccaggagggcagtgcattccccaccatacccctgagtcgcctcttcgataatgccatgctgcgggcccaccggctgcatcagctggcatttgatacatatcaagagttcgaagaggcgtacatcccaaaggagcagaagtatagctttttacagaatccccagacctctctgtgttttagtgaaagcataccaacaccttcgaatcgcgaggagacccagcaaaaaagcaacctcgaactgttaaggataagcctgctgttgatccagtcttggctggaacccgtgcagttcttgcgaagcgtctttgcaaatagccttgtgtacggggccagtgacagcaacgtgtatgaccttctgaaggatctcgaggagggcattcaaactctgatgggccggcttgaagatggaagtccaaggaccgggcagatcttcaaacagacctactccaaattcgataccaattctcacaacgacgatgccctgctgaagaactatggtctgctttactgctttcgcaaagatatggacaaagttgaaacgtttctgcgaatagttcagtgccgttcagtggagggcagttgtggattt

SEQ ID NO: 13385 - DNA, 651 bp, Artificial Sequence
  Description of Artificial Sequence: Synthetic coding sequence
atggcgactggatcgagaactagccttctcctcgcattcggtttgctttgtttgccgtggttgcaagagggatccgctttccctaccatcccactctcgcgcctgttcgataatgccatgctgagagcacaccgcctgcatcaactggcgtttgatacctaccaggaattcgaggaggcttacattccgaaagagcaaaagtactcatttttgcaaaacccacaaacttctctttgctttagcgagagcatacctaccccgtcgaaccgcgaagaaacccagcagaagagtaacctggagctcctccggatctcgctcctgctcatccagtcctggcttgaaccagtccagttccttcgctcggttttcgccaatagcctcgtgtacggagcgtccgattccaatgtctatgatctcctgaaagatttggaagaaggaattcagaccttgatgggccggctggaagatggaagccctcggactggacagatctttaagcaaacgtactcaaagtttgacaccaattcacacaacgatgacgccctcctgaagaactacggtttgctgtactgttttaggaaagacatggacaaagtggaaaccttcctccgaattgtccagtgccggagcgtcgaaggatcatgcggtttc

SEQ ID NO: 13386 - DNA, 651 bp, Artificial Sequence
  Description of Artificial Sequence: Synthetic coding sequence
atggcaacgggctcccgcacttcattgctgctcgcctttggactgctgtgcctgccttggctccaggagggatcagcgttcccaaccatccccctgtcgcgcctgttcgacaatgcgatgctcagagcacataggctgcaccagcttgcattcgacacctaccaagagtttgaggaggcatacatcccgaaggaacagaagtactcatttctgcaaaatccgcaaacgtcactgtgcttctcggaaagcattccaactccatccaatcgcgaagagactcagcaaaagtcaaacctcgaactgctgcggatttcgctgctgctcattcaatcgtggctcgagccggtgcagttcctgaggagcgtgttcgccaacagcctcgtctacggagcctccgatagcaacgtgtacgatctgctgaaggacctggaggaaggaatccaaactctcatgggtcggctggaggatggcagcccaagaaccggacaaatcttcaaacagacctactcgaagttcgacaccaattcgcataacgatgacgcacttctcaaaaactacggcctgctgtactgcttccggaaagacatggacaaggtggaaaccttcctgcgtatcgtgcagtgcagatcggtggagggatcctgcggattc

SEQ ID NO: 13387 - DNA, 651 bp, Artificial Sequence
  Description of Artificial Sequence: Synthetic coding sequence
atggcaacgggatcacggacctcacttctgctggcattcggcctgctctgtctcccttggctgcaggaaggttcggcctttccgactatcccactttcgaggttgtttgataacgccatgcttagggctcatcgcctgcaccaactggcatttgacacctaccaagaattcgaagaagcatacattcccaaagaacagaaatactccttcctccagaacccccaaacctcgttgtgtttcagcgagagtatacctacgccttcgaatagagaagaaactcagcaaaaatcgaacttggaactgctgcgaatatccctgcttttgattcagtcctggcttgaaccagtgcagttcctgagaagcgtctttgccaattcactcgtctacggagcaagcgattcgaacgtttacgacctcctgaaggatctcgaagaaggtattcaaaccctcatggggcggcttgaagatggcagcccccggactggacagatctttaaacagacttactcaaagtttgatactaactctcataacgatgatgccctgcttaagaactacggacttttgtactgctttagaaaagatatggacaaagtcgaaacctttctgagaattgtccagtgtagaagcgtggagggctcctgtggtttt

SEQ ID NO: 13388 - DNA, 651 bp, Artificial Sequence
  Description of Artificial Sequence: Synthetic coding sequence
atggcaacaggatcacgcacatcccttctcctggcttttggattactctgtttgccttggttacaggaggggtcggcctttcctacaatccccctatcacgcctattcgataacgccatgctaagagctcatcgtctccatcagttggccttcgatacttatcaggaattcgaagaagcttacattcccaaggaacagaaatattcatttctacagaatccacagacatccctgtgtttcagtgaaagtatccccactccatctaatcgggaagaaacacagcagaagtccaacttagaactccttcgaatctccctcctgctcattcagtcatggctggaaccggtccagttcctgagatccgttttcgctaattccttagtgtatggggcctcagattccaacgtgtatgatctgctcaaagacttagaggaaggaattcagacactcatgggacggctcgaagatgggagtcctcggacagggcagatattcaaacagacatattcaaaatttgacactaactcccataatgatgatgccctgctcaaaaactatgggctgctgtattgttttagaaaagatatggataaagtcgaaactttcctgagaattgtgcagtgtagaagtgtagaagggtcatgcgggttc

SEQ ID NO: 13389 - DNA, 651 bp, Artificial Sequence
  Description of Artificial Sequence: Synthetic coding sequence
atggccaccggctcccggacctcgctgctcctggcattcggactgctctgtctcccatggttgcaggaagggtccgcttttcccaccatcccgctgtcgcggctctttgacaacgcaatgctgcgagcccacagactgcaccagctcgccttcgacacttaccaggagttcgaggaagcatacatcccgaaggagcaaaagtactcctttcttcagaatccgcagaccagcctttgcttttccgaatcaatcccgaccccgtcaaatcgggaagagacgcaacagaaaagcaatctggagctcctgagaatctcgctcctgctcattcagtcatggctggaacctgtgcaatttcttagatcggtgttcgcaaattccctggtctacggcgcatcggattccaacgtgtacgacctgctgaaagacttggaggaaggaattcagacgcttatggggagactcgaggacggaagcccgcgaactggccagatcttcaaacagacgtactccaaattcgacaccaattcgcataacgacgatgctctcctgaagaactacgggctgctgtactgcttccggaaggacatggacaaagtcgagactttcttgcgcatcgtgcaatgtaggagcgtcgaaggttcatgcggattt

SEQ ID NO: 13390 - DNA, 651 bp, Artificial Sequence
  Description of Artificial Sequence: Synthetic coding sequence
atggccacgggcagcagaacatccctcttacttgccttcggcctgctgtgtcttccctggttgcaggaggggtctgcgtttccaacaattccactgtcacgactgttcgataatgcaatgctcagagcccatagactccatcagttggcctttgatacctaccaggaattcgaagaggcgtatataccaaaggagcagaagtacagctttctgcagaacccccaaacttcactgtgttttagcgagtctatcccgacccctagtaatagggaggagacacagcaaaagagtaacttagagctgctgcgaatctccctgctgctgatccagtcctggcttgagcccgttcagttcctgcgcagcgtttttgccaactccctcgtttacggcgccagcgatagcaatgtctatgacctgttgaaagacctcgaagaaggaatacagactcttatggggcgtctggaggacggctccccccggacaggccagatatttaaacagacatatagcaaattcgatactaattcacacaacgacgatgcgctcctgaaaaactatggtcttctatactgctttagaaaggatatggataaggttgagacattcttgcgtattgtgcagtgcagatccgtggaaggaagttgcggtttt

SEQ ID NO: 13391 - DNA, 651 bp, Artificial Sequence
  Description of Artificial Sequence: Synthetic coding sequence
atggccaccggaagtaggaccagtctgctgttggcgtttggacttctctgtttgccttggctccaggaaggttcagcgttccccacaattcccttgtcacgcctgtttgataatgcgatgctcagagcacacaggctccaccagctggcatttgatacctatcaggagttcgaagaggcttacattcctaaggaacagaagtattcgtttttacagaatccacagacttcactgtgcttctccgagtcaatccccacaccttcaaatcgggaggagacccaacagaagagcaatttggaattgctccggatatccctgttgttgattcagagttggttggaacctgtgcagtttctccgtagcgtcttcgccaacagtctggtatacggggctagcgattccaacgtctacgatctgctcaaagacctggaggagggtatccaaaccctgatgggccgtctggaagatgggagcccccggaccggccagatttttaaacagacctacagtaagttcgataccaattctcacaatgacgacgcgctgctgaaaaactatggcctactttactgttttagaaaagacatggacaaggtcgaaactttcctgcggattgttcaatgtcgctccgtggaagggagttgcgggttc

SEQ ID NO: 13392 - DNA, 651 bp, Artificial Sequence
  Description of Artificial Sequence: Synthetic coding sequence
atggcaactggctcaagaacctcgttgttgctggcgttcggtctgctgtgcctgccgtggctccaagagggctccgcattcccaactatcccgctctcgcgactctttgacaacgccatgctgcgggcacacaggctccaccagctcgccttcgatacgtaccaggaattcgaggaagcatacattccgaaggaacagaagtattcattcctccagaacccgcaaacctcgctgtgtttttcggagtcaatcccgaccccatcaaaccgggaagaaacccagcagaagtcgaacctcgaacttctgcggatctcccttctgctgattcagtcgtggctggaaccggtgcagtttttgcggtcggtgttcgcgaatagcctcgtctacggagcttcagactcgaacgtgtacgacctcctgaaggacctggaggagggcatccagactctcatgggcaggcttgaggacggctccccacgcaccgggcaaatctttaagcagacttactccaagttcgatactaactcccataatgacgatgctctgcttaagaactacgggctcctctactgcttccgtaaagacatggataaggtggagacgttcctgagaatcgtgcagtgcagatcggtcgaaggatcgtgcggcttt

SEQ ID NO: 13393 - DNA, 651 bp, Artificial Sequence
  Description of Artificial Sequence: Synthetic coding sequence
atggccacgggaagccgcacatctctgctgctcgcctttgggctcctgtgccttccctggctgcaggaaggcagcgcctttccaacaatccccctgtcacgactgtttgacaacgccatgctgcgagcacacaggttgcaccaactagctttcgatacataccaggaattcgaggaggcatacattccaaaggaacagaagtattctttcctgcagaatccccagacctcgttgtgcttttcagaatctattccaactccctctaacagggaggaaacacagcagaaaagtaacctagagcttctccgaatctccctgctgctgatccagtcctggctggaacccgtccagttcctgaggtccgtgtttgcaaatagtctagtgtatggtgcgagtgactcgaacgtttacgacttgttgaaggatctggaggaggggatacagaccctgatgggtagactggaagacggaagtccccgcacaggtcagatctttaagcagacctatagcaaatttgacacaaatagtcacaatgatgatgccttgctaaagaactacggattattgtattgcttccgtaaggatatggataaagtcgagacattcctgcgaattgtgcaatgtagatctgtagaaggctcttgtggcttc

SEQ ID NO: 13394 - DNA, 651 bp, Artificial Sequence
  Description of Artificial Sequence: Synthetic coding sequence
atggcgacggggagccgtactagccttctgcttgcatttggtttgctgtgtctgccatggctgcaagaaggatcggcatttcccaccatccccctgtcgcggctgtttgataacgcgatgcttagagcacataggcttcatcagctcgccttcgacacttaccaggaattcgaggaggcatacatcccaaaggaacagaagtattcctttctccagaacccccagacttccctgtgtttttccgaatccattcctaccccgtcaaatcgcgaagaaactcaacagaagtcaaatcttgaacttcttcggattagcctcctgctcatccagtcctggcttgaaccggtccagtttctccgatcggtgttcgctaactctctggtctacggagcatcggactctaacgtttacgatctcttgaaagacttggaagaaggtatccagacccttatgggtcgactcgaagatggatcgcctcggactggtcaaatcttcaagcaaacttatagcaagtttgataccaattcacataacgatgatgcactgcttaagaattacggtctgctgtactgtttccggaaggatatggataaggtggaaaccttccttcgcattgtgcaatgtagaagcgtggagggatcatgtggattc

SEQ ID NO: 13395 - DNA, 651 bp, Artificial Sequence
  Description of Artificial Sequence: Synthetic coding sequence
atggcgaccggctcacgcacttcgcttcttcttgcatttggattgctttgcttgccttggctgcaggaaggtagcgcctttcctactatcccactgtcccggctttttgacaacgcgatgctgagggcgcacaggcttcatcagttggcatttgacacctaccaggagttcgaggaagcgtacattcctaaagaacagaagtactcgtttctgcaaaaccctcaaactagtctttgttttagcgaatcgatccctaccccatcaaaccgagaagagactcaacaaaagagcaatctcgaacttctcaggatctcgttgcttctcatacaatcctggctggaaccagtgcaatttctgagaagcgtttttgcaaatagcctcgtgtacggagcgtcagatagcaacgtgtatgacctgctgaaggatctggaggagggcatacagacgctcatgggtcggctggaagatggatcaccccgcaccggccaaatctttaagcaaacctactccaaatttgataccaactcgcataacgacgacgcccttcttaagaactacggactgctgtactgctttaggaaggatatggataaggtggagactttccttcgaattgtccagtgtcgctcagtcgagggctcgtgtggtttt

SEQ ID NO: 13396 - DNA, 651 bp, Artificial Sequence
  Description of Artificial Sequence: Synthetic coding sequence
atggcgaccggcagccggacgtcactgttgctggcattcggcctgctctgcctgccctggctgcaagagggatcggcgttcccaacgatcccgctctcgagattgttcgacaacgctatgcttagagctcataggcttcaccagctcgccttcgacacttatcaagaatttgaagaggcatacatcccgaaagaacagaaatactcgttcctccagaacccgcagacttccctgtgcttctccgaatcgatccctacccctagcaaccgtgaagagactcaacaaaagtcaaacctggaattgctgcggatcagcctgctgctgatccagtcgtggctggagccggtgcagttcctccgctccgtttttgccaattctcttgtctacggggcctccgatagcaacgtgtacgacctgctgaaggacctcgaggagggaatccagacccttatgggacgcctcgaggacgggagcccacggactggacagattttcaagcaaacctactcgaagttcgataccaactcacacaatgacgatgccctcctgaaaaattacggcctcctgtactgcttccgaaaggatatggacaaggtcgaaacttttctgcgcattgtgcagtgtcgctccgtggaaggttcatgcggattt

SEQ ID NO: 13397 - DNA, 651 bp, Artificial Sequence
  Description of Artificial Sequence: Synthetic coding sequence
atggcaacaggatctagaacttcattacttctggcattcggattgttatgccttccatggttgcaagaaggatcagcgttccctacaattccactgtcacgactgttcgataatgctatgctcagagcacacagattgcatcagcttgcatttgacacataccaagagtttgaggaggcttacatcccaaaggagcaaaaatactcttttttgcaaaacccacaaacatccctctgtttctctgaatctattccaaccccttcaaatcgagaagaaacgcaacaaaagtcaaaccttgagttgcttcgcatttcattgcttttgatccagtcttggctggaacctgttcagttcctacgcagtgtgtttgctaactctttagtttatggagcttcggattcgaacgtttacgatttgcttaaggaccttgaagaaggtattcaaacattgatgggtagattagaggatgggtcaccaagaacaggacagatattcaaacaaacatactctaaattcgacacgaattcacacaacgacgacgctcttctgaagaattacggacttctatactgttttagaaaagatatggataaggtagagacgttcctacgcattgtccaatgtaggagcgttgagggaagctgcggtttt

SEQ ID NO: 13398 - DNA, 651 bp, Artificial Sequence
  Description of Artificial Sequence: Synthetic coding sequence
atggctaccggttcccggacttcactcctcctcgccttcggactgctgtgtttgccgtggctgcaggagggttccgccttcccgaccatccccctctctcggcttttcgacaatgccatgctgcgcgcccaccggctccaccagctggcgttcgacacctaccaggagtttgaagaagcgtacatcccgaaggagcaaaagtactccttcctgcaaaaccctcagacgtcactctgtttcagcgaatcgattccaaccccatctaacagggaagaaacccagcaaaaaagcaacctcgaactcctgcgcatctctctgctgctcatccagtcgtggctcgagccggtccaattcctgagaagcgtgttcgccaattcactcgtgtacggcgcatcagattcgaacgtgtatgacctgttgaaggaccttgaagagggcattcaaactttgatgggacggcttgaggatggatcaccaaggactggacaaatcttcaaacaaacgtactcaaagttcgacacgaactcacacaatgatgacgctctccttaagaattacgggctgctgtactgcttccgcaaggacatggataaggtcgagacttttctgcggattgtgcagtgccgctcggtggaaggatcttgcgggttc

SEQ ID NO: 13399 - DNA, 651 bp, Artificial Sequence
  Description of Artificial Sequence: Synthetic coding sequence
atggcaaccggctcccgcacttcgctgctgctggcatttggtttgctgtgtctcccatggctccaagaagggagcgcgttccctactatcccgttgtcccgtctttttgataacgcaatgctccgagcacataggctgcatcaactcgcatttgatacctaccaggaatttgaggaagcctacattcctaaggaacagaagtactcgttccttcagaaccctcaaacctccctgtgcttctcggaatcgatcccaactccgtccaaccgcgaggaaacgcaacagaaatccaacctcgagcttctccgaatctcactgctgttgattcaatcgtggcttgaacctgtgcaatttctgaggtctgtctttgcaaattcgcttgtctacggagcatccgattcgaacgtctacgatctgttgaaggaccttgaagaagggattcaaacccttatgggacggcttgaggacggtagccctcggaccggtcaaatcttcaaacagacgtacagcaagtttgatacgaactcacacaacgacgacgcgcttctcaagaactacgggctgctgtactgtttccgtaaggacatggataaggttgaaacctttctgcgcattgtgcagtgtcgctccgtggaaggctcatgtggcttc

SEQ ID NO: 13400 - DNA, 651 bp, Artificial Sequence
  Description of Artificial Sequence: Synthetic coding sequence
atggcgacgggttcgcgtacgtcgctactattagcgtttggtttattatgtctaccgtggttacaagaaggttcggcgtttccgacgataccgctatcgcgtctatttgataatgcgatgctacgtgcgcatcgactacatcaattagcgtttgatacgtatcaagaatttgaagaagcgtatataccgaaagaacaaaaatattcgtttttacaaaatccgcaaacgtcgttatgtttttcggaatcgataccgacgccgtcgaatcgtgaagaaacgcaacaaaaatcgaatttagaattactacgaatatcgttattattaatacaatcgtggctagaaccggtacaatttttacgttcggtatttgcgaattcgctagtttatggtgcgtcggattcgaatgtatatgatctattaaaagatttagaagaaggtatacaaacgctaatgggtcgattagaagatggttcgccgcgtacgggtcaaatatttaaacaaacgtattcgaaatttgatacgaattcgcataatgatgatgcgttattaaaaaattatggtttactatattgttttcgaaaagatatggataaagtagaaacgtttttacgtatagttcaatgtcgatcggtagaaggttcgtgtggtttt

SEQ ID NO: 13401 - DNA, 651 bp, Artificial Sequence
  Description of Artificial Sequence: Synthetic coding sequence
atggcaactggctctcgcacctccctgctgctggcctttggtctgctgtgcctgccctggttgcaagagggatccgcattccctaccattcctctgtcgcgtcttttcgataacgccatgctcagagcacataggctccatcagctggcatttgatacttaccaagaattcgaggaggcatacatacctaaggagcaaaagtactcatttcttcaaaatccacagaccagcttgtgtttttcagagtcgatacctaccccctctaaccgggaggaaacccagcaaaaatcgaatctggagcttttgcgcatttcccttctgctgatccaatcctggcttgagccagtccaatttcttagatcagtctttgctaactcactggtgtatggcgccagcgattccaatgtgtacgaccttctgaaggatcttgaagaaggaatccagactcttatgggtcgtctcgaggacggctccccccgtacgggccagatctttaaacagacttactcaaagtttgatactaattcccataacgacgatgcactcctgaagaactacggcttgctgtattgttttcgcaaggatatggataaggtggaaacttttctcaggatcgtgcagtgccgatcggtggaaggatcctgtggtttc

SEQ ID NO: 13402 - DNA, 651 bp, Artificial Sequence
  Description of Artificial Sequence: Synthetic coding sequence
atggctacgggatcacggacctcccttttgcttgcttttggcctgctttgtctcccttggctgcaagagggttccgccttcccaacgattcctctgtctaggttgtttgacaacgcaatgctcagagcgcatcgcctccaccagttggcgttcgacacctaccaggaatttgaagaagcgtacatccctaaggagcagaaatactcctttctgcaaaatcctcagacctccctctgcttttcggaatccattccaaccccgtccaatcgcgaagaaacccaacagaaatcgaatctggaactgctgagaatttctctcctgcttattcagtcctggcttgaacctgtgcagtttctgagatcagtgttcgcaaacagcctggtgtacggtgcatcggatagcaacgtgtacgatttgctgaaggacctggaggaaggaattcagactctgatgggcagactcgaagatggctccccgcgaaccgggcagattttcaaacaaacttacagcaagtttgacaccaactcgcataacgatgatgcactgcttaagaattacggactgctctactgttttcggaaggacatggataaggtcgaaacttttctccgcatcgtgcagtgcaggtcagtcgagggatcttgcggtttt

SEQ ID NO: 13403 - DNA, 651 bp, Artificial Sequence
  Description of Artificial Sequence: Synthetic coding sequence
atggccaccggttctagaacatctcttcttctcgctttcggactgttatgtcttccttggctacaggagggcagcgccttcccaaccattcctcttagtaggctttttgacaacgccatgcttcgtgctcatcgcttacatcaacttgcgttcgatacctaccaagagtttgaagaggcatacatccccaaagagcaaaagtactcttttctccagaacccacaaacctcactttgtttttcggaatcaatacccacgccctccaatcgcgaggagactcaacagaagagtaatcttgagctgttgaggatttccttattgctgatccaaagctggctggaacctgttcagtttcttagatcagttttcgcaaatagccttgtttatggggcaagtgattcaaacgtgtatgaccttttgaaggatctcgaggaaggtatacaaacgctgatgggaaggttagaggacggatcaccaaggactggtcagatcttcaagcagacttacagcaagtttgatactaacagccataacgatgatgcacttttgaaaaactacggtttattatattgtttcagaaaagatatggacaaggtagagacattcctcaggattgtccagtgtcgttcggtcgagggaagttgtggtttt

SEQ ID NO: 13404 - DNA, 651 bp, Artificial Sequence; identical to SEQ ID NO: 13340
  Description of Artificial Sequence: Synthetic coding sequence

SEQ ID NO: 13405 - DNA, 651 bp, Artificial Sequence
  Description of Artificial Sequence: Synthetic coding sequence
atggccaccggctcccgaacttctctcctgctggcctttggacttctctgcctgccctggctgcaggagggatccgcatttcccaccatccccctctccaggctgtttgataatgcgatgcttagagcccaccgccttcatcaactggcgtttgacacgtaccaggagtttgaagaggcttacattccaaaagaacagaagtatagttttctccagaatccccagacgagcctttgctttagtgagtctatcccaactccctctaatcgggaagaaacgcagcagaagtctaatctggaattgctgaggatcagcttgctgctgatccagagttggctggaaccggtgcagtttctgcggagcgtgttcgctaattccttggtgtatggggcgtccgattctaacgtgtatgatctgctgaaggatctggaggaggggattcaaacattgatggggcgactggaggatggctctccacgcaccgggcagatcttcaagcagacctattcaaagttcgacaccaattcacataatgacgatgctctgttgaagaattatggcctcctgtactgcttccggaaggacatggacaaagtggagacctttcttcgcattgtccaatgtaggtcagtggagggcagctgcggattc

SEQ ID NO: 13406 - DNA, 651 bp, Artificial Sequence
  Description of Artificial Sequence: Synthetic coding sequence
atggccaccggaagtagaacgtctctgctgcttgcgtttgggctgctgtgtcttccatggctgcaggaagggtcagcttttcctaccataccgctcagtcgactgtttgataacgcaatgctgcgggctcataggttgcatcagttggctttcgacacttatcaggagtttgaggaggcatacatccccaaagagcaaaagtactccttcctgcagaacccccagaccagcttgtgtttttccgaatctattccaacaccttccaaccgggaggagacccaacagaagtccaacctggagctgctcagaatttccctgctgttgatccaaagctggctcgaacccgttcaattcctgaggtccgtatttgccaattccctcgtgtatggtgcctctgactcaaatgtttacgatttgcttaaggacctcgaagagggcatccagacacttatgggcaggctcgaggacggttctccaaggacaggccaaatattcaagcagacctacagtaagttcgatacgaattctcataacgatgatgccctgctgaagaactacgggctgctgtactgcttccggaaagatatggataaagtggaaacttttttgcggatagtccagtgcagaagcgtggaaggaagttgtgggttc

SEQ ID NO: 13407 - DNA, 651 bp, Artificial Sequence
  Description of Artificial Sequence: Synthetic coding sequence
atggctaccggatcaagaacctcacttctgctggccttcggcctgttgtgcctgccctggttgcaggaagggtctgccttccccacaattcctctgtctaggcttttcgacaatgcaatgctacgagctcatagactccatcagctggcattcgatacgtaccaagaatttgaagaagcatatataccaaaggagcagaagtactcctttctgcagaacccacagacaagcctgtgcttcagcgaatctattccaaccccatcaaaccgagaggaaacgcagcagaagtcaaatcttgaactgctgcgaatcagtctcctgctgatccaatcatggctggagccggtgcagttcctccgatccgtcttcgcaaattctctcgtgtatggtgcgagtgattctaacgtgtatgacctgctaaaggatctcgaagagggcatccaaaccttgatgggcagactagaggatggatcacccagaactggacaaatattcaaacagacatactcgaagtttgacacaaactcccataatgatgatgcattgctgaagaactatggcctactgtattgctttagaaaggacatggataaggtggaaaccttccttcgcatcgtgcagtgcaggtcagtagaaggaagttgcggcttt

SEQ ID NO: 13408 - DNA, 651 bp, Artificial Sequence
  Description of Artificial Sequence: Synthetic coding sequence
atggcaacagggtcccggacatccctgctgcttgcttttgggttactgtgccttccatggctccaagagggaagcgcgttccctacaattccgctatcccgactctttgataacgcaatgctgagggctcacaggctgcaccaactcgctttcgatacatatcaggaattcgaagaagcttatatacctaaggagcagaagtacagcttccttcaaaatcctcagacgtcactgtgcttctcagagtcaattccaaccccatctaaccgggaggagacccagcagaaaagcaacctagaacttctgaggatctccctgctcctaattcagagttggctggaaccagttcagttcctcaggtccgtgttcgcaaactctctcgtgtatggagccagtgatagcaatgtgtacgacctgctaaaggatctggaagaggggatccagacattaatgggaagacttgaggacgggagcccccgcaccggccagatctttaagcagacctacagcaagttcgatactaactcccacaatgatgacgctcttctgaaaaattacgggttactgtactgttttaggaaggatatggacaaggtggaaacatttttacgaattgtgcagtgcaggtccgttgagggatcatgcgggttc

SEQ ID NO: 13409 - DNA, 651 bp, Artificial Sequence
  Description of Artificial Sequence: Synthetic coding sequence
atggccactgggtccaggacgtcgctgcttctcgcgttcggtctgttgtgccttccttggcttcaggaagggtcggcattcccaactattcctctttcccgtttgttcgataatgcaatgcttagagcacatcgcctgcatcagctggcatttgatacgtaccaggaatttgaagaggcctacattcccaaagaacaaaagtactccttcttgcagaacccccagacttcgctttgctttagcgaatcaatccccacgcccagcaatcgtgaggaaactcaacaaaagtcaaacctggagcttctgagaatttcactgctccttattcaatcctggcttgaacctgtccaatttctgagatccgtttttgctaactcgctggtctacggggccagtgactcgaacgtgtacgatcttctcaaggacctggaggaaggaatccagaccctcatgggtagactggaagatgggtcgccccggaccgggcagattttcaaacaaacctactccaaattcgataccaactcgcacaatgacgacgcgctgcttaagaattacggactcctgtactgttttagaaaggacatggacaaggtggaaactttcctcaggatagtccagtgccgaagcgtcgaaggatcctgtggattt

SEQ ID NO: 13410 - DNA, 651 bp, Artificial Sequence
  Description of Artificial Sequence: Synthetic coding sequence
atggctaccggatcgcggacctccctactgctggccttcgggctgctgtgcctcccatggctgcaggagggcagcgcgtttcctacaataccattaagccgcttgtttgacaacgctatgctgcgggcccacagactgcaccagctcgcctttgacacctatcaggaattcgaagaagcctacatccccaaagagcagaaatactcattcctgcaaaatccccagacctccctctgcttctccgaatcaatccccactccatcgaatagggaggagacacagcagaagtctaatctggagctactgcgaatctctctactgctcattcagagctggctagagcccgtgcagttcctccggtcggtcttcgccaacagccttgtatacggcgcttctgactccaacgtgtatgacctgttgaaggatttggaggagggaatacagacattaatgggtcgcctcgaggacggttctcctaggacaggacagatttttaagcagacatatagtaaatttgacacaaactctcacaatgacgacgctctgcttaagaactacggccttctttattgttttcggaaggatatggataaggtggagacgttcttgcgtatcgtgcaatgcagaagcgtagaagggagctgcggcttc

SEQ ID NO: 13411 - DNA, 651 bp, Artificial Sequence
  Description of Artificial Sequence: Synthetic coding sequence
atggctaccggatcccgaaccagcctgctcctcgcatttggcctgttgtgcctgccgtggctgcaggaaggctcagcatttcccactatcccactgagtcgtctgtttgacaacgcaatgctgcgcgcccaccgcctgcaccagctagccttcgatacctaccaggagtttgaagaagcctatatcccaaaggagcagaagtactcatttcttcagaatcctcagacctccttgtgtttcagcgagtccattccaacaccgtctaatcgggaagagacccagcagaagagcaatctggaacttctgcgaattagcctgctgcttattcagagttggctggagccagtgcagttcctccgtagtgtgttcgcaaatagcttggtgtacggagcctccgatagcaatgtttacgatttgctgaaagatctggaggaaggaatccaaacgttgatgggacgcctggaggatggcagcccacgtacaggacaaatttttaagcagacgtactctaaatttgacacaaacagccacaacgacgacgcattattgaagaattacgggctgctgtactgcttccgcaaagatatggacaaagttgaaacttttctgcgtattgtgcaatgtcgtagcgttgaggggtcatgcggtttc

SEQ ID NO: 13412 - DNA, 651 bp, Artificial Sequence
  Description of Artificial Sequence: Synthetic coding sequence
atggctaccggcagccggactagcctgctgctggccttcgggcttctttgtcttccctggttgcaggaagggtcagctttccccactatcccactctcgcgcttgttcgataacgctatgctgagagcccacagattgcaccagctggccttcgacacctaccaggagtttgaggaagcctacataccaaaagaacagaaatattcttttttgcagaacccccagacgtcgctctgcttctccgagtctatccccactccgagcaatcgcgaggaaacccagcagaagtccaatttagaactcctgaggatttccctcctactgatccaaagttggttggaacccgtgcagtttctgcgctctgtctttgccaacagcttagtctacggcgcctcagacagcaatgtgtatgatctgctgaaggacctggaagaaggcatccaaaccctcatggggcgcctcgaggacggttctcctcgcaccggccaaatattcaagcagacctatagcaaatttgacacgaattctcataacgacgatgccctgttgaagaattatgggttgttgtattgttttcgcaaggatatggataaagtggagactttcttgcgaatcgtgcagtgcaggtccgtggaagggtcatgtggcttc

SEQ ID NO: 13413 - DNA, 651 bp, Artificial Sequence
  Description of Artificial Sequence: Synthetic coding sequence
atggctacaggcagtagaacctcgctgcttttggcgttcggcctgctctgtctcccatggttgcaagaaggctctgcatttcctaccattcccctatccaggctattcgacaatgcgatgctgcgggcccacagactgcaccagctggccttcgacacatatcaagaatttgaagaggcttacattcccaaggagcagaagtactctttcctgcaaaacccccagacctcactctgtttctctgagtctatccccactccatccaacagggaagaaacccagcagaagagcaatctagagttgctgcggatttcactgctgttaatccagtcctggttagagcccgttcagtttttacgatctgtgttcgctaattctttagtctacggtgcatcagactcgaacgtctatgacctgctgaaagatctggaggagggcattcaaacactcatgggccgtctcgaggacggatcccccaggactggccaaattttcaagcagacatactccaagttcgatacaaatagtcacaatgacgatgctctgctgaagaattacgggctactgtactgcttccggaaggacatggataaggtggagacatttctgcggattgttcagtgtcggtctgtggaagggagctgtgggttc

SEQ ID NO: 13414 - DNA, 651 bp, Artificial Sequence
  Description of Artificial Sequence: Synthetic coding sequence
atggccacggggtcaaggacctccctgctgttggccttcggtctgctgtgtcttccatggctccaagaaggaagcgcattccctaccattccattgtcacgactgttcgacaatgcaatgctcagagcccatcgtctgcatcagcttgccttcgacacctatcaggagtttgaagaggcgtatattcctaaggagcagaagtacagctttttgcagaacccacagacaagcttgtgcttcagcgaatctatacccacaccctcgaaccgcgaggagactcagcaaaaaagcaatctggagctccttcgcatctctctattgcttatccagtcgtggctagaacccgttcagttcttaaggtccgtcttcgccaacagtcttgtctacggcgcctccgactctaacgtgtacgatctccttaaggatctggaggagggtatccagactctcatgggccggctggaggacggctctcctagaaccggtcagatcttcaagcagacttattctaagtttgatacgaactctcacaatgacgacgccctactgaaaaattacgggctcctgtactgttttcgaaaggacatggataaagtcgaaacattcttgcgcatcgtacagtgtcggtcagttgagggatcctgcgggttc

SEQ ID NO: 13415 - DNA, 651 bp, Artificial Sequence
  Description of Artificial Sequence: Synthetic coding sequence
atggcaacaggaagccggacaagtcttttgttggcttttggcctgctgtgtctgccgtggctgcaggaggggagcgctttccccaccatccccctctctcgcctcttcgacaacgctatgttgcgggctcaccggcttcatcaactggctttcgacacttatcaggaattcgaagaagcttacattcccaaggagcagaagtacagtttcctccagaacccgcagacgagcttgtgtttcagtgagtctattccaactcctagcaatcgtgaggaaactcaacagaaatcaaacctagagctcctcagaatctctctgctgctgatccagtcttggcttgaacccgttcagtttctgagaagtgtgtttgctaacagcctggtctatggagcctctgactcaaatgtgtatgatcttctgaaggacctggaggagggaatccagaccttgatggggagactggaggatggtagccctaggacaggccaaatcttcaagcagacatattctaaattcgatactaattcccataatgacgacgccctcctgaagaactacggcctgctctattgttttcggaaagatatggacaaggttgaaacgttcctccgaattgttcagtgtcggtcagtcgagggatcgtgcggtttc

SEQ ID NO: 13416 - DNA, 651 bp, Artificial Sequence
  Description of Artificial Sequence: Synthetic coding sequence
atggccactggatcccggacctcgctcctcctggcctttggtctgctgtgcctgccgtggctccaggaaggatcagcgtttccaactatccctctctcccggttgtttgacaatgcgatgttgcgggctcatcggctccaccagttggcgtttgacacctatcaggaattcgaagaggcgtacatccctaaagagcagaagtacagctttctgcagaatccacagactagcctctgcttctcggaatcgatcccgaccccatctaaccgggaagagacgcaacagaagtcgaatcttgaattgctccgcatctccctgctcttgattcaaagctggctggagcccgtgcagttcttgcggtcagtgttcgccaattccctggtgtacggagcaagcgattcgaacgtgtatgacctcctgaaggacttggaagaaggcatccaaaccctgatgggccgcctggaagacggcagcccacggaccggacaaatcttcaagcagacttacagcaagtttgataccaactcccacaatgatgacgctttgctgaagaactacggactcctgtactgtttcagaaaggatatggacaaagtggaaaccttcctccgcattgtgcaatgcagatcagtggaagggtcatgtggcttc

SEQ ID NO: 13417 - DNA, 750 bp, Artificial Sequence
  Description of Artificial Sequence: Synthetic coding sequence
atggaaaaaggacctgtgcgagcaccagcagagaagccgagaggtgcacgctgctcgaacggttttccagagcgtgaccctcctaggcctggtccatccagacctgcagagaagcccccaagaccagaggccaagagcgcccaaccggcagacggatggaagggcgaacggccccgttccgaagaagataacgaactgaacttgcctaaccttgctgcagcatacagctcaatactttcgtcacttggggagaatcctcagagacaaggcctcctgaaaacgccttggagagccgcgtcggctatgcagttctttaccaagggataccaagaaactatttccgatgtgctcaacgatgcaattttcgatgaggaccacgacgagatggtgatcgtgaaagacatcgatatgttttcaatgtgcgaacatcatctggtaccttttgtgggaaaagtgcatattggatacttgcccaataagcaggtgctgggcttgtcgaagctggctaggatcgtcgaaatctattcgcgcagactgcaagtgcaggaaagacttaccaagcagattgcagtggcaatcaccgaagcactgcgtccggcaggagtgggagttgttgtggaagccacgcatatgtgtatggtgatgcggggagtgcagaagatgaacagcaagaccgtgacttccaccatgctgggagtctttagggaagatccaaagacccgggaggaatttcttactctgataagaagc

SEQ ID NO: 13418 - DNA, 750 bp, Artificial Sequence
  Description of Artificial Sequence: Synthetic coding sequence
atggaaaaaggcccagtgcgggcccccgccgaaaaacctcgaggtgcaaggtgttccaacggcttccccgaaagggatcccccccgaccgggcccctcgagaccagcagagaagccgcctaggcctgaggccaaatcagcccagcctgccgatgggtggaagggggagagacctagaagtgaagaggacaacgagctgaatctacctaatctagcagccgcttattcttctatcctgagttcactgggagagaatccacagcggcagggcttgctcaagaccccgtggcgggcagcttccgccatgcaattcttcaccaagggttaccaggaaacaatctcagacgtgctgaacgatgcaatttttgacgaggaccacgacgagatggttattgtgaaggacattgacatgttttccatgtgcgagcatcacttggtgccctttgtgggaaaagttcacatcggatacttgccaaacaaacaggttctcgggttgtcaaagttggctcgaatcgtcgaaatctactcaagacggctgcaggtgcaggagcgcctgacgaagcagattgctgtggcaatcacagaggctctgcggcccgccggagtgggagtagtggtcgaagccacacatatgtgcatggtcatgaggggtgtccagaagatgaattcaaagaccgtcactagcaccatgctaggcgtcttccgcgaggatcccaaaactagggaagagttcctaaccctcattagatcc

SEQ ID NO: 13419 - DNA, 750 bp, Artificial Sequence
  Description of Artificial Sequence: Synthetic coding sequence
atggagaaaggaccggtgcgggccccagcagagaagccacgcggcgcacggtgttcgaatggcttcccggagcgcgatccgccgcggcctggcccgtcgcgcccggccgaaaaaccgccgaggcccgaagcgaaaagcgcccaaccggcggatggttggaaaggtgaaagaccgaggtcggaagaggataacgagttgaatctgccaaacctggccgccgcatactccagcattctgtcctcactgggagaaaatccacagcgccaggggctcttgaaaactccttggagggccgcatccgctatgcagttcttcaccaagggataccaagaaactatcagcgatgtgttgaacgacgccattttcgatgaggaccacgacgaaatggtgatcgtgaaggatatcgacatgttctctatgtgcgaacatcacttggtgccttttgtgggaaaagtccacatcggctaccttccgaataagcaagtgctcggtctgtcgaaactggcgagaatcgtggaaatctactcgcgtagactccaggtccaggaacgcttgaccaagcagatcgccgtggcaatcaccgaggctttgcgcccggcgggagtgggagtggtcgtggaagcaacccatatgtgcatggtcatgcgcggagtgcagaagatgaacagcaagactgtcaccagcactatgctcggtgtgttcagggaagatcctaaaactcgcgaagagtttcttactctgatccgctcc

SEQ ID NO: 13420 - DNA, 750 bp, Artificial Sequence
  Description of Artificial Sequence: Synthetic coding sequence
atggagaagggccccgtccgagcacctgccgagaagcctcgcggagcccgatgctccaatggcttccccgagcgcgacccaccccgacctggaccttctcgaccagccgaaaagccacctaggccagaagcgaagtccgctcaaccagccgatggttggaagggagagcgcccacgaagtgaggaggacaatgagctgaatcttcccaacctggccgccgcttactcctcaatcctctcaagcctgggagagaacccgcaaagacaggggttactgaaaactccttggcgggcggcttccgccatgcagtttttcacaaaagggtatcaggagactatttccgatgttctgaacgacgcaatatttgatgaggaccatgatgaaatggttatagtgaaggacatcgatatgttcagcatgtgcgagcaccatctcgtgccattcgtgggcaaagtgcacattggatatttgcccaacaaacaggtgctgggactatccaagcttgcccggatcgtggagatttactcacgtaggcttcaggtacaggagaggctgactaaacagattgcagtagcgattacggaggctttgaggcctgctggagtgggagttgtggtagaggccacccatatgtgcatggtgatgagaggcgtccaaaaaatgaatagcaaaaccgtgacctctaccatgttgggcgtgttccgtgaggaccctaaaacccgcgaggaattcctgaccttgatccggagc

SEQ ID NO: 13421 - DNA, 750 bp, Artificial Sequence
  Description of Artificial Sequence: Synthetic coding sequence
atggaaaaggggccagtgcgggcgccagcggagaagcctcggggcgcacgatgctcgaatggattccccgagagagaccctcctcgacccggcccaagcagaccagcagagaaaccccccaggcccgaagctaagtctgcccagcccgccgatggctggaaaggcgaacggccgcggtctgaagaagacaacgagctcaatttgcctaacctcgcagctgcctatagctcaatcctttcatcactaggggagaatcctcagcgccagggactgctcaagactccatggcgagcagccagtgccatgcagttctttaccaagggctaccaggaaaccatctcagatgtcctaaacgatgccatttttgacgaagatcatgacgagatggtaatcgttaaggatattgacatgttctcaatgtgtgagcaccacctcgtgccattcgtcgggaaggtgcacattgggtatctgccaaacaagcaggtactgggcctctctaagctggcgcggattgttgagatttacagcaggcgtctccaggtgcaggaacgccttacaaaacagatcgccgtggccatcaccgaggctttgcggcccgccggcgtcggagtggttgtggaagccacgcatatgtgcatggttatgaggggagtccagaagatgaactctaagacagtgacctccactatgctcggtgtcttcagggaggatcctaagacgcgcgaagagtttctgacccttatccgcagc

SEQ ID NO: 13422 - DNA, 750 bp, Artificial Sequence
  Description of Artificial Sequence: Synthetic coding sequence
atggagaaaggcccagttcgcgccccagccgaaaagccgaggggtgccagatgtagcaatggcttcccggagcgtgacccgcccaggcctgggccgtcaagaccggccgagaaaccacctcgtcctgaggccaagtcggctcagccagctgacggctggaaaggggagagaccgaggtcggaggaggataacgagctgaatctgcccaacctggccgcagcgtatagctctattctatcctccctgggggaaaacccccagaggcagggactccttaagacaccatggcgtgccgcttctgcaatgcaattttttaccaagggctaccaggagacaatttcggatgttttaaacgacgcgatatttgacgaggaccacgatgagatggtgatcgtcaaggacattgacatgttctccatgtgtgagcaccaccttgtccccttcgtgggtaaggtgcatataggatatctcccaaacaagcaggtgctcgggttatcaaaactggccaggatagtggaaatttattcccggcgcctgcaagtccaagaaagactgaccaagcaaatcgccgtcgccataaccgaagcgctaagaccagccggggtcggtgttgtcgtggaggctacgcacatgtgtatggtcatgcgtggagtccagaaaatgaacagtaagaccgtgaccagtaccatgctcggggtgtttcgcgaggaccctaaaacacgcgaggaattcttgaccttgattagatca

SEQ ID NO: 13423 - DNA, 750 bp, Artificial Sequence
  Description of Artificial Sequence: Synthetic coding sequence
atggaaaaaggccccgtgagggcacctgccgaaaagcccaggggagccagatgtagcaacgggttccctgagagggatccacctaggcctggtccttccagaccggctgagaagccacctagaccagaagcgaagtccgcacaacccgcggatggatggaagggagaaagaccaaggtcagaagaggataatgaacttaaccttcccaatcttgcagccgcttacagctcgatcctgtcatccctgggagagaaccctcaacggcagggtctgctcaagactccttggagagcagcatccgcgatgcagttcttcaccaagggctaccaggaaacgatatcggatgtgcttaacgatgcgatttttgacgaagatcacgatgaaatggtgatcgtcaaagatattgatatgttttccatgtgcgaacaccatctcgtgccttttgtgggaaaggtccacattggctaccttccaaacaagcaagtgctggggttgtccaagctcgcccggattgtggagatttactccagacgtctccaggtgcaggagcggctgactaagcagatcgccgtggcaattaccgaagcacttagaccagctggcgtgggagtcgtcgtggaagcaactcatatgtgtatggtgatgcggggagtccagaaaatgaacagcaagactgtgaccagcaccatgcttggtgtgttccgtgaggacccaaagacccgtgaggaatttcttactctgatccgctcc

SEQ ID NO: 13424 - DNA, 750 bp, Artificial Sequence
  Description of Artificial Sequence: Synthetic coding sequence
atggagaaaggtcctgtgcgggcccccgctgagaaacctagaggggcccggtgcagcaacgggtttcctgaacgggacccaccaaggcccgggccaagtaggcccgccgagaaaccgcctaggccggaggctaagtctgcacagcccgccgacggttggaagggagagaggcccagatccgaggaagataatgaactcaacctcccaaatctggccgctgcctacagctcaattctgagcagtctgggcgagaacccgcaaaggcagggactgctgaagacaccctggcgcgcagcatccgcaatgcagttttttaccaagggttaccaggagaccatttcagacgtgttgaatgacgcaattttcgatgaggaccacgacgagatggtaatcgtcaaagacattgacatgttctctatgtgcgagcaccatctcgtgccgttcgtcggaaaggtgcacatcggctacctccccaacaagcaggttttgggcctttccaaacttgcccgcattgttgagatctactctcgccggctccaagtccaagagagattgacaaagcagattgccgtcgccatcactgaggcccttaggcccgccggggtgggggtggtggtggaggctactcacatgtgcatggtgatgaggggggtccaaaagatgaactccaagaccgtaacttccactatgctcggcgtcttccgcgaggacccgaaaacccgggaggagttcctcaccctcatccgcagt

SEQ ID NO: 13425 - DNA, 750 bp, Artificial Sequence
  Description of Artificial Sequence: Synthetic coding sequence
atggaaaagggtccagtcagagcacccgctgagaagccccgcggagccagatgtagcaacggttttccagagcgagaccctccaagacccggtcccagccggcccgccgagaaacctcctcgcccagaggctaagtcggctcagcccgcagacggttggaagggcgaaagaccaagatcagaggaggataatgagctgaatctgccgaaccttgccgccgcttatagttcaattctgtcctccttgggcgagaatccacagcgtcagggcctgctcaagaccccatggagagccgcaagcgcgatgcaattttttactaaaggctaccaggaaactatttcagatgtcctgaatgacgccatattcgatgaagatcatgacgaaatggttatagttaaggacatcgatatgttcagtatgtgcgagcaccatttagtgccctttgtgggcaaagtccatatcggttacctccccaataagcaggtgctcgggctgtccaagctggcacggatcgtcgagatatacagccgcagactccaggtgcaggagagactgaccaagcagattgcagtggcaatcaccgaagccttacggcctgccggagtgggagtggtggtcgaagctacacacatgtgtatggtcatgcgtggagtgcagaagatgaattcgaaaaccgtcacatcaacaatgctgggagtgttccgtgaggaccccaaaactcgagaagagttcctcacactgattcgaagc

SEQ ID NO: 13426 - DNA, 750 bp, Artificial Sequence
  Description of Artificial Sequence: Synthetic coding sequence
atggagaagggccccgtgagggcccccgcggaaaagcctcgcggtgcgcgctgttccaacggattcccagagagagacccccctcgtccgggcccgtcccgcccggctgaaaagccaccacgccctgaggccaagagcgcgcagcccgcggacggctggaagggtgaaaggcctcgcagcgaagaggacaatgaactgaatcttccaaatttggcggccgcctactctagcatcctgagcagcctgggtgaaaatccacagcgccaaggtctgcttaagaccccatggcgcgcagcaagcgccatgcaattcttcaccaagggctatcaggagactattagtgatgtcctgaacgacgcaatctttgacgaggaccatgatgagatggttatcgtgaaagatatcgatatgttttctatgtgcgaacatcacctggtcccatttgtgggtaaagtgcacattggctatctgcctaataagcaagttctaggcttgtcaaaactggcccgcatcgtagagatttactcccgacgtctgcaggtacaggagcgtctgaccaagcagatcgcggtggctatcaccgaggccctgcgcccagcaggagtgggcgttgtcgtggaggctactcacatgtgtatggtgatgcgtggcgttcagaagatgaatagcaaaacagtcacgagcactatgctgggtgtcttccgggaagatccaaagacgcgggaggagtttctcaccttaatccgcagt

SEQ ID NO: 13427 - DNA, 750 bp, Artificial Sequence
  Description of Artificial Sequence: Synthetic coding sequence
atggagaaaggccccgtccgcgctcctgctgaaaaaccacggggtgccaggtgcagtaatggtttccctgaacgggatccccccaggcctggcccatctcgtcccgcagagaaaccccccaggcctgaggctaaatccgcacagccggccgatggttggaagggcgagagacctcgtagcgaggaagacaacgaattaaacctgcccaatttggccgcagcttactccagcatcttgtcgagtctcggggaaaatccgcagcgacaagggttgctaaaaactccctggagggctgccagtgccatgcagttttttaccaaaggataccaggagaccatctcagatgtgcttaatgatgccatatttgatgaagatcatgacgagatggtcatcgtcaaggatatagatatgttcagcatgtgtgaacatcaccttgtgccctttgtaggcaaggttcatattggctatttacccaacaagcaggtactgggtttatctaagctggcccgtatagtcgagatatactcacggaggctccaggtccaggagagattgactaaacagattgcagtcgctatcacggaggcgctgcggcctgctggcgttggagtcgtggtggaggcaacacacatgtgcatggtgatgcggggtgtccagaaaatgaactcaaaaaccgtgactagcacaatgctgggagtttttcgggaggatccaaaaacccgcgaagagttcctgacactaattcggtca

SEQ ID NO: 13428 - DNA, 750 bp, Artificial Sequence
  Description of Artificial Sequence: Synthetic coding sequence
atggagaaggggcccgtcagggccccggctgaaaagccccggggagctagatgttcaaatggttttccagagagggatccacctagaccaggacctagcagacccgcggaaaaaccaccgagaccggaagccaaaagtgctcagcctgctgacggttggaagggggagagaccgaggagcgaagaagataatgaactcaacctgcctaatctggctgctgcttatagttccattctgagctctttaggggaaaatccccaaagacagggactcctgaagactccttggcgcgccgcttcggcaatgcaattctttaccaaaggttatcaagagaccatatccgacgtgctcaatgacgccattttcgatgaggatcatgatgaaatggttatcgtcaaggacatcgatatgttttccatgtgcgagcaccacttggtgccttttgtcgggaaggttcacattggatatctgccaaataaacaggtcctggggctgtcaaaattagcccgaattgtggagatatatagcagacgcctgcaggtgcaggaacgcctaacaaaacagatcgcggtagcgatcaccgaggccctgcggcctgccggcgtgggcgttgtagtagaggccactcacatgtgcatggttatgcggggggtgcagaaaatgaactctaagacagtgaccagtacaatgctcggagtatttagagaggatccaaaaacccgcgaggaattcctcacactcatccgatcc

SEQ ID NO: 13429 - DNA, 750 bp, Artificial Sequence
  Description of Artificial Sequence: Synthetic coding sequence
atggagaaagggccggtgagggctcctgccgaaaagccgcggggagcccgctgctcgaatggcttcccggaacgggacccgccgcggccggggccaagccggccggccgaaaaacccccacgcccagaagcgaaatccgctcagccggcggacggatggaaaggagaaagacctcgatcggaagaggataatgaacttaacctccctaacttggccgcggcatacagctcgatcctctcgagcctgggagaaaaccctcagcgccaaggacttctgaaaacgccatggcgggcggcgtcagcgatgcagtttttcactaagggataccaagagactatttccgacgtcctgaacgatgcgattttcgacgaggatcacgatgagatggtcatcgtgaaggacatcgacatgttctcgatgtgcgaacatcacctggtcccgttcgtggggaaggtccatatcggataccttccgaacaagcaagtcctcggactgtcgaagctggcacggattgtcgagatttactcgcggcggctgcaggtgcaggagcgcctgaccaaacaaatcgcagtcgccatcactgaagccctgcgacctgctggcgtgggcgtcgtggtggaagcaacccacatgtgtatggtgatgcggggagtgcagaaaatgaactcaaaaactgtcacttcaacgatgctcggcgtctttagagaagatccaaagactcgcgaagaattcctcactctcatccgctca

SEQ ID NO: 13430 - DNA, 750 bp, Artificial Sequence
  Description of Artificial Sequence: Synthetic coding sequence
atggaaaaggggccagttagggcaccagcagagaaaccaaggggtgcccgatgttctaacggattccctgagcgggacccgcccaggccagggccgtcccggcccgctgaaaaaccccccagacccgaggcaaagagcgcacagcccgcggacggctggaagggcgaaagaccccgatctgaggaggacaacgagcttaatcttccaaacttggccgcagcttacagctccattctcagtagcctgggggagaacccccaacgtcagggtctccttaagactccgtggagggccgcctctgccatgcaatttttcacaaaagggtatcaggagacaatttctgacgtgctgaatgacgctatcttcgacgaagatcacgatgagatggtgatcgttaaggacatcgacatgttttccatgtgtgagcatcatctcgtcccgttcgtgggcaaagtgcatatcgggtatctgcctaacaagcaagtcctgggactttcaaagttggcccgaatagtcgagatatattcaaggcgattgcaggtgcaggaacgcctgaccaagcagattgcggtagcaatcacggaggccctcagacctgcaggagtgggcgttgtggtggaagcaacccatatgtgcatggtgatgcggggcgtgcagaagatgaactcaaagactgtgaccagcacaatgcttggagtgttcagggaagacccaaagaccagagaggaatttttaaccttaatccggagt

SEQ ID NO: 13431 - DNA, 750 bp, Artificial Sequence
  Description of Artificial Sequence: Synthetic coding sequence
atggagaaaggaccggtgagagctcccgcagagaagcctcggggcgcccggtgtagcaatgggtttccagaaagggacccaccgcgccccgggccgtcacggccagctgagaagcccccccggcccgaagctaagtcagcacagccagcagacgggtggaagggcgaacgcccacgcagtgaggaggacaatgagctgaacctgccaaatttagctgccgcttacagttctatcttgtctagcctgggggagaacccacagcggcagggtttgctgaagacgccttggcgggcggcatccgccatgcagttctttaccaagggctatcaggagacaatatccgatgtgctgaacgacgccatattcgatgaggaccatgacgagatggttattgtcaaagacatagatatgttctcaatgtgcgagcaccatctagtgccgtttgtgggaaaggttcacatcggatatctgccgaacaagcaagtcctcgggctgagcaaactggcacgtattgtcgagatatatagccgtcgcctccaggtgcaggaacggctaacaaaacagatcgcagtcgccataacagaagctcttaggcctgcgggagttggcgttgtggttgaggctactcacatgtgtatggtaatgcggggggtccaaaaaatgaacagtaagacagtgaccagcaccatgctgggagtgttccgcgaggaccctaaaacacgcgaggaatttctgactctgatacgatct

SEQ ID NO: 13432 - DNA, 750 bp, Artificial Sequence
  Description of Artificial Sequence: Synthetic coding sequence
atggagaagggccctgtccgggctcctgccgagaaaccccgaggggctcgttgctccaacggcttcccggagagggatccaccccgacctggcccttcacggccagctgagaagccgcctcggccagaggcgaagtctgcccagcccgcagacggatggaagggtgaaagacctagaagcgaagaggacaatgaactcaacctcccaaaccttgcagcggcttacagctcaatacttagcagcctgggcgagaatccgcagaggcaaggcctcctcaaaacgccttggcgagcggcaagcgcgatgcagttcttcaccaaggggtatcaagaaaccatatctgacgtgctgaacgacgcgatttttgacgaagaccacgatgaaatggtcatcgtaaaggacattgacatgttctctatgtgcgagcaccacctggtaccctttgttggcaaggtccatatcgggtatctgcccaacaagcaggtactgggcctgagcaagctcgcccgaattgtcgaaatctatagtcgtagattacaagtgcaggaaaggttgacaaagcagattgccgtggctatcactgaggccctgcggcccgctggagtaggtgtggtggttgaggcgacccatatgtgtatggtcatgcgcggagtccagaaaatgaattctaaaacagtgacgtccaccatgctgggggtgttcagagaggatcccaaaacacgtgaagagtttcttaccctaattaggtct

SEQ ID NO: 13433 - DNA, 750 bp, Artificial Sequence
  Description of Artificial Sequence: Synthetic coding sequence
atggaaaagggaccagtgagggctcccgctgagaaacctaggggggccaggtgttctaacggctttcctgagagggacccgccacgccctggccctagcagacccgcggaaaagccacctcgtccagaagccaagtctgcccaacctgccgacggatggaaaggggagagaccaaggtccgaggaggacaatgaactcaatctcccaaatctggccgcagcctacagttccatactgtccagccttggggaaaaccctcagaggcaaggattgctgaaaactccgtggagagcggcttccgccatgcagttcttcacgaagggttaccaggaaactatttctgacgtcttaaacgatgccatcttcgatgaagaccacgatgaaatggtcatcgtaaaagacatcgatatgtttagcatgtgtgagcaccatctggtcccattcgtcgggaaggtgcacattggttatttgcccaacaagcaggtactcggcctgtcaaagctagcaaggattgtggagatctactcgcggagactccaggtgcaggagaggcttaccaagcagatagccgttgccatcaccgaggctctgcgacctgccggagtaggcgttgtggtagaggcaacacacatgtgcatggtgatgcggggagtgcagaagatgaattccaagaccgtaacgtccactatgctgggcgtattcagagaggaccccaagacacgcgaagagtttcttactctcattagaagc

SEQ ID NO: 13434 - DNA, 750 bp, Artificial Sequence
  Description of Artificial Sequence: Synthetic coding sequence
atggaaaagggtccggttagagcgccggctgaaaagccacgtggtgctagatgcagcaatggttttccggagcgtgatcctccgcgaccgggtccctcacgcccagccgaaaaaccaccgagacctgaggcgaaatcagcacaaccggcggatggttggaaaggcgaaagaccgcggagtgaagaagataatgaactgaatctccctaacttagccgcagcatatagcagtatcttgtctagcttaggtgaaaacccgcaaagacagggcctattgaaaacaccgtggcgcgctgcgagcgccatgcagttttttacgaaaggataccaggagacaatatctgatgtactgaacgacgcgatcttcgatgaggatcatgacgaaatggttatagtgaaagatattgatatgttctcgatgtgtgagcatcatcttgtgccgttcgttggcaaggtgcatataggctacctgccgaataaacaagtactgggtctaagcaaactggcccggatagtagaaatctacagtagacggcttcaggttcaagagcgtctgacaaagcaaatcgccgtggcgattacggaagctctcagacccgccggggttggagtggtggtagaggcaacgcatatgtgcatggtgatgagaggagtccagaaaatgaattctaagacagtgacatccaccatgcttggagtttttcgcgaggatccaaaaacgcgtgaggaatttctcacattgattcgttcc

SEQ ID NO: 13435 - DNA, 750 bp, Artificial Sequence
  Description of Artificial Sequence: Synthetic coding sequence
atggagaagggccccgtgcgcgcccccgccgagaaaccaaggggagcccggtgctcgaacggatttccggagagggatccgccgcgtccaggcccgagtcgccctgccgagaagccaccgcgcccagaggccaaaagcgcccagcctgccgatggctggaagggtgagcgcccgcgctccgaggaggataatgaactgaacctgcccaatctggcggctgcctactccagcattctctcgagtcttggcgagaacccccagcgacagggcctgctcaagacaccctggcgcgccgcctccgccatgcaattcttcacgaaaggataccaggagacaattagtgacgttctcaacgacgcgatctttgacgaggatcacgacgagatggtaattgtcaaggacatcgatatgttttcaatgtgtgagcaccacctcgttccattcgtgggcaaggtgcatattggctatttgcccaacaagcaggtgctcggacttagcaagctggctcgtattgtggagatttacagtcgtcgtctgcaagttcaggagaggctgacaaagcagattgcagtcgcgattaccgaggccctgcgcccggccggagtgggagtggtggtcgaggctactcacatgtgcatggtgatgcgaggcgtgcagaagatgaacagcaagacggtcacttccactatgctgggagttttccgcgaagatcctaagacgcgcgaggagttcctgaccctcattcgatcg

SEQ ID NO: 13436 - DNA, 750 bp, Artificial Sequence
  Description of Artificial Sequence: Synthetic coding sequence
atggagaagggaccggtgagggcgcccgcggaaaagccccggggtgcacgatgctctaacggtttccctgaacgagatccacctcggccgggcccctcgcggcctgccgagaagcccccgaggcctgaggccaagagcgcccagccagcggatggatggaagggagaaagaccacgcagcgaagaggacaatgaactgaatcttcccaacctcgcggcagcatactcgagcatcctgtcctcactcggagaaaaccctcaaagacaagggctgctgaaaaccccatggcgcgccgcgtcggcaatgcagttctttaccaagggataccaggagactatttccgatgtgctcaacgatgcaatattcgacgaggatcatgacgaaatggtgattgttaaggatatcgacatgttttcgatgtgtgaacatcatttggtcccattcgtgggtaaggtccacatcggatacctccctaacaaacaggtgctggggctgagcaagctcgcccgcatcgtggaaatctactcgcgaaggcttcaggtgcaggaacgacttaccaagcaaatcgcagtggccattaccgaggctctgcgccctgcaggagtgggtgtggtcgtcgaggccacccatatgtgtatggtgatgcgcggagtgcaaaagatgaacagcaagactgtcacctcaactatgcttggagtctttagggaagatcctaagaccagagaagaatttcttaccttgatacgatcc

SEQ ID NO: 13437 - DNA, 750 bp, Artificial Sequence
  Description of Artificial Sequence: Synthetic coding sequence
atggaaaagggaccggtgagagctcccgccgaaaagccacgcggcgcgaggtgctccaacggttttcccgaacgggatcctccacgacccggcccctctcgtcctgctgagaagcccccaaggccagaggcaaagagtgcacagccagccgacggatggaagggtgagcgaccgcgatctgaggaggacaacgaactgaatctgcccaatctggcagcagcctactctagtatactcagctcactgggggaaaatcctcagaggcagggcctgttgaaaactccatggagggctgcttcagcaatgcagttttttactaagggctatcaggaaaccatctccgatgtgctgaatgacgcgatcttcgatgaggatcatgatgagatggtgatcgtgaaggacatcgacatgttcagcatgtgtgaacatcaccttgtaccctttgtggggaaagtgcatattggttacctccccaataagcaggtacttggtttatctaaactcgcccggattgttgagatctattcccggcggctgcaggtgcaggagcgtttaactaagcagattgccgtggcaattactgaagcacttagacctgctggagtcggagtcgtcgtggaggcaactcacatgtgcatggtcatgagaggagtgcagaagatgaattctaagacagtgacctctaccatgttaggagtgttcagggaagatcccaaaacacgagaagaattcctcaccctcataagaagc

SEQ ID NO: 13438 - DNA, 750 bp, Artificial Sequence
  Description of Artificial Sequence: Synthetic coding sequence
atggaaaagggccccgtgagagcgccagctgaaaaacccagaggagccaggtgttctaacggattccccgagcgcgacccccctcggccagggccttccaggcctgcagagaagcccccgcggcccgaggccaaatctgcacagcccgctgacgggtggaagggcgagcgacctagaagcgaggaggataacgagctcaacctgcctaatctcgccgccgcttactccagcattctctctagcctgggtgaaaacccacagcgccagggtctgctgaaaactccttggagagccgcctccgcaatgcagttttttacaaaaggctatcaggaaacaatttccgacgtgctgaacgatgctatcttcgatgaggaccatgatgagatggttatcgtgaaggacattgatatgttcagcatgtgtgaacaccatttggtgccttttgtaggaaaggtgcacatcggctatctccccaataaacaggtgctcgggctgagcaagctggcgaggatcgtcgagatatatagccggaggctccaggtgcaagaacgcctgacgaagcagatcgccgtggctattaccgaggcattgagaccggctggcgtgggagttgtcgtggaggccacccatatgtgcatggtgatgcgcggagtccaaaaaatgaattctaaaacagtcacatctactatgctcggagtgtttagggaagacccaaaaacgagggaagagtttctgacactcatcagaagc

SEQ ID NO: 13439 - DNA, 750 bp, Artificial Sequence
  Description of Artificial Sequence: Synthetic coding sequence
atggaaaaggggccggtgagagctcctgccgaaaaaccgcgcggcgcgcggtgctccaacggattccccgagcgtgatccaccgaggccaggcccgtcgcggccagccgaaaagccaccgcggcccgaggccaagtcggcccaaccagccgacggatggaaaggagaacgccctagatccgaagaggacaatgaactgaacctgccgaaccttgccgcggcatattcctccatcctctcgtccctcggagaaaacccgcaacgccagggcctgctgaaaactccgtggagggcagcttcggcaatgcagttctttacgaaaggataccaagaaaccatctcggacgtgcttaatgatgctattttcgatgaggaccacgacgaaatggtgatcgtgaaggacattgacatgttttcgatgtgcgagcaccatttggtgccatttgtgggcaaggtccacatcggataccttccaaataagcaggttctcggtctgagcaagctcgcgcgaatcgttgagatttactcacgcagactccaggtgcaggagcggctcaccaagcagatcgcggtggccatcactgaggcccttagaccggctggagtgggagtggtcgttgaggcaacccacatgtgcatggttatgaggggggtgcagaaaatgaactcgaaaaccgtcacttctactatgctcggcgtgttccgcgaagatccaaagacccgggaggaattcctgactctcatccgcagc

SEQ ID NO: 13440 - DNA, 750 bp, Artificial Sequence
  Description of Artificial Sequence: Synthetic coding sequence
atggaaaaggggccggtccgggccccagcggaaaaaccgcgtggtgctcgctgctctaacggcttcccggagcgcgacccacctcgcccgggtccgtcgaggccggccgaaaaaccaccgaggcccgaagctaagtcagcacaaccagcggacggatggaagggagagcggccacgaagcgaagaggacaatgagctgaacctgccgaatttggccgccgcctactcctcaatcctctcgtccctgggcgaaaaccctcaacgccagggactgctcaagactccctggagagcagcgtccgccatgcagttcttcaccaaggggtaccaggaaaccattagcgacgtgctcaacgatgccatcttcgacgaggatcacgatgagatggtcatcgtgaaggatatcgacatgtttagcatgtgcgaacatcacctggtgccattcgtgggaaaggtgcacatcggatacctgcctaataagcaagtcctgggcctgtcgaaacttgcacggatcgtggaaatctactcccggagactgcaagtccaggagcggttgacgaagcagatcgcggtggcaattactgaggcgcttcgccctgctggagtcggcgtggtcgttgaagccacccatatgtgtatggtgatgcggggagtgcagaagatgaacagcaaaactgtgacttcgaccatgctcggagtgtttagagaggacccgaaaactagagaagaattcctcaccctgatccgctca

SEQ ID NO: 13441 - DNA, 750 bp, Artificial Sequence
  Description of Artificial Sequence: Synthetic coding sequence
atggaaaagggtcccgtcagagcaccagcagagaagcctaggggagccagatgttcaaacggatttccagaacgggatcctcctaggccaggtcccagcagaccagcggaaaagcctccccgtcccgaagcaaaatcagctcagccagccgatgggtggaagggagaaaggcccagaagcgaggaggacaacgaactgaacctcccaaacctggccgcagcgtactccagcattctttcctcgctgggcgagaacccccagaggcaagggcttctgaaaaccccatggcgtgccgcatcagccatgcaattcttcaccaagggataccaggaaactatttccgacgtgctcaacgatgcaatctttgatgaggaccacgacgagatggtgatcgtcaaggatattgatatgttttcgatgtgcgagcaccacctggtgcccttcgtgggcaaagtgcatatcggatacctcccaaataagcaggtgctgggcttgtcgaaacttgcaagaatcgtggaaatctacagcaggagactgcaagtgcaagaacgtttgactaagcaaatagcagtggccatcactgaggcccttcgtcctgcgggagtgggcgtggtcgtggaagccactcatatgtgcatggtgatgcggggagtccagaagatgaattcgaaaaccgtcacctcaactatgcttggagtgtttagagaggaccccaaaaccagagaagagtttctgacgctcattcgatcc

SEQ ID NO: 13442 - DNA, 750 bp, Artificial Sequence
  Description of Artificial Sequence: Synthetic coding sequence
atggagaaaggccccgttagagcccctgcagaaaaacccaggggcgctcgctgctcaaacggctttcctgagagagatcccccaaggcccgggccatcgagaccggccgaaaaacccccacgcccggaggccaagtctgcccagcccgcagacggctggaagggagaacgtccacgaagtgaggaggacaacgagctgaacctgcccaacctggctgcagcctatagtagtatcttatccagtctcggcgaaaacccacagcggcagggcttgttgaagaccccatggcgggctgcatcagctatgcagttctttaccaaggggtaccaagaaactatcagtgatgtgctaaatgacgccatcttcgatgaggaccacgatgagatggtgatcgttaaggatatcgatatgtttagtatgtgcgagcatcatctcgtacctttcgtggggaaagtgcatatcggatacctacctaataagcaagttctcgggctaagcaagctggctcgaatcgtggaaatatactctcggagattgcaagtccaagaaagactaaccaagcagattgccgtggcaatcactgaagcgctacggccagcgggagtgggagtggtggttgaagccacccacatgtgcatggtaatgcgcggcgtgcagaaaatgaactccaagaccgtcacatctaccatgctgggtgtttttagagaggaccccaagactcgggaggagttccttacacttatacggagt

SEQ ID NO: 13443 - DNA, 750 bp, Artificial Sequence
  Description of Artificial Sequence: Synthetic coding sequence
atggaaaaaggtccggttcgagcgccggcggaaaaaccgcgaggtgcgcgatgttcgaatggttttccggaacgagatccgccgcgtccgggtccgtcgcgtccggcggaaaaaccgccgcgtccggaagcgaaatcggcgcaaccggcggatggttggaaaggtgaacgaccgcgttcggaagaagataatgaactaaatttaccgaatctagcggcggcgtattcgtcgatactatcgtcgctaggtgaaaatccgcaacgacaaggtttattaaaaacgccgtggcgagcggcgtcggcgatgcaattttttacgaaaggttatcaagaaacgatatcggatgtattaaatgatgcgatatttgatgaagatcatgatgaaatggtaatagttaaagatatagatatgttttcgatgtgtgaacatcatttagttccgtttgtaggtaaagtacatataggttatttaccgaataaacaagtattaggtctatcgaaattagcgcgtatagtagaaatatattcgcgtcgattacaagtacaagaacgtctaacgaaacaaatagcggttgcgataacggaagcgttacgtccggcgggtgttggtgtagtagtagaagcgacgcatatgtgtatggtaatgcgtggtgtacaaaaaatgaattcgaaaacggtaacgtcgacgatgctaggtgtatttcgtgaagatccgaaaacgcgagaagaatttttaacgctaatacgatcg

SEQ ID NO: 13444 - DNA, 750 bp, Artificial Sequence
  Description of Artificial Sequence: Synthetic coding sequence
atggaaaagggtccggtgcgggcgcctgctgaaaagccgaggggtgcaagatgctcaaatggattccctgagcgtgatccgccccgcccaggcccctcgcgcccggccgaaaaaccaccaagacctgaagccaaatccgcacagcctgccgacggatggaagggcgaacggcctagatcggaggaggataacgagttgaacctgcctaacctcgctgctgcttacagctccatcctgtcatccctcggcgaaaatccacagcgccagggactgctcaagacgccgtggcgggctgcgtcggcgatgcaattcttcaccaagggatatcaggaaactatctccgatgtgcttaatgacgccatcttcgacgaggatcacgacgaaatggtcattgtcaaggacattgatatgttcagcatgtgcgaacatcacttggtgcccttcgtcggaaaggtccatattgggtacctgcctaacaaacaggtgctggggctttcgaaactcgcccgcatcgtggagatctactcgcggaggctgcaagtgcaggagcggcttactaagcaaatagccgtggcgatcaccgaagccctgcgtccggcgggcgtgggagttgtggtggaagccactcacatgtgtatggtcatgcgaggtgtgcaaaagatgaacagcaagactgttaccagcaccatgttgggagtgtttcgagaggacccaaagactcgggaggagtttctcaccctgatccgatca

SEQ ID NO: 13445 - DNA, 750 bp, Artificial Sequence
  Description of Artificial Sequence: Synthetic coding sequence
atggaaaagggtcccgtgagagcaccagccgaaaagcccagaggagcccgctgttccaacggctttcctgaacgagatcctccaagaccaggaccatccaggccagcagagaaacctcctcgccctgaagccaaatctgcacagcctgctgatggctggaaaggcgaacggcccaggtcggaagaggataacgagctgaaccttccaaaccttgccgcagcgtattccagcattctttccagcttgggagagaatcctcagcggcagggtctgctgaaaactccttggcgtgcagccagcgccatgcaattctttaccaaaggttaccaagagactatatcagacgtgcttaacgatgcgattttcgacgaggaccacgatgagatggtgattgtgaaggacattgacatgttcagcatgtgtgaacaccatttggtccctttcgtgggtaaggtgcatattgggtaccttcctaacaaacaagttcttggactttccaaacttgcccgcatcgtcgagatttactcaagacggctgcaagtgcaagagaggcttactaaacaaattgcggtggcaataaccgaagcactccgacctgccggtgtgggagtggtggtggaagcaacccacatgtgcatggttatgcgcggcgtccagaagatgaattctaagaccgtgacttcaaccatgcttggtgtgtttcgcgaagatccaaagaccagggaagaatttctcacgctgattcggtcc

SEQ ID NO: 13446 - DNA, 750 bp, Artificial Sequence
  Description of Artificial Sequence: Synthetic coding sequence
atggaaaagggaccagtccgagctcctgccgaaaagccacgtggcgcaagatgcagcaatggctttcctgagagagatccgccccggcccgggccctcgcgcccagccgagaagccgccaaggccagaggctaagagtgcccagcccgctgatgggtggaagggcgagcggcctagaagtgaggaggataacgagctgaatctgccaaatttggccgctgcttacagcagtattctgtcctctctaggagagaacccacagcgccaaggcctgctgaaaactccttggagggcagcctcagctatgcagttcttcactaagggttaccaagaaaccatctccgacgtgctcaacgatgctatttttgatgaagatcacgacgaaatggttattgtcaaagacatcgacatgttcagcatgtgtgagcaccatctcgtccctttcgtgggaaaagtgcatattggttatcttcctaacaagcaggttctaggtctgtccaagctcgctcgtatagtggaaatctattctcggcgcctccaggttcaggagcgtctgactaaacaaatcgcagtggctattacggaggccttgagaccagctggcgtgggcgttgttgtggaggctacacacatgtgtatggtgatgcgcggcgtgcaaaagatgaatagcaaaacagtcacttctaccatgctgggagtctttcgcgaagaccccaagacacgggaggaatttttgaccctaattcgatcg

SEQ ID NO: 13447 - DNA, 750 bp, Artificial Sequence
  Description of Artificial Sequence: Synthetic coding sequence
atggaaaagggaccagtgcgcgctccagccgagaaaccacggggagcaagatgcagtaatggattcccagaaagagatcctccaagacctggaccgtctcgaccggcggagaaaccacctcgaccagaagcaaagtccgctcagccagctgatgggtggaagggagaacgcccacgatcagaggaagacaacgagttgaacttaccaaacttggctgcagcatattcctcgattcttagttcgcttggagagaatccacagcggcaaggcctccttaagactccatggcgagcggctagtgcaatgcagtttttcactaagggatatcaagagacgatttctgatgttcttaacgatgcaatttttgatgaggatcacgatgaaatggtcatcgtgaaagacattgatatgttctccatgtgcgagcatcatctcgtgcctttcgtaggaaaagtgcatatcggatatcttcctaataaacaagttttaggactctcgaaactcgctcgcatagtagagatttactctcggagattacaagtacaagaaagacttactaagcaaatcgctgtcgctattactgaagctcttcgtccagcaggagtcggtgtggttgttgaggctacccatatgtgtatggtgatgagaggagttcaaaagatgaacagcaaaacagttaccagtactatgctcggtgtgttccgtgaagatccgaaaaccagagaagagttcctgacgttaatcagatca

SEQ ID NO: 13448 - DNA, 750 bp, Artificial Sequence
  Description of Artificial Sequence: Synthetic coding sequence
atggagaagggaccggtgcgagcgccggcggaaaaaccacgcggggcccggtgcagcaacggatttcccgagcgcgaccccccgcggcctggtccgtcgaggcctgcagaaaagccccccagacccgaagctaaatccgcacaaccagccgacggatggaagggggagcgcccacgctcggaggaggacaatgaacttaacctgcctaacttggccgccgcgtattcttcgatcttgtcgagcctgggagagaatccacagaggcaaggcctccttaaaactccctggcgtgccgctagcgccatgcagttcttcaccaagggatatcaggaaaccatctcggacgtcctcaatgatgcaatcttcgatgaggatcatgacgagatggtgatcgtgaaagatattgacatgttctcaatgtgtgaacatcatctcgtgccatttgtcggaaaggtgcatatcggatacttgccaaacaaacaggtcctgggcctctcaaagctggcccggatcgtggagatttactcaaggagactgcaggtccaagagcggctgaccaaacagatcgccgtggccatcactgaagccctccgcccggcaggggtgggcgtggtggtcgaagctactcacatgtgcatggtaatgcgtggagtgcagaagatgaacagcaagactgtcacctcaaccatgcttggagttttccgcgaagatcctaaaactcgcgaagaattcctgacgctgatccgaagc

SEQ ID NO: 13449 - DNA, 750 bp, Artificial Sequence
  Description of Artificial Sequence: Synthetic coding sequence
atggaaaaaggacctgtcagagcccctgccgaaaaacctcgaggggcgagatgttccaatggatttcccgaaagagatccaccaaggcctggaccaagtcgacccgccgaaaaaccccccaggccagaggctaaatccgcccagccagcagatggatggaaaggagaacgccctcgatcagaagaagataacgaattaaatcttcctaatcttgcagctgcctactcctcgatcctgtcttcactcggggaaaaccctcagaggcaggggctcctgaaaactccttggcgggctgccagtgcaatgcagttctttacaaaaggatatcaggaaacaataagtgatgtcctgaacgatgctatatttgatgaagatcacgatgaaatggtgatcgtaaaagacatcgatatgttctctatgtgtgaacatcatctcgtcccattcgtgggaaaagtgcatatcgggtatttacctaacaaacaggtattagggctcagtaaactcgctcgcatcgtggagatctattcccgtcgcttgcaggtccaggagcggctcactaaacagatcgctgtagctatcacagaagctctcagaccagcaggggttggagtagtcgtagaagccactcatatgtgtatggttatgcgaggggtgcagaaaatgaactcgaaaactgtgacatccactatgttaggggtattcagggaagatccaaaaactcgcgaggaattccttactctcatcagatca

SEQ ID NO: 13450 - DNA, 750 bp, Artificial Sequence
  Description of Artificial Sequence: Synthetic coding sequence
atggagaagggaccggtgcgcgcgccggccgaaaagccgagaggggcgcgctgttccaacggcttcccagaaagagatccaccaagaccgggaccctctaggcctgcggaaaaaccaccacgcccggaagccaagtcggcacagccggcggacggctggaagggagaacgcccaagaagcgaggaagataatgagttgaacctgccgaaccttgccgccgcgtactcgtcaatcctctcgagcctgggagaaaacccccagagacagggactgttgaaaaccccgtggcgtgcggcatcggctatgcagtttttcactaaaggataccaagaaactatttcggacgttctgaatgatgccatctttgacgaagatcacgacgaaatggtcatcgtaaaggacatcgatatgttctcgatgtgcgaacatcaccttgtaccattcgtgggaaaggtgcacatcggttaccttcctaacaaacaggtgctgggtctgtcaaagctcgcaaggatcgtggagatctattccagacggctgcaagtgcaagagcgattgaccaaacagatcgccgtcgcgatcactgaggctctcaggccggccggagtcggtgtggtggtcgaagccactcatatgtgtatggtgatgcgcggggttcaaaagatgaattcgaaaactgtcacttccactatgctgggcgtgttccgggaggaccctaagactcgcgaagaattcctcaccctcattcgctca

SEQ ID NO: 13451 - DNA, 750 bp, Artificial Sequence
  Description of Artificial Sequence: Synthetic coding sequence
atggaaaaggggccggttcgtgctcccgcagagaagccccgcggcgcgcgctgctccaatgggttcccggagcgagatccaccccgcccgggaccctcccgccccgccgagaagccgcctcgtccagaggctaagagcgcccagccagcggatggctggaagggtgaacgcccccgctccgaggaggacaacgagcttaacctgcccaacctcgctgctgcatattcctctatcctgtcttcgcttggtgagaacccccagcgacagggcctgctgaagacgccgtggagggctgcctcggctatgcaattcttcactaagggttaccaagagaccatctctgatgtccttaacgatgcgatctttgacgaagaccacgatgagatggttatcgtcaaggatatcgatatgttttctatgtgcgagcaccatctcgtccctttcgttgggaaggtgcatatcggttatctgccgaataagcaggtgttgggtctttcgaaattagcgcgcattgtcgagatctacagccgccggctgcaagttcaggagcgactcacgaagcagatcgccgtcgctatcacggaggccttgcgtccggccggtgtaggtgtcgtggtcgaggcaacccatatgtgcatggtcatgcgtggtgtgcagaagatgaactcgaagaccgtcacctctacgatgttgggcgtctttcgcgaggatccgaagacgcgtgaggagtttcttacccttattcgttct

SEQ ID NO: 13452 - DNA, 750 bp, Artificial Sequence
  Description of Artificial Sequence: Synthetic coding sequence
atggaaaagggtcctgtgagggccccggcagagaaaccacggggagctagatgttccaacggattcccagagcgcgacccaccaagaccgggaccatcccggccggcagagaagcccccgcggccggaggcgaagtccgcacaaccggctgatggatggaaaggagaacgaccgagatctgaggaagataatgaactcaatctcccaaatttggccgcagcctactcatcgatactgagctcattgggtgagaacccgcagcgccaagggctcctcaagactccatggagagctgcaagcgcgatgcagttcttcacgaagggttatcaggaaaccatctcggatgtgctgaacgatgccatcttcgacgaagatcatgacgagatggttatcgtgaaggacattgatatgttctcgatgtgcgaacaccacctggtgcccttcgtgggcaaggtgcatatcggttacctcccaaacaagcaggtcctgggactctccaagctcgccaggatcgtggagatctactcacggcggctgcaagtgcaggagaggctgacgaaacagatcgctgtggctattaccgaagcccttagacccgccggcgtcggagtcgtggtggaagccacccacatgtgcatggtcatgcggggagtgcagaagatgaattcgaaaaccgtgactagcaccatgcttggggtgtttcgggaagatccaaagactcgcgaagagtttctgactctgatcagatcg

SEQ ID NO: 13453 - DNA, 750 bp, Artificial Sequence
  Description of Artificial Sequence: Synthetic coding sequence
atggaaaagggtcctgtgagagccccagcagaaaagcctcgcggtgcgcgctgctcaaacggttttccagaaagagatccgccccgtccgggaccaagcagaccagcagagaagccacctagaccggaggcaaaatccgcgcagcctgcagatggatggaagggagaacgcccacgtagcgaagaggataacgagttgaacctcccaaatctggccgcagcctattcttcgatactgtcctcgcttggggaaaatcctcagcggcaaggccttcttaagaccccttggcgggctgcttcagccatgcagtttttcactaagggttaccaagagacgatctcagacgtgctgaacgatgccatttttgatgaagatcatgacgagatggtgatcgtgaaggacatcgacatgttttcgatgtgtgagcatcatcttgtgcctttcgtgggcaaggtgcacataggatacttgccgaacaagcaggtgcttggcctctccaagctggcgcgcattgtggagatctattcccgcagactgcaggtgcaggagcgactgaccaagcagatcgcagtggcaatcaccgaagcccttcgacctgctggcgtcggtgtcgtggttgaagcaactcatatgtgcatggtcatgaggggcgtgcaaaagatgaattccaagacggtcaccagcaccatgctcggagtctttcgtgaggatcctaagactagagaggaatttcttacccttatcagatcc

SEQ ID NO: 13454 - DNA, 750 bp, Artificial Sequence
  Description of Artificial Sequence: Synthetic coding sequence
atggagaaaggaccagttagagcgccagccgaaaagcctcgcggtgcgcgctgctccaacggattcccggaacgagatccgcctaggccaggcccgagcagaccggctgagaagccccctagacccgaagccaagagtgcccagcctgcagatggatggaaaggcgaaagaccgaggtcggaagaggacaacgaactcaaccttcctaaccttgcggccgcctatagctcgatcttgagcagcctgggagaaaaccctcaacgtcaagggctgctgaaaactccatggcgggcggcttcggccatgcagttctttactaagggataccaggagacgatctcggatgtcctgaatgacgcgatctttgacgaggatcacgacgagatggtcatagtgaaggacatcgatatgttctcgatgtgtgaacatcatctggtgccattcgtggggaaggtgcacatcggctacctcccaaacaaacaagtcctcggactgtctaagctggcccgcatcgtagaaatctactcgaggcggctgcaggtgcaggaacggctcactaagcagattgcggtggcgatcactgaggcgctccgccctgcgggggtcggcgtcgtggtggaagccacccacatgtgcatggtcatgcgaggagtgcagaaaatgaattcaaagactgttacctcaaccatgctgggagtgttccgggaggaccctaagacgagagaggaattcctgaccttgattcgctcg

SEQ ID NO: 13455 - DNA, 750 bp, Artificial Sequence
  Description of Artificial Sequence: Synthetic coding sequence
atggagaagggacccgtgagggctccggccgagaagcctaggggagcaagatgctcaaacggcttcccagagagggaccctccgcgcccagggccttcgcgcccagccgaaaagccaccgcgccctgaagcgaagtcggcccaacctgccgatggatggaagggcgaaagacctaggtcggaggaagataatgaacttaacctgccgaacctggccgccgcgtactcctcaatcctcagctcgctgggagaaaaccctcagcggcagggactccttaagaccccgtggcgggccgcatcggcgatgcagttctttactaagggataccaggaaactatctcggacgtcctcaacgatgccattttcgatgaggaccacgatgaaatggtaatcgtgaaagatatcgacatgttttcgatgtgtgagcaccatctggtgccattcgtgggaaaggtgcacatcggctacctcccgaacaagcaggtgctcggcttgagcaagctggcccggatcgtcgaaatctactcccgccgcctccaagtgcaagaacgcctgacgaagcaaattgcggtcgccatcaccgaggctctcagaccagcgggagtcggtgtcgtggtggaagctactcacatgtgcatggtgatgcggggggtgcagaagatgaactccaagactgtgacgtcaacgatgctgggggtgttcagagaggacccgaaaacgcgggaggaattcttgactcttatccgctca

SEQ ID NO: 13456 - DNA, 750 bp, Artificial Sequence
  Description of Artificial Sequence: Synthetic coding sequence
atggaaaagggccccgtcagagccccagcggaaaaacctcgcggcgctaggtgcagcaacggatttccggagagggatcctcctcgcccaggccccagtcgcccggctgaaaaacctccccgccccgaggccaagagcgctcagcctgctgatggctggaagggagagaggcctaggtctgaggaagataacgagctcaatctcccaaatttggctgcagcctattccagcattttgtctagcctgggcgagaacccacagaggcagggcctgttgaagactccctggagagcggcgagcgccatgcagttctttactaagggatatcaggaaactatcagcgacgttcttaatgatgccatttttgatgaagaccatgacgagatggtgatcgtgaaggatattgacatgttcagcatgtgtgaacaccacttggtccccttcgtaggcaaggttcatattggatatctgccaaacaagcaggtgctgggcctctcaaaactggcccgcatcgtggagatatactctagacgcctgcaggtgcaagaacgcctgactaagcagattgccgtggcaataacggaagctctccgccccgctggtgtcggagtggttgtcgaggccactcacatgtgtatggtcatgagaggagttcagaaaatgaacagtaaaactgtgacttccacgatgcttggcgtttttagagaagaccctaagacacgcgaggagttcctcaccctgatccgctca

SEQ ID NO: 13457 - DNA, 750 bp, Artificial Sequence
  Description of Artificial Sequence: Synthetic coding sequence
atggaaaaaggccccgtccgtgcgcctgccgaaaagccccggggagcacgttgtagcaacggttttccagagagagatccgcctagaccaggacctagcagacctgccgaaaaacctccccgccccgaggcaaagagcgctcaaccagccgatggatggaaaggtgaacggcctaggtcggaagaagataacgagttgaatcttcccaatcttgcggcagcctattcgagcatcctgtccagcctgggcgagaaccctcaaaggcaaggattgcttaagaccccctggcgggccgcatcagcaatgcaattctttacgaagggctaccaggaaacgatttctgacgtgctcaatgatgcaatattcgacgaagatcatgacgaaatggtgattgtgaaggatattgatatgttctcgatgtgtgaacaccatcttgtgccttttgtgggcaaagtgcacattggatacctgccaaacaagcaggtgctcggactgtccaaacttgcgaggatcgtggagatttactcgcgcaggcttcaggtgcaggaacgcctgaccaagcagattgccgtggcaatcacggaagcactgcgaccagccggggtcggggtcgtggtggaggcgacccatatgtgcatggtgatgagaggtgtgcagaagatgaattccaagactgtcacttccactatgctgggcgtctttagagaggaccctaagactcgcgaggaatttctgacgctcattagatcc

SEQ ID NO: 13458 - DNA, 750 bp, Artificial Sequence
  Description of Artificial Sequence: Synthetic coding sequence
atggaaaagggtccagtccgtgcgcccgctgagaaaccaaggggggctcgatgttcgaatggattcccagagcgggacccaccacggccaggccccagcaggccagccgaaaaacctcccaggccggaggccaagagcgcccagccagcggacggttggaagggggaacggccaagaagcgaggaagacaacgaactgaatttgccaaacctggctgccgcctactcatccattctgagcagcctgggggaaaatccgcagagacaaggcttgttgaaaacaccgtggcgggcagcctctgcgatgcagtttttcacgaagggttaccaggagaccatctccgacgtcctgaacgacgccatttttgacgaagaccacgacgagatggtcattgtgaaagatattgacatgttcagcatgtgcgagcaccacctagtgcccttcgtcgggaaggtacacatcggctacctgccaaacaagcaggtattgggactttctaaacttgccaggatcgtggaaatatattctcgcagattgcaggtgcaggaaagactgacaaagcaaattgccgtggcaataacagaggctctgcgccctgcaggagttggcgtcgttgtggaggccacccatatgtgtatggtaatgcgcggggttcagaagatgaacagtaaaactgttacgtccactatgctgggagtgttccgtgaggaccccaagacacgggaagaatttttgacactcatcagaagc

SEQ ID NO: 13459 - DNA, 750 bp, Artificial Sequence
  Description of Artificial Sequence: Synthetic coding sequence
atggagaagggtcctgtgagagcaccagcggaaaagcctcgaggagcacgctgctccaatggttttcccgagcgagatcctccgaggccagggccatccagacctgccgaaaaaccgccgaggccggaagcaaagtcggcccagccggctgatggctggaagggtgaaagacctcgctctgaagaagataacgaacttaaccttcccaacctggcggccgcatactcgagcattctgtcgtctctcggagagaacccccaacgccaagggctccttaagaccccctggcgagccgcatcagctatgcagtttttcactaagggttaccaagagactataagcgatgtcctgaacgatgccattttcgatgaggaccatgacgagatggtcattgtcaaagacatcgatatgttctccatgtgtgaacatcacctggtcccttttgtggggaaggtccatattggatacctgcccaacaaacaggtgctgggtcttagcaaacttgcaagaattgtcgagatttacagccgtagactccaggtgcaggagcgccttacgaagcaaattgcagtcgcgatcaccgaagcacttaggccagccggagtcggtgtggtggtcgaagccactcacatgtgtatggtgatgagaggtgtgcaaaagatgaacagcaagaccgtgacgagcacgatgttgggagtgttcagagaggatccaaaaactcgggaggagttcctgaccctgatccgttcg

SEQ ID NO: 13460 - DNA, 750 bp, Artificial Sequence
  Description of Artificial Sequence: Synthetic coding sequence
atggaaaagggaccagttagagcaccagctgaaaaaccaagaggagcaagatgtagtaatggattccctgaaagagatccacctaggcctggtccatcaagaccagctgaaaaacctccaagacctgaagctaaatcagctcaaccagcagatggatggaagggagaacgtccaaggtctgaagaagataatgaattaaatttaccaaatcttgctgcagcatattcatctattcttagttcattaggagagaatccacagaggcaaggacttcttaaaacaccttggagagcagcatcagcaatgcaattttttacaaaaggatatcaagaaacaatttctgatgttcttaacgatgctattttcgatgaagatcatgatgagatggttattgtcaaagatattgacatgttttcaatgtgtgaacatcatttagtaccatttgttggaaaagttcatattggatatttaccaaacaaacaagttttaggtcttagtaaattagctcgtattgtggaaatttactctagaagactacaagttcaagaaagattaactaaacaaattgcagttgcaattactgaagcattgagacctgcaggagttggagtggtagttgaagcaactcatatgtgtatggtaatgcgaggagtacaaaaaatgaattcaaaaactgttacaagtacaatgttaggagttttcagagaggatccaaaaacccgagaagaattcttaactttaataagatca

SEQ ID NO: 13461 - DNA, 750 bp, Artificial Sequence
  Description of Artificial Sequence: Synthetic coding sequence
atggaaaaaggaccagtaagagctcccgctgaaaagccccgaggggctaggtgttctaatggattccccgaaagagatccgcctcggcctgggccaagtcgacctgcagagaaacctcctcgccctgaggctaaatcagcccagccagcagatggatggaagggggaacgaccacgctcagaagaagataacgaactcaaccttccaaacctcgcagcagcatattcctcgatacttagttctctcggggagaatccacagagacaggggcttcttaaaactccatggcgggccgcatctgccatgcaattttttacgaagggatatcaggaaactatctccgatgttctaaacgatgccatttttgatgaagatcacgacgaaatggtgatcgtgaaagacatagacatgttttctatgtgtgaacaccacctcgtcccattcgtggggaaagtccacataggatatcttccaaataaacaggtgttggggctctcaaaattagctcggatagtagaaatctactctaggagattacaagtccaggaacggctaacaaaacagattgccgtcgcaataactgaagccctaaggccagctggggtaggagtggtagtagaagccactcatatgtgcatggtgatgaggggagtgcagaaaatgaattcaaaaactgtgacatctactatgctaggggtgtttagggaggatccaaaaacaagagaagaattcctcacactgatcagatct

SEQ ID NO: 13462 - DNA, 750 bp, Artificial Sequence
  Description of Artificial Sequence: Synthetic coding sequence
atggagaagggccctgtgcgcgcacctgccgagaaaccccgcggagcaaggtgttctaacgggttcccagagagggaccctccccgcccggggccttcccgacctgccgaaaaaccgcctaggccagaggccaaatctgcccagcctgccgacggatggaaaggcgaaagaccgcgctctgaagaggacaacgaactgaatctaccaaatcttgccgctgcctactcgtccatcctctcgtctctaggagagaatccccagaggcaggggctgttaaagactccttggagggcagcaagtgcgatgcagtttttcaccaaggggtaccaagagacaatttcagatgttctaaatgacgccatctttgacgaggatcacgatgaaatggtgatcgttaaggacatcgacatgttttccatgtgtgagcatcacctcgtgcctttcgtgggaaaggttcacatcggatatctgcctaataagcaagtattagggctatctaagctagctaggatagtggaaatctactcgaggcgtctgcaggtgcaggaaaggcttaccaagcagatcgccgttgcgatcactgaagccctacgccccgcaggcgttggggtggtggttgaagccacacacatgtgcatggtgatgcgaggggtacagaagatgaattccaagaccgtcaccagtaccatgttgggggtgtttcgggaggaccctaagacacgtgaggaattcctcactctgatcaggtca

SEQ ID NO: 13463 - DNA, 750 bp, Artificial Sequence
  Description of Artificial Sequence: Synthetic coding sequence
atggaaaaagggccagtgagggcccctgccgagaaaccacggggggcacgctgttctaacggtttcccagaacgcgatccccctcgacctggccctagtagaccagctgagaagccccctcggccagaggcaaaatccgcacagcctgctgacgggtggaaaggggagcggcctcggagcgaggaagacaacgaactgaatctaccaaacctggccgcagcatactctagcatactatctagcctaggagaaaaccctcagagacagggcctgctgaaaacaccctggagagctgcctccgctatgcagtttttcaccaagggttatcaggagaccatttccgatgtgctgaatgacgccatttttgacgaagatcatgatgagatggttattgtgaaggatattgacatgttcagcatgtgcgaacaccacctagtgccattcgtgggcaaggtgcacattggttacctacctaataagcaagtgctgggactctccaagctggcccgcatcgtggaaatctactcccgaaggctgcaggtgcaggagaggctcacaaagcagattgccgttgctattactgaagccctgcggcccgccggagtgggtgtcgtggtggaagccacacacatgtgcatggtcatgcgaggagtgcagaaaatgaacagcaagaccgtgactagcaccatgctgggcgtgtttagagaagatcctaagacacgcgaggaattcttaaccttgattcggtcc

SEQ ID NO: 13464 - DNA, 750 bp, Artificial Sequence
  Description of Artificial Sequence: Synthetic coding sequence
atggagaaaggcccggtgagagcacccgctgaaaaaccgaggggagcacggtgctctaacgggtttcccgagagggatccccctaggcccggacccagcagacctgcggagaagccccctcgccccgaggcgaagtctgcccagcctgcagatggttggaagggggaacggccgcggagcgaggaggataacgagctgaatttacctaacctagccgcagcatattcctcaatactttcctctctgggagagaatccacagcgccagggtctactcaaaacgccctggcgggctgcttcagctatgcagttctttaccaagggttatcaggagaccattagtgacgtcctaaacgacgccatttttgatgaggaccatgatgaaatggttatcgtcaaggacattgatatgttttctatgtgtgaacaccatctggtccccttcgtgggcaaggtccatattggctacttgcccaacaaacaggtgctgggactcagcaaattagcacgaatcgtggagatctacagtagacggctgcaggttcaggagcggcttaccaaacagattgctgtggccataacggaggcattaaggcctgcaggtgttggcgttgttgtggaggccacacacatgtgtatggtgatgcgcggtgtccagaagatgaacagcaagacagtcacttcaacaatgctgggagtcttccgtgaggacccaaaaaccagagaggaatttcttactctcatccggtcg

SEQ ID NO: 13465 - DNA, 750 bp, Artificial Sequence
  Description of Artificial Sequence: Synthetic coding sequence
atggagaagggccctgtgcgcgcgcctgcagaaaagcctcgtggagcaaggtgttcgaacgggtttcctgaacgagatccaccacgccctggaccatcaagaccagcagaaaagccaccaagacctgaggccaagagtgctcaaccagcggacggatggaagggggaaagacctcgctcggaagaagataatgaactcaatctccctaacctcgccgcagcatactcctcaatcctgagctcactgggtgaaaatccacaacgacaaggtctgcttaaaaccccctggcgggcagcgagcgcaatgcagttcttcactaaaggttaccaggaaactatttccgatgtcctgaatgacgcaatctttgatgaagatcatgatgagatggtgattgtgaaggatattgacatgttttccatgtgtgaacatcacctggtaccttttgtcggcaaagtgcatattggttacttgccgaataagcaggtccttggccttagcaagttggctcgcattgttgagatttacagccgccgactgcaggtccaggaaagactcactaagcagatagccgtcgccataactgaagccctgaggcctgccggggtcggtgtggtggtggaagctacccacatgtgcatggtcatgcggggggtgcagaagatgaattcgaaaaccgtgacttcaaccatgctgggtgtgtttagagaagatccaaagactagagaggaattccttacccttattcgttcg

SEQ ID NO: 13466 - DNA, 750 bp, Artificial Sequence
  Description of Artificial Sequence: Synthetic coding sequence
atggaaaaaggacccgtcagagcccctgctgagaaacctcgcggtgcacgctgcagcaacggctttcccgagcgcgatcctcctagaccaggacccagccggcctgccgaaaagccacctaggccagaggcaaaaagcgcacaaccagctgacggctggaaaggcgagcgccccaggtctgaggaagacaacgaactgaacctgccaaaccttgcagccgcatatagcagcatcctctctagcttaggcgagaaccctcagaggcagggactccttaaaacaccttggcgtgctgcatccgctatgcagttttttacaaagggataccaggagaccatcagcgacgtgcttaacgacgccatttttgacgaagaccacgacgagatggtgatcgtcaaggacatcgacatgttttcaatgtgcgagcaccatctggttcctttcgtcgggaaggttcacattgggtacttgcccaacaaacaggtactgggcctgtctaagctggctcggatcgtggagatttatagtcgcaggcttcaagttcaagagagacttaccaaacaaattgcggtcgcgatcacagaagcactgcgtccagctggcgttggtgtggtggtggaagcaactcatatgtgcatggtgatgcgcggcgttcagaaaatgaacagcaagacagtgacctctaccatgttgggagtgtttagggaggatcccaagacaagggaagagttcctgactctgatcaggagt

SEQ ID NO: 13467 - DNA, 750 bp, Artificial Sequence
  Description of Artificial Sequence: Synthetic coding sequence
atggagaaagggcccgtgcgagcaccagcggagaaaccccggggcgcgcgctgttccaatggcttcccagaaagagatcctccgcgcccgggtccttcgcggcctgccgaaaagccccctagacctgaggctaagtcggcccagcctgcggacggttggaagggagagcgtcctaggtccgaagaagataacgagttgaatttgccgaacctggctgccgcgtattcgtcaatcctgtcctcactgggagaaaatccgcaacgccaaggcctgctgaaaaccccatggcgcgctgcatcagccatgcagtttttcactaaagggtaccaggaaacgatctccgacgtcctgaacgacgcgatttttgatgaggaccatgatgaaatggtgattgtcaaggacatcgatatgtttagtatgtgcgaacatcacctggtcccatttgtgggaaaagtgcacatcggttacctgcccaacaagcaggttctcggactctcgaagctggctagaatcgtggaaatctactcgaggagacttcaagtccaggaaagactgaccaagcagatcgctgtggctataactgaggccctgcgccccgccggagtgggagtcgttgtggaggccactcacatgtgcatggtgatgcgcggagtgcagaagatgaactcaaagacggtgacctcgactatgctgggagtgttcagagaggatccaaagactcgggaagagttcctgactctgatccggtca

SEQ ID NO: 13468 - DNA, 750 bp, Artificial Sequence
  Description of Artificial Sequence: Synthetic coding sequence
atggagaagggaccagtgagggcccccgcagagaaacctcgcggtgcaagatgtagcaacggatttccagaaagagatccgccaaggccgggtcctagcagacccgcagaaaagccgccccggcctgaagccaaatcggcccagcctgcagatggatggaagggtgagcggccgaggtccgaggaggataatgaactcaaccttccaaacctggcagcggcatactcctcaattctgtcgtcgctcggagaaaatccgcagcggcaaggacttctcaagacgccttggcgagccgccagcgcaatgcaattcttcactaagggttaccaggagactatctccgatgtgctcaatgacgcaatcttcgatgaggaccatgacgagatggtgatcgtcaaggacatagatatgttttcaatgtgcgagcatcacctcgttccttttgtgggaaaggtgcatatcggctacctccctaacaagcaagtgctgggtcttagcaaactggcaagaattgtcgaaatctacagcaggaggcttcaggtgcaggagcgcttgaccaaacaaatagccgtggcgatcaccgaagcgctgcggccagcaggagtgggagtcgtggtggaagcaacccacatgtgtatggtgatgcggggagtgcaaaagatgaactccaagacggtgacctcgactatgctcggggtctttagggaggaccctaaaactcgggaggaatttctgactctgattcggtcc

SEQ ID NO: 13469 - DNA, 750 bp, Artificial Sequence
  Description of Artificial Sequence: Synthetic coding sequence
atggaaaagggccctgtacgggcacccgcagagaaaccgcggggagcacgatgcagtaatggtttccccgaacgagatcctcctagaccaggaccatcaaggccggccgaaaagcctccgcgccctgaggcgaagtcggcacagccagcagacggttggaagggggagcggccgcggagcgaagaggataacgaattgaacttgcccaaccttgcagcagcgtacagctccatactctcgtcgcttggagaaaacccacagaggcagggcttgcttaagaccccttggagggcagcatcagctatgcagttctttaccaaagggtaccaggagactatctccgatgtcctcaatgacgccatttttgatgaagatcacgatgagatggtgattgtgaaggacatcgacatgttttcgatgtgtgagcatcacctcgtgccctttgttggaaaggtccatataggttaccttcctaataagcaagtcctgggactgtccaaactcgcgagaattgtggaaatctatagcagaaggctgcaagtccaggaacgtcttaccaaacaaattgctgtggcgatcaccgaggcgcttcgccccgccggtgtgggcgtggtggttgaagcaacgcatatgtgtatggtcatgaggggagtgcaaaagatgaatagcaaaactgtgacttcgactatgctgggagttttcagagaagatccaaagacgcgagaggaatttctcaccctgattcgttca

SEQ ID NO: 13470 - DNA, 750 bp, Artificial Sequence
  Description of Artificial Sequence: Synthetic coding sequence
atggaaaagggacctgtgcgggcaccagcagaaaagccacgcggagcgcgctgtagcaacggctttcctgaacgtgatcctcccagacctggtccgagtcggcctgccgaaaaacctcctagacccgaagccaaatcggcacaaccagcagacggctggaaaggtgaacggcccagatcggaggaggacaacgaattgaacctgcctaacctggcagcggcatacagctccatactgtcatccctcggagaaaacccgcaaaggcaagggctgttgaaaacgccttggcgagcagcaagcgcaatgcagttctttactaagggttaccaggagactatctcggatgtcctgaacgacgcgatctttgatgaagatcatgatgaaatggtgatcgtgaaggacatcgatatgttctccatgtgtgagcatcacctggtgcctttcgtgggaaaagtccatattggatacctccccaacaagcaagtgcttgggctctcaaagctcgccaggatcgtggagatttactcgagacgacttcaggtgcaggagcgccttacgaagcagattgccgtcgcaatcactgaagcacttcgaccggcaggagtgggagtggtcgtggaagcaactcatatgtgtatggtgatgcgtggtgtgcagaagatgaactcaaagactgtgacttcaaccatgcttggagtttttagagaggatcccaagactagagaggaattccttacgttgattagatcg

SEQ ID NO: 13471 - DNA, 750 bp, Artificial Sequence
  Description of Artificial Sequence: Synthetic coding sequence
atggagaagggcccagtgagggccccagccgagaaacctaggggggcacgatgctccaacggcttccccgaaagagacccccctcggcctggtccctcaagacctgctgaaaagccccccaggcctgaagctaaatccgcccaacccgcagatggttggaagggagagaggcctagatccgaagaagataacgagctcaacctgcccaacctagccgcggcctactcaagtatcctgagctccctgggggagaacccacagcgccaggggctgctgaagacaccatggcgggctgccagtgcaatgcagttctttactaaggggtaccaggaaacgataagcgatgtgctgaatgatgcgatattcgacgaggaccacgacgagatggtgattgtgaaggatatcgacatgttctctatgtgcgaacatcacttagtgccttttgttggcaaagtgcacatcggctatttgcccaataaacaggtactcggcttgagtaagctggccaggatcgtcgagatttattctcggcgcctacaagttcaggagcgacttacaaagcagatagccgtcgctatcactgaggcactacgacctgcaggggtaggagtcgttgtggaagcgacacacatgtgcatggtgatgaggggggtacagaaaatgaattctaaaaccgttacgagtacaatgttgggcgttttcagagaggatccaaagactcgggaagagtttctgacccttattcgttca

SEQ ID NO: 13472 - DNA, 750 bp, Artificial Sequence
  Description of Artificial Sequence: Synthetic coding sequence
atggaaaagggtccagtccgggccccagcggaaaaacctcggggcgcaaggtgtagcaacggtttcccggagcgcgacccgccgcggccagggccttctcgccccgccgagaagccgcctaggccagaggcaaagagcgcccagccggccgacggatggaagggggaacggccacggtcggaggaggacaacgagctcaacctcccgaacctggcagcagcgtactcgtctatcctgagctcccttggagagaacccacagcgccaaggactgctcaagaccccatggcgcgcggcctccgccatgcagttcttcaccaaggggtaccaggagactatctcggatgtgctgaatgatgcgatttttgatgaggaccacgacgaaatggtgatcgtgaaggacatcgatatgtttagcatgtgcgagcaccatctggtgcctttcgtcgggaaggtgcacatcggatacctccctaacaaacaagtcctgggactctccaagctggctcgaatcgtggaaatctactcacggcggctccaagtgcaagagagacttacgaagcagatcgcagtcgccatcaccgaagctctccggcctgcaggagtgggtgtggtggtcgaagctacccacatgtgcatggtcatgagaggagtccagaagatgaactcgaaaactgtgaccagcactatgttgggcgtctttagggaagatccgaaaacgcgggaggaattcctgaccctgatcagatcc

SEQ ID NO: 13473 - DNA, 750 bp, Artificial Sequence
  Description of Artificial Sequence: Synthetic coding sequence
atggaaaaagggccggtgcgggcccctgccgaaaagccgcgcggagccaggtgtagcaatggtttcccagaacgggatccacccagacctgggccttccaggcccgccgagaagccgccaagaccggaggctaagagcgcgcagccggctgacggatggaagggagaacgccctagatcggaggaggacaatgaactgaacctgccgaatctggccgcagcctacagctcaatcctgagcagcttgggagaaaatccgcagaggcagggactccttaagactccgtggcgcgccgcatctgccatgcaattcttcaccaagggttaccaggaaaccatctccgatgtcctgaatgacgctatcttcgacgaagatcacgacgaaatggtgattgtgaaggatatcgacatgttctcgatgtgtgaacatcacctggtgccgttcgtgggaaaagtgcacattggatacctgccaaacaagcaggtcctgggactgtcgaagctcgcccgcatcgtcgaaatctactcccggcggctccaggtgcaagaacggttgactaagcagatcgcggtggccatcactgaagcacttaggcctgctggcgttggagtggtggtggaagcaacccacatgtgcatggtcatgagaggcgttcagaagatgaattcgaaaacggtgacctccactatgcttggagtctttcgcgaggaccctaagacgcgggaagagttccttaccctgatcaggtcg

SEQ ID NO: 13474 - DNA, 750 bp, Artificial Sequence
  Description of Artificial Sequence: Synthetic coding sequence
atggagaagggccctgtacgcgcccccgcagagaaaccgcgcggggcaaggtgttctaatggtttcccagaaagagatccacctaggccaggaccatcccggcctgccgaaaagccaccgcgccctgaggccaaaagtgctcagccggcagacggctggaaaggcgagcgaccccgcagcgaagaagataacgaacttaatctgcctaacctggccgccgcctattcatctatactgagttctctgggggaaaaccctcagcggcagggactcctgaaaacgccttggcgcgccgcctccgccatgcagttcttcactaaggggtatcaagagaccatctcagacgtgcttaacgatgctatcttcgacgaagaccacgatgaaatggtgatagtgaaagacatcgacatgtttagtatgtgcgagcaccatcttgttcccttcgtcgggaaggttcacattggctacctgcccaataaacaagtgctgggcctgtctaaacttgccaggattgtggaaatttacagcaggaggttgcaggttcaggagcgcctgacaaagcagatcgcggtggctattaccgaagcgctgaggcccgccggggtgggagttgtagttgaggccacacacatgtgtatggtgatgcgcggggtccaaaaaatgaacagtaaaactgtgacctcaaccatgctcggcgtatttagagaggatccgaagactagggaggaatttctgacactcatccggtcc

SEQ ID NO: 13475 - DNA, 750 bp, Artificial Sequence
  Description of Artificial Sequence: Synthetic coding sequence
atggaaaaagggcctgtcagagcccctgcagagaagccgcggggagcccggtgctcgaatggattcccagagcgcgacccaccgcgcccaggaccgtcccgcccggccgaaaagccgccacgccccgaagcgaagagcgctcagccggccgatgggtggaagggcgagcgcccacggtccgaagaagataatgagctcaacttgcccaacctcgccgcggcatactcgtcaattctctcatcgcttggagaaaacccacagcgccaaggcctcctgaaaacgccgtggcgggcagcatccgcaatgcagttcttcactaagggctaccaggaaaccatctcggacgtgctgaacgacgcgatcttcgatgaagaccatgatgaaatggtgatcgtgaaggacattgacatgttttcaatgtgcgagcaccatctggtgccattcgtcgggaaggtgcacattggatacctgccgaacaaacaggtgctcggattgtctaaacttgccaggatcgtggaaatctactcgcgacggctgcaagtccaagagagactgactaagcagattgccgttgccatcaccgaggctcttcgcccggccggcgtgggagtggtggtggaggcgacccacatgtgcatggtgatgcgcggagtgcagaagatgaattcgaagactgtcactagcactatgctcggagtgttccgcgaagaccctaaaacccgggaggaattcctgactctcatcagatca

SEQ ID NO: 13476 - DNA, 750 bp, Artificial Sequence
  Description of Artificial Sequence: Synthetic coding sequence
atggaaaagggtcctgtgcgtgcccccgctgaaaagcctcgaggagctagatgcagtaatggcttccccgaacgagacccccctagaccaggcccgtctagacctgctgaaaagcctcctcgacctgaggccaagtcagcccagccagcggatgggtggaagggggagagacccaggagcgaggaagacaacgaactcaacctacctaatttggcggccgcttacagctcaatactgagctctttgggggaaaatcctcagaggcagggcctgctgaagacaccatggcgagcagcgagtgctatgcagtttttcactaaaggctaccaagagacaattagtgatgttttaaatgatgccatttttgacgaagaccatgatgagatggttatcgtgaaagatattgatatgttcagcatgtgcgaacaccacctggttccctttgtcggtaaagttcacattgggtatctcccgaacaaacaggtgctgggcctgtcgaagttggcgcgaatagtcgaaatttactcccggaggctccaggttcaagaacgacttacgaagcagatcgcagtggctatcactgaggccttgcgcccagctggcgtaggagtggtcgtggaagctacccacatgtgtatggtgatgcgtggcgttcagaaaatgaacagtaagacagtcacgagtaccatgctcggagtcttcagagaggaccccaaaaccagagaggaattcctgaccctgatccgatcc

SEQ ID NO: 13477 - DNA, 750 bp, Artificial Sequence
  Description of Artificial Sequence: Synthetic coding sequence
atggagaagggaccagtccgagcgccggccgaaaagccgcggggcgcgagatgctccaatggattcccagaacgcgatccgccacggcctggcccatcaagaccggcagagaaaccaccccgccctgaggccaaatcggcccagccggccgatggctggaagggcgagcgcccgagatcggaggaggacaacgagctgaacttgccgaacctggccgcggcttacagctcgatcctgtcgtcgcttggggaaaaccctcagcggcaaggcctgcttaagactccttggagggcggcgtccgctatgcagttcttcactaagggataccaggagactatcagcgatgtgctcaatgatgcgatatttgacgaggaccatgatgagatggttatcgtgaaggacattgacatgtttagtatgtgcgaacatcacctggtgcccttcgtgggtaaagtccacatcggttacctgcccaataagcaggtgctgggcctcagcaagttggcgcgcatcgtggagatctactcccgcagactgcaggtgcaggaacgcctcacgaagcagatcgctgttgctattactgaagcccttcggcctgccggagtgggcgtggtggtggaggccacgcacatgtgtatggtgatgcgtggtgtgcaaaagatgaacagcaaaaccgtgacttctaccatgctgggagtgttccgagaagatcccaaaacccgagaagagttcttgactctcatcaggtcg

SEQ ID NO: 13478 - DNA, 750 bp, Artificial Sequence
  Description of Artificial Sequence: Synthetic coding sequence
atggaaaaggggcccgtgcgggccccagccgaaaaaccgcgaggcgctagatgctcgaacggatttccagaacgcgatccaccgcggcctgggccatccagaccagctgagaaaccaccgcgccctgaggccaaatcggctcagccggccgacggatggaagggagagcgcccccggagcgaggaagataacgagctgaaccttccaaacctggcagcggcgtactcctcaatcctgtcgagcctgggcgaaaatccccagaggcagggactgctcaagaccccttggcgtgctgcatcagcgatgcaattctttaccaagggttaccaggaaactatctccgacgtgttgaatgacgccatcttcgacgaggatcacgatgagatggttattgtcaaggacattgatatgttcagcatgtgtgagcatcacctcgtgcccttcgtgggaaaggtgcatatagggtacttgccgaacaagcaggtcctcggcctctcaaagctggccaggatcgttgaaatctacagccggcgccttcaagtccaagaacgattgacgaagcaaatcgcggtggcaatcaccgaagcgctcaggcctgccggagtcggagtggtcgtcgaggctactcacatgtgcatggtgatgaggggggtgcagaagatgaattcgaaaactgtcacctcaactatgctgggtgtgttccgcgaggaccccaaaactcgcgaagagttccttactctgatacgctcg

SEQ ID NO: 13479 - DNA, 750 bp, Artificial Sequence
  Description of Artificial Sequence: Synthetic coding sequence
atggaaaagggacccgttcgagctcccgctgagaaaccaagaggagccagatgcagtaacggattcccagagagagatccgcctagacctgggcctagcagacccgctgaaaaacccccaaggcctgaagcaaagtccgctcaacccgcggacggatggaagggcgaacgccccagaagtgaagaggataatgaactcaatctgcctaatctggccgcagcgtattcctctattctgtcatcgctcggcgagaatccccagcgacaaggcctgttgaaaaccccgtggcgggcagcttccgccatgcagtttttcactaaaggatatcaggaaaccatcagcgacgtgctgaatgacgccatattcgatgaagatcacgatgagatggtcatcgtgaaagatatagatatgttttcgatgtgcgagcatcatctggtcccttttgtggggaaagtgcacattggttatttgcctaataaacaggtgctgggcttaagtaaactggctcgaattgtggaaatctattcccggcgtctgcaagtgcaggagcgtcttacaaaacaaatcgctgtggcgataaccgaagcattgcgccctgccggagtgggcgtcgtggtggaagccacacacatgtgcatggtcatgcgcggagtgcagaagatgaattctaagaccgtcacaagcaccatgttgggtgtgtttagggaggacccgaaaacacgagaagaatttctgacactcatccgatct

SEQ ID NO: 13480 - DNA, 750 bp, Artificial Sequence
  Description of Artificial Sequence: Synthetic coding sequence
atggagaaggggcctgttagggctccggctgaaaaaccacgaggagcgcggtgttccaatggcttccctgaaagagaccccccacggcctggcccatctagacccgccgagaagcctccacgtccggaggccaaatctgcccagcccgccgatggatggaagggcgagcgtcccaggtccgaggaggacaatgagctgaatcttcctaacctggctgcagcgtattcaagtatccttagcagtctgggggagaacccacagcgccaggggttgctgaagaccccgtggcgagcagcatcagctatgcaattcttcaccaagggctaccaggagacaatttctgacgttctcaatgacgccatttttgacgaagaccatgacgagatggtcatagtcaaggacatcgacatgttcagtatgtgcgagcaccatctggtgcccttcgtgggcaaggtccatattggatatcttccaaataagcaggttctgggcctatcaaaactcgcgcggatcgtcgagatttattctcggcggttacaggtccaggaaaggttaacgaagcagatagccgtagctattacagaggctttgcgccccgccggcgtcggggtggtcgttgaggctacccacatgtgtatggtaatgcggggtgtccagaaaatgaactccaagacagttaccagtaccatgcttggggtgtttcgagaagaccctaaaacgcgggaagagttcctgactttgattcgcagc

SEQ ID NO: 13481 - DNA, 750 bp, Artificial Sequence
  Description of Artificial Sequence: Synthetic coding sequence
atggaaaagggccctgtcagagcgccagctgagaaaccacgcggagctcgatgcagcaacggattccctgagcgagacccaccacggcccggaccatcccggcctgctgagaagccccctcgccctgaagcaaagtctgcccaaccagctgatggctggaaaggagaaagacctaggtccgaagaggacaacgaactcaatctgcctaacctggccgcagcatactccagtatcctcagcagtcttggcgagaatccccagcgacagggtcttcttaagaccccctggcgcgctgcttcggcgatgcaattcttcaccaagggttatcaggaaacaatctccgatgttcttaacgacgccattttcgacgaggatcatgacgaaatggtgatagttaaggacatcgacatgttcagtatgtgcgagcatcaccttgtccctttcgtcggaaaggtccacatcgggtacctgcccaacaagcaggtcttgggactgtcgaaactcgcaaggatcgtggaaatatacagcagaaggcttcaagtgcaggagaggctgaccaagcagatagccgtggccataacagaagccctgcgcccagccggggtgggagtggtagtcgaggcaacgcatatgtgtatggtgatgcgtggcgtacagaagatgaattctaaaaccgtgacatcaaccatgctgggcgtattccgagaggatcccaagaccagagaggaatttctgacattgattcggagc

SEQ ID NO: 13482 - DNA, 750 bp, Artificial Sequence
  Description of Artificial Sequence: Synthetic coding sequence
atggaaaaaggccctgtacgtgccccagccgagaaaccacggggggcgagatgttcaaacggattcccggaacgcgaccccccccgccccgggccgagtcgccctgcagagaaacccccgagaccagaagctaagagcgctcagcccgccgatggctggaagggtgaacgccctcggtctgaagaggacaacgagctaaatctgccaaacttggctgcagcttatagcagcatcttatctagcctcggcgaaaatccacagcgacaagggcttctaaagactccatggcgggcagcgtctgccatgcagttctttaccaaggggtaccaggagactatctctgatgtccttaacgatgctatttttgatgaagatcacgacgagatggtgatagtgaaagacattgatatgttcagtatgtgtgagcatcacctggttccctttgtgggaaaagtgcatattggatacttgcctaataaacaggtccttggtttgtccaagctggcgcggatagtggagatttactccaggagactccaggtgcaggaacgtttgactaaacaaatcgccgttgccatcacggaggcccttcgcccagccggggtgggagttgtggttgaagctactcacatgtgcatggtgatgaggggggttcagaaaatgaatagtaagactgttacaagcacgatgttgggggtgtttagagaggaccccaaaacacgtgaggagtttcttaccttaatcaggtcc

SEQ ID NO: 13483 - DNA, 750 bp, Artificial Sequence; identical to SEQ ID NO: 13479
  Description of Artificial Sequence: Synthetic coding sequence

SEQ ID NO: 13484 - DNA, 750 bp, Artificial Sequence
  Description of Artificial Sequence: Synthetic coding sequence
atggagaagggccccgtgcgcgcacccgctgagaaacctcgcggcgcacgatgttccaatggcttccctgagagagaccctccacgaccgggtccttctagacccgcagaaaaaccccctcgacccgaggcaaagtccgcacagccggccgacggctggaagggggagcggccccgtagcgaagaggacaatgagttgaacttgccaaacctggctgccgcctactcaagcatcctctccagtctgggggagaacccacaacgccaggggctcctgaaaaccccttggcgcgccgcttcagctatgcagttttttacgaaaggttaccaggagaccataagcgatgtactcaacgacgccattttcgatgaagaccatgacgaaatggtgatcgtaaaggacatcgacatgttctcaatgtgcgaacaccacttggtgccattcgtaggaaaggtgcatattggatacttgcctaacaagcaagttctgggactgtcgaagcttgctagaatcgtggaaatttactcccggcggctccaggtgcaggagcggctgacaaagcaaattgccgttgccatcacagaggcccttcgcccagctggggtgggtgtggtggtggaggccacacacatgtgtatggtgatgagaggagtgcagaagatgaactcaaagaccgtcaccagcaccatgctaggagtctttcgagaagaccctaaaactcgagaggagttcttgacgcttataagaagt

SEQ ID NO: 13485 - DNA, 750 bp, Artificial Sequence
  Description of Artificial Sequence: Synthetic coding sequence
atggagaaaggcccagtccgcgcaccggcggagaagcctcgaggggctcgctgctccaacggattcccagagcgtgaccctccccgacctggacctagcagaccagccgagaagccacccagaccggaagcgaaatcagcgcagcccgcagatggatggaaaggagagcggccacgctccgaagaggataatgagttgaacctgcctaatttggcggcagcctactcgtccatactctcttctcttggggaaaaccctcaacgccaaggcctgcttaagaccccctggcgagcagcatcagcaatgcagtttttcactaagggttaccaggaaactatttcagacgtgcttaatgatgcaattttcgatgaggaccacgacgagatggtcatagtgaaggatatcgacatgttttcaatgtgtgaacaccatcttgttccctttgtgggcaaggtgcatatcggttacctcccaaacaagcaagtgctcggcctttccaaacttgcaagaattgttgaaatctactcaaggcgcctccaagtgcaggaacggctcacgaagcaaattgccgtggccattactgaggctcttaggccagcaggtgtgggggtcgtggtggaagcaacccatatgtgtatggtgatgcgtggcgtccagaagatgaactcgaaaacggtgacctctaccatgctgggtgtctttagagaagatccaaaaactcgggaagaatttctgacgctgataagaagc

SEQ ID NO: 13486 - DNA, 750 bp, Artificial Sequence
  Description of Artificial Sequence: Synthetic coding sequence
atggagaagggaccagtgagagcccccgccgaaaagccgcggggagcacgctgttcgaatggtttccctgagcgcgaccctcctaggccaggacccagccggcccgcggagaagccgccacgcccagaggcaaagtcggcacaacctgcagatgggtggaagggggaacggccacgctccgaggaagataatgagctgaacttgcctaaccttgctgccgcctatagctcgattctctcctcccttggcgagaatccacaacgacaaggtttgcttaaaactccgtggcgtgccgcatccgcaatgcagttctttactaaaggatatcaggaaactattagcgacgtgctgaacgatgcgatatttgatgaagatcatgatgaaatggtcatcgttaaggatatcgatatgttttcaatgtgtgaacaccacctggtgccattcgttggcaaggtgcatattggatacctgccgaataagcaagtgctgggattgtcgaagctggcgagaattgtggaaatctattctcgcaggctccaggtgcaggaacgacttactaagcagatcgcagtggcaattaccgaagcacttagacctgccggggtcggtgtggtggtggaggcaacccacatgtgtatggtgatgcggggagtgcaaaagatgaactcaaagaccgtcacctcaactatgctgggagtctttagagaggaccctaagaccagggaagagttccttactctcattagatcc

SEQ ID NO: 13487 - DNA, 750 bp, Artificial Sequence
  Description of Artificial Sequence: Synthetic coding sequence
atggaaaagggcccagtcagggcccctgccgagaagccgagaggggctagatgctcaaacggtttcccagagagggatcctccccggcccggaccaagcagaccagctgaaaaacctccacgacctgaggctaagagcgctcagcccgcagatggctggaagggagaaagacccagatctgaggaagacaacgaactgaacctgccaaacttggctgccgcttatagttcaatcctcagttccttgggcgagaatcctcaaagacaaggcctcctcaagactccatggcgtgcggcgtctgcaatgcagtttttcaccaaagggtatcaggagaccatctcagacgtgttgaacgatgctatcttcgatgaggatcacgacgaaatggtgattgtgaaagacatcgatatgttttccatgtgtgaacaccacttggtgccttttgttggaaaagtccatattggatacctccctaacaagcaagtcttagggcttagcaaattagcccgaatagtggaaatttattctagaaggctgcaagttcaagagaggttgaccaaacagatcgctgtagctatcacggaggcgctcaggcctgccggcgtgggggtggtcgtggaggcgacccatatgtgcatggtgatgaggggagttcaaaagatgaacagcaagaccgtcaccagtacgatgcttggagtcttcagagaggaccctaagactcgggaggagtttttaaccctgatccgatct

SEQ ID NO: 13488 - DNA, 750 bp, Artificial Sequence
  Description of Artificial Sequence: Synthetic coding sequence
atggagaagggcccggtccgagcgcccgcagagaagccccggggggccagatgttcaaatggcttcccagagagggatcccccaaggcccgggcctagtcgaccggcggaaaaacccccaagacctgaggcgaagtctgcccagccagcggatggttggaaaggcgagcggcccagatccgaggaagacaacgagctgaacttgccaaacctagccgccgcctattcctcaattttatcaagtctaggagagaatcctcagcgtcagggactgttaaagacgccctggcgggcggcgagtgctatgcagttctttacgaaaggctaccaagagaccatcagcgacgtgttgaatgacgccattttcgacgaggatcatgacgagatggttattgtcaaggacatcgacatgttctccatgtgtgagcaccaccttgtaccatttgtgggcaaggtccacattggctaccttcccaacaaacaggtgttgggcctctccaaattggcccgtatcgtggaaatctactctaggcgactccaggtgcaggagaggctcactaagcagattgccgttgccatcacagaggcacttcggcctgctggcgtcggggttgtcgtagaggccacgcatatgtgtatggttatgcgcggcgtgcagaaaatgaattcgaagaccgtgacaagcactatgttgggggtgttccgtgaagacccgaagacccgcgaggagttcttgaccctgatccgtagc

SEQ ID NO: 13489 - DNA, 750 bp, Artificial Sequence
  Description of Artificial Sequence: Synthetic coding sequence
atggaaaagggaccggtacgagcgccagcggaaaaacctcgtggagccaggtgttctaacggcttccctgagagagatcctcctagaccaggaccctcacggcctgcggagaagccaccaagacctgaggcgaagtcagcacagccggctgatggttggaagggggagcgccctcgcagtgaagaggacaacgagctgaaccttccaaacctggctgcggcttacagtagtattctttctagtttaggcgaaaaccctcagcgtcaaggattgctgaagacgccgtggcgggcagctagcgctatgcaattctttacaaagggctatcaggaaacaatctccgatgttcttaacgatgctattttcgacgaggatcatgacgaaatggtcatcgtcaaagacatcgatatgttcagcatgtgcgagcaccatctcgtgccgttcgtcggtaaagtgcatatcggatatcttcctaataagcaagttcttggtctttcaaaactcgcccggattgtggaaatctatagtagacgcctccaagtccaggaacgactcacaaagcaaatcgctgtcgcaataacagaggctctaagaccggcgggcgtcggagtcgttgtggaagcgacccatatgtgtatggtgatgcgcggcgttcaaaagatgaattccaagaccgtaacatcgactatgttgggtgtctttcgcgaggaccccaagacgcgcgaggagttcctcacactgattcgctca

SEQ ID NO: 13490 - DNA, 750 bp, Artificial Sequence
  Description of Artificial Sequence: Synthetic coding sequence
atggagaagggaccggtgagggccccagcagagaagcctcggggcgcacggtgttcaaatggattccctgaaagggatcctccacgccctggcccatcaagacctgcagaaaaaccccctcgtccagaggcgaaatcagcacagccagctgatggttggaagggtgaaagaccacggtcagaagaggacaacgaactcaacttgcctaacctcgcagcagcatactcgtcaatcctgagctcactcggagagaatccacaacgtcaaggcttgcttaagactccctggcgcgcagcttccgccatgcagttctttactaagggataccaggaaaccattagcgacgtgctcaatgacgctattttcgacgaagatcacgatgaaatggtgatcgtgaaggatattgatatgttctccatgtgtgagcatcatctggtgcctttcgtgggaaaggtccatattggttacctccctaacaagcaggtccttgggctcagcaagctggcaaggatagtcgaaatctatagccggagattgcaggtgcaagaaagactgaccaagcaaatcgcagtggcaattaccgaagcacttcgacccgccggtgtgggtgtggtggtcgaagcaacccatatgtgtatggtgatgagaggagtccaaaagatgaattccaaaactgtgacgtcaactatgctgggagtgtttagggaagatcctaagactcgtgaggagttccttacccttatccgttcg

SEQ ID NO: 13491 - DNA, 750 bp, Artificial Sequence
  Description of Artificial Sequence: Synthetic coding sequence
atggagaagggcccagtgcgggcacccgcagaaaagccgcgcggcgcccggtgtagcaacggatttcctgaacgggatcccccccggcctggacctagcaggcctgctgagaaaccacccaggccggaggcgaaaagcgcacagcccgctgacggttggaagggggagagacctagaagcgaggaagataatgagttgaatctgccaaatctcgccgcagcatacagctcgatcctgagctctctgggggagaacccccagagacaagggcttctgaaaacgccatggcgagccgcatctgcgatgcagttcttcacaaagggataccaggagaccattagtgacgtgctgaatgacgctattttcgatgaggaccatgacgagatggtgatcgtgaaggacattgatatgttttctatgtgtgagcatcacttggtcccgttcgtggggaaagtccacattggctatctgcccaacaaacaggttctgggtctatcaaaactcgcacggattgtggaaatatactcacgccgactacaagttcaagaacgtctgacgaagcagatcgccgtggccatcactgaggcattacggccagcaggagtgggcgtagtggttgaggccactcacatgtgtatggtgatgcgtggtgtgcaaaagatgaactccaagaccgtcacctctactatgctcggcgtctttagagaggatcctaaaacaagggaagagttcctcaccttgatccgctcc

SEQ ID NO: 13492 - DNA, 750 bp, Artificial Sequence
  Description of Artificial Sequence: Synthetic coding sequence
atggagaaggggcccgtgcgtgcccccgcagaaaaacctagaggtgcaagatgttccaacgggttccccgagcgcgaccccccacgcccaggcccatcaagaccggccgaaaagccaccccgtcctgaggcaaagtcggcacaacctgcggacggttggaaaggcgaacgtcctaggtccgaagaagataacgagcttaacttgccaaaccttgctgcagcctactcttctatcctgagtagcctgggggagaaccctcaacggcaggggttgcttaagactccgtggcgagcagcatcagctatgcagttcttcaccaagggataccaggaaactatcagcgatgtgctgaatgacgcgatttttgatgaggaccatgatgaaatggtcattgtgaaggatattgacatgttttccatgtgcgaacaccatcttgtgccctttgttgggaaggtgcatattggttacctgccaaacaagcaggtgcttggactctcaaaactggctagaatcgtggagatttactcgcggcggctgcaggtccaagaacgtctgactaagcagattgcagtggcgatcacggaagcgctgcgcccggccggagtgggcgtggtggtggaagctacccatatgtgcatggtgatgcggggcgtgcagaaaatgaattccaagactgttacttccaccatgcttggtgtctttcgcgaggatcctaaaacgagagaagaatttcttactttgatccggagc

SEQ ID NO: 13493 - DNA, 750 bp, Artificial Sequence
  Description of Artificial Sequence: Synthetic coding sequence
atggaaaaggggccggtgagagccccggccgaaaaacccagaggagcacgctgttcgaatggcttccccgaacgggacccgccgcgccccggtcctagccggccggccgagaaacccccgcgccccgaagccaagtcggcacagccagctgatggatggaagggagaacgaccccggagcgaggaagataatgagctgaatctcccaaatctggccgcagcctacagctcaattctcagctccctgggggagaatcctcagaggcaagggctcctgaaaaccccttggagggcagcctcggctatgcaattctttactaaaggataccaagaaaccatctcggacgtgctgaatgatgcgattttcgacgaggaccatgacgagatggtcatcgtgaaggacatcgacatgtttagcatgtgcgagcatcatctggtgcccttcgtgggaaaggtgcacatcggatacctgccaaacaagcaggtgctgggactgtccaagctggcgcgcatcgtcgaaatctattcccggagacttcaggtccaggaacgcctgactaagcagatcgcggtggccattaccgaagccctgcgcccagctggggtgggcgtggtggtggaggccacgcatatgtgcatggtgatgcgtggagtgcaaaagatgaactccaagactgttacctctaccatgctgggcgtctttcgggaagatccaaaaactcgggaagaattcctgaccctcatccgctcg

SEQ ID NO: 13494 - DNA, 750 bp, Artificial Sequence
  Description of Artificial Sequence: Synthetic coding sequence
atggaaaaaggacccgtgcgcgcaccggccgagaagcctaggggcgctcggtgtagcaatgggttcccagaaagggatccacctcgccccggcccatcccggcccgccgagaagccgcccagacctgaagcaaagagcgcccaaccggccgatggatggaagggtgagcggccccgatccgaagaagacaatgagctgaatttgcccaacctcgccgccgcatattcctctatccttagctccttgggtgaaaaccctcaacggcaggggctactgaagacaccctggagagccgcctccgccatgcagttctttaccaagggttatcaagagactattagcgacgtgctgaatgatgccatttttgacgaggaccacgatgagatggtgattgtgaaggatatagacatgttcagcatgtgtgaacaccatctcgtgccatttgtgggtaaagtgcacattggatacctgccgaataagcaggtacttggtttaagcaagcttgctaggatcgtcgaaatctatagcagaagactccaggtccaagaaagactcacgaaacaaattgcagtggcaatcactgaggccttacgccctgcaggtgtaggggtcgtcgtggaagcaacacacatgtgtatggtcatgagaggcgtgcaaaagatgaacagcaagactgtcaccagtactatgttaggtgtgttccgtgaggaccccaagacacgggaagaattcttgacactgattcggagt

SEQ ID NO: 13495 - DNA, 750 bp, Artificial Sequence
  Description of Artificial Sequence: Synthetic coding sequence
atggagaagggacctgtacgggctccagccgagaagccccggggtgcccgctgcagtaatgggttcccggagcgcgaccccccaagacccggacccagccgaccggcagagaaacctcccaggcccgaagccaagtctgctcagcccgccgatggttggaagggcgagcgacccaggtcagaagaggacaacgagctgaacttgcccaatcttgcagccgcttattcttctatcctgtcaagccttggggaaaatccgcagagacagggactactgaaaacaccctggcgggccgctagcgccatgcagttcttcacaaagggctaccaggaaaccatcagcgacgtattgaatgacgcaatttttgatgaagaccacgacgagatggtgattgtgaaagacattgatatgttctccatgtgtgagcatcacctcgttcctttcgtgggaaaagttcatataggatacttgccaaacaaacaagttctgggactgtccaagttggcgcgcatagttgagatttacagtcgtaggctgcaggtacaggaaaggcttacgaaacaaattgcggtggctatcactgaagccctgagacccgcaggcgtcggagtggtcgtggaagcaacccatatgtgcatggtcatgcggggcgtccagaagatgaatagtaagacggtgacgtccacaatgttgggagtgttccgcgaggacccgaagaccagagaggagttcctgactctgatccgcagc

SEQ ID NO: 13496 - DNA, 750 bp, Artificial Sequence
  Description of Artificial Sequence: Synthetic coding sequence
atggagaagggtcccgtcagggccccagcagagaagccacgcggagcaagatgttcaaacggttttcctgagcgggatcctccccggccaggcccaagcagaccagccgagaagccacccagacccgaagcaaaatcggctcagccggcagatggttggaaaggagaaaggccacgaagcgaagaggacaacgagctgaacctgcccaaccttgctgccgcgtactcgtccatcctcagctcccttggagagaaccctcaacgccaaggccttcttaagacgccgtggagagcagcgtccgcaatgcagtttttcacgaagggctaccaggaaaccatttcggatgtgttgaacgatgccattttcgatgaggatcacgacgaaatggtcatagtgaaggacattgacatgttttcaatgtgtgagcaccatctcgtccctttcgtcgggaaagtccatattgggtaccttccgaataagcaggtgctcggtctttcaaaactggcccggatagtcgaaatctatagcaggcgtctgcaggtgcaagaaaggctcactaaacaaattgccgtggcaattaccgaagcgctccggccagccggggtgggtgttgtggtggaggccacccatatgtgtatggtgatgcgaggtgttcaaaagatgaactctaagactgtgaccagcacgatgcttggcgtctttagagaggatcctaagactcgggaggagtttctcactctcattaggtcg

SEQ ID NO: 13497 - DNA, 750 bp, Artificial Sequence
  Description of Artificial Sequence: Synthetic coding sequence
atggagaaaggcccagtccgagccccagcagagaaacccaggggcgctcggtgtagcaacgggtttcccgaacgggaccctccgcggccaggtccttcacgccccgctgaaaagcccccccggccagaggctaagtccgcacagccagctgatggatggaagggagagagacctcgatccgaggaggacaacgaactgaatctacccaatttagctgcggcgtattcctccatcctttcttccctcggagaaaatcctcaacgtcagggcctgctcaaaactccatggcgcgcagcctccgccatgcagttcttcacaaaaggttaccaggagacaatctccgacgtcctgaatgacgccatcttcgacgaagaccatgatgagatggtaatagtgaaggacattgatatgttctccatgtgtgagcatcatctggtgccctttgtcggcaaagttcacatcggctatctgcctaataagcaggttctcggcctgtccaagctggctagaatcgtcgagatatattcacgccgcctgcaagtgcaggaacgcctgacaaaacagatcgctgttgccatcacggaggcactgagacctgccggtgtcggcgtagtggttgaagcgacgcatatgtgtatggtgatgaggggtgtgcaaaagatgaactctaaaacagttactagtaccatgctgggggtttttagagaagatccgaagacacgggaggaattcctcaccctcattcggtca

SEQ ID NO: 13498 - DNA, 750 bp, Artificial Sequence
  Description of Artificial Sequence: Synthetic coding sequence
atggagaagggacccgttagggcccctgcagagaaaccaaggggcgccaggtgtagtaatggtttccctgagagggatccaccccgccccggcccttctaggccagccgagaagccaccaaggcccgaggctaaatccgctcagccagcagatggttggaaaggtgaaaggccacgcagtgaggaggacaacgaactgaacctgcctaaccttgccgcagcctatagcagtatcctttcctcattgggcgagaaccctcagcgtcaaggactgctcaagactccctggcgtgcagctagtgccatgcagtttttcaccaaaggctatcaggagaccatctctgacgtacttaacgacgctatcttcgacgaagaccatgatgagatggtaatcgtcaaagatatcgacatgttcagtatgtgtgagcaccatcttgtcccattcgttggtaaggtccacatcggttacctgcccaacaaacaggtgctgggtctgagcaagctcgctcgcattgtcgagatctattctcgtcgtctgcaggtgcaggagaggctgacaaaacagattgctgtagctataaccgaagccttgcgtcccgccggtgtaggtgtcgtggtggaggccacacatatgtgcatggtaatgaggggcgtgcagaaaatgaacagcaagacagttaccagcaccatgctgggcgtcttcagggaagacccaaaaaccagggaggagttcctgaccttgattaggtcc

SEQ ID NO: 13499 - DNA, 750 bp, Artificial Sequence
  Description of Artificial Sequence: Synthetic coding sequence
atggaaaagggaccagttcgggcccccgctgaaaaacctcggggtgcccggtgctcaaatgggtttccagaacgcgatcctcccagaccggggcctagccgcccagcagagaaacctccgaggcccgaggccaagtctgcgcagccagccgatggctggaaaggcgaaaggcctcggtcagaggaggataatgagctcaatctccccaatctggccgccgcgtacagcagcattcttagctccctcggcgaaaatccccaacgccagggcctgctgaagacgccttggcgagccgcatcagcaatgcagttctttacaaaggggtatcaagagacaatttctgacgtactgaacgatgccatttttgacgaggaccacgatgagatggtgatcgttaaagacattgatatgttctctatgtgcgaacaccacctggtcccatttgttgggaaagtccacattggttaccttccgaataagcaggtgttaggactgtctaagctcgcaagaatcgtcgaaatctattccaggagactacaggtgcaagaacggctaaccaagcaaatcgccgtagcaatcacagaagcactccggcctgctggcgtgggcgtggtggtggaagctacacacatgtgcatggtgatgcgcggagtccagaaaatgaacagtaagactgtgacatcaacaatgctaggtgtttttagggaagacccaaaaactagggaggagtttcttacgcttattcgttcc

SEQ ID NO: 13500 - DNA, 750 bp, Artificial Sequence
  Description of Artificial Sequence: Synthetic coding sequence
atggaaaaggggccagtgagggcgcccgctgaaaaacctaggggtgctagatgctcgaatggattccctgagcgcgatcctcctagaccgggaccaagtagaccagccgaaaaacctcctcgccctgaagctaaaagcgcgcaaccagctgatggttggaaaggtgagagaccccgttcagaggaagataatgaacttaacttacctaatctagcagccgcatacagttcaattttatcctccttgggtgaaaacccacagaggcaaggattgctcaagactccatggcgggcagcttctgcaatgcagttctttaccaaaggatatcaggaaactatttctgacgttttgaacgatgcgattttcgacgaagatcacgatgaaatggtgattgtaaaagatatcgacatgttctctatgtgtgagcatcatctggtaccatttgtcggcaaagtccacattggttacctccctaataagcaggtgttgggtctatcaaaattggcaaggatcgtggagatctattctagacgtctccaggtccaggagaggttaacgaagcagatcgcggtcgctattactgaagccttgcgtccagctggcgtgggtgtggtggtggaggctacccatatgtgtatggtaatgagaggagtgcaaaagatgaactctaagacagtgacttccactatgctaggagtttttagggaagatccgaagaccagggaagagttcctaactctgataagaagc

SEQ ID NO: 13501 - DNA, 750 bp, Artificial Sequence
  Description of Artificial Sequence: Synthetic coding sequence
atggaaaagggaccggtacgcgcacccgccgaaaaaccccggggggcccgctgcagcaacggctttcctgaaagggatcctccacggccaggcccctcacgcccagctgagaaaccaccaagaccggaagctaagtcagcgcagcccgcggatggatggaagggcgagcgcccgcggtcggaagaggataatgaactgaacctgcccaacctggccgccgcctactcgtcaatcctcagcagcctcggagaaaatccgcaaagacaaggactcctcaagactccctggcgcgccgcttccgccatgcaattcttcacgaaggggtaccaagagactatctcagacgtcttgaacgacgcgatctttgacgaggaccatgacgagatggtgatcgtcaaggacatcgatatgttctcgatgtgcgaacaccatctggtgccgtttgtgggaaaggtgcacattggatatctgccaaacaaacaggtcctcggcctgtctaagttggccagaatcgtcgaaatctactcccggcggctccaagttcaggaaaggctcactaaacagatcgccgtggctattactgaagcactccggccagcgggcgtgggagtcgtggtggaggccacccatatgtgtatggttatgcggggagtgcagaaaatgaacagcaagaccgtgactagcaccatgctgggggtgtttcgcgaggacccaaagacccgggaggaatttctgactctcatccgaagc

SEQ ID NO: 13502 - DNA, 750 bp, Artificial Sequence
  Description of Artificial Sequence: Synthetic coding sequence
atggagaagggacccgtccgcgctccggcagaaaaaccaagaggagcccggtgttccaacggattcccagaacgcgaccctccccggccgggcccgtcccgcccggccgaaaagcctcctagaccggaagctaagtcggcgcagcctgcggatggatggaagggagaaagaccgagaagcgaagaggataacgaactgaacctcccaaatctggcagccgcttactcttccatcctgtcgtccctgggcgaaaacccacaacggcaggggctgctcaagaccccatggagagccgcaagcgcaatgcagttctttactaagggatatcaagagactatctcggacgtgctgaacgatgcgatcttcgacgaggaccatgatgagatggtgatcgtgaaagacatagacatgttctcgatgtgtgaacatcacctggtgccattcgtcggaaaggtgcatatcggttacctcccaaacaagcaggtgctcgggctttcgaagctcgctcgcatcgtggagatttactccaggcggctgcaggtgcaggaaagactcaccaagcagatcgccgtggcgatcactgaggcactgcgccctgctggtgtgggagttgttgtggaagcgacccatatgtgcatggtgatgcgtggagtccagaaaatgaattcaaagaccgtcacctccaccatgctgggcgtgttcagggaggacccaaagacccgagaagaattccttacgcttattcgctcc

SEQ ID NO: 13503 - DNA, 750 bp, Artificial Sequence
  Description of Artificial Sequence: Synthetic coding sequence
atggaaaaaggtccggtcagagctcctgccgagaaaccacggggagcacgttgttcaaacggattcccggagagggacccccctcgtccaggccctagtcggcctgcggagaagccgcctcggccggaagcgaaatccgcccagcccgcggatggctggaaaggggagaggccgcgttccgaagaggacaatgagttgaatctgccaaatttagccgctgcttactcttctatcctgtctagcctgggtgaaaatccccagcgtcagggattgctgaaaactccctggcgcgcagctagcgcgatgcaatttttcaccaagggctatcaagaaaccatttccgacgtgcttaacgatgcgatcttcgacgaggatcatgatgagatggtcattgtgaaggatatcgatatgttttcaatgtgcgagcaccatctggtgccatttgttgggaaggttcacatcggatatcttcccaataaacaggtgctgggtttatctaagttggcacgaatagtggaaatttactcccggagattacaagtccaggagaggttgacaaagcagatcgcagtggctatcacagaggccttgcggccagccggggttggggttgtcgttgaggccacgcacatgtgtatggtgatgaggggcgtccaaaaaatgaacagcaagacggttacatctaccatgttgggtgtgttccgggaagatccaaaaacccgagaggagtttttgacccttatccgatcg

SEQ ID NO: 13504 - DNA, 1278 bp, Artificial Sequence
  Description of Artificial Sequence: Synthetic coding sequence
atgggagagccaggccagtctccctccccgcggagttcgcatggttcccctcctacattgagtacgctgacgttgctcctgttactctgtggccacgctcactctcagtgtaagatcctgagatgtaatgcagaatacgtcagcagcaccttgtccctgcgtggaggcggatcttccggcgcacttcgcggcggcgggggcggcggccgtggcgggggcgttgggtctggtggcctctgccgggcattgagatcttacgcattatgcactcgcaggactgcccgaacatgccgtggtgatctggcatttcattccgcggtccatggaattgaagacctgatgattcagcataattgtagccgccagggacctacggcccctcccccacctcgagggcccgctctccccggagcaggctctgggctacctgcccctgacccctgcgattatgaaggtcggttttctcgactccacggaagaccccctggatttcttcattgcgcctccttcggcgaccctcacgtacggtcctttcatcaccatttccatacttgtagagtacaaggcgcttggccattgctggataacgacttcctgttcgtccaggccacatcatctcctatggccttgggtgctaatgccacagctacgaggaagttgaccattatttttaagaatatgcaggagtgcatcgaccagaaagtgtatcaggccgaggtggataatttgccagtggcttttgaagacggcagcatcaacgggggagatcgacccggcggctccagccttagtattcagacggcaaatcccggaaaccacgttgagatacaagccgcatacatcgggaccacaataataattagacagactgccggacagttgagtttttcaattaaagtggcagaggatgtggcgatggctttttccgcagagcaggacttgcagctgtgtgtgggaggttgtcccccctcccagagactatctcggtccgaaaggaacagacggggagcaataacaatcgacacggccagaagactttgcaaagaggggcttccggttgaggatgcatactttcactcgtgcgtatttgatgttctcatctcaggggacccaaacttcaccgtcgcagcacaggcagcgcttgaagacgcacgggcatttttgccagatctagagaagctgcatctgttcccaagcgatgctggggtgccactcagttctgcgactttgttagcccctcttctctccggtttatttgtcctatggttgtgtatacag

SEQ ID NO: 13505 - DNA, 1278 bp, Artificial Sequence
  Description of Artificial Sequence: Synthetic coding sequence
atgggagagcctggacagtcccctagcccgagatcatcccatggctctccgccgaccctttccacgctgaccctgctgctgctcttgtgtggacatgcccacagtcagtgcaagattctgagatgcaatgccgagtatgtgtcctcaacactgtctctcaggggggggggatctagcggtgcactcaggggaggggggggagggggcaggggtggcggcgtcggaagcgggggcctgtgcagggctctgagaagttatgccctgtgtaccaggcgcaccgcacgcacatgtcgcggggacctcgccttccactctgccgtgcatgggattgaggacctgatgattcagcacaactgcagccggcagggccctacagcacctccccctcccaggggacctgctctgcccggagcaggttctggccttcctgccccggatccctgtgactacgagggcagattttcaagacttcacggcagacctcctggatttctgcactgcgccagcttcggggaccctcacgtccggagtttccaccatcatttccacacatgccgggtccagggagcctggccgctgctcgataatgacttcctgtttgttcaggccacttcctcaccaatggctttgggtgctaacgccaccgccacaagaaagctgactattatttttaagaacatgcaggagtgcatagaccaaaaagtataccaggccgaggtcgacaacttgccggtggccttcgaagacggaagcatcaacgggggcgaccggcccgggggcagttcattgtccatccaaaccgccaaccccggcaaccatgttgaaattcaggccgcttatattgggacaacaatcattatccggcagacagccggtcagctttcctttagcatcaaagtggccgaggacgttgcaatggcattttctgccgaacaagaccttcagctttgcgtggggggatgcccaccctcacaacgcctgtcacggtctgagaggaacaggagaggggcaattactatcgacactgcacggaggttgtgcaaggagggcctccccgtggaggatgcctacttccatagctgtgtgttcgacgtgcttatcagcggtgacccaaattttaccgtcgccgcccaggctgccctggaagacgcccgcgcattcctgccagatctggagaaattgcatctgtttccgtctgacgcaggcgtgccgctgagctctgccaccttgctggcaccccttctgagcggactttttgttctctggctgtgtattcag

SEQ ID NO: 13506 - DNA, 1278 bp, Artificial Sequence
  Description of Artificial Sequence: Synthetic coding sequence
atgggcgaacccggccagtcaccttcgccacgatcctcacacggctctccgcccacgttgagtacgttaaccctactgctactgctgtgtggacacgcgcactcgcagtgcaaaattctgcggtgcaacgctgagtacgtgtcgtccaccctttcactcaggggaggcggttcctctggagcgctgcgcggggggggaggaggcggcaggggaggaggcgtagggagcggcggtctttgtcgggccctgagaagttatgcactatgcacccggcggacggcgagaacctgccgaggagacctggccttccacagcgctgtccatgggatagaagacctgatgattcagcacaattgctcacggcaaggtccaacagcacctccccccccacggggtccggccctgcccggcgcagggtcagggctgccagctcctgatccatgcgactacgaagggaggtttagcaggttacacggacgtccaccaggatttcttcattgcgcaagttttggcgatccacacgtcaggtccttccatcaccattttcatacctgtagggtccagggggcctggccgcttctcgacaatgacttcctatttgtgcaggcaacctcatctcccatggcgttaggtgccaacgctaccgcgacacgtaagttgacaattatcttcaagaatatgcaggaatgtatagatcagaaggtttaccaagccgaagtcgataacctaccggtggcgtttgaagacggctctattaatggcggagaccggccaggcgggagctctctatcaatccagaccgctaacccgggtaaccacgttgagattcaggctgcctacatcggcacgacgattatcattaggcaaacagccggacagctgagcttcagcatcaaagtcgctgaggacgtggccatggctttttcagcggaacaggacctgcagctttgtgtgggcggatgtcccccttcacagcgcttaagccgatcagaaaggaacaggcgtggcgctataacaattgacaccgcccggcgtctgtgcaaagaggggcttcccgtagaggacgcatactttcactcatgcgtgtttgatgtgctgatctctggtgatcccaatttcacggttgctgctcaggctgcacttgaagatgccagggctttcctccccgacttggagaagctgcacctctttcctagcgatgctggggtgcccttgtcatctgccaccttgctcgctcctctcctttccggacttttcgttctctggctgtgcattcag

SEQ ID NO: 13507 - DNA, 1278 bp, Artificial Sequence
  Description of Artificial Sequence: Synthetic coding sequence
atgggcgagccgggccagtccccgtccccacggagttcacacggtagcccgccgaccctgagcaccctgacgctgctgctactgttatgcgggcatgcccacagccaatgtaagatccttcgctgtaacgcggagtatgtttcatcaaccctctctcttagaggcggcggcagctctggtgcgttgcgtgggggcggcggtggcggccgcggtggcggcgttggaagcggagggctgtgccgcgcgctgcgtagctacgctctctgtacccgtcgaactgcgcgcacctgccgcggcgatttggccttccattccgctgtccacggcattgaggatctgatgatccagcataattgttctaggcagggtccgacggcccctccgcctcctagaggccctgctctgccgggcgctggtagcggactgccggcccctgatccatgtgactatgagggtcggttcagccgcttgcacggtcgcccgcctggttttcttcactgtgcaagcttcggggaccctcacgttcgctcgtttcatcaccacttccacacctgccgtgtccaaggtgcgtggcccctgctggacaacgacttcctgtttgtccaggcaacatcgagccctatggcgctgggcgcaaatgcgactgctacccgcaaactgaccattatcttcaagaatatgcaggagtgcatcgaccaaaaagtatatcaagccgaggtggataacctgccggtcgcatttgaagacggctcaattaatggtggcgatcgcccaggcggcagctccctgagcatccagactgccaaccctggcaatcacgtcgaaatccaggccgcttatattggcactacgataattattaggcaaacggcgggccaattgagcttctctattaaagttgccgaagatgtggctatggctttttcggcggagcaggacctccagctgtgcgtgggcggatgtcctccgagccagcgcctgtcccgcagcgaacgcaatcgtaggggtgctatcacaatcgacacagcaaggcgcctctgcaaggaaggtctgccagtggaggatgcctatttccacagctgcgtgtttgacgttctcatcagcggcgacccgaacttcaccgttgcggcacaagcagccctggaggatgcaagggctttcctgcccgatctcgagaaactccacctattcccaagcgatgccggcgtgccgctgagctcggctactctgctggcgccgttgctgagcggtctgtttgtgctgtggctgtgtatccag

SEQ ID NO: 13508 - DNA, 1278 bp, Artificial Sequence
  Description of Artificial Sequence: Synthetic coding sequence
atgggggaacccggtcaaagcccctcccctcgttcctcacatggatctcctccaactctgtcaaccctcacgctgcttcttctgctttgcgggcacgcccactcacagtgtaagattctgcgctgtaatgcggaatacgtctcgtccactctctccttgcgtggcgggggttcctcgggagcacttcgcggaggaggagggggaggtcggggaggtggagtgggttcagggggactctgtagggccctgcgcagctacgcattgtgtaccagaagaaccgcaaggacttgtcggggagatctcgcctttcactcggcagtgcatggtatcgaagatttgatgatacaacacaactgttcgagacagggcccaactgcacctcctcctcccagaggcccagcactccctggggcaggaagcggactgcccgctcctgatccatgtgactacgaggggcggttcagccgccttcacggccggcctcctggttttcttcattgcgcgtccttcggggatccccatgtgcggtccttccatcatcactttcatacctgccgtgtccaaggcgcgtggcctttgctggacaatgacttccttttcgtacaggccacttcgtccccaatggcacttggtgcgaatgcaactgctacccgcaagctgactatcatctttaagaatatgcaagagtgcatcgaccaaaaggtgtaccaagcagaagtggataatctgcctgtggcattcgaagatggttccatcaacggcggcgaccgcccaggtggatccagcctttcgatccagaccgccaacccgggtaaccatgtcgagatccaggccgcctacattggaaccactatcatcattagacaaaccgcaggacaactttccttttcgattaaagtggctgaagatgtggcgatggctttttcggcggaacaagatctgcaactttgtgtgggagggtgccctccgtcacaacggctcagcagatcagaacgcaatagacgaggagcgattactatcgatacggctcgtcgcctttgtaaggagggattgcctgtggaggatgcatactttcattcgtgtgtgttcgatgtgctgatcagcggcgatccaaactttaccgtggcggcacaggcagcacttgaagatgcacgggcttttctcccagacctggaaaaacttcacctgttcccttcagacgctggggtgccactgtcctcggcgaccctcctggcgcctctccttagcggactcttcgtgttgtggctgtgcattcag

SEQ ID NO: 13509 - DNA, 1278 bp, Artificial Sequence
  Description of Artificial Sequence: Synthetic coding sequence
atgggagaaccaggacaatcaccaagcccaagatcatcacatggaagtccaccaaccttatcaacactgactctattgttgttgttgtgcggacacgcacattcacaatgtaagatattgagatgtaatgcggaatatgtgtcctctactctttcacttaggggaggaggatcttcgggagcattgcgtggagggggggggggtggaaggggtggtggtgtgggatcgggaggactgtgccgggccctcagatcttacgcgttatgtactcgtcgcactgcccggacctgtcggggagacctcgcattccactcagcggtacacggaatagaagacttgatgattcaacacaattgctctcgacaaggaccgacggcgccgccaccgccacgcggaccagccctccctggagcaggttcgggactgccagctccggacccatgcgattacgagggacgtttctctcgactgcacggacgtcccccaggatttcttcactgtgctagctttggtgatccgcacgtgcggagttttcatcatcacttccatacttgcagagttcaaggagcgtggcctcttcttgacaatgattttttgttcgttcaggctacatcatctccaatggcactcggtgcaaatgcaacagctaccaggaaattgactattatttttaaaaatatgcaagaatgtatcgatcagaaagtgtatcaggcagaagttgacaatctcccagtggcgtttgaagatggatcaattaacggaggcgatcgacctggaggatcatctttaagtattcagaccgccaatccgggaaaccatgtagaaattcaggcggcttatatcggaaccactatcattatccgacaaactgctggtcaactttcgttcagcatcaaggtggctgaggacgttgcgatggctttttcggcggagcaggacttgcagttgtgcgttggggggtgtccaccaagtcaaagactcagccgatccgaaagaaatcgtaggggggccataacaatcgacaccgccagaaggttgtgtaaggaaggactcccagtggaagacgcatattttcattcctgtgtgtttgatgtattgatttccggtgatccgaatttcacagtggcggcccaagcagcactagaagatgctagggcgttccttccagatctagaaaaactccacctcttcccatcagacgctggagtgccactttcttcagcaacattgcttgcccctttgctgtccggcttattcgtcttatggctgtgcatccag

SEQ ID NO: 13510 - DNA, 1278 bp, Artificial Sequence
  Description of Artificial Sequence: Synthetic coding sequence
atgggtgagccaggacaaagccctagcccccggtcgtcgcatggatccccacccactctgtccaccctcactctccttctgctgctttgtggacatgcgcactcgcaatgcaagattctgcggtgcaacgccgaatacgtgtctagcactctttctcttagaggaggtggctcctcgggtgcactcagaggcggcggaggtggtgggaggggaggaggtgtggggtcgggaggactctgtcgggcactgagatcatacgcgctgtgcactagaagaacggcccggacgtgtcgtggtgacctcgcctttcatagcgctgtgcatgggatcgaggatcttatgatccagcataactgtagtcgccagggcccaactgcacccccacctccgagaggcccagcactgcctggcgcagggagcggcctgcctgcgccggatccttgtgattacgaaggacgcttttcacggttgcacggccgtccgcctggcttcctgcattgcgcctcgtttggtgacccgcacgtcagatcgtttcatcatcatttccacacttgcagagtgcaaggagcttggcccttgcttgataatgacttcctctttgtacaagccacctcgtctccaatggcactgggtgcaaacgccaccgccacccgaaaacttaccatcattttcaagaacatgcaggaatgtatcgatcagaaagtgtatcaagcagaggtcgataatctgcctgtggcgtttgaagatggaagcattaatgggggagacagaccaggaggaagcagcctttcgattcagactgcgaatccaggtaaccacgtggaaattcaggcggcatacattgggaccactataatcataaggcagaccgcaggccagctcagcttttccattaaggtggcagaggacgttgcaatggcattcagcgcagaacaagatttgcagctttgcgtcggaggatgtcctccttctcaacggctctccagatcggagcgtaatcgacggggagcgattacgatagacactgcccgtaggctgtgtaaagagggccttccagtggaagatgcatactttcattcctgtgtgtttgacgttctgatctctggtgaccctaactttactgtggcagcccaagcggctctggaagatgccagggcttttctgcccgatctggaaaagctgcacttgtttccatctgatgcaggcgtgccactttcgtccgcaactctgctcgcacctctcctgtcaggcctgttcgtgctgtggctgtgcattcaa

SEQ ID NO: 13511 - DNA, 1278 bp, Artificial Sequence
  Description of Artificial Sequence: Synthetic coding sequence
atgggggaaccagggcagtccccttctccccgctcttcacacgggagtccaccaaccctgtcgactctgacactcctgctcctgctgtgtggccatgcacacagccagtgcaaaatcttacgctgtaatgccgagtacgtttcctcaacactgtctctacgggggggcggctcctctggagccctgaggggaggcggaggcgggggccgtggggggggagtcggaagtggggggttatgccgagcactcaggtcttacgcgctttgcacgcgacgtaccgcacgaacgtgtcggggtgatttagcctttcacagtgccgttcacggtatcgaagacttgatgatccagcataactgtagcaggcagggccctaccgctccacctccacctagagggcccgccctgcctggggccggatctgggctcccagcaccggacccctgcgattatgagggaagattctcacggctgcacgggaggcccccaggctttttacattgcgcctcatttggggatccacatgtcagatctttccaccaccatttccatacctgccgtgtccaaggggcatggcccctgctggataatgattttctattcgtccaggctacatcttcgccaatggccctcggagcaaacgctactgccactcggaagctcacaatcatatttaagaacatgcaggaatgcatagaccagaaggtctatcaggcagaagtggataacctgcctgtcgcgtttgaggacggcagtataaatgggggcgaccgcccgggcgggagttcactgagcatacaaacggccaatccaggtaaccatgttgaaatacaggctgcgtatatcggtaccacgattattatcagacagacggccggccagctgtccttctcgatcaaggttgctgaggatgttgctatggcatttagtgcagaacaagatctgcagctatgcgttgggggctgcccgcctagccagcgcctgagccgcagcgaacgaaacagacgtggcgcaatcaccattgacaccgcaagacgcctatgcaaggaaggcctccccgtcgaagatgcctacttccatagttgtgtttttgacgtcctgatttccggcgatccaaacttcacggtagcagcccaggccgccctggaggacgcccgcgcctttctcccagatctggaaaagctgcaccttttcccatccgatgcgggggtgccactgtcttctgccacacttctggctcctctactgtccgggttgtttgtcttgtggctgtgcatccag

SEQ ID NO: 13512 - DNA, 1278 bp, Artificial Sequence
  Description of Artificial Sequence: Synthetic coding sequence
atgggggaacctggacagagtccttcaccgagaagctctcacgggtctccccctaccctaagcacccttactctcctgctcctgctgtgcggccacgcccatagtcagtgcaaaatcctcagatgcaatgccgaatatgtgagctccacactctcacttcgcggaggcggatcatcgggagctctgcggggcggcggtggcggtggacgaggtggaggggttggaagcgggggactttgtcgagcgctcagatcatatgccctgtgtacccgacgaactgctcgcacttgtaggggggatctggcttttcactccgcagttcacgggattgaggacctgatgattcagcacaattgctccagacagggccctactgccccacctccacctcgaggacctgcactccctggcgccggtagtggcctgccagctcccgacccttgcgactacgaaggccggttctcacggttgcatgggcggcctcctgggttcttgcactgcgcctccttcggcgaccctcatgtgcgttccttccatcatcacttccacacatgcagagtgcaaggagcctggcctctcttggacaacgattttctgtttgtgcaggccaccagctcccctatggccctcggagcaaatgccacagcaacccgcaaacttactattattttcaaaaacatgcaggaatgtattgaccaaaaagtttaccaggctgaagtggacaaccttcctgttgcctttgaggacggatccattaatggtggagacaggccaggagggtcctctctgtccatacagacagcaaaccccggaaatcatgtggaaatccaggccgcatacattgggactaccattattataaggcagactgccggccaattgtccttcagtataaaagtggccgaagatgtcgccatggccttcagtgctgaacaggacctccagttatgtgtcggaggctgcccaccttcccagcggctctcacgaagcgagagaaacaggcggggagcgattacaattgatactgctcgccgtctgtgtaaggaggggctgcctgtggaagatgcgtactttcatagctgcgtttttgatgtgctaatctctggcgatccgaatttcaccgtcgccgcccaggccgcccttgaggacgccagggcttttctccctgacctcgaaaaattgcatttgttcccttcagacgcaggtgtgcccttaagttccgctacactgttggccccactgctaagtggactctttgtgctgtggctctgcattcaa

SEQ ID NO: 13513 - DNA, 1278 bp, Artificial Sequence
  Description of Artificial Sequence: Synthetic coding sequence
atgggtgaacctgggcagtcgcccagcccaagatccagccatggctcccctcctaccctttcgactttgacccttctgttgctgctttgcgggcacgcacattcgcaatgtaagatcctgagatgcaatgcagaatacgtgagttccactctttcacttcgcggaggaggttcgtccggtgctcttcggggcggtggaggtgggggaagaggagggggagtgggttcgggaggactgtgtcgggccctcaggtcatacgcactttgtacgaggagaaccgcacgaacttgcagaggagatctggcctttcacagtgcagtccatggcatcgaagatctgatgatccaacataattgttccagacagggaccaactgccccgcctcccccacgtggcccagcacttccgggtgcagggtcaggactgcctgcaccagacccgtgtgattatgaaggaagatttagccgactgcatggtcgacctccgggattccttcactgtgcctcgttcggagatcctcatgttcgctcctttcatcatcacttccacacctgccgcgtgcagggcgcgtggcccctcctggataatgattttctgtttgtccaagcgacctcgagcccaatggcacttggagcaaacgcgactgcaacccgcaaactgactatcatctttaagaacatgcaggagtgcatcgatcagaaagtgtaccaagcggaggtggataacctcccggtggcctttgaagatggaagtatcaatggaggcgatcggcccggcggctcgtcgctgtcaatacaaactgccaatccaggcaaccacgttgaaattcaagcagcgtacattggcaccacgataatcataagacagaccgccgggcaactctcgttttcaattaaggtcgcagaagatgtcgctatggcattttcggcagaacaggatctccaactctgtgtgggtggatgtcccccatcccagcgtctgagcaggagcgagagaaacagacggggtgcaattaccattgatactgcccgccgcctttgtaaggagggtctgccagtggaggacgcctacttccattcgtgcgtgttcgatgttcttatttccggggaccctaacttcaccgtcgcagcacaggccgcacttgaagatgcgcgggcctttctgccagatctggagaaacttcatcttttcccgtcagatgcaggggtgcctctctcgagcgctactctcctggcaccactgctctcaggtttgtttgtgctttggctgtgcattcaa

SEQ ID NO: 13514 - DNA, 1278 bp, Artificial Sequence
  Description of Artificial Sequence: Synthetic coding sequence
atgggtgaacctggacagtcaccttcgccacggagctcacatggctcgccaccgactctctccaccctgacccttctcttgctcctctgcggacatgcccattcgcagtgtaagatccttcggtgcaatgcagaatacgtctcctcgacgctgtcactgcgcggtggagggtcgtccggagcactccgcggaggtgggggtggaggtcgtggcggaggcgtgggttcgggcggactttgcagagctctgaggtcatatgccctgtgcacgcggcggaccgctagaacttgccgcggcgacctcgctttccacagcgccgtgcacggaatcgaagatttgatgatccaacacaactgctcccgtcaggggcccaccgcaccacctccgccgagggggccggcactcccgggggccggcagcggactgccagctccggatccttgtgattacgagggacggttcagccgcctgcacgggcggcctcctgggtttctccactgcgcttcattcggagatcctcatgtgagaagttttcaccatcatttccacacttgtagagtccagggtgcctggcccttgctggacaatgactttctgttcgttcaggctacttcctcacctatggccttgggagctaacgcaactgcgactcgcaaattgaccatcatcttcaagaacatgcaggagtgcattgatcaaaaagtgtaccaagcagaagtggacaacttgccggtggcgttcgaggacggatccatcaacggaggagataggcccggcggctcgtccctctcgatccagactgcaaatccgggcaaccatgtggaaatccaggcggcctacatcggaactaccatcatcatcagacagaccgccggccagctgtcgttttcaattaaggtggccgaggacgtggccatggcgttttcagcggagcaagatctgcagttgtgcgtgggagggtgcccgccgtcccagcggctgagccgctctgagcggaatcgccgcggagccatcacgatcgacaccgcccggagactgtgcaaggagggtctgcctgtggaagatgcatacttccattcctgtgtgttcgatgtcctcatatctggcgatccgaacttcaccgtggccgcccaagctgcgctggaagatgcccgggcgttcctgccagatctggaaaagctccacctgttcccatcagacgctggtgtgcctctgagctcggccactctcctcgccccgctcctctcgggactgttcgtgctgtggctgtgcatccaa

SEQ ID NO: 13515 - DNA, 1278 bp, Artificial Sequence
  Description of Artificial Sequence: Synthetic coding sequence
atgggtgaacctggtcagagcccctcgccaagatcatcgcatggcagccctcccacgcttagcactcttacccttcttctgctgctttgtggtcatgcacattcacaatgtaagattcttcgttgcaatgcggaatacgtgtcctcaaccctgtcacttaggggcggtggcagctccggcgcactcaggggtggaggaggtggagggagaggaggcggggttggctctgggggtctttgtcgcgcacttagatcctacgcactttgcaccaggcgaaccgcccgcacgtgtaggggcgatctggcattccactcggcagtccatggtattgaagatctgatgattcagcacaactgttcgaggcaggggccaactgctcctcccccaccgcggggacctgcgctcccgggggcggggtcgggactgcctgctccggatccttgtgactacgagggcaggttctcccggctgcatggacgcccacccggatttctccattgcgcatcgtttggcgatcctcacgttaggtcgtttcatcatcatttccatacgtgtagagtgcaaggagcatggccgctgctcgataacgactttctgtttgtccaagctaccagctcccctatggcgcttggagcaaatgcaactgccacccggaaacttaccattatcttcaaaaacatgcaagagtgtattgatcagaaggtgtaccaggcagaagtcgataaccttcctgtggcatttgaagatggttcaatcaatggcggggacagacctgggggttcctccctgtcgattcaaactgctaatccaggtaatcatgtcgaaattcaggcagcttacattggcaccaccatcatcattaggcagactgcaggacaactttccttttctatcaaggtggcagaagatgtggccatggcattttcggccgaacaagatctgcagctgtgtgtggggggatgtccacccagccaaagattgtcgcgatcagagcgcaacagaaggggagccattactattgataccgcaaggcgactgtgcaaggagggactccctgtggaggatgcgtactttcactcctgtgtgtttgacgtgctcatttcgggtgatcctaactttactgtggctgcccaggcagctttggaggatgcacgcgcattccttcccgacttggaaaagctccacctctttccttcggatgccggagtgccactgtcatctgcaactctgctggctccactgctttccggcctgtttgtgctctggctgtgcatccag

SEQ ID NO: 13516 - DNA, 1278 bp, Artificial Sequence
  Description of Artificial Sequence: Synthetic coding sequence
atgggcgaaccaggacagtccccttcaccgcgcagctcacacggaagcccgccgaccctttctactttgacactgttactcctcctctgtggccatgctcattcccaatgcaaaatattaagatgtaatgcagaatatgtgagtagtacgcttagcttgcgtggaggtgggtcttccggggcacttcggggcggtggaggtggcggacgcggcggcggcgtcggatctggaggcttatgtagagctctgcgctcgtatgcgctctgcacaagaaggacggctaggacgtgtagaggagatcttgcctttcattcagctgtccacgggattgaagatttgatgattcagcacaactgttcacgccagggcccgactgctcctccaccgccacgtggaccggcgttaccgggtgcagggtcaggccttccggcgccggacccctgtgattatgaaggacggtttagccgccttcatgggcgcccgccagggttcttgcattgcgcatcttttggcgatccgcatgtccgtagctttcatcaccattttcatacgtgcagggtccagggtgcttggccgcttctggataatgactttttgtttgtacaggcgacatctagcccaatggccttaggggcaaatgcgacggcaacaagaaaattaacaataattttcaagaacatgcaagagtgcattgatcagaaagtataccaggcagaagttgataatctccctgtggcttttgaggatggctccattaatggaggcgataggcctggtggatcttctctgagtatccagacagcaaatcccggtaaccatgtcgaaattcaagctgcttatatcggaacaacgattatcattagacagacagctggacagttaagttttagcatcaaggttgctgaggatgtcgcgatggcattctcagccgaacaggacctgcaactgtgcgtagggggttgtccgccgtcccagagattatccaggtcggaacggaatcgccgaggtgccattaccatcgacacggcccgcaggttgtgtaaggaaggcttgccggtagaggacgcatactttcattcttgtgtttttgatgtcttgatttccggagatccgaattttactgttgctgcacaggcagcgttggaagatgccagagctttccttccggatcttgaaaagttgcatctgtttccttctgatgcgggcgttccgctcagtagtgcgactctgctggcccctctcttgagcggcctttttgtcttatggctttgtatccaa

SEQ ID NO: 13517 - DNA, 1278 bp, Artificial Sequence
  Description of Artificial Sequence: Synthetic coding sequence
atgggggagcctggccaaagcccgtcccctcgatcttcccacggcagcccccctactctgagcactttaacactcttgcttctcctctgcggtcacgcccactctcagtgtaagattttgaggtgcaatgctgagtatgtgtccagtaccctgagcctgagaggaggagggtcatcaggtgccctccgtggcggtggaggaggtggaaggggtggcggcgttggaagcggcggactctgtcgagcactgcgcagctatgccctttgcacgcgaagaaccgcccggacttgcaggggcgatctggccttccactcagctgtgcacggtattgaagatctgatgatccagcacaattgttctagacagggacctacggctccccctccaccccgaggacccgccctgcctggcgccggttctgggctgccagcacccgacccttgcgactatgagggacgcttctctaggctacacgggagacctcctgggttcctccactgtgcctctttcggcgatccacacgtgagatctttccaccaccattttcacacatgtagagttcagggtgcttggcctcttcttgataacgattttctgtttgtgcaggccacttcctccccaatggccctaggagccaacgcaacagccactcgaaaactgacaatcatctttaagaatatgcaagagtgtatcgaccaaaaggtgtatcaggctgaagtagacaacctgccagtcgcctttgaagatggatcaattaatgggggcgatagaccgggcggctcctcactcagcatccagacagcaaatcctggcaatcacgttgaaatccaggccgcatacatcggcaccacaataataattcgacagaccgcaggtcaattgagcttttctattaaggttgctgaagatgttgcaatggctttctctgccgagcaagacctgcagctatgcgtaggcggatgtcccccttcgcagaggttgtccaggagcgagcggaaccgaaggggcgctattactattgataccgctcgacgcctgtgcaaggagggactgcctgtggaagatgcatacttccattcttgtgtgttcgacgtgcttatctccggtgaccctaactttaccgtggctgcgcaggctgccctggaagatgcgagagcatttctgcctgacctggagaaattgcatctgtttccaagtgacgccggcgtgcccctcagttcagcgaccctgttagctcctctcctgtccggccttttcgtactttggctctgcatacaa

SEQ ID NO: 13518 - DNA, 1278 bp, Artificial Sequence
  Description of Artificial Sequence: Synthetic coding sequence
atgggggagccaggacagtctccatcccctcggagcagccatggcagccccccaaccctcagcactttgacattgctcctgttattatgcggccacgcccacagccagtgcaaaatccttcgctgtaacgccgagtatgtgtcaagcacgttgtctctgcgaggaggaggtagcagtggcgcactccgaggaggcggaggaggcggtcgcggtgggggagtgggaagtgggggactgtgtcgcgctctgcggagctatgcactgtgtacccggcgcaccgcgcgtacctgtcgaggggatctggcattccatagtgcggtgcacggaatcgaagacctaatgattcagcacaactgttcccggcagggtcccactgcacccccgccaccacggggcccggcactgcccggtgccggatctggtcttccagctccggacccctgcgattacgaggggagatttagtcgcctacacggccgcccccctgggtttttgcactgcgcttcttttggggaccctcatgtaaggtcctttcaccaccacttccacacctgccgggtgcagggagcctggcccctattggataatgacttccttttcgttcaagccaccagctcccctatggctcttggagcaaacgccacagccacaagaaaacttacaattattttcaaaaacatgcaggagtgtattgaccagaaggtgtatcaagctgaggtggataacttaccagtcgcttttgaagatggctccatcaatggcggtgacagaccaggaggttcctcattaagcatacagacagctaacccgggcaatcatgtggagattcaagcagcatatattggaacaacaattataatccgtcagaccgccggccagctatctttctcaatcaaggtcgccgaagatgttgccatggcgtttagcgcagagcaggatctccaactgtgtgtcgggggttgtccaccttcacagcgactatccaggtccgaaagaaaccgtcgaggcgctataacaatcgacaccgcaagacgcctgtgtaaagaaggattgcctgtggaggacgcctacttccactcttgtgtcttcgacgtgctgatctcgggcgaccccaattttacagtcgcggcccaggcagcgctggaagacgccagggcctttcttcctgacctggagaagttgcatctctttccgtccgatgccggcgtgcccctatcctcggccacgttactcgctcctctgctcagcggcctttttgttctgtggttgtgtattcag

SEQ ID NO: 13519 - DNA, 1278 bp, Artificial Sequence
  Description of Artificial Sequence: Synthetic coding sequence
atgggtgaaccaggacaatctccgtcgccccgaagctcccacggatcaccaccgaccctgagcactctgacgctgctgctgctcctgtgcggtcatgcacactcgcaatgtaaaatcctccgctgcaacgccgaatacgtctcgtccaccctctcactcagaggaggcggatcgtcaggcgcgctgcgcggaggaggagggggaggacggggaggaggggtcggatcaggaggactctgccgcgcactgagatcctacgccctgtgcacgcgccgcactgcccgcacttgccgcggagatctggctttccactcggccgtgcacggaatcgaggaccttatgatccagcacaattgctcacggcagggaccaaccgctccgcccccgccgcgcggacctgcgctcccaggggcgggctcaggacttcccgcaccagacccgtgtgactacgaaggcagattctcgcgcctgcatggacggccgccaggtttccttcactgcgcatcgttcggtgacccacatgtccgctctttccaccaccatttccacacctgtcgtgtgcagggcgcctggccgctgctcgacaatgacttcctcttcgtgcaggctacctcaagcccgatggctctcggagctaatgccaccgccacccgcaagctcactatcatcttcaaaaacatgcaggaatgcattgatcagaaagtgtaccaagccgaagtggacaatctgccagtggccttcgaagatggctcaatcaacggaggagataggccgggaggctcgtccctgtccattcagactgcaaacccgggtaaccacgttgaaatccaggctgcgtacatcggaactaccatcattatccggcagaccgccggacaactctcattttccatcaaggtggcagaggatgtcgcgatggcgttttcggcggaacaagacttgcaactgtgcgtcggcggttgcccgccgtcccagcgcctctcccggtccgaacgcaaccgccggggcgcgatcactatcgacaccgcacggcgcctctgtaaggaaggcttgcccgtggaggatgcatacttccactcctgcgtgttcgacgtcctgatcagcggagatccaaatttcacggtggcggcacaagccgctctggaggacgctagggccttcctgccagatctggaaaaactccacctttttccttccgatgccggggtcccactgtcatcggcgacgctgctggctccgcttctgtccgggctgtttgtgctctggctctgcatccaa

SEQ ID NO: 13520 - DNA, 1278 bp, Artificial Sequence
  Description of Artificial Sequence: Synthetic coding sequence
atgggggaaccaggccaatcaccatcaccccggagttcccatggttccccacccaccctcagcacgctcacccttctgctgctcctgtgtgggcacgcccattcacagtgcaagatactgaggtgtaacgctgaatatgtgagctctaccctgagtctgcgcggcgggggcagctctggcgccctgcgcggaggtggcggcggcggacgcggtggtggtgttgggtccgggggtctgtgcagagcactgaggtcctatgctctttgcacccgaaggactgctcgaacctgtcgaggcgatctggcctttcattccgcggtgcatggcatcgaggacttgatgatacaacacaattgttcccgacaggggccaaccgctcctcctcccccccggggacccgccctcccaggtgcaggatccggactgcccgctcctgatccctgtgactacgaagggcggttttcacgactgcatggaaggccacccggttttctccactgcgcatcattcggagatccgcatgtcagaagcttccatcaccatttccacacatgccgggtgcaaggtgcctggccactgctggacaatgattttttgttcgtgcaggcgacgagctctcctatggcactgggggcgaacgccaccgctacaagaaagctgacaatcatttttaagaacatgcaggagtgcatcgaccagaaggtttatcaggccgaagtagataacctgcctgtcgcgttcgaagacggctccataaatggcggagaccgaccggggggttctagcctgtcaattcaaaccgcaaacccaggaaaccacgtcgaaatccaggcagcctatatcggcaccaccatcatcatcaggcagacggcgggccagctttctttttcaattaaggtggctgaggatgtggcaatggctttcagtgcagaacaggatttgcagctgtgcgtgggcggatgccctccctctcaacggcttagccgctccgaaaggaaccgccgcggcgctataaccatagacaccgcccgccgactttgtaaggagggtctgcccgtggaagatgcatacttccattcatgcgtgttcgatgttctcatctctggagaccctaacttcactgtggctgcacaagcagcattggaggacgcgagagcgttcctgcccgaccttgagaagctccatctgtttccttccgatgcgggcgtccccttgtcctctgccaccctcttggctcccttgctgagcggcctgtttgtgctgtggctgtgcattcag

SEQ ID NO: 13521 - DNA, 1278 bp, Artificial Sequence
  Description of Artificial Sequence: Synthetic coding sequence
atgggagaaccgggccaatcgcccagccctcgctcatctcacggctcaccgccgacgctgtccactcttaccctcctcctgctcctctgcggacacgctcactcccagtgcaagatcctgcgctgtaacgccgaatacgtcagctcgaccctctcgttgcggggagggggatcgtcgggcgccctgcggggcggaggcggaggaggccgcggaggaggagtgggtagcggcggactttgtagggcactgcgctcatacgccctgtgcacccggcggacggcgagaacgtgcaggggagatctggcttttcactcagccgtccacggaattgaggacctcatgatccagcataattgctcccgccagggacctaccgcacctccaccacctcggggtccagcgctgcccggggctggcagcggactgccggcaccggatccgtgcgattacgagggacggttctcacggttgcacggacgacctccgggcttcctgcattgcgcatcattcggagatccgcatgtgagatctttccaccaccacttccatacgtgcagggtgcaaggagcctggcctcttctcgacaacgactttttgttcgtgcaggcgacttcgagtcccatggccctgggggccaacgccactgccactcggaagctgactatcatctttaagaatatgcaggaatgcatcgaccaaaaggtctaccaggccgaggtcgataatctgccggtggcgttcgaagatgggtcgatcaatggtggggacaggccggggggatcgtccctgagcatccagaccgcgaacccaggaaatcacgtcgagatccaggcggcctacatcggaaccaccatcatcattagacaaacggcaggacagctgtcgttttccatcaaggtcgcggaagatgtggccatggcgttctccgctgaacaggatctgcagctttgcgtcggagggtgccccccgtcgcagcgtcttagcagatccgaaaggaaccggcgcggggctattactatcgatactgcacggagactttgcaaggagggacttccagtcgaagatgcgtactttcattcctgtgtgttcgacgtgctgatctcgggcgaccccaatttcaccgtggcagcgcaggcagcgctcgaagatgctagagcatttctgcctgatctggagaaactgcacttgttcccctccgatgctggagtgcccctctcgagcgccaccctgctcgcgccgctgttgtccggactgttcgtcctctggctctgtatccag

SEQ ID NO: 13522 - DNA, 1278 bp, Artificial Sequence
  Description of Artificial Sequence: Synthetic coding sequence
atgggagagccaggccaatccccgtccccgagatcgtcacacggctcgccacccactctgtcgacgctcactctgcttcttctgctctgcggacacgcgcacagccagtgcaagatcctcaggtgtaacgcggagtacgtcagctccaccctctccctgcgcggagggggtagctccggcgcgcttagaggaggagggggaggaggacgcggcggcggagtcggatcgggtgggctctgccgggccctgcgctcctacgccctctgcactcgccgcaccgcccggacctgccgcggagatctggccttccactcggcggtgcatggaatcgaggacctgatgatccaacataactgctcacgacaggggccgacggcgccgccgcctccgcggggaccagccttgccgggtgcaggaagtggactgccggcaccagacccttgcgactacgaaggcagattttcaaggctgcatgggcggcctccaggatttttgcactgtgccagcttcggcgatcctcacgtgcgctcatttcatcaccacttccacacgtgtcgggtccaaggagcttggccgctgctggacaacgacttcctgttcgtgcaggcaacttcgtcgccgatggctctcggcgctaatgcgactgcgaccagaaagctgaccatcattttcaagaacatgcaggaatgtatcgaccaaaaagtttaccaggccgaagtggacaacctgccagtcgcgttcgaagatggatctatcaatggcggtgatcggcccggaggaagctcgctctccatccagaccgccaatccaggaaatcatgtggagattcaggccgcttacatcggcactaccatcatcatcagacaaaccgccggccaactttcgttctcaattaaagtggctgaggacgtggctatggccttcagcgccgagcaagacctgcagctctgtgtaggaggttgccccccttcacagaggctctctcgctccgagcgcaacagacggggcgcgatcactatcgacaccgcccgtcggctgtgcaaggaaggtctgccagtggaagatgcatatttccattcctgcgtctttgacgtgttgatttcaggggatcctaactttactgtggcagcgcaggccgcacttgaagatgcccgcgcattcctgccggatctggaaaagctgcacttgttcccgagcgacgctggggtgccgctgtcgtccgccaccctgctcgcacccttgctgagcggactcttcgtgctgtggctctgcatccag

SEQ ID NO: 13523 - DNA, 1278 bp, Artificial Sequence
  Description of Artificial Sequence: Synthetic coding sequence
atgggggaacctggacagtcgccttctccccggtccagtcatggatcccctcccacactgtccactcttacactccttctcctgctatgtggacatgctcattctcagtgtaaaatcctgaggtgcaacgcagaatatgtctcatctactctttctctgcgcgggggaggaagttcgggagcccttagaggggggggggggggaggacggggaggaggggtcggatcaggaggactctgtagggctctgcggtcctatgccctctgcactagacgcacagcaagaacatgtagaggggacttagccttccattctgcagttcatgggatcgaagatctcatgattcagcacaactgttcccgccagggaccgacagccccacctccacctagagggcctgccctcccaggggccgggagtgggctgcccgcccctgatccatgtgattatgaaggaaggttctctcggctgcacggaagacctccaggattccttcattgtgcatctttcggggatccacacgtcagaagtttccatcaccacttccacacttgccgggtccagggagcctggccactcctcgacaatgacttcttgttcgtacaggcaacaagttcacccatggcacttggggccaacgcaacggctacacggaaacttacaatcattttcaaaaacatgcaggaatgcatagaccagaaagtgtaccaggccgaagtagataacctcccagtcgcgttcgaggatgggtcaatcaatgggggggatcggccaggggggtctagtctctcaatccagactgctaatcccgggaatcatgtggaaatccaggcggcatatatcggaactacaataataatcagacaaactgcagggcagctatcattttctatcaaagttgccgaggatgtggcgatggctttttcggcagaacaggatctacagttgtgcgtcggaggatgccctccttctcagagactctcccggtctgaaagaaacagacggggagccatcacaatagatacagcccggagactgtgcaaagaagggctgcctgtggaagatgcttacttccactcctgcgtttttgatgtcttgatctctggagatcctaattttactgttgccgcacaggccgccctagaagacgctcgggcattcctccccgatctggaaaaactgcacctgttcccatccgatgcaggggtccccctctcatcggctacattactcgcaccactcctctccggattattcgtcctctggctctgcatacag

SEQ ID NO: 13524 - DNA, 1278 bp, Artificial Sequence
  Description of Artificial Sequence: Synthetic coding sequence
atgggagaacccggtcaatctccaagtcctagatcatcacacggatcgccccccacactgtcaaccctcacacttctgttgctactatgtggacatgcacactcgcagtgtaagatcctccgctgcaacgccgagtatgtatcctcgacgctgagtttacgggggggtggctcgtctggcgcgctgcgtggtggcggcggaggtggcagaggaggtggcgtggggagcggcgggctctgcagagcattacgcagctatgcattgtgcacgagacggacggctagaacttgtagaggagatcttgcgttccatagcgccgtccatgggatcgaggacctaatgattcagcacaactgtagcaggcagggacctacggctcccccaccaccacgcggacccgctcttccaggagcaggatccggtctgcctgcacctgacccatgcgactacgaaggtaggtttagtcgcctgcacggcaggccccccggctttcttcattgtgcttcttttggagatccacacgtcaggagttttcatcatcattttcatacatgccgcgtacagggtgcttggcccctcctggataatgattttctgttcgtgcaggcaacatctagtccaatggctctgggcgcgaatgccacagccacgcgtaagcttactattattttcaagaatatgcaggagtgtatcgaccagaaggtgtaccaggcggaagtggataaccttcctgtggcatttgaggacggatcgattaacggcggagacaggcctggggggagcagccttagtattcagactgcaaatccagggaatcacgtcgagattcaggccgcctatattgggactaccatcatcattcggcaaactgcaggccagctgtccttttcgatcaaggtagccgaggatgttgccatggcgttttctgcggagcaagatctgcagttatgcgtgggcggctgtcccccctcccaacgcctgtccagatccgagcgaaatcggagaggagctatcaccatcgataccgcccgccggttgtgtaaagagggtctgcccgtggaggatgcatacttccactcgtgtgtgtttgatgtcctgatctcaggagatcctaactttaccgtcgctgcgcaggccgccctggaagatgctagggcctttcttccggatctggagaaactgcacctgttcccctcagatgccggcgtacctctctctagcgccacgctcctagcccccttgctcagtgggctgtttgtactgtggctctgtattcag

SEQ ID NO: 13525 - DNA, 1278 bp, Artificial Sequence
  Description of Artificial Sequence: Synthetic coding sequence
atgggtgaaccgggtcaatcgccgtcgccgcgatcgtcgcatggttcgccgccgacgctatcgacgctaacgctactattattattatgtggtcatgcgcattcgcaatgtaaaatattacgttgtaatgcggaatatgtttcgtcgacgttatcgttacgtggtggtggttcgtcgggtgcgctacgtggtggtggtggtggtggtcgtggtggtggtgttggttcgggtggtttatgtcgtgcgttacgttcgtatgcgttatgtacgcgtcgtacggcgcgtacgtgtcgtggtgatttagcgtttcattcggcggtacatggtatagaagatttaatgatacaacataattgttcgcgtcaaggtccgacggcgccgccgccgccgcgaggtccggcgctaccgggtgcgggttcgggtttaccggcgccggatccgtgtgattatgaaggtcgtttttcgcgactacatggtcgtccgccgggttttttacattgtgcgtcgtttggtgatccgcatgttcgttcgtttcatcatcattttcatacgtgtcgtgttcaaggtgcgtggccgttactagataatgattttttatttgtacaagcgacgtcgtcgccgatggcgctaggtgcgaatgcgacggcgacgcgaaaattaacgataatatttaaaaatatgcaagaatgtatagatcaaaaagtatatcaagcggaagttgataatctaccggtagcgtttgaagatggttcgataaatggtggtgatcgtccgggtggttcgtcgttatcgatacaaacggcgaatccgggtaatcatgttgaaatacaagcggcgtatataggtacgacgataataatacgtcaaacggcgggtcaattatcgttttcgataaaagtagcggaagatgtagcgatggcgttttcggcggaacaagatttacaattatgtgttggtggttgtccgccgtcgcaacgattatcgcgttcggaacgtaatcgacgtggtgcgataacgatagatacggcgcgtcgattatgtaaagaaggtctaccggttgaagatgcgtattttcattcgtgtgtatttgatgtactaatatcgggtgatccgaattttacggtagcggcgcaagcggcgttagaagatgcgcgagcgtttttaccggatttagaaaaattacatctatttccgtcggatgcgggtgtaccgctatcgtcggcgacgctattagcgccgctattatcgggtctatttgtattatggttatgtatacaa

SEQ ID NO: 13526 - DNA, 1278 bp, Artificial Sequence
  Description of Artificial Sequence: Synthetic coding sequence
atgggcgagcctggtcagtcaccgtcaccgcgcagcagccatggatctcccccaacgctcagcactctcacactgctcctgctcctttgcggacacgcccactcccagtgcaagatcctgcgctgtaatgccgaatatgtgtccagtactctcagcctgaggggcggtggcagttctggcgcactgaggggcggtggcggcggcggtaggggaggaggagtcggaagtggaggcctctgtagagccctgagaagctacgctttgtgtaccagaaggaccgctcgcacatgtaggggcgatctggcattccacagcgcagttcacggtatagaggacctgatgatccagcacaattgcagtagacagggacccaccgctccacctccacccaggggacctgcgctccccggtgccggctctggtcttcctgccccagatccatgcgattacgagggaaggtttagcagactgcacggcagaccgccgggttttctgcattgcgcgagcttcggcgatccacacgtcaggagtttccaccaccacttccacacatgtagagttcagggagcttggccgcttttggacaacgacttcctgtttgtccaggctacgtctagccccatggctctgggtgcgaacgctacagcaactcgcaagcttacaattatcttcaagaacatgcaggaatgcatagaccagaaggtatatcaggcggaggtggacaacttgcctgttgcgtttgaggatggttctataaacggcggagatagaccgggcggcagcagcctgtcaatccaaactgccaatcctggaaatcatgtggaaatccaggccgcttacattggtaccacaataataatcaggcagaccgctggccagctctctttttcaataaaggtggccgaagatgtggccatggccttttcagctgaacaggacctccagctgtgcgttggaggttgcccgccttcacaacgcctcagtagatccgagcgcaatcgcagaggcgccattaccatcgacacggccagaaggctgtgcaaggagggtctgccagtagaagacgcttactttcactcatgcgtttttgacgtgctcatctccggagatcccaacttcactgtagctgcccaagccgccctggaggacgcgagggcgtttctcccagacctggagaaattgcacctcttcccctctgacgctggagtcccccttagctctgctaccctgttggccccgctgctctccggcttgttcgtcctgtggctctgcatccaa

SEQ ID NO: 13527 - DNA, 1278 bp, Artificial Sequence
  Description of Artificial Sequence: Synthetic coding sequence
atgggcgaacccgggcaatccccgagtccgcgttcctcccacggctcccctccaaccttatccacactgacactcttgctcctgctctgcggccacgcacacagccaatgtaagattctgaggtgtaacgccgagtatgtgagttcgactctcagcctgaggggagggggctccagcggcgccctgagaggagggggagggggagggaggggtgggggcgtaggcagcggaggtttgtgccgtgctctgcgatcatacgctctgtgtacacgccgcaccgcccggacctgtcgtggggatctggcttttcactccgcggtgcacggcatcgaggatctgatgatccagcataattgttcgcgccagggccctactgctccgcctcctccacgcgggcccgctctgccgggtgctgggagtggcctcccagcgcctgacccctgcgattatgagggacgcttttcacgcctgcacgggagaccgcccggctttctccattgcgcaagttttggagatcctcatgttagaagttttcatcatcacttccatacatgtagggtgcagggcgcctggcctctactggataacgacttcttgttcgtgcaagcgacctcaagtccgatggctctgggagccaacgcaactgccacaagaaaactgactattatctttaagaatatgcaagagtgcattgatcagaaggtgtaccaggccgaggtcgacaacctgccagttgccttcgaagatgggagcatcaatggaggggaccgccccggagggtcttccctgtcaattcagacagccaacccaggaaatcacgtggagatacaggcagcttacatcggaactaccatcataattaggcaaactgccgggcagctctcgttctctataaaggtcgcagaggacgtcgcaatggccttctccgcagagcaggacctgcagctgtgcgtaggtggatgccccccatcccagcgcttaagtcggagcgagcggaatcgtaggggcgccatcacgatagacactgcaaggcggttgtgcaaagagggtttgccagtagaggacgcctatttccattcctgtgtcttcgatgtgctgatatccggggaccccaacttcacagtcgccgcccaggcggcattagaagatgcccgagcgtttctgcccgatctggagaaactgcatctatttccctctgatgctggggtgcccctgagctcggccaccttactagccccactgttatcagggctctttgttctgtggttgtgtatacag

SEQ ID NO: 13528 - DNA, 1278 bp, Artificial Sequence
  Description of Artificial Sequence: Synthetic coding sequence
atgggagagcccggtcaaagtccaagcccgaggtcttcacatggcagtcctcctacgctgtctactctcacgcttctgctgctgctatgtggccatgcacacagtcagtgtaaaatcctgagatgtaatgctgagtacgtgtcttcgacactctccttgagagggggtgggagttcaggcgccctaagagggggaggcggcgggggtagaggagggggcgtcggcagcgggggcctgtgtcgagcgcttcggagttacgcattatgtacgcgtaggaccgccagaacctgtagaggcgacctcgcgtttcattccgctgtccacggaatcgaggacctgatgatccagcacaattgctccaggcagggaccgactgcccctccgcccccgcgagggcctgcccttcctggggccgggagcggacttcccgctcccgatccctgcgattatgaaggccgtttctcaaggctccacggtaggccacctggtttccttcactgcgccagctttggggacccacatgtccggagttttcaccaccattttcatacctgtagagtgcagggcgcctggccactgctcgacaatgatttcctgtttgtccaggccacttcttcacccatggcactgggagccaatgccacggccacacgcaagcttaccatcatttttaaaaatatgcaggagtgcatagaccagaaggtgtatcaggctgaggtggataatctccccgtcgccttcgaggatggaagtattaatggcggcgacagacccggaggcagttcactgagcatccagactgctaacccgggaaaccacgtcgaaatacaggccgcctatattggaaccacaatcattattcggcagactgccggccagctctctttttccatcaaagtggccgaagatgtggctatggcgttttcagccgagcaggacctacagctgtgtgtcggggggtgtcccccatcgcaacgcctgtcccgctctgagcgcaatagacggggggccatcacaatcgacaccgctcgcagattgtgcaaggaaggtttgcccgtagaagacgcatacttccatagctgcgtctttgacgtcttgatctcaggcgatccaaatttcaccgtggcggcgcaggctgcccttgaggacgcaagagctttcctgcctgatctggagaagttacacttgtttccatccgatgccggggtgcccctgagcagcgctaccctgctcgcccccttattgagtggactcttcgtcctgtggctctgcatacag

SEQ ID NO: 13529 - DNA, 1278 bp, Artificial Sequence
  Description of Artificial Sequence: Synthetic coding sequence
atgggtgagcccggccagtctccgtcgcctcgctcttcgcatggctcccccccgaccctgtcgaccctcactttactacttctgttatgcggtcatgcacactcacagtgcaagatcctgagatgtaacgccgaatacgtgtcatctactttaagcctccgcggtggggggtcttctggcgcactgcgcggaggaggcggcggtgggagaggcggtggagttgggtcaggaggcttatgcagagcattacgtagttacgccctgtgtactcgtcgaacagcaaggacctgtcgcggcgacctggccttccactccgctgtgcatggcatcgaagacctgatgattcagcacaactgttcccgccagggccccacagcgccgccaccacctagaggaccagcgttgcctggtgcagggagcggcctgcccgcccccgatccctgtgattatgagggaagattcagcagactccatggacggcccccgggtttcctccactgcgcctctttcggggatccacacgtcagatcctttcatcaccatttccatacctgtcgcgtgcagggagcctggccgctccttgataatgacttcctattcgtgcaggccacctcctcccctatggctctcggggcaaacgctacagcgacacggaagttgacgatcatcttcaaaaacatgcaggagtgcatcgaccagaaggtctatcaggccgaagtggataatttgcctgtggctttcgaggacgggtcgattaatgggggggacaggccaggaggctcttccctctccattcagactgccaatccaggaaatcacgtcgagatacaggcagcatacatcggcaccacaatcataattcgccaaaccgccggccaactgtccttttctataaaagtggctgaggacgtagcaatggccttctctgccgagcaggatctccagttgtgtgttggcggctgcccgccatcacagcgattaagcagaagcgaaagaaaccgtagaggagccattacaatcgataccgcaaggagactctgcaaagaaggattaccagttgaggacgcctatttccactcctgtgtgtttgacgtccttatcagtggcgatcctaactttacagtggcagctcaagccgcgctcgaggatgcgcgcgcctttttacccgacttagagaagcttcaccttttcccttctgacgccggagtccctttgtcatcggctacactgcttgccccactactgagcggcttgtttgtgctatggttatgcatccaa

SEQ ID NO: 13530 - DNA, 1278 bp, Artificial Sequence
  Description of Artificial Sequence: Synthetic coding sequence
atgggtgagccaggccagtctcccagccctaggagctctcacggcagcccaccaaccctgtccacactcacactgctgctgttgctgtgcggacacgctcatagtcagtgtaagatactaagatgcaatgctgagtacgtttcctctacattgtctctgcggggaggaggaagttcaggggctctccgggggggaggcggcggaggccggggaggaggggtgggctcaggaggactctgtagggctctaagaagttacgccctgtgtacacgccgcaccgctcggacatgccgcggagaccttgcttttcactccgcggttcacggaatcgaggacctaatgattcagcataactgtagcagacagggccctaccgctcctccacccccgcggggtcccgcgttgcccggtgcaggaagtggcttgccggcacccgatccatgcgattacgaaggacgcttttctagacttcacggtaggccacccgggttccttcattgcgcttctttcggagatccacacgtgaggagcttccatcatcacttccatacctgccgggtgcagggcgcttggccactcctggacaacgacttcctgttcgtgcaggcaacctcttcgccaatggcactcggcgccaatgccaccgctacccgtaagttgacaatcatctttaaaaacatgcaagaatgcattgatcaaaaagtgtatcaagctgaggtcgataacctgcctgtggcattcgaagatggcagcatcaatggcggcgatagaccaggaggctccagcctgagcatccaaaccgctaacccaggtaaccacgtagaaatacaggctgcgtacatagggacgacaatcatcataagacagacagccgggcagctgtcctttagcatcaaggttgccgaagacgttgcaatggcctttagcgccgagcaggacctccagctttgcgtgggaggctgcccccccagccaaagactttcaaggtccgaacgtaataggaggggcgctatcacaatcgacactgcgcgcaggctgtgcaaagagggactgccggtggaggacgcctattttcacagttgcgtctttgacgtattaattagcggcgatcctaactttaccgtggccgctcaggccgcgttggaggatgcaagggcttttctgcccgatctcgaaaaattacatcttttcccaagcgatgctggcgtccccttgtcttctgcaaccctgctcgcacctctgctgagcgggctgtttgtcctctggttgtgcatacaa

SEQ ID NO: 13531 - DNA, 1278 bp, Artificial Sequence; identical to SEQ ID NO: 13512
  Description of Artificial Sequence: Synthetic coding sequence

SEQ ID NO: 13532 - DNA, 1278 bp, Artificial Sequence
  Description of Artificial Sequence: Synthetic coding sequence
atgggcgagcctggacagtcccccagccctaggtctagccatggcagtccgcctacactgtccaccctaaccttactcctgctgttatgcggccatgcccacagccagtgtaagattcttcgatgtaacgcagaatacgtgagctcaacccttagtctccggggcggcggctccagtggggcactaaggggcggtggcgggggtggccgagggggcggcgtcggaagcggagggctctgtcgtgccctgcgctcttacgcattatgcacgcggagaaccgctcgaacgtgtaggggggatctggcattccacagcgccgtgcatggtatcgaagacctcatgattcagcacaactgcagccgccaggggcccactgcaccacccccaccgaggggaccagcacttcccggagcaggctctggcttgcctgcgcctgacccctgtgactatgaagggcgattcagtagactgcatggccggccccccggctttctccactgtgcatcgttcggcgaccctcatgtccggagcttccatcaccactttcatacgtgccgtgtgcagggggcctggcccttgctggacaatgacttcctgtttgttcaggccacatcctccccgatggcactgggcgctaacgctacagccactagaaagctgacaatcatttttaagaatatgcaggagtgtatagaccagaaggtttatcaggcagaggtggacaatctgccagtcgcctttgaagacgggagtattaacggcggcgatcggcctggcggctcaagtctctccatccagaccgcaaaccccggaaatcacgtagagatccaggcagcatacatcggcactacaataatcatccgacaaacggcgggccagctgtcgtttagcatcaaagtggccgaagatgtggctatggccttttcagcagagcaagatttgcagctgtgcgtgggtggatgcccccccagccagcgcctctctcgtagcgagcgaaaccgcaggggcgctattacgatcgacacagccagacgactctgcaaggaagggctgccagtggaggacgcgtacttccacagttgcgttttcgatgtgttgataagcggagaccctaacttcacggtggccgcacaagcagccttggaagatgcacgcgccttccttcccgatctagaaaagctccatctcttcccatctgatgccggggtgcctctctccagtgccactttgctggcccccttgctttcgggcctgtttgtcctgtggctctgtattcaa

SEQ ID NO: 13533 - DNA, 1278 bp, Artificial Sequence
  Description of Artificial Sequence: Synthetic coding sequence
atgggtgaaccaggacagtccccgagtcctcgatcttcccatggtagccctcccaccttatcgacactcactcttctgctgttgctgtgtggccatgctcattctcaatgtaagatactgagatgtaacgctgagtatgtcagctccacgttgagcctgaggggagggggcagcagcggggccctgagaggaggcggcggaggaggaaggggcggaggagttggctcaggaggcttgtgccgagcacttaggtcctacgctctgtgcacaaggcgcaccgctcgtacctgcagaggcgacctcgcattccattcagcagtccacggaattgaggatcttatgatccaacacaattgcagtcggcagggccctacagctcctcctccaccaagaggccctgctttgcccggcgcagggagtggactccccgcaccggatccctgtgactacgaaggtcgttttagtagactccatgggcgacctccaggttttttacactgtgcatcctttggggacccacatgtcaggtccttccatcatcatttccacacttgtcgcgttcagggggcgtggcctctcctcgataacgattttctctttgtccaggctacctcaagtcctatggctctcggggccaatgcaaccgctactagaaaactgacaatcatatttaaaaacatgcaagagtgcatagaccaaaaggtctaccaggccgaggtggataacctgcctgtggctttcgaggacggatcaattaatggcggagatagaccagggggctcctcgctcagcatacagactgcaaacccagggaaccacgtggagatccaggctgcgtacatcggtaccactatcatcatcagacagacagccggccaattgtcatttagtattaaagttgcagaggatgtggcaatggcattttcggcagagcaggatcttcaactctgcgtcggaggatgtcccccttcacaaagactgagccgcagtgaaaggaacaggcgcggcgccatcacaattgacactgccaggagactctgtaaagagggcctccctgtggaggatgcttacttccatagctgtgtgtttgacgtgcttatttccggagacccgaacttcaccgtggcggctcaagcggcactggaagacgcccgtgcattcttgcctgatctcgaaaagctgcatctttttccaagcgacgccggcgtgccactttcctctgcaacactccttgccccccttctgtcaggccttttcgtcctctggctttgtatccaa

SEQ ID NO: 13534 - DNA, 1278 bp, Artificial Sequence
  Description of Artificial Sequence: Synthetic coding sequence
atgggggagcctggccagtcgccatccccccgttcatcacatggtagccccccaacactaagcacgttaacgctactgctcctgctgtgcggacatgcacactctcagtgcaaaatcttacggtgtaatgccgaatacgtctcttcaacattaagcctccgcggcgggggaagctctggcgccctgcggggcgggggcgggggaggaagaggcggaggcgtggggagtggcgggctgtgccgggccttgcgaagctatgcgctctgtactcgacgcactgctaggacttgtagaggagacctggcttttcacagcgctgtccatgggatcgaggatctcatgattcaacacaattgctctcgccagggtccaaccgccccccctcccccccggggccctgcgttacccggcgctggctcagggctccccgcaccggacccctgcgattacgaaggccgctttagtcgacttcatggcaggcctcccggttttctgcattgcgcgagcttcggagatccacacgttcggtcttttcaccatcattttcacacatgtcgtgtgcagggcgcgtggccactgcttgacaacgattttctctttgtacaggcaacatcttcccccatggcgctgggggcaaacgctaccgccacacggaagttgaccatcatcttcaaaaatatgcaagagtgcatcgaccagaaggtgtaccaagctgaagttgataatctgcctgtggcctttgaggacggaagcattaacggaggcgaccggcccggggggagctcactgtcaattcagactgcaaaccccggaaaccatgtggaaattcaggctgcctacattgggactaccattataattcgccaaaccgccgggcaactatcctttagcattaaggtagctgaagatgtcgccatggccttctccgccgagcaggatctgcagctatgcgtcgggggatgtccacccagtcaacggctgtctaggagcgaacggaataggaggggagcgataacgattgacaccgctcgccgtttgtgtaaggaagggctgcctgtggaagacgcttatttccattcctgtgtgtttgatgtgctaatcagtggggatccgaactttaccgtcgccgctcaggccgcgctggaggacgcccgggccttcctgccagatctggagaaactgcatctattcccctcagacgccggggtacctctgtcaagtgccactctgcttgcgcccctgttgagcggcctgtttgtgttatggttatgcatacag

SEQ ID NO: 13535 - DNA, 1278 bp, Artificial Sequence
  Description of Artificial Sequence: Synthetic coding sequence
atgggtgaacccggccaatcgccgagcccccgtagctcgcatgggtcaccgcctaccctgtcaaccttgacccttcttctgcttttgtgcgggcatgcacattcccagtgtaagatacttcgctgtaacgctgaatacgtgtcatcaactctttcccttcgcggcggtggatcatctggtgctcttagaggaggagggggaggaggtcggggcggaggagtcggaagcgggggcttgtgcagggcacttaggtcgtacgcactctgtacgagacgaaccgcacggacctgccggggcgacctcgcatttcacagcgccgtgcatggaattgaagatctcatgattcagcataattgttccagacagggacctactgcacccccaccaccacgcggaccagccctcccgggggcaggatccgggctgcctgccccggacccatgtgattacgaagggcgtttttctcgactccacggtcgtccaccaggttttctgcattgcgccagctttggtgaccctcatgtgcggtcgttccaccaccatttccacacttgtagggtccaaggtgcatggccacttctggataacgatttccttttcgttcaggcaacgtcgtcccctatggctctcggtgcaaacgcaaccgccacccgcaagttgaccatcattttcaaaaacatgcaagaatgtattgaccagaaagtgtaccaagcagaagtcgataatctcccggtggcatttgaggatgggtcgattaacggtggagatcgcccaggcgggagcagcctctcgattcaaactgcaaatcccgggaaccacgtcgaaatacaagcggcgtacatcggtaccaccatcatcattagacaaaccgcaggacaacttagcttttccatcaaggtggcagaggacgtggctatggcattctccgctgaacaggatcttcagctttgtgtcggaggatgccctccatcccaaaggttgtcacgttccgaaaggaatcgccgaggggcaataactatagataccgcacgacggctgtgtaaggagggcttgcctgttgaggacgcatatttccattcgtgtgtgtttgatgttttgatctcaggagatccaaactttaccgtcgccgcacaagcggcccttgaggatgcccgagcctttctgcccgatctggagaagctgcaccttttcccatcagatgccggcgtgccgctgtcctcagcaactctgctcgcgcctctgctgtcgggactgtttgtgctgtggctttgtattcaa

SEQ ID NO: 13536 - DNA, 1278 bp, Artificial Sequence
  Description of Artificial Sequence: Synthetic coding sequence
atgggcgaaccaggacaaagcccctcccctaggtcgagccatgggtcaccgccaactctgtccaccctcacgttgctgctgctgctctgtggacacgcacattcgcagtgtaagatccttcggtgtaacgccgaatacgtgagttcaaccctgtcgctccgcggagggggttcctcaggtgcgctgaggggaggtggtggcggaggcaggggaggcggggtggggagcggaggactgtgccgcgctctgagatcctacgccctgtgtaccagacggaccgcgcggacctgcaggggcgatcttgctttccattcggctgtccacggaatcgaagatcttatgatccagcataattgttcacgccagggcccaaccgccccgccaccaccacgcggcccggccctgccaggtgcgggaagcggactgcctgcaccagacccgtgcgattacgaaggacggttctcgcgcctccacgggaggcccccgggcttcctgcactgcgctagctttggggacccccatgtgcggtccttccaccaccatttccacacttgccgcgttcaaggagcctggccactcctcgacaatgacttcctgttcgtccaggccacgtcatccccgatggcattgggtgcaaacgcaacggccactcggaagctgaccattatcttcaagaatatgcaggagtgcatcgatcaaaaggtgtaccaagcagaggtcgataacctgccagtggcgttcgaggatggttcgatcaacggaggggaccgcccggggggttccagcctcagtattcaaaccgcaaacccgggcaaccacgtggagatccaggcagcctacattggcactactatcatcattcgccaaactgcgggacaactgtccttctccatcaaggtcgccgaagatgtcgctatggccttctccgcagaacaagacctccaactttgcgtcggaggatgccctccgagccaacgcctctcccgctccgaacggaaccgcaggggggcgatcactattgatactgcccggcgactgtgcaaggaaggcttgcctgtcgaagatgcgtacttccactcgtgcgtgtttgacgtcctgatctcaggcgatccgaatttcaccgtggctgctcaggccgccctggaagatgcgcgggcgtttctgccggatctggaaaagctgcacctttttccgtcagacgcgggggtgcctctctcgtccgcgactctcctcgctccgctgctgtccggactgttcgtgctgtggctctgcatccag

SEQ ID NO: 13537 - DNA, 1278 bp, Artificial Sequence
  Description of Artificial Sequence: Synthetic coding sequence
atgggcgagcctggccagagtccaagccctcgaagctcccacggcagcccccccacactatctacactcactctgctgctgctcctctgcgggcatgcgcattcgcagtgtaaaatcctcagatgcaacgcggagtacgtttcctctacactgtctttgagaggcggaggcagctccggtgctttaaggggcggggggggaggcgggagagggggtggtgtcggcagcggcggcctctgcagggctctccgcagctacgccctgtgcaccaggaggaccgcaagaacgtgcaggggcgatctggcctttcacagtgctgtccacggcatagaggatcttatgatccagcataattgcagccggcagggacccacggcacccccaccacccaggggacccgctcttccaggtgcagggagcggcctgcctgcccctgacccctgtgactatgaagggagattttctagactgcacgggcgcccgccaggttttctgcactgtgctagctttggtgatcctcacgtgcgaagttttcatcatcacttccacacatgtcgagttcagggcgcctggcccctgctagataacgattttttatttgtccaggcaacatcctctcccatggccctgggtgctaacgccacagccacacgaaagctgaccattatttttaagaacatgcaagaatgcatcgatcaaaaggtttatcaggccgaggtagacaacctgccggtggcctttgaggacggctctataaacggcggcgacaggccaggagggtcctcactgtccattcagaccgcgaaccccgggaatcatgtggagatccaggctgcatacatcgggacaacgatcatcatccgacagaccgctggccagttgagtttctcaatcaaggtggccgaggacgtggctatggctttttcggcagaacaggacctccagctgtgcgttggcggatgcccacccagccagaggctgtctcgatcagaacgtaatcgaagaggcgccatcaccatcgacactgctagacgattgtgcaaggaaggccttccggtcgaggatgcctacttccatagttgtgtttttgacgtgctgataagtggggatccaaactttaccgtggctgcccaggccgccctggaggacgctcgagcgtttctccccgacctggaaaaactgcaccttttcccgtctgacgccggtgtgccattgtcgagcgccaccttactcgcccctctcttatccggcctgttcgtgttgtggctgtgtatacag

SEQ ID NO: 13538 - DNA, 1278 bp, Artificial Sequence
  Description of Artificial Sequence: Synthetic coding sequence
atgggcgagcccggccaatcacccagtccaagatcatcccatgggtccccaccgacgctctccaccttgacactactgctgttactatgtgggcacgcacactcacaatgcaaaatccttcggtgtaacgcagaatacgtgagcagtacgctgtccctccgtggcggaggatcctcaggggcactgcgtggggggggagggggcggacgaggcggaggcgtgggaagcggcggactgtgtcgagccttgaggagttatgccttgtgcacgcggcgcacagcgaggacttgccggggggatttggcattccactccgccgtgcacgggatcgaggacctcatgattcagcacaactgctctaggcaggggccgacagccccccctcctcctcggggccccgcactgcccggagccggatcaggtctgcccgcacctgatccgtgcgattacgaagggcggttttcccgccttcacggtcggccaccaggctttctacactgcgctagcttcggcgaccctcatgtcagaagcttccatcaccacttccacacctgtagagttcagggagcctggcctctgcttgacaacgactttctttttgtgcaggccacttcatcacccatggctcttggagcgaacgctacagcgacacgcaagctgaccatcattttcaaaaacatgcaggaatgtatagaccagaaagtgtatcaggctgaagtcgacaaccttcccgtggccttcgaggacggcagcattaacggcggcgaccgacccggcgggtccagtctgagtatccagaccgcgaatcccggcaaccacgtagagattcaggcggcgtacatcggcacaacaatcattatccggcaaacagcaggacagttaagtttcagtatcaaggtggccgaagacgtggctatggcatttagtgccgagcaggaccttcagctgtgcgtggggggatgcccaccctcccagagactcagtaggtccgagagaaacagaagaggggctatcaccatcgatactgcacggaggctgtgcaaagagggcctcccagtcgaggatgcatattttcattcttgcgtgttcgatgtgctgatttcaggcgatcccaattttaccgttgccgcacaagctgccctggaagacgcccgagctttcctgcccgatttagagaaacttcaccttttcccctctgatgccggagttcctctgtcatccgctacactgctcgcacccctgctgtctggtctatttgtcctctggttatgcatccag

SEQ ID NO: 13539 - DNA, 1278 bp, Artificial Sequence
  Description of Artificial Sequence: Synthetic coding sequence
atgggagaacccgggcagtcaccgtccccgcggagctcccatggatccccccccacacttagtactctgacactgctgctcctgttgtgcggacatgcacactcccagtgtaagattctaagatgtaacgcagaatatgtgtcttccactctgtccctgaggggcggcggatcctctggtgccctcagaggcggcgggggaggtggcagaggggggggggtgggctcaggtggactgtgtagggccctgcgaagctacgcactctgcacacggagaactgctcgaacctgccgaggggacctggcctttcattccgcagtgcacggtatagaggatctcatgatacagcataattgttcacgccagggtcctacagctcctcctccaccccgcgggcctgcgctgcctggtgccggatccggcttgcctgcacccgatccctgcgattacgaggggcggttcagtcgtctccatgggaggcctccaggctttctgcactgcgcctctttcggtgacccgcacgtgcgcagctttcaccaccacttccacacatgtcgcgtgcagggagcctggcccctgctggataatgactttctctttgtccaggctacatcttctccaatggcgttgggagccaatgccactgcaacccgcaagctgaccatcatcttcaaaaacatgcaggaatgcattgaccagaaggtgtatcaggcagaggtggacaatctgcctgtggccttcgaggatggaagcatcaacggtggagaccgcccaggaggcagttccctttccatccagacggccaaccctggaaatcatgtagaaattcaggcagcttacatcggcacgaccattattatcaggcagacggcaggacagttaagctttagtatcaaagttgcagaggatgttgcaatggccttctctgctgaacaggatttgcagctgtgcgtgggtgggtgccctccctcccagaggcttagccgttcggaaaggaatcgtagaggtgctataaccatagataccgcgcgacgcctgtgtaaggagggcctgcctgtggaagacgcgtatttccattcatgcgtgtttgatgtgcttatcagtggtgaccctaactttactgtcgccgctcaagccgcgctcgaggacgctcgtgcctttttacccgatcttgaaaagctgcacctgtttcccagtgacgccggggtcccgctgtcctctgccacactcttggcccctctgctctctggcctgtttgtgttgtggttgtgcatacag

SEQ ID NO: 13540 - DNA, 1278 bp, Artificial Sequence
  Description of Artificial Sequence: Synthetic coding sequence
atgggtgagcctggacaatctccatcacctcggtcaagccacggatcgcccccaaccctgtcgacccttaccctgctgctgctcctgtgcggacacgcacattcgcaatgcaaaatccttcggtgtaatgcagaatacgtctccagcactctgtcgctgcgtggcgggggatcctcaggagcactgagaggtgggggaggtggtggtagaggtggcggagtgggctcggggggtctttgtagagcgcttcggtcgtacgcgctttgtacgcggcgcactgcaagaacctgccggggtgatctggcattccactccgcagtccacggaatcgaggatctcatgatccagcacaattgttcaaggcagggtcctaccgcccctcccccaccacgtggacctgccctgccaggagcaggatccggtctgccagcgcccgacccttgtgactacgaaggtcgcttttcgcgcctgcatggtagacctccaggatttctgcattgtgctagctttggagatccccacgtccggtcctttcaccatcattttcatacctgccgcgtgcaaggcgcctggccactgcttgataacgatttcctctttgtgcaggctacctcatcaccaatggcacttggtgcgaacgctactgcaacccggaagctgaccattatcttcaagaatatgcaagaatgcatagaccaaaaagtgtaccaggcagaggtggacaatttgccagtggcctttgaggacggttccattaacggaggggatcgtcccgggggctcgtcactttccattcagaccgcgaaccctggaaatcatgtcgaaattcaggcagcttacatcggtaccactattatcatccggcaaaccgcaggccagctgtccttcagcatcaaggtcgcagaagatgtggcaatggcgttctccgctgagcaagatctgcaactgtgtgtgggcgggtgtcctccatcccagcggttgtccagatcggaacgaaacagacggggcgccatcaccattgacaccgcccgtagactttgcaaggaaggactgccagtggaggacgcttactttcattcctgtgtctttgacgttcttatttccggtgatccgaatttcacggtcgcagcccaagccgcattggaagatgcacgcgcgttcctccctgatcttgagaaacttcatcttttcccttcggatgcaggagtgcccctgtcctcggcaactttgcttgctccccttctgagcggtcttttcgtgctgtggctttgtattcaa

SEQ ID NO: 13541 - DNA, 1278 bp, Artificial Sequence
  Description of Artificial Sequence: Synthetic coding sequence
atgggagaaccagggcagtccccatctcctcggtcatcgcacggttcccccccgaccctatctacattgacactgctgctgctcttatgtggacacgcccactcacaatgcaagatactgaggtgcaacgccgaatacgtctcttcaaccctgagcttacggggcggcggcagtagcggggccctcagggggggaggagggggtgggcggggcggcggggtcggtagcggaggcttgtgtagggccctgaggtcctatgcactgtgtacccggaggaccgcaaggacgtgtagaggcgatctagcttttcacagtgcagtccatgggattgaggaccttatgatccagcacaactgcagtcgccaaggcccaaccgccccacctcctccccggggcccagccctacctggcgccggctctgggctcccagctcctgacccatgcgattatgagggccgtttttcacggttgcatggaagacctccagggtttctccattgtgcctctttcggcgatccccacgtgcggagcttccaccaccactttcacacctgcagggtacagggggcatggccgctccttgacaatgacttcctgttcgtgcaggctaccagctcaccaatggcattgggcgccaatgctacagctactcgtaagctgacaataatatttaaaaacatgcaggagtgtatcgatcagaaagtgtatcaggccgaggtggataatctgcctgtcgcctttgaagacggctccataaatgggggagatagaccgggagggtcttcgttgtccattcaaaccgcaaacccaggaaatcacgtggagatccaggccgcatatatcggaaccacaattataatccggcagaccgcgggccagctgagcttttccatcaaggtggccgaagatgtggccatggctttctctgccgaacaggatttacagctctgcgtgggcggatgccctccatcacagcggttgtcccgatcagagcgtaatcgtcgcggtgcgataactatcgatacagctcgtagactctgtaaggaaggcctgccagtggaggatgcctactttcattcttgtgtgttcgatgttctgatctccggcgacccaaatttcacagtggccgcccaggcggccctagaggacgccagagcctttcttcctgatttggagaagctgcacctgtttccctccgatgctggggtgccactctcatctgctacactgctcgcccccctcctttctgggctgttcgtactgtggctctgcatccag

SEQ ID NO: 13542 - DNA, 1278 bp, Artificial Sequence
  Description of Artificial Sequence: Synthetic coding sequence
atgggggagcctggccagtcccctagtcctcggagctctcatggaagcccgccaaccttgagcaccctgacactgttgctgctgctttgcggacatgcccacagccagtgtaagattctcaggtgcaatgccgaatatgtgtcatcaacgttatccctgcgaggcgggggttcctccggggctctgcggggagggggcggaggaggccggggggggggcgttggctccggcgggctctgtagggcattgcgctcctacgccctgtgtacgagacggaccgctcggacttgtcgcggcgacttggccttccactctgccgttcacggtatagaggacctgatgattcagcacaactgcagccgccaggggcctaccgcccctcccccccctcgcggacccgctcttcctggggctggaagtggcctgcccgctccggatccctgtgactatgaaggaaggttctctagactgcacggcagaccccccggttttctgcattgcgccagcttcggggatccgcacgttagatcgttccatcaccacttccatacctgtcgcgtccagggggcctggccgctccttgacaatgacttcctctttgtgcaagccacaagttcaccgatggccctcggagcaaacgccaccgctactcgcaagctgacaataattttcaaaaatatgcaggaatgcatcgatcaaaaagtttaccaggccgaggtggataaccttccagtagcgttcgaagatggcagcattaacggcggggaccgcccaggcggctcttccctatcgatccaaactgctaaccccggcaatcatgtggaaattcaggcagcctacattggaacaaccatcattatacggcagaccgcaggacaattatctttttccattaaggttgcagaagacgtggctatggctttcagtgccgagcaggatctccagctctgcgtagggggatgtccccccagccaacggctgtctcgaagcgagaggaatcgtcgaggcgccattactatcgatacagctcggagactatgcaaagaggggctgccggtcgaagacgcgtacttccattcgtgcgtgtttgatgtgctaataagtggcgacccaaacttcaccgttgccgcacaggccgctctggaggatgctcgggcctttctgccagatctcgaaaaattgcacttgtttccatctgacgcaggtgtgccactttccagtgctactctgctggcaccgctgctgagcggcttgtttgtactttggctttgcatacag

SEQ ID NO: 13543 - DNA, 1278 bp, Artificial Sequence
  Description of Artificial Sequence: Synthetic coding sequence
atgggcgagcccgggcagtcgccatcacccagatctagccatggtagccctcccacgctgtcaaccctaactttgctgttgctgctgtgcggtcacgcccatagccagtgtaaaatacttcggtgcaacgccgaatacgtgtcctccactctctcacttcgggggggcggcagcagcggagctcttcgcgggggaggcggaggcgggagagggggaggcgtggggagcgggggcctgtgtcgagccctgagatcgtacgcactctgtacgaggcggacagcccgcacatgtagaggcgacctggctttccattcggccgtccatgggattgaggacctcatgatacagcataactgttcgaggcagggtcccaccgctccccctcccccccgtggaccagcgttgccaggagcagggtcaggactgcctgcccccgacccctgcgattatgaagggagattttccaggcttcatggccggccccccggattcttacactgtgccagtttcggagatccacacgtgagatcgtttcatcaccacttccacacgtgtagggtccaaggggcatggcctctgctcgataatgattttcttttcgtgcaggccacctcgagcccaatggcgctgggtgccaacgccacagccactagaaagttgactattatattcaaaaatatgcaggagtgcattgaccagaaggtgtatcaagcggaggtggataatctgccggtcgcctttgaggatggctccattaacggtggggaccggccaggaggatccagtctgtctatccagacagctaatcccggaaaccatgtcgaaatccaggcagcttatattggaacgacaattattatcaggcagactgctggacagctcagcttctctattaaggtggccgaggacgtggctatggctttttctgccgaacaggatttacagctgtgcgtggggggctgcccaccgagccagcggttaagtaggtccgaacggaatcgacgtggcgcaattaccatagacaccgcacgccggctttgtaaggagggcctgcccgttgaggatgcgtatttccactcttgtgtatttgacgtgctaatcagcggggaccccaatttcaccgtagcagcacaggccgcgctcgaagatgcacgagcatttctcccagatcttgaaaagctgcatcttttcccatccgacgcgggggtccccctctcatcggctaccttgctagctccattgcttagtggactcttcgtgttatggttgtgtattcaa

SEQ ID NO: 13544 - DNA, 1278 bp, Artificial Sequence
  Description of Artificial Sequence: Synthetic coding sequence
atgggagagccaggtcaatccccttccccgcggagcagtcacggatctccgcccacgctgtcaactctcactctgctccttctcctgtgcggacatgctcattcccaatgcaaaattcttcggtgtaacgctgaatacgttagcagcaccttgtcgttgaggggaggagggtcatccggagccctccgaggaggaggtggaggaggacgcgggggtggcgtcgggtcgggcggactctgccgcgcgctgcggtcgtacgcactctgtactcgcagaactgccaggacttgcagaggggacctggctttccatagcgcagtacacggcatcgaagatcttatgattcagcataactgttcgaggcagggaccgaccgcccctccgcccccgaggggtcctgcactgccaggagcaggctccgggctgccggccccagatccctgcgactacgagggacggttctcaagactgcacggcaggcccccgggttttctccactgcgccagcttcggcgatccacacgtcagatccttccaccaccattttcacacttgcagggtgcaaggggcatggcctctccttgacaacgacttcctgttcgtgcaagcaacctcatcaccgatggctctgggcgcaaatgcaaccgctactcgcaaactgaccattatcttcaagaacatgcaagaatgcatcgaccaaaaggtgtaccaggccgaagtggacaacctgccggttgcgttcgaggatgggtcaatcaatggcggagatcgtccgggaggctcctcgttgtcgatccagactgcgaatcccggcaaccacgtggaaatacaggcggcgtacattgggaccaccatcatcatccggcagacggccgggcagctctccttctccataaaggttgcggaggacgtggccatggctttcagcgccgagcaagatctgcagttgtgcgtcggcgggtgcccgccgagccagcgactgtcaagaagtgagcgtaatcggagaggtgcaatcaccatcgacactgcaagacgcctgtgcaaggaaggactcccggtggaagatgcctatttccattcatgcgtgtttgacgtgctcatctcgggcgatccgaacttcaccgtggcagcccaggcagctttggaggacgctcgggcctttctgccagacctggagaagctgcatttgtttccctcggacgccggagtgccactgtcgtccgccacccttctggctccgttgctttcgggcctgtttgtgctgtggctgtgtatccag

SEQ ID NO: 13545 - DNA, 1278 bp, Artificial Sequence
  Description of Artificial Sequence: Synthetic coding sequence
atgggagagccgggccaatcaccttcaccgcggagtagccatggttcgcctccgaccctgtccacgctgaccctcctccttctcctgtgcgggcacgctcactcccagtgtaagatcctccgctgcaacgccgaatacgtgtcgtcgaccctctccctgcgcggaggaggctcatcgggagcactgcgagggggaggcgggggcggccgcggcggcggcgtcggatccggcggattgtgtcgcgcgctgcggtcatacgccctgtgtactagacggactgcacgcacctgcagaggagatcttgcctttcacagcgcggtgcatggcatcgaggacttgatgatccagcacaattgctcgaggcaaggtcctaccgctccgccgccaccaaggggaccagctctgccgggtgcaggatccggactgccagccccggatccctgcgattacgagggacggttctcccggctgcatggaagaccgcctggctttctgcactgcgcctccttcggcgatccacacgtgaggagtttccaccatcatttccacacttgtcgcgtgcagggagcctggcctttgctggataatgattttttgttcgtccaggccacgtccagccccatggccctgggagccaacgccaccgccactcggaagttgaccattatcttcaagaatatgcaagagtgcattgaccaaaaagtttatcaggcggaagtagataacctccccgtggctttcgaggatggaagcatcaatggtggggacagaccgggtggatctagcctcagcatccagactgccaacccgggcaaccatgtcgaaatccaggcggcctacataggaactacgatcatcattcggcagacggcggggcaattgtccttcagcatcaaggtagcggaagacgtcgctatggctttcagcgcggaacaagatctgcagctctgcgtgggtggctgcccaccgtcccaacgcctctcgaggtcagaacgcaacaggagaggagccatcaccatcgacactgcccggcgcctgtgtaaagagggtctgccggtggaagacgcgtactttcattcgtgtgtgttcgacgtgctgatctcgggggaccctaacttcaccgtggccgcacaggccgcgctggaagacgcgagggcctttctgccggacctggaaaagctgcacctctttccgtcagacgccggagtgccgctttccagcgcaaccctccttgctccgctgctgtccggcctgttcgtgctctggctctgtatccag

SEQ ID NO: 13546 - DNA, 1278 bp, Artificial Sequence
  Description of Artificial Sequence: Synthetic coding sequence
atgggcgagcctggtcagtccccatcacctagaagctcgcatgggagccccccgacgctgtcaacgctcaccttgcttctgctgctctgtggacatgctcattcacaatgcaagattctgcgttgcaatgcagaatacgtgtcgtcgaccctgtcgctgcgtggaggcggctccagcggcgcacttcgtgggggaggaggaggaggtcgcggtggaggagtgggctccggtggactctgtcgcgcactccggagctacgccctctgcactcgccgcactgcacggacttgtcgtggagatctggcatttcattcggcagtgcacggaattgaagatcttatgatccagcataattgttcaagacaaggacctactgcaccgcccccaccacgcggtcccgcgctccctggagccggctcaggcctccctgcacctgatccgtgcgattacgaaggacggttttcgaggctccatggtcgaccgccaggattcctccattgtgccagcttcggagatccacacgtgcgatcattccatcaccactttcatacctgtagggtgcaaggagcgtggccactgctggataatgactttctgttcgttcaagctacttcgtcaccgatggccttgggagccaatgcaaccgccacgaggaagttgacgatcatctttaagaacatgcaggaatgtattgatcaaaaggtgtaccaggcggaggtggataaccttccagtcgccttcgaagatgggtccataaacggtggagatagaccaggcggatcgtcactttcgattcaaactgcaaacccaggaaatcacgtggagattcaagccgcatacattggaactaccatcatcatccgacagaccgcaggacaactgtcattctcgattaaagtcgcagaagatgtggcaatggcattcagcgcagaacaggacctgcaactgtgtgtcgggggttgtcctccatcccaaaggctttcgcgatcggaaagaaatcggagaggggcaatcacgattgacaccgctcggagactgtgcaaagagggtttgcctgtggaagatgcgtactttcatagctgtgtatttgacgtgctcatttcgggtgaccccaactttacggtggcggcccaggcagcactggaagatgccagagcatttctgccggatctcgaaaaacttcatctgtttcccagcgatgcaggagtccccctttcgtcagcaacccttcttgccccactcctttcaggcttgtttgtcctttggttgtgcattcaa

SEQ ID NO: 13547 - DNA, 1278 bp, Artificial Sequence
  Description of Artificial Sequence: Synthetic coding sequence
atgggagagcccggtcagtcaccatcgccacgatcatcacatggatcaccgccaactctctcaaccctgaccctgcttctcctgctctgcggtcatgcccacagccaatgtaagatcctgcgctgcaacgcagagtacgtttcctcgaccctctcacttcggggcggaggaagctcaggagcactgcggggaggaggcggagggggacgcggcggaggagtgggaagcggagggctgtgtagagccctcagatcatatgccctgtgcacccgccgtaccgccaggacgtgcagaggtgacctggcattccattccgccgttcacggaatagaggacctcatgatccaacacaactgctcgaggcagggaccaaccgcgcctcctccgcctcgcggacccgcattgcctggcgctggctccggccttcccgcaccggacccgtgcgattatgagggccggttctcgcgcctgcacggcaggccccctgggttcctccactgcgcgtccttcggagatccgcatgtacgttcgtttcaccaccatttccacacgtgccgcgtccagggcgcatggccgctcctcgacaacgacttccttttcgtgcaggccacctcttcgcctatggcactgggagctaacgcaactgcgaccagaaagctcaccatcatcttcaagaatatgcaagaatgcattgaccaaaaagtgtaccaggccgaggtggacaacctgccggttgcctttgaggacggatcgatcaatggaggcgatcggcctggaggaagctccctcagcatccaaactgccaaccctggcaaccacgtcgagatccaggccgcctacatcggaactaccatcatcatccgccaaaccgcaggacaactgtcattttccatcaaggtggccgaagatgtcgcaatggcgttctcggcagaacaggatctgcagctctgtgtcggaggatgcccgccttcacagcgcttgagccgctccgaacggaacaggcggggtgctatcactatcgacactgcaaggcggctgtgcaaagaaggactgcctgtggaagatgcgtacttccattcctgcgtgttcgacgtgctcatcagcggtgacccaaatttcactgtggcagcacaggctgcgctcgaggacgcgcgggcctttctgccggatctggaaaaacttcatctgttcccatccgacgccggcgtgccgctgtcgtcggccaccctgttggcgccgttgctgagcggcctcttcgtgctctggctgtgcattcag

SEQ ID NO: 13548 - DNA, 1278 bp, Artificial Sequence
  Description of Artificial Sequence: Synthetic coding sequence
atgggagaaccaggccaatccccttcgcccaggagctcgcacggaagcccgcctactctttcgactcttacgctcttgctgcttctctgtggtcacgctcactcgcaatgtaagattctgcgttgcaatgcggaatatgtgtctagcactctgagcttgcggggaggtggttcgtccggtgcgctgcggggtggtgggggtggaggccgcggaggaggagtaggatcagggggactgtgtagggcactccgttcgtacgcactgtgtactcgtagaaccgcccggacctgccggggggatcttgcatttcattccgcagtccatggtattgaggacttgatgatccaacataattgcagcagacagggacctactgcccctccaccaccgaggggacctgcacttcctggggcgggctccggactgccggcgccagacccgtgtgattacgagggtaggttttcgagacttcatgggaggccgccaggatttctgcattgtgcctcatttggtgatcctcacgtccggagctttcaccaccattttcatacctgtagagtccagggcgcctggccactccttgataatgatttcctcttcgtgcaagcgactagctcacccatggcacttggggccaacgccactgcaacccgcaaactgaccatcattttcaagaacatgcaagaatgtatagatcagaaagtctaccaggccgaagtcgataacctgccagtggcattcgaggatggatcgataaacgggggtgatcggcctggtggttcgagcctgtctattcaaaccgcaaacccaggaaatcatgtggagattcaggccgcttacattggaaccaccatcattatccgccagactgctggacagctctcgttttcgatcaaggtggctgaggatgtggccatggccttctccgcggagcaggaccttcagctctgcgttggcgggtgccctccttcccagagactctcgcgatctgaacgcaacagacgcggagcaatcactattgatacggcacgtagactttgcaaagaggggcttccagtcgaggacgcatacttccattcgtgtgtgtttgatgtcctgatctccggtgatccgaacttcaccgtcgcagcccaagctgcactggaggacgcacgtgctttcttgccagacctggagaagttgcatctgtttcccagtgatgcaggtgtgcccttgagcagcgcgacgctgctggccccgcttctgtcaggcctttttgtgctgtggctttgtatacag

SEQ ID NO: 13549 - DNA, 1278 bp, Artificial Sequence
  Description of Artificial Sequence: Synthetic coding sequence
atgggtgagcccgggcagagcccgtcaccacggagtagccacggaagccctcccacattgtcaactctcactttactgctgctgttgtgtggtcacgcgcactctcagtgtaagattctgagatgcaatgctgaatatgtttcctcaactctgtcactgcggggtggcggatcctctggtgcgctgcggggcggcggggggggagggcgcgggggtggcgtcggtagcggagggttgtgtcgggccctgagatcttatgcactatgcactaggaggacggctagaacctgccgcggagatctggccttccactccgccgtccacgggatagaagatcttatgatacagcacaattgctcacgacagggccccactgcgcccccaccgccccgagggcctgccctcccgggcgctgggtccgggcttcccgcacctgatccctgtgattacgaaggtcgcttcagccgtcttcatggtaggccaccgggttttctgcattgcgcaagctttggcgatccacatgttcggtccttccatcatcacttccacacatgtcgcgtccagggggcgtggccattgctggacaacgacttcctttttgtacaggccacaagctctccgatggccttaggtgcaaacgccaccgccaccaggaagttgactattatcttcaagaacatgcaagagtgtatagaccagaaagtctaccaggccgaagtggacaatttaccagttgcttttgaggatggcagcatcaatggaggggacaggccgggtggatcatctctcagcatccagacagccaaccctggaaatcacgttgaaatacaggccgcatatattgggacaacaataatcattcgtcagacagccgggcaattgagcttcagcatcaaagtcgcagaggacgtcgctatggccttctccgcagagcaagatctgcagctctgcgtgggcggttgccctcccagtcagcgtttgagccgaagcgagaggaatagaagaggagccataactatagatactgcacggcgtctttgcaaagaaggattgccagtcgaagacgcctatttccactcttgtgtgtttgacgtgctgatctccggtgatccgaattttacagtggccgcgcaggccgccctggaggatgcacgggcatttctccccgatcttgaaaagctgcatctttttccaagcgacgcaggcgtgccgctgtcctctgccactctcctggcacccctactgtccgggctgttcgtcttgtggctgtgtatacaa

SEQ ID NO: 13550 - DNA, 1278 bp, Artificial Sequence
  Description of Artificial Sequence: Synthetic coding sequence
atgggcgagccgggtcaatccccatctccacgctcttcgcatggctccccaccaactctgagtactctgaccctgcttcttcttctttgtggccatgcccactcgcagtgtaagattcttagatgcaacgcagaatacgtgtcctccactctctcattgcgaggcggtggatcgtcaggtgcactgagaggcggagggggtggagggcgcggcggaggtgtcggatcgggaggtctgtgtagggcactgcggtcctacgcactctgcaccagacggactgcacgcacttgtagaggggatttggccttccattcggccgtccacggcattgaggacctgatgattcaacataattgctcacgtcagggcccaaccgcacctcctccccctcgaggaccggcactgcctggcgcaggctcgggacttcccgcccccgacccttgtgattatgagggtcgcttttcgagacttcacggacgccccccaggttttctgcattgcgcatcatttggagatccacatgtgcgctctttccatcatcactttcatacttgccgcgtgcaaggtgcctggcccctgctggataacgactttctttttgtgcaggcgacctcctcgcctatggcactcggggcgaatgcgactgcaacccgaaagctcaccatcattttcaagaacatgcaggaatgcattgatcagaaggtttaccaagcggaagtggacaacctccccgtggcattcgaagatggcagcatcaacgggggcgaccgtcccggggggtcgtcgctttccatacaaaccgccaatcccgggaaccatgtggaaatacaggcagcctacattggtactactattatcattagacaaactgcaggccaactgtcctttagcattaaggtcgcagaggatgtcgccatggcgttctccgccgaacaggacctccaactttgtgtcggaggatgccctcctagccaaaggctgtcacggtcggaaaggaaccgtagaggtgcaatcaccattgacactgcgcgcaggctctgcaaagaagggctcccagtcgaggatgcatacttccatagctgtgtgtttgacgtgctgatttcaggtgaccctaactttaccgtggcggcacaagcagcactcgaagatgcaagagcattccttcctgacctggagaagctgcacctgttcccctcggacgcaggagtgccgctgtccagcgccactctcctggcaccacttctgtctggtcttttcgtgctgtggctctgtatccaa

SEQ ID NO: 13551 - DNA, 1278 bp, Artificial Sequence
  Description of Artificial Sequence: Synthetic coding sequence
atgggggaacccgggcagtcaccctctccaagaagtagtcacgggtctcctcccacactctccacactgacattactcttactgctctgtggacatgcccactcccagtgcaagatcctgcgctgcaacgctgaatatgttagttccacactaagtcttcggggaggaggatcttctggagccctccgaggaggagggggaggaggacggggagggggggtgggatctgggggattgtgtcgggccctgaggagttatgctttatgcacacggagaactgcacggacttgtagaggagatctcgccttccactccgctgttcacggaatcgaagatttaatgatacagcataactgcagtcggcagggacctacagccccaccacccccccgagggccagctctgcccggagctggatctgggctccctgctcctgatccctgtgattatgaagggaggttctctcgactgcacggaagacccccagggttcctacattgcgcctcttttggagatcctcatgtgagatctttccaccaccactttcatacatgtcgagtacagggggcttggccattattagataacgatttcctcttcgttcaggcgacttcatccccaatggccttaggagctaatgccacagctacaagaaaactaacaataatatttaaaaatatgcaagaatgcatagatcagaaagtttaccaggcagaagtcgataatctacctgtggcttttgaagacgggagtattaacgggggggatcgccccggagggagttccctgtcaatacagacggcgaatccaggaaatcatgtggaaatccaggctgcatatatcggaactactataatcatcaggcagacagcagggcagctctcattttctataaaagtggctgaagatgtagcaatggccttttccgcagaacaggatctacagctttgcgtggggggatgtccaccctcccagaggctctctaggagtgaacgaaatagacgcggagccataacaatagatacagcccgtagactctgtaaagaaggacttcctgtggaagatgcttattttcactcatgcgtgtttgatgtcctaatatctggagatcccaactttacagtggctgcacaggctgctctagaagatgcccgggccttcctcccagatttagagaaactccacctatttccctctgacgctggggtcccactttcctctgccacactgcttgcacctcttctttctggattattcgtactatggttatgcatccag

SEQ ID NO: 13552 - DNA, 1278 bp, Artificial Sequence
  Description of Artificial Sequence: Synthetic coding sequence
atgggtgagcccggacagtccccttcccccaggtcaagtcatggtagccctcctaccctctctaccctcactctcttgcttttgctgtgcggacatgcccatagccaatgcaagatcctgaggtgtaacgctgaatatgttagctccaccctctctcttcgtggcggcggttcttctggcgctttgcgtggtggaggcggcggtggtagaggcggtggcgtgggatcaggtggcctgtgtagggctctccgcagttacgctttgtgtactagaaggaccgctcgcacatgtaggggtgatttggccttccatagcgctgtgcacggtatcgaagatctgatgatacagcacaactgttctcgtcagggtcccacagcccctccaccaccacgtggccctgccctgcccggagccggatccggcctgcctgccccagacccctgcgactacgagggaaggttctcccgtctccacggtcgtccacctggattcctccactgtgcctcctttggcgacccccatgttcgctcttttcatcaccactttcacacctgccgcgtccagggcgcctggcctttgctggacaacgacttcctctttgtccaggctaccagctctcccatggccctgggcgccaacgccactgccaccagaaagctcactataatcttcaagaacatgcaggagtgtattgaccagaaggtctatcaggctgaggtggataacctgccagtcgctttcgaggatggaagcatcaatggtggagaccgcccaggcggtagttcactgtccatccaaactgcaaacccaggcaaccatgtggagattcaggctgcttatatcggtaccactatcatcatcaggcaaacagcaggtcaactgagcttcagtatcaaagtagctgaggacgtcgctatggcttttagcgctgagcaagatctgcaactctgcgtcggcggatgtcccccctcccagcgcctgagccgttccgaacgcaatcgcaggggagccataaccattgacactgcacgccgtctctgcaaagaaggcttgccagttgaggacgcttatttccattcatgtgtctttgacgtccttatctcaggtgatcccaattttacagttgccgcccaagcagcattggaagatgctcgcgcttttctgcctgatctggagaagttgcatctcttccccagcgacgctggagtgcccctctcatcagctacattgctggcacccctgctgtcaggcctctttgtactttggctctgtatccag

SEQ ID NO: 13553 - DNA, 1278 bp, Artificial Sequence
  Description of Artificial Sequence: Synthetic coding sequence
atgggggaacctgggcaatccccaagccctcgaagctcccacggttcgccacccaccttgtcaacactgaccttgctcctcttgctttgtggccacgcacactctcaatgtaaaatcctgcgctgtaatgccgaatacgtctcttccacactgtctttacgcgggggcggatctagcggcgcccttcgaggcggcggaggggggggccgcggaggcggcgtgggctctggcggcttatgtagggccctgcggtcgtacgcgctgtgtacccgcagaacggccaggacatgcaggggagacctggcatttcacagcgccgtccacgggatagaagatctcatgattcaacataactgtagccgtcaagggcccacagccccccctcctcctcggggacccgcccttcctggcgcaggtagtgggctgcccgccccagatccctgtgactacgagggccggttttcccggctgcacggtcgacccccgggatttttacactgcgcgtcatttggggacccacatgtccggtcatttcaccaccatttccatacctgcagagtccagggggcttggccgttactggacaacgattttctgtttgtgcaagcaaccagttcaccgatggcgctgggtgccaacgccaccgcgactcgtaagctgactattatcttcaaaaacatgcaggagtgcatagatcagaaggtgtaccaggcagaggttgataacctgcccgtggctttcgaggacggcagtataaacggaggtgatagacctgggggcagtagcctctctatacaaactgctaatccaggtaatcatgtggaaatccaggccgcatatataggcaccaccatcatcatccggcagaccgccggccagttgtctttttctatcaaagttgcggaagacgtggccatggctttctccgctgaacaagatcttcagttgtgtgtgggtggttgtcctcccagtcagcgtttatctcggagtgaacgcaatcggcgcggtgccatcaccatagatactgctagacggctgtgcaaggagggattaccagttgaggacgcctatttccactcttgcgtgttcgatgtgcttatttctggagatcccaatttcacagtcgcagctcaagcggccctcgaagacgcacgggccttccttcccgatcttgagaagttacatctctttccttccgacgctggcgtaccgttgagttctgccacactgctggcccccctgctctctggcctgttcgtactgtggctgtgtatacag

SEQ ID NO: 13554 - DNA, 1278 bp, Artificial Sequence
  Description of Artificial Sequence: Synthetic coding sequence
atgggagagccgggccagtcaccttcgccaagatccagccatggaagcccgccgactctctccactctcactctgctcctcttgctgtgcggccatgcccatagccaatgcaagattctccggtgcaacgccgagtacgtgtcatcgactctgtctctccggggcggcggatcgtcgggagcactgcgcggcggagggggaggtggccgcgggggaggagtgggatctggtggcctctgccgcgccctgcgctcgtacgccctgtgtacccgcagaacggcgcggacctgccgcggggatctcgcctttcactccgcggtgcatggaatagaagatttgatgatccagcacaattgtagccggcagggaccgactgccccacccccaccacgcggacccgcgttgcctggcgcaggctccggactccccgctccagatccgtgcgactacgagggaaggttcagcagactgcatggtcggccgcccgggttcctccactgcgcgagcttcggtgacccgcacgtgagatccttccaccaccatttccacacttgccgggtgcagggtgcctggcccctcttggacaacgacttcctgttcgtgcaagcgacgtcatccccaatggctctgggagcaaatgccaccgcgacgcggaagttgactatcatctttaagaacatgcaggagtgtatcgaccaaaaggtgtaccaggcggaggtggacaatctgcccgtggccttcgaggacgggtcaatcaacggaggagatcgccctggaggcagctcactgagcatccaaaccgcaaaccctggaaatcacgtggaaatccaggcagcttacatcggcaccaccatcatcattcgtcaaactgccgggcaactgtctttctcgatcaaagtggccgaagatgtcgccatggccttctcggccgaacaggacctgcagctgtgcgtgggtggatgccccccgtcccagagactctcaagaagcgaaagaaatagacgtggagcaatcactatcgacacggcccgcagactttgcaaagaaggactgccagtcgaagatgcgtactttcattcttgcgtgttcgatgtccttatctcaggagatccaaacttcactgtggctgcacaggcggcactggaggacgctcgggccttcctgccggaccttgagaagttgcatttgtttccatccgatgcaggagtcccgttgtcgtccgccactttgttggcaccgctcctttccggcctcttcgtgctgtggctgtgtatccag

SEQ ID NO: 13555 - DNA, 1278 bp, Artificial Sequence
  Description of Artificial Sequence: Synthetic coding sequence
atgggcgagccagggcagtcaccaagccctcggagttctcatggctcaccgccaactctgagtacgctgacgttgctgctgctcctgtgtgggcacgcccacagccaatgtaaaattcttcgctgcaatgccgaatatgtgtcctccaccctgtccttgcgggggggaggatcttcaggtgcgctccggggtggagggggaggggggagaggcggaggcgtcggctctggcgggctgtgccgggccctgcgctcctatgccctctgcactagacggacggcaaggacgtgtagaggtgatttggctttccactctgctgttcacggcattgaagaccttatgattcagcacaattgtagtaggcaaggaccaacggctcctccccctccacgcggtccagctctcccgggcgccggctccgggctgcccgccccagatccctgcgactacgaggggaggttcagtagactccatggacgaccccctgggttccttcattgtgccagctttggagacccgcacgtcaggtcttttcaccaccacttccatacctgccgagtccaaggagcttggcccctgttggacaacgatttcctgtttgttcaggctacgtcatcccctatggcgctgggagcaaacgccacagcgacccgcaaacttactatcattttcaagaatatgcaggagtgtatagatcaaaaggtgtaccaggcagaggtcgacaatttgcccgtggcctttgaagatggaagcatcaatggaggcgatcgcccgggaggttctagcctcagcatccagaccgcgaaccccggaaatcacgtagaaattcaagccgcctacattggcaccacgattattattcgacaaaccgccggccagctcagcttctccattaaagtggccgaggatgtggctatggcctttagtgcggagcaggacctgcagctgtgtgtaggggggtgtcccccaagccagcggttgagccgctctgagcgcaaccgccgcggagctattaccatagataccgccaggagattgtgcaaggagggactgcccgtggaggacgcttacttccattcctgcgttttcgacgttctcatctcaggggaccccaactttaccgtggctgcccaggccgccctggaagatgcccgggcctttctgccggacctcgaaaagctgcacctcttccctagtgatgccggcgtgcccctgtcctccgcaaccctcctggcccctctgctgtccggcctttttgtcctgtggttgtgtattcag

SEQ ID NO: 13556 - DNA, 1278 bp, Artificial Sequence
  Description of Artificial Sequence: Synthetic coding sequence
atgggagaaccaggacaatccccctcgccaagatcatcccacggcagcccacccacgctctccactctcactctgcttttgctgctgtgcgggcatgcccattcacaatgcaagatcctccggtgcaacgcagaatacgtgtcgtccactctgtcgctgagaggaggaggctcctccggagctctgagaggcggaggagggggaggcaggggcggtggagtgggatcaggtggtctttgccgggccctgcggtcgtacgctctttgtacccggcgcactgcacgcacttgccgcggcgatctcgcctttcacagcgcggtgcatggcatcgaggatctgatgattcagcacaactgctcccggcaagggcctactgcgcccccgccaccacgcggtcccgcccttccgggagcgggatcgggactgcccgcaccggacccatgcgattacgaaggccgcttcagcagactgcacgggcgccctccgggattcctccactgcgcctcatttggcgaccctcacgtccgcagcttccatcaccacttccacacttgccgcgtccagggtgcttggccgctcctggacaacgactttctgtttgtccaggcaacttcgtccccgatggcgctcggagcgaatgcgaccgcaacccgcaaactgaccatcatcttcaaaaacatgcaggaatgcatcgaccaaaaggtgtaccaggccgaggtggacaatctgccagtggcattcgaagatggctccattaacggcggggatcgcccagggggaagctcgttgagcatccaaactgcgaaccctggtaaccacgtggaaatccaggctgcctacatcggcactactattatcatccggcagaccgccgggcaactctcgttctcgatcaaggtggccgaggacgtggcaatggcattctccgccgagcaagatctgcagctgtgtgtgggaggctgtccgccttcccagaggctgagcaggtccgaacggaaccggcgcggggccatcaccatcgacaccgcgcgtcgcctctgcaaggagggactgccggtagaggatgcgtatttccactcctgcgttttcgatgtgttgatctccggggacccaaactttactgtggccgcacaggccgcgctggaagatgcgcgcgctttcttgccagacctcgagaaattgcacctgtttccctccgacgcaggcgtcccgctttcgtccgccactctgctcgcaccgctcctctccggattgttcgtgctctggctgtgtattcaa

SEQ ID NO: 13557 - DNA, 1278 bp, Artificial Sequence
  Description of Artificial Sequence: Synthetic coding sequence
atgggcgagcctgggcaaagccctagtcctcgttctagccatggctctccgcctacactaagcaccctcactctcctgctattactgtgtgggcatgctcactcacagtgcaagatcctccgttgcaacgccgagtacgtgagtagcacccttagcctgcgggggggaggaagtagtggtgcgctgcgcggcggcggcgggggggggagagggggcggagttgggtctggagggctgtgtagggcactcaggagctatgctctttgtactcgtcgaactgcacgtacctgtcgcggggacctggcttttcatagcgcagttcatggtatcgaagatttgatgatacagcataattgtagccgtcaaggcccaacggcaccccctccaccacgaggccccgctctgccaggcgcagggagtggcctaccagcaccggatccttgcgactacgaaggcagatttagtcggctccacggtcgccccccaggttttctgcactgcgcaagcttcggggatcctcacgttcgatctttccaccatcatttccatacatgccgggttcagggagcatggcctctcctggataacgattttctgttcgtgcaggcaacgagcagccccatggcattgggcgcaaatgccacagccacccggaaacttacaataatattcaagaatatgcaggagtgtattgatcagaaagtgtaccaggctgaggtggataacctgcctgtcgcctttgaagatggtagcatcaacggtggtgacaggcctggcgggtcctcgttgtcaatacagaccgccaatccgggaaaccatgtggagattcaggcagcctatataggtaccaccattatcattcgtcaaacagccggccagctctcgtttagtattaaggtagcagaggatgtggcaatggcattctccgctgagcaagacctgcagttatgcgtgggggggtgccctccttctcagcgactaagtcgatctgaacggaacagacggggcgccattaccatcgataccgctcgtcgcttgtgcaaagaaggtctgcccgtagaagacgcatattttcatagctgtgtatttgacgtattaatatccggtgacccaaatttcactgtggccgcccaggcagcactggaagatgccagagcattcctccccgatctggaaaagctccatctgtttccttcagatgccggcgtccccctttcttccgcaaccctgttggcacccttactgtctggtttgtttgttttgtggctctgtattcaa

SEQ ID NO: 13558 - DNA, 1278 bp, Artificial Sequence
  Description of Artificial Sequence: Synthetic coding sequence
atgggggagcccggacagagcccttccccacgttcatcacatgggtccccacctacattgtcaacactgactctccttttactgctctgtggtcatgcgcattcccagtgcaagatacttcggtgtaacgccgagtacgtaagtagcacgctgtcgctcagagggggggggtcgagcggcgctctaaggggtggaggtgggggagggaggggcggtggcgtcgggtccggaggcctctgcagggccctgcggtcctatgctctgtgcactagacgcacagcccggacctgcaggggcgatttggcctttcactccgcagtacacggaatcgaggacctgatgattcagcataactgcagtcgccaggggccaaccgctcctcccccccccaggggtccggcactgccgggtgcgggaagcgggctaccagctccggacccatgtgactatgagggtcggttcagccgccttcatggccggcctccagggttcctccactgtgcttccttcggcgacccacacgtaaggtccttccatcaccacttccatacatgccgggtgcagggagcctggcctctattggacaacgacttcctgtttgtccaggccacatcttcaccaatggcccttggcgccaatgccacggcaacacggaagctgacaatcatttttaaaaacatgcaagaatgcattgatcaaaaggtgtatcaagctgaagttgataacctccccgtagctttcgaagatgggtccatcaatggcggcgacaggcctggcggctctagtctctccatacagacagcaaatcctggcaatcacgttgagatccaggccgcatatattggcacaactatcatcatacgtcaaacagccggtcagctgtccttcagcattaaggtggccgaggacgtggccatggcatttagcgccgagcaggatcttcaattgtgcgtgggtgggtgccctccttctcaaaggctcagccgctctgagagaaatcgtcgaggggccatcacaatcgacactgcacgaaggctgtgcaaagagggactaccagtggaggacgcctactttcattcatgcgtgttcgacgtgctcatttccggagatccgaactttactgtcgccgcgcaggcagcactggaagatgcaagggcctttctccccgatctggagaaattgcatctgttcccctcggacgcaggggtgcctttgtcctcagccacccttctggctcctctgttgagtggcctgttcgtattgtggctctgtattcag

SEQ ID NO: 13559 - DNA, 1278 bp, Artificial Sequence
  Description of Artificial Sequence: Synthetic coding sequence
atgggcgaaccagggcagtcaccgtcgccacggtcctcgcacggttccccacctactctttccacccttaccctcctgctgttgctgtgcggacacgctcatagccaatgcaagatcctgagatgcaatgccgaatacgtgtcatcgacgttgtcattgcggggtggagggtcgtctggagccctccgcggcggcggaggtggaggacggggaggtggcgtgggttcgggcggactgtgcagagccctgaggtcctacgcgctctgtactagacgcaccgcacgcacctgccgcggcgacctcgccttccattcggccgtccatgggattgaggaccttatgatccagcacaactgctccaggcagggacctactgccccaccacctccacgcggaccggcgctccccggcgcgggcagcggactgccggcgccagatccctgcgattatgaaggacggttttccagattgcacggccgcccgccaggcttcctccattgcgcatcgttcggtgacccgcacgtcaggtccttccatcatcatttccacacctgcagggtgcagggagcctggccactgcttgacaacgatttcctgttcgtccaagccacttcctcacctatggccctgggagccaatgccaccgccacccgcaagctgactatcatcttcaaaaacatgcaagagtgcatcgatcagaaggtgtatcaggccgaggtggacaacctgccggtagcctttgaagatggatcaatcaacggtggagatagacctggaggctcttctctttcaattcagaccgcgaacccggggaaccatgtggaaatccaagctgcctacatcggaactactatcatcattcgccagaccgccggacaactctcgttctccatcaaagtggctgaagatgtcgctatggcgttttccgcggaacaggatttgcaactgtgtgtgggtggatgccctccgagccaacggctgtcacgctcggaaagaaacaggcgcggagcaatcactattgacactgcacgtcgcctctgcaaggaggggctgccagtggaagatgcttacttccactcctgcgtgtttgacgtgctgatctcgggtgaccctaatttcacggtggccgcgcaggccgcgctggaggacgctagagccttcctgccggatctcgagaaacttcatctcttcccatccgacgccggggtgcccctgtctagcgctaccctgcttgcaccgctcctgagcggcctcttcgttctctggctctgtatccag

SEQ ID NO: 13560 - DNA, 1278 bp, Artificial Sequence
  Description of Artificial Sequence: Synthetic coding sequence
atgggggagcctgggcagtctccaagccctaggagctcacacggatcccctccgacgttgtccactctcactctcctgctccttctgtgtggacacgcacactcacagtgcaaaattctgcgctgtaatgcggaatacgtgtcgtcgaccctctcgttgcgagggggagggtcgtctggcgcactcagaggtggaggaggaggtggacgaggaggtggcgtcgggagcggtggactgtgcagggcccttaggtcgtacgcactgtgcactcgtcggacggcacgaacctgtcggggcgatctcgcctttcatagtgctgtgcatggtatcgaagatctgatgattcagcataattgcagcagacagggtcctaccgcccctccacctccaagggggccagctctgcctggagcaggatccggcctgcctgcaccagacccatgtgattacgagggtcgctttagccgccttcatggtagacctccaggatttctgcattgcgcctcgtttggcgacccacatgtgagatcgtttcaccatcactttcacacctgtagggtgcaaggtgcatggccgctgttggataacgatttcctgttcgtgcaggcaacctcaagcccaatggcactgggagccaatgcgaccgcgaccagaaagctgaccatcattttcaagaacatgcaagaatgtatagatcaaaaagtgtaccaagcagaagtcgacaaccttcccgtcgcatttgaagatggttcgattaatggtggtgatcgccctggaggttccagcctctcgatccagaccgcaaaccctgggaatcatgtggagatccaagcagcctacatcggcacgaccattatcattcgacaaaccgcgggacagctctcgttttccataaaggtggccgaagatgtcgcaatggccttcagcgcggaacaggatcttcaattgtgcgtgggcggatgccctccgtcgcaaagactctccagatcagaacgcaatcggcggggagccatcaccattgacaccgcgagacgcctgtgtaaggagggactgcccgtggaggacgcttactttcacagctgtgttttcgacgtcctgatttccggggacccaaatttcactgtggcagcacaagcagctctggaagatgcacgggcttttcttcccgacctcgaaaagctgcatctctttccgtccgacgcaggcgtccctcttagctcggcgactctgctcgcgcctcttctgtcagggctgtttgtcctgtggctctgcatccag

SEQ ID NO: 13561 - DNA, 1278 bp, Artificial Sequence
  Description of Artificial Sequence: Synthetic coding sequence
atgggagagcctggacagtcgccgtcaccccggtcgtcccatggatccccgccaactttgagcaccctcactctgctgcttcttttgtgtggacacgcacattcgcaatgcaagattcttcgctgtaacgcagaatacgtgagctcgaccttgagccttcggggaggaggaagctcaggagcactcagaggtggtggaggcggtggacggggtggtggagtgggaagcggaggactctgtcgagcccttaggtcgtatgcactttgtactcggcgaaccgcacgtacctgcaggggtgatcttgcctttcactccgcggtccacggaattgaagatctgatgattcaacataactgttcgcggcagggtcctactgcgccacctcctccgagaggccctgccctgcctggagccggttcggggctgccagcaccagatccttgtgactacgaaggtagatttagccgacttcatggtagaccccctggtttcttgcattgtgcctcgtttggcgatcctcatgtgaggtcattccatcatcattttcatacgtgtagggtgcagggcgcatggccgcttctggataacgattttctttttgtgcaagccacctcctcaccaatggcgctgggcgccaatgccaccgccacgagaaagctgactatcatcttcaaaaacatgcaagaatgcattgatcagaaggtctaccaagcagaggttgataacctgccagtcgcatttgaagatggaagcatcaacgggggcgaccgtcctggaggatcttctctgtcgatacaaactgcgaatccaggcaaccatgtggaaatccaagcagcttacatcgggaccactatcatcattagacaaactgctggacagctctcattctccatcaaagttgcagaagatgtagcgatggcattttccgcggaacaggatcttcaattgtgtgtgggtggatgtccaccttcgcaacgactttcccgttccgaaagaaatagaaggggcgctattaccatcgacactgcaaggagattgtgtaaggaggggcttcctgtcgaagatgcctacttccattcctgtgtctttgatgtgctgatttcgggtgaccccaatttcacggtggcggcacaagcagcccttgaagatgcgagagcctttctgcctgaccttgaaaagctgcacctcttccctagcgatgcaggtgtccctttgtccagtgcaaccctgctcgctcctcttctgtcgggtctttttgtgttgtggctttgtatacaa

SEQ ID NO: 13562 - DNA, 1278 bp, Artificial Sequence
  Description of Artificial Sequence: Synthetic coding sequence
atgggggagccagggcaatcaccttcaccgagaagttcccatgggtctccacccacactatccacacttaccctcctactgctgctgtgtgggcatgctcactcccagtgcaagatcctgcggtgcaatgctgagtacgtaagctcaacactgagtctgaggggcggggggagtagcggcgcactccggggagggggtggcggaggacgcggcggtggtgtgggaagcggaggcctttgccgggccctgcgcagctatgccctatgtacccggaggactgcaagaacttgtcgcggggacctggccttccatagcgccgtgcacggcattgaggacctgatgatccagcacaactgttcgcgccaaggcccaaccgctccacctcccccccgcggtcccgcgctacccggcgctgggtctgggctgcccgctccagacccttgtgattacgaagggaggttctctaggttacatggtcgaccccccggattccttcactgcgcatcgtttggcgacccacatgtaagaagcttccaccaccacttccatacgtgtcgggtgcagggcgcatggcctctgctagacaacgatttcctgttcgtgcaagcgacctcctcaccaatggcccttggggcgaacgctacggccacgagaaagctaactatcatcttcaaaaacatgcaggaatgtatagaccagaaagtttaccaggcagaagtggacaacctgccagtagcttttgaggacggttccattaacgggggtgatcgccccggaggctcctcactgtctatacagaccgccaaccccggtaaccatgttgagatccaggccgcatacatcgggaccacaattattatacgacagactgctggccagttgtcttttagtattaaagttgccgaggacgtcgccatggcattcagtgccgaacaagatttgcagctgtgcgtgggcggttgtcctccaagtcaaagactcagccgttcagagaggaacagacgaggcgctatcaccattgacacggcaaggagattgtgtaaggaaggtttgccggtcgaggatgcctactttcactcatgtgtttttgacgtgctcatcagcggagaccccaacttcaccgtggccgcccaagcagcactggaggatgcgagagcctttctcccagacctagaaaaactgcacctgtttcccagcgatgcaggtgttcctttgtcctcagccaccctgctggccccactcctgtccgggctgtttgttctctggctttgtattcaa

SEQ ID NO: 13563 - DNA, 1278 bp, Artificial Sequence
  Description of Artificial Sequence: Synthetic coding sequence
atgggggagcctggtcagtcacccagcccccggagcagccacgggtctccgccaacactgtctacactcacactcctcctcctcctttgcggacatgctcactcacagtgtaaaatacttcggtgtaatgctgagtatgtttctagcaccctgagcctgcgcggaggaggaagctccggcgcgctgcgcggaggagggggtggcggtagaggtggtggcgtggggagcgggggcctatgcagagccctccggtcatatgccctatgcacacgccgtacggctcgaacctgcaggggggatctggcctttcactcagccgttcatggcatagaggatctgatgatacaacacaattgttctaggcagggtccgactgcccctccccctccacggggacctgccctgccaggcgctggttctgggctccccgcacccgatccttgtgactacgaaggcagattcagtcggctgcacggccgcccacctggtttcctccactgtgcatctttcggagacccacatgtccggtcatttcaccaccacttccatacatgccgcgtccagggcgcgtggcctctcctcgacaatgactttttgttcgttcaggccacctctagcccgatggcacttggagcaaatgctactgctaccaggaaactcacaatcatcttcaaaaatatgcaggagtgcattgatcagaaggtatatcaggccgaagtggacaatctcccggttgcattcgaagacggcagtattaatgggggcgatcggcccggtggcagttccctgtcaattcagaccgctaacccgggaaaccacgttgaaattcaggccgcttatatcggtactacaattattattcgccagacagccggtcagcttagtttttcaattaaggttgcagaggatgtcgccatggctttcagtgcagaacaggatctgcaattgtgtgttggaggttgtccgccctcccagaggctgagccgttccgagaggaatagacgcggggccattacgatcgataccgccaggcgattgtgcaaggaaggcctaccagtggaggacgcctatttccactcctgcgtgttcgatgtcctgataagcggcgatccaaactttacagtggctgcacaggctgcccttgaggatgctcgtgcattcttacctgatctggagaagctgcatctgtttccaagtgacgccggtgttcctctctccagtgcaaccttgctcgcccctctcctctcaggcttattcgtgctgtggctgtgcattcag

SEQ ID NO: 13564 - DNA, 1278 bp, Artificial Sequence
  Description of Artificial Sequence: Synthetic coding sequence
atgggtgaacccggccaatcgccctcgccccgcagcagccacggaagcccgcctactctgtctaccctcacccttctcctccttttgtgtggtcacgcgcattcgcaatgtaagatcctccgctgtaatgcagagtacgtctcgtcgaccctttcgctgagaggagggggatcgtccggtgcactgcgaggaggtggcgggggaggtcgtggaggaggagtgggttccggaggtttgtgtcgtgctctgcgctcatacgcactttgcacgcgacgcactgcaagaacgtgtaggggcgatctcgcttttcactcagctgtgcatggtattgaagatcttatgatccaacataactgctccaggcagggtccaactgcgcctccgccgccacgtggccctgcacttcctggagcaggctcagggcttccagcccctgatccatgcgactacgaaggacgttttagcagacttcacggtagaccacctggattcttgcattgtgcatcctttggcgacccacatgtgagatcatttcatcatcattttcatacctgccgggtgcagggagcttggccacttctggacaatgatttcctgtttgtgcaagcaacctcctcgcctatggcccttggcgctaacgccactgcgactaggaagctgaccatcattttcaaaaacatgcaggaatgtatagaccaaaaggtgtaccaagcggaagtggataatcttcccgtggcatttgaggacggtagcatcaatggtggagatagacccggaggttcctccctttcgattcagaccgctaaccctggtaaccacgtggaaattcaagctgcatacattggaaccactatcattattcgccagacggcaggacagttgtcgttttccattaaagtggcagaggacgtggcgatggcattttccgcagaacaggatttgcaactttgtgttggcggttgcccaccttcgcagcgcctgtcgagatccgaaagaaaccgtcggggagcgattaccatagataccgcacgccgactttgtaaagaaggactgcctgtcgaggatgcttactttcatagctgtgtctttgacgttctgatttcaggtgatcccaatttcaccgtcgccgcgcaagcggcccttgaagatgcgagagccttccttccagacttggagaagttgcacctttttcctagcgacgcaggcgtgcctctcagcagcgcaactctccttgcaccgctgctgagcggtctgttcgtgctctggctttgcattcag

SEQ ID NO: 13565 - DNA, 1278 bp, Artificial Sequence
  Description of Artificial Sequence: Synthetic coding sequence
atgggagaaccgggacagagcccttcgccaagatcatcccacggatcgccaccaacgctctcgactctgaccctgcttctgctgctgtgcggtcacgcgcacagccaatgcaagatcctccgctgcaacgccgaatacgtttcctcgacgctttcgcttcggggaggaggttccagcggcgcactgcgcgggggtggtggaggaggccgcggcggtggtgtcgggtccggaggactctgtcgggcccttcggagctacgccctgtgtactaggcggactgcaagaacttgccggggggatctggccttccatagcgcagttcatggaatagaagatcttatgatccagcacaactgttcccgtcaaggacccactgcacccccaccacccagaggacccgcacttcctggagcaggatcaggacttcctgcaccagacccatgcgactacgagggccgtttcagccgccttcatggaaggccccccggctttctgcattgtgcctcctttggtgaccctcatgtgcggtcgttccatcaccatttccacacctgcagagtgcagggggcgtggccgttgctcgataacgattttctgttcgtgcaagccaccagctcgccaatggccttgggggcgaacgctacggccaccaggaagctcaccataatcttcaagaatatgcaagaatgcatcgaccagaaggtctatcaggcagaagtcgataacctgcctgtcgcatttgaggacggctcaatcaacggtggcgaccggcccgggggtagctccctgtcaatccaaactgcaaatccgggaaaccacgtcgagattcaagctgcgtacattggtaccaccattatcatccgacagacggcgggccaattgagcttctccattaaagtggcagaggatgtggcaatggctttttcggcggaacaggatctccagctctgcgtgggcggatgtcctccgtcgcagcgcctgtcaagatcagaaaggaaccgaagaggagcaataaccatcgacactgcgcggagactttgcaaagaaggacttcccgtggaggacgcttactttcatagctgcgtattcgacgtgcttattagcggagatcctaactttactgtggctgcacaagccgcactcgaagatgcgagggccttccttcctgatctggagaagctccatctctttcccagcgatgccggagtgccactgagctccgcaacgctgctcgcaccacttctttcgggacttttcgttctgtggctctgcattcaa

SEQ ID NO: 13566 - DNA, 1278 bp, Artificial Sequence
  Description of Artificial Sequence: Synthetic coding sequence
atgggtgagcctggccagtccccttctcccagaagctcacatggcagtccacccactctgtctacacttaccttgctgctacttctctgtggtcacgcccactctcagtgtaagattctgcgatgtaacgcagagtacgtaagttccactttgagcctgcgcggcggcggttcatcgggcgcgcttaggggaggcgggggcggtggccgtggcggcggtgtaggctccgggggtctctgcagagccctgcggtcatatgctttgtgtacaagacgtaccgcaagaacctgtagaggagacttagccttccactctgctgtgcatggcatcgaagaccttatgattcagcataattgctcacggcaggggccaacggctccccccccaccaagggggcctgctctgcccggggctggttccggccttccagcaccagacccctgtgactacgaggggcgattcagccgtctgcatggtcgccctcctggcttcctccattgcgcctcttttggcgacccacacgtgcgctcgtttcatcatcacttccacacctgccgagtccagggggcgtggcctttactggataacgactttctgtttgtacaggcaacctcctctcctatggctctgggtgcaaacgccacagctactaggaaactgaccatcatctttaagaatatgcaggagtgcatcgaccagaaggtttatcaggccgaagtggataacttaccagtggccttcgaggacggctcaattaacggaggagatagacccggaggatccagtctgagcatccagactgcaaatcccgggaatcacgttgaaattcaggcagcttacatcggtacgaccatcatcatcaggcagaccgccgggcagctctcttttagcatcaaggtagctgaagatgtcgcgatggcttttagtgctgagcaggacctccaattgtgcgtcggcggctgtcctccaagccagcgcctgtccagatctgaacgcaaccgcaggggagcgatcaccattgatactgccagacgcctgtgtaaagaggggttgccagttgaagacgcatatttccattcatgcgtgtttgacgtcttaatcagtggcgatcccaactttacagtcgcagcccaggccgccctggaagatgccagggcatttcttccggaccttgaaaagctccacttgtttccgtcggatgcaggtgttcctctgtcatctgccaccttactcgcaccgcttctgagtggcttgtttgttttgtggttatgcattcag

SEQ ID NO: 13567 - DNA, 1278 bp, Artificial Sequence
  Description of Artificial Sequence: Synthetic coding sequence
atgggcgagccagggcagtcccctagtccaaggtccagccacggtagcccccctaccttgagtacgctcacattactgctcctgctgtgtggtcacgctcactctcaatgtaagatacttaggtgcaatgccgaatatgtctcctccactcttagcctgaggggtggggggtcatccggagccctgaggggaggtgggggaggaggccgcggcggcggcgtcggatcagggggcttatgccgagctttgcgatcttacgcactctgcacacgccgtaccgcaagaacctgcaggggcgacttggccttccacagcgccgtgcacgggatagaggatctgatgattcagcacaactgtagtagacaggggcccaccgccccaccacctcccagggggcccgctctgccaggcgcgggcagcggactgcccgcgccagacccctgtgactatgagggtcggttctcaaggctgcatgggagaccacctggattccttcactgcgcctcttttggagacccacacgtgagaagcttccatcaccattttcacacatgccgggtgcagggcgcctggcctctgcttgacaacgactttctgtttgtacaggccacttcatcaccaatggccctcggcgcaaatgccacagccaccaggaagttgactatcattttcaaaaatatgcaggagtgcatcgaccagaaggtatatcaagctgaggtcgacaatttgccagtggcattcgaggacggcagcatcaatggaggcgatcgccctggcggatcgagtctgtctattcagacagctaatccggggaaccacgtggagattcaggcagcgtacattggtacaacaatcattattcgtcagacagccggccagctatcctttagcatcaaggttgccgaagacgtagcaatggcattctcagcggaacaagaccttcaactgtgtgttgggggatgtccgcccagccagagattatctcggtctgagagaaataggagaggggcaatcaccattgacactgctagacggctatgcaaagaaggacttccagtggaggatgcttactttcactcttgtgttttcgatgtgctgatcagcggagatccaaacttcacggtcgccgctcaggccgcactagaggatgcacgagcctttttgccagatctcgagaagttgcacctgttccccagcgatgcaggtgtaccactttcttccgctactctgctggcacctttactctctggcctttttgtgctctggttgtgcattcaa

SEQ ID NO: 13568 - DNA, 1278 bp, Artificial Sequence
  Description of Artificial Sequence: Synthetic coding sequence
atgggcgagccaggacagtccccatcgcccagatcatcccatggttcgcctcctacgctctcaactctgactctcctgcttcttctctgtgggcatgcacattcacagtgtaaaatcctgcgctgtaacgctgaatacgtgagctccactctgtcgttgcggggtggagggtcgtcaggtgccctgcggggtggcggtggaggagggcgagggggaggagtcggatccggtggactgtgccgagcgcttcggtcatatgcactttgcacccgtcgaacggcaagaacctgccgcggcgatctcgccttccatagcgcagtgcacggaatcgaagatctgatgatccagcataactgttctcgccaaggccctactgcgccccctccgccacggggccctgcacttccaggtgcaggatccggcctgcctgcgccagacccatgtgattacgagggtaggtttagcagactgcatggtaggccgccagggtttctccattgcgcgtcttttggtgacccacatgtgcgcagctttcaccatcattttcatacctgtagggtccagggagcctggcctcttctggataacgacttccttttcgtccaagcaacctcctccccaatggcgctgggtgctaatgctactgccacccgaaaacttaccatcatcttcaagaatatgcaagaatgcatagaccaaaaggtgtaccaggccgaagtggataatctgccagtcgcttttgaagatgggagcatcaacggaggagatcgtccaggcgggtcgtcgctctcaattcagactgcaaaccctggtaaccatgtggaaatccaagcagcctacattgggaccaccatcattattcgccaaaccgcaggacagctcagcttcagtatcaaagtcgcagaggacgttgcaatggcgttttcggcagaacaagatctgcagctgtgcgtcgggggttgtcctccgtcgcaaagacttagccggtccgaacggaaccgtcgcggtgcaatcactattgatacggcacgtcgcctgtgcaaggaggggctgccagttgaagatgcgtactttcacagctgtgtgtttgatgtcctcattagcggcgaccccaactttactgtggctgcacaagccgccctcgaggatgctagagctttcctgcccgacttggagaaactccatttgtttccgtctgatgcaggagtaccacttagcagcgccaccctgctggcgcctcttctgagcggtctgttcgttctttggctctgcatccaa

SEQ ID NO: 13569 - DNA, 1278 bp, Artificial Sequence
  Description of Artificial Sequence: Synthetic coding sequence
atgggagagcccggacaatcgccgtctccacgctcctcgcacggaagcccgccaaccctctcaaccctgaccctgttgctgctcctgtgcggacacgcacatagccaatgcaagatccttcggtgcaacgcagagtacgtttcgagcactctgtcattgagaggaggaggctcgagcggggccttgcgcggaggtggaggaggcggccgcggcggtggagtgggctcgggagggctctgtcgcgcgctgcgctcatacgccctttgcactcgaaggactgctcggacctgcagaggggatctcgcctttcactctgcagtgcacggaattgaggacctcatgatacagcataactgtagccgccaaggcccgaccgccccacctccgccgcggggcccggcccttccaggagcgggctccgggttgcccgcgcccgatccctgtgactacgaaggacgcttctcccggttgcatggacggccgccgggatttctccattgcgccagcttcggtgacccccacgttagatcgtttcatcaccattttcatacttgccgcgtgcagggagcttggccactcctggataacgacttcctgtttgtgcaggcaacttcctcgcctatggcattgggagcaaatgctaccgctactaggaagctgaccatcatcttcaaaaacatgcaagaatgcattgaccaaaaagtgtaccaggccgaagtggacaatctgcccgtggccttcgaagatggatccattaacggaggtgatagaccaggagggtcgagcttgtccatccagaccgccaaccctggaaaccacgtggagatccaggcggcatatatcggaaccaccattatcatccggcaaaccgcgggacagctcagcttctcaatcaaagtcgctgaggacgtggctatggcattctccgcggagcaggacctgcagctgtgtgtcgggggttgtccccctagccaacggctgagccggtcagagaggaaccgtcggggagccatcactatcgatactgcacgccgcctgtgcaaggaaggactcccggtggaagatgcatactttcattcgtgcgtgttcgatgtgcttatcagcggagatccaaactttactgtggcggcgcaagcggccctggaagatgccagggctttcctgccggatctggagaagctccaccttttcccatcggatgcaggagtgcctctgagctcggcgactctgctcgcgcctctcctgtccggcctgttcgtgctgtggctctgtatccag

SEQ ID NO: 13570 - DNA, 1278 bp, Artificial Sequence
  Description of Artificial Sequence: Synthetic coding sequence
atgggggagcctggccagagtccctccccgaggtcatcacacggctccccacctaccctcagcactctcactctcctgctcctgttgtgcggtcacgctcactctcagtgcaaaatactgcggtgcaacgctgagtatgtgtcgtcaacgctatcactgagagggggcgggtcctcaggagcactgcgcggcggagggggaggagggaggggcggaggcgttggatcgggagggctgtgtcgcgcgctccgtagctacgcgttgtgtacccggcggactgcgcggacctgtaggggcgacttggcctttcacagcgccgtccacgggatagaagatctcatgattcaacataattgctctagacagggacctaccgcacctcccccacccaggggtcctgcactgcccggcgctggctcgggcctgcccgctccagacccatgcgactatgaaggccgcttctccaggctccatgggcggcctcccggatttctgcattgcgcatcatttggcgatccacacgtcagatcgtttcaccatcatttccatacatgtagggttcagggcgcttggcctctgctggataacgattttctgttcgtccaagcaacaagctcacccatggctcttggcgctaacgctactgctacacgtaaactgacaatcatcttcaaaaatatgcaggaatgcatcgatcagaaggtgtaccaggccgaagtggataacctccccgttgctttcgaggatggcagcattaacggtggcgatagacctggcggctcgtctctctcgatccagacagccaatcccggtaatcacgtcgaaatccaggcagcttacattggaactaccattattatacggcagaccgccgggcagttaagcttctcaatcaaggtggcagaagacgtagcaatggcgttctcagccgagcaggacctgcaactctgcgtgggtggttgccccccgtcacaacggctctctaggtctgaacggaatcggcgaggcgcaattaccatagataccgctcggcgactatgtaaggagggactgcctgtcgaggatgcatattttcacagctgcgtgttcgatgtcctcatctcaggcgacccaaattttacggtggccgcccaagcggcccttgaggacgcaagggctttcctccctgatctcgagaaactacaccttttcccatccgatgcaggagtgccccttagttcagctactttgctcgcaccacttctgagtgggttgtttgtgttgtggctatgcatacaa

SEQ ID NO: 13571 - DNA, 1278 bp, Artificial Sequence
  Description of Artificial Sequence: Synthetic coding sequence
atgggagagcctgggcaaagccccagcccacgcagctcccacgggtcacctcccacactgtccacgctgactcttcttttgttactgtgcggacacgcccattcacagtgtaagattctcagatgcaatgccgagtatgtcagctccaccctgagcctacgaggtggtggctctagcggagccttgagagggggggggggaggtgggcggggagggggggtcgggtctggtggactgtgtagagctttgcggtcgtacgcgctgtgcacccggagaactgctcgaacctgtcgcggcgacctggcgtttcacagcgccgttcacggcatcgaagatcttatgatacagcacaattgctccagacagggacccactgctccacctcccccacgcggaccagcactgcccggggcgggctctgggctgccagcaccagacccttgcgactacgagggtagattttcccggctccacggccgccctcctggatttcttcactgtgccagctttggcgaccctcatgtacggagctttcatcatcactttcacacatgccgggtccaaggggcctggccgctgctcgacaacgatttcctatttgtgcaggccacttcctccccgatggcattgggagccaatgccactgccactagaaagctgaccatcatttttaagaatatgcaggagtgcatcgatcagaaggtataccaagcagaggtcgacaatctgcccgtggcctttgaggatggaagtatcaacggcggcgatcgccctggggggtcaagtctttcaatccaaacggctaaccctggcaatcacgtggaaatccaagccgcttatatagggacaaccatcattattagacagacagctggccaattaagctttagcatcaaagtggctgaggatgtggcaatggccttttcggctgagcaggacttacagttgtgcgttggaggttgccccccaagtcaacgcctttcacgaagtgagcgcaatcgaaggggcgctattaccatcgatactgcacgcaggctgtgcaaggagggccttccggtggaagacgcctacttccatagttgtgtctttgacgtgctgatcagcggtgatccaaatttcacagtggccgcccaggcggccttggaagacgcgcgtgcgttcctccccgatctggagaaattgcatttattcccgtccgacgccggagttcccctcagcagtgcaactcttctagcgccgctgctgagtggtctctttgtactctggctgtgtattcaa

SEQ ID NO: 13572 - DNA, 1278 bp, Artificial Sequence
  Description of Artificial Sequence: Synthetic coding sequence
atgggggagccgggacagagcccgagtcctcgatcgagtcacggtagtcctcctaccctaagcaccttgacattgctgttgttgttatgtggccacgcccattcacaatgcaagatccttcgctgcaatgcggagtatgtctcttccaccttatccctgaggggaggtggctctagcggagcgctgcgagggggcggcggtggtgggcgggggggcggtgttggcagtggaggtctctgccgggctctccgatcctatgctctgtgcacgcgtcgtacagccaggacctgccgaggcgacctggctttccatagcgctgttcacggtatcgaggatttaatgatccaacacaattgtagtcgccaagggccgaccgctcctcccccaccccgcggacccgctcttcctggagcgggcagcggtctccctgctcctgacccttgcgactacgaaggccgcttctcacgactgcatggccgccccccgggctttttgcattgtgcgtccttcggcgatccccatgtgcggtcattccatcatcacttccacacctgcagagttcaaggagcctggcccctgctggacaacgatttcctgttcgttcaagcaacatccagtcccatggcattgggagctaatgctacggcgacccggaagctcacgatcatcttcaaaaatatgcaggaatgcattgatcaaaaggtttatcaagctgaggttgataacttgccagtggccttcgaggacggttctattaacggcggagacaggccgggcggtagctccctttctatccagactgcaaatccgggcaaccacgtggagattcaggccgcgtacatcggaaccacgattattatccgacagaccgccggacaactttccttctctatcaaagttgcggaggacgtcgcaatggcattctctgccgaacaggacctgcagctctgcgtgggcggttgtccaccctcacagcgtctctctagaagcgaaagaaaccgcaggggagctatcacaattgacacggcgagacgtctgtgcaaggaagggctacctgttgaggacgcctacttccactcttgcgtcttcgacgtgctaatctctggtgaccctaatttcaccgtcgctgcgcaggcggctcttgaggatgcgagagcattcttgcccgacctcgaaaaactgcacttgttccctagcgacgctggcgttcctctgtcctcggcgacgttgcttgcaccccttctatccggcctattcgtcctttggctctgtattcag

SEQ ID NO: 13573 - DNA, 1278 bp, Artificial Sequence
  Description of Artificial Sequence: Synthetic coding sequence
atgggagagccgggccagagcccctcgcctcgctcaagccatggaagtccgccaaccctgtccaccctgactcttctgcttctgctgtgcggacatgcacattctcagtgcaaaatcctccgctgcaacgctgagtacgtctcttcgaccttgtccctgcggggcggaggatcttccggagcactccgtggaggcggtggcggcggacggggaggaggagtcggatcaggaggtctgtgccgcgctttgcggtcgtacgcgctgtgcactcggcggaccgccagaacctgtcggggggaccttgcgtttcattccgccgttcacggcatcgaagatctcatgatccagcacaactgctcacggcagggtccaactgcgccaccaccgccgcggggaccagccttgccaggagcagggtcaggcttgcctgcgccagacccgtgtgattacgagggacgcttctcacggctccacggcagaccgcccggctttctgcattgcgcgagcttcggtgacccccacgtgcggagcttccatcatcacttccacacttgtcgcgtccaaggtgcatggccgctgctggataacgacttcctgttcgtgcaggccacttcgtcgccgatggcgctcggagcgaacgccactgccactcggaagctcacgatcatcttcaagaatatgcaagagtgtatcgatcagaaagtctatcaagccgaagtggacaatctgccggtcgcattcgaggatggcagcattaacggaggcgaccggccaggaggatcatcgctgagcatccagactgccaacccgggaaaccacgtggagatccaggctgcatacatcgggaccactatcatcatccgccagactgcgggacagttgtccttcagcatcaaagtggctgaggacgtggcaatggcattctcagcggagcaagacctgcagctgtgcgtgggaggttgccctccatcccagagactgtcgcgatccgaacgcaacaggaggggagcgatcaccattgatacggcgagacgcctgtgtaaagaagggctgccggtcgaggacgcgtacttccactcctgcgtgtttgacgtgctgatctctggcgacccgaatttcacggtcgctgcacaagccgcccttgaagatgcaagggcgtttctgccggacttggaaaaactgcacttgttccctagcgacgctggagtgccgctgtccagcgccactctgctggccccgctgctctccggcctcttcgtcttgtggctgtgtattcag

SEQ ID NO: 13574 - DNA, 1278 bp, Artificial Sequence
  Description of Artificial Sequence: Synthetic coding sequence
atgggagagcctggtcagtccccctccccgcgctcgtctcacgggtctccgcccacccttagtacgttaacgctgctgctacttttgtgcggccacgctcactctcagtgcaagatccttcgttgcaatgccgagtacgtgtcctcgactttgtctttgcggggcggtgggagctcgggagccctgcggggtggaggcgggggcggccgcggtggcggtgtcggcagcggcggcctgtgtcgtgctctgcgttcgtacgccctatgcacccgtaggaccgcaagaacctgtcgtggcgacctggccttccactctgctgtgcatggtatagaggatctgatgattcagcacaactgctctaggcagggcccgaccgctccccctcctcctcgtgggccagcgcttcccggcgctggttccggcctccctgctccagatccatgtgactatgagggccgcttcagccgtctccatgggcgacctcccggttttctgcattgcgccagcttcggtgatccccacgtccgctcattccaccaccatttccacacctgccgcgtgcagggtgcatggccattgttggacaacgacttcctgttcgtccaagcgactagcagccccatggccctcggcgcaaacgccaccgcaacgcgtaagttgaccataattttcaagaacatgcaagagtgcatcgaccaaaaggtctaccaggccgaggtggacaacttaccagttgccttcgaggacgggtccattaacggtggagatcgtcccggtggttcctctctgtccatccagaccgcgaacccgggcaaccacgtcgagatccaggcagcgtacattggtactaccatcatcattcgccagaccgccggtcagcttagtttttccattaaggtggctgaggatgtcgccatggccttcagcgctgaacaggacctccagctttgcgttggtggctgcccgccaagtcagcgcctgagtcggtctgagaggaaccgccgcggcgcgattactatcgatactgctcggcggctgtgtaaggagggactgcccgtcgaggacgcctatttccactcttgcgttttcgatgtgctgatctccggagacccgaacttcaccgtcgctgcgcaagctgccctggaagacgcgcgcgcattcctgcctgatctcgagaagctccatttgtttccatcggacgcaggtgtccccttgtcctctgccactcttctagctccccttctgagcggcctgtttgttctgtggctgtgcatccag

SEQ ID NO: 13575 - DNA, 1278 bp, Artificial Sequence
  Description of Artificial Sequence: Synthetic coding sequence
atgggggaacccggacagtccccgagccctcggagctcccacggatcaccgccgacgctgagcaccctcaccctgctgttgctgctgtgtggccatgcgcactcacagtgtaagatcctgcgctgcaacgcggaatacgtgtcctcaaccctgtcgctgcgcggcggtggctcgtcaggcgcacttcgaggaggcggtggtggaggacgcggtggcggagtggggtctggcggtctgtgccgggcacttcgctcgtacgcgctgtgcactcggcggactgcgaggacctgccgcggggatctcgcgtttcactccgccgtgcatggtattgaggacctcatgatccagcataattgcagcagacagggacctaccgcccctccaccgcccaggggaccggccctgccgggagcggggtccgggttgcctgctccggacccatgcgattatgagggccgcttttcacgcctgcacgggcggccaccgggattcctccactgcgcatcgttcggtgaccctcatgtgcgctcatttcaccaccacttccacacctgccgggtgcagggagcatggccgctcctggacaacgatttcctgtttgtgcaggcgacctcgagcccgatggcactgggggccaacgcgactgctactagaaagctcaccatcatcttcaagaacatgcaggaatgcatcgaccaaaaggtgtaccaagccgaggtcgataatctgccggtcgctttcgaagatggatctattaacggtggcgatcggcccggaggttcgagcctgtcgatccagactgccaatccaggaaaccacgtcgagatccaagcagcctacattgggaccaccatcatcatccgccagactgccgggcaactctcattctcgatcaaggtcgctgaagatgtggctatggcgttcagcgcagaacaagatctgcagctctgtgtgggaggatgccccccgtcacaaaggctgtcaaggtccgagcgcaataggcggggggccatcaccatagacacggcaaggcggctctgcaaagagggactccccgtggaagatgcatactttcactcctgcgtgttcgacgttctcatcagcggggaccctaactttactgtggcggcgcaagcggcactggaggacgcccgcgcattcctgccagacttggaaaaactccatttgttcccatctgacgcaggagtgccactctcgtcggcgaccctgctcgcgccgctgctgtccggacttttcgtgctctggctttgtattcag

SEQ ID NO: 13576 - DNA, 1278 bp, Artificial Sequence
  Description of Artificial Sequence: Synthetic coding sequence
atgggggagcctgggcaaagcccatcgcctagatcatctcatggttccccaccaactctttccactctcacccttcttttgcttttgtgcggtcatgctcattcacaatgtaaaatcttaaggtgcaatgcagagtatgtttctagcacgttgagtttacgaggaggcgggtcaagtggagctttgagggggggaggaggtggaggaagaggtggtggcgttggaagtggcggcctttgtagagcccttagatcttacgcactttgtacacggaggacggcccgtacttgtcgaggagaccttgcatttcactcagcggttcatggaatcgaagatcttatgattcagcataattgttcccgccaaggcccgacagctccaccgcctcctagagggcccgctttgccaggagcagggtccggcctcccagcaccagacccatgtgattacgaaggtcgtttttctcgcctccatgggcggccgccaggtttcctacattgtgcttccttcggggatccacacgttcgctccttccaccatcacttccatacctgcagggttcagggtgcatggccgttattagacaacgacttcctgttcgtgcaggctacatcctctcctatggctctcggtgctaacgctactgctactcgaaagttgaccatcatctttaagaatatgcaggagtgcattgatcagaaagtgtaccaggctgaggtggacaatttgcctgttgcctttgaagatggttcaattaacggaggtgataggccaggcggttcgtctctgtctattcaaacagcgaatccgggaaaccatgtggagattcaggctgcctacatcggtacaaccataataattagacagaccgctggtcagcttagcttttcaatcaaagttgctgaagatgtggccatggctttttctgcagagcaggacctccaactgtgcgtgggtggatgcccaccctcccaaagattatcccgatcagagcggaatcgaaggggtgctataactattgataccgctaggagactctgtaaggagggacttccagttgaagatgcttatttccattcatgtgtgtttgacgtgttgatctcaggtgacccaaactttaccgtggcggcacaagcagcactagaagatgcacgtgcttttcttccagatttggagaagcttcatttgttcccttctgatgctggcgttccgttatcctcagcaactctcctggccccactgcttagcgggctgttcgtgttgtggctttgtatacaa

SEQ ID NO: 13577 - DNA, 1278 bp, Artificial Sequence
  Description of Artificial Sequence: Synthetic coding sequence
atgggagaaccaggacaaagtcctagtccaagatcttcacatggttcgccaccaactttgagtactcttacacttttacttttattatgtggtcatgctcattctcaatgtaaaattttaagatgtaatgctgaatatgtttcttcaacattatcattacgaggaggtggatcatctggtgctctaagaggaggtggaggaggaggaagaggaggaggagttggatcaggtggtttgtgtagagctttaagatcatatgcattatgtactagaagaacagcaagaacctgtcgtggagatttagcatttcatagtgcagttcacggaattgaagatttaatgattcagcataattgctctagacaaggaccaactgctccacctccaccaagaggtccagcacttccaggtgcaggaagtggtttaccagctccagatccatgcgattatgaaggaagattctcaagattacatggaagaccaccaggatttctacattgtgcttcttttggtgatccacatgttaggtcatttcatcaccattttcatacttgtagagtacaaggtgcatggccattacttgataatgattttttattcgttcaagctacatcatcacctatggctcttggagctaatgctactgctactagaaaacttacaattatatttaagaacatgcaagaatgtattgatcaaaaagtgtatcaagctgaagttgataatcttccagttgcttttgaagatggttctattaatggaggagatcgtccaggtggatcatcattgagtattcaaactgcaaatccaggaaatcacgttgaaattcaagcagcctatattggaacaacaataataattagacaaacagctggacaactttcattttctattaaagttgctgaagacgttgcaatggcattttccgctgaacaagatttacaattatgtgttggaggatgtccaccttctcaaagattatctagaagtgaaagaaatagaagaggagctattactattgatacagcacgaagactatgtaaagaaggattacctgtagaggatgcatatttccatagttgtgtatttgatgtgttaattagtggggacccaaattttactgtagctgctcaagcagctttagaagatgctagagcatttttaccagatcttgaaaaacttcatctttttccttcagacgcaggtgtaccattaagttcagccactttacttgctccattattatctggtctatttgtactttggttatgtattcaa

SEQ ID NO: 13578 - DNA, 1278 bp, Artificial Sequence
  Description of Artificial Sequence: Synthetic coding sequence
atgggagagccagggcagtccccatctcctcgctcttcacacggaagccctcctacactatctactcttaccctgttacttctcctttgcggccatgcgcatagtcagtgtaaaattctgagatgcaatgccgaatacgtatcgtccactctcagcctccgcgggggcgggtcctccggcgccctgcggggagggggcggcgggggaagaggggggggcgtgggaagtggcggcctgtgtcgggccctgcgcagctacgcactctgcacgcgacggaccgcccgcacatgcaggggcgatcttgcttttcatagtgccgtgcatggcattgaggacttgatgatccagcacaactgctcaagacagggtccaacagccccgccccctcctaggggccccgcattgccgggagcagggagcggcctccccgcccccgatccctgcgactacgaaggtaggttttcccggctccatgggagaccaccaggctttctgcattgtgcatcattcggggatccccacgtaaggtcctttcaccatcacttccacacctgtagggttcagggggcatggcccctactggacaatgactttttgtttgtccaggcaacctcctcccctatggctctcggcgcaaacgctacagccaccaggaagcttacaattatatttaaaaatatgcaggagtgcattgatcagaaagtctaccaggcagaggtagacaatttgcccgtggccttcgaggacggctccatcaatgggggggatcgacccggcggatcgagcttatccatccagaccgctaatccaggcaaccatgtggagatccaggccgcctatatcgggacaacaattattatacggcagacagctggccaactttcttttagcattaaggtggctgaggacgtagcgatggccttctctgccgagcaagacctccagctgtgcgtgggaggatgtccaccttctcagcgcctgagccgatccgagcgcaatagaaggggagcaatcaccattgatacggctagacgcttgtgtaaggaggggctcccagtggaagacgcctacttccattcgtgtgttttcgacgtgctgatttcaggggatccgaatttcaccgtggccgcacaggccgcgctcgaggatgccagagctttcctgcccgatttggagaagttgcatctattcccaagtgacgcgggcgtgcccctgagcagtgctacattgctggcacccctgctgagcgggctatttgtgctgtggctgtgcattcag

SEQ ID NO: 13579 - DNA, 1278 bp, Artificial Sequence
  Description of Artificial Sequence: Synthetic coding sequence
atgggggaacctgggcaaagtccctccccaagatcatctcacggcagcccccctactttatccacactgactctgctgctgctcctgtgcggccatgcacacagccagtgcaaaatactacgctgtaacgccgagtacgttagctcaactctgtctctacgggggggtgggtcctctggcgctctacgggggggcggagggggcggacgcggcggaggggtggggtccggcgggctctgtcgtgcactgcggtcttatgcactttgcaccaggaggaccgctagaacatgccggggcgacttggctttccacagcgctgttcacggcattgaggatctaatgatccagcataattgcagtaggcagggaccaaccgctccaccaccaccacggggccctgccctaccaggcgccggctctggcctgcctgcccctgacccatgcgactacgagggcagattctctcgcctgcatggcaggccccctggcttcctccattgtgcctcattcggcgatccccacgtgcgcagttttcaccatcacttccatacttgccgtgtgcagggcgcctggcccctgcttgacaatgacttcctgttcgtgcaggccaccagtagccctatggcactgggggctaatgccaccgccactcgcaagttaactatcatcttcaaaaatatgcaggagtgcatagaccaaaaggtgtaccaagctgaggtggacaacttgcctgttgccttcgaagatgggtccattaacggcggcgacaggccaggtggaagctccctgtctattcagactgcaaacccaggaaaccacgtcgagatacaggctgcttacataggtaccacaataatcattcggcagactgctggccagctttcttttagcataaaagtggccgaggacgtggccatggctttttcagccgagcaggacctgcagttatgcgtcggaggttgccccccttcccagaggttatcccgatcagaacggaaccgtcgcggcgcaatcactattgacacagcccggcgactgtgtaaggagggcctgcccgtcgaggacgcctattttcactcctgcgtgtttgatgtcttaatcagcggtgatcctaactttaccgtcgccgcccaggccgccctagaagacgctagggccttcctccccgatctggagaaactccacctgttcccatctgacgccggagttcctctgagtagcgctacactactggctccactgctgtctggcctgtttgttctatggttatgtattcag

SEQ ID NO: 13580 - DNA, 1278 bp, Artificial Sequence
  Description of Artificial Sequence: Synthetic coding sequence
atgggagagcctggccagtccccctctccacgaagctcacacggatctcccccaactctatctacacttactctgctgttgttgctatgcgggcacgctcactcccagtgcaagatactgaggtgtaacgccgagtacgtcagctctaccttgtcccttagaggcggcggctctagcggcgcattaagaggtggtggtggtggaggtcgcgggggcggtgtcggaagcgggggactgtgccgcgctttgcggagctacgccctatgcacaaggcgtaccgcgcgaacttgccggggcgacctggccttccacagcgccgtgcacggtatcgaggaccttatgattcaacacaactgcagccggcagggacctaccgctccgcctccccctagaggtcctgcccttcccggcgccggaagcggcctgcccgctcccgacccctgcgactatgagggaaggttctctaggctgcatggacgccccccaggatttctgcactgcgcgtcgtttggcgaccctcatgtccgtagctttcatcatcactttcacacctgcagagtccagggcgcctggcctttgctggacaacgacttcctcttcgtgcaggccaccagttcccctatggctcttggtgctaatgctaccgccacacggaaactcacaatcattttcaaaaatatgcaggagtgcatcgatcagaaagtttatcaggctgaagttgataatctgccagtggccttcgaagacggctcaattaacgggggggatagacccggcgggtcgagcctgtcgatccagacggccaacccaggcaatcacgtggaaattcaagctgcgtatatcgggacgaccataatcattagacagaccgctgggcagctaagcttttccatcaaagttgcagaggacgtcgcgatggcattttcagctgaacaagacttgcagctgtgtgtaggagggtgccctccttcccaaaggctgtcaaggtccgagcgcaaccgccgcggagccattactattgacactgccaggcgcctctgcaaggaaggactgccggtggaggacgcttatttccattcctgcgtgtttgatgtgttgatatccggtgaccccaacttcactgtggcagctcaggcagccttggaggatgctagagcgttcctgcctgacctggagaagctgcaccttttcccgtctgatgcgggcgtgccattgagctcagccacactgctggcgccgctgctcagcggattgttcgttctatggctctgtatccaa

SEQ ID NO: 13581 - DNA, 1278 bp, Artificial Sequence
  Description of Artificial Sequence: Synthetic coding sequence
atgggggagccaggacaatccccatcgccccgctcttctcatggatcaccgcctactctgtccaccctgactctgctgctgttgctgtgcggtcacgcacactcccagtgcaaaattcttcggtgcaatgccgaatacgtgagctcgactctttcgctgcggggcggcggatcaagcggagcactccgcggtggaggagggggaggaagagggggaggagtgggttcaggaggcctgtgccgggcacttcgcagctatgccctctgcaccagacgcactgcgcggacctgccgcggcgacttggcattccattcggcggtgcacggaatcgaagatctgatgattcagcataactgctcacgccaggggccaactgctccgcctccccctcgcgggccggcactcccgggcgccggatccgggctgccggctcctgacccgtgtgattacgaaggacgcttctcccgcctgcatggacggccgccaggattccttcactgcgcatcgttcggtgacccacacgtgcggtcgttccaccatcacttccatacttgtagagtgcagggtgcctggcctcttctggataacgacttcctctttgttcaagctacttcctcccctatggcgctcggagctaatgcaactgccactagaaagctgactatcattttcaagaacatgcaggagtgcatcgatcaaaaggtgtaccaggccgaggtcgacaacctgccagttgccttcgaggacggatccattaacggcggtgaccgcccaggaggatcttcgctgagcatccaaacggcgaatcctggcaatcatgtcgaaatccaggccgcctacatcgggacgaccatcatcatcaggcaaaccgccgggcagctgtcattcagcattaaggtggccgaagatgtggctatggccttctcggccgagcaggatctgcagctctgcgtggggggatgcccacccagccaacggctgtcgcggagcgagcggaaccgccggggagccatcactatcgacacggcccggcgtctctgcaaggagggcctcccggtcgaggacgcctacttccactcctgtgtgtttgatgtgctgatctctggcgaccctaactttaccgtcgctgcccaggcagcgcttgaagatgcccgagcttttttgccggatttggaaaaactgcacttgttccctagcgacgccggcgtgccgctctcgtccgcgacccttttggctccgttgttgtctggactctttgtcctttggctctgtatccaa

SEQ ID NO: 13582 - DNA, 1278 bp, Artificial Sequence
  Description of Artificial Sequence: Synthetic coding sequence
atgggcgagccgggccagtcgccgagccctcgctcgagccacggcagcccaccaactctcagcaccctgactcttctgctcctcttgtgtggccacgctcattcccaatgcaaaatccttcggtgcaacgctgagtacgtgtcgagcaccctgtccctcagaggcggcggttcttcgggtgccctccgcgggggaggaggcggcggccgcgggggtggggtcggctccggaggcctgtgccgggcgctgcggtcatacgcgctgtgcacccgcaggaccgcccgaacgtgtcggggcgacctggccttccactcagccgtgcacggaatcgaagatctcatgatccagcataattgcagccggcaaggacctaccgcacctccgcccccacggggacccgcactcccgggcgccgggtcgggactcccagcccctgatccgtgcgattacgagggacggttctctcgcctgcacggacggccgccaggatttctgcactgcgcctcattcggcgacccccatgtcaggagctttcaccaccacttccatacttgccgggttcagggtgcctggccgctgctggataacgactttctgttcgtccaggcgacgtcgtcgccgatggcactcggagccaatgcaaccgcaactcgcaagctcactatcatctttaagaatatgcaggaatgcatcgaccaaaaagtgtaccaggcggaggtggacaacctgccagtggcattcgaagatggatctatcaacggcggcgacaggccgggtggaagctcactctccatccaaacggcaaacccgggaaaccatgttgaaatccaggccgcatacatcggaaccaccatcatcatcagacagaccgctggtcaactgtccttttcaatcaaggtcgctgaagatgtggccatggctttttccgcggaacaagacctgcagctctgcgtgggagggtgccccccgagccagcgcctcagccggtctgagagaaaccggcggggggcaattactatagataccgcccggaggctgtgcaaggaaggactgcctgtcgaggacgcgtacttccactcatgcgttttcgatgtactcatcagcggagatccgaatttcaccgtggcggctcaagcggcgctcgaggatgccagagcctttttgccagacctggaaaagctgcacctgttcccatcggatgccggagtgccgctttccagcgcgactctcctggccccgctgttgagcggactcttcgtgctgtggttgtgcatacaa

SEQ ID NO: 13583 - DNA, 1278 bp, Artificial Sequence
  Description of Artificial Sequence: Synthetic coding sequence
atgggagaacccgggcaaagcccctcgcctagatcatcccatggctcccctccaactttgtccactctgactcttctcctccttttgtgtgggcacgcccattcacaatgtaagatcctccgctgtaacgcagaatacgtgagcagcaccctgtcactgcgaggagggggatcaagcggtgctcttaggggaggcgggggaggtggtcgcggaggaggagtcggatctgggggactctgcagagcacttcggtcgtatgctctgtgcactcgtcggactgcgcgcacgtgtagaggggatctcgcattccattcggcagtccatggtattgaggatctgatgattcaacacaactgctcgcgccagggaccaactgcacccccgcctcctagagggcccgcactccctggagccggtagcggcctgccagcaccagatccttgtgattacgaaggacgattttcaagacttcacggccggccacctggtttccttcattgcgcttcttttggagatccccacgtgcgatcatttcatcatcacttccacacgtgtcgtgtccagggcgcatggcccctgcttgacaatgacttcctctttgtccaagcaactagcagccccatggcactcggggcaaacgctactgcaacgcgtaagctgaccatcattttcaaaaacatgcaggagtgtattgatcagaaagtctaccaggccgaagtggataatctccccgtggcatttgaagatggctcaatcaatgggggcgaccgccccggtggttcgtccctcagcattcaaactgccaaccctggtaaccatgtcgagattcaggcagcctacattggcaccactatcattatcaggcagactgcaggacaactgtcgttttcgataaaggtggcggaagatgtggcaatggcgtttagcgccgaacaagatctgcagctgtgcgtcggagggtgccctccctcgcagaggctctcgcgatcagagcggaataggaggggcgcaattacgattgataccgcaaggagattgtgtaaagaaggccttccagtggaagatgcttactttcattcatgcgtgtttgatgttctgataagcggtgaccccaactttacggtggcagcacaagcagcactggaagatgcccgggcgtttcttccggatcttgaaaaactccacctctttcctagcgatgccggggtgcctttgtcgtccgcaacccttcttgcacctctccttagcggactcttcgtgctttggctttgtatccaa

SEQ ID NO: 13584 - DNA, 1278 bp, Artificial Sequence
  Description of Artificial Sequence: Synthetic coding sequence
atgggtgagccggggcagtcgccttcgcctcgttcctcccacggttccccgccaactctgtcgacccttactttgcttctcctgctgtgcggacacgcgcattcgcagtgtaagattctccgatgtaacgcagagtacgtgtcgtccactctgtcgctccgcggaggtgggtcatccggcgcactgcgtggtggtgggggaggcggacgcggaggaggagtgggatccggaggtctgtgtagggcattgcggtcctacgcactgtgtacccgccggaccgccagaacctgtaggggcgatctggcattccattcggctgtgcatgggatagaggatcttatgatacaacataattgtagccgtcaaggtcccactgctccccctcctcctagaggccctgcacttcctggagcagggtcagggctgccagcacctgatccgtgtgattacgaaggaaggttcagccgactgcatgggcgcccgcccgggtttcttcattgtgcgagctttggagatccacatgtcaggagctttcatcaccacttccatacttgcagggtccaaggggcgtggccactcctcgataatgactttctgttcgtccaggcaacgtcatcacctatggcacttggcgcaaatgcaactgcaaccagaaagttgactattatcttcaagaacatgcaagagtgtatagatcagaaggtgtatcaggccgaagtggataacctgcccgtcgccttcgaagatggatccattaatggtggggacagacctggcggatcatcgttgtccattcagactgcaaatcctggaaaccatgttgaaatccaagcggcatacattggcactactattatcatccggcaaacggccggccaacttagcttctccataaaggtggcagaagatgtcgctatggctttctcggccgaacaggatcttcaactctgcgtcggaggatgtccaccatcgcaacggcttagcaggagcgagcggaaccggagaggtgcaattaccattgacacggccagacgactctgcaaggaaggtctgccagtggaggacgcatacttccattcctgcgtgttcgacgtgctgatctcaggagatcccaactttaccgtcgcagcacaagcagctctggaagatgcaagagcgttccttccggatttggaaaaactccatctgtttccttcggatgcaggtgtacccctttcctcagcaactcttttggcaccattgctcagcggcctgtttgtgctgtggctgtgcattcag

SEQ ID NO: 13585 - DNA, 1278 bp, Artificial Sequence
  Description of Artificial Sequence: Synthetic coding sequence
atgggcgagccgggccagagcccaagtccaaggagcagtcacggtagtcccccgacactgtcgacattgacactcctgctcctgctgtgcggccacgcgcactcccagtgcaaaattctccggtgtaacgctgagtatgtgtcgagcacactttcgttgcggggcggtggaagttccggcgccttgcgtggcgggggcgggggcggccgaggaggcggtgtgggctccggtggactgtgccgtgccctgcgaagttatgctctgtgcaccagaagaacggctaggacctgccgcggagacctcgctttccatagcgcagtgcacggcattgaagatctaatgattcagcataattgtagtaggcagggcccgactgccccaccgccccctcgcggaccggcgcttccgggtgccggatcgggtctgccagctccagatccgtgcgattacgagggtcgctttagtcggctgcatggccgtccccccggattcctgcattgtgccagcttcggagatccacacgtccgcagttttcatcatcactttcacacgtgcagagtgcagggtgcctggccgcttctggataatgacttcctgtttgtgcaggccacgtctagcccaatggccctgggagctaacgccaccgccacacgtaaactcactatcattttcaagaatatgcaggaatgcatcgatcaaaaggtgtaccaagctgaggtagacaacctcccggtggcctttgaggatgggagcatcaatgggggagaccgcccgggcggaagcagtctgtcaattcagaccgcgaacccagggaatcacgtagagatacaggcagcgtatattggaacgactataattatccgccagaccgcgggccaactctctttctcgatcaaggtcgcggaggacgtggccatggccttttcagccgagcaggatctgcagctgtgtgttggtggctgccccccatcacagcgtctgagccggagtgagcgcaacagacgtggtgctatcaccatcgacaccgcccgccgtctttgtaaggagggtcttcccgttgaggacgcctacttccactcctgcgtcttcgatgtactcatctcgggcgatcccaactttacggtggccgcgcaggcggctttggaagatgctcgcgccttcctgccagacttggaaaaattgcacctgttcccaagtgacgcaggggtgccacttagtagtgccactctactggctccccttctttccgggctctttgttctttggctgtgcatccaa

SEQ ID NO: 13586 - DNA, 1278 bp, Artificial Sequence
  Description of Artificial Sequence: Synthetic coding sequence
atgggagagcctggacaatcaccgtcaccccgctcatctcatggatccccgccgacccttagcaccctgacccttctcctcctcctgtgcggacacgcgcattcgcagtgcaagatcctgaggtgcaacgccgaatacgtgtcgtcgaccctcagcctgcgcgggggaggatcttcaggagcactgcgcggaggaggaggtggaggtcgcgggggcggagtgggctccggtggtctgtgtagagccctcaggtcgtacgcgctgtgcactcgcagaaccgctagaacttgcagaggggacctggccttccactcggctgttcacggaatcgaggacctgatgatccagcacaattgttcgcgccaaggcccaaccgccccgccgccgccacgcggtccggctctgccgggggccggatcgggcctgcccgccccggatccgtgcgactacgaaggccgcttctcgcgcctccatggccgcccgcctggcttcctgcactgcgcctcgttcggtgaccctcatgtgcgctccttccatcaccacttccacacctgcagggtccagggagcatggccgctgttggataacgattttctcttcgtgcaggccaccagctcccccatggcgcttggagcaaatgccaccgccaccagaaagctgactatcatcttcaaaaacatgcaagaatgcattgaccaaaaggtctaccaagcggaagtggataacctcccggtggccttcgaggacggttccatcaatggcggggatagaccgggagggagcagcctgtcaatccaaacggcgaatccgggaaaccatgtggaaatccaggcagcctacatcggaactaccatcatcatccgccagacggctgggcaactctcgttctccatcaaagtcgcagaagatgtggccatggccttctcggcagaacaagacctgcagctgtgtgtagggggctgcccgccgtcccaacggctcagccggagcgaacggaaccgcagaggggcaatcactattgatactgccagaaggctttgtaaggaaggcctgcccgtggaagatgcgtactttcattcgtgcgtctttgacgttctgatctcaggggacccaaatttcaccgtggccgctcaggcggcactcgaggacgcgagagccttcctcccagatcttgagaagctgcacctcttcccgtccgatgccggagttcctctgagctccgctactcttcttgcgccgcttctctccggactgttcgtcctgtggttgtgtattcaa

SEQ ID NO: 13587 - DNA, 1278 bp, Artificial Sequence
  Description of Artificial Sequence: Synthetic coding sequence
atgggcgagcccggccagtcaccgtccccaaggtcctcccatggatccccgcccaccctgtcaacccttaccctcctgctcctgctgtgcgggcatgctcatagccagtgcaaaatcctgagatgcaacgcggaatacgtgtcctcgactctctccctccggggaggcggaagctcaggagcgctgcggggtgggggaggtggcggccgcggaggtggggtcgggtctggcggcctgtgcagagcgctgcgctcctacgcgctgtgcactcgccggaccgcccgcacttgccgcggagatctggcatttcactcagccgtccacgggatcgaagatctcatgatccaacacaactgctcgagacagggccctaccgccccgcctccaccacgcggacctgcactgccgggagcaggatcaggcctcccggccccggacccgtgtgattacgaaggacggttcagccgccttcatggtaggccgccgggcttcttgcactgcgctagctttggggatccgcacgtcaggtcgttccatcaccacttccatacctgccgggtgcaaggagcttggcccctgctggataacgacttcctctttgtgcaggcaacctcctcccctatggcccttggagccaacgccactgcgactaggaaactgaccatcatcttcaaaaacatgcaggaatgcatcgaccagaaggtgtatcaggctgaagtggataatctcccggtcgcgttcgaggacggatctatcaacggcggcgatcggccgggaggcagctctttgtcgatccaaactgccaaccccggaaaccacgtggaaatccaggctgcgtacatcggaactaccatcatcatcagacaaactgccggccaactctccttcagcatcaaggtggccgaggacgtggctatggcattctcggccgagcaagatctgcagctctgcgtgggaggatgcccaccgtcacagagactgtcgcgctcggaacggaaccgccggggagcaatcaccatcgatactgcaagaaggctctgcaaagaaggcctgccagtcgaggacgcgtacttccactcctgcgtgttcgatgtgctcatatcgggggacccgaacttcactgtggcggcgcaggcggccctggaggacgctagggcgttcttgccagatcttgaaaagctgcatttgttcccaagcgacgccggggtgccgctgtcgtcagctacccttctggcccccctgctgtccggcctcttcgtgctctggctttgtatccag

SEQ ID NO: 13588 - DNA, 1278 bp, Artificial Sequence
  Description of Artificial Sequence: Synthetic coding sequence
atgggagagccaggccagagcccctcacccaggagctctcacggatctcctcctacgctctccacactcaccctgctgttgctgctgtgtggccatgcacacagtcaatgcaaaattttacgctgcaacgctgaatatgtgtcgagtaccctgagcctcaggggggggggatcctccggggccctgcgaggaggcggcggcggaggaagaggcggaggcgttgggtccggaggtctgtgccgagcactgcggagctatgcgctttgtactcgaagaaccgcaagaacctgtcggggggacctagcctttcattccgccgttcacggcattgaggatctaatgatccagcacaactgcagccgtcaggggccaacagccccaccccctccaaggggaccagcgcttcctggcgctgggtcgggcctgccggccccagacccatgcgactatgaagggaggttctctagactgcacggtaggccccccggtttcctacactgcgcgtcattcggcgatccacacgtcagaagtttccatcatcacttccatacctgccgagtccagggagcatggccactgttggataatgacttcctgtttgtccaggccacatccagccccatggctctgggagcaaacgccaccgccaccagaaaactgaccatcatcttcaagaatatgcaggaatgcatcgaccaaaaggtataccaggccgaggtggacaacctccctgtcgcgttcgaggacggaagcataaatggcggggaccgtcccggcggttcgtccctcagcatccaaacagctaatcccgggaatcatgtagagattcaggccgcttacatcggcaccaccataatcattcgacaaacggccggtcagctgtctttcagtatcaaagtggcagaggacgtggcaatggcattttctgctgaacaggatctccaactgtgcgtgggaggctgtccaccaagccaaagactgagcagaagtgagcgaaataggaggggcgcaatcaccatcgatacggcccggcggctgtgcaaggaggggttgccggttgaggacgcttacttccactcttgcgtcttcgacgtgcttatcagcggggaccccaatttcaccgttgctgcccaggccgctctggaagatgctcgcgcgttcttacctgacctggagaagcttcatctatttccatccgatgcgggggtgccccttagttccgctacattgcttgccccgttgcttagcgggctgttcgtgctctggctgtgcatccag

SEQ ID NO: 13589 - DNA, 1278 bp, Artificial Sequence
  Description of Artificial Sequence: Synthetic coding sequence
atgggcgagccaggacagtcaccctctcctcggtcctcacatgggtcgccgcctactctctcaacgctcaccctgctgctgctgctctgtggacacgcgcacagtcagtgcaagatcctgagatgcaatgccgaatatgtcagctccactttgtcacttagagggggagggtctagcggagctctgcgaggaggaggcgggggaggacggggaggcggagtgggatcgggaggcctgtgccgcgcactgcgcagctacgccctttgtacccggaggacggccaggacttgccggggcgacctggctttccactcagccgtgcatggaatcgaagatctgatgatccaacacaactgctcccggcagggtcctaccgcgcctccaccgccccgtggacccgctctgcctggagcgggatcgggtctgccagccccagacccctgtgactacgaggggcgcttctcacgcctgcacggtcgccctccgggattcctgcattgcgcatcctttggtgatccccatgtacggagctttcatcaccacttccacacctgtcgcgtccaaggtgcttggccgctgcttgacaatgactttcttttcgttcaggccacctcctcaccgatggcgcttggagcgaacgccaccgcgactcgcaaactgacgatcatctttaagaatatgcaagagtgtatcgatcaaaaggtgtatcaagctgaagtggacaatctgcccgtggcctttgaagatgggtcgatcaacggaggggaccgcccaggcggtagctcgctgtcgatccagaccgcgaaccctggaaaccatgtggagattcaagcagcctacatcgggaccactattatcatccgccagactgccggacagctttccttcagcatcaaggtggcagaagatgtggctatggctttctcggctgagcaggaccttcagctctgcgtgggaggttgcccgccatcgcaacggctgtcgagatcggagagaaatcgccggggagccattaccatcgatactgcgagaaggctgtgcaaggagggcttgccggtggaagatgcatacttccactcatgcgtctttgatgtgcttatatcgggggacccgaacttcactgtggctgctcaggccgcgctcgaagatgcgcgggccttcctgccggatttggagaagctccacttgttcccgagcgacgcgggcgtcccactgtccagcgccactcttttggccccgctgctcagtggtctgttcgtgctgtggctctgcatccag

SEQ ID NO: 13590 - DNA, 1278 bp, Artificial Sequence
  Description of Artificial Sequence: Synthetic coding sequence
atgggggaacctggacaatcaccgtcacctcggtcatcgcacggatcaccacctactctctccaccctgactctcctgctgcttctgtgcggccatgcacatagccagtgtaagattcttcgctgtaatgcagaatacgtgagcagcactctctccttgagagggggcggttcctcaggagctctgcgaggtggcggaggagggggacgcggtggaggtgtggggagcggaggtctttgtcgtgcactgcggagctacgcactgtgtactagacggactgcaagaacctgcagaggtgacctggcgtttcattcggcagtgcatggcatagaggaccttatgattcagcacaattgttcacggcaggggcctactgcaccaccgccaccacgcggacccgccctgccaggagctggttccggacttccggcacctgatccatgtgattacgaaggtagattttcacgcctccacggtcgacctccagggttcctgcattgcgcatcctttggggatccgcacgtcagatccttccaccatcattttcatacgtgccgcgtgcaaggagcatggcctctccttgacaatgatttcctctttgttcaagctacttcatccccaatggcgctgggcgcaaatgcaactgcgaccaggaaacttacgattatctttaagaacatgcaggaatgcattgaccagaaggtgtaccaagcagaagtggacaacctgcctgtcgcttttgaagatggaagcatcaatggcggagacagacctgggggttcatcgctgtcaattcagaccgcaaacccaggaaaccacgtggaaattcaggcggcgtacattggcactaccatcataatccgacaaaccgctggacaacttagctttagcattaaggtcgcagaagatgtggcaatggcattttccgcagagcaagatctccagctgtgtgtgggaggatgtccgccctcgcagagactctcccgctcggaacgtaatcgacggggcgcaataactatcgatactgctcgacgactctgtaaggaggggcttcctgtcgaagatgcatactttcattcgtgtgtgtttgacgtgcttatttcgggggaccctaactttactgtggcggcacaggcagcactggaggacgcacgtgccttcttgccagaccttgagaaactccatttgttcccatccgacgccggcgtgccactgagcagcgcaacgcttcttgcgccacttctctccggtctgtttgtcctttggctgtgcatacaa

SEQ ID NO: 13591 - DNA, 2184 bp, Artificial Sequence
  Description of Artificial Sequence: Synthetic coding sequence
atgtgggtgacgaagttgctgcccgcactgttgcttcagcatgtgcttttgcatcttctgttgctgccaattgctatcccatacgccgaaggacaacgtaagaggcgaaacacgatccatgagtttaagaaatcggcgaaaactaccctcataaagatcgatcctgcccttaagattaagaccaagaaagttaacacggcagaccaatgtgcaaatcgatgtacgaggaacaagggtctgccgttcacctgcaaggctttcgtgtttgacaaagctcgcaagcagtgtctctggtttccatttaactccatgagttcgggagtgaaaaaagagtttgggcacgagtttgatctgtacgagaacaaagactacatcagaaactgtattatcgggaaggggcgaagctacaaggggactgtctcaataaccaaatctgggatcaaatgtcagccgtggtcgtcgatgatcccacatgagcacagcttcctcccttcctcataccggggaaaggatctccaagaaaactattgcagaaacccaagaggtgaagaaggcggaccttggtgtttcacctcgaatccagaggtgcgatacgaggtctgcgatattccacagtgttctgaggtggaatgtatgacctgtaatggcgagtcgtacagaggccttatggatcacactgagtccggtaagatttgtcaaagatgggatcaccaaactccccaccggcacaagtttctcccagagcgctaccctgataagggatttgatgacaactattgccggaatcccgatggccaaccgcgtccgtggtgctacaccctggacccgcatacgagatgggaatactgtgcgattaagacctgcgcagacaatactatgaatgacaccgacgtccctctggaaaccactgaatgtattcagggccagggagagggataccgcggtactgtcaataccatctggaacggtatcccctgtcaacggtgggattcgcagtaccctcatgagcacgacatgactcctgaaaactttaagtgtaaggatcttcgcgaaaactactgcagaaaccccgacggttctgaatcgccatggtgctttaccactgatcctaacattcgtgtcggctactgttcccaaataccaaactgtgatatgagtcacgggcaggattgctacagagggaatggcaaaaactatatgggaaatctttcccaaaccagaagcggactcacttgtagcatgtgggataagaatatggaagatctccaccggcacattttctgggaaccagacgcatcaaagctcaacgagaattactgtaggaacccggatgacgatgcccatggaccctggtgttatactgggaatccactgataccctgggattactgcccaatttcacggtgcgagggagataccactcccaccattgtgaaccttgaccatcctgttatctcgtgtgcgaaaactaagcaactgcgagtggtcaatggaatccccactcggaccaacattgggtggatggtcagcttgcgataccggaataagcatatatgtggtggttcactcatcaaggaatcgtgggtgcttaccgcacgacaatgttttccttcgagggatctgaaggattacgaggcatggttgggcattcatgacgtccacggccgcggcgacgagaagtgcaagcaagtcctgaacgtgtcgcagctggtgtacgggcctgagggaagcgatctcgtgcttatgaagctcgccagacctgcagtgcttgatgattttgtgtccacgatcgatcttccaaactacggctgtacgattcctgaaaaaacttcttgcagcgtctacggatggggatacacgggtctgatcaattacgatgggctgctgagggtcgcccatttgtacattatgggtaacgagaagtgctcgcagcaccatcgcggaaaggtcaccttgaacgaatccgaaatttgcgcaggagcagaaaagatcggctcgggaccatgcgaaggcgattacgggggacctttggtgtgcgaacaacacaaaatgcggatggtccttggagtgatcgtgcctggaagaggatgtgctattcctaaccgtcctggcatctttgtgagagtggcatactatgccaagtggattcataagattatcctgacgtacaaagtgccacagtcc

SEQ ID NO: 13592 - DNA, 2184 bp, Artificial Sequence
  Description of Artificial Sequence: Synthetic coding sequence
atgtgggtgacaaaactgttaccagcgcttctcttacagcacgtgctcttacatctcctgctgctgcctatcgcaatcccatacgctgagggacagcgcaagcggaggaacactattcatgaattcaagaagtctgcaaagaccactctgattaagattgatccagcattgaaaattaagacaaaaaaagtgaatacggccgaccagtgtgccaaccgatgcacacgtaacaagggcctgccatttacatgcaaagcctttgtttttgacaaggcccgtaagcagtgcctgtggtttccattcaattctatgagttccggcgtgaagaaggaatttggccacgaatttgacttatacgaaaacaaagattacatccgaaactgcatcatcggaaagggacggtcctacaaaggtacggtgtccattactaagtctggtatcaagtgtcaaccctggtcaagcatgatccctcacgaacatagcttcctgccatccagttatagaggcaaggatctacaagagaactattgtagaaatccaaggggcgaagagggggggccttggtgctttacaagcaatcccgaagtccggtacgaagtgtgtgacattccccagtgttccgaagtcgagtgtatgacatgtaatggtgagtcctatcgggggttaatggaccacacagagtccggcaaaatctgccaacgctgggaccatcagaccccacaccgccacaagtttttgcctgaaaggtatcccgataaaggctttgatgacaattactgccgcaaccccgatggtcagccccggccctggtgttacacactggacccacatactcgctgggagtattgtgctattaagacgtgtgccgacaataccatgaatgatacagacgtgcctttagagacgaccgagtgtatccagggacagggcgagggatacagaggcacggttaacacaatctggaatggaattccatgtcagaggtgggattcacagtacccgcacgaacatgacatgactccagagaacttcaaatgcaaagacctgagggaaaattactgtaggaatcctgacggatctgaatctccctggtgtttcacgacagaccctaatattcgagtgggctattgttcacagatccccaattgtgacatgtctcacggccaggattgctatcgcgggaacggcaagaattatatgggtaacttgagtcagacaaggtccggactcacctgctcgatgtgggacaagaacatggaggacctacacaggcatatcttttgggagcctgatgctagcaagcttaatgagaactactgccgtaatcctgatgacgatgctcacggtccctggtgttataccggcaatccactcattccctgggactactgccccattagccgatgtgagggtgacacgacaccgacaatcgtaaatctcgaccaccccgttatctcttgtgctaaaacgaaacagttacgcgttgtgaacgggatcccaacacgcaccaacatcgggtggatggtgtccctgagatatcggaataaacatatatgtggcggcagcctgatcaaagaaagctgggtgctaacagcacgccaatgcttcccctcacgcgacctcaaagattacgaagcctggctcggcatccatgatgtccacggcaggggcgatgagaagtgcaaacaagtgctgaacgtcagtcagctggtgtatgggccagagggctccgatctggttctcatgaagctggccagacccgctgttttggatgactttgtgagcaccatagatctcccaaactatggctgcactattccagaaaagaccagttgctcagtgtatggttgggggtacacagggctcattaattatgacggactgctacgggttgcccacctatatatcatgggaaatgaaaaatgttcacagcaccatcggggaaaagtgactctgaatgagtctgagatttgcgccggcgccgaaaaaataggctccggtccttgtgagggggattacggcggacctctggtgtgtgaacaacacaagatgagaatggtgctgggggtgatcgtaccaggccgcggatgtgctatcccaaatcgaccggggatctttgtgcgagtagcctattatgccaaatggatacacaagatcatcctcacctataaggtgcctcagagt

SEQ ID NO: 13593 - DNA, 2184 bp, Artificial Sequence
  Description of Artificial Sequence: Synthetic coding sequence
atgtgggttacaaagctcttgcctgccttattgctccagcatgtacttcttcacctgcttctcctgccaatcgctatcccctacgccgagggtcagcgcaaaaggcgaaacactatccacgagttcaaaaagtccgctaaaacaaccttgatcaaaattgatcccgctcttaagatcaaaactaagaaggtgaacaccgcagatcagtgcgccaacaggtgtacccgaaacaaaggcctccccttcacttgtaaggccttcgtattcgataaagccaggaagcagtgcttatggtttccgtttaactctatgagcagcggggttaaaaaggaatttggacacgagttcgacctttatgaaaacaaggactatatacgcaattgcattatcggcaagggacggagctataagggtactgtctccatcacaaagtcaggaatcaagtgtcagccctggtcatcgatgatccctcatgagcacagctttttacccagctcgtacaggggcaaagacctccaggaaaactactgtcgtaatccgcggggtgaggaaggcgggccttggtgtttcaccagtaacccggaagtcaggtatgaggtgtgcgatataccacagtgcagtgaggtggagtgtatgacttgtaacggcgagagctatcgtggactcatggaccatactgagagtggcaaaatttgccaacgttgggatcaccaaactccccatagacataaatttttacctgagcgctacccggataaaggcttcgatgataactactgccgtaatccggacggccagccccgcccctggtgctatactctggacccccatacccgctgggagtattgtgccatcaagacatgcgctgacaataccatgaatgacaccgatgtgccacttgaaaccaccgagtgtatccagggccagggcgagggctacaggggcacagtgaatacaatctggaacggcataccgtgtcagcgttgggattcccagtacccccacgaacatgacatgaccccagagaacttcaaatgcaaggatttgagggagaattactgccgaaatcccgacggatctgagtctccttggtgttttacaaccgatcccaacatccgagtcggctattgctcgcagatacctaactgcgacatgtcccacggacaggattgctaccgtgggaatggaaaaaactacatgggaaatttgtcacagacgagatctggcctgacatgcagcatgtgggataaaaacatggaggatctgcaccgccacatcttttgggagcccgatgcaagcaagcttaatgagaattattgccgcaaccccgacgacgacgcccacgggccctggtgctataccggcaatccactgattccctgggactactgcccgatctccaggtgtgaaggagacaccacacccacgatagtgaatctggatcacccagtcatcagctgtgccaagacaaagcagcttcgtgtggtcaatggtatccctacaagaaccaatatcggatggatggtaagtctgagatatcggaataaacacatctgcggtggctcgctgattaaggaaagttgggttctcacggcgcgtcagtgctttccgtctagagacttgaaggactacgaagcctggctggggattcatgacgtccacggtcggggggatgaaaaatgcaaacaggttttgaatgtaagccaacttgtctatggtcccgaaggaagcgatctagtcctaatgaagcttgctagacccgccgtcttagacgatttcgtgagtacaattgatctgcccaactacggctgtacaattcccgaaaaaacttcttgcagtgtctatggttgggggtacactgggctgattaactatgatggtctgctgagagtggctcacctgtatatcatgggaaacgagaaatgtagtcagcaccataggggaaaggtgacccttaacgagtcagagatctgtgccggagccgagaagatcggatctggcccttgtgaaggtgactacgggggccccctcgtgtgtgagcagcacaaaatgcggatggttttgggagttatcgtgcccggaagaggatgtgccattcccaatcggcctgggatcttcgtgagggttgcctactacgccaaatggatccataaaatcatcctgacctataaggtgccacagagc

SEQ ID NO: 13594 - DNA, 2184 bp, Artificial Sequence
  Description of Artificial Sequence: Synthetic coding sequence
atgtgggtaaccaaactgcttccagcattgcttcttcagcatgttctgctgcatctgctccttctgcctattgccattccctatgctgagggccaaaggaagagaagaaacaccattcatgagttcaagaagtccgccaagactaccctcattaagattgacccagctctgaagattaaaacaaagaaggtaaataccgccgaccagtgcgccaacaggtgtacaagaaataagggcttgccatttacttgcaaggccttcgtgtttgacaaggctcgcaaacagtgtctttggttcccattcaacagcatgtcctctggtgttaagaaagagtttggtcatgagtttgatctgtacgagaataaagattacatccgcaactgcataatcggaaagggccgttcatacaagggcaccgtttctattacaaaatcaggcatcaagtgccagccttggtctagcatgataccacatgagcacagcttccttcctagctcttacagaggtaaggacctgcaggaaaactactgtaggaatcctcgtggagaagagggcggtccctggtgcttcacctctaatcccgaggtccgctatgaggtgtgcgacatcccccagtgcagtgaggtcgagtgcatgacctgcaacggcgagagctatagaggtctcatggatcatacagaatctggcaaaatttgccagagatgggatcaccagacaccccacagacataagttcctccctgagaggtaccctgacaagggattcgacgacaattactgtcgtaatcctgatggtcagcctcgcccctggtgttacacccttgatccccacactagatgggaatactgcgccatcaagacctgtgccgataacaccatgaacgacaccgacgtaccactggagaccaccgagtgcatccagggccagggcgagggatacaggggaaccgtcaacaccatctggaacggaattccttgtcaaagatgggactcccagtacccccacgagcatgacatgacacctgagaactttaagtgtaaggacctccgtgaaaactactgtagaaacccagatggaagtgaaagcccatggtgctttaccaccgatcctaatatcagggtcggttactgcagccaaatccctaactgcgatatgtcacacggacaagactgctaccgtggaaacggcaaaaactatatgggaaatctgtcccagactcgctccggtctgacttgcagtatgtgggataagaacatggaagaccttcatcgccacatcttttgggagcctgacgccagtaagttgaacgagaattactgtaggaaccctgacgatgacgcacatggcccttggtgctacaccggcaatcccctgatcccatgggactactgtcccatttcacgctgcgaaggcgacactacccccaccattgttaacctggaccatcccgtgatatcatgtgccaagacaaagcagctgcgcgtagtgaacggtatccccaccaggaccaacatcggttggatggtctctctgaggtacaggaacaaacatatctgtggaggaagcctgatcaaggagagttgggtcttgaccgcccgccagtgtttcccatcccgtgatttgaaggactacgaggcttggcttggaatccacgatgtccacggcaggggagacgagaagtgtaagcaggtcttgaacgtttctcagctggtttacggtccagaaggttccgatttggtcctgatgaagcttgcacgtcctgcagtactcgatgactttgtttccacaatcgacctgcctaactacggctgcaccatcccagagaaaacctcatgttctgtctacggctggggttacactggtctcatcaactatgacggcctcctccgcgtggctcacctctacattatgggcaacgagaagtgcagtcagcaccatcgcggcaaggtgaccctgaatgaaagcgaaatttgcgccggtgctgagaagattggaagcggaccttgcgagggtgattacggaggtcccctcgtttgtgagcagcataaaatgagaatggtgctgggtgtaatcgtgccaggcagaggctgtgccattcccaatcgcccaggcatcttcgtccgcgtagcttactacgcaaaatggattcataagatcatcctgacttacaaagtcccacaaagt

SEQ ID NO: 13595 - DNA, 2184 bp, Artificial Sequence
  Description of Artificial Sequence: Synthetic coding sequence
atgtgggttaccaagctgctgccagccctgcttttacaacacgtgttactgcatttactgctgctgcctatcgcaataccatacgctgagggccagcggaagcggcggaatactatacacgaattcaaaaaatccgctaaaactacccttataaagatagatcctgctcttaaaatcaagaccaagaaggtgaatacagcagaccagtgtgccaaccgctgcacacgtaataagggcttgccatttacctgcaaagcctttgtttttgacaaggcacgcaagcaatgcttatggtttccctttaattccatgagcagcggcgtgaagaaagagtttggccatgagttcgatctctacgaaaataaagattacataaggaactgcatcatcggtaaggggaggagttacaaggggacagtgtccatcactaagtctggcatcaaatgccagccatggtctagcatgattccccatgagcattccttcctgccaagctcctaccgggggaaggacctccaggagaattactgccggaaccctcggggcgaagaaggcggcccatggtgtttcacctctaacccagaagtgcggtacgaggtgtgtgacatcccacagtgcagtgaggtagagtgcatgacctgcaatggggaaagctaccggggccttatggaccataccgaatccggaaagatctgtcagcgctgggaccatcaaacaccccaccgtcacaaatttctccccgagagatatcccgacaaaggcttcgacgacaattattgcaggaaccccgacgggcagccaagaccttggtgctataccctggacccccacacaaggtgggagtactgcgccataaaaacctgcgctgacaacaccatgaatgatacagatgtgcctctggaaaccacagagtgcatccagggtcagggggaaggttatcgggggactgttaatacaatttggaacggcattccctgccagaggtgggactcacagtacccccacgaacacgacatgaccccagagaattttaagtgtaaagaccttcgtgaaaactactgtagaaaccccgatggaagcgagagtccatggtgctttaccacagaccccaatattcgcgtcggatactgttctcaaatccccaattgcgatatgagtcacggccaagattgttacagagggaatggaaaaaattacatgggaaacctgtcacagactaggagtggactgacatgttccatgtgggacaagaatatggaagatctgcatcgacatatcttctgggaacccgacgccagcaagttaaatgagaactactgtcgcaaccctgacgatgacgctcacggcccttggtgttataccggtaaccccctgatcccgtgggactactgtcccatctcaaggtgcgaaggagatacaactccaaccatcgtaaatctcgatcatcccgtaattagttgtgccaagaccaagcaactgcgcgtggtgaatggaattcccacccggactaatatcggctggatggtaagccttcgttatcgaaataagcacatttgcgggggctctctgataaaagagagttgggtcctgaccgcccgccagtgtttccctagtcgggacctgaaggattatgaagcctggttaggcattcatgacgtgcacggcaggggggatgagaagtgtaaacaggtgctgaacgttagccagctggtctatggaccagaaggcagcgatctcgtactcatgaagctagcaagaccagctgtgttggacgacttcgtgagtactattgatctgccaaactacggctgtactattcccgaaaagacatcctgcagtgtctatggttggggctacacaggcttaatcaactacgatggccttctaagagtggcccatctctatatcatgggcaatgaaaaatgcagtcaacaccatcgtggaaaagttacactaaacgagtccgaaatctgtgctggggccgagaaaattggctcaggcccatgtgagggagattatggcgggcccctggtgtgtgagcagcacaagatgcggatggttttgggggtgattgtgcctgggagaggctgtgccatccctaaccggcctggtatattcgtgcgggtggcttactatgccaagtggatacacaagataattctcacatacaaggtgccccagtct

SEQ ID NO: 13596 - DNA, 2184 bp, Artificial Sequence
  Description of Artificial Sequence: Synthetic coding sequence
atgtgggtgacgaagctgttgccagccctcctgctccagcatgttctgctccacctccttctgctgccgatcgccattccatacgctgagggccaacgcaagcgccgcaatactattcatgagtttaagaaatccgcaaagactacgctgatcaagatcgacccggccctcaagatcaaaaccaagaaagtgaacaccgcggaccaatgcgcaaaccgctgtacccggaacaagggcctcccctttacttgcaaggccttcgtgttcgacaaggcacgcaagcagtgtctgtggtttccgtttaactcgatgagctccggagtgaagaaggaattcggtcatgagttcgacctgtatgaaaacaaggactacatcagaaactgcatcatcggaaaaggccggtcgtacaagggtactgtgtccatcaccaagtcaggcatcaagtgccagccgtggtccagcatgatcccgcatgaacactcatttctgccgtcctcgtaccgcgggaaggatttgcaggagaattactgccgcaatccgagaggtgaagaaggtggtccgtggtgctttacctcgaatccggaagttaggtacgaggtgtgcgatatccctcaatgttcggaagtggaatgcatgacctgcaatggggaatcgtaccgcggactcatggatcacaccgagagcggaaagatctgccagaggtgggatcaccagactccacaccggcacaaattcctgccggaaaggtaccccgacaaggggttcgatgacaactactgtaggaatcctgacgggcagccacgcccttggtgttacacgctcgacccgcacacgcggtgggaatactgcgcgatcaagacctgcgcggataatacgatgaatgacaccgacgtccctctggaaaccactgagtgcatccagggacagggtgaaggatacagaggtacggttaataccatctggaatgggatcccgtgccaacgctgggattcacaatacccacacgagcacgacatgactccggaaaacttcaaatgtaaggacctgcgcgagaactactgccgtaacccggatgggagcgaatcaccctggtgtttcactaccgatccaaatatcagagtgggatactgttcgcagatccctaattgtgacatgagccatggacaggattgctaccgcggcaacgggaagaactacatgggcaacctctcgcagactaggtccggtctgacctgctcgatgtgggataagaacatggaagatctgcaccggcacatcttctgggaacctgacgcctcgaagctcaacgaaaactattgtcggaaccctgatgacgatgcccatggaccgtggtgctacactggaaacccgctcattccttgggactactgccctatcagccggtgcgaaggggatactaccccgactatcgtcaatctggaccaccctgtgatctcttgcgctaaaacgaagcagctgagagtcgtgaatggcattccgacccggaccaacattgggtggatggtgagcttgcgataccggaacaaacacatctgtggcggatccctcatcaaggagtcctgggtgctcactgctcgacagtgcttcccatcgagggatcttaaggattacgaagcctggttgggaatccatgacgttcatggccgcggcgacgaaaaatgtaaacaggtcctgaatgtgagccagttggtctacgggccagagggttcggatttggtgcttatgaagctggctaggcctgcagtgcttgacgactttgtttccactatcgacctgccaaactatgggtgtaccatccctgaaaaaacctcgtgctcagtgtacggctggggatataccggactgatcaactatgatggactcctgcgggtggctcatctctacatcatgggaaatgaaaagtgttcgcagcatcaccggggcaaggtgaccctgaacgaatcggaaatctgcgcgggggcagaaaagatcggaagcggtccgtgcgaaggagattacggaggaccccttgtttgtgagcagcataagatgagaatggtgctgggtgtcatagtcccaggaaggggatgcgccatccctaaccgtccgggaatcttcgtgagagtggcctactacgccaagtggatccataagatcatcctgacctacaaggtgcctcagtca

SEQ ID NO: 13597 - DNA, 2184 bp, Artificial Sequence
  Description of Artificial Sequence: Synthetic coding sequence
atgtgggtgaccaaactgctgccggcccttctgctgcagcatgtgctcctgcacctgctcctccttccaatcgcgatcccgtacgccgaaggacaaagaaaacggcggaacactattcatgagttcaagaagtcggccaaaaccaccctgatcaagatcgacccagcgctgaagatcaagaccaagaaagtgaacaccgctgatcagtgtgccaaccgctgcacgcggaataaggggctcccgtttacttgcaaggctttcgtattcgataaggcccgcaagcaatgtctctggttcccattcaactcgatgtcctcaggtgtcaagaaggagtttggacacgaattcgacctgtacgaaaacaaggactacatcaggaactgtatcatcggaaagggccgctcgtacaaagggactgtgagcattactaaatcgggtataaagtgccagccttggagctccatgataccgcacgaacactctttcctgccatcgtcgtaccgcggcaaggatctgcaggaaaactactgcagaaacccgagaggggaggaaggcggcccatggtgcttcactagcaacccggaagtgaggtacgaagtgtgcgacatccctcagtgctcagaagtggagtgcatgacgtgcaacggagagtcatatcggggacttatggaccacaccgaaagtggaaagatctgccagcggtgggaccatcagactccgcatcgccacaagtttctgcctgagcggtacccagacaaaggcttcgacgataactactgtagaaatccggacggtcaacccagaccgtggtgctacacgctggacccgcacaccagatgggagtactgcgcaatcaagacttgcgcggacaacaccatgaatgataccgatgtgccgctggagactaccgaatgcattcaaggacagggagaaggatacagagggaccgtgaatactatctggaatggaatcccgtgccaaagatgggactcccaatatccgcatgaacacgatatgaccccggagaatttcaaatgcaaggatctccgggagaattactgccgaaaccctgatgggtccgagtcgccttggtgcttcacgactgatccgaacatccgcgtcggatactgttcacaaatccctaactgcgatatgtcgcatggacaggactgttatcgcgggaacggtaagaactatatgggaaatctttcacagacgcgctcgggattgacctgttcgatgtgggataagaatatggaggatttgcaccgtcacatcttctgggaaccggatgcatcgaagttgaacgaaaactactgtcgaaatcctgacgatgacgcgcacggaccctggtgctacaccggaaacccactgatcccatgggactactgcccgatctccaggtgcgaaggcgatactaccccaactatcgtgaatctggatcacccagttatctcctgcgcaaagacgaagcagctgagggtggtgaacggcatcccgaccagaaccaatatcggatggatggtcagcttgagataccggaacaagcatatctgcggaggatcgctgatcaaagaaagctgggtgttgactgcccggcagtgctttccaagcagagatctgaaggactacgaagcctggttgggtatacacgacgtacacggtcgcggtgacgaaaagtgcaagcaggtgctcaatgtctcacagttggtgtatggccccgagggctccgacctcgttctcatgaagctcgctcgcccggccgtcctggacgattttgtcagcaccattgacctgcccaactatgggtgtaccattcctgagaaaacttcatgttcagtgtacggctggggctacaccgggctgatcaactacgacggactgcttcgggtggctcatctgtacatcatgggaaacgagaaatgctctcagcatcatagaggcaaagttacccttaacgagtcggaaatttgcgcgggggccgagaagattggatcgggcccgtgtgaaggagattacggcggccccctggtgtgtgagcaacacaaaatgcgcatggtcctcggagtgatcgtgccgggacgaggatgtgccattcctaaccggccaggtatctttgtgcgcgtcgcttactacgccaagtggatacacaaaatcatcttgacctacaaagttcctcaatca

SEQ ID NO: 13598 - DNA, 2184 bp, Artificial Sequence
  Description of Artificial Sequence: Synthetic coding sequence
atgtgggtgactaagctgctgccagcccttttgctccagcatgtcctccttcatcttttgctgttgccgattgccattccttacgcagaaggacaaaggaaacgccgcaatacgatccacgagttcaagaaatccgcgaaaactaccctgatcaaaattgatcccgcccttaagatcaaaactaaaaaggtgaacactgcagatcaatgcgcaaaccgctgtaccagaaacaaaggccttccctttacttgtaaggcgttcgtctttgataaggcacggaagcagtgcctctggtttccgttcaattccatgtcgtcgggcgtgaaaaaagaatttggacatgaattcgatctctacgaaaacaaagattacataagaaactgtatcattgggaaaggccggtcctataaaggcaccgtctcgattactaagtcagggattaagtgtcaaccatggtcatcgatgattccacatgaacattcctttctgccctcatcatataggggaaaagatctccaagaaaactactgcaggaatccaagaggagaagaagggggcccttggtgtttcacttcgaacccagaagtccgttacgaagtgtgcgacattccacagtgttcggaagtggagtgtatgacctgcaacggagagtcgtaccgaggactgatggaccacaccgaatcaggtaagatctgtcaacgttgggatcaccaaactcctcatagacataagtttctccccgaacgttaccctgataagggtttcgatgataactactgtcgtaatcctgacggccaaccccgtccctggtgctacaccctcgatcctcatactagatgggaatactgcgccattaagacctgtgccgataacactatgaatgataccgacgtgcctcttgagactaccgaatgtattcaaggacaaggagaaggataccggggtaccgtgaacaccatttggaacggcattccttgtcagaggtgggactcgcagtatccgcatgagcacgatatgaccccagagaatttcaagtgcaaggatctgagagagaattactgcagaaacccggatggctcggagtcgccgtggtgttttaccaccgatcccaatattcgtgtgggatactgttcacaaataccaaactgcgacatgtcacatggacaggattgctacaggggaaacggaaagaactacatgggaaatctttcgcagacccgctcgggactcacttgctcaatgtgggataagaatatggaggatctgcatagacatatcttttgggaaccagacgcaagcaaacttaacgagaactactgccggaaccctgatgatgatgcccatggaccttggtgctatactggtaaccctctgataccctgggactactgcccaatcagccggtgtgaaggggacaccacgccgactattgtgaatctcgatcatccagtgatttcttgcgctaaaactaagcaactcagagtggtcaatggaatacccacccgaactaatatcggatggatggtgtcccttcgctaccggaacaaacatatttgtggcggttccctcatcaaggagagctgggtgctgactgcaagacagtgctttccgtcgcgcgatcttaaggattacgaggcctggctcgggatccatgatgtccatggacgcggagatgaaaagtgtaagcaggtgctcaacgtgagccaactcgtttacggccctgagggatccgatctcgtgcttatgaagctggccaggcctgcagtgctggatgacttcgtgtcgactattgacctgccaaactacggatgtaccatccccgaaaagacctcctgctcagtctacggatggggatataccggtctgatcaattacgatggactgctgagagtggcacatctttacatcatgggtaacgaaaaatgttcccaacatcataggggaaaggtgaccctgaatgagtccgagatctgtgcaggcgcagaaaagataggctctggaccctgtgagggggactacggaggcccgttggtctgtgaacagcataagatgcggatggtgcttggtgtgatcgtgcctggtagagggtgtgctattccaaatagacctgggatctttgtgcgggtggcttactacgcaaagtggatccataagatcatacttacttacaaggtgccgcaaagc

SEQ ID NO: 13599 - DNA, 2184 bp, Artificial Sequence
  Description of Artificial Sequence: Synthetic coding sequence
atgtgggtgactaagctcctgccggctctgctcctgcaacatgtgctcctccatcttctgctgctgccaatcgcgatcccatacgccgagggtcagcggaagcggcggaataccatccatgagttcaaaaagtcggccaagactaccctgatcaaaatcgaccctgctctgaagatcaagactaagaaggtcaacactgcggaccaatgcgccaatcgatgcactcggaataagggattgccgtttacctgcaaggctttcgtgtttgacaaagcgcgcaagcaatgtctgtggttcccgtttaacagcatgtccagcggagtgaagaaggaattcggacacgagttcgatctgtacgaaaacaaggactacatcagaaactgcatcatcggaaagggacgcagctacaaggggactgtctcgatcaccaaatcggggatcaagtgtcagccgtggagctctatgatcccgcacgaacattcgttcctcccctcgtcctaccgggggaaggaccttcaggaaaactactgtcggaatccgaggggtgaggaaggtggtccgtggtgcttcacctcgaacccagaagtgcggtacgaagtgtgcgacattccacaatgcagcgaggtggagtgtatgacttgtaacggggaatcgtaccgcggactgatggaccataccgaaagcggcaagatctgccaacgttgggatcaccaaactccgcatcgccacaaattcctgccagaacgatacccggataaggggtttgacgacaactactgcaggaaccctgacggccagccgcgcccgtggtgttacaccttggacccacataccagatgggagtactgcgcaatcaaaacttgcgctgataacaccatgaacgacaccgacgtgccgctggagacgactgagtgcatccagggtcagggggaaggctaccggggaactgtgaacaccatctggaatggaatcccttgtcaacgctgggacagccagtacccgcatgaacatgatatgacccctgaaaacttcaagtgcaaggacctcagggagaattactgccggaacccagacggatcagaatcaccgtggtgctttaccactgacccgaacatccgggtgggatactgtagccagatcccaaactgtgatatgagccatggtcaggattgttaccgcggaaacggaaagaactacatgggcaacctgtcgcagacccgcagcggactgacttgttcaatgtgggataagaacatggaagatctgcacaggcatatcttctgggagccagacgcatcaaaactgaatgaaaactactgccgcaatcctgacgatgatgcccacggaccttggtgttacactggaaatccgctgattccgtgggactactgtcccatctcgcgctgtgagggtgacactactccgaccatagtcaatctcgaccatccggtgatctcgtgcgccaagaccaagcagctccgcgtggtcaacggcatcccaactcgcactaatatcggctggatggtttccctgagataccgcaacaagcacatctgcggcgggtcgcttatcaaggaatcgtgggtgctgaccgcgcggcaatgtttcccatccagggacctcaaggattacgaagcctggctcggaatccacgatgtgcacggccgcggtgatgagaagtgcaagcaggtgctcaacgtgagccaattggtgtacggacctgaggggtcggatttggtgctgatgaagctggcgcgcccggccgtgctggatgactttgtgagcaccattgacctccccaactacggatgcaccatcccagagaaaacttcctgcagcgtgtacgggtgggggtacactggactgatcaactatgatggcctgcttagagtcgcgcacctgtacatcatggggaatgaaaagtgttcgcagcaccatcgcggaaaggtgactctgaacgaatccgaaatctgcgccggagcagagaaaatcggatcgggcccttgtgaaggagattacggaggcccactggtgtgtgagcaacacaaaatgcgcatggtgcttggggtgattgtgcctggcaggggatgcgcaatcccgaacagaccaggcatctttgtccgggtggcatactatgcaaagtggattcacaagattatactgacctacaaggtccctcagtcc

SEQ ID NO: 13600 - DNA, 2184 bp, Artificial Sequence
  Description of Artificial Sequence: Synthetic coding sequence
atgtgggtcaccaagctgcttccggcgttgctcctgcagcatgtgctcctccacctgctcctgctcccgatagcgatcccctacgctgaagggcaacgcaagcgccgcaacaccatccatgagttcaaaaagagcgccaagactaccctgatcaaaatcgacccggcattgaaaatcaaaactaagaaggttaacacggctgaccaatgtgcgaatcgctgcactagaaacaaaggactgccttttacctgcaaggccttcgtgttcgataaggcacggaaacagtgcctttggttcccatttaactccatgagctccggagtcaagaaggagttcgggcacgaattcgatctgtacgaaaacaaggactacattagaaactgtatcataggaaagggaagatcctataagggcactgtctcgatcaccaagtcaggcattaagtgccagccgtggagctcaatgatcccgcatgaacattccttcctgccatcgagctaccgcggtaaggatctccaagagaactactgtcgaaaccctcggggcgaggaaggcggtccgtggtgcttcacctccaacccagaggtgagatacgaggtgtgcgacatcccgcagtgctcagaagtggaatgcatgacctgcaatggagagtcgtatcgcggactgatggaccataccgaatcaggcaagatctgtcagagatgggaccaccaaactccgcataggcacaagttcctgcctgaacggtacccggacaagggattcgacgacaactactgccgcaatcccgatggtcagccacgaccatggtgctacacgctggatccacacactcgttgggagtactgtgccatcaaaacctgcgcagacaacactatgaatgacactgacgtcccgttggagactaccgaatgtatccaggggcagggagagggttaccgcggcaccgtcaacaccatctggaatggcattccgtgccaacgatgggactcccaatacccccatgaacacgatatgactcccgaaaacttcaagtgcaaggacctgcgggaaaactattgccggaatcccgacggctccgagtcgccttggtgctttactaccgatcccaatatccgcgtgggttattgctcgcagatccccaactgcgacatgagccatgggcaggattgttatcggggcaacggcaagaactacatgggaaacctgtcgcagactaggagcgggctgacctgctcaatgtgggataagaacatggaggacctccaccggcacatcttctgggagcccgatgcatctaaactcaatgaaaactactgtcgcaatccagatgatgatgcgcatggaccctggtgctacaccggaaatcccctgattccatgggactattgtccgatttctcggtgcgaaggggacactaccccaactatcgtcaacctggaccatccagtcatttcatgcgcgaaaactaagcaactccgcgtggtgaacgggatcccgaccagaaccaacatcggatggatggtgtcactgagatacagaaacaaacacatctgtggaggctcactcattaaagaatcatgggtgctcaccgcgcgccagtgcttcccgtcgagagatctcaaggattacgaagcctggctgggaatccacgacgtgcatggccgcggagacgagaagtgcaagcaagtgctgaatgtctcgcaactcgtgtacggtcctgagggaagtgacctcgtcctgatgaagctcgcccggccagcagtgctggatgatttcgtgtcaacgatcgatctgccaaattacggatgcaccatccctgaaaaaacctcctgttccgtgtacggctgggggtacactgggctgattaactacgatggtctgctcagagtggcgcacctttacatcatgggaaacgaaaaatgttcgcagcaccaccggggaaaggtgactctgaacgagtcggaaatctgcgcgggagcggaaaagatcggctcaggcccgtgcgagggagactacggaggaccgctcgtctgcgaacagcacaagatgagaatggtgctgggagtcatcgtgccgggtcgcggctgcgctatcccaaataggcctggaatctttgtgcgggtcgcgtactacgccaagtggatccacaaaatcattttgacgtacaaagtgcctcagtca

SEQ ID NO: 13601 - DNA, 2184 bp, Artificial Sequence
  Description of Artificial Sequence: Synthetic coding sequence
atgtgggttacgaagctgcttcctgcactcctgctgcagcacgtgctgctgcatttgttgctgctccccatcgcaatcccctacgccgaagggcagcgtaaaaggcgtaataccatccacgaattcaagaagtccgcaaagaccaccctgatcaaaattgatcctgccttgaagatcaaaacaaaaaaggtgaacacggctgatcagtgcgccaaccgctgcacaaggaataaaggccttccctttacatgcaaagccttcgtcttcgacaaggcccggaagcaatgtctatggtttccttttaattccatgtcatctggcgtgaagaaggagtttggccacgagtttgatctatacgagaacaaagactacatacgtaattgtatcatcggtaaaggccgctcctataaagggaccgtttctatcaccaagagcgggatcaagtgtcagccgtggtcttccatgatccctcacgagcatagtttccttccgtcttcataccgggggaaggatcttcaggagaactactgtcgaaaccctaggggggaggaaggcggcccttggtgtttcacctcgaacccggaggtgcgatatgaggtgtgcgacattccccagtgctccgaagtcgaatgtatgacttgtaacggcgaatcataccggggcctgatggaccatactgaatccggaaaaatctgccaacgttgggaccaccagacaccccaccgacacaagtttctgccagagaggtacccagacaagggattcgatgacaactactgtaggaatccggacggccagccccgaccttggtgttacacgctcgaccctcatacccgatgggagtactgtgccatcaagacgtgcgcagacaacaccatgaatgataccgacgtgcctctggaaacgaccgagtgcatccaaggtcaaggcgaaggctaccgaggtactgtgaatacaatttggaacgggattccttgtcagagatgggacagccagtatccccacgaacacgatatgacccctgaaaactttaagtgcaaggacctccgcgagaattattgtagaaatcctgacgggtcagagagcccctggtgcttcactacggacccgaatattagagtcggctattgttcccaaattcccaactgcgatatgagccacggccaggattgctacagaggaaacggtaagaactacatgggaaatctctctcaaacccgaagcggcctgacctgttctatgtgggataagaatatggaagacctgcaccgccatatattctgggaaccagatgccagtaagttgaatgagaattactgcagaaacccagatgatgacgcccacgggccatggtgctacacaggaaaccctctcatcccctgggactattgtccaatctcccggtgtgagggggataccacccccaccatcgtcaacttagaccaccctgtgatatcgtgcgccaaaaccaagcaactaagggtcgtgaatggcatccctacgagaaccaacattggctggatggtgtccctgaggtacagaaataaacacatctgcggcggctctttgatcaaagaatcttgggtactgactgcgcggcagtgcttcccctctcgggatctgaaggactatgaggcctggttgggcattcacgatgtccatgggaggggggacgaaaagtgcaagcaagtactcaatgtgtcccaattggtgtatggccccgagggcagcgacctggtcctaatgaagttagccagacccgcagttctggacgattttgtaagcacaattgacttaccaaactatgggtgcacgattccagaaaaaacatcttgcagtgtgtacggttggggctacactggtcttatcaactatgatggattgcttcgtgtagctcatctttacatcatgggaaatgagaagtgttcccaacatcaccgaggcaaggtcactctgaatgaatccgagatctgtgctggagccgagaagattggatccggcccctgtgaaggagattatggcgggccgctcgtttgcgagcaacataagatgcggatggttcttggcgttatagtccctggaagaggatgtgcgattcccaacagaccgggaattttcgtgcgggtcgcgtattatgcgaaatggatccataaaattattcttacgtacaaagtgccccagtcc

SEQ ID NO: 13602 - DNA, 2184 bp, Artificial Sequence
  Description of Artificial Sequence: Synthetic coding sequence
atgtgggtgacgaagctcctgcccgcactgctgcttcaacatgtgctgctgcatttgcttcttctcccaatagcgatcccatacgcagaaggtcaaagaaaacgccggaacaccattcatgagttcaagaaaagcgccaagactactcttatcaaaatcgaccctgcgctcaagataaagacgaaaaaagtcaataccgccgaccagtgtgccaaccgctgcacccgtaataagggtctgccttttacttgtaaggcctttgtgtttgataaggcacgtaaacagtgtttgtggtttccgtttaacagcatgtcgtccggggtcaagaaggaatttggacacgaatttgacctgtacgagaacaaggattacatcagaaactgcattataggcaaggggagatcctacaagggcaccgtgtcgatcaccaagtccggaatcaaatgccagccgtggtcatcgatgatccctcatgaacattccttccttccatcatcttatcgcggaaaggaccttcaagagaactactgtcgaaaccccagaggagaagaaggaggtccttggtgtttcacttcgaaccctgaagtccggtacgaagtctgcgacattccgcagtgttccgaagtcgaatgtatgacctgcaacggagagagctacagaggccttatggatcataccgagtcagggaaaatctgccaacggtgggaccatcagactccacatagacacaagttcctgcctgagcggtaccccgataagggttttgatgacaattactgtcgcaaccctgacggacaacctagaccgtggtgctatactctcgacccacacactcgctgggaatactgtgctattaagacttgtgccgacaatactatgaacgatactgacgtgcctctggaaaccactgaatgtattcaaggtcagggggaaggttaccggggcactgtgaacaccatttggaatggaattccgtgtcaaaggtgggactcccaatacccacacgagcatgacatgaccccagaaaacttcaagtgcaaggatcttagagaaaactactgtaggaaccccgacggttcggaatccccctggtgcttcactaccgatcccaacataagagtgggttactgttcccaaattcccaattgcgatatgtcacatgggcaagattgttaccgcgggaatggaaagaactacatgggaaacctgtcgcagacccgatccggacttacttgttccatgtgggacaagaatatggaggatctccatcggcatatcttttgggaaccagacgcatcgaaactgaacgaaaactactgccgcaacccagacgacgatgcacacggtccctggtgttacactggaaacccgctgattccttgggattactgtcctatttcgagatgtgagggagataccaccccaaccattgtcaaccttgatcatccagtcatttcctgcgctaagaccaaacagctgagagtggtcaatggaatacccacccggactaacatagggtggatggtgagccttcgataccgcaacaagcatatatgtggtgggtcgctgattaaggaatcgtgggtgctgaccgcacgacagtgctttccatccagggacctcaaagattacgaagcatggttggggattcacgatgtccacgggcggggcgacgaaaagtgtaaacaagtgcttaatgtgtcgcaactcgtgtacggaccggagggcagcgatctggtgctgatgaagctggcacgacccgcagttctggatgacttcgtttccactattgatcttccgaactacggatgtactattccagaaaagactagctgttccgtgtacggctggggttacaccggactcattaactacgatggcctgttgcgcgtcgcccatctttacattatgggcaacgaaaaatgctctcagcaccatcgtgggaaggtcacccttaacgagtcagagatctgtgccggcgcagagaaaattggaagcggcccttgcgaaggagactacggaggccctcttgtgtgcgagcagcacaagatgcggatggtgctcggcgtcattgttcccggtagaggatgcgcaattcccaatcgccctggaatctttgtgagggtggcgtactacgcaaagtggattcataagatcattctcacttataaggtgccgcaatcg

SEQ ID NO: 13603 - DNA, 2184 bp, Artificial Sequence
  Description of Artificial Sequence: Synthetic coding sequence
atgtgggtgactaaactgttacctgccctgctgcttcagcatgtgctcctccatctactgcttctgcctatcgcaatcccctatgccgagggtcagcgaaaacggagaaatactatccatgagttcaagaaaagtgccaaaaccacattgatcaagatagatcctgcgcttaaaataaaaacaaagaaggtcaacaccgcagaccagtgtgccaatcgctgcaccagaaataaagggctccctttcacttgcaaggctttcgtcttcgacaaagctaggaaacagtgtctgtggtttcccttcaatagcatgtcctccggcgtcaagaaggaattcgggcatgaattcgacttgtacgagaacaaggattatattcgcaactgtatcattggcaaggggcgttcttacaagggtaccgtgagtattacaaagtccgggataaaatgtcagccttggtccagcatgatacctcatgagcattcctttttgccaagctcatatcgggggaaagaccttcaggagaattactgcagaaatcctcggggcgaggagggggggccatggtgctttacgtcaaatccggaagtgaggtacgaagtatgcgatattcctcagtgttcggaagtggagtgcatgacgtgtaacggagagagctatcgcggtttaatggatcacacagaaagcggcaagatttgtcagagatgggaccaccagacgccacatcggcacaagtttctgcccgaacgataccccgataaaggctttgatgataactattgcaggaatcctgacggacagccccgcccatggtgttacaccctggacccccatacgagatgggaatactgcgcaattaagacctgcgctgacaacacaatgaatgatacagacgtccccttagaaaccaccgaatgtattcagggtcaaggcgaaggctaccgcgggactgtgaataccatatggaacggaattccatgtcaaagatgggattcacagtacccccacgagcacgacatgacaccggaaaatttcaagtgcaaagaccttagagaaaattactgtcggaaccctgatggaagtgagagcccgtggtgtttcactaccgaccctaatatacgggtgggatactgttctcagattcctaattgtgatatgtcacacggacaggattgctatcggggaaatggaaagaactacatggggaacttgagccaaacccgctctggcctgacttgtagcatgtgggacaagaatatggaggacctgcatcgacacattttttgggagcccgatgcatcaaagctgaacgagaattactgtcgcaaccctgatgatgatgcccatgggccgtggtgctacaccggcaatccactgatcccatgggactattgccccatctcgaggtgcgagggggatacaaccccgacgatcgtaaacctggaccaccccgtgatctcttgcgccaagaccaagcagctgagagtggtgaacggtatcccaacccggacaaatatagggtggatggtctcccttagatacaggaataagcacatctgcggtggatctcttattaaggaatcctgggtgctaaccgccagacaatgttttccgagccgggacttgaaggactatgaagcctggctcggcattcacgacgtgcatggaaggggggacgagaaatgtaaacaggtgctcaacgtcagccagctcgtctatggcccagagggatcagatctggtgctcatgaagttggcgaggccggcagtgcttgacgactttgtgtccacgattgacctgccaaactacggatgtactatccctgagaaaacttcctgctctgtctacggttgggggtacactgggctgatcaactatgacggattgctgagagttgctcatctgtatattatggggaacgaaaaatgctctcaacaccatcggggcaaggtgacgctgaacgaatctgagatatgtgcaggggctgaaaaaatcggctcgggcccatgtgaaggtgattacggcggtccactggtttgcgaacagcacaagatgcgtatggtgctgggggtgatagtacccggccgcgggtgcgcgattcccaacagaccgggcattttcgtacgagtcgcctactatgccaagtggatccataagatcatcctgacctacaaagttccccaatct

SEQ ID NO: 13604 - DNA, 2184 bp, Artificial Sequence
  Description of Artificial Sequence: Synthetic coding sequence
atgtgggtcactaaactcctgcccgctctgctcttgcagcacgttcttcttcacctgctgctgctacctattgccattccatatgcagaaggccagcggaaaagacggaatactatacacgaatttaagaagtcagccaagactaccctgatcaagatagatcccgcattgaaaattaaaaccaaaaaggtgaacacagccgaccagtgcgccaacaggtgcactcggaataaaggcctgcccttcacgtgcaaagcctttgtgttcgataaggcacgtaaacaatgcctgtggtttcccttcaactccatgagcagcggcgtgaaaaaggagttcggacacgagtttgacctctatgaaaacaaggactatataagaaattgcatcatcggtaaggggcgctcctacaaggggaccgttagcatcacaaagtccggaatcaaatgccaaccctggtcaagcatgatcccccatgaacatagttttctccctagcagctataggggtaaggacctgcaggagaattactgccgcaaccctcgcggagaggaaggcggaccttggtgcttcacatccaatccagaagtgagatacgaagtctgcgacattccacagtgtagcgaagtggaatgtatgacctgtaacggggaatcatatagggggctcatggaccacactgaaagcggtaagatatgtcagagatgggatcaccagaccccccatcgccacaaattccttccagagcggtatccagataaggggttcgacgataattactgtaggaatcctgatgggcagccgcggccttggtgctacacgctagatcctcatactagatgggagtattgtgccatcaagacgtgcgcagataacactatgaacgacacagatgtccccctggagacaacagagtgtatccagggccagggagaggggtatcgggggactgtgaatacgatctggaacggcatcccgtgtcagagatgggatagccaatatccccacgaacacgatatgacccctgaaaatttcaaatgcaaagatctgagggaaaactactgtcgcaaccccgatggtagcgaaagcccgtggtgctttacgaccgatcctaacatacgggtaggttattgcagtcagatccctaattgtgacatgtcacacggccaggactgttaccgcggcaacgggaagaattatatgggcaatctgtcgcagacccgctctgggttgacttgttcgatgtgggacaagaacatggaagatctgcacaggcacatcttctgggagccagatgccagcaagctgaatgaaaattactgtaggaacccagacgatgatgctcatgggccttggtgctatacgggaaatccattgattccttgggactattgtcccataagtcgctgtgaaggcgatacgacacctacaatcgtaaacctcgatcaccctgtgatctcgtgtgccaaaactaaacagctcagggtggtcaatggtatccccacacggacgaatatcggatggatggttagtttgcgatatagaaacaagcatatttgcggcggttccctgatcaaggagtcctgggttcttactgccagacaatgctttccaagcagagacctgaaagattatgaagcctggctcggaattcacgatgtgcacggaaggggtgatgagaagtgcaagcaggtgctgaatgttagccagctggtatatgggcctgagggatccgatctcgttctcatgaagttagccaggcctgctgtgcttgacgactttgtgtcgacaattgatctgccgaactatgggtgcactatccccgaaaaaacatcctgtagcgtgtatgggtggggttacactggcttaattaactacgacggactgcttagggtggctcacttgtacatcatggggaacgaaaaatgttcccagcaccaccgaggaaaagtcacattgaatgagtccgaaatctgtgctggcgctgaaaaaataggtagtgggccctgtgagggagattatggggggccactggtgtgtgagcagcataagatgaggatggtgcttggcgtgatagttcctggacgtgggtgtgccattccaaaccgccctgggatttttgtgcgtgtggcctactacgctaagtggatacacaaaatcattctaacttataaggttccccagtcc

SEQ ID NO: 13605 - DNA, 2184 bp, Artificial Sequence
  Description of Artificial Sequence: Synthetic coding sequence
atgtgggttacgaaattacttccggcgttactcctgcaacatgttttattgcacttgttactgttaccgatcgcgattccgtatgcagaaggacaaagaaaaaggcggaacacgattcatgaatttaaaaaatctgctaagacgaccctgatcaaaatagaccctgctcttaagataaaaacaaaaaaagtgaatactgcagatcagtgtgcaaacagatgtaccaggaacaagggccttccatttacttgcaaagcattcgttttcgataaggcacgtaaacagtgtttgtggtttccgtttaattcaatgagctcgggcgttaaaaaagaatttggacatgaattcgacctttatgaaaataaagattacataagaaactgcattattggcaagggtcgctcttacaaaggtacagtttcaatcactaaatctgggattaaatgccaaccgtggtcatcgatgatcccacatgagcacagtttcttaccgtcaagctatcgcggcaaagacttacaagagaactattgtcgcaaccctcggggcgaagagggtggcccctggtgttttactagcaatccggaagtgcgttacgaagtttgtgatattccccagtgctcagaagttgaatgcatgacctgtaacggtgaatcatatagaggactgatggatcacaccgaatcaggtaaaatttgccaacgatgggaccatcaaacaccgcatagacacaaattcctgcccgaacgttacccggacaaagggttcgatgataattattgtcgtaatcctgatggacaaccgcgtccatggtgttacacgttggatccacacacacggtgggagtattgcgcgatcaaaacttgcgcagataatacaatgaatgatacggacgttccgcttgagacaacagagtgcattcaagggcaaggtgaagggtatagagggacagtcaatacaatctggaatggcattccatgccaacgatgggattcccagtatccgcatgagcatgatatgacaccggaaaattttaaatgcaaagatttgcgagagaactactgtcgcaatcctgacggatctgaatctccttggtgttttaccaccgatccgaatatcagggtaggctattgttcacagataccaaattgcgatatgtctcatgggcaagactgttatcgtggtaatggaaaaaactacatggggaacttgtcacaaactcggtcgggtttaacctgcagcatgtgggacaaaaatatggaagatttacatagacatatcttttgggagccggatgcgtcgaaattaaatgaaaactactgtcgtaacccggacgacgatgcacacgggccttggtgttatactggcaatccgcttattccatgggattactgccctatctctcgctgcgaaggagatacaacgcccacaattgtcaatctcgatcatccagtcatctcatgcgcaaagacaaaacagctgcgggtggtaaatgggattcctaccaggacaaatattgggtggatggtaagtcttcgttaccgcaataaacatatttgtggtgggtctcttataaaagaaagttgggttcttacagcacggcaatgttttccaagcagagacttaaaagattatgaagcctggctggggatccatgacgtgcacggccgaggggatgaaaagtgtaaacaggttcttaacgttagtcagctggtctatggtccggagggatctgatttagttctgatgaaacttgcgcgccccgcagtgcttgatgactttgtgtcaacaattgatttaccaaactacggatgcaccatccctgagaaaacgtcctgtagcgtatatgggtggggttacacaggactgataaattatgacggactacttagagttgctcacttgtatatcatgggtaacgagaaatgtagccaacatcatcggggtaaagtgacacttaacgaatcggaaatctgtgctggcgctgaaaaaattggctcaggtccgtgcgagggcgactatggcggacctctggtttgcgaacagcacaagatgaggatggttttaggcgtcatcgtaccgggaagggggtgcgcaatcccgaaccgccctggtatctttgtccgtgtggcatattacgcaaaatggattcataaaattattctgacctataaagttccgcaatca

SEQ ID NO: 13606 - DNA, 2184 bp, Artificial Sequence
  Description of Artificial Sequence: Synthetic coding sequence
atgtgggtgaccaagcttctgccggcactgctacttcagcacgtgctgctgcatcttttgcttctccccatcgccatcccttacgccgaaggacaacgtaagaggagaaacaccatccacgagttcaagaaaagtgccaaaaccaccctgataaaaattgatcctgctctgaagattaagaccaagaaggtcaacactgcagaccagtgcgcaaaccggtgcactcgcaacaagggtctgccttttacttgtaaggcgtttgtgttcgataaggctagaaagcaatgtctatggttccctttcaattctatgtcctccggtgtcaagaaagagttcggacatgaatttgatctgtatgaaaataaggattatatcagaaattgcatcataggaaagggccgctcctataagggcacagtgtcaattactaaatctggcatcaaatgccagccttggtcatccatgatccctcatgagcatagttttctacccagctcctatcgcggcaaggatctacaggaaaactactgcagaaatccccgcggcgaagaaggaggaccctggtgcttcacatccaaccccgaggttcgctacgaggtgtgtgacatccctcaatgttccgaagttgagtgcatgacttgtaatggagaaagctaccgtgggcttatggaccacactgaaagcggcaaaatttgccaacggtgggatcatcagacgcctcatagacataagtttctgcccgagcggtatcccgacaagggctttgatgacaattactgtaggaatcctgatgggcagcctcgcccttggtgctacacactggacccacatacgaggtgggagtattgcgcaatcaaaacatgcgctgacaatactatgaatgacaccgatgtccctttggagaccaccgagtgtatacagggccagggcgagggatacagaggaaccgtcaatacaatttggaatggtattccatgtcagaggtgggattcccaatacccacacgagcacgatatgactcccgaaaacttcaaatgcaaggatctgagggaaaactactgccgcaatccagacgggtctgagtctccttggtgcttcaccactgacccaaacatccgcgtaggctactgctcacagatccccaactgcgacatgtctcatggccaggattgctaccgtggcaatggcaagaactacatgggaaacctgagccagacacgcagtggcctgacttgttccatgtgggacaaaaatatggaggatctgcatcgccatatcttctgggaaccagacgcatccaagctgaatgagaattattgtcgaaatccggatgacgacgcgcatggcccatggtgttataccggcaaccccctgatcccgtgggactactgtcctatttctcgatgtgaaggcgatactacgcccacaattgtgaatttggaccaccccgtaatctcttgcgccaaaacgaaacagctgcgagtggtcaatgggatcccaacccgaactaacattggatggatggtgagtctgcgttacaggaataagcacatctgcgggggctctctcattaaggagtcttgggtgctgaccgcccgccaatgctttccaagccgcgacttgaaggattacgaagcatggctagggattcacgacgttcacggcaggggagacgagaaatgtaagcaggtcctgaatgtatcacagctggtatacgggccagagggaagtgatctggttctgatgaagctcgcacgccccgccgtgctcgatgacttcgtctcaactatagacctccccaattacgggtgtacaatacccgagaaaacttcatgttcagtttacggatggggctacactggcctaattaattacgacggacttctgagggtcgcccacctttacatcatgggcaatgaaaagtgctctcagcatcaccgtgggaaggttacactgaatgagtctgagatttgtgccggcgccgaaaaaatcgggagtggaccttgcgaaggggattatgggggccccctggtttgcgagcagcataaaatgcggatggttttgggcgttatcgtgccgggtcgcggatgtgccatccctaaccgaccaggaattttcgtgcgggttgcatactacgccaaatggatccataaaatcatcctgacatacaaggtacctcagagc

SEQ ID NO: 13607 - DNA, 2184 bp, Artificial Sequence
  Description of Artificial Sequence: Synthetic coding sequence
atgtgggtgaccaagctgttgccagcacttctgcttcagcacgtgttgctccatttgctgctcctgcctatcgccataccctatgctgaggggcagaggaaaaggaggaacactatccacgagtttaagaaatctgcaaaaactaccctgattaagattgacccagcgctgaaaatcaagaccaagaaggtgaacacggccgatcagtgcgccaatagatgtacgagaaacaaaggactgcccttcacgtgcaaagcctttgtgtttgataaagcaagaaagcagtgtctgtggtttcccttcaattcaatgtcttcaggagtaaaaaaggagttcggccacgagttcgacttgtatgaaaataaggactacatccgcaattgcatcatcggaaaggggagatcatataaaggtacggtgtctattaccaaatcgggaatcaaatgccagccttggtctagcatgatcccccatgaacattccttcttgccgtcctcttaccgcgggaaagaccttcaggaaaactactgccgcaatccgagaggggaggagggcggaccatggtgttttacctccaaccccgaagtgcgttatgaagtttgtgacatccctcagtgtagtgaagtcgaatgcatgacatgcaacggagagagctaccgagggctgatggatcataccgaatctggaaaaatctgccagcggtgggaccaccagactcctcaccgacacaagtttcttcctgaaaggtatccagataagggcttcgacgacaactattgtcgaaaccctgacggtcagcctaggccatggtgttacaccctggatcctcacactcggtgggaatactgcgcgatcaagacctgcgcagataataccatgaatgatacagacgtaccattggaaacgacagaatgtatccagggccagggagagggctatcgggggacagtcaataccatttggaacggaatcccttgccaaagatgggactcccagtacccgcacgagcatgatatgactcccgagaattttaagtgcaaggatctgagagaaaactattgcagaaaccccgatggttcagagagtccctggtgttttacaaccgatccaaacatccgtgttgggtactgtagccagattcctaattgtgacatgtcgcatggacaggattgttatagggggaatgggaaaaattatatgggcaatctgtcccagacacgatcaggcctgacctgtagcatgtgggacaaaaacatggaggatctgcatagacatattttttgggagccagatgcgagcaagcttaatgagaattactgtaggaaccctgatgatgacgcacatggcccatggtgttatacgggtaaccctctcatcccttgggactactgcccaattagtcggtgtgaaggagataccaccccaactattgttaacttggatcaccccgttatctcatgtgccaaaaccaaacagctaagggtggtgaacggcataccaactaggacaaatatcgggtggatggtgtcactgcggtacaggaataaacatatttgcgggggctcactgattaaggaaagctgggttttgacggctcggcaatgcttccctagcagggacctcaaggattacgaggcgtggttgggtatccacgatgtgcatggccgcggagacgagaaatgcaagcaggtgctgaacgtctcccagctggtgtacgggcccgaaggaagcgatttagtcctgatgaaactagctcggccagcagtgctcgacgattttgtgtctaccattgacctgccgaactatggctgcactattcctgagaagacatcatgtagtgtgtacgggtggggctacaccggcttgatcaattacgacggcttactgagagtagcacatctttacatcatgggtaatgaaaagtgttctcagcaccacagaggcaaagttaccctgaatgaatcggagatatgtgccggagctgaaaagattggatctggcccttgcgagggggactatggagggccattggtctgcgagcagcacaaaatgaggatggttctgggagtgatcgtcccgggcaggggatgtgccattcctaacaggccggggatcttcgtgcgtgttgcatactacgctaaatggatccataagatcatcctgacttataaggttccccagagc

SEQ ID NO: 13608 - DNA, 2184 bp, Artificial Sequence
  Description of Artificial Sequence: Synthetic coding sequence
atgtgggtgaccaaactgcttccagccctgcttcttcaacacgtccttctccacctgcttttgcttccaatcgcaatcccatacgccgaaggacaacgtaagcgcaggaatacgatacacgaattcaaaaagtcagcaaaaactaccctgatcaaaatcgacccagcgcttaagattaagacgaagaaggtgaacactgctgatcaatgtgccaacaggtgcactcgtaacaaggggcttccctttacctgcaaggcctttgtgtttgacaaggcacgaaagcagtgtctgtggtttccctttaactccatgagctcgggagtgaagaaggaatttggccatgagttcgacctgtacgagaacaaagattacatccgaaactgcattattggcaagggtcgatcatacaagggaactgtctcaattaccaagtccggaattaagtgccaaccctggtcgtccatgatcccacatgaacattcattcctgccgtcatcgtacagagggaaagatttgcaagagaactactgtcggaacccccgcggcgaagaaggtggaccttggtgtttcacctccaatccagaagttagatacgaggtttgtgatatcccacaatgctccgaggtggagtgcatgacctgtaacggcgagtcatacagaggacttatggaccataccgagtcgggaaagatctgccaacgctgggaccaccagacgccccatcgtcataagttccttcctgagcggtaccctgataagggctttgacgacaattactgtcgtaatcctgatggacaacccaggccttggtgttacaccctggatcctcataccaggtgggagtactgtgcaattaagacttgtgccgataacactatgaatgacactgatgtcccgctggaaactactgaatgtattcaaggccaaggtgagggatacagaggaactgttaacaccatttggaatggtatcccatgtcaaagatgggatagccagtatccccatgagcatgacatgactcccgagaactttaagtgcaaagacctgagagaaaactactgtcgaaatccggatggatccgaatcgccttggtgcttcaccaccgaccctaacatcagggtgggctactgttcccagatacctaattgcgatatgtcgcacggacaggattgttacagaggaaatggaaagaattacatggggaacctgtcacaaactcgatcaggcctgacgtgctcgatgtgggataagaacatggaggatttgcatcgacacattttctgggagccggacgcgtcgaaactgaatgaaaactactgccggaatcctgatgatgatgcacatgggccctggtgttacacgggaaatcctcttattccctgggactactgtccaatctcacgctgtgaaggagataccactccaaccatcgtgaacctcgatcaccctgtgatctcgtgcgcaaaaaccaagcaactgagggtggtgaatggcattcccacccgcactaatatcggttggatggtgtcccttagatacaggaacaagcatatctgcggaggtagccttatcaaggagtcgtgggtgctcactgcgagacaatgttttcctagccgcgacctgaaagactatgaagcatggctgggtattcatgatgtccatggcagaggtgacgaaaagtgtaaacaagtccttaatgtgtcccagctggtgtacggccccgaaggaagcgaccttgtccttatgaaattggcacgacccgcggttctggatgattttgtcagcaccatcgatctgcccaattacggttgtaccattccagaaaaaacctcctgttcggtctacggttggggatacaccgggctcatcaactacgatggtctgctgcgggttgcacatctgtacataatgggtaacgaaaagtgttcacagcaccatcgggggaaagtgaccctgaacgaatccgagatttgcgctggagccgaaaagattggctccggcccatgcgagggcgattatggaggaccgctggtctgcgaacaacataagatgcggatggtcctgggagtgattgtgcccggtcgtggatgtgcaataccgaatcgtccggggattttcgtgcgtgtcgcgtattacgcaaagtggattcataagataattctgacctacaaggtgccacagtcg

SEQ ID NO: 13609 - DNA, 2184 bp, Artificial Sequence
  Description of Artificial Sequence: Synthetic coding sequence
atgtgggtcactaagctgctgcctgctcttctcctccaacacgtgctgctgcacctcttgctgctgcctatcgctattccatatgctgaaggccaaagaaagaggcgcaacacaatccacgaatttaagaagtctgccaagaccacactgatcaaaatcgaccctgcgcttaaaattaagacaaagaaggtgaacacagcggatcagtgcgccaaccgctgcacacgcaacaagggattgccttttacttgcaaggcatttgtcttcgataaggcgcgcaagcagtgcctgtggttccccttcaactctatgagctccggtgtcaagaaggaatttggccacgaatttgatctctacgagaacaaagactatattaggaactgcataattggtaaaggaaggtcatataagggtaccgtgtccatcactaaatcaggaatcaaatgccagccctggtcttcaatgattccccacgagcacagttttcttcctagctcatatcgcggcaaggatcttcaggaaaactattgccgcaatccacgcggtgaagaaggcggtccttggtgctttacttctaatccagaggtcaggtatgaggtctgtgatataccacaatgttccgaagtcgagtgcatgacctgcaacggagagtcatatagaggactgatggaccacacagagagcggaaagatttgtcagcgctgggaccaccaaactccccatagacacaagtttcttcctgaaaggtaccctgataaaggcttcgacgacaactactgtagaaaccctgatggtcaacctaggccgtggtgctacacgctcgacccccacaccagatgggagtactgtgccattaagacttgtgccgataacactatgaacgacactgacgttcctttggaaaccacagagtgtattcaaggtcagggtgagggttataggggcactgtcaatactatctggaacggaatcccatgccaaagatgggactcccaatatccgcacgaacacgatatgaccccagagaattttaagtgcaaggacctgagagaaaactactgcagaaatccagacggaagtgagagtccgtggtgctttacaactgatccgaacatcagggtgggatattgctctcaaatcccaaattgcgacatgagccacggccaagattgctatagaggcaatggcaagaactacatgggaaatctgtcacagacccgctccggattgacttgctcaatgtgggataagaatatggaggacctccatcgccacatattttgggagcctgatgctagcaaactgaacgagaattactgtcgcaacccagatgacgacgcccacggcccctggtgctatacaggcaatcctctgatcccttgggactattgcccaatctctcgctgtgaaggcgacacaactcctacaatcgtgaacctcgaccatcccgttatctcctgcgcgaagacgaagcaacttcgcgtcgtaaacggaatcccaactaggactaacattggttggatggtgtcccttcgctacaggaacaaacatatttgtggaggatctttgataaaggagtcctgggtgttgacagctcgccaatgcttcccttctcgcgatctgaaggactatgaagcttggttgggcatccacgatgtgcacggcaggggcgatgagaagtgtaaacaagttctgaacgtctcccagctggtgtatggtcccgagggctctgacttggtccttatgaagttggccagacctgccgtccttgacgatttcgtgtctactatcgacctcccaaactacggctgtacaatccccgagaaaacgtcctgttcagtttacggttggggatacaccggactgataaattatgacggccttctgagggtcgctcatctgtacatcatgggcaatgaaaaatgttcccagcatcatcgcggcaaggtcactctgaatgagtctgaaatctgcgctggcgccgaaaagatcggttcaggcccatgtgaaggcgactatggaggaccactcgtgtgtgagcagcataaaatgcgcatggtgctgggtgtaattgtacccggtcgcggctgcgcgataccaaatcgcccaggtattttcgttagggtggcgtactacgccaaatggattcataaaatcatcctcacatataaggttccccaatcc

SEQ ID NO: 13610 - DNA, 2184 bp, Artificial Sequence
  Description of Artificial Sequence: Synthetic coding sequence
atgtgggtgaccaagctcctccccgcactgcttttgcagcacgtgctgctgcacctcctgctgttgcctatcgctatcccctatgctgagggacaacgtaagaggagaaacacaattcacgagtttaaaaagagcgccaaaacaacattgataaagatcgacccggctctcaagatcaaaacaaagaaagtcaacaccgctgaccagtgtgccaatcgctgtactcggaacaagggactgcccttcacctgcaaggctttcgtgtttgacaaggctaggaaacagtgcctctggttcccttttaatagcatgtcgagtggggtgaaaaaggagttcgggcacgagtttgacctgtacgagaacaaggactatatcagaaactgcatcatcggaaagggcaggagttacaagggtaccgtgtcaatcaccaagagtgggatcaaatgccaaccttggtcttcaatgatcccacatgagcattcctttttaccctcttcttaccgggggaaagacctgcaggaaaactattgccggaacccacgaggcgaggaagggggcccctggtgtttcacatccaaccccgaagtccgatatgaggtatgcgatatcccacagtgcagcgaggtggagtgtatgacctgcaacggggagagctatcgtggactgatggatcataccgagtctggtaagatctgccaacgctgggatcaccagacaccacacagacataagtttctgcctgaaagataccccgacaaaggcttcgatgacaactactgcaggaatccagatggacagcccagaccctggtgttatacactcgaccctcacactcgctgggaatactgcgcgatcaagacttgtgctgataacaccatgaacgacaccgacgtgcccctggaaaccaccgagtgtattcaaggacaaggcgaggggtaccgggggactgttaacaccatttggaacggtatcccctgtcaaaggtgggattcacaatatccacatgagcatgacatgacccccgagaactttaaatgtaaggatctccgggagaattattgtaggaaccctgatggctctgaatccccatggtgcttcactacggaccctaacatcagggttgggtactgctcccagatccccaattgcgatatgtctcatggacaagattgctaccgcggaaacgggaagaactacatgggaaatcttagccaaactcggtccggcctgacctgctccatgtgggataagaatatggaggacttgcaccgccacatcttttgggaaccagacgcatctaagcttaacgagaattactgcagaaaccccgatgacgacgctcacggaccctggtgctacactggaaaccctctgatcccatgggattactgccccatttcccgttgcgaaggagacactaccccaaccattgttaacctggaccacccagtcatcagttgtgctaaaaccaagcagctgcgggtcgtgaacggcatcccaacaagaactaacatcgggtggatggttagcctccggtataggaacaagcacatctgcggcggcagcctgattaaagagtcttgggtgctcacggcgcgccagtgttttccaagccgggacttgaaagattacgaagcatggttagggatccacgatgtgcacggccggggagacgagaagtgtaaacaggtacttaacgtgtcccaattagtctatggaccagagggaagtgatctggtacttatgaagctcgcccgtcccgcagtcctcgacgactttgtctcaacaatcgacctccctaactacggatgcacaatccccgagaagacaagctgtagtgtttacggctgggggtatacaggattgatcaactatgacgggctgcttagggtagcccatctatatataatgggcaatgaaaagtgcagccaacaccacagaggcaaggtcacacttaacgaaagtgagatctgtgccggagctgaaaagattggctcaggaccttgcgagggtgactacggaggcccactggtgtgcgagcagcacaagatgagaatggtgcttggtgttattgtacccggacggggctgcgctatcccaaacagacctggaatctttgtcagggtggcttactacgccaagtggatccacaaaatcatactcacatacaaggtacctcagtct

SEQ ID NO: 13611 - DNA, 2184 bp, Artificial Sequence
  Description of Artificial Sequence: Synthetic coding sequence
atgtgggtgacgaagctcctccccgccctgttgttacagcacgtcctcttgcacctcctgttgctgcccatcgctatcccatacgccgagggccaacgtaaacggagaaacacgattcacgagttcaagaaatcagccaagaccacgctcatcaagatcgatccggctcttaagattaagacaaagaaggtcaacaccgccgaccagtgcgcaaaccggtgcacgcgtaataagggactcccatttacatgtaaggcttttgtgttcgacaaggcccgcaagcagtgcctgtggttcccttttaacagcatgtcttccggagtgaagaaggagttcggccacgagtttgacctctatgaaaacaaggattatatccgcaactgcatcatcggtaaggggcgctcgtacaagggcactgtgtcgatcactaagagcggtatcaagtgccagccgtggtcctccatgatcccgcacgagcacagcttcctgccgagcagttaccgtggcaaggacctccaagaaaactactgtcgtaatcccagaggtgaggagggtggaccctggtgctttacttccaaccccgaggtccgctacgaagtctgcgatatcccgcagtgttctgaggtcgagtgcatgacctgcaatggcgagtcgtacaggggtctcatggatcacactgaaagcggtaagatttgccagcgctgggaccaccagactcctcatcggcacaagttccttcctgagcgttaccctgacaagggcttcgatgataactattgtcgtaaccccgacggtcaacctcgaccgtggtgctacactctcgatccgcacactaggtgggaatattgcgctatcaaaacctgcgcagataacacgatgaatgacactgacgtgccactagaaacgaccgagtgtattcaggggcagggcgaaggctaccgcggcacggttaataccatctggaacggcatcccctgccagagatgggattcgcagtacccccacgagcacgacatgactcctgagaacttcaagtgcaaggacctccgtgagaactactgtcgcaaccctgacggctccgagtccccatggtgcttcaccaccgatccgaatatccgggtcggatactgtagccaaatccccaactgtgatatgtcccacggtcaggactgctaccgtggcaatggcaagaactatatgggtaatcttagtcagacgcgctcaggtttgacttgctccatgtgggacaagaacatggaggatctccaccgacatatcttctgggaacctgacgcttccaaattgaacgagaactattgccgcaatcccgatgacgacgcccacggaccctggtgctacaccggcaatccccttatcccttgggattactgcccgatctccagatgcgagggtgataccacgcccacgatcgtgaacctggaccacccagttatttcctgcgccaagacgaagcagctgcgtgtcgtcaacggtattccgactcgcacaaacattgggtggatggtgtccctccgatacagaaacaagcacatctgcggtggttcattgatcaaggaatcctgggtcctcacagcccgccagtgcttcccctccagggacctgaaggattatgaggcatggctcgggatccacgatgtgcacggtcgcggtgatgagaagtgcaagcaggttctgaacgtgagccagctcgtttacggtccggagggctccgacctggtcttgatgaagttggcgcgtccagctgtcctggacgactttgtgtccaccattgatctccccaactacggatgtaccatccccgagaagacctcttgttcggtgtacggttggggctacacgggattgatcaattacgatggtcttctgagggtcgcgcacctgtacatcatgggcaacgaaaagtgttcacagcatcaccgcggcaaggttaccctcaacgaatctgagatttgtgcaggcgcggagaagattggttccggaccgtgcgagggagattacggtggccctctggtttgtgaacagcacaagatgcgcatggtcttgggtgtcattgtacccggtcgtggttgcgcaatccctaaccggcccggtatattcgtacgagttgcctattatgccaagtggatccacaaaatcatcctcacgtacaaagtgcctcagagt

SEQ ID NO: 13612 - DNA, 2184 bp, Artificial Sequence
  Description of Artificial Sequence: Synthetic coding sequence
atgtgggtgacaaaactcctgcctgcactgctcctgcagcacgtcctactccatctacttctcctaccaatcgctatcccctatgccgaagggcagagaaaacgccggaacactatccatgaattcaaaaaatcggctaaaactacgctcatcaaaatcgatcccgcactgaagatcaaaactaaaaaagtgaatacagccgatcagtgcgccaacagatgcacacggaacaaaggactgccattcacgtgcaaagccttcgtcttcgataaagcaagaaagcagtgcctttggttccccttcaattcaatgagttctggagttaaaaaagaattcgggcatgaattcgatctgtacgaaaacaaagattatataagaaactgcattatcgggaaggggcggtcatataaaggaactgtgtctatcactaaatccggaataaagtgtcagccctggtcttctatgatcccccacgaacattcttttctgccctcttcatatagggggaaagacctacaggagaactattgtcgcaacccacggggggaggaaggaggaccctggtgctttactagtaatcctgaagtgagatatgaagtgtgcgatatccctcagtgctctgaggtcgagtgtatgacatgtaacggggagagttatcgggggctgatggatcacactgagtccggaaaaatctgtcagaggtgggatcaccagactccacatcgccataaatttttgcctgaacggtatcccgataaagggtttgacgacaactattgccggaatccagatgggcagcctaggccctggtgctatactttggatccccatacgcggtgggaatattgcgcaattaagacatgtgcagataacactatgaacgatacagatgtgccactcgaaacaacagaatgtatccaggggcagggagaagggtataggggaacagtaaacactatttggaatggaataccttgtcagaggtgggattcccagtaccctcacgagcacgatatgacaccagaaaactttaagtgcaaagatcttcgggaaaattattgtagaaatcccgacgggtctgaatcaccttggtgcttcactactgaccctaatatcagggttggatattgttcgcagatccctaattgtgatatgtcccatggacaagattgctaccgggggaatggaaaaaactacatgggaaacttgtctcagacgcggagtgggcttacatgctctatgtgggataaaaacatggaagatctgcatcgccatatcttctgggaacctgatgcttctaagctgaacgaaaactactgccgaaatcctgatgatgatgcgcatgggccctggtgctatactggaaatcccctgatcccttgggactattgccccatctctaggtgtgaaggagacacaactcctacaatcgtgaaccttgatcaccctgttatttcttgtgccaaaactaaacagctgagagtagtgaatggaatacctacacgcacaaatatcgggtggatggtaagtctcagatataggaacaaacatatatgtggggggtcattgattaaagaatcatgggtgctgactgccaggcaatgctttccctctagggatctgaaggattatgaagcttggttaggaatccacgatgttcacgggcggggagatgaaaagtgtaagcaagtgctaaacgtttctcagctcgtatatggaccagagggatctgatctagtactcatgaaactggctaggccagccgtgttggatgattttgtttctacaattgacttgccaaattatgggtgtactatccccgaaaaaacttcatgctcagtgtacggatggggatatacagggttaatcaattacgatggacttcttagagtggcacatctttatattatgggaaatgaaaaatgttctcagcaccaccgcggaaaagtgactctaaacgaatccgaaatttgtgccggagccgagaaaatcggatccggaccctgcgaaggagattacggagggccccttgtgtgtgaacagcacaaaatgcgaatggtgctaggagtgatcgtgcctgggcgcggatgtgccatccccaatcgccccgggatctttgtcagagtagcttattacgcaaaatggatccataaaataatcctaacttataaagtacctcagtct

SEQ ID NO: 13613 - DNA, 2184 bp, Artificial Sequence
  Description of Artificial Sequence: Synthetic coding sequence
atgtgggttaccaagctcctcccagcactcctgcttcaacacgtgctgcttcatctcctgctgcttccaattgcgattccttacgcagaaggtcaacgaaagagaaggaataccatccatgaattcaagaagtccgccaagaccaccctgattaagatcgaccctgccctgaagattaagactaagaaggttaacactgcagatcaatgtgcaaacagatgtactagaaataagggacttcctttcacctgcaaggcttttgtgtttgataaagcaagaaagcagtgtctttggtttccatttaacagcatgagctccggtgtgaaaaaggaattcggccatgaattcgacctgtacgagaacaaggactacatcagaaactgtattatcggtaagggtagatcctacaagggtaccgtgtcgattactaagtccggaattaagtgtcagccctggagctctatgatacctcacgaacactcgtttctgccgtctagctatcggggaaaggacttgcaagaaaactactgcagaaatcccagaggggaggaaggaggaccctggtgcttcacctccaaccccgaagtcagatacgaggtctgtgacatccctcagtgttccgaagtggagtgtatgacctgtaacggagaatcgtacaggggactgatggatcacaccgagagcggaaagatctgtcaaaggtgggaccatcagaccccacataggcataagtttctgcctgaacgatacccagacaagggttttgatgataactactgtcgcaatccagacggacaaccccgcccttggtgttacacgcttgatcctcataccaggtgggaatactgtgcaatcaagacttgcgcggataacaccatgaatgataccgacgtgccactggaaacgactgaatgtatacaaggacaaggcgaaggttacagaggcactgttaacactatttggaacgggattccatgtcaaagatgggactcccaataccctcacgaacatgatatgaccccagagaactttaagtgcaaggatcttcgagagaattactgtcgcaacccggatggctccgaatccccatggtgttttactactgacccgaacattcgcgtcggatactgttcacagatcccaaattgtgacatgagccatggacaggattgttaccgagggaacggaaagaattacatgggaaacctgagccagacccgatcagggcttacctgttcgatgtgggacaagaatatggaagatctgcataggcacatattctgggaaccagacgccagcaaacttaacgagaactactgccgtaaccctgacgacgatgcacacggcccgtggtgctatactgggaaccctcttataccttgggattactgccccatttcgcggtgtgagggagacactacccctactatcgtgaatctggatcacccggtgatctcatgcgccaaaactaagcaattgcgggtggtcaatggcattccgactagaaccaatataggctggatggtgtcacttagatacagaaacaaacacatatgtgggggctcgcttatcaaggaatcctgggtgctgaccgcaagacaatgctttccctcccgagacttgaaggattatgaagcatggctgggtattcatgatgttcatgggcgtggagatgaaaagtgtaagcaggtccttaacgtgtcccaacttgtgtatggtccagagggttccgatctggtgcttatgaagctggcaaggcctgctgtccttgacgatttcgtgtccaccatcgatctgccgaattacggttgtactattccagaaaagacctcgtgttcagtgtacggctggggctacactggcttgattaactacgatggactcctgagagtggcacacttgtacatcatgggaaatgaaaagtgctcgcagcatcaccgagggaaggtgactctgaatgaatccgaaatctgcgcaggtgcagagaagattggctccggaccttgcgaaggtgattacggtggtccactggtgtgtgaacaacacaaaatgcggatggtccttggcgtcattgtgccaggtcgtggatgtgcaattcctaacagaccaggtattttcgtgagagtggcatactatgcaaaatggattcataagatcattctgacgtacaaagtccctcagtca

SEQ ID NO: 13614 - DNA, 2184 bp, Artificial Sequence
  Description of Artificial Sequence: Synthetic coding sequence
atgtgggttacaaaattactacctgcactgctacttcaacacgtccttctgcatctgctgctactgccaattgccatcccatacgcagaaggccaacgtaagcgcaggaatacaattcatgagtttaagaagagtgccaagaccacacttatcaaaattgacccggccttgaaaataaagaccaaaaaagtgaacaccgccgatcagtgcgccaacagatgcaccagaaacaaagggctcccttttacatgtaaggcgttcgtttttgataaagcccggaaacagtgtctttggttcccctttaacagtatgagtagcggagtcaaaaaagagtttggccacgaatttgatctgtacgagaataaggactacatcaggaattgtattatcggcaaagggaggagctataaaggcacagtgtccattaccaagtccggcattaaatgccagccttggtcttccatgattcctcacgaacattccttcctgccttcttcttaccgtggcaaggatctgcaggaaaattattgtcggaatccacggggcgaggagggtggcccctggtgctttacttctaatcctgaggtgaggtacgaggtgtgcgatatcccccagtgctctgaggtagagtgcatgacctgcaatggggaatcatatcggggacttatggatcatactgagagtggcaagatatgtcagagatgggaccatcagactccccatagacacaagttcctacctgagaggtatccagataaaggctttgacgataactactgccgaaacccagatggacagccaaggccatggtgctacaccctggaccctcacacccgctgggagtactgtgctatcaaaacctgcgcggacaatacaatgaacgacactgacgtgccactggaaactacagagtgtatacaggggcagggcgagggctacagaggaactgtcaataccatatggaacggcattccatgtcagcggtgggattctcaataccctcacgaacacgacatgacacctgaaaacttcaagtgtaaggaccttagggaaaactactgccgcaacccggatggaagcgagagtccctggtgcttcactacggacccaaatattagggtgggctattgttctcaaatccccaactgcgatatgtcacatggtcaggactgttaccgagggaatggcaagaactatatgggcaacttgtcccaaaccagatctgggctgacttgcagcatgtgggacaaaaacatggaggaccttcataggcacattttctgggaaccagatgcctctaaactgaatgagaactactgtcggaacccagatgacgatgctcacggcccttggtgttacaccggaaatcccctcatcccctgggattattgccccatatcccggtgcgaaggggatactacccccacaatcgtgaatctggatcaccctgttatctcttgtgccaaaaccaagcagctgcgcgttgtcaacgggatccctactcgaaccaacattggatggatggtgagtctcagatatcgcaataagcacatctgtggcgggtctcttattaaggaaagttgggtacttacggcacggcagtgtttcccctcccgggatctgaaagactacgaggcttggctcggcattcacgatgtgcatggcaggggagatgagaagtgtaagcaggttttaaacgtaagccaactggtatatggccctgagggctcagatctggtcctaatgaagctagcccgacctgcggtcctggacgatttcgtctcaactatcgatctgcctaactatgggtgtactatccccgagaaaacaagctgttccgtttacggatggggatacacagggttgattaactatgatggcctactgcgagtggctcacctgtacataatgggtaatgagaagtgttcccagcaccaccgaggaaaggtcacactgaacgaatccgaaatatgcgccggtgccgagaagattggaagcgggccttgcgagggagactatggtggccctctcgtctgcgagcagcataaaatgaggatggtgctgggagtgatcgtgccagggcgggggtgtgcaatacccaaccggccaggtatatttgtgcgagtggcatactacgccaagtggattcacaaaatcatccttacttacaaagtgccccaatct

SEQ ID NO: 13615 - DNA, 2184 bp, Artificial Sequence
  Description of Artificial Sequence: Synthetic coding sequence
atgtgggttacgaaattgttgcctgccctgcttctgcagcacgtcctcctgcacctgttattgctacccattgcaatcccctatgctgaggggcagaggaagcgacggaacaccatccatgagttcaaaaagtccgctaagaccactttaatcaaaattgaccctgctctgaaaattaagaccaaaaaggtgaacactgccgaccagtgtgcaaatcggtgcactagaaacaaagggttgccgttcacatgcaaggccttcgtctttgataaggctcgcaagcagtgcctgtggttcccctttaattcaatgtcatctggagtgaagaaggaattcggacatgagttcgatctttacgaaaataaagattatattcgcaactgcattatagggaagggacggtcctataagggcactgtctccattaccaaaagcggtataaagtgtcagccctggagcagtatgatcccacacgaacatagcttcctgccaagttcatacagaggaaaggacttacaggagaattactgtcgtaatcccagaggcgaggaaggcggcccatggtgttttacctccaaccccgaggtccgctatgaggtgtgtgatattccgcagtgcagcgaggtggaatgtatgacatgcaacggcgaaagttatagaggtctgatggaccatacagagtctgggaaaatctgccaacggtgggatcatcagacaccacatcgccacaagtttctgcccgagaggtacccagataagggtttcgacgacaactattgccgaaaccctgatgggcagcctaggccctggtgttataccctggaccctcatactcggtgggagtattgtgcgatcaaaacatgcgctgataacaccatgaatgataccgatgtaccactggaaacaaccgaatgcatccaaggccagggcgagggatacagagggacagtaaacacgatctggaatggcatcccctgtcagcgatgggatagtcaatacccccacgagcacgacatgacccctgaaaactttaaatgtaaggacttgcgcgagaactactgtagaaaccccgatggaagtgaatccccttggtgcttcaccacagatccgaatatcagggttgggtattgctctcagatccctaattgtgacatgagccacgggcaggattgctaccgcggaaacgggaagaattacatgggcaatttgagccagactcggagcggactaacatgcagtatgtgggataagaacatggaagacctgcaccgtcatattttttgggaacctgacgccagcaaactgaatgagaactactgccgcaaccctgacgatgatgcccacgggccttggtgttatacaggaaaccccttaatcccgtgggactattgccccatttcaaggtgcgagggtgacactaccccaaccatcgtcaacctggatcaccccgtgatttcttgcgcaaaaacaaagcagctgagagtcgtgaacggtattcctactagaaccaatataggctggatggtctctctgcggtatcgcaacaaacacatatgtggaggttccctgatcaaggagtcctgggtccttaccgcacgtcagtgcttcccaagtcgcgaccttaaggattacgaggcatggctggggattcatgacgttcacgggaggggagacgaaaaatgtaagcaggtgcttaatgtgtcccagctggtctacggacctgaagggtctgatctggtgctgatgaaactggcccggcccgccgtcctggatgattttgtgagcaccattgatctgcctaactatggttgtactattccagagaagacatcatgttccgtgtatggctggggatataccggcttgattaactacgatggactgctccgcgtggcacatctctacataatggggaacgaaaagtgcagccagcatcaccggggcaaggtgaccctcaacgagtcagagatctgcgcaggagccgagaagatcggtagcggaccctgtgagggggattatgggggtcccctggtgtgcgaacagcacaagatgcggatggtcctgggagttattgtgccgggtcgtggttgcgccattcctaatagacctggtattttcgtacgcgttgcttattacgccaagtggattcacaaaataattctcacttacaaggtaccccagtcc

SEQ ID NO: 13616 - DNA, 2184 bp, Artificial Sequence
  Description of Artificial Sequence: Synthetic coding sequence
atgtgggtcaccaagctcctccctgcactgcttcttcaacatgtgctgcttcaccttctgcttctgccaatagcgatcccttacgcggaagggcagcggaaaaggaggaataccatccatgaattcaagaagtcagcaaagacgaccctcattaagattgaccccgcactgaagattaagactaagaaggtgaataccgccgaccagtgcgcaaaccgatgcactcgcaataaggggcttccttttacttgtaaggcttttgtgttcgacaaagcaaggaaacaatgcctctggtttcctttcaacagcatgtcctcgggcgtgaagaaggagtttggacacgagtttgatctctacgaaaacaaggactacattcggaattgtatcattggaaagggtaggtcgtataagggtaccgttagcatcactaagtctggaattaagtgtcagccttggtcctcgatgatcccacacgaacactcatttctgccatcaagctaccgtggaaaggaccttcaggagaactactgtaggaacccgcggggggaggagggtgggccatggtgttttacgtcgaaccctgaagtgcgttacgaggtttgcgatattccacagtgttccgaggttgagtgtatgacctgtaatggagagtcatacaggggcctcatggatcataccgaatcaggaaagatttgtcagcggtgggatcatcaaactcctcatcgccataagtttctgccggaaagataccccgataaagggtttgacgataactactgtcgcaaccctgatggccagccccgcccgtggtgctacacccttgatccacacaccagatgggaatactgcgcaattaagacttgtgccgataataccatgaacgacaccgatgtgcctcttgaaaccaccgaatgtatacaaggacaaggagaaggttacagaggtaccgtgaacacgatctggaacgggatcccttgtcagagatgggactcccagtaccctcacgagcatgatatgactcctgaaaactttaagtgcaaagaccttagagagaattactgtcgaaatcccgacggcagcgaatcaccctggtgctttacgaccgatcctaatatcagagtgggctattgttcgcaaatccccaactgtgatatgtcgcatggacaggattgctatcggggcaacggtaagaactacatgggaaatctgagccaaaccagatcaggacttacttgttcaatgtgggataagaacatggaggacctgcaccgacatatcttttgggagccagatgcatccaaactcaacgaaaactactgcaggaaccctgacgatgatgcacatggaccatggtgctacactggaaatccactcattccatgggattactgccctatttccaggtgtgagggggatactacccctactatcgtgaacctggaccaccccgtcatctcttgcgcaaagacgaagcaactgcgcgtcgtcaacggaattccaacccggactaacattggctggatggtgtccctgagataccgcaataaacatatctgtggaggtagcttgattaaggagtcgtgggtgctcactgcacgtcaatgcttcccctcgcgcgatctcaaagattacgaagcctggttgggaattcatgacgtgcacgggcgcggcgatgaaaaatgtaagcaagtgctcaacgtctcgcaacttgtctacggacctgaagggtcggaccttgtgcttatgaagctggcgcgccctgccgtccttgacgattttgtgtcaacgatcgacctgcctaattacggatgcaccattcctgaaaagaccagctgttcagtgtacggttggggttacaccggactgataaactacgacggacttttgcgggttgcacatctgtacattatgggtaacgaaaagtgtagtcaacatcatagaggaaaggtgactctgaacgaatccgaaatctgcgcaggagcagagaaaattggaagcggcccatgtgagggtgattatggaggacctctggtctgtgaacagcataagatgagaatggtgctgggcgtcattgtgccaggaagaggatgtgcaatccccaaccgtccaggaattttcgtgcgcgtggcttactatgccaaatggattcataagattatactcacctacaaggtgccccaaagc

SEQ ID NO: 13617 - DNA, 2184 bp, Artificial Sequence
  Description of Artificial Sequence: Synthetic coding sequence
atgtgggtgactaagctgctgccggctttactgttgcagcacgtgctcctccacctcctgctgttgcccatcgccattccgtacgctgaaggtcagagaaaacgacgaaacacaattcacgagttcaagaagagcgctaagacaaccttaatcaagattgatccggccctgaagattaagacaaaaaaggtcaatacggctgaccaatgtgccaaccgttgcacccgcaataagggcctgcccttcacgtgtaaggcattcgtcttcgacaaggcgcggaaacagtgcctgtggtttccatttaactctatgagtagcggcgtgaagaaggagtttggacacgagtttgacttgtacgagaacaaggactatatacgaaattgcattatcggcaagggtcgctcctacaaaggcacggtgtcgataacgaagtccggtattaaatgtcagccgtggtcctccatgataccccacgagcactcatttcttcccagctcatacagaggcaaggacctacaagagaactattgtcgcaaccctcgcggtgaggagggcggcccatggtgctttacgtctaaccccgaggtgcgctatgaggtatgcgatattccacagtgctcggaggtggagtgcatgacatgcaacggtgaatcctaccgcggactgatggaccacacggagtccgggaagatttgtcaacgttgggaccatcagaccccccaccgacataaattcctacccgagcgttatccagataaaggattcgatgataattattgcagaaatccagatggtcaaccacggccctggtgctacaccctggatccacacactcgttgggagtactgcgctataaaaacatgtgccgataacactatgaacgataccgacgtgcccctggagacaactgaatgcatccagggacagggcgagggttataggggcacagtcaataccatctggaacggcattccgtgccagcgctgggatagccagtatccacatgaacacgacatgacacccgaaaatttcaagtgcaaagatctgcgagagaattactgtaggaaccctgatggttcagagtcgccatggtgcttcaccactgaccccaatatccgtgttggctattgcagccagatccctaattgcgatatgagccacggccaggactgctatagaggaaacggcaagaactacatggggaatctgagccaaaccaggtccggactgacttgctccatgtgggataagaatatggaggatctacaccgccacatattctgggagcctgatgcgtccaagctcaacgagaattactgtcgtaaccccgatgacgatgcgcacggaccctggtgctacacgggtaacccactaatcccttgggattactgcccaatttccaggtgcgagggcgacaccaccccaacgattgtgaacctggaccaccccgtcattagctgtgccaagactaaacaactgcgggtcgtgaatgggattcctacccgcacgaatattggatggatggtttcgttacgttatagaaacaagcatatttgcggtggcagcctgattaaggaatcttgggttctgacggcccgacagtgcttcccgtcccgcgacctgaaggactatgaggcatggctgggcattcatgacgtgcatggtcggggcgatgaaaaatgcaagcaggtcctgaatgtgtcccagctggtgtacggaccggagggcagcgacttggtcctgatgaagctcgcgcgaccggcggtgctcgacgactttgtgtcgaccattgatctaccgaactatggatgcacgataccagagaagacatcgtgcagcgtatacggatggggctacacgggcctgattaattacgatggactgctgcgtgtcgcccatttgtacattatgggtaacgagaagtgttcccagcaccacaggggtaaggtcacgctcaatgaatctgagatatgcgctggcgctgagaaaatcgggagtggaccatgcgagggcgactatggtggcccccttgtgtgtgagcagcacaaaatgcggatggtcctcggtgttattgtaccaggccgcggctgcgctataccgaaccgcccgggaattttcgtcagggttgcatactacgccaagtggatccacaagatcattctgacatacaaggttccacagagc

SEQ ID NO: 13618 - DNA, 2184 bp, Artificial Sequence
  Description of Artificial Sequence: Synthetic coding sequence
atgtgggtcactaagctgctgccggcactcctgcttcaacatgtgctgctgcacctcttgttgctgccaatcgcgatcccttacgccgaagggcaacggaagcgacggaatactatccacgagttcaagaaatcagccaagactactctgatcaagattgatccagctctgaaaatcaagactaagaaggtgaacaccgcggaccaatgcgcgaataggtgcaccagaaataagggacttccgttcacctgcaaggcattcgtgttcgataaagcacgcaaacaatgcctgtggttcccatttaactctatgagcagtggggtcaagaaggagtttggccatgagttcgatctgtacgagaacaaggactacatcaggaactgtataatcggaaagggtcggtcctataaaggcactgtcagcatcactaaatcaggaattaagtgtcaaccttggtcgtcgatgattccgcatgaacatagctttctgccctcctcttataggggaaaggatctccaggaaaactactgtcgtaatccacgaggagaagaaggaggcccatggtgcttcacctccaacccggaagtgcggtacgaggtctgtgacatcccccaatgcagcgaagtggaatgtatgacttgcaacggagaatcttacaggggcctgatggaccacaccgaatccggcaagatctgtcagagatgggaccaccaaaccccacatcggcacaagttcttgccggaacgatatccagataagggtttcgatgacaactactgtcggaaccctgacggacaaccgcggccctggtgctacaccttggatccgcatacccgctgggaatactgcgctatcaaaacttgcgccgacaacaccatgaatgacaccgacgtgccactcgagacgacggaatgcatccagggacaaggagaaggataccgcggaaccgtcaataccatttggaacggaatcccatgccagcggtgggattctcagtacccgcacgaacacgacatgaccccagagaactttaagtgcaaggacctgagggagaactactgcaggaacccagatggatccgaatccccgtggtgcttcactactgaccctaacatacgggtcggatactgctcccagattccgaattgtgatatgtcgcatggccaggattgctacagaggcaacggaaaaaactacatgggaaatctctcgcaaactagatcaggactgacgtgtagcatgtgggacaagaacatggaagatttgcatcgtcacatcttttgggagccggacgctagcaaactgaatgagaattactgcagaaaccctgacgacgatgcccatggaccgtggtgctacactggaaacccgctcatcccatgggactactgtccgatctctcggtgcgagggagatactaccccgactatcgtgaacctggaccacccggtgatctcgtgtgcgaaaaccaaacagctgcgcgttgtgaatggaatccctacgcgcaccaatatcggatggatggtcagcctccggtaccgcaataagcacatctgtggcggaagccttatcaaggaatcgtgggtgctgacggcgaggcagtgtttcccgtcccgtgatttgaaggactacgaggcatggttgggtatccacgacgtccacgggcggggtgacgagaaatgcaaacaagtgttgaacgtgagccagctggtgtacggacccgagggatccgacctggttctgatgaaactggcgcggccagcagtgctggacgacttcgtgtcaactatcgacctgcctaactacgggtgcaccatcccggaaaagacttcgtgctcggtgtacggctggggatacacgggcctcataaactacgacggtctgcttcgggtggcgcacctctacatcatggggaatgagaagtgcagccagcatcacaggggaaaagtcactctcaatgaatcggagatctgcgcaggcgcggagaaaattggttcaggaccctgcgagggtgactacggaggccccttggtgtgcgaacaacataagatgcgcatggttctgggagtgatcgtgcccggccgcggctgtgctatcccgaacagacctggaatcttcgtccgcgtcgcttactacgccaagtggattcacaagatcatcctcacctacaaggtcccacagtcc

SEQ ID NO: 13619 - DNA, 2184 bp, Artificial Sequence
  Description of Artificial Sequence: Synthetic coding sequence
atgtgggtgaccaagctgctgcccgcactcttactgcagcacgtactcctgcacttgctgctgctgccaatcgctattccttatgccgagggacaacggaagcgacgaaataccattcatgaattcaaaaaatctgccaagacaaccctaattaagatcgatcccgcgctcaagattaaaactaaaaaagtgaacaccgcagaccagtgtgctaatcggtgcacccgcaacaaggggctgccatttacctgcaaggcgtttgtcttcgataaggcacggaaacagtgcctgtggttcccgttcaactcaatgtccagcggtgttaagaaggagttcggtcacgaatttgatctctatgagaataaggactacatacggaattgcattatcgggaaaggacgatcgtacaaagggaccgtgagcatcacaaagtccggaattaaatgccagccatggagctccatgattccacatgaacactcgtttctgccatcatcctacagaggcaaggatctgcaagagaattactgtcgcaaccccaggggcgaagagggaggcccttggtgcttcaccagtaatcccgaagtgaggtacgaagtgtgtgatatccctcagtgttcagaggtagaatgtatgacctgtaatggcgagagctaccggggactgatggaccacactgagtcaggtaagatttgtcaacgctgggaccaccagactccccacagacacaaattcttgccagagaggtatccggacaagggcttcgacgacaattactgccgcaaccctgatgggcagccacggccttggtgttatactcttgatccacacacccggtgggagtactgcgctattaagacctgtgcagacaatacaatgaacgacacagacgtcccccttgagacgacggaatgcattcagggacagggtgagggctatcgcggtaccgttaacactatttggaatggtattccttgccagaggtgggacagtcagtatccccacgaacacgatatgacaccggaaaacttcaagtgtaaagacctgcgcgaaaactactgtcgaaatccagatggcagcgagtccccttggtgcttcaccacggatcctaacattagggtggggtactgtagtcagatccccaactgtgatatgtcccacggtcaggactgttaccggggcaacgggaagaactatatggggaacctcagccaaacccggtcagggttgacctgctccatgtgggacaaaaacatggaggatttacatagacatatcttctgggagccagatgcctccaagcttaatgagaattactgtcgcaaccccgacgatgatgcccatggtccctggtgttacaccggcaatccgctgatcccctgggattactgccccatatcccgctgcgagggggataccactcctacaattgtaaacctcgatcaccccgttatcagttgtgccaaaacgaaacagctgcgtgttgtcaatggtattcccacgagaaccaatattggctggatggtctcccttcggtatcgtaataaacatatctgtggtgggtcactgataaaagaaagttgggtgctgacggctcgccagtgcttcccttccagagacctcaaagattacgaggcatggttagggattcatgatgtccatggaagaggcgacgagaaatgcaaacaagtactaaacgtaagtcaactcgtgtacgggcctgaaggcagcgacctcgtgctcatgaagctggccaggccagcggttttggacgactttgtatcaaccattgatctgccgaactacggctgcacaattccggagaagaccagttgcagcgtgtatggctggggatacacagggcttattaactacgatggcctattgcgggtcgcccatttatatataatgggcaacgagaagtgctcacagcaccaccgaggaaaggtgacgctcaacgagagcgaaatctgcgctggcgcggagaaaattgggagtggcccctgcgagggggactatggcggcccgctggtgtgtgaacagcacaagatgcggatggtgctgggagttatagtgcccggcaggggttgcgctatcccaaatcgtcctggtatttttgtcagggtggcctactacgccaagtggatacataagatcattttgacatataaggtcccccagtcg

SEQ ID NO: 13620 - DNA, 2184 bp, Artificial Sequence
  Description of Artificial Sequence: Synthetic coding sequence
atgtgggtcaccaaactcctgccagctctgctgctgcagcacgtgctactccacttgttgttactgcctattgccataccgtacgccgagggacagagaaagagacggaacactatccacgagtttaagaagagcgcaaagaccacgttgatcaagatcgatcctgcgctgaaaataaagaccaagaaagtcaatacggcagatcagtgcgcgaatcggtgcacccgcaacaaggggctgccatttacctgtaaggcctttgttttcgacaaggcaagaaagcagtgtttgtggtttccatttaattctatgtcatccggagtgaaaaaagaatttggacacgaatttgacctatacgaaaacaaggactacattcgcaactgcattatcggcaaggggcgtagctacaaagggacagttagtatcactaaatctggcattaaatgccagccgtggtcttcgatgattccgcacgaacactcgtttcttccaagcagttaccgcgggaaagacctccaggaaaactattgtcgtaacccgcgaggagaagagggagggccttggtgtttcaccagcaatccagaagtgaggtacgaagtgtgcgatatcccacagtgctcagaagttgagtgtatgacctgtaacggcgaatcctaccggggacttatggaccatacagagagcggaaagatctgtcagaggtgggatcatcagaccccacatcgtcacaagttcctaccggagcgctaccccgataaggggtttgacgacaattactgccgcaatcctgatggacagcctcgtccttggtgctacacgctcgaccctcataccagatgggagtactgcgccataaagacttgcgctgacaataccatgaatgacaccgatgtgccactagaaaccactgaatgcatccagggtcagggcgagggctacagaggtaccgtgaacacgatctggaacgggattccttgtcagagatgggatagtcagtatccccatgagcatgacatgacccccgaaaacttcaagtgtaaagatctgcgagaaaattattgccggaatccggacggaagcgaatctccgtggtgcttcacgacagatccgaatatccgggtcggctactgctcccagattcccaactgcgatatgtcacatgggcaagattgctatcgtggcaacggcaagaattatatgggtaatctgtcacaaacaagatctggcctgacatgcagcatgtgggataagaacatggaggacctgcaccgacacatcttttgggaacccgatgccagcaagctcaatgaaaattactgccgaaaccccgacgacgacgctcatgggccttggtgttataccgggaatcccctcatcccttgggactactgccctatttctagatgcgagggagacacaactccaaccatcgtaaacctggatcacccagtgatctcttgtgccaagactaagcaactgagggtcgtaaacggcattcctactcggaccaacatcggctggatggtgtctttacgctaccggaataaacacatatgcggaggctccctgatcaaagagagctgggtgctgacggcaaggcagtgctttccgtcgagggatcttaaagactacgaggcctggctgggaatacacgacgtacacggcagaggtgacgagaagtgcaaacaagtcctgaatgtatcccagctagtctatgggcccgaaggaagcgatctggtgctgatgaaactggcccgaccggctgtcctggacgactttgtatccaccatcgacctacccaattacggttgcactattccagaaaagacatcttgttccgtctatggctggggttatacaggtttgattaactacgacggacttctcagagtggctcatctttacatcatgggtaatgagaagtgtagtcagcaccatcggggcaaggttaccctgaacgagtccgaaatctgcgccggagccgagaagatcggaagcggcccctgtgaaggggactatggcggaccgctggtatgtgagcagcataagatgcgcatggtcctcggagtgattgtgccagggcggggctgtgccattcctaacagaccagggatctttgtgcgcgtggcgtattatgcgaagtggatacataagattatacttacctataaagtacctcagtca

SEQ ID NO: 13621 - DNA, 2184 bp, Artificial Sequence
  Description of Artificial Sequence: Synthetic coding sequence
atgtgggttacgaaactattaccggcgctattattacaacatgtattattacatttactactactaccgatagcgataccgtatgcggaaggtcaacgtaaacgacgtaatacgatacatgaatttaaaaaatcggcgaaaacgacgttaataaaaatagatccggcgttaaaaataaaaacgaaaaaagtaaatacggcggatcaatgtgcgaatcgttgtacgcgaaataaaggtttaccgtttacgtgtaaagcgtttgtatttgataaagcgcgaaaacaatgtttatggtttccgtttaattcgatgtcgtcgggtgttaaaaaagaatttggtcatgaatttgatttatatgaaaataaagattatatacgaaattgtataataggtaaaggtcgatcgtataaaggtacggtttcgataacgaaatcgggtataaaatgtcaaccgtggtcgtcgatgataccgcatgaacattcgtttctaccgtcgtcgtatcgtggtaaagatttacaagaaaattattgtcgtaatccgcgtggtgaagaaggtggtccgtggtgttttacgtcgaatccggaagtacgatatgaagtttgtgatataccgcaatgttcggaagtagaatgtatgacgtgtaatggtgaatcgtatcgtggtttaatggatcatacggaatcgggtaaaatatgtcaacgttgggatcatcaaacgccgcatcgtcataaatttctaccggaacgttatccggataaaggttttgatgataattattgtcgaaatccggatggtcaaccgcgtccgtggtgttatacgctagatccgcatacgcgttgggaatattgtgcgataaaaacgtgtgcggataatacgatgaatgatacggatgttccgctagaaacgacggaatgtatacaaggtcaaggtgaaggttatcgaggtacggtaaatacgatatggaatggtataccgtgtcaacgttgggattcgcaatatccgcatgaacatgatatgacgccggaaaattttaaatgtaaagatctacgtgaaaattattgtcgtaatccggatggttcggaatcgccgtggtgttttacgacggatccgaatatacgtgttggttattgttcgcaaataccgaattgtgatatgtcgcatggtcaagattgttatcgtggtaatggtaaaaattatatgggtaatctatcgcaaacgcgatcgggtctaacgtgttcgatgtgggataaaaatatggaagatctacatcgtcatatattttgggaaccggatgcgtcgaaattaaatgaaaattattgtcgaaatccggatgatgatgcgcatggtccgtggtgttatacgggtaatccgttaataccgtgggattattgtccgatatcgcgttgtgaaggtgatacgacgccgacgatagtaaatttagatcatccggtaatatcgtgtgcgaaaacgaaacaattacgtgtagttaatggtataccgacgcgtacgaatataggttggatggtatcgttacgttatcgtaataaacatatatgtggtggttcgttaataaaagaatcgtgggtattaacggcgcgtcaatgttttccgtcgcgagatttaaaagattatgaagcgtggttaggtatacatgatgtacatggtcgaggtgatgaaaaatgtaaacaagtattaaatgtttcgcaactagtttatggtccggaaggttcggatttagttctaatgaaattagcgcgtccggcggtattagatgattttgtatcgacgatagatttaccgaattatggttgtacgataccggaaaaaacgtcgtgttcggtatatggttggggttatacgggtttaataaattatgatggtctattacgagttgcgcatctatatataatgggtaatgaaaaatgttcgcaacatcatcgtggtaaagtaacgttaaatgaatcggaaatatgtgcgggtgcggaaaaaataggttcgggtccgtgtgaaggtgattatggtggtccgttagtatgtgaacaacataaaatgcgaatggtattaggtgttatagtaccgggtcgtggttgtgcgataccgaatcgaccgggtatatttgttcgtgttgcgtattatgcgaaatggatacataaaataatattaacgtataaagtaccgcaatcg

SEQ ID NO: 13622 - DNA, 2184 bp, Artificial Sequence
  Description of Artificial Sequence: Synthetic coding sequence
atgtgggtgactaagctgctgcccgccctgttactccagcacgttttacttcatttgctgctactgcccattgctattccctacgcagagggtcagcggaaaaggaggaataccatccatgaattcaaaaagtcggctaaaacaactctaataaaaattgatccggccctcaagattaaaaccaagaaggttaacaccgcggaccaatgtgctaacaggtgcaccaggaataaagggctgccgttcacctgcaaagcttttgtgttcgacaaagcccgcaaacaatgtctgtggttccccttcaactccatgagctccggggtgaaaaaggagtttgggcatgaattcgacctgtatgaaaataaagattacatccgtaattgcattataggaaagggacggagttataaggggactgtctcaattaccaaatccggcattaagtgccaaccttggtcaagcatgatccctcacgaacactcatttttgccgagttcttatagggggaaagatttacaggagaactactgtcggaacccaagaggagaagagggagggccttggtgtttcacctctaacccagaggtccgctacgaagtgtgtgatataccacaatgtagtgaagtggagtgtatgacatgtaatggggagtcctaccgcgggctgatggaccacacagaatcggggaagatttgccaacgttgggaccaccagacaccacacagacacaagttcctgcccgagagatatccggataaagggtttgacgataattattgccggaatcccgacgggcagccaagaccctggtgctatacgcttgatccacacacgagatgggagtattgcgccatcaaaacgtgcgctgacaatacaatgaacgacactgacgtaccactcgagacgaccgagtgcatccagggacagggcgagggctaccgtggcaccgtaaacaccatctggaatgggatcccctgccagaggtgggactcccagtacccccacgagcacgacatgacacccgagaattttaagtgcaaggacctaagggaaaactactgtcgaaaccccgacgggtccgagagcccatggtgttttacgaccgacccgaacattcgagtggggtactgctcccagatcccaaactgcgatatgtcccatggtcaggactgctaccgcggaaatggaaaaaactatatggggaatctttcgcagaccagaagcggcctaacatgtagcatgtgggataagaacatggaagacctacatagacacatcttttgggaaccagacgcaagtaagcttaacgaaaactattgccgaaaccctgatgatgacgcccacggcccctggtgctatacaggcaatcctctgatcccatgggactattgtcctatctctcgctgcgagggcgacacgactccaacaattgttaatctggaccaccccgtaatttcctgtgccaagaccaagcagctcagagttgtaaatggcataccaactcggactaatatcggatggatggtgagtttgagatatagaaacaaacacatatgtggcggttcactgataaaagaaagttgggtattgactgcacgccagtgttttccgtcccgagacctgaaagattacgaggcttggctggggatccatgatgtgcacggaaggggggacgagaagtgcaaacaagtgctgaatgtgtcgcagttggtgtacgggccagaggggtccgatctcgtgctgatgaagttggccagacccgccgtgctggacgacttcgtgagcacaatcgacctgcccaactatggctgcactattcccgagaaaacatcatgtagcgtctacggatggggatacacagggctgattaactacgatggcctgcttcgtgtagcccacctttatattatgggcaatgagaaatgcagccagcaccaccgcggcaaagtcaccctgaacgaaagcgagatatgcgcgggagcagaaaagattggctcgggtccttgcgaaggcgactacggcggtccactggtgtgcgagcaacacaagatgcgcatggtgctgggggtaattgtgccgggtcggggttgcgccattcctaacagacccgggattttcgtccgggtggcctactacgcaaaatggatccacaagattattctcacgtacaaagtccctcagagc

SEQ ID NO: 13623 - DNA, 2184 bp, Artificial Sequence
  Description of Artificial Sequence: Synthetic coding sequence
atgtgggtgaccaagcttttaccagcactccttctgcaacacgtacttctacacctcctcctcctccctattgctatcccctacgctgaagggcaacgcaagcggcgtaatactatccatgaattcaaaaaatctgccaagacgacactaattaagatcgacccagctttaaagatcaaaacgaagaaggttaacaccgctgatcagtgcgccaatcggtgtacacgtaataagggcctgccatttacttgcaaagcttttgtgttcgataaggcacgaaaacagtgcctgtggttcccattcaacagcatgtcttctggggtaaaaaaggaattcggccacgaatttgacctgtacgaaaacaaagattatattagaaattgtattatcggaaagggcagaagctataaaggaaccgtgtcaatcacgaaatcagggatcaagtgtcagccttggtcttccatgatcccacatgagcactcgttcctaccttcctcctaccggggtaaggatttacaggagaattattgtcgtaatccaaggggtgaagagggcgggccctggtgtttcacaagtaatccggaggtgcgctacgaggtctgtgacatcccccagtgcagcgaagttgagtgcatgacttgcaatggcgagtcatatcgggggctcatggaccacaccgaatccggcaagatctgtcagagatgggaccatcagacgccacaccggcacaagttccttcctgaacgctatcccgataagggattcgacgataattactgtagaaatcctgatggccagccgagaccctggtgctatacactggacccacacacgaggtgggagtactgcgccataaaaacgtgcgcagacaatactatgaacgataccgacgtaccacttgagaccactgaatgtattcaggggcagggcgagggctataggggcacggtcaacaccatttggaacggcataccttgccaaagatgggatagccagtacccacacgaacacgatatgacccctgagaacttcaagtgcaaagatctgagggaaaactattgccgcaatcctgatggctccgagtcgccttggtgcttcaccacagatccaaatatccgtgtggggtattgcagccagattcccaattgcgatatgtcccatggccaggattgctacagaggaaatggcaagaattatatgggcaacctgtcacagacccggagtggcctgacctgttcgatgtgggataaaaatatggaagacttgcatcggcacattttctgggaacccgacgcctctaaactgaatgagaactactgtcgcaaccccgatgacgatgcccatggaccctggtgttacactggcaatcctctgattccctgggactactgccccatcagcagatgtgaaggagacaccactcccactatcgtcaacctggaccacccagtgatcagctgtgccaaaaccaagcagctgagggtggttaacggcattcccactcggacaaacataggctggatggtgagcctgcgctaccgcaacaaacatatctgcgggggttccctgattaaggagtcctgggtgctgacagcccggcagtgtttcccctcacgagacctcaaagattacgaagcatggctgggtatccacgatgtacacgggaggggcgatgagaagtgtaagcaggtactgaacgtgagtcaactggtttatggccccgaaggctccgatctcgtgcttatgaagctggctagacccgctgtgctggatgacttcgtgtctacaatagacttgccaaactatggctgtacaatacccgagaagacttcctgttctgtctatggttggggatacaccgggttgattaactatgacgggctgttgcgagtggcccacctgtacattatgggcaatgaaaaatgtagtcagcatcatcgcggcaaggtaacactcaatgaatctgaaatctgcgctggcgccgagaagattgggtctggcccttgcgagggtgactacgggggcccgctagtgtgtgagcagcacaaaatgagaatggtcttgggggtaattgtgcccgggcgcggttgcgccatccccaacagaccgggtatctttgttcgcgtggcctattacgcgaaatggattcacaagatcatccttacatataaggtgcctcagtct

SEQ ID NO: 13624 - DNA, 2184 bp, Artificial Sequence
  Description of Artificial Sequence: Synthetic coding sequence
atgtgggtcaccaaacttctgccggctctcctgctgcagcatgttctgctccacttgttgctccttccaatcgccatcccatatgcagaagggcaacgtaaacgtcgaaacaccattcacgaattcaagaagtcggcaaaaacgaccctgatcaagatagatcctgcccttaagatcaagaccaagaaggtcaacactgcagatcaatgtgcgaaccggtgtacccgaaacaagggacttcctttcacctgtaaggcctttgtgtttgacaaggcgcgtaagcagtgtctctggtttcccttcaattccatgtcctctggagtaaagaaagaatttggtcatgagtttgatctgtacgagaataaggactacattcgtaattgcatcatcggaaagggtcggtcgtacaaaggcaccgtgtcaataactaagagcggaattaagtgtcaaccatggtcatcgatgatacctcatgagcactctttccttccctcgtcctaccggggcaaggaccttcaggaaaactactgccggaatccacgaggggaagagggtggaccctggtgtttcacctctaacccagaagtcagatacgaagtgtgcgatattcctcagtgtagcgaagtcgaatgcatgacttgtaacggagaaagctacagaggtctgatggaccatactgaatcagggaagatttgtcagcgttgggaccaccagacccctcaccgacacaaattcctccctgaaaggtaccctgataaaggttttgacgacaattactgcaggaatccagatggacaacctagaccttggtgttacacccttgacccccacactaggtgggagtactgcgcaattaagacctgcgccgacaatacgatgaacgacaccgatgtgcctctggagactactgagtgtatccaaggacaaggagagggatataggggaaccgtgaacaccatttggaacggtattccttgtcaacggtgggactcccaatacccccatgaacatgatatgacccccgaaaactttaagtgtaaggacctgcgcgaaaactactgtcggaacccagatggttccgaatccccttggtgctttactactgatcccaatattcgagtggggtattgttcacaaatcccgaactgcgatatgagccatggacaagactgttaccggggtaatggaaaaaactatatggggaaccttagccagacccgtagcggactgacgtgttcgatgtgggacaaaaacatggaagatcttcatcgccacattttctgggaaccagacgcgtctaaactcaacgagaactactgtagaaaccctgatgatgatgcgcacggaccatggtgctacactggaaacccactcattccatgggattactgccccatttctcgctgtgaaggagacactaccccgactattgtcaacctggatcatcccgtgatttcctgtgccaaaaccaagcaactgcgggtcgtcaacggtatcccaactcgcactaacatcggatggatggtgtcgctgcgataccgcaataaacacatctgcggcgggagtcttatcaaggaatcatgggtgcttaccgcacggcaatgtttcccctcacgtgatcttaaggactacgaggcttggctgggaatccatgatgtgcacggcaggggggatgagaagtgtaagcaagttctgaacgtctcacagcttgtgtacggcccagaaggatccgatctggtcctcatgaagctggcaagacctgcggttctggacgactttgtttccaccattgatcttcccaactacggatgtaccattcctgagaaaacgtcatgctcggtgtacgggtgggggtacactggcctgataaactacgacgggcttctgcgagtcgcacatctttacatcatgggaaatgaaaagtgttcgcaacaccataggggcaaggtgacgctgaatgaatcagagatatgtgcgggcgcagagaaaattggttcaggaccctgtgaaggtgattacggaggcccgctggtgtgtgaacagcacaagatgcggatggtgctcggtgtcattgtcccaggacggggatgcgcaattcctaatagacctgggatatttgtgcgggtggcttattacgcaaaatggattcataagattatcctcacttataaggtgccacagagc

SEQ ID NO: 13625 - DNA, 2184 bp, Artificial Sequence
  Description of Artificial Sequence: Synthetic coding sequence
atgtgggtgacaaagcttctccccgctcttctgttgcaacacgttttgctgcacctcctactcctgcctattgctatcccctatgctgagggacagcgcaaaaggcggaacaccatacacgagtttaaaaagtccgccaaaaccaccctgataaagatcgatcccgcgctcaagatcaaaactaaaaaggtgaatacggccgatcagtgtgctaatcggtgcactaggaataaggggttaccgtttacatgcaaggcattcgtctttgataaggccaggaagcagtgtctgtggttcccgttcaactcgatgagctctggggtaaagaaggagttcggccatgaattcgacctctatgagaacaaggactacatcagaaattgtatcattgggaaagggaggtcctataagggcacagtctcgatcacaaaatcaggcattaagtgccagccatggtccagcatgattccacacgagcacagctttcttccctcttcctacagaggcaaagacctgcaggaaaattattgtcgcaacccccgcggggaggaaggaggaccatggtgtttcacgtcaaatccggaggtcagatacgaggtgtgcgatatcccccagtgtagtgaggtcgagtgtatgacctgtaacggagaaagttataggggactgatggatcataccgaatctgggaagatttgtcagaggtgggatcaccagacaccacataggcacaaattcttacctgaaagataccccgataaaggttttgatgataattattgtaggaacccggacgggcagccccgtccctggtgttatactttagatccccacacccggtgggaatactgcgctatcaagacctgtgccgataataccatgaatgacactgatgttcctctggagactacagagtgcatacaggggcagggcgaggggtacaggggaactgttaacaccatttggaatggcataccctgtcagagatgggattcccaatatccccacgagcacgacatgacacctgagaactttaagtgcaaggacctgagagaaaactactgtagaaaccctgacggctcggagtctccatggtgctttaccaccgaccccaacattcgggtaggttactgtagccagattccaaactgtgatatgtcccacgggcaggattgctaccggggaaacgggaagaactatatgggcaatttgagccagacacgctctgggctgacctgctctatgtgggacaaaaacatggaggatctccatagacatatcttctgggagcctgacgctagcaagttgaatgaaaactactgccgcaatccagacgatgatgcacatggcccatggtgctatactggcaatcctctcattccttgggattattgtccgatttcgcgctgcgaaggtgacacaacaccaaccatcgtcaatcttgatcaccctgtcattagttgcgcgaaaactaaacaactccgagtggtcaatgggattcccacgcgaacgaatattgggtggatggtgtctctacggtaccgtaataagcacatctgcgggggcagcctgatcaaggaatcttgggttcttaccgctaggcagtgtttcccctcccgtgacttaaaggactacgaagcatggctgggaatacatgacgtgcacggtcgtggggatgagaaatgtaagcaggtgcttaacgtgtcccagcttgtctacggccctgagggatcagacctggttctgatgaagttagcccgacctgctgttctggatgactttgtttctactattgatctgcccaactacgggtgcacaatacctgagaagaccagctgttccgtatacgggtgggggtacacaggcttgattaactatgatgggctgctccgagttgctcacctctatattatggggaacgagaagtgctcccagcaccaccgtggtaaggtgactctcaatgagagcgaaatttgtgctggcgctgaaaagattggttccggcccctgcgagggagattacggcgggccgctggtctgcgagcaacacaagatgcgcatggtactcggggtcattgtcccgggccgcggttgtgccatccctaataggcccggcattttcgtgagagtcgcctattatgccaaatggattcataagatcatcttaacgtataaagtgccacaatcc

SEQ ID NO: 13626 - DNA, 2184 bp, Artificial Sequence
  Description of Artificial Sequence: Synthetic coding sequence
atgtgggtaactaagctcctcccagcactgctcttgcagcatgtgcttctgcacttgctcctgctcccaatcgcgataccatacgctgaaggccaacggaagagaaggaacaccatccatgaattcaagaaatcggcgaagaccactctgattaagatcgacccggcactgaagataaagactaagaaagtgaacaccgctgatcaatgtgccaaccgctgcacccgcaacaagggcctccctttcacttgcaaggcttttgttttcgacaaagcccgtaagcagtgcctgtggttcccgttcaattccatgtcatctggagtgaagaaggagtttgggcatgaattcgacctgtacgagaataaggactacattagaaactgtataatcggcaagggacgatcgtacaaaggaactgtgtcaattactaagtcggggatcaagtgccagccatggtcctcaatgattccgcacgagcacagctttctcccgtcaagctaccggggcaaggatctgcaagagaactattgtaggaacccccggggcgaagagggaggtccgtggtgcttcacctcaaacccagaggtgagatacgaagtctgtgacatcccgcaatgtagcgaggtggaatgcatgacctgcaatggagagtcctatcggggactcatggaccacaccgaatcaggcaagatttgccagcggtgggatcatcagaccccacaccgccacaagttcctgccagaacgatacccggataaggggttcgacgacaattactgccgcaaccctgatggacagcctcgcccgtggtgttacaccctggacccacatactcgctgggagtactgcgccatcaagacctgcgccgataatacgatgaacgataccgacgtgccgcttgaaaccaccgaatgtatccaggggcagggagagggatacaggggcactgtgaatactatctggaatggcatcccatgccagagatgggactcgcagtatccgcacgaacatgacatgaccccggaaaactttaagtgtaaagacctgagagaaaactattgtcggaacccagatggctcggagtcaccatggtgcttcactaccgacccgaacatccgcgtcggttattgttcgcagattcctaactgcgacatgtcccacggacaggattgctacaggggaaacgggaaaaactacatggggaacctgtcccagaccaggtctgggctgacttgctcaatgtgggacaagaacatggaagacctgcatcgccacatcttctgggaaccggacgcaagcaaactgaatgagaactactgtagaaaccccgacgatgatgctcacgggccgtggtgctacaccgggaaccctcttattccttgggactactgtccgatctcacggtgtgagggagacacgacccctaccatcgtgaatcttgatcacccagtcatttcgtgcgctaaaacgaaacaactgcgggtcgtgaatgggatcccaacccgcactaacatcggttggatggtcagcctgcgctaccgtaacaagcacatctgcggtggctcgctcatcaaagagagttgggtgctgaccgcccgccagtgttttccctcccgggatctgaaagattacgaggcatggttgggaatccatgacgtgcacggacggggagatgagaaatgcaagcaggtgctgaatgtgtcacaactggtgtacggaccagagggatcggatctggttctgatgaagctggcgcgccctgcggtgcttgacgacttcgtcagcacgattgacctcccaaactacggatgcacgatcccagaaaaaacttcatgttccgtgtatgggtggggatacactgggttgatcaattacgacggactgctgagagtggctcacctctacattatgggcaacgagaagtgttcgcaacatcacagaggaaaagtcactctgaatgaatccgagatctgtgccggtgccgagaagattggaagcgggccgtgcgagggagactacggagggcctctcgtgtgcgagcagcacaaaatgcggatggtgttgggtgtcatcgtccctggacggggctgcgcaatcccgaaccggccgggaattttcgtgcgggtggcctattacgcgaagtggatccacaagattattctcacttacaaggtgccacagtcc

SEQ ID NO: 13627 - DNA, 2184 bp, Artificial Sequence
  Description of Artificial Sequence: Synthetic coding sequence
atgtgggttaccaagctgctgccagccctgctgcttcagcacgtcctcctgcatctcctgctgctgcctattgccatcccatacgcggagggacaaagaaagcgcaggaacaccatccacgagttcaaaaagagcgctaaaaccactctcatcaagatcgacccggcgctcaaaatcaagaccaagaaagtgaatactgccgaccagtgcgccaatcgatgcactcgcaacaagggtttgccattcacttgtaaggcgttcgtgttcgataaggcccggaagcagtgcctttggttccccttcaactcgatgagctccggggtcaagaaggagttcggccatgagttcgacctctacgagaataaggactatatccgtaattgtatcattggaaagggaagaagctacaagggcacggtgagcatcaccaagtccgggatcaagtgccagccgtggtcgtcgatgattccgcacgaacattcatttcttccttcatcataccgcgggaaagacctgcaagaaaactactgccggaacccacgcggagaagagggagggccttggtgcttcacctcgaacccagaagtccggtacgaggtgtgtgacattcctcaatgctcagaggtagaatgcatgacctgcaatggcgagtcttacagaggactgatggatcacacggaatcaggcaagatctgccaacggtgggaccaccagactccgcaccgccacaagttcttgcccgagaggtatccggacaagggattcgacgataactactgtcgcaatcctgatggacagccacgcccttggtgttacaccttggatccgcacactcgctgggaatactgcgcgatcaagacctgcgccgacaatactatgaacgacactgacgtgccgctggaaacgaccgagtgtatccaaggccagggagaagggtacagaggaacggtgaacactatctggaacgggattccatgtcagagatgggatagccagtacccccacgagcatgacatgaccccggagaacttcaagtgtaaagacttgcgcgaaaactactgtagaaatcctgacggctccgagtcgccgtggtgctttactactgatccaaacattagggtggggtactgctcgcaaatcccaaactgcgatatgtcacacggtcaagactgctatcgcggaaacggaaagaactacatgggcaacctcagccagacccggagcggcctcacctgctctatgtgggacaagaatatggaggacctccaccggcatatcttctgggagccggacgcctcgaagttgaacgaaaactattgtcggaacccagacgacgatgcccacgggccatggtgttacactggaaaccctctgataccatgggactactgcccgatctcacggtgcgagggagataccacgccgaccatcgtcaatctggaccatccggtgatctcgtgcgccaagaccaagcagttgcgggtggtgaacggcatccccactaggactaacattggatggatggtcagcctgcgttacaggaataaacacatctgcgggggcagcctgatcaaggagtcatgggtgctgaccgcgcgccaatgttttccgtccagggacctgaaagactacgaggcatggctcggaatccacgacgtgcatggaaggggagacgaaaagtgcaaacaagtgctgaacgtgtcccaattggtgtatgggccagaaggatctgatctggtgctcatgaaactggccagaccggcagtgctggacgacttcgtcagcactattgaccttccgaattacggctgcacgatcccagagaaaacctcatgttcggtgtacgggtggggctacaccggactgattaactacgacggtctgctgagagtggcacatctgtacattatgggaaacgagaaatgctcgcaacatcaccggggaaaggtcactctgaacgaatccgaaatctgcgcgggggcggagaagatcggttccggaccttgcgaaggcgattacggcggaccactcgtgtgtgaacagcataagatgagaatggtcctgggagtcatcgtgccggggcggggttgtgcaatccctaataggccaggaattttcgtccgggtggcctactacgctaagtggattcacaaaatcattctgacctacaaagtgccccagtcg

SEQ ID NO: 13628 - DNA, 2184 bp, Artificial Sequence
  Description of Artificial Sequence: Synthetic coding sequence
atgtgggtgaccaagctgctccctgccctgctgcttcagcacgtgctccttcatctgcttctgcttcccattgcaattccttacgcagagggacaacgaaaaaggcggaacaccattcacgaattcaagaagtcggcaaagaccaccctcattaagatcgatccagcacttaagatcaagaccaagaaggtcaatactgcagatcaatgtgccaaccggtgtactagaaacaagggccttcctttcacttgcaaggcatttgtgtttgacaaggctcgcaaacagtgcttgtggtttccatttaacagcatgtcgagcggagtcaaaaaggagtttggacatgagtttgatctttatgagaacaaagattacattagaaattgcattattggcaagggtaggtcgtacaagggcaccgtgtcgatcacgaaatcaggcattaagtgccaaccctggagctccatgattccacacgaacactcctttttgccctcctcctaccgagggaaagacctgcaagaaaactactgcagaaaccctcgcggtgaagagggtggcccgtggtgttttacgtccaacccagaagtgcgatacgaagtgtgtgatattcctcaatgttcggaagtggaatgcatgacctgcaatggggaatcctacagagggttgatggaccataccgaatcggggaagatttgccaacggtgggaccatcagacccctcatcgccataagttcttgcccgaaagatacccagataaaggtttcgatgataactattgccgcaatccagatggtcaacctcgaccttggtgctacacccttgatcctcataccagatgggagtactgcgccataaagacctgtgctgataacactatgaatgataccgatgtgcctctggagactactgaatgtattcagggacaaggcgagggctaccggggtactgtgaacaccatttggaatgggataccctgtcagcgttgggattcccagtacccccatgaacacgacatgactccggagaatttcaaatgtaaggacctcagggagaactattgccgaaacccagacggctccgaatcaccttggtgctttactacggaccctaatatcagagtgggttactgtagccaaataccgaattgtgacatgtcgcatggacaggattgctatcgggggaacggaaaaaactacatgggcaatttgtctcaaactcgctcgggacttacgtgctcgatgtgggataagaacatggaagatctgcatcgtcatatcttctgggaacctgatgccagcaaacttaacgagaattactgccgcaatcctgatgacgacgcccacggaccctggtgttacactggtaaccctttgatcccatgggactactgtcctatctcgaggtgtgagggcgatactactcctactattgtgaatctcgaccaccctgtgatctcgtgtgcaaagactaagcaactgcgcgtggtcaacggaattccgacccgaactaacatagggtggatggtttctctgcgctataggaacaagcatatctgtgggggatcgctcattaaggaatcctgggtgctcactgcaaggcaatgctttccatctcgggacttgaaagattatgaggcgtggcttggtattcacgatgttcatggacgcggcgatgaaaagtgtaagcaagtgctgaacgtctcgcaacttgtctacggtccagaaggatccgacctcgttcttatgaaactggcaagaccggctgtgctggacgattttgtgagcactattgatctgcccaactacggatgtactatccccgagaaaaccagctgttcggtgtacggttggggatacactggactcatcaactacgatggacttctccgcgttgcacatctgtacattatgggaaatgagaagtgtagtcaacatcacagaggtaaggtgactttgaatgaaagcgaaatatgtgccggagcagagaagattggttccggcccatgcgaaggagactacggcggcccactggtctgtgaacagcacaagatgagaatggtgctcggtgtcatagttccaggaagaggatgtgcgattcccaatcgaccagggattttcgtcagagtggcttactacgcaaagtggatccataagatcatactgacctacaaggtccctcaatcg

SEQ ID NO: 13629 - DNA, 2184 bp, Artificial Sequence
  Description of Artificial Sequence: Synthetic coding sequence
atgtgggtgaccaagttgctaccggcgctgcttttgcaacacgtcctcctacacctcctgctcctacctatcgcgataccgtatgccgaagggcaacgcaaaaggcgcaataccatacatgaatttaagaagtccgctaaaacaacgcttatcaagatagatccggccctcaaaatcaagactaagaaagtcaatacggctgaccagtgcgccaatcggtgtacgcgtaataaaggcctcccctttacatgcaaggcatttgtgttcgataaggctcgtaaacagtgcctgtggttccctttcaacagtatgtcgtccggagttaagaaagagttcggccatgaatttgacctatacgaaaacaaggattacatccgcaactgcattatcgggaaaggtcgaagctataaaggcacggtctcgattacaaagtccgggattaagtgccaaccatggtcctctatgattccgcatgaacactcgtttttgccttcttcttacagagggaaggatctccaggaaaactactgtcgaaaccctcgtggcgaggagggtggcccctggtgcttcacgtcgaaccccgaagtgcggtatgaagtatgcgacatcccacagtgctccgaggtcgagtgcatgacctgtaacggtgaatcctatcgtggtcttatggaccacacagagagtgggaaaatttgtcaacgctgggatcatcagacaccacaccgtcacaagtttctgcccgaaagatatcccgataagggcttcgatgataactattgccggaacccagatggccaacctcgcccatggtgctatactctggaccctcatacacggtgggagtactgcgccatcaagacctgcgctgacaacacaatgaacgacacagatgttcccctcgaaaccacagagtgtattcagggtcagggagagggctatcggggtacggtcaatacgatctggaacggaatcccctgccagaggtgggactcacagtaccctcatgaacacgatatgacacccgaaaactttaagtgtaaggatttgcgagagaactattgtcgaaatcctgatggcagtgagtccccatggtgctttactacggaccctaatatacgtgtcggatactgcagtcagatccctaactgtgatatgtctcatggacaggattgttatcgcgggaacggtaaaaattatatggggaacctgtcgcaaacacgatccggcttgacctgtagcatgtgggataagaatatggaggatctgcaccgacacatattctgggaacctgatgctagtaagttaaatgaaaattactgtcggaacccagatgacgacgctcacggtccgtggtgctatacaggaaacccccttatcccttgggactattgtcccatctctcgttgtgagggtgataccaccccaactatcgttaatctagatcatcccgtcatatcctgcgctaagaccaaacaattgagggtggttaacggaataccaacgaggacaaacattggttggatggtgtccctgcgatatagaaataaacacatttgtgggggttctctgattaaggagtcgtgggtacttaccgcgcgccagtgctttccgtcccgagacttgaaggactacgaggcctggctcggaattcatgatgtgcatggtcgcggggacgaaaaatgtaaacaagtccttaacgtttcgcagctcgtgtatggccccgaaggttcggacttggtgctgatgaagcttgcgagacctgctgtactagatgatttcgtgtctaccatagacttgccgaactatggctgcactatccccgagaagacctcttgtagcgtttacggttggggctatacgggattgataaactacgacggtctgcttagagtggcgcacctctacatcatggggaatgagaagtgctcacagcatcaccgaggcaaggtcactctcaacgagagcgaaatctgcgccggcgctgaaaagattggaagtggcccctgtgaaggagactacggtggcccgttggtttgcgagcaacataagatgcgtatggtccttggggttattgttcccggtcggggttgcgcgatcccaaaccgccctggcatctttgttcgcgtcgcctactacgctaagtggatccataaaatcatcctaacctataaagtcccgcaatct

SEQ ID NO: 13630 - DNA, 2184 bp, Artificial Sequence
  Description of Artificial Sequence: Synthetic coding sequence
atgtgggtaaccaaactgcttcctgcactgctgctgcaacatgtgctcctgcatctgctcctgcttcctatcgcaatcccatacgctgagggacaaaggaagcgcagaaataccattcacgaattcaagaaatccgcgaaaacaacactcatcaaaatcgatccagctcttaagattaagaccaaaaaggtcaacaccgcggaccagtgcgctaacagatgcacaaggaacaaaggattgccatttacctgcaaagcttttgtctttgacaaggcgaggaaacaatgtttgtggttcccttttaacagtatgtcatcaggcgttaaaaaagagttcggccatgaatttgatctgtacgaaaacaaggactacatcaggaactgtatcataggtaagggcaggtcttataaagggacagtctctatcacaaagagtggcattaagtgtcagccgtggagcagcatgatcccgcacgagcatagttttctgccctccagttatcgcggcaaggatctgcaggaaaattactgccgtaatccacggggagaagaaggaggtccttggtgtttcacctctaacccagaggtcaggtatgaagtttgcgacatcccccagtgctcagaagttgagtgcatgacctgcaacggtgagagctaccgcgggctgatggatcacacagagtctggaaagatctgccagcgctgggaccaccaaactccacatcgccacaaatttctgccggaacgttatcccgataagggatttgacgataactattgcaggaacccagatggtcagcccaggccatggtgttacaccctggatccgcacaccaggtgggagtactgtgccataaaaacatgcgctgataacaccatgaatgataccgatgtgcctctcgaaaccaccgaatgtatacaaggccagggcgagggctacaggggaacagtgaacactatttggaatggaatcccctgccagcgttgggattctcagtacccccacgagcacgacatgacacccgagaactttaagtgcaaagacctgcgcgaaaattactgcaggaacccagacggttccgagtctccctggtgcttcaccacagacccgaacattagagtgggctattgttctcagattccaaattgcgatatgagccacggacaagattgctacaggggaaatgggaaaaactacatgggcaacctgtcccagactcgaagcggcctaacgtgcagcatgtgggataaaaacatggaagatcttcacagacacattttttgggagccagatgcatctaaactgaatgaaaactactgcagaaaccctgatgatgatgcccatggcccatggtgttacaccggcaaccctttgattccttgggactattgcccgatcagcagatgcgaaggagataccacccccaccattgtgaacttagaccatcctgtgatctcatgcgccaaaaccaaacaattgagggtggttaacggaatccctacccgcactaacataggctggatggtcagtcttaggtaccgcaataaacatatatgtgggggcagtctcattaaggaaagttgggttctcacagctagacaatgttttcctagccgtgaccttaaagattatgaagcttggctgggaatccatgacgtgcatggtagaggagacgagaaatgcaagcaggtgcttaacgtgagccagctcgtatacggtcctgaaggctctgatctcgtactgatgaaactggccaggccagcagttcttgatgactttgtgagtacaatagacctgccgaactacggctgcacaattcctgaaaaaacatcgtgttctgtgtacggatggggttacaccggactgattaattacgatgggttgctccgcgtggcacacctgtacattatggggaacgaaaaatgttcccaacaccacagagggaaggtgaccctgaacgagtctgagatttgcgctggagcagaaaagattgggagcggaccttgcgaaggggattatggaggtcccttagtgtgtgaacagcataaaatgcgcatggttctgggagtaatcgtgccaggccgaggctgcgctatccccaaccggccaggtatcttcgtaagggtcgcttattatgcgaaatggattcataagattatactcacatacaaagtgccacagagc

SEQ ID NO: 13631 - DNA, 2184 bp, Artificial Sequence
  Description of Artificial Sequence: Synthetic coding sequence
atgtgggtgaccaagctgctccccgcgctcctgctccagcatgtgctgcttcaccttctgctgttgccgattgctatcccgtacgccgaaggccaacgcaagcgccgcaacactatccacgagtttaagaagtcggcaaagaccactctcatcaagattgaccctgccctgaaaatcaaaacgaagaaagttaacactgcagaccaatgcgctaatcgctgcacccgcaataagggcctgccatttacctgcaaggcgttcgtgttcgataaggcccgtaaacagtgtctgtggttcccgttcaattcaatgtcatccggagtcaagaaggagtttggacacgaatttgacctttacgagaataaggactacattcgcaattgcatcattggtaaagggagatcttacaagggaacggtgtccattactaaatcgggaattaagtgccagccgtggtcgagcatgatcccgcatgagcactcattcctgccttctagctacagaggaaaagatctgcaggaaaattattgccgcaacccgaggggtgaagaaggagggccttggtgtttcacgtcgaaccctgaagtgcgctacgaagtgtgcgacatcccccaatgctcagaggtcgaatgcatgacctgcaacggagagtcgtacagaggactgatggaccataccgagtcgggcaagatctgccagaggtgggaccaccagactccgcacagacacaagttcttgccagaacggtacccagataagggattcgatgacaattactgtcgcaatcctgatggtcaacctcggccgtggtgctatacgctggaccctcatactcggtgggaatactgcgcaatcaagacttgcgctgacaacaccatgaatgacactgacgtgccgttggagactactgagtgcatccagggccaaggagaaggataccgcggaactgtgaacaccatctggaacggaataccgtgccaacgctgggacagccagtacccccatgaacacgatatgaccccggagaacttcaagtgcaaagacctgcgggagaactactgccggaacccggacggatcagaatcgccctggtgcttcaccaccgatccaaatatcagagtcggatactgttcccagatcccaaactgcgatatgagtcacggccaggattgttacagaggcaacggaaagaattacatggggaacttgtcgcaaacccgaagcggtctgacctgtagcatgtgggataaaaatatggaagatctccacaggcacatcttctgggaaccggatgcctccaaactcaatgaaaactactgcaggaatccggatgatgacgcccacgggccctggtgttacaccggaaacccgctgatcccttgggattactgcccgatatccagatgcgaaggcgacaccaccccaactatcgtgaacctggaccatccagtgatctcctgtgccaaaaccaaacagctgcgcgtggttaacggcatcccaactagaaccaacatcgggtggatggtgtcccttcggtacagaaacaagcatatctgcggcggcagcctgattaaggaaagctgggtcctgaccgctcggcagtgctttccatcgcgggacctgaaggactacgaggcgtggctggggatccacgacgtgcatggacggggagacgaaaagtgtaagcaggtcctgaacgtgtcccagttggtgtacggaccagagggaagcgacctggtgctgatgaagctcgcccgcccagcagtcctcgacgatttcgtgtcaactatcgatttgcccaactatggctgtactatcccggagaaaacctcgtgctccgtctacgggtggggatacactgggctcatcaattacgacggtctgcttcgggtggcgcacctctacatcatgggaaacgagaagtgctcgcaacaccatcgcggaaaggtcactctcaacgagagcgaaatctgcgcaggtgccgaaaagatcggctcaggtccctgcgagggagactacggaggaccactcgtgtgtgagcaacacaagatgcggatggtgctcggtgtcatcgtgccgggaaggggctgtgcgattcctaaccggccggggatcttcgtgcgagtcgcctactatgcgaagtggatccataaaatcatcctcacgtacaaagtcccgcagtcc

SEQ ID NO: 13632 - DNA, 2184 bp, Artificial Sequence
  Description of Artificial Sequence: Synthetic coding sequence
atgtgggttaccaagctgctacccgccctcctgctacagcacgtgctcttgcatctgttactgctgccgatagcaattccctatgccgaaggccagcgcaagagaagaaacacaatccacgagtttaagaaatcagccaagaccaccctaataaagattgacccagctctcaagattaaaacaaaaaaagtgaatacagccgaccagtgcgccaacagatgtactaggaataagggtctgcccttcacttgtaaagccttcgtctttgataaagcccggaaacagtgcctgtggtttccctttaatagtatgagcagtggagtaaaaaaggaattcgggcacgaatttgatctgtatgagaacaaggactatattcgtaattgcatcatcggcaagggccgctcctataagggaaccgtttccataacgaagtccggcatcaagtgtcagccctggtccagcatgatcccccacgagcacagttttcttccttccagctaccggggcaaggatctgcaggaaaattactgtagaaaccccaggggggaggagggtggcccttggtgctttacaagtaacccggaagtaaggtatgaggtctgtgacattccacagtgctcggaggtggaatgcatgacgtgtaacggagagtcctatagaggcttaatggaccacacggagtccggcaagatttgccagagatgggaccaccagacaccccacaggcacaagttcctccccgaacgctaccccgacaaaggtttcgatgacaattattgccgcaatcctgatggccaaccgcgcccttggtgctacacccttgatccacatacccgctgggagtactgcgctatcaagacttgtgcagacaataccatgaacgataccgacgtgccactcgaaacaacagagtgcatacagggccagggggaaggatatcgtgggaccgtgaacactatttggaatgggatcccttgccaaagatgggattcgcagtacccacacgaacatgatatgactcccgaaaatttcaagtgcaaagacttaagggaaaactattgcagaaaccccgatgggtcagagagcccttggtgtttcacgacagacccaaacatcagggtcgggtattgttcccagatccctaattgtgatatgtcgcacggccaagattgctatagaggaaacgggaagaattacatgggtaatctctcacagaccagaagcggcctcacctgcagcatgtgggacaagaatatggaggacttacaccggcacatattctgggagcctgatgcctctaagcttaatgagaattattgcagaaaccctgatgacgacgctcatggcccctggtgttatactggtaacccgctcattccctgggactactgtcccatctccaggtgcgagggagacaccacacctaccatcgtgaatctggaccaccccgtaatatcttgtgccaagacaaaacagctgagggtcgtcaacgggatcccaacaagaactaatatcggatggatggtgtcacttcggtatcgcaataaacacatctgtggtggctccctgatcaaggagtcatgggtcctgacagccagacagtgctttcctagcagggacttgaaagactacgaggcctggctgggaatccacgatgttcacggcaggggcgatgagaaatgcaaacaggtgctcaatgtgagtcagctggtgtacggccctgaaggaagcgacctcgtcctcatgaagctggctcgtccagcagtcttagacgattttgtgagtactatagatcttcctaactatggttgtactatccctgagaagacctcatgctcagtatacggttggggatacaccggcctcataaactatgatggtctattacgagttgcccacctctacataatggggaacgaaaagtgttcccagcaccatcggggtaaggtgacgctgaatgagtctgaaatatgtgccggtgcggaaaaaatcgggagtggtccgtgtgagggcgactatggcggcccacttgtatgcgaacaacataaaatgcggatggtgctaggcgtgattgtgcccgggagagggtgcgccatacctaacagaccaggcatattcgtacgcgttgcatattacgcgaagtggatccacaagatcatattaacctataaggtcccgcagtcc

SEQ ID NO: 13633 - DNA, 2184 bp, Artificial Sequence
  Description of Artificial Sequence: Synthetic coding sequence
atgtgggtcaccaagctgctgcctgcactgcttctccaacacgtcctgcttcatcttctccttctgcccatcgcaattccatatgcagaaggacaaagaaagcgaagaaacactattcatgagttcaaaaagtcagccaaaactaccttgatcaagatcgatccagcactgaagattaagactaagaaggtgaataccgcagatcagtgtgccaatagatgtaccagaaacaaggggctgccctttacttgcaaggcctttgtttttgataaggcaaggaagcaatgtctgtggttcccattcaactccatgtcgtcgggcgtgaagaaagaatttggtcatgagttcgacctgtacgaaaacaaagactacatacggaactgcataattggaaagggacggtcctacaagggaactgtctccattactaaatcgggtattaagtgccagccctggagctcaatgattcctcatgaacatagctttctgccttcaagctaccggggtaaggatctgcaagaaaactattgtagaaatcctcgcggggaagaaggcggcccatggtgttttacctcaaaccctgaagtgagatatgaggtgtgcgatatcccgcaatgctcagaggtcgaatgtatgacttgcaatggggagtcgtaccgcggactgatggaccacactgagtccgggaagatttgtcagaggtgggaccaccagaccccccatagacataagtttctgcctgagaggtacccagacaagggttttgatgacaactactgtcgcaatcccgatgggcagcctcggccgtggtgctacactcttgatccacatacgagatgggaatactgtgcgataaagacttgtgcagacaacactatgaacgacaccgatgtccctcttgaaaccaccgaatgtattcagggacagggagagggataccgaggaaccgtgaacactatctggaatggcattccatgccaaagatgggattcccagtacccgcatgagcacgacatgacgccagaaaactttaagtgcaaagacctgagagaaaactactgccgaaaccccgacggaagcgaatcgccttggtgctttaccactgatcccaacattagggtcggctactgctcccaaatacctaattgtgatatgtcccatggtcaggactgttatagagggaacggaaagaactacatgggaaacctttcccaaactagatcggggttgacctgttcgatgtgggataagaacatggaagatcttcatagacatatcttttgggaaccagatgcatccaagctgaacgagaactactgtagaaacccagatgatgatgcacatggtccttggtgttacaccggcaatcctcttattccttgggattactgcccgatttcccgctgtgaaggagataccactcctacgatcgtgaatcttgatcatccagtgattagctgtgccaagacgaagcagctgcgggtcgttaatggaatcccaactcggaccaatattgggtggatggtcagcttgcggtaccggaacaagcatatctgtggagggtcgctgattaaagaatcttgggtgttgaccgccaggcaatgtttcccctcaagggatctgaaagactatgaggcatggttgggtatacatgacgtgcatggtcgcggtgatgagaaatgcaaacaggtgctgaatgtctcgcaactcgtgtacggtcctgaaggatcagacctggtcttgatgaaactggcacggccagcggtgctcgacgatttcgtctccactattgatctgcctaactatggatgtactatccctgaaaagacctcctgttcggtctacggatggggttacactggtctgattaactacgatggtctgctgagagtggcccacttgtacataatgggaaacgagaaatgttcccagcatcatcgcggtaaagtgaccctgaatgagagtgagatttgcgcgggggcagaaaagattgggtcgggaccttgtgaaggcgactacggcggcccactggtctgcgagcaacataagatgaggatggtgcttggcgtcatcgtgcctggacggggctgcgccattccaaacagacccggaatctttgtgagagtggcgtactatgcgaagtggatccataagataattcttacgtacaaggtgccccagagc

SEQ ID NO: 13634 - DNA, 2184 bp, Artificial Sequence
  Description of Artificial Sequence: Synthetic coding sequence
atgtgggtgaccaaactcttgccggccctgcttcttcaacatgtgctgctgcacctcctgctcctgcccattgctatcccatacgctgaaggccagcgcaaacgcaggaataccatccatgagttcaaaaagtcagcgaaaactaccctgatcaaaatcgatcctgctctgaaaatcaaaactaaaaaggtgaataccgcagaccaatgtgctaataggtgcaccagaaataagggcctcccattcacgtgcaaggctttcgttttcgataaggcccggaagcagtgtttgtggtttccgttcaactcgatgtcatccggtgtcaagaaggagttcgggcatgaattcgatctgtacgaaaacaaagactacatccgcaactgcatcatcgggaaaggacggagctacaagggaactgtgagcattaccaagtcgggcatcaagtgtcagccctggtcctcaatgatcccgcacgagcactcattcctcccgagctcgtatagagggaaggacctccaagagaactactgccgtaacccgcggggagaggaaggaggaccatggtgcttcacctcgaaccctgaggtgcggtacgaggtgtgcgatatccctcagtgctcagaagtggagtgtatgacttgcaatggtgagtcctaccgggggctcatggaccacaccgaatcggggaagatctgccagcgatgggatcaccaaacgcctcatcggcacaagttcctccctgaacgatatccggacaaggggttcgacgacaactactgtcgaaacccggacggccagccccgcccatggtgttacaccttggatccgcacactcggtgggaatactgcgcaatcaagacttgtgcggataacactatgaacgacactgacgtgcctcttgaaacgaccgaatgtatccaaggacaaggagaaggttacaggggaactgtcaataccatttggaacggtatcccgtgccaacgatgggactctcagtaccctcacgagcatgatatgactccggagaacttcaaatgtaaggacctcagggaaaactactgcaggaacccagacggatccgagtcaccgtggtgctttactactgaccccaacattcgtgttgggtactgctcccagatcccaaactgtgatatgtcccatggtcaggactgctacagaggcaacggaaaaaactatatgggcaacttgagccaaacccgctcggggctgacgtgctccatgtgggataagaacatggaggacctgcacagacacatcttctgggaaccggacgcatccaagctcaatgagaattactgccgaaatccagatgatgacgctcatggaccgtggtgttatactggcaatccattgattccatgggattactgtccgatctcaagatgcgaaggcgacacgaccccaaccatcgtaaatctggatcacccagtgatctcgtgtgccaagactaagcaactgcgggtggtgaatggcataccgacccgcaccaatatcggctggatggtgtcgctgcggtatcgcaataaacacatttgtggcggatcgctgattaaagaaagttgggtgctgacggcccgccagtgctttccgtccagagatctgaaggattacgaggcttggcttggaattcacgatgttcatggtcgcggggacgagaaatgcaagcaggtgctgaacgtctcgcagctggtgtacggtccggaagggagtgacctcgtgctgatgaagttggcccggccggccgtgttggacgactttgtgtcgactatcgacctccccaactacggatgcactattcctgagaaaaccagctgctcagtctacggatggggctatacgggactcatcaactacgacggactcctgcgcgtcgcccatctctacatcatgggaaacgaaaagtgcagccagcaccatcgcggcaaggttacgctgaatgaatcggagatctgcgccggagccgaaaagattggctctggcccgtgtgagggggactacggaggaccgctcgtgtgtgaacagcacaagatgagaatggtgttgggagtcatcgtgccaggtcgcggatgtgcaatcccgaacagacccggaatcttcgtgagggtcgcatactatgccaagtggatccataagattatacttacctacaaagtgccccagtca

SEQ ID NO: 13635 - DNA, 2184 bp, Artificial Sequence
  Description of Artificial Sequence: Synthetic coding sequence
atgtgggttaccaagttactcccagcgctgcttctgcaacatgttttgctgcacctgctgctgttgccaattgctatcccatacgctgaaggacagcggaagaggcgcaataccatccacgagtttaaaaaatctgctaagacgactttgattaagattgaccctgccttgaagattaaaacgaagaaagttaacactgcagaccagtgtgctaataggtgcacgcgtaataagggtctgccgttcacctgcaaagcgtttgtatttgataaggctcgcaagcagtgcctgtggttcccattcaactccatgagcagcggtgtgaagaaagagtttggtcacgagttcgacctgtatgaaaataaggattacatccgaaactgcatcataggcaagggtaggagctataaaggtaccgtttcaattaccaagagtgggattaaatgtcagccgtggtcttctatgatccctcatgaacactcattccttccaagctcctatcgcggcaaggacctgcaggagaattactgccgcaacccacgtggcgaggagggtggaccttggtgtttcacttccaatccggaggtgagatacgaggtgtgcgatatccctcaatgctcggaggttgagtgtatgacttgtaacggagagtcgtaccgcggtctgatggaccataccgaatccgggaaaatctgccagagatgggatcatcagaccccccatcgccataaattcctgcccgaacgctaccctgacaaaggcttcgatgataattactgtagaaacccagacggtcagccacgcccgtggtgttacaccctggatcctcacacccggtgggagtattgtgccataaagacgtgtgccgataataccatgaacgacactgatgtgccactggaaaccacggaatgtatccaaggtcaaggggagggttaccgaggcacggtcaatacgatctggaatggtatcccttgccagcgctgggatagccaatatccacatgagcacgacatgacccctgagaattttaaatgcaaagatctccgcgaaaactactgtagaaatcctgatggtagcgagagcccgtggtgtttcacgaccgatccgaatatccgagtcggttattgtagccagattccaaactgcgatatgagtcatggacaggattgctacaggggcaacggcaagaactatatgggcaatctgagccagactcgcagcggcctcacctgtagcatgtgggataagaatatggaggacttacaccgccacattttttgggagccagacgccagcaaactgaacgagaactactgccggaatccagacgatgatgcccacggaccatggtgttatacggggaatccattgatcccatgggattactgcccaattagccgatgtgaaggtgatacgaccccgactatcgtgaatctggatcatccagtcatcagctgtgctaaaacaaaacaacttcgcgtagtgaacggtatcccgacacgcacgaacattggctggatggtgagtctgcgctatcgaaataagcacatttgcggtggcagcctgatcaaggagagctgggtcctgaccgcacgccaatgctttccgtcgcgcgatctgaaagattatgaggcatggctgggaattcatgacgtgcatggccgtggagatgaaaagtgcaagcaggttctgaatgtctctcagctcgtgtacggtccggaggggagcgacctagtgttgatgaaacttgcgcgcccagcggtcctggatgactttgtgagcacaatcgatctgccgaactatggttgcacgataccagagaaaacgagctgttctgtttacggatggggttatacgggcctaatcaactatgacggactgctgcgagtcgcgcatctctatataatgggcaatgaaaaatgcagccagcatcaccgcggtaaagtgaccctgaatgagagcgagatttgcgcaggtgcggagaaaatcggttccggtccctgtgagggtgactacggtggccctctcgtctgtgagcagcacaagatgcgcatggtgcttggggtaattgtaccgggtaggggctgcgcgatccctaatcgcccgggtatctttgttagagttgcgtattacgcgaagtggattcacaaaattattttgacgtacaaggtcccacaatca

SEQ ID NO: 13636 - DNA, 2184 bp, Artificial Sequence
  Description of Artificial Sequence: Synthetic coding sequence
atgtgggtgactaagctgctgccagctctactcctgcagcacgtcctcctgcatcttctgctcctgcctatcgctattccctatgctgaaggacagagaaaaaggcggaacactatacatgaattcaagaagtctgctaagacaactttaataaagatagatcccgcgctaaaaatcaagacaaaaaaagtgaatactgccgatcagtgtgccaatcgctgcactcggaacaaaggactccctttcacttgtaaagccttcgtgtttgataaggctagaaaacagtgtctctggtttccatttaactcgatgagttctggagtgaaaaaagaattcgggcatgagtttgacctgtacgagaataaagattatataagaaattgcatcatagggaaagggcgatcctataaaggaacagtgtccataactaaatctggaatcaagtgccaaccctggtcttcgatgatccctcatgaacattctttcctgccctcctcctatcgagggaaggatctgcaggaaaactattgtcggaaccctaggggggaggaaggagggccctggtgctttacttctaatccagaagttcgatatgaggtgtgtgatatcccacagtgctccgaagtcgaatgcatgacttgtaacggggagtcttataggggactgatggatcatactgaaagtgggaaaatctgtcagcggtgggatcatcagactcctcatcggcacaaatttctgccggaacgctatcccgataaaggattcgatgacaattactgtagaaaccctgatggacagccccggccctggtgctatacacttgatccacatactcgatgggaatattgcgccatcaagacttgtgctgataatactatgaacgacacagatgtccctctggaaacaacagaatgcatacagggacagggggaaggatacagaggaacagttaatacaatctggaacgggataccatgtcagcgatgggacagtcagtatccccatgaacacgatatgacacccgagaatttcaaatgcaaagatcttcgagaaaattattgtaggaatcctgatggatctgaatctccatggtgttttacaacagatcccaatataagagttgggtattgtagtcagatccccaactgcgacatgagtcatgggcaggattgttatcgggggaatggaaaaaattatatgggaaatctttcccagacacgttcaggactaacatgtagtatgtgggacaaaaatatggaagacctacaccgacatatcttttgggagcctgatgcctccaagttaaatgaaaattattgtagaaaccccgatgacgatgcacatggaccctggtgttatacagggaaccccttaattccctgggattactgccctatatcaaggtgcgaaggagatacgactcccacaatcgtgaacctggatcatcctgtgatttcttgtgcaaaaacgaagcagctcagagttgttaatgggataccaactagaacaaacatcgggtggatggtgtcgctccgataccgaaacaaacatatctgtgggggatctctcataaaagaatcatgggtgctgacagctaggcagtgctttcccagtcgcgacctgaaagattatgaagcgtggctgggaatacatgatgtgcatggaaggggagacgagaagtgtaagcaggttctgaacgtgtcccagttagtatatgggcctgaagggtcagatctcgtgctcatgaaacttgcaagaccagccgtcctggatgatttcgtatcaacaatcgatctgccaaactatgggtgtacaatacctgaaaaaactagttgttccgtctatgggtggggatatactggactcatcaactacgacggactactccgggttgcacatttgtatatcatggggaacgaaaaatgcagtcagcaccatagagggaaagtgacactcaatgaatccgagatatgtgccggagccgaaaaaatcggatcaggaccatgcgaaggggattatggggggcccctcgtgtgtgaacagcacaaaatgaggatggtgctgggggtgatagtgcctgggcggggatgcgctattcccaacaggcctgggatattcgttagagttgcgtactatgctaagtggatacacaagatcatactaacttataaagttccccagtcg

SEQ ID NO: 13637 - DNA, 2184 bp, Artificial Sequence
  Description of Artificial Sequence: Synthetic coding sequence
atgtgggtcacgaagctcctccccgcactcctgctccagcatgtgctcctgcatctcctcctgctgccgatcgcaatcccatacgcagagggacagcgcaagagaagaaacaccatccacgagttcaagaagtcagccaagactacccttatcaaaatcgaccctgcgctgaagatcaagaccaaaaaggtgaatactgcagatcagtgcgctaataggtgcactcggaacaaaggcttgcccttcacttgcaaggcgttcgtctttgataaagcccgcaagcaatgtctgtggttccctttcaactcgatgtcgtccggcgtcaagaaggaatttggacacgagttcgatctgtacgaaaacaaagattacattagaaactgcatcatcggcaagggaaggtcctacaaaggaaccgtgtctatcaccaagtccggaatcaaatgtcagccatggtccagcatgatcccccatgagcatagcttcctgccatcgtcctatagagggaaggacctgcaagagaactattgccggaatccgcgcggagaggaaggcggaccgtggtgcttcacttccaacccagaggtgcggtacgaagtgtgtgatatcccacaatgctcggaagtggagtgcatgacttgcaatggagagtcctaccgcgggttgatggatcataccgagtccggcaagatctgccaacgctgggaccaccagaccccacataggcacaaattcctgcccgagcggtacccagacaagggattcgatgataactattgcagaaacccggacgggcagccacgcccttggtgttacaccttggacccgcacacccggtgggagtactgcgcaatcaagacgtgcgccgacaataccatgaatgacactgatgtgccactcgagactaccgagtgcatccaagggcagggcgagggataccggggaactgtcaacaccatctggaatggcatcccgtgccagaggtgggattcccagtacccgcatgaacacgatatgactcccgagaatttcaagtgtaaagatctcagagagaactactgtcgcaatcccgacggttcggaatcgccatggtgttttactactgaccccaacatccgcgtcggctactgctcacagattccaaattgtgacatgtcgcacggtcaggattgttaccggggaaatggtaagaactacatgggcaatctttcgcaaaccagatcaggcctgacctgttcgatgtgggacaaaaacatggaggacctccaccgccatatcttttgggagcccgacgcgtcaaaactcaacgaaaactactgtcggaatccggacgatgacgcacatggaccttggtgctataccgggaatcctcttatcccatgggactactgccccatttcccggtgcgaaggcgacaccaccccgaccattgtcaacctggatcatccggtgatctcgtgcgccaaaactaagcaattgagagtggtaaatggcatccccactcggacgaacatcggttggatggtttcactgagatacaggaataaacatatctgcggaggaagccttatcaaggaatcttgggtcctgaccgctcgccagtgcttcccgagccgggatctcaaggactacgaggcatggttgggcatccacgacgtgcacggtcggggcgacgagaaatgcaagcaagtcctgaacgtcagccaactggtgtacggaccggagggatcggatcttgtcctgatgaaactggccaggccggcggtgctggatgatttcgtgtctactatcgacctgcctaactacgggtgcaccatcccggagaaaacctcctgttccgtctacggatgggggtataccgggttgattaactacgacggtcttttgcgagtggcccacctgtacatcatgggaaacgaaaagtgcagccaacatcaccgcggaaaggtcacgctgaatgagtccgaaatttgcgcgggcgccgaaaagatcggaagcggaccctgcgaaggagactacggtggaccgttggtgtgcgaacaacacaaaatgaggatggtcctgggcgttatagtgccgggacgcggttgcgcaatcccgaaccggcccgggatcttcgtcagagtcgcctactacgcaaagtggatccacaaaatcatcctgacctacaaggtcccgcagagc

SEQ ID NO: 13638 - DNA, 2184 bp, Artificial Sequence
  Description of Artificial Sequence: Synthetic coding sequence
atgtgggtgaccaagctgctgccggccctccttctgcaacacgtgcttctccatctcttgcttctgccgatcgcgatcccttacgccgaaggacaaagaaaacggcgcaacactatacatgagtttaagaagagcgcaaagaccaccctgatcaagatcgatcctgccctgaagattaagacgaagaaagtgaacaccgcagaccaatgcgcgaatcggtgcacccggaacaagggacttccgttcacctgtaaagcgttcgtgttcgataaagctaggaaacaatgcttgtggttccctttcaactcgatgagcagtggtgtgaaaaaggagttcggacatgagttcgacctgtacgagaacaaagattacatccggaactgtatcatcggaaagggacggagctacaagggcaccgtgagcatcactaaatccggaataaagtgccagccctggtccagcatgattccgcatgaacactccttcctcccctcatcctacagagggaaggatcttcaggaaaactattgcaggaatccgcggggggaggaaggggggccgtggtgcttcacgtctaaccccgaagtgcgctacgaggtgtgcgatatcccgcagtgctcagaggtcgaatgtatgacctgcaacggtgaatcatatcgcgggctcatggatcataccgaatcgggaaaaatctgccagcgctgggatcaccaaaccccacaccggcataagtttctgccagaaagatacccggacaaaggtttcgacgataactactgtcgaaacccagacggtcagccgaggccctggtgctatacgctggaccctcatactcggtgggagtattgtgctattaagacttgcgcagacaatactatgaatgacactgatgtgccgctggaaaccaccgagtgcatccagggccagggggagggataccgcggaaccgtgaacactatctggaatggcatcccttgccagagatgggattcccagtacccgcacgagcacgatatgacccctgaaaactttaagtgcaaggacttgcgcgagaactattgccgcaacccagacggctccgagtcaccgtggtgctttactaccgatccgaacatccgagtgggttactgctcgcaaattccgaattgtgacatgtcgcacggacaggactgctaccgcgggaatggaaagaattacatgggaaacttgtcacagacgcggagcggattgacttgttcgatgtgggataagaatatggaggacctgcaccgccacatcttttgggaaccggacgccagcaagctgaatgagaactactgccggaatccggacgacgacgcgcacggaccctggtgctacactggaaacccactcatcccctgggattactgtcccatctcacgctgcgagggagataccaccccaacgatcgtgaatctggaccacccagtcatctcctgtgcaaagaccaagcaattgagagtggtaaacggcatcccaacccgaaccaatataggatggatggtgtcgctccgctaccggaacaaacacatttgcggtggatcgctgatcaaggaatcctgggtcttgactgccaggcaatgcttcccatcgagagatctgaaagactacgaagcgtggctcgggatacacgatgttcatggtagaggcgacgaaaaatgcaagcaagtcctcaatgtttcccagctcgtgtacggaccggaaggttctgacctggtgcttatgaaactggcccgccctgcagtgttggatgatttcgtcagtactattgacctgccaaactatggctgcactatccccgaaaagacttcgtgctcggtgtacggttggggatacaccggactgatcaattacgatggactcctccgagtggcccatctgtacatcatggggaacgaaaagtgttctcagcaccatcgcggtaaagtgactctgaatgaatcggaaatctgtgcaggcgccgaaaagattggctccggcccgtgcgagggcgactacggaggaccacttgtctgtgagcagcacaagatgaggatggtcctgggcgtgatcgttccggggagaggttgtgcgatcccgaaccggcctggcatcttcgtgagagttgcctactacgcaaagtggattcacaaaatcattctcacctataaggtcccacagtcc

SEQ ID NO: 13639 - DNA, 2184 bp, Artificial Sequence
  Description of Artificial Sequence: Synthetic coding sequence
atgtgggtgaccaagctcctgccggccctacttctgcagcatgttcttctccacctactccttctgcccatagccatcccctacgctgagggtcagcgcaaaagacggaacaccattcatgagttcaagaaaagcgccaaaacgaccctgatcaaaattgatcccgcactgaagatcaagaccaagaaggttaataccgctgaccagtgcgcaaaccgctgtaccaggaacaaagggctacccttcacttgtaaggcctttgtttttgacaaggcaaggaagcagtgcctgtggtttccattcaattctatgtcatccggagtgaaaaaggagttcggtcacgagttcgacttgtacgagaataaggactacattaggaattgtatcattggtaagggacggtcatataaggggactgtgtccatcaccaagagcgggatcaaatgccagccatggtcaagcatgattccacacgaacactcctttttgccaagcagctatcggggtaaagatctgcaggagaattattgccgaaatccaaggggagaggaaggcgggccgtggtgctttacctctaaccccgaagttaggtacgaggtttgtgacattcctcaatgctctgaggtcgaatgcatgacatgtaacggagaaagttatcgcgggctcatggaccacaccgaatcaggaaaaatctgccaacggtgggatcatcagaccccccaccgccataagtttctacctgagagatatcctgataagggattcgatgacaactattgcagaaaccccgatggacagccacgaccttggtgctatacattggatcctcataccagatgggagtattgcgcaatcaagacttgtgccgacaacaccatgaacgacactgacgtgcctctggagacgaccgagtgcatccaggggcagggagagggctaccggggaacagttaacacaatatggaatgggataccctgccagaggtgggatagtcagtatccccatgagcacgatatgacccccgagaatttcaaatgtaaggacctccgggaaaactactgcagaaaccccgacggcagcgagtctccttggtgctttacaacagaccccaatatcagggttggttattgttctcagattcctaactgcgacatgagccacggacaggactgctatcggggaaacgggaaaaattacatgggcaatctgagtcagacacgaagcggtctcacatgtagcatgtgggataagaacatggaggacttgcaccggcacatattctgggagcccgatgcaagtaagcttaacgagaactactgcagaaatcctgacgacgacgcacatgggccttggtgctatactggcaatcccttgattccttgggattactgccccatctctaggtgtgagggcgatactacacccaccattgtgaatttggaccacccagtgatctcctgcgctaaaaccaagcagctgagggtcgtgaacggtatacccacaaggacaaatatcggatggatggtgtccttgcgctatcggaacaaacacatttgtgggggatctcttatcaaggagtcctgggtcctgacagcgaggcagtgcttcccttcccgcgatctcaaggattatgaggcctggctgggtatacacgacgtgcacggccgaggggatgagaaatgtaagcaagtactgaacgtcagccagctggtctacgggcctgagggatctgacctggttctcatgaagctcgcccggccagctgtcctcgacgatttcgtgtccacaatcgatcttccaaactacggatgcaccatacctgaaaagacatcttgctcagtttatggctggggctacacaggcctaatcaactatgacgggctactcagagtggcacatctgtacataatggggaatgagaagtgctcccaacatcaccgcggtaaagttacactgaacgagtcggagatttgcgcaggcgcagagaaaatcggcagcggcccatgtgagggcgactacggaggcccgctggtctgcgaacagcacaagatgcgcatggtgctgggggtaattgtgcccggcagagggtgtgccataccaaaccggcctggcatattcgtcagagtggcctactacgcaaaatggattcataagataatcctgacctataaagtcccgcagtct

SEQ ID NO: 13640 - DNA, 2184 bp, Artificial Sequence
  Description of Artificial Sequence: Synthetic coding sequence
atgtgggtgaccaagctgctccctgccctgctgctgcagcatgtgctcctgcacctactgctgttacccatagcaatcccatacgctgaaggtcaaaggaaacgcagaaacactattcacgagttcaagaaatctgctaagacaacgctgatcaaaatcgatcctgcactaaaaataaaaacaaagaaagtgaacaccgcagatcagtgcgctaacaggtgcacccgtaacaagggtcttccttttacatgcaaggcatttgtattcgataaggctagaaagcaatgcctgtggttcccctttaacagcatgagctctggcgtgaaaaaagagttcggccatgagtttgacctgtacgaaaacaaagactacataaggaactgcataataggcaagggtcggtcctacaagggaaccgtgagtatcactaagagcggaatcaagtgtcagccttggagcagcatgattccgcatgagcactcatttctgccctctagctataggggtaaggatctccaagaaaactactgccggaaccctaggggagaggaaggtgggccttggtgctttaccagcaacccagaggtccggtacgaggtgtgtgacattccccaatgctccgaagtcgagtgcatgacgtgcaacggagaaagctatagaggcctaatggaccataccgagagcgggaagatatgccaaagatgggatcaccagactccgcatcgccacaagttcttaccggagagatatcccgacaaagggttcgacgacaattattgcagaaacccagatggccagcccagaccctggtgttataccctggacccacataccaggtgggagtattgtgctattaagacgtgtgctgataacactatgaacgacacagacgttcctctggaaacaactgaatgcatccaaggtcagggagagggatatcgtggcacagtgaatacaatctggaatggcatcccgtgccagcggtgggattctcagtatccccatgagcatgacatgacccccgaaaattttaagtgcaaggacttaagggaaaattactgccgaaaccccgatggctccgaatccccctggtgtttcactaccgaccctaatatcagggtaggatactgctcccagatccctaactgtgacatgagtcacggccaggattgttaccgggggaacggaaagaactatatgggcaatctcagccaaacacggagtggtcttacatgttccatgtgggacaaaaacatggaagatctgcacaggcatatcttctgggagccagacgcgtccaaactgaacgaaaattattgtcgcaatcccgacgatgacgctcacggtccgtggtgttatacaggcaatcccctcatcccctgggactattgtccgatctcacgatgtgagggagatacgactcccacaatcgtaaatttggaccaccccgttatctcttgcgcaaaaaccaaacagctgcgcgtggtcaacggcatccctaccaggacaaatataggatggatggtctcactcaggtatcgaaataaacatatctgtggtggatcgctcattaaggaatcctgggtgctgaccgcccggcaatgcttcccctcccgcgacctcaaggattacgaagcatggctcggcattcacgacgttcacgggcgtggcgacgaaaagtgcaaacaggtcttgaacgtaagccagcttgtgtatgggcctgaggggagtgatctcgtcctcatgaagttagcgcgacctgccgtgctcgacgattttgtttctacaatcgacttacccaactacgggtgcactattcctgaaaagactagctgtagcgtctacgggtggggttatacagggctcattaattacgatggccttttgagggttgcccacctgtacatcatggggaatgagaaatgctcccagcatcacaggggcaaagtgacactaaacgagagcgagatttgtgccggagccgagaaaatcgggtccggaccttgcgagggtgattatggtggccctttggtctgcgaacagcacaagatgcgtatggtcctcggagtgatagttcctggcaggggctgtgccatcccaaatcgcccaggtatatttgttcgagtggcctattacgcaaaatggatccataaaatcatactgacctacaaagtgccacagagc

SEQ ID NO: 13641 - DNA, 2184 bp, Artificial Sequence
  Description of Artificial Sequence: Synthetic coding sequence
atgtgggttacaaagcttctgcctgcccttctgctgcaacacgtcctcctccatcttctgctcctgcctatcgccattccatatgcggaaggccagcgaaagaggagaaacaccatccatgagtttaaaaagtcagcgaaaactacgctcataaagattgacccagcactgaagatcaagacaaaaaaagttaacactgccgaccagtgcgccaatcgctgtactcgtaataagggactaccattcacctgcaaggcctttgtatttgacaaagccaggaaacagtgcctatggtttcctttcaactccatgagtagcggggtgaaaaaagaattcgggcacgagttcgacttatacgagaacaaggattatattaggaactgtatcattggcaaaggcaggagctacaaaggtactgtgtctatcacgaaatccggcataaagtgccagccttggagcagcatgatcccccatgaacacagtttcctcccgagtagctatagaggaaaagatctgcaagagaactactgccgaaatccaaggggtgaggaaggaggcccctggtgctttacctccaaccccgaagtcaggtatgaagtttgtgacatccctcagtgttccgaggttgagtgcatgacctgtaatggagaatcctataggggactcatggaccataccgagagcgggaaaatatgccagaggtgggatcaccagactccgcatcgacataagtttctgcccgaacgctacccagataaaggtttcgacgataattactgtcgaaacccagacggtcagccccggccgtggtgctacacattggatcctcacactcgatgggaatactgtgctatcaagacttgtgccgacaacaccatgaatgataccgacgtgcctctcgagaccacggagtgcatccaaggacaaggcgagggataccgtggcactgttaacaccatctggaatgggatcccatgccagagatgggattctcagtacccacacgaacatgatatgacaccagagaatttcaagtgcaaggatctccgggagaactactgtcggaaccctgacggctcagagtctccatggtgttttaccactgacccaaacatccgcgtgggttactgctctcagatcccgaattgtgacatgtctcacggccaggattgttacaggggaaatggtaaaaactatatgggaaacctgtcgcagacacgatccggcctcacatgttctatgtgggataaaaatatggaggatctacacaggcatatattctgggagcccgatgcttcaaagctgaatgaaaattactgtagaaatcctgatgatgatgctcacggcccctggtgctataccgggaatccactgatcccatgggattactgcccaattagcagatgtgagggagatacaaccccaaccatagttaatctggatcacccagtgattagctgtgcaaagactaaacaactcagggtggttaatgggatcccgacaagaaccaatatcggttggatggtgagcctgcggtataggaacaaacacatttgtggaggatctctgattaaggagagttgggtcctgacagccaggcagtgctttcctagcagagatctaaaggactacgaagcttggttggggattcacgacgtgcatggaaggggggacgagaagtgcaaacaggtgctaaatgttagccagctggtctatggaccagagggttccgacttggtacttatgaaactggcccgcccggcggttctcgatgactttgtttccacaattgatctgcctaattacggctgcactattcccgaaaaaacctcctgtagcgtgtacggttggggatacacaggcctgatcaactacgatggcttactcagagttgcacacctctatattatgggaaacgagaaatgttcccagcaccataggggcaaagtcacgctcaatgagtctgaaatctgcgccggcgccgaaaagatcgggagcgggccttgcgagggggattacggcggcccacttgtttgtgaacaacacaagatgcgaatggtgctgggggtcatagtgccaggaagggggtgtgcgattcctaatagacctgggatttttgtccgagtggcttattacgccaaatggatccacaagattatccttacatacaaagtccctcagtcg

SEQ ID NO: 13642 - DNA, 2184 bp, Artificial Sequence
  Description of Artificial Sequence: Synthetic coding sequence
atgtgggtgaccaaattgctgcccgcgctcttgctccaacacgttttattgcatctacttctgttgccaatcgcgattccctacgccgaggggcagcgtaaacgacggaacacgatacatgagtttaagaagtctgccaagaccacgttgatcaagatagaccccgctctcaagattaagacaaagaaggttaatacagccgatcaatgcgcaaaccgatgtacaaggaataaaggtctcccattcacctgcaaggctttcgtatttgacaaggcacggaaacaatgtttatggttcccattcaactcgatgagttcgggtgtgaaaaaggagttcgggcatgagtttgacctgtacgagaacaaggattacattagaaattgcattatcggaaagggccgctcttacaaggggactgtctcaatcaccaaatccggaatcaagtgccagccatggtcatcaatgatcccccatgagcactccttcctcccaagctcctatcgtggcaaggatctgcaggagaattattgccgaaacccccgcggcgaggagggcggcccatggtgtttcacatctaatccagaagtgcggtatgaagtgtgcgacatccctcagtgttcggaggtcgaatgcatgacgtgtaacggcgaaagctaccgcgggctcatggatcataccgaatcagggaagatatgccagcgttgggatcatcagaccccccaccgacacaagttcttgccagagcgatacccagacaaggggttcgatgacaattattgcagaaacccagatggccagccccgtccatggtgctacacattggatcctcacacgaggtgggaatactgtgctattaaaacatgtgctgataacacaatgaatgataccgacgttccccttgagaccacggagtgcattcaaggccaaggggaaggttatcgtggaacagtgaacactatctggaatggcataccatgccaacgatgggacagccagtacccccacgagcatgatatgacacctgagaatttcaaatgtaaggacctacgagagaattattgcagaaatccagatgggagcgaatctccttggtgcttcactaccgaccctaacattcgggtcgggtattgttctcagattccaaattgtgacatgagtcatggccaggactgctacaggggtaatggcaaaaattatatggggaacctctcacaaacgcggtctggcttgacatgctccatgtgggataagaatatggaggatctgcatcgtcacattttctgggagcctgatgctagcaaactcaacgagaactactgcaggaacccagatgatgatgctcacggaccatggtgctatacaggaaatccccttataccttgggactactgtcccatttcccgttgtgagggagatactacgcccacgatcgttaacctggaccaccccgttattagctgcgcgaagactaaacagcttcgtgtagtgaacggaatacccacacggaccaacattggctggatggtaagccttcgataccgaaataaacatatttgcggcggaagtttgattaaagaaagctgggtgctgaccgcccgccagtgtttcccgtcaagagatttgaaggactacgaggcctggctcggtatccatgacgtacatgggcgcggcgatgaaaagtgtaagcaggtacttaacgtttcccagctcgtctacggcccagagggatcagacctagtgctcatgaagcttgcccgacccgctgtattggacgattttgtgtccactatagatctgcccaactacggctgtacaattccagagaaaacctcatgctccgtatacggctggggctatacagggctgatcaactacgatggactcctccgcgttgcacatctgtacattatgggcaacgaaaagtgttctcagcatcacagagggaaggtgaccctgaatgaatccgagatctgcgcaggggccgagaaaatcgggagcggcccctgcgagggggattatggaggcccactggtgtgcgagcagcacaaaatgagaatggttttgggggtgattgtgcccggtcgtggttgtgccatccccaatcgccctggcatcttcgttagagttgcatactatgcgaagtggatccataaaattatcttaacctacaaagtcccgcaaagt

SEQ ID NO: 13643 - DNA, 2184 bp, Artificial Sequence
  Description of Artificial Sequence: Synthetic coding sequence
atgtgggtgaccaagctccttccggccctgttgctccagcacgtactgctgcacctcttgctgctcccgatcgccatcccttacgcggaggggcagcggaagagaagaaacaccatccatgagttcaagaagtcagcgaaaacgaccctgatcaaaattgacccagccctgaaaatcaagactaagaaagtaaacaccgccgaccagtgcgcaaaccgctgcaccagaaacaaaggactcccgttcacctgtaaggctttcgtgttcgacaaggcaaggaaacaatgcctctggttccccttcaacagcatgtcatcaggcgtgaagaaggagttcgggcacgaattcgacctttacgaaaacaaagactacatcagaaattgtattatcggtaagggacggtcctacaagggtactgttagcattactaagtctggaatcaaatgtcaaccttggagcagcatgatcccacatgagcacagctttctgccatcctcctatagaggcaaggacctccaggagaattactgccgcaacccgcggggggaggaaggtggcccatggtgtttcacctcaaacccggaggtgcggtatgaagtgtgtgatattccccaatgcagtgaagttgaatgcatgacttgcaacggagaaagctaccgcggacttatggaccatactgagtcgggtaagatctgccaacgctgggaccaccaaactcctcaccgacataagttcttgccggagagatacccagataagggatttgatgacaattactgccggaaccccgacggccaaccgcgcccgtggtgctacaccctcgacccgcacaccaggtgggaatactgcgcaattaagacttgtgccgataacactatgaacgataccgacgtgccgctcgaaactactgaatgcatccagggacagggggaaggctaccggggtaccgtgaatacgatctggaacggcatcccgtgccagcgctgggatagccaatatccacatgagcatgacatgactccagaaaacttcaagtgcaaggacctcagagagaactactgtagaaacccagatgggtccgagtccccgtggtgttttacgaccgaccctaatatccgcgtcggatactgctcacaaatcccaaactgcgatatgtcccatgggcaggactgctatcggggaaatgggaagaactacatgggcaatctgtcgcagactcgctccggtctgacctgttcaatgtgggacaaaaacatggaggacctccaccggcacatcttttgggaaccggacgcatcaaaacttaatgagaactattgccggaacccggatgatgacgcgcacggcccctggtgttacacgggaaaccctctgatcccttgggattactgcccgatctccaggtgcgagggagataccaccccgaccatcgtgaacctggatcatccggtcatcagttgtgcaaagaccaagcagctcagggtggtgaacggcattccgactcggactaacattggatggatggtgtcgctgagataccggaacaaacacatctgcggagggtccctcatcaaggagagctgggtgttgactgctagacagtgcttcccaagccgcgatctgaaggactatgaagcctggctcggtattcatgatgtgcacggaaggggggacgaaaagtgcaaacaggtgctgaacgtgtctcagcttgtgtacggaccggaggggtcggacctcgtcctgatgaagctcgcccgcccggcggtgctcgacgacttcgtttcaactatcgacctgcctaattacggctgtaccattcctgaaaagaccagctgctccgtgtacggctggggctacactggattgatcaactacgacggcctgctgcgggtggctcacctctatatcatgggaaatgagaagtgctcccaacaccaccgcgggaaggtgactctgaacgagtccgagatctgcgcaggtgccgaaaagatcggatcgggaccctgtgaaggggattatggaggtccgcttgtgtgcgagcagcacaaaatgcggatggtcctgggcgtcattgtgccaggcagaggatgcgccatcccgaaccggcctggcatcttcgtccgcgtcgcgtactacgcaaagtggatccacaagattatcttgacgtacaaggtgccccagtcg

SEQ ID NO: 13644 - DNA, 2184 bp, Artificial Sequence
  Description of Artificial Sequence: Synthetic coding sequence
atgtgggtgacgaagctcttgccggcgctgcttttgcagcatgtccttctgcacctgctcctcctgccgatcgccattccgtatgctgagggacagcgcaaacggcggaacaccatccatgaattcaagaagtcagcaaagaccactctgatcaaaatcgatccggcgctcaagatcaaaactaagaaggtgaataccgcagaccagtgcgctaacaggtgcactagaaacaaaggactcccattcacgtgcaaggctttcgtgtttgataaggcgcggaaacagtgcctctggtttccattcaatagcatgagctcaggtgtgaagaaagaatttggtcatgagttcgatctctacgagaacaaggactacatccgcaattgcatcatcggaaagggacggtcatacaagggcactgtcagcattaccaagtctgggatcaagtgccaaccttggtcgtcaatgatcccacacgagcactcgtttctgccaagctcctaccgtggcaaggacctccaagagaactattgccgcaatccgcgaggggaggaaggcggaccgtggtgcttcacgtccaacccagaagtccgatacgaggtttgcgatattcctcaatgctcggaggtggagtgtatgacctgcaacggagaatcctaccggggactcatggaccacactgagtcgggcaaaatctgtcagaggtgggaccaccagacgccacatcgccacaagttcctgccggaacggtacccggacaaagggttcgatgataactattgcagaaaccccgacgggcagccgcggccctggtgttacactctcgacccgcatactagatgggaatactgcgccatcaaaacgtgcgcggacaacaccatgaacgacactgatgtccccttggaaaccaccgagtgtatccagggacagggagaaggctatcgcggaactgtgaacaccatctggaatgggattccatgccagcgctgggatagccaatacccccatgaacacgatatgaccccggaaaacttcaaatgcaaagaccttagggaaaactactgccgcaacccggacggatccgaaagcccgtggtgttttacgactgacccaaacatcagagtcggctactgctcacaaatcccgaattgcgacatgagccacggacaagactgttaccgcggaaacggcaagaactacatgggtaacctgtcacaaacccgctcgggcctgacttgctcaatgtgggacaagaatatggaggatctccacagacacatcttctgggaacccgatgcatcgaagctgaatgagaattactgccggaatccagatgatgacgcgcatgggccttggtgctacaccggaaatcccctgataccttgggactactgccccatcagccggtgcgagggtgacaccactccaaccatcgtgaacctggatcacccagttatctcgtgcgccaagactaaacaacttcgtgtggtgaacggaatccctactcgcacgaatatcggatggatggtgtccctccggtaccgaaacaaacatatttgcgggggatcgctgatcaaagagtcatgggtgctgaccgcacgccagtgcttcccgtcccgagacttgaaggactacgaagcctggttgggaatccatgacgttcatgggcggggtgatgagaagtgtaagcaagtgttgaacgtgagccaattggtgtacggaccagaagggtcggacctggtcctgatgaagctcgctcggccggcggtgctggacgacttcgtgtctactattgatctccccaattatggttgtactatcccagaaaagacctcgtgcagcgtgtacggatgggggtacaccgggctgatcaattacgacggactgctccgcgtggcccatttgtacattatgggtaacgaaaagtgctcccagcaccaccgcggaaaggttaccctgaacgaatcggagatctgcgccggcgcggagaagatagggagcggcccttgtgagggagattacggagggcctctggtgtgtgaacagcacaaaatgagaatggtcctgggtgtcatcgtcccgggtcggggatgtgcgataccgaatcgccccggaatcttcgtcagagtggcgtattacgccaagtggatccacaagattatcctgacctacaaggtgccgcagtcc

SEQ ID NO: 13645 - DNA, 2184 bp, Artificial Sequence
  Description of Artificial Sequence: Synthetic coding sequence
atgtgggtgacaaagttgctgccagctctgctgttgcagcacgtcctcctgcacctcctgttgctgcccattgctatcccgtacgctgagggtcaaagaaagaggcgcaacacaatccatgaatttaagaagagtgccaagacaactctcatcaaaatcgaccctgcccttaagatcaagaccaaaaaagtcaacaccgccgaccagtgcgccaacagatgcacccgcaacaagggtctgcctttcacatgcaaggcattcgttttcgacaaagctcgcaaacagtgtctctggttcccatttaactccatgagttcgggggtaaagaaggaattcggacatgagttcgacctgtatgaaaacaaggactatataagaaactgtattatcgggaagggccggagctacaagggcaccgtgtcaataacaaaatctgggattaagtgtcagccatggagctccatgatcccccacgaacatagctttttacccagcagctatcgcggaaaggaccttcaggagaactattgcagaaatcctcgcggagaggaggggggaccttggtgtttcacgagtaaccccgaggtacgatacgaggtgtgtgacattccacagtgcagcgaggtcgagtgtatgacctgtaacggcgagagttacagaggtttgatggaccataccgagtccggcaagatatgccagagatgggatcaccaaaccccgcatcgccacaagtttctgcctgaaaggtaccctgataaaggttttgatgacaattattgccgtaaccccgacggacagccccgtccttggtgctacacactggatccacatactcgatgggagtactgcgcaattaagacgtgtgccgataacaccatgaatgacaccgacgtgccattggagaccactgaatgcatccaaggccagggtgaagggtaccgtggaaccgtcaataccatctggaatgggattccctgtcagaggtgggattcccagtacccacacgagcatgacatgacaccagaaaactttaagtgtaaagatcttagagaaaattactgtcggaacccggacggaagtgagagtccatggtgtttcacaactgatcctaacatccgagtgggatattgttctcagatacctaactgtgatatgagtcacggacaggattgctaccgcggaaatggtaagaactacatgggcaatctgtcccagaccagatctggcttgacttgcagcatgtgggataaaaacatggaggacctccaccgacacatcttctgggagccggatgcatctaaactgaacgagaactactgccgaaacccagacgatgacgcccatggaccgtggtgctacacaggcaacccactaataccgtgggattactgtccaattagccgatgcgagggggataccactcctacaatagttaaccttgatcaccccgtcatctcttgtgccaaaaccaagcaactgagagttgtaaacggcatccccacccgtactaatatcggatggatggtgtctttacgttatcgcaataagcacatatgtggcggaagtctaataaaggaaagctgggttctgacagcgcggcagtgcttcccatcgcgggacttaaaagactatgaagcctggctcggtatccacgatgtgcatggaaggggagatgagaaatgtaagcaggtgcttaatgtgagccaactggtttacggtcccgagggcagcgacctggtgctaatgaagctggctcgtcctgcggtgttggacgactttgtcagcacgattgacctgcctaactatggatgcacgatcccggagaaaactagttgttccgtgtatggttggggctacaccggcttgatcaactatgacggtttgctgcgagtggcccatctgtatatcatgggcaacgagaaatgcagtcagcatcaccgtggaaaggtgacacttaatgagagtgagatctgtgccggcgctgagaaaattggctcggggccatgtgaaggggactatgggggtcctctagtgtgtgagcaacacaagatgagaatggtcctaggcgtgatcgtgccaggacggggatgtgcaatccccaatagacctgggattttcgtcagggttgcttattatgccaaatggattcacaaaatcatcctcacatacaaggtgcctcagagc

SEQ ID NO: 13646 - DNA, 2184 bp, Artificial Sequence
  Description of Artificial Sequence: Synthetic coding sequence
atgtgggtgacgaaattgctcccagcactgctcctgcagcatgtcctgctgcacctgttattgctgcctattgccatcccctacgcggaaggacaacgtaagagacgaaacactattcacgagttcaaaaagagcgcaaaaacaactctgattaagattgacccagccctaaaaattaagaccaaaaaagtgaataccgccgatcagtgcgccaacagatgcacgcgcaataaaggattaccttttacttgcaaggccttcgtcttcgacaaggcgagaaagcagtgtctgtggtttcccttcaatagtatgagttcgggagtgaagaaagagtttggtcatgagtttgacctctatgaaaacaaagattatatccgtaattgtataataggtaaaggccggtcttataagggcaccgtcagcattacaaaaagtgggatcaaatgtcagccctggtccagcatgattccgcacgaacattcttttctgccatcaagctaccggggaaaagatttgcaagagaactactgcaggaacccacgcggcgaagaaggcggcccctggtgttttaccagtaatccggaagtacggtacgaagtgtgtgacattccacagtgttctgaggtcgaatgcatgacatgtaatggcgagagctacaggggcctgatggaccataccgaatcaggaaaaatatgtcagcggtgggaccaccagacgcctcacaggcataagtttcttccagagaggtatccagataaagggttcgatgataactactgccggaaccccgatggtcagcccagaccctggtgctacactctggatccccatacccggtgggagtactgcgctataaagacatgcgcagataacaccatgaacgatacagacgtccccctggagaccaccgagtgcattcagggacaaggagagggttatcgaggtactgtcaatacaatctggaacggcattccttgccagaggtgggattcgcaatacccccatgaacacgatatgactcccgagaacttcaagtgcaaagatctgcgggaaaactattgccggaacccagatggaagcgaatccccctggtgttttaccacggatcctaatattcgggtgggttactgcagccaaattccgaactgtgacatgagccacggtcaggattgctaccgggggaacgggaagaattacatggggaatctcagccaaacacgaagcggcttaacctgcagcatgtgggacaagaacatggaggacctgcaccggcacatattctgggagcctgacgcaagtaaactgaacgaaaattactgccgaaacccagatgatgacgcccacggaccttggtgttacacagggaacccacttattccctgggattactgtcccatcagcagatgcgaaggagatactacccctactatcgtcaacctagaccaccccgtgatatcatgcgcgaagaccaagcagctccgagtagtgaacgggattccaacccggactaacatcgggtggatggtgagcctgcgctatcggaacaaacacatttgcggcggatcactgatcaaggaaagttgggtgctgactgcacggcagtgttttcctagcagggacttgaaggattacgaggcatggttaggcattcatgatgtgcacgggcgtggggacgaaaaatgcaagcaagtgctgaacgtgtctcagctggtatacggtcctgaggggagcgacctggtccttatgaaattggcgcgacccgccgtgttggatgactttgtatcaacaatagacctgcccaactacgggtgtactatccctgaaaagacttcatgtagcgtttatggctggggctacaccggactcattaactacgacgggctgcttcgagttgcacacctgtacatcatgggcaatgaaaagtgcagtcaacaccacagagggaaagtgactttgaacgaatccgagatttgtgctggtgcggaaaaaatcggcagcggcccttgtgagggggattacggcgggccgctcgtgtgcgaacagcacaaaatgaggatggtcctgggggtcatcgtgcctgggcggggctgcgcaatacccaatcggcctgggatttttgttagggtggcatattatgccaaatggatccacaagattatcttaacgtacaaggtgccacagtca

SEQ ID NO: 13647 - DNA, 2184 bp, Artificial Sequence
  Description of Artificial Sequence: Synthetic coding sequence
atgtgggtaacaaagcttttacctgcgctgctgctacagcacgtactgttgcacttgctacttctgcccatagccattccttatgccgaaggccagcggaagcggcggaacacaatccacgaattcaagaaatcagccaagaccacccttataaaaatcgatccagcactcaaaatcaagaccaagaaagtcaataccgcagaccaatgcgcaaaccggtgtactcgaaacaagggcttgcctttcacatgtaaagctttcgtcttcgacaaagcgagaaagcagtgcttgtggtttccctttaacagcatgagcagcggcgtgaaaaaggaatttggccacgagtttgatttatacgagaataaggactatattaggaattgcattatcggcaaggggcgcagctacaagggaaccgtttccataactaagtctggcatcaagtgccagccttggagcagcatgatcccacatgaacattcgttccttccaagtagctacagggggaaggacctgcaggaaaactactgtagaaatccacggggagaggagggggggccttggtgttttacctcgaatccagaggtccgatacgaggtttgcgatattccgcagtgcagcgaagttgagtgcatgacctgcaacggagagtcctaccgaggtctgatggaccatacagagagcggcaagatctgtcagcgatgggaccatcagaccccccataggcataagttccttccagagcgatacccagacaagggattcgacgataactattgccgcaatcccgacggacagccccgaccatggtgctacacattggacccccatacgaggtgggaatactgtgcgattaagacctgcgctgataataccatgaatgatacagatgttccactggagactaccgaatgtatccaggggcagggggagggatatagggggacggtgaatacaatctggaacgggataccctgccagcgctgggacagccagtatccccacgagcacgatatgactcccgaaaacttcaaatgcaaagatttgcgggagaactactgccgcaaccccgatggcagcgaatctccctggtgttttacaacagatcctaatattcgcgtcggatactgctctcagatacccaattgtgatatgagccacggtcaggattgttatagagggaacggcaagaattacatgggtaatctctcccagacccgttccggcctgacttgtagcatgtgggataagaatatggaagacctgcatagacacatcttttgggagccagatgctagcaaacttaacgagaattactgtcgaaaccctgatgatgatgcacatgggccgtggtgctatacagggaacccactgatcccctgggactattgcccaatttccaggtgtgagggggatactactcccacgatagtaaatctcgatcacccagtcatttcatgtgccaaaacaaaacaactgagagttgttaacggaattccgactcgaaccaatattggctggatggtaagcctgagatacagaaataagcacatctgtggaggtagtctgatcaaagagagctgggtgctgacagccaggcagtgtttccccagcagggatctgaaagattatgaggcctggctcgggattcacgatgtccacggacgcggcgacgagaagtgcaaacaggtcttgaatgtcagccagctggtgtatggacctgagggcagcgacctggtcctaatgaagctggcgcggccagcggtcctggatgactttgtatcaaccatcgacctgccaaactatggatgtaccatccccgagaagacgtcgtgctccgtgtacggatggggctacaccgggcttatcaactacgacgggctgctcagagttgcacacctgtatattatggggaacgagaagtgttctcagcaccacaggggtaaggtgactctgaacgaaagtgaaatctgtgccggtgccgaaaagatagggtccggaccttgcgaaggggactatggtggccctttggtgtgtgaacagcataaaatgagaatggtgctgggcgtcatcgtaccagggcggggatgtgctatacctaatcgccccggcatctttgtcagggtcgcctattacgctaaatggattcacaagattattttgacctacaaggtgccccaaagc

SEQ ID NO: 13648 - DNA, 2184 bp, Artificial Sequence
  Description of Artificial Sequence: Synthetic coding sequence
atgtgggttacgaaactcctgcctgcgctgctcctgcagcatgtgctcctgcatctccttcttcttccaattgcaattccttacgcagaaggccaacgtaagaggaggaacaccatccatgagttcaagaagtcggcaaagactactctgattaagattgaccctgcacttaagatcaagaccaagaaggtcaacacggctgaccagtgcgcaaaccgatgtactaggaacaaaggtctgccttttacctgtaaggcattcgtctttgataaagcaagaaaacaatgtctgtggtttccttttaactcgatgtcaagcggggtgaagaaggaatttggtcacgaattcgacttgtacgaaaacaaggattacattcggaattgcattattgggaaaggtagatcgtacaagggaaccgtttcgataactaagtcaggaataaagtgtcaaccttggagctccatgattccacatgaacattcatttctcccgtcctcctacagggggaaggatctccaagagaactactgtaggaaccctcggggtgaggaaggtggtccctggtgttttacctcgaacccggaagtccgctacgaagtctgtgacatccctcagtgttcggaagtggaatgcatgacgtgtaacggggaatcctaccgtggactgatggaccacaccgagtccggaaagatctgtcagcgttgggatcaccagaccccacatcgccacaagtttcttcccgaacgttaccctgacaagggattcgatgacaactattgtcggaatcctgatggccagccacgcccttggtgctatactcttgacccacacaccagatgggaatactgtgccattaagacctgcgcagataacactatgaacgacaccgacgtgcctcttgagactaccgaatgtattcagggccaaggtgaaggataccgcggaaccgtgaacaccatatggaacggaattccatgtcaacggtgggactcgcagtacccgcatgaacatgatatgactcccgaaaacttcaaatgcaaggacttgcgcgaaaactactgtagaaacccagatggctccgaatcaccttggtgttttacgactgatcctaacatccgcgtcgggtactgttcacagattcctaattgcgatatgagccacggtcaagactgctaccgtgggaatggcaagaattacatggggaacctcagccagactcgttcaggactgacttgtagcatgtgggacaaaaacatggaagatctgcacaggcatatcttctgggaaccggatgccagcaagttgaatgagaactattgccgaaatcccgatgatgatgcgcatggaccgtggtgttatacgggtaatccccttattccttgggactactgcccaatttcgcggtgcgaaggtgataccactcctaccatcgtgaatttggatcatccagtgatttcctgtgcaaagactaaacaacttcgggtggtgaacggaataccaacccggaccaacattgggtggatggtgtcactgaggtacaggaacaagcatatctgtgggggatcacttatcaaagagtcgtgggtgctgaccgcacggcagtgtttcccctccagggacctcaaggattacgaagcatggcttggtattcacgacgtgcatggaagaggagatgaaaagtgtaagcaggtgcttaacgtgtcacaactggtgtacggtcctgaaggctcggatcttgttctgatgaaacttgcacgacctgccgtcctcgatgattttgtctccacgattgatcttcccaactacggctgtacgatacctgagaaaacctcatgctcagtgtacgggtggggttacactggactgatcaactacgacggcctccttagagttgcccatctgtatatcatgggaaacgaaaagtgttcgcagcatcaccgagggaaggtgactttgaatgagagcgagatttgcgccggagcagagaaaatcggctccggaccttgtgaaggggattacggaggcccacttgtgtgtgaacaacacaagatgaggatggtgcttggtgtgattgtgcccggtagggggtgtgcaattcctaatcgtcccggtatcttcgtgagggtcgcgtactacgcgaaatggattcacaaaatcattctgacctacaaggtgcctcaatcc

SEQ ID NO: 13649 - DNA, 2184 bp, Artificial Sequence
  Description of Artificial Sequence: Synthetic coding sequence
atgtgggtcactaaactccttccagcacttttattacaacacgtcctcttgcacttgcttttgcttccaattgctataccatatgcagaggggcaacgtaaacgtagaaatactatccatgaatttaaaaagtccgctaaaactacgcttattaaaatcgatcccgcactcaaaattaagactaaaaaagttaatactgcagaccagtgtgctaacagatgcacgagaaacaaagggttaccatttacatgtaaagcgttcgtcttcgataaagcaagaaaacagtgtttgtggttccccttcaattccatgtcctctggggtgaaaaaagagtttggacacgagttcgatctctacgaaaataaagactatattaggaattgcattatcggaaagggtagaagctacaagggaactgtgtcaattacaaaaagcggtataaagtgccaaccctggtctagcatgattccgcacgaacatagtttcttgccaagctcttatcgtggaaaggacttgcaagaaaattattgtcgaaaccctcgaggagaagaaggcggcccatggtgctttacttcgaatcctgaagttagatacgaggtgtgtgacattccacagtgttcagaggttgagtgtatgacttgtaatggtgaatcatatagaggtcttatggatcatacagaaagtggaaaaatttgccaacgttgggatcaccagactcctcatagacataaatttcttcccgaacgatacccggataaagggttcgacgataattactgtcggaatccggatgggcaaccacgtccgtggtgttacacattagatcctcatacgcgctgggaatattgcgctatcaagacatgcgctgacaatacaatgaatgatacggatgtcccacttgagactaccgaatgtatccaagggcaaggtgaaggctatcgaggaacagttaatactatctggaacggtattccatgtcaacgctgggattctcagtatccacatgagcacgacatgacgcctgagaactttaagtgcaaagacttacgggagaattattgtcgaaatcctgatggatctgaaagcccatggtgttttaccacagacccaaacattcgggtgggatactgctctcaaatcccaaactgcgatatgtcacacggacaagattgttatcgaggtaatgggaagaattatatgggaaatctttcgcaaaccaggtcaggactaacatgctctatgtgggataagaatatggaagatctacaccgacatatattctgggaaccagacgcgtccaaacttaatgaaaactattgcagaaatccagatgacgatgctcatggtccgtggtgctatacaggaaatccacttatcccatgggactactgccctatcagtcgatgcgaaggagatacgacacccacaatagtcaatcttgatcatcccgtgatttcctgtgcaaaaactaaacagcttagggtggtgaacggtataccaacaagaaccaatatcggttggatggtgagtctccgatatcgcaataagcatatctgcggaggcagtctcattaaggagtcttgggttcttacggcacggcaatgttttccgtccagagacctgaaagattatgaagcttggttaggcatacacgatgttcatggacgtggggacgagaaatgtaagcaagttttaaatgtgtcgcagctcgtgtatggaccagaaggttctgatctggtgctaatgaagcttgcgcgtccagcagtgcttgacgactttgtatccactattgatttaccaaattacggttgtacaataccagagaaaacaagctgcagtgtttatggatggggttataccggattgattaattatgatggtctcttgcgtgttgcccatttatacatcatgggaaatgaaaaatgctcacagcatcacagaggaaaggtgactcttaacgaatctgaaatttgcgcaggagctgaaaagattggttctggaccttgcgagggtgattacgggggtcctctggtttgtgagcagcacaagatgagaatggtgctgggagttattgtgcccgggagaggctgtgccatccctaaccgtcccggtatctttgtaagggtcgcttactatgcgaagtggatacataaaatcattcttacatataaggtcccacaaagt

SEQ ID NO: 13650 - DNA, 2184 bp, Artificial Sequence
  Description of Artificial Sequence: Synthetic coding sequence
atgtgggtgaccaagctccttcccgcgctcttgttgcaacacgttcttctccatctgctcctcctgcccattgccataccatatgctgagggccagagaaaaagacgaaacacaatacacgaatttaaaaaatccgcaaagaccaccctgatcaagatcgatcctgcactcaagataaagacaaaaaaggtaaacactgcagaccagtgtgccaatagatgcacgaggaataagggccttccctttacttgtaaggccttcgtcttcgacaaggctcggaaacagtgtctctggttcccctttaattcgatgagttctggagtaaaaaaggagtttggccacgagtttgacctatatgaaaataaagattacattcgcaattgcattatcggcaagggccgctcttacaaagggaccgtttcaatcactaagtcaggtattaagtgccagccttggagctctatgataccacacgagcacagtttccttccttcctcctaccggggcaaggacttacaggagaactactgtcggaacccaagaggggaggagggaggaccatggtgcttcacaagtaatcctgaagtgaggtatgaagtctgtgacatccctcagtgcagtgaggtggagtgcatgacgtgcaacggcgaatcttatcggggcctcatggaccacactgagtccggtaaaatctgccaacgttgggaccatcagacgcctcatagacataagttcctccctgaacgctaccctgacaagggatttgatgataactactgtcgcaacccggatggtcagcccaggccttggtgctatacactggatccccacacgcggtgggagtactgcgcaataaaaacgtgtgcggacaataccatgaacgacacagatgtacccctggagaccaccgaatgtatccaaggtcagggtgagggctatagaggaactgtcaacaccatttggaatggcataccatgtcagcgatgggattcgcagtacccacatgagcacgacatgacaccggagaatttcaagtgcaaggaccttagggaaaactattgccgcaaccccgatggtagcgagagtccttggtgcttcaccacagaccccaatattagggtaggctactgtagccagatcccgaattgcgatatgtctcatggccaggactgctacaggggcaacggcaagaattacatgggtaacctgtcacagacgcggtccggtcttacatgttcaatgtgggacaaaaatatggaggatctccataggcacatcttctgggagcctgacgccagcaagctcaacgagaactactgtcgcaaccctgacgacgacgcccacgggccttggtgttatacagggaatccattgatcccatgggactattgtcctatctcgcgctgtgagggcgacaccactcctaccattgtgaacctggatcatcccgtcatctcctgcgccaaaaccaagcaactgagagtagtgaatggcatcccgactaggaccaatatagggtggatggtgtcactgaggtacaggaacaaacacatttgcggtggaagcctgatcaaggagagttgggtcctaactgcgcggcaatgtttcccaagtcgggatctgaaagattatgaagcctggctgggcatccatgacgtgcatgggaggggggatgagaagtgtaagcaggtgctaaatgtttcacagctggtatacggtccagaaggaagtgacctcgtgcttatgaagctcgcccgccctgcagtgctggacgatttcgttagcacaatcgatctgccaaactatggctgcactatcccagagaagaccagctgcagcgtttatggttggggctacacaggattaattaattacgacggtctgctgagggtggcccatctgtacatcatgggcaatgaaaaatgttcccagcaccaccgtgggaaagtaaccctaaatgagagcgagatctgcgccggcgccgagaagattggtagcggaccctgtgaaggtgattacggcggccctttggtgtgtgagcaacacaagatgaggatggttctaggggtgattgtgcctgggcgcggatgtgccattccaaatagaccagggattttcgtgagagttgcgtattatgcgaagtggatacacaagatcatcctgacgtataaagtgccacaatcg

SEQ ID NO: 13651 - DNA, 2184 bp, Artificial Sequence
  Description of Artificial Sequence: Synthetic coding sequence
atgtgggttaccaaacttttaccagcattattattacaacatgtattacttcatcttttattactaccaattgctattccatatgctgaaggacaacgaaagagaagaaatactattcatgaattcaaaaaatcagctaaaacaactttaattaagattgatccagcattaaaaataaaaactaaaaaagttaacacggctgatcaatgtgcaaatagatgtaccagaaataaaggtttaccatttacttgtaaagcatttgtttttgacaaagcacgaaagcaatgtttatggtttccatttaattctatgtcatcaggagttaaaaaagaatttggacatgaatttgatttatatgaaaataaagattatataagaaattgtattattgggaaaggtagaagctataaaggtacagtttcaataacaaaatcaggtattaaatgtcaaccatggtcttcaatgatacctcatgaacattcatttttgccttcaagttatagaggaaaagatttacaagaaaactattgtagaaatccaagaggagaagaaggaggaccatggtgttttacctctaatccagaagttagatatgaagtatgtgatataccacaatgtagtgaggttgaatgtatgacatgtaatggagaatcatatcgtgggttaatggatcatactgaaagtggtaaaatttgccaaagatgggatcatcaaactccacatcgacataaatttcttccagaaagatatccagataagggatttgatgataactattgtcgtaatccagatggacaaccaagaccttggtgttatactcttgatcctcatactcgatgggagtattgtgctattaaaacatgtgctgataatacaatgaatgataccgatgtaccacttgaaacaacagaatgtattcaaggacaaggagaaggatatagaggaactgtaaatacaatttggaatggaattccatgtcaaagatgggactcacaatatccacacgaacatgatatgaccccagaaaatttcaagtgtaaggatttaagagaaaattattgtagaaatcctgatggaagtgaatcaccatggtgttttacaacagatccaaatattagagtaggttattgtagtcaaattccaaattgtgatatgtcacatggtcaagattgctatagaggaaacggaaaaaattatatgggaaatcttagtcaaactagatcaggattgacatgttcaatgtgggataaaaatatggaagatcttcatagacatattttctgggaaccagatgcttctaaattaaatgaaaattattgtagaaatccagatgatgatgcacatggaccttggtgttatacaggtaatcctttaattccatgggattattgtccaatatcaagatgtgaaggagatacaacaccaacaatagtaaatttggatcatccagtaatttcatgtgcaaaaactaaacaattaagagttgtaaatggaatcccaactcgaactaatattggatggatggtaagtttgagatatagaaataaacatatttgtgggggaagtcttattaaagaaagctgggttcttactgccagacaatgtttcccatcaagagatcttaaagattatgaagcatggttaggtattcatgatgttcacggaagaggagatgaaaaatgtaagcaagttttaaatgttagtcaattagtatatggaccagaaggatcagacttagttcttatgaaattagcaagaccagcagttttagacgattttgttagtactatagatcttccaaattatggatgtacaattccagaaaaaacaagttgttcagtatatggatggggatacacaggtcttatcaattatgatggactacttagagtcgctcatttatatattatgggaaatgaaaaatgtagtcaacatcatagaggaaaagtaactttaaatgaatcagaaatttgtgctggtgcagaaaaaataggtagtggaccatgtgaaggagattatggaggaccattagtttgtgaacaacataagatgagaatggttcttggagtaatagtaccagggagaggatgtgcaattccaaatagaccaggtatttttgttagagtcgcatattatgcaaaatggattcataagattattttaacttataaggttccacaaagt

SEQ ID NO: 13652 - DNA, 2184 bp, Artificial Sequence
  Description of Artificial Sequence: Synthetic coding sequence
atgtgggtgactaagctgcttcctgcacttcttctccaacacgtgctgctccaccttttgctgctgccaattgcaattccctacgccgaaggacaacgtaagagacggaatacgatccatgagtttaagaaatcagcaaaaaccacgctgataaagattgaccctgccctcaaaatcaaaactaagaaggttaatactgcagatcaatgcgccaatagatgtacgcggaataagggacttcctttcacctgtaaagcgtttgtctttgacaaggcacggaaacagtgtctgtggtttccatttaactcgatgagctcgggtgtgaagaaggaatttgggcatgaattcgacctgtatgaaaacaaagattacataaggaattgcatcattggaaagggaagatcgtacaagggtactgtatctatcaccaagagcggaattaagtgtcagccatggtcgagcatgatcccacatgagcattccttccttccctcctcctaccgggggaaggatcttcaggaaaactactgcagaaatccacggggcgaggaaggtggcccttggtgttttacctcgaaccccgaggtgaggtacgaggtgtgtgacatcccgcaatgctcggaggtggaatgcatgacttgtaacggcgagagctaccggggcctcatggatcacactgaatctggtaagatttgtcagaggtgggatcaccaaaccccgcatagacacaaatttcttcctgaacgttacccagacaaaggattcgacgataactattgtagaaatccagatggccagcctagaccttggtgctacactcttgacccacacactcgttgggagtactgcgccatcaagacctgcgccgataacactatgaacgataccgacgtcccccttgaaactactgaatgcatccaaggtcagggagagggatatcgcggaactgtgaataccatctggaatggcatcccatgtcaacgttgggatagccagtaccctcacgaacacgatatgaccccagaaaacttcaagtgtaaggatctgcgtgagaactattgtcgaaaccctgatggtagcgagtcaccatggtgtttcaccaccgacccaaacatccgggtcggatactgttcgcagataccaaactgcgatatgtctcatggacaagattgttaccgtggaaatggtaaaaactacatgggaaatctgtcccaaactcgttcaggcctcacgtgttcaatgtgggacaagaacatggaagatcttcacagacatatcttctgggaacctgacgcttcgaaactcaacgagaattactgtaggaatccagatgacgatgcgcacggcccgtggtgttacactggaaaccccttgattccatgggactactgcccaatttccagatgtgagggtgacaccactcccaccatcgtgaacctggaccatcctgtgatatcatgtgcaaaaactaaacagctgcgggtggtcaacggaatcccgacgagaaccaacattgggtggatggtgtcgctgagataccgaaacaagcatatttgcgggggaagccttatcaaagaatcatgggtgctgactgcacgccagtgttttccatcgagagatctgaaagactacgaagcatggctggggatacacgacgtgcatggtcgcggagatgagaaatgcaagcaagtgcttaatgtgagccagcttgtgtatggaccagagggttccgaccttgtcctgatgaagctggccaggccggcagtgcttgatgatttcgtgtccactattgatctcccaaactacggctgtaccattcctgagaaaaccagctgtagcgtgtacggctggggctacaccggtctgatcaactatgatggacttctcagggtggcacatctttacatcatgggtaacgaaaagtgttcccaacaccatcggggaaaggtgactcttaacgagtcggagatatgcgccggagcagaaaagattggttcaggaccatgtgaaggagattacggaggtcctctggtgtgcgaacaacacaagatgcgcatggtcttgggtgtgattgtgcctggccgcggttgtgcgatcccaaaccgtccaggtatattcgtccgtgtggcatactacgcaaagtggattcataagatcattctgacctacaaggtcccacaatcg

SEQ ID NO: 13653 - DNA, 2184 bp, Artificial Sequence
  Description of Artificial Sequence: Synthetic coding sequence
atgtgggtgactaagctgcttcctgccctgctgctccagcatgttcttctgcaccttctgctgctgccaatagcaattccatatgcagaaggccagagaaagcggaggaatactatccacgaatttaagaagagcgccaagactaccctgattaaaatcgacccagctcttaaaataaagaccaagaaggtgaacaccgccgaccagtgtgcaaacagatgcacacggaacaagggactgcctttcacctgcaaggcctttgtctttgacaaggccaggaagcagtgcctctggttcccgttcaactccatgtctagcggtgtgaagaaggaatttggtcacgagttcgatctgtatgagaacaaagactatattagaaattgtattataggcaagggcagaagctacaagggaactgtctctattactaagagcggaataaaatgtcaaccttggtcctcaatgattccccacgaacacagtttccttccttcctcttaccgcggcaaggatctgcaggaaaattattgtaggaatccccgcggcgaagaaggagggccttggtgtttcacaagcaatcccgaggtgcggtacgaagtctgcgatataccccagtgcagcgaagtcgagtgtatgacttgtaacggtgagtcatacagaggccttatggatcacaccgaatccgggaagatctgtcagagatgggaccaccagactcctcaccgccacaaattcttgcccgaacggtaccctgacaaaggtttcgatgataactactgcaggaatcccgatggtcagccccggccctggtgttacacgctggatcctcacaccaggtgggaatattgtgctattaagacgtgtgccgacaacaccatgaacgacaccgacgttcctcttgaaacaactgaatgcatccaggggcaaggcgaggggtatcggggcacagtaaataccatatggaacggtattccctgtcagaggtgggatagtcagtatcctcacgagcacgatatgaccccggagaacttcaagtgtaaagacctgcgggaaaattactgtagaaatcccgacggctcagagagcccctggtgcttcacaacagatccgaacataagagttgggtactgtagccagatacccaactgtgatatgtcccacggacaggactgctatcgcgggaatggaaagaattacatgggcaatcttagtcagacacgctcaggactcacctgcagtatgtgggacaagaacatggaggacctgcatcggcatattttttgggagccagacgctagcaagcttaatgagaattattgcaggaacccagacgacgatgctcacggcccatggtgttataccgggaatcccctgatcccttgggattattgtcctatatctcggtgtgaaggtgacaccacccccacgatcgttaatctggaccacccagttataagttgcgccaagacgaaacagctgagagttgttaacggtatccccacgagaaccaacattgggtggatggtctccttgaggtaccggaataagcacatttgtggcggttccctcattaaagagtcatgggtgctgacggctcgacagtgcttcccatctagagacctcaaggattacgaggcttggctggggattcacgacgtccacggccgaggggacgagaagtgcaaacaggtgctgaatgtgagccagctggtgtacggacctgaaggctcagatctcgtgctcatgaagctcgcacgccccgccgttttggacgactttgtcagcaccatcgacctgccaaactacggatgcactattcccgaaaagacatcttgtagcgtgtatgggtggggatacaccggcctgattaattatgatggattgcttcgagtagcccatctttatattatgggcaatgaaaaatgttctcagcatcaccgaggtaaggtgaccctgaacgagtccgagatatgcgctggggctgaaaagataggctctggaccatgtgaaggcgactacggcgggcctcttgtgtgcgagcaacataagatgaggatggtcctgggagtgatcgtgccagggaggggatgcgcgataccaaatagacctggaattttcgttagagtggcatattacgcaaagtggattcacaaaattatcctcacctacaaggtgcctcagagt

SEQ ID NO: 13654 - DNA, 2184 bp, Artificial Sequence
  Description of Artificial Sequence: Synthetic coding sequence
atgtgggtgaccaaactgctgccagcactgctgctgcagcacgttctgcttcatctgttgctcctgccgatcgctattccgtacgcagagggacagcgcaagcgccggaacaccatccacgagttcaagaagtccgctaagacgaccttgattaagatcgaccctgctctgaagataaagacgaagaaagtgaacactgccgaccagtgtgccaacagatgcacccggaacaaagggctgccgttcacttgtaaagccttcgtgttcgacaaggcccggaaacaatgcctgtggtttccatttaactcaatgtcgtccggtgtgaaaaaggagtttggtcacgagttcgacctgtacgagaataaagactacatccgcaattgcatcattggtaaaggacgctcgtacaaaggaactgtctcgatcactaaatcgggcatcaagtgtcagccttggtcatcaatgatcccgcacgagcacagcttcttgcccagctcttaccgcggaaaagacctgcaggagaactactgtcgcaacccgcggggagaagagggaggcccgtggtgctttacttccaatccagaagtgaggtacgaggtgtgcgacatcccgcagtgctccgaggtggagtgcatgacctgtaacggagagagctaccgcggactgatggaccacaccgaaagtggaaagatctgccagcgctgggaccaccaaaccccccatcgccacaaattcctgccagagagatacccagacaaagggtttgacgataactattgcagaaatccagatggacagcctaggccatggtgctacaccctcgacccgcacaccaggtgggaatactgcgcaatcaaaacttgtgccgataacactatgaacgacaccgatgtacctctggaaaccaccgagtgcatccaaggacagggagagggatacagaggcactgtcaataccatttggaacggaattccctgtcagagatgggactcgcagtatccacatgagcacgacatgactccagaaaacttcaagtgtaaggacctgagagagaattactgtcgaaacccggacggatctgagtcgccctggtgcttcacgactgatccgaacattagagtcggatactgttcgcagatcccaaactgcgatatgtcgcatggtcaggactgttaccgggggaacggtaagaactatatgggaaatctttcgcagacgcggtcgggtcttacctgctccatgtgggataagaatatggaagatctgcacagacacatcttctgggaaccggacgcgagcaagctgaatgaaaactattgtaggaacccggatgatgacgcgcatggaccctggtgttacacgggcaacccactgatcccctgggattactgcccgatctcgcggtgtgagggcgatactacccctaccatcgtgaatctcgaccatccagtcatctcgtgcgcaaaaaccaaacagctgcgcgtggtcaacggcatcccgaccaggacgaacatcgggtggatggtgtcactgcggtacaggaacaagcacatttgtggagggtccctgatcaaagaatcatgggtgctcaccgctcggcaatgcttcccatcgagagacttgaaggactacgaggcgtggttggggatccacgacgtgcacggacggggcgatgagaagtgtaagcaggtgctcaatgtctcccagctcgtgtacggacccgagggctcggatctcgtgctgatgaagctggccagaccggcagtgctcgacgacttcgtgagcactatcgatctgcccaattacggctgtactatcccggaaaagacttcatgctctgtgtacggatggggctacacggggctgatcaattacgacgggcttctgcgcgtggcgcatctgtacatcatgggaaacgagaaatgctcccagcatcacagaggaaaggtgactcttaatgagtcagaaatctgtgccggagcggaaaagatcggctctggaccatgcgaaggcgattacggagggccgctcgtctgcgagcaacacaagatgcgcatggtgctgggcgtgatcgtcccgggaagagggtgcgcaatccctaaccgcccgggtattttcgtcagagttgcctactacgcaaagtggattcacaagattatccttacctacaaggtccctcagtcc

SEQ ID NO: 13655 - DNA, 2184 bp, Artificial Sequence
  Description of Artificial Sequence: Synthetic coding sequence
atgtgggtgaccaagctgctgcccgccctgctgctgcagcatgtgttgctgcacctgctgcttctgccgatcgcgatcccgtacgcggagggacagcgcaagagaagaaacactatccacgaattcaaaaagtcagctaagactactctgatcaagatcgacccagcactgaagatcaagactaagaaagtgaacaccgcggaccaatgcgccaataggtgcactcggaacaagggcctgcctttcacctgtaaggccttcgtgttcgacaaagcccgaaaacagtgcctgtggttcccctttaactcaatgtctagcggagtgaaaaaagagttcgggcacgaattcgatctgtacgagaataaggactatatcaggaactgtatcatcggcaagggacgcagctacaaggggaccgtttccattaccaagtcaggaatcaagtgtcagccatggtcctcgatgatcccacacgaacactcattcttgccgtcaagttatagagggaaggacctccaggagaattactgcagaaatccgcgaggagaggaaggaggaccttggtgtttcactagcaatccagaggtcaggtacgaggtttgtgacatcccacaatgctccgaggtcgagtgcatgacctgcaacggcgagtcatacagaggactcatggatcataccgagtcagggaaaatctgccaaagatgggaccaccagaccccgcaccggcataagttcctcccggagcggtacccagacaagggctttgacgacaactactgccggaaccctgatggtcagccaaggccgtggtgttacactctcgatccgcacactcgctgggagtactgtgcaattaagacttgcgcggacaataccatgaatgacaccgatgtaccgctggaaactactgagtgcatccagggtcaaggagaaggctataggggtaccgtcaacactatctggaacggaatcccttgccaacgctgggatagccaatacccgcacgagcatgatatgactcctgaaaacttcaaatgcaaggatctgcgcgagaattactgtaggaatccggacggctccgaatccccctggtgcttcaccaccgacccaaatatccgggtcggatactgcagccaaatcccgaattgcgacatgtcacacggacaagactgttatagaggcaacggaaagaactacatgggaaacctcagccagactaggtcggggctgacctgttcgatgtgggacaagaatatggaagatttgcacagacacatcttctgggaaccggacgcatcgaagctcaacgaaaactactgccgcaacccagatgatgacgctcacggaccatggtgctatacgggaaatccactcatcccgtgggactattgccctatttcgcgatgcgagggggatactacgcctaccatcgtcaatctggatcatccggttattagctgtgcaaagactaagcaactgagagtggtcaacggaatcccgactaggaccaatatcggatggatggtgtcgctgcggtacaggaacaagcacatctgcggtggttcactgattaaggagtcatgggtcctgaccgcgcgccagtgcttcccctccagagatctgaaggattacgaggcctggctgggaatccatgacgtccacggacggggcgacgagaagtgtaagcaagtcctgaacgtgtcgcagctggtgtacggaccggagggctctgacctggtgctgatgaaactcgctcggcctgccgtgctggacgactttgtgtcaaccatcgatctccccaattacggatgtacgatcccggaaaagacctcatgttcagtgtacggatggggatacactgggcttatcaattacgatggactgctccgcgtggcgcacttgtacatcatgggcaatgagaagtgctcccagcatcatcggggaaaggtgacccttaacgaatccgaaatttgcgcaggcgcagagaagattggatcgggtccatgcgagggagactacggcggcccactggtgtgtgaacaacacaagatgcggatggtcctcggagtcatcgtcccaggacgcggctgtgctatcccaaaccgccccggaatcttcgtgcgcgtcgcctactacgccaaatggatccacaaaatcattcttacctacaaggtgccgcagtcc

SEQ ID NO: 13656 - DNA, 2184 bp, Artificial Sequence
  Description of Artificial Sequence: Synthetic coding sequence
atgtgggttacgaaattattacccgcactgctcctacaacacgtgctccttcacctactgttactgcccattgccattccctatgccgaaggacagcgcaaacgtcgtaacaccatccacgagttcaaaaaatcagccaagaccacccttataaagattgaccccgcccttaagattaagactaagaaagtgaatactgcagatcaatgcgccaatcggtgtacccgcaacaaaggcttacccttcacctgcaaagccttcgtcttcgataaggcgcggaagcagtgcctgtggttcccctttaactccatgagcagcggggtgaaaaaggagtttggacatgaattcgatctctacgagaacaaggattacatcaggaattgcattatcggcaagggccgctcttataagggcaccgtctcgataacgaaaagtggtataaaatgtcaaccgtggagtagcatgattccgcatgagcatagctttctaccttcatcttaccgtggtaaggatctgcaggagaactattgcaggaatcccaggggcgaggagggcggcccctggtgcttcacctcaaaccccgaggtgcggtatgaagtctgtgatatcccacagtgtagcgaggtcgagtgtatgacttgcaatggcgagtcttaccgaggactcatggaccatacagaatcagggaagatttgccagcgctgggaccatcagactccacataggcataagttcttgcctgagcgctaccctgataagggatttgacgacaactactgccgtaatccggatggacagccccgcccatggtgttatacgctggacccgcacaccagatgggaatactgcgccattaagacttgcgccgacaacaccatgaacgacaccgatgtgcccctggagactactgagtgtattcagggccagggcgagggatatagaggtacagtgaacaccatttggaatgggataccttgtcagagatgggactcccaatacccacatgagcacgacatgacacctgagaatttcaagtgtaaggatctccgagaaaattactgtaggaacccggatgggtctgaatcaccctggtgcttcactacagatccaaatataagagttggatattgctctcagattccaaattgcgacatgtcacacggtcaggactgctaccgcggcaatggcaagaactatatggggaatttgagtcaaacaaggtccgggctgacctgttctatgtgggataaaaacatggaggacctgcacagacatatattttgggaacctgatgcttctaagttgaatgaaaattactgccggaaccctgatgacgacgcccacggcccttggtgctataccgggaatcctctgatcccctgggactattgtccgatcagccgatgtgaaggggataccacgcctacaatcgtgaatctggatcacccagtgatttcgtgtgctaagactaagcagctcagggtggtcaatggcataccaacccggaccaatattgggtggatggtgtcgctgcggtatagaaataaacatatttgcgggggttcgctcatcaaggaatcctgggtcctgacagcccgtcaatgctttccatcaagagatctcaaagactatgaggcctggttgggtatacatgatgtccacggaaggggagatgaaaagtgtaaacaagtactgaacgtgagccagctggtgtacggccctgaaggcagtgatctagtgctgatgaagttggcacgccccgctgtgctggatgacttcgtaagcacaattgacttgcccaattatggttgcaccatccccgagaagacctcttgcagtgtttacgggtggggatacaccggcttgattaattatgacggcctgctccgtgtcgcgcacttgtacatcatgggcaatgagaaatgttcgcagcaccaccgaggcaaggtcacactcaacgaatcagaaatttgtgccggcgcagaaaaaattggatcaggtccatgcgaaggagactatggtgggcccttggtttgtgagcagcataagatgaggatggtcctgggggtcatcgtccctggtagaggctgcgccattcctaaccgtccaggtatatttgttagggtcgcctactatgcgaaatggatccacaagattatcttgacctataaagtacctcagtcc

SEQ ID NO: 13657 - DNA, 2184 bp, Artificial Sequence
  Description of Artificial Sequence: Synthetic coding sequence
atgtgggtaaccaagttgttgcctgctctgcttctgcagcacgtccttctgcacctgctgctgctgcccatcgccattccatacgccgagggtcagcggaagcgaaggaataccatccacgagttcaagaagagcgcgaagactactctcattaaaatcgacccggccctcaaaatcaaaacaaagaaggtcaatacagccgatcagtgcgcaaatcgatgtactagaaacaaaggtctccccttcacctgcaaggcattcgtgtttgataaggccaggaaacagtgcctgtggttcccctttaattccatgagctccggcgtgaagaaggaatttggacacgaatttgacttgtatgagaataaagactacatacggaactgcatcatcggaaaaggccgctcttataagggtacagtcagcatcacgaagtccggaattaagtgccagccctggagctctatgattccccatgagcactcctttctgccttccagttacaggggtaaagatttgcaggagaactactgtagaaaccctcggggagaagagggcgggccttggtgcttcacctccaatccagaagtcagatatgaggtctgtgacatcccgcagtgctcagaagtcgaatgtatgacttgcaatggcgagtcctatcgcggactcatggatcatacagaaagtggcaagatttgtcagcggtgggaccaccagactccgcaccgacataaattcctccccgagcggtaccccgataaggggtttgatgataattactgccgcaacccagatggtcagcctagaccatggtgttatacattggatccccacacacgctgggaatattgtgcgatcaagacatgcgccgataacacaatgaacgacaccgacgtaccactcgagacaaccgagtgcatacaggggcagggcgagggctacaggggtactgtaaatacgatatggaacggcattccctgtcaacgatgggatagccagtacccccacgaacatgatatgactcccgagaatttcaagtgcaaagacctcagggagaattactgcagaaatccagatggcagtgagtccccctggtgttttacaactgacccaaatatcagagttggatactgctctcagatccccaactgtgacatgtcccacggtcaggattgctaccgggggaacggaaaaaattatatgggaaatctctcccagaccaggtcaggactgacctgttccatgtgggataagaatatggaagatttgcaccgacatatcttctgggagcccgatgcctccaagctcaacgaaaactactgtaggaatcccgatgacgatgcccacggaccctggtgttatacaggaaaccccctgattccctgggactactgcccaatttccagatgcgagggcgataccacaccaaccattgtgaacctggaccacccagtgatttcctgcgcaaagacaaagcaactgcgggtggtgaatggaatacctactagaaccaatattgggtggatggttagtctcaggtatagaaacaagcacatctgtggtgggtctttgatcaaagaaagctgggtgctcaccgcccgacagtgcttcccttctcgcgatcttaaagactacgaggcctggttgggtatccacgatgttcacggtcggggggacgagaaatgtaagcaggttctgaatgtctcacagctcgtatacggaccagaggggtctgatctcgtgctcatgaagctcgccagaccagctgtccttgatgatttcgtgagtactatcgatctgcccaattatggttgtaccatcccagaaaagacatcttgtagcgtgtacgggtggggttatacagggctgatcaattatgatggcttgctgcgcgtagctcacctgtacatcatggggaacgagaagtgctctcagcatcatagaggcaaagtgacactcaacgaaagtgagatttgtgcaggtgccgagaagatcggttccggcccatgtgagggggattatggcgggcctctcgtttgcgagcaacataagatgaggatggtcctgggcgtcatcgtaccgggccgggggtgtgcaatccccaaccggccaggcatattcgttagagtggcctactacgccaaatggattcataagatcattctgacatataaggttccacagtct

SEQ ID NO: 13658 - DNA, 2184 bp, Artificial Sequence
  Description of Artificial Sequence: Synthetic coding sequence
atgtgggtgaccaagttgctgcctgccttgctgcttcaacatgttctccttcatctgctgctgctccctatagccattccttacgcagaaggacagagaaaacgaagaaacactattcatgaattcaagaagtcggccaaaaccactttgattaagattgacccggcacttaagatcaaaaccaagaaggtgaacactgcagaccagtgcgcgaacagatgtactcggaacaagggtttgccattcacttgtaaggcatttgtgtttgataaggcacggaagcagtgcctctggtttcctttcaattcgatgtcaagcggcgtgaagaaagagtttggacatgaatttgacctctacgagaacaaagattacatcagaaactgcattataggaaaaggccgatcatacaagggtactgtgagcatcactaaaagcgggataaagtgtcaaccgtggtcctcaatgattcctcacgaacactcttttctgccatcttcctatcggggcaaagatctgcaagagaactactgtcgtaatcccagaggagaagaaggaggaccctggtgttttacgtcgaaccccgaggtcagatacgaagtgtgtgacatacctcaatgttctgaagtcgagtgtatgacctgtaacggggaatcgtaccgaggactgatggaccacaccgagtcgggaaagatctgtcaacgatgggaccatcagactcctcaccgtcataagtttcttccagaaaggtatcccgacaaggggtttgatgacaattactgtagaaaccccgatggacaacctcggccctggtgttacaccctggaccctcatactcggtgggaatattgcgctatcaagacctgtgccgacaatactatgaatgacaccgacgtgccactcgagactactgagtgcattcaaggtcagggagaaggttacaggggcaccgtgaacaccatttggaacggtatcccctgtcaaagatgggattcacaataccctcatgaacatgatatgactccggagaatttcaaatgcaaggaccttagagaaaactactgccgcaaccctgacggctccgaaagcccttggtgctttaccaccgatcccaatattcgcgttgggtactgttcgcaaattccaaactgtgatatgtcacatggccaagattgctacaggggtaacggaaagaactacatgggaaatctcagccagacccgctcgggattgacctgtagcatgtgggataagaatatggaggatctgcatcgacatatcttttgggaacctgacgcaagcaagctgaacgagaattactgtaggaaccctgatgatgatgcacacggaccttggtgctacactggtaacccgctgattccctgggactactgcccaatctcgcgctgcgaaggcgacaccaccccaacgattgtgaaccttgatcatcctgtgatttcgtgtgccaagaccaagcagcttagagtcgtgaacggcatccctaccagaaccaatattggctggatggtcagccttagataccggaacaaacacatttgtggcggatcgctgataaaagaatcgtgggtgttgaccgcccgacagtgtttcccgtcgagagatctcaaggactacgaagcctggctggggatccacgatgtgcatggacggggcgatgaaaaatgtaagcaggtgctcaacgtgtcgcagctggtgtacggcccagaaggcagcgatcttgtgctcatgaagctcgcacgcccggccgtgcttgacgattttgtgagcaccattgatctgcctaattacggctgcacgatccccgagaaaacgtcctgttccgtgtacggttggggatacactggactgattaactatgatggacttctgagggttgctcatctctacattatgggaaatgagaaatgtagccaacaccacagaggtaaggtcactctgaacgaatccgagatctgcgcaggtgcggagaagattggaagcggaccttgcgaaggtgattacggaggtcctcttgtctgtgagcaacataagatgaggatggtgctgggcgtgattgtgcctggacggggctgcgcaatcccgaacaggccaggtattttcgtgcgagtcgcatactatgcaaagtggatccataagattatccttacctacaaagtgccacagtcg

SEQ ID NO: 13659 - DNA, 2184 bp, Artificial Sequence
  Description of Artificial Sequence: Synthetic coding sequence
atgtgggtgaccaaattgctgccagccctgctgcttcaacatgtgctgctgcatttgctgttgcttccgatcgctatcccttacgccgaaggacagcggaagcgccgcaatacgattcacgagtttaagaaatcagcaaagactaccctgatcaagatcgatcccgcactgaagatcaagacgaagaaggtcaacactgcagatcaatgtgccaatcgctgtacgcgcaacaagggattgccgttcacctgcaaggccttcgtgttcgataaggcgcgcaaacagtgtctgtggtttccgttcaacagcatgtcgtccggagtgaaaaaggaatttgggcatgagtttgacctgtacgagaacaaggactacatcaggaattgtatcatcggaaaggggcggtcctacaaaggaactgtgtcgatcactaagtccggaatcaagtgtcaaccatggtcatcgatgattccccacgaacatagcttcctcccgtcatcctaccggggcaaagatctccaggaaaactattgtcgcaaccctcggggagaggagggaggaccatggtgcttcacctccaatcctgaagtaagatacgaggtctgcgacatcccacagtgctccgaggtggagtgcatgacttgtaatggggaatcatacagaggactgatggaccataccgagtcaggaaaaatctgccagcgctgggatcaccaaactccgcaccgccataagttcctgcccgaacggtatccggacaagggcttcgatgataactactgccggaatcccgacggtcagccccggccgtggtgctacaccctggacccgcatacgagatgggagtactgcgcgatcaagacctgcgcggacaacactatgaacgacactgacgtccccttggagactaccgagtgcattcagggccaaggggagggctaccgagggaccgtgaatacgatctggaacggcatcccatgccaacggtgggacagccagtacccccatgagcatgacatgaccccggaaaacttcaagtgcaaggacctccgggagaactactgcaggaaccccgacggatcggagtcaccttggtgcttcactaccgatccgaacatccgcgtcggctactgttcccaaatcccgaattgcgacatgagccacgggcaagattgctatagggggaacggcaagaattacatgggtaatctgtcgcagacccgcagcggcctgacctgctccatgtgggacaaaaacatggaggaccttcaccgacacatcttctgggaaccagacgcttcaaaacttaatgaaaactactgccgcaacccggacgatgacgctcacggcccttggtgctacactggaaacccgctgattccgtgggactactgcccgattagccgctgcgaaggcgacactacccctactatcgtcaacctcgaccatccagtcatctcgtgcgcgaaaaccaagcaactcagggtcgtgaacggaatccctacgcggactaatatcggttggatggtttccctgagatatcggaataagcatatatgcggcgggtcactgatcaaagaaagctgggttctcaccgctcggcagtgtttcccctcccgggatctgaaggattacgaggcctggctggggatccatgatgtgcacggtcgcggagatgaaaagtgcaagcaggtgcttaatgtctcccagttggtctacggccccgaaggatccgacctggtgctcatgaagctggcacggccggcggtgctggatgacttcgtgagcaccatcgatctgcctaactacgggtgcactatccctgagaaaacttcgtgctcggtctacggatggggatacacgggattgatcaactacgatggactgttgcgcgtcgcccacctgtacatcatgggtaatgaaaaatgctcgcagcaccaccggggaaaggtgaccctcaacgaaagcgaaatttgtgccggcgcggagaagatcggttccggcccgtgtgaaggggattacggaggcccgcttgtgtgcgagcaacataagatgcgcatggtgttgggagtgatcgtgcctggacgcggttgcgcaatcccgaaccgcccggggatcttcgtgcgcgtcgcctactacgctaaatggatccataagattatcctcacttacaaggtgcctcaatcg

SEQ ID NO: 13660 - DNA, 2184 bp, Artificial Sequence
  Description of Artificial Sequence: Synthetic coding sequence
atgtgggtgaccaaactcctgccagccctgctcctgcaacacgtgctcctgcatctgctgttgctgccgattgcaatcccgtacgctgagggccaacggaagagacgcaacactatccacgagttcaagaaaagcgccaagactactctgatcaagatcgaccctgcactgaagatcaagacgaaaaaagtgaataccgctgaccaatgcgcgaaccgttgtactagaaataagggattgccattcacctgcaaagccttcgtctttgacaaagcaagaaagcaatgtctgtggttcccgttcaattccatgtcatccggcgtcaagaaggaattcggtcatgagttcgacctgtacgagaataaggattacatccggaattgtattatcggaaagggccgcagctacaaagggactgtctcgattacgaagagcggaatcaagtgccagccgtggtcctcgatgatacctcatgaacactccttcctgccgtcctcctaccgcggaaaagacctccaggaaaactactgtcgcaatccccggggggaggaaggaggcccgtggtgtttcacctcgaatccagaagtcagatacgaggtctgcgacatcccgcaatgctcggaagtcgaatgcatgacgtgcaatggcgaatcctaccgcggcctcatggaccataccgagtccggcaagatctgccagcggtgggaccaccagactcctcaccgccacaaatttctccctgaaagatacccggacaaaggtttcgatgacaattactgccggaaccctgacggacaacctcggccgtggtgttataccctcgacccgcacacccgctgggaatactgcgcaatcaagacctgcgcagacaacactatgaatgatacggacgtgcctctggagactactgagtgtattcaaggacagggcgaaggataccgggggaccgtcaacactatctggaacggaatcccgtgccagcgctgggacagccagtatccacacgaacacgacatgaccccggaaaacttcaagtgcaaagacttgcgggagaattactgtcgcaacccagacggaagcgagtccccatggtgttttactactgaccccaacattcgcgtggggtactgctcacagattccgaactgcgatatgtcgcacggacaggattgctaccgggggaatggcaagaattacatgggaaacctgtctcaaactcgcagcggcctcacgtgcagcatgtgggacaaaaacatggaagatctgcatagacacattttctgggagcccgacgcttccaagctgaacgagaactactgccgcaacccggatgatgatgcgcacggtccatggtgctacacgggcaatcctcttatcccgtgggactactgcccgatctccaggtgcgagggcgatactactcctactatcgtgaacttggaccatccggtgatctcctgcgctaagaccaaacagctgagggtggtgaacggaattccgacccgcactaacattgggtggatggtttccctgcgctatcggaacaagcatatctgtggagggagcctgatcaaggagtcatgggtgttgactgcaagacagtgtttcccgtcgcgcgatctcaaggattacgaggcatggctcggaatccacgacgtgcatggaaggggagatgaaaagtgcaagcaagtgctgaatgtctcccagctggtgtacggaccggaaggaagcgacctggtgctgatgaaactcgcaagaccggcggtgctggatgatttcgtgtcgactatcgaccttcctaattacggctgcactatacccgaaaaaacgtcttgctccgtctacggatgggggtacaccggactcatcaattacgacggactgctgcgggtggcccacctttacatcatgggcaacgaaaaatgctcccaacaccatagaggcaaagtgaccctcaacgaatccgagatctgcgccggagcggagaagatcgggtccggtccttgcgagggagactacggagggcctctggtctgcgaacagcataagatgcgaatggtgctcggagtgatcgtcccgggtcggggatgcgctatccccaacagaccgggaatctttgttagggtggcctactacgcgaaatggatacataagattatcctcacctacaaggtccctcaaagc

SEQ ID NO: 13661 - DNA, 2184 bp, Artificial Sequence
  Description of Artificial Sequence: Synthetic coding sequence
atgtgggtgactaagctgcttcctgcactccttctgcaacatgtgcttctccatcttctgcttctccctatcgcaattccctacgcagaagggcagagaaaaaggagaaacactatacatgaattcaagaagagcgccaagactaccttgattaagattgatccggcgctgaaaatcaaaaccaagaaggtgaatactgcggatcaatgtgcaaaccggtgtacccgaaacaaggggctcccatttacttgtaaggcctttgtgttcgataaggcaagaaaacaatgtctgtggttcccctttaacagcatgtcgtcaggcgtcaaaaaagaatttggacacgagtttgatctgtacgagaacaaggattacatcagaaactgtatcattggcaagggaagatcgtacaaaggtaccgtgtccattaccaaatcgggtattaagtgccaaccttggtcgtcgatgataccacacgagcactcatttctgccttcgtcgtacaggggtaaggatctccaggagaactactgtagaaaccccagaggagaggaagggggtccttggtgtttcacctccaatcctgaggtgcgctacgaggtgtgcgacataccccagtgttcggaagtggagtgcatgacttgtaatggggaatcataccggggacttatggaccataccgaatcaggcaaaatctgccaacgatgggatcaccagaccccccatcggcacaagttccttccagagcgttaccccgacaaaggttttgatgataactactgtcgtaatcctgatggacagccacgaccttggtgttacaccctcgaccctcatacccgctgggaatactgtgccatcaagacctgtgccgataacactatgaatgacaccgatgtccccctggagactaccgaatgtatccaaggtcagggagagggataccgcggtaccgtgaacactatctggaacggaattccttgtcaaaggtgggactcgcaatatccacatgaacatgatatgacccccgaaaactttaagtgcaaagacctgcgagagaactactgcaggaatcccgatgggtcagaatcgccttggtgttttactactgatcccaacattagagttggatactgcagccagattccgaactgtgatatgtcgcacggccaagattgttacagaggcaacggtaagaactacatgggaaacctttcacagactcgttccggattgacctgttccatgtgggataagaacatggaagatcttcatcgacacatcttctgggagcctgatgcttcgaaactgaacgagaactattgcagaaacccggacgacgatgctcatgggccttggtgctacacgggaaacccattgataccgtgggattactgtccgatatcaagatgtgagggcgacacgacccctaccattgtgaatctggatcatcctgtcatttcctgtgcaaagactaaacaacttcgggtcgtgaacggtatccctactcgcaccaacattggatggatggtcagcctgcggtacagaaacaagcacatttgtggaggctcacttatcaaggagtcgtgggtgctgaccgccaggcagtgttttccttcgcgtgatttgaaagattacgaagcgtggctcggaatccacgacgtccatggaagaggcgatgagaagtgcaagcaggtgctgaacgtgtctcaactcgtgtatggtcctgaaggttccgacctggtgctgatgaaactggcacggcccgccgttctcgatgattttgtgtcgaccatcgacctgccgaattacggatgtaccattcctgaaaagacttcctgctcggtctacgggtggggttacaccggcctgatcaattacgacggactgctccgggtggcacatctgtacattatggggaatgaaaagtgttcacagcatcataggggtaaggtcacgctgaatgagtccgaaatttgtgctggggcagaaaagattgggtccggcccttgtgagggagattacggcggacctctggtctgcgaacagcataagatgcgtatggtcctgggcgtgatcgtgccgggacgcgggtgcgcaattccaaacaggcctggaattttcgtgagagtggcatactacgcaaaatggatccacaaaatcattctgacctacaaggtaccacaaagc

SEQ ID NO: 13662 - DNA, 2184 bp, Artificial Sequence
  Description of Artificial Sequence: Synthetic coding sequence
atgtgggtgaccaagctgctgccagctctactactgcaacacgttctgctgcacctcctgttgttgcccatcgccatcccctacgctgaaggacagcgaaagagaagaaacaccattcacgaattcaaaaaatccgcaaaaacaacattgataaagattgaccccgcgttaaaaataaagaccaagaaagtgaatacagccgatcaatgtgccaaccggtgtacacgaaataagggcctgccttttacctgcaaagcattcgttttcgataaagcacgcaagcagtgcttgtggtttcctttcaattccatgtctagcggagtaaaaaaggagtttggccacgagttcgacctctacgaaaacaaggactatatcagaaattgtatcatcggtaaaggacgaagttacaaaggcacggtgagcatcaccaaatccgggatcaagtgtcagccgtggagctccatgatacctcacgaacattcctttctgccaagcagctacaggggcaaggatttgcaggaaaattactgccggaacccccgaggagaggagggaggcccttggtgttttacatccaaccccgaagttcggtacgaagtatgcgacattccacagtgttctgaagtggagtgcatgacgtgtaatggagaatcctaccgaggcctgatggaccacacggagtcaggaaagatctgtcagcgctgggaccaccagaccccacatcgtcacaaattcttacctgagcggtaccctgacaaaggcttcgacgacaactattgtcgcaaccctgacggccagccccgcccctggtgctataccctggaccctcacaccaggtgggagtactgcgcgataaaaacgtgcgccgacaataccatgaatgatacagatgtgccattagaaactacagagtgcattcagggccaaggtgagggatacaggggtaccgtgaataccatttggaacgggattccttgccagcgttgggatagtcagtaccctcatgagcacgatatgactcctgagaattttaagtgtaaggacttaagggagaactattgccgaaaccccgatggttccgagtccccttggtgctttactaccgatcccaatatccgcgttggctattgtagtcagatcccgaattgtgatatgtcccatgggcaggactgctaccggggaaatggcaagaattacatgggcaacctcagtcagactagatcaggtcttacctgcagcatgtgggataagaacatggaagatctgcaccggcacatcttctgggagcctgatgcgagtaagcttaacgaaaattattgtcggaaccccgacgatgatgctcatggtccatggtgctataccggaaatcccctaatcccctgggattactgtcctattagccggtgcgagggtgatacaaccccaacaattgtgaatctggaccacccagtgatctcttgtgccaaaaccaagcagctgagggtcgtaaacgggataccgacacgcacaaatatcggatggatggtttctctgcgttatcggaataagcatatttgtgggggttcattgattaaagagagttgggtcctgacggcaaggcagtgcttcccctcacgtgatttaaaggattacgaagcatggctcggaattcacgacgtgcacggtcgtggagatgaaaagtgtaagcaggtcctcaacgtcagtcagcttgtctatgggccagaaggctcggacctggttcttatgaagctcgcccgtccggccgtcttggatgatttcgtttccaccattgacctccccaattacggttgtaccatccctgaaaagacgagctgttcggtctatggttgggggtacaccggccttatcaattatgacggcctgctgagagtcgcacacctgtatatcatgggaaacgaaaagtgctcccaacaccaccgcgggaaagtcactttaaacgagtctgagatctgtgccggcgccgagaaaataggctcgggaccctgcgagggtgactacggcgggccgctggtatgcgagcaacataaaatgcgaatggtcttgggggttatcgttcccgggaggggctgcgcaattccaaatcggcctggtatcttcgtgcgtgttgcatactacgcaaaatggattcataaaataattcttacgtacaaggtaccccaaagc

SEQ ID NO: 13663 - DNA, 2184 bp, Artificial Sequence
  Description of Artificial Sequence: Synthetic coding sequence
atgtgggtgactaaacttcttcctgccctgctgctgcaacacgttctgctgcacctcctgctgctgcccatagcaattccttacgcagaaggtcaacgcaaaagaagaaatacgattcatgagttcaagaaaagcgcaaagaccaccctgatcaaaattgatcctgcacttaagattaagactaagaaagtgaataccgctgatcaatgtgctaacagatgtacccggaacaagggactccccttcacctgcaaggcctttgtgttcgataaagcaagaaagcagtgcctttggttccccttcaactccatgagctcaggagtgaagaaggaatttggtcacgagtttgatctgtacgagaacaaggactacattaggaactgtatcattgggaagggccggtcgtacaagggaactgtctcaatcaccaaatccggcattaagtgccagccatggtcgtcaatgattccacatgagcattcgtttcttcctagctcgtaccggggaaaagatcttcaggagaactattgtcgaaaccctagaggcgaagaggggggaccatggtgtttcacttccaatcccgaggtgcgctacgaggtctgtgatatcccgcaatgctccgaagtggaatgtatgacgtgtaacggtgagtcgtatagggggctgatggatcacaccgaatcaggcaagatttgtcaacggtgggatcaccagaccccccacagacataagtttctcccagaacgctaccctgacaagggctttgatgataactactgcagaaaccctgatggtcaacccaggccctggtgctataccctggatccacacactcgctgggagtactgtgcaattaagacttgcgcggataataccatgaacgacactgacgtgcctctggagactaccgagtgtattcaaggacagggcgagggataccgtggaaccgtgaatacgatttggaatggaatcccctgtcagcggtgggattcgcaataccctcatgagcatgatatgacccctgaaaacttcaaatgtaaggatctgcgtgagaattactgtaggaacccggacggatccgaatcaccttggtgcttcaccaccgatcctaacataagagtgggatactgttcgcagattccaaattgtgacatgtcgcacggacaagactgttacagagggaacggaaagaactacatgggtaacctgagccagacgagatcaggtcttacttgtagcatgtgggacaaaaacatggaagatctgcatcgacatatcttttgggaacctgatgcatcaaaacttaatgagaactactgccgtaaccccgatgatgatgcacatggtccgtggtgttacacgggtaatcccttgattccatgggactactgtcctattagccggtgtgagggagatactactccaaccatcgtgaaccttgaccacccagtgatctcatgtgcaaaaacgaaacagctgcgcgtggtgaatggcatccctacgaggacgaacattggctggatggtgtccttgcgttatcgcaacaagcatatctgtggaggttccctcattaaggaaagctgggtcctgaccgcaagacagtgttttccctctcgagatcttaaggactacgaagcatggcttggaatccatgatgtgcacggacgaggggatgaaaaatgtaagcaggtgctgaatgtgtcgcagctcgtgtacggaccagaaggctccgaccttgtccttatgaagctggccagacctgcagtgcttgatgactttgtgtcaaccattgacctgcctaattacggctgtaccattcccgaaaagacttcgtgcagcgtgtacgggtggggttacaccggcttgattaactacgatggactccttcgggtcgcacatttgtacattatgggtaatgagaagtgttcgcaacaccataggggaaaggtgaccctgaatgaatcagagatttgtgcaggcgccgagaagataggatcaggaccttgtgagggtgactacggtggcccactggtctgcgaacaacataagatgaggatggtgctgggagtcatagtgccaggtagaggatgtgcaatcccaaatcgaccagggatttttgtcagggtcgcatactacgcaaagtggattcacaagattattctgacctacaaagtgccacaaagc

SEQ ID NO: 13664 - DNA, 2184 bp, Artificial Sequence
  Description of Artificial Sequence: Synthetic coding sequence
atgtgggtgaccaagctactccctgctctccttctccagcacgtgttgctgcatctgttactgctgcccattgccattccatatgccgaggggcagcgaaagcgaagaaacacaatccacgaatttaaaaagagcgccaaaaccacactgattaagattgatcctgcactcaaaatcaaaaccaaaaaagtaaataccgccgatcagtgcgccaacaggtgtacgcgtaacaagggcctcccctttacatgcaaagctttcgttttcgacaaggccaggaaacaatgtctgtggttcccctttaactccatgtctagcggcgtgaagaaggagtttgggcacgaattcgacctctacgaaaataaggactatattagaaattgcataattgggaaggggaggtcatataaaggaactgtttctattaccaagtctggaattaagtgtcagccctggagcagcatgatcccccatgagcacagcttcttgcctagctcctatagaggtaaagacctgcaagagaactactgtcgcaaccccagaggtgaagagggggggccttggtgctttacctctaaccccgaagtccgttatgaggtctgcgacatccctcagtgctctgaggtcgagtgtatgacgtgtaacggggaatcctataggggtctcatggatcacaccgaaagtgggaaaatttgtcagcgatgggaccatcaaaccccccacagacataagttcctgcctgagagatacccggataaaggattcgacgataactattgtcgcaatcctgacgggcaaccaaggccttggtgctacacacttgatccacacaccagatgggagtattgcgccattaaaacatgtgcagacaacactatgaatgacactgatgttccattagagaccacagagtgtattcagggacagggagaaggatatagaggaaccgtgaacacgatctggaatgggataccctgccaacgatgggattcacagtacccccatgagcacgacatgacgccagaaaatttcaagtgtaaggacttgcgcgagaactactgccggaatccggatgggtccgagtcaccttggtgtttcactactgacccaaatattagagttggttactgctctcaaatacctaactgtgatatgtcccacggtcaggactgttacagaggtaacggcaaaaattatatggggaatctgagccagacacggtccggactgacatgctcaatgtgggacaagaacatggaggatctgcacagacacatcttttgggaacctgatgccagtaaactcaatgaaaattattgtcgaaatccagatgacgatgctcatggtccctggtgctacaccggtaacccattaatcccatgggactactgccctataagccgatgtgaaggggatacgactccaactatcgtcaacctggaccatcccgtcatcagttgtgcaaagacaaagcagctaagggttgttaatggaatccccacgcgtactaatatcggctggatggtctcactgaggtatcgaaacaaacacatatgcgggggcagtctgataaaggaaagttgggtgctgaccgcccgacagtgttttcccagtcgagacttgaaggactacgaggcgtggctgggtatccacgacgtacacggacgaggggatgaaaagtgtaagcaggtgctcaacgtctctcagctggtctatggacctgagggctcagacctggtgttgatgaagctcgccaggccagctgtgcttgatgacttcgtctcaaccatcgacctccctaattacggctgtaccattccagaaaaaacatcctgcagtgtctacggatggggctataccggccttataaattacgatggactactcagagttgcccatttgtatattatgggcaacgagaagtgtagtcagcatcatcgaggtaaagtgacgttaaatgagagcgaaatttgtgctggagccgaaaaaatagggtctggaccttgcgaaggtgattatggggggccactggtgtgcgaacaacataaaatgagaatggtgctgggagtgatcgtaccgggacggggatgtgccattcccaacaggccaggcatcttcgtgagagtggcgtactacgcaaaatggatccataagataatcctcacatacaaggtaccacagtca

SEQ ID NO: 13665 - DNA, 2184 bp, Artificial Sequence
  Description of Artificial Sequence: Synthetic coding sequence
atgtgggttacgaagttactccctgcgctgttgctgcagcacgtgctgctgcacttacttctgctacctattgctatcccatacgccgaggggcagagaaagcgtcgtaatactattcatgagttcaagaaatcagccaaaaccactctgatcaagattgatcccgccttgaagatcaagaccaaaaaagtgaataccgcagaccagtgtgccaaccggtgtacacgaaataaaggactaccttttacttgtaaggcttttgtgttcgataaagcaagaaagcaatgcctatggttcccctttaattccatgtcttccggcgtgaaaaaagaatttgggcacgagtttgatctgtatgagaataaagactacattcgcaattgcatcattggcaaaggtcgttcttacaagggaaccgtgtcaatcacaaaaagcggaattaagtgtcaaccttggtcctcaatgatcccccacgagcatagcttccttcccagctcataccgcggcaaagacttgcaagaaaattattgcaggaacccccggggcgaggagggaggtccgtggtgtttcactagcaatcctgaagtgaggtatgaggtgtgtgacatcccacagtgtagtgaagtggagtgcatgacctgcaacggagagtcctacagagggctgatggatcacacagaaagtggaaagatctgccagagatgggatcatcaaaccccacaccggcataaattcctaccagaacggtacccagacaagggctttgacgacaactactgccggaacccagacggccagcccagaccttggtgctacacactggatcctcacacccgttgggagtactgcgccatcaagacatgcgccgataatacaatgaacgataccgacgtgccactggagactacagagtgcattcaaggacagggcgagggctatcgtggaacagtaaacacaatctggaacggtattccatgtcagcgttgggacagccagtatccacacgaacatgacatgactcccgagaatttcaagtgtaaagacttgagagagaattactgccgcaaccctgatggatccgaatctccctggtgtttcacaacagaccctaatatcagagtcggatattgttcgcagatccctaactgtgacatgtcgcacggccaagattgctaccgtggaaatggtaagaactacatgggcaacctgagccagaccagatcagggctgacctgcagtatgtgggataagaacatggaggacctccaccgccacatcttctgggagccggatgcctcaaagctcaatgagaattattgtaggaatccagatgacgatgcccatgggccctggtgttacacaggcaatccattgataccctgggactattgccccatatctcgctgcgagggtgacaccacgcctacaattgtcaatttagaccatcccgttataagctgtgccaagaccaaacagttacgggtagttaatggaatcccaacccgcaccaacatcgggtggatggtgtccctccgatatcggaataaacatatctgcggaggctccctgattaaggaatcgtgggtgctgaccgctcgccagtgtttcccatctcgggatctgaaagattatgaggcatggttaggtatccacgacgtgcatggacggggtgacgagaagtgcaagcaagttctgaacgtatcacagctggtgtacggacctgaaggaagcgacctagtacttatgaaactggcacggccagccgtcctggatgactttgttagcaccatcgacttgccaaattatggctgtaccatcccggagaagaccagttgctcagtctacggctggggatatactgggctcataaactacgatggactcctccgtgtggcacacctgtacattatgggaaatgaaaagtgctcccagcatcacagggggaaagtgacattaaatgaaagtgaaatctgtgcaggcgcagaaaagatcggtagcggtccttgtgagggggactatggtggtcctctggtgtgcgagcagcacaagatgcgcatggtgctgggcgtgattgtgcccggtcggggttgcgcgatcccaaaccgcccaggaatttttgtccgggtcgcctattacgccaaatggattcataagattatcttgacctacaaagtgcctcagtca

SEQ ID NO: 13666 - DNA, 2184 bp, Artificial Sequence
  Description of Artificial Sequence: Synthetic coding sequence
atgtgggtgacaaagctgttacctgccctcctgctccagcatgttctgcttcacctgttactcctgcccattgctatcccttacgcagagggacagcggaaacggcgtaacacaattcacgaatttaaaaagagtgccaaaaccacccttatcaagatcgacccagcccttaaaatcaagacaaagaaagtgaatacagccgatcagtgtgcaaatcggtgtaccaggaataagggacttcccttcacctgcaaggcttttgtctttgacaaggcaaggaaacagtgcctgtggttccctttcaattctatgagcagcggggttaagaaggagtttggtcacgagttcgatctctacgaaaataaggattatattagaaattgtattatcggaaaggggcgttcttacaaggggacggtgtctattactaaatccggaatcaagtgccagccttggtctagcatgattccccatgagcattccttccttccttcctcctaccggggcaaagacctccaggagaattactgtcgtaacccacgtggtgaggagggcggcccctggtgcttcacgtcaaaccctgaagtaagatatgaggtctgtgatatcccacagtgcagcgaggtggagtgcatgacctgcaatggagaatcttatcgcgggctaatggaccatacagagtcgggaaagatttgccaacgatgggatcatcagaccccccaccgtcacaagttcctgcctgagcgctatccagataaggggttcgatgacaactactgtagaaacccagacggccagccccggccttggtgttatacacttgacccgcatacgcgatgggagtactgcgccatcaaaacttgtgccgacaatactatgaacgacactgatgtgccactcgagaccaccgaatgcatacagggacagggggaggggtaccggggaaccgtgaatacaatttggaacgggataccttgtcagagatgggattcccagtacccccatgaacatgacatgacgccagagaatttcaagtgtaaagatctgcgcgagaattactgtcgcaaccctgatgggagcgaatccccatggtgttttacgactgaccccaatatccgggttggctattgctcacagatccccaattgcgatatgtcccatggccaggattgctatcggggaaacggcaagaactatatgggtaatctcagtcaaacacggagcggcctcacttgttcaatgtgggataaaaacatggaagacctgcaccgccacattttttgggaacctgacgcatccaaacttaacgaaaactattgcagaaacccggatgatgatgcccacggtccttggtgttacacaggcaacccgctgatcccttgggactactgcccaatcagtagatgcgagggggacacgacccccaccattgtgaacctagatcacccggtgatcagctgcgctaaaaccaagcagctgcgcgtcgtaaatggaattcccaccaggaccaatataggttggatggtgtccctgcgctaccggaacaaacatatctgtgggggaagtctgattaaggagtcttgggtgctgaccgccaggcagtgcttccccagtcgcgatctgaaggattatgaggcttggttgggcatacatgacgtgcacggaagaggggacgaaaaatgcaaacaggtcttaaatgttagccagcttgtgtacggacctgaagggagcgacctcgtgctgatgaaactcgcccgacctgccgttttggacgattttgtgtctactatcgacctccctaactatggctgcacgatccccgagaaaacatcttgtagcgtgtatggatggggctatacaggcctgattaactatgatggcctcctgagagtggctcacctgtacatcatgggcaacgagaaatgcagccagcaccatagggggaaggtgactctgaacgagtcggagatctgtgcaggcgctgagaagatcggcagtggaccctgtgaaggtgactacggggggccgcttgtctgtgagcagcacaaaatgcggatggttctgggggtgattgtaccaggaagggggtgtgctatccctaaccggccgggcatctttgttcgggtggcctactatgcgaaatggatccacaagataatattgacgtacaaggtgccgcagtct

SEQ ID NO: 13667 - DNA, 2184 bp, Artificial Sequence
  Description of Artificial Sequence: Synthetic coding sequence
atgtgggtcaccaagttgctgccggccctgctcctccagcacgtccttctgcacctgctgctcttgccgattgccatcccgtacgccgaaggacaacggaaaaggcgcaacacgatccacgaattcaaaaagagcgccaaaactactctcattaagatcgacccggccctgaagatcaaaacgaagaaggtgaacaccgccgaccaatgcgccaatagatgtaccaggaacaagggactcccgttcacttgcaaagccttcgtctttgacaaggcccggaagcagtgcctgtggttcccttttaactcgatgagcagcggagtgaagaaggaatttggccacgaatttgacctgtatgagaataaagattacatcagaaactgcatcatcggaaagggccgctcttacaaagggactgtgtccatcactaagtccggtatcaagtgccagccatggagcagcatgatcccacatgagcactccttcctgccgagctcgtaccgggggaaggatctgcaagagaattactgccgcaatcctcggggagaagagggtgggccgtggtgctttacctctaacccggaggtgcgctacgaagtgtgtgacatcccccagtgcagtgaagttgagtgcatgacctgcaacggcgagtcctaccggggactgatggaccacaccgagtcaggtaagatttgccagagatgggatcaccaaactccgcatcgccacaagttcctgcctgagcggtacccggacaaaggtttcgatgacaattactgtaggaaccctgacggacagccaagaccttggtgctacactctggaccctcacacccggtgggagtactgcgccatcaaaacttgcgccgacaacaccatgaacgatactgacgttccacttgaaacgaccgagtgtatccagggccagggcgagggatacagaggcactgtcaatacgatttggaacgggatcccatgtcagcggtgggacagccagtacccacacgaacatgacatgactccggagaatttcaagtgcaaggacttgcgggaaaactattgcagaaacccagatggatccgagtccccatggtgcttcactactgatccgaacatccgcgtgggatactgcagccagatccctaactgcgacatgagccacggacaagactgctaccgggggaatggtaagaactacatgggaaatctctcgcagactaggtcgggactgacttgctccatgtgggacaaaaacatggaggatcttcaccggcatatcttctgggaaccggatgcttccaaacttaacgagaattactgtcggaatcccgacgatgacgcgcacggcccgtggtgctatactggtaacccactgatcccgtgggattattgccctatctccaggtgcgaaggggacaccactccaacgatcgtgaaccttgaccaccccgtcatctcgtgcgcgaaaactaagcaactgagggtagtcaacggaatccccacccggaccaacatcgggtggatggtgtcactgaggtaccggaacaagcatatttgcgggggaagcctgattaaagaatcctgggtcttgaccgcgaggcagtgcttcccctcgcgcgacctgaaagactacgaagcatggctgggaattcacgatgttcacggcagaggggacgaaaagtgtaagcaagtcctcaacgtctcccagctggtgtacggacccgaaggatcagacctggtgctgatgaagctggcgaggcctgcagttctcgacgatttcgtgtcaaccatcgacctcccaaattacggctgcactatcccggaaaagacttcgtgcagcgtctacggatggggatacaccgggctcatcaactacgatgggctcctgcgcgtggcgcacctgtatatcatgggcaatgaaaagtgctcccaacatcatcggggcaaagtgactctgaacgaaagcgaaatttgtgcgggcgctgaaaagatcggttcaggcccgtgcgaaggagattacggtggaccactggtgtgcgaacagcataagatgagaatggtgttgggagtcatcgtgcccggccgcggatgcgcgatcccgaatcggccgggaatattcgtcagagtggcctactacgccaaatggatccacaaaatcatcctgacctataaggtgccgcaaagc

SEQ ID NO: 13668 - DNA, 2184 bp, Artificial Sequence
  Description of Artificial Sequence: Synthetic coding sequence
atgtgggtgactaaactccttcctgcactgctccttcaacatgtgctcctgcatctcctgcttcttcctattgcaatcccatacgccgaagggcaaagaaagcggaggaacactatccacgaattcaaaaagtcggcaaagaccactcttatcaaaatcgatcctgcacttaagatcaagaccaagaaagtcaacaccgccgatcaatgtgcaaatcgatgcaccagaaataagggtttgccattcacttgtaaggcgtttgttttcgacaaagcaagaaagcaatgcctgtggtttccattcaacagcatgtcctccggagtcaagaaagaatttgggcatgaatttgacctgtacgagaacaaggattacattagaaattgtattatcggaaaggggagatcgtacaagggtactgtgtcaatcactaagagcggcattaagtgccaaccatggtcgagcatgattccacatgaacattccttcttgcctagcagctaccgcggcaaggacctgcaagagaactactgcaggaatccacggggggaagaaggcggaccttggtgctttacctccaacccagaagtgcgatacgaggtgtgcgatataccccaatgctccgaggtcgaatgcatgacttgcaacggagagtcatacaggggtctgatggatcataccgaatccgggaagatttgtcagcgctgggatcaccagacgccccaccgtcataagtttctgcctgaaagatacccagacaaaggtttcgatgacaactattgtcgcaacccagacggtcagccccgtccatggtgttacacgcttgatccacacaccagatgggagtactgcgcaataaagacttgtgcagacaacactatgaacgatactgatgtcccacttgaaacgaccgaatgcattcagggacagggcgaagggtaccggggaaccgtgaacaccatatggaacgggatcccctgtcaacgctgggactcccaataccctcatgagcatgatatgactccggagaactttaagtgcaaagacttgagagagaactattgtcggaaccctgacgggtccgaatctccgtggtgttttacgaccgatccaaacatacgggtcggatactgctcccaaatccctaactgcgatatgtcccatggtcaagattgttaccgcggaaatggaaagaactacatggggaatctttctcagactcgatcgggtcttacttgctccatgtgggataagaatatggaagatctgcatagacacatcttttgggaaccagatgcgtcgaaactcaatgaaaactattgtagaaacccggacgatgatgcgcatggtccttggtgctacactggcaacccactgatcccctgggactactgtcctatcagcagatgtgaaggcgataccaccccgactatcgtgaaccttgaccatcctgtgatctcgtgcgccaagaccaagcagctgagagtggtcaacggaattcccaccagaactaacatcggatggatggtttctctgagatacagaaataagcatatttgcggaggatcacttatcaaggaaagctgggtcctgacggccagacagtgttttcccagccgcgatcttaaggattacgaggcatggcttggcattcatgacgtgcatggtaggggagatgaaaagtgcaaacaggtgctgaatgtgtctcagctggtgtacggtccggagggatccgatctcgttctgatgaagctcgcacgaccagcagtcttggacgattttgtctctaccattgacttgccaaattacggatgtaccattccggagaaaacgtcgtgctcagtctacggttggggatacactggattgatcaattatgatggccttctccgggtcgcacatctttacataatgggaaacgagaagtgtagccaacatcaccgtggcaaggtgactctcaacgagagcgaaatttgtgcaggtgcagaaaagatcggatcgggaccgtgcgaaggcgactacggaggcccccttgtctgtgaacagcataagatgcggatggtgttgggagtcattgtccccggtcgggggtgtgccattcctaacaggcccggtatattcgtgagagtcgcctactacgccaaatggatccacaagattattctgacctacaaagtgccccagtcg

SEQ ID NO: 13669 - DNA, 2184 bp, Artificial Sequence
  Description of Artificial Sequence: Synthetic coding sequence
atgtgggtcactaagctgctgcccgccctgcttctccagcatgtcttgctccatctgctgttgctgccaatcgcaattccctacgctgagggacaaagaaaacggcgcaacactatccacgaattcaagaagtccgctaagaccaccctcatcaaaatcgaccccgctttgaagataaagactaagaaagtgaatacggcggatcagtgcgccaaccgctgtaccagaaacaaaggacttccatttacttgtaaggcgtttgtgttcgacaaagcgcgcaagcaatgcctctggttcccgttcaactccatgagctcgggagtgaagaaagaattcggacatgaatttgatctgtacgagaataaggactacatcagaaattgtatcataggaaagggccggtcatataagggcactgtcagcatcaccaaatcgggaattaagtgtcaaccgtggtcgtcgatgatcccacacgaacactcgttcctgccgtcatcctaccgggggaaggatctgcaagagaattactgccgcaacccccggggcgaggaaggaggaccgtggtgttttacctccaacccggaggtgagatacgaggtctgcgatatcccacagtgctccgaggtggaatgtatgacttgcaacggagagagctaccgcgggctcatggaccatactgagtccggaaagatctgtcagcgctgggatcatcagacgcctcaccggcacaaattcctgccggaacgctaccctgacaaagggttcgatgacaattactgccggaaccccgatggacaaccacgtccctggtgttacaccttggacccacacacgagatgggaatattgcgcgatcaagacctgcgcagacaatactatgaatgatactgacgtgccgctcgaaaccaccgaatgcattcagggtcagggagaaggatacagaggtaccgtgaatactatttggaatgggataccatgtcagcggtgggatagccaatatccacacgaacatgatatgaccccggaaaacttcaagtgcaaggacctcagggagaactactgcagaaacccggacggttcagaatcaccgtggtgcttcaccaccgaccctaacattagagtgggttactgctcgcagatcccgaactgcgatatgtctcacggacaggactgctaccgcggcaacggaaagaattacatgggtaatctgtcccagacgcggtcaggattgacgtgtagcatgtgggacaagaatatggaagatctgcatcgccacatattctgggagccagacgcctcaaaactcaacgaaaactattgccgaaacccagacgacgatgcacacggaccgtggtgctacactggaaaccctctcataccttgggactactgcccgatctcgcgctgcgagggtgataccactccgacgatcgtgaacctcgaccaccctgtgatcagctgcgccaaaactaagcagctcagagtcgtcaacggcattcctacccgaaccaatatcggctggatggtgtcacttcggtacagaaataagcacatctgcgggggttctctgatcaaggagtcgtgggtcctgaccgcccgccaatgtttcccgagcagagatcttaaagattacgaggcttggttgggtatccatgatgtccacggccgcggagacgaaaagtgtaagcaggtgctcaacgtgtcacagctcgtgtacggcccggaagggtcggacctggtgctgatgaagctggctagaccggccgtcctggacgactttgtgtcgaccatcgacctgccaaactacgggtgtaccatcccggaaaagaccagctgctccgtgtatggctggggatacactggcttgattaactacgacggcctgctgcgtgttgcccacctgtacatcatgggtaacgaaaaatgctctcaacatcacagggggaaggtgactctcaatgagtcggagatctgcgcgggagcagaaaagatcggatcaggaccatgcgagggagattacggcgggcctctggtttgcgagcagcacaaaatgcggatggtgctcggcgtcattgtgcctggacggggatgcgcaatcccgaatcgcccaggaatcttcgtgcgggttgcctactacgcgaagtggatccataagatcatcttgacttacaaggtgcctcaaagc

SEQ ID NO: 13670 - DNA, 2184 bp, Artificial Sequence
  Description of Artificial Sequence: Synthetic coding sequence
atgtgggttacgaaacttctgcctgccctgctgcttcagcacgtgctcctgcatctgctcctgctcccaatagccattccttacgccgagggacaaagaaaacgaaggaataccattcacgagtttaagaagtccgcgaaaaccacccttatcaaaatcgatccggcgctcaagatcaagaccaagaaggtcaatacggcagatcaatgtgcgaaccggtgtactagaaataagggactcccttttacctgcaaggcctttgtgttcgataaagcaagaaaacagtgtctgtggtttcccttcaacagcatgtcgtccggtgtaaagaaagagttcggacatgagttcgatctgtatgaaaacaaggactacatccgtaactgtatcattgggaagggtcgctcatataagggaaccgtgtcaattactaagagcggaattaagtgtcaaccttggtcctcgatgattccgcacgaacacagcttcctcccatcgtcttaccgcggaaaggatcttcaagaaaactactgtcgcaacccgcgaggtgaagaaggtggtccgtggtgtttcactagcaaccccgaagtgcgatacgaagtgtgtgatattcctcagtgctcggaagtggaatgtatgacttgtaacggagaaagctaccgcggccttatggatcacacggaaagcgggaagatatgccagagatgggatcatcaaacgccacatagacataagtttctgccggagagataccccgacaaaggatttgatgacaactattgccggaatcctgatggccagcctcggccgtggtgctacactctggacccacatactcgctgggaatactgcgcaattaagacttgcgcggacaatacgatgaacgacactgatgtgccacttgagactaccgaatgtatccaaggacaaggagagggatacaggggaaccgtgaacaccatttggaacggaatcccttgccaacgctgggactcacaatacccccatgaacacgatatgactcccgaaaactttaagtgcaaggacctgcgcgaaaactactgccggaaccctgatggatcggaatcaccttggtgctttactaccgaccctaacataagagtgggttactgttctcagattcctaactgtgatatgagccatggtcaggattgttaccgcggcaacggtaagaattacatgggcaatctgtcgcagaccagatccggacttacgtgttcgatgtgggataagaatatggaggaccttcaccgacacattttctgggaaccagacgcgagcaagctgaatgagaactactgtaggaaccccgatgacgatgcgcacggtccttggtgctacaccggaaaccctttgattccatgggactactgtccaatctcgcgctgtgaaggcgatactaccccaactatcgtcaatctggaccatcctgtgattagctgtgcaaagactaagcaactgcgcgtcgtgaatgggatccctaccagaacgaacattgggtggatggtgtcactgcggtaccgtaacaagcatatttgtggtggttcgctcattaaggagagctgggtgctgaccgcgaggcaatgctttccttcgagagatcttaaggactacgaagcatggctcggaatacatgatgtgcacggcaggggagatgaaaagtgtaaacaagtcctcaacgtctcgcagctggtctacggacctgagggatcggatcttgtgcttatgaagttggcaaggccggcagtgttggacgactttgtctcgactattgatctcccaaactacggctgtaccatcccagagaaaacgtcatgtagcgtgtacggttggggctacactggacttatcaactacgacgggctccttcgagtcgcacatctctatatcatggggaatgaaaagtgctcccagcatcaccgcggcaaggtgacgcttaacgaatcggagatttgtgcaggagccgaaaagatcggttccggaccatgcgagggagactacggggggcctctggtctgtgagcagcataagatgagaatggtgctcggtgtcatcgtccctggtagagggtgtgccatccctaaccgtccaggtattttcgtgcgggtggcatactatgctaagtggattcataagattattcttacctacaaggtgcctcagtcg

SEQ ID NO: 13671 - DNA, 2184 bp, Artificial Sequence
  Description of Artificial Sequence: Synthetic coding sequence
atgtgggtcaccaagttgcttccggccctcctgttacaacacgttctcctgcatctattactcctgcccatcgcgatcccatacgccgaaggacaaagaaagagaagaaatacgatccatgagtttaagaaatcagcaaagacaactttgattaagatagatccggcgctgaagatcaaaacgaagaaggtcaataccgctgatcaatgcgcaaatagatgtacccgcaataagggattaccttttacatgcaaggccttcgtgtttgataaggccaggaagcagtgtctctggtttcccttcaattccatgtctagcggggtaaaaaaagagttcggtcatgagtttgatctttatgagaacaaggattacatccgaaactgtatcattggtaaaggtagatcgtacaaggggaccgtgagtatcacaaagagtggaataaaatgccagccctggagttccatgataccccacgaacattcttttctcccctctagctaccgtggcaaagatttacaggagaactactgtagaaacccgcggggggaggagggggggccgtggtgcttcacgtcgaaccccgaggtgagatatgaagtgtgtgacatcccacagtgctctgaggtggagtgcatgacctgtaatggcgagtcataccgaggcttgatggatcacaccgagtctggcaagatttgtcagcggtgggaccaccaaactccccataggcacaagtttctgccagaaaggtatcctgataaaggattcgacgacaactattgcagaaaccccgatgggcaacctcgaccctggtgttacactctagatcctcacacacggtgggaatactgcgccattaaaacatgtgccgacaacactatgaatgatacagacgttcccctggagacaaccgaatgcattcaggggcaaggcgagggatatcgagggaccgtaaataccatatggaacggaattccatgccagagatgggattcccagtaccctcatgaacatgacatgacccctgaaaatttcaaatgtaaggacctgagggaaaactactgccgcaatcccgatggatctgagagcccatggtgtttcactacagatcctaatatcagagtagggtattgttctcaaatcccgaactgcgatatgagccatggacaggattgttaccgggggaatgggaaaaactacatgggtaatctctcccagaccagatccggactgacctgctctatgtgggacaagaatatggaagatctgcaccgtcacatcttctgggaaccagacgcctccaagcttaatgaaaattattgtagaaatccagacgacgacgcccacggcccatggtgctatactggcaatcccctcatcccttgggactactgccccatatcaaggtgcgagggtgacactaccccgacaatagtgaacctcgatcacccggtgataagctgtgccaagacgaaacaactccgcgtggtaaatggcattcccaccaggacgaatattgggtggatggtgtccttaaggtatagaaataaacacatatgcgggggatccctgattaaggagtcttgggtactcacagctcgtcagtgctttccctctagggatcttaaggattacgaggcgtggctcggcattcatgacgtccatggcaggggggacgaaaaatgtaagcaggtgctgaacgtctcacagctggtctacgggcccgaaggcagtgatctggtgctgatgaagcttgcaaggccagccgttctcgatgactttgtgagcactattgatctcccaaattacggctgcacaattcccgagaagaccagttgctctgtgtatgggtggggctacacagggcttattaattatgatggactgctgagggtcgctcacctctacattatgggaaatgaaaagtgctctcagcatcatcggggcaaggtcaccctgaatgagagtgaaatatgtgccggagcagagaagataggaagcggcccgtgcgagggagactacgggggccctttagtttgcgagcagcacaagatgcgcatggtactcggagtgatagtccctggacgtggttgtgctattccaaaccgccctggtatattcgttcgagtagcctactatgcgaagtggatccacaaaataatcttaacctacaaggtcccgcagtct

SEQ ID NO: 13672 - DNA, 2184 bp, Artificial Sequence
  Description of Artificial Sequence: Synthetic coding sequence
atgtgggttacaaaattgctgcccgcccttcttcttcagcacgttttgctgcacctgttgttattgccaatcgcaataccttatgccgagggacaaaggaagcgtagaaacaccatacacgaatttaaaaagagtgctaagaccacgttgattaaaatcgatcccgctttaaaaattaaaacaaaaaaagttaacacagcagatcagtgcgcaaaccgctgcacaaggaacaaaggtttgccttttacctgtaaggcttttgtttttgacaaggccagaaaacagtgcctttggtttccatttaactccatgtcttcaggggttaaaaaggaattcgggcatgagttcgatttatacgagaataaagactacattaggaactgcatcattgggaagggtaggtcctataaagggactgtaagtatcactaagtctggtattaagtgtcagccatggtcctcaatgattcctcacgagcattcgttccttccatcctcttatagggggaaggatcttcaggagaattactgtaggaaccctcggggtgaggagggcggtccttggtgtttcaccagcaacccggaggttagatatgaagtttgtgatatacctcaatgttccgaggtggaatgcatgacgtgtaacggggaatcgtatagaggtttaatggatcataccgaaagtggtaagatctgccagaggtgggatcatcagacccctcaccgccacaaattccttccagagaggtatccagataaaggtttcgacgataattattgtagaaatccagatggacaaccacgaccgtggtgttatactctggatccacacactcgatgggagtattgtgctattaagacttgcgctgataatactatgaacgatactgatgtgcccttggaaactactgagtgcattcagggacagggggagggttatagagggactgtcaatacgatttggaatggcatcccatgtcaaaggtgggattcccaatatcctcatgagcatgatatgactcctgaaaatttcaagtgtaaggatttaagggagaattactgcagaaacccagacgggtccgagtccccttggtgcttcacaacggatcctaatatcagggtgggatattgtagtcaaatacccaactgtgatatgagtcacgggcaagattgttataggggcaacggtaagaattatatgggaaatttgtctcaaacacgtagtggccttacttgctctatgtgggataagaatatggaagatctccatcgacatattttctgggaacctgatgcctccaaacttaatgaaaactattgtcgtaatcccgatgatgacgctcacggcccttggtgttataccgggaatccacttatcccctgggattactgtccgatttcgaggtgcgaaggtgataccactcctaccatcgttaacctggaccacccagttatatcttgtgccaagaccaaacagcttagggtagtcaatggtataccgacaagaactaacatcggatggatggtgagtttgaggtatagaaataagcatatctgcggaggatcattgattaaagaaagctgggtgctgaccgcgagacaatgctttccttctcgagatcttaaagactacgaagcctggttgggaatccacgatgtgcatggtaggggggatgagaagtgtaagcaagtgcttaacgtcagccaactcgtgtacggccccgaaggttccgatctcgttttgatgaagctcgctagaccagcagtgcttgacgatttcgtgtcgacaattgaccttcccaactatgggtgtacaatacctgagaaaacaagttgcagcgtttacggttggggctacacaggcttgatcaattatgatggtctgctgcgcgttgcccatttatacattatgggaaatgagaaatgctctcagcatcataggggtaaagtgactctcaatgagagtgaaatctgtgccggtgctgaaaaaatcggctccggaccttgtgaaggagactatggggggccactggtatgtgagcagcacaagatgcgcatggtattgggggtgatcgtgcctggaagaggctgtgccatacctaacagacctggaatctttgtcagagtagcatattatgccaagtggatacataagattatacttacctataaggtgccacagagc

SEQ ID NO: 13673 - DNA, 2184 bp, Artificial Sequence
  Description of Artificial Sequence: Synthetic coding sequence
atgtgggtcaccaagctgttgcccgcccttctgcttcaacacgtcttgctgcacttgctgctccttccaatagcaataccgtacgcagaaggacagcgcaaaagaagaaacactattcacgagttcaagaaatccgcgaaaactactctgataaagatcgatcctgcactgaagataaagacgaagaaagtgaacactgcggatcaatgcgcaaatcggtgtactagaaacaaaggacttccattcacttgtaaggcatttgtgtttgacaaggcgaggaaacaatgtctctggtttccttttaacagcatgtcctcgggggtgaaaaaggaatttggccacgaattcgatctctacgaaaacaaagactacatccgaaactgcataattggcaagggtcggtcatacaagggaaccgtctccatcacgaagtcgggcattaagtgtcagccttggtccagcatgatccctcatgagcattcgtttctgccttcctcgtacagaggaaaggaccttcaagaaaactactgtcgaaaccctcggggtgaggagggaggcccctggtgcttcacctctaatcctgaagtgagatacgaggtgtgtgatataccgcagtgctcggaggtggagtgcatgacttgtaatggggaaagctacagaggcctcatggatcataccgaatccgggaagatttgtcaaaggtgggaccaccagactccacatcgccacaagttcctgcctgagcgataccccgataaggggtttgatgataactactgtcggaaccctgacggacaaccaagaccctggtgttacaccctcgatcctcatacccgctgggaatactgcgcaatcaagacctgcgcggataataccatgaacgatactgatgtgcctcttgagactaccgagtgtatacaagggcaaggtgaaggctatagaggaaccgtgaataccatttggaacgggatcccttgtcagagatgggattctcaatacccccatgaacatgatatgacgcccgagaactttaagtgtaaggatttgcgggagaactactgtagaaacccagatggctcggagtccccttggtgctttactactgatcccaacatccgtgtgggatactgctcccaaataccgaactgtgatatgtcccatggccaagactgctaccgcgggaacgggaagaattacatgggaaatcttagccaaactagaagcggccttacctgttccatgtgggataagaatatggaggacctgcaccgtcatatcttttgggagcctgacgcatccaaactcaacgagaattactgtcgcaatcctgacgatgatgcccatggaccgtggtgttacactggaaatcctctgattccgtgggactactgtccaatttcaaggtgcgagggcgacaccactcctaccatagtcaatctggatcaccctgtgatttcgtgtgccaagaccaagcaactgcgggtggtgaacggaattccaactaggactaacattgggtggatggtatcgctgagatatagaaacaagcatatctgtggcggatccctgataaaagaatcgtgggtgttgaccgcccgacaatgttttccttcacgggaccttaaagactacgaagcatggctggggatacatgatgtgcatgggcgaggggatgaaaagtgcaagcaggtcctcaacgtgagtcaactggtctacggtccagaaggttcggacctggttctgatgaaactggcacgtcctgcagtgctggacgactttgtgagcactattgatttgcccaactacggttgtaccattccagagaaaacctcctgttccgtgtatggttggggctacaccgggctgattaactacgacggcctccttcgggtggctcacctttacattatgggaaacgaaaagtgttcacagcaccatcgcggtaaggtcaccctgaatgagagcgaaatttgcgcaggagcagaaaagattggtagtggtccatgcgaaggagattacggaggacctttggtgtgtgaacagcacaaaatgagaatggtgctgggagtgattgtgcctggacgcggatgtgcaattcctaacagacctggtattttcgtgcgggtcgcgtattacgctaagtggattcataagattattctgacttacaaggtcccacaatca

SEQ ID NO: 13674 - DNA, 2184 bp, Artificial Sequence
  Description of Artificial Sequence: Synthetic coding sequence
atgtgggtaactaagctcttgcccgctctcctgctacagcacgttctcctgcacttgctcctgctacccattgccatcccctacgcggagggacagagaaagcgacgaaacaccatccatgagttcaaaaagtccgccaagaccactctgataaaaatcgaccctgctttgaagattaaaaccaagaaggtcaacacagccgaccaatgtgcaaatcgttgcacccggaacaagggactcccctttacatgtaaggcttttgtttttgataaggcgcgcaagcaatgtctttggttcccttttaattctatgagttctggcgtgaaaaaggagttcggccacgagtttgacctgtacgagaacaaggattatatcaggaattgcatcataggcaagggccgaagctacaagggcactgtgagcattacaaaatccggcataaagtgccagccatggtcttccatgatcccccatgaacactcattcctgccatcctcttaccgtggcaaggatctgcaggagaattactgtagaaatcctcgcggcgaagagggaggaccctggtgctttactagcaatcccgaagttcggtacgaagtctgtgacatccctcagtgctctgaggtcgagtgtatgacatgcaatggcgaaagttatcgggggcttatggaccataccgagtccgggaagatctgccagcgctgggaccatcagaccccgcaccggcataaatttctgccggagaggtatcctgataagggttttgatgataattactgccgcaatcctgatggccagcccaggccctggtgctataccctggacccacacaccagatgggagtactgcgctattaaaacgtgtgccgacaacacaatgaatgatactgacgtaccattggagaccactgagtgcatccaagggcaaggcgagggctatagggggacagtgaataccatctggaatggcattccctgtcaacggtgggacagccagtatcctcacgaacacgacatgactcctgagaactttaaatgcaaagatttgcgtgagaattattgtaggaatcccgatgggagtgagagcccctggtgtttcaccactgatcctaacattagagtgggctactgttctcagataccaaattgcgacatgagccacggccaagattgctacaggggtaacggcaagaattacatgggaaacctatcacaaacgcgcagcgggcttacatgttcaatgtgggacaagaacatggaggacctccacaggcacatattttgggagcccgatgcttccaagctgaacgagaattattgccgtaacccagacgatgacgctcacggaccctggtgctataccggaaacccccttataccttgggactactgtcctatctccagatgtgagggtgacacaactcctaccattgtgaatttggatcaccctgtcattagttgcgcaaagaccaagcaactgcgcgttgtaaacgggatacccacgagaaccaatatcgggtggatggtgtcactgaggtaccggaacaagcatatctgcggtggaagtctgattaaggagtcttgggtgctcacagcccggcaatgcttcccctctagggacctcaaagactacgaagcctggctagggattcatgacgtgcacggccgaggagatgaaaagtgcaaacaggtcctgaacgtttcccagctggtatatgggccagaagggtctgatttggtattgatgaagctggctagaccagcggtcctagacgatttcgtgagtacaatcgacctgccgaattacggatgcacaattccggagaagacgtcctgcagtgtatatggatggggctacactgggcttatcaactatgatgggctgttgagagtagcccacctatatattatgggaaacgagaaatgctcacagcaccataggggcaaagtaacactgaacgaaagtgagatctgcgccggagctgaaaagattggatcaggcccatgcgagggcgactacggcggcccactggtgtgcgagcagcataagatgaggatggttctcggggtcatcgtgccaggtagagggtgtgcaattcctaaccggcctggaatttttgtgagggtcgcctattatgccaaatggatccacaaaatcattctgacttataaagttccccagagc

SEQ ID NO: 13675 - DNA, 2184 bp, Artificial Sequence; identical to SEQ ID NO: 13666
  Description of Artificial Sequence: Synthetic coding sequence

SEQ ID NO: 13676 - DNA, 2184 bp, Artificial Sequence
  Description of Artificial Sequence: Synthetic coding sequence
atgtgggtgaccaagctcttgccagcactgctgctgcagcacgtgctgctgcatcttctccttctgccaattgctatcccctatgctgagggtcagaggaagcggagaaacacaattcacgagttcaagaagagcgccaagaccacgcttattaaaatcgaccccgctttgaagataaaaacaaagaaggtaaacacagccgaccagtgtgccaaccgctgcacccgcaataagggtctgccgtttacctgcaaggcgtttgtgttcgataaggcgcgcaagcagtgtctctggtttcctttcaactctatgagcagtggggtgaagaaggaattcggccacgagtttgatctctacgaaaataaggattatattcgcaattgcatcataggcaagggaagaagttataagggcactgtctccatcaccaaaagtggaatcaagtgccagccgtggtcctccatgattccccacgagcatagctttctcccttcttcatacaggggtaaagacctccaagagaactattgccggaatcctagaggggaagagggtggcccttggtgtttcacaagtaatccagaggtgcgctacgaggtctgcgatattccacagtgctctgaggtggaatgcatgacatgtaacggtgaatcttatcgaggcctgatggaccatacagaatccgggaagatctgccagagatgggaccaccagacgcctcatcgccataagttccttccagagaggtaccccgataaggggttcgatgacaactactgtcgaaatcctgatgggcagcctagaccttggtgctataccctggatccccatacacgatgggagtattgtgctatcaagacctgcgccgataatacgatgaacgacacggacgttcctctcgagactactgagtgcatccagggacaaggtgaaggctatcgggggaccgtcaacacaatttggaatggcattccgtgccagagatgggactcacagtatcctcacgaacacgacatgacccctgaaaactttaaatgcaaagacctgagggagaactattgccgcaatccagacgggtcagagagcccctggtgtttcaccacagatccaaatattagggtcgggtactgcagtcagatacctaattgcgacatgagccatggacaggattgttatcggggcaatggaaagaactatatgggcaatctgagccagacgcgcagtggacttacttgcagcatgtgggacaaaaatatggaggacttgcaccggcacattttctgggaacccgacgcgtctaaattgaacgaaaattactgccgcaaccccgatgatgatgctcacggtccttggtgctacactggtaacccgctgattccatgggactactgtccaatttccagatgtgagggagacaccacgcccactattgttaatttggatcatcccgtcatttcatgcgctaagaccaagcagctgagggtggtcaacggcattcccactcggacaaacataggatggatggtgagtctcaggtatcgaaataagcacatttgcggtggctcactcattaaggagtcatgggtgcttacagcacgccaatgtttccctagtcgggatctgaaggactatgaggcctggctcgggattcacgatgtgcatggtcgaggcgacgaaaaatgcaagcaggtgttgaacgtgtcacagttggtgtatggcccagagggctccgacctggttctcatgaagctcgccaggcccgcggtcctcgacgacttcgtgtcaacaattgacttgcctaactatggttgcaccatccctgaaaagacttcctgcagcgtctatgggtgggggtatacaggcctgattaactatgacggtctgctgcgcgtagcacacctttatatcatgggcaatgagaagtgtagtcagcaccacaggggaaaggttacacttaatgaatccgaaatttgcgctggagcagaaaagataggcagcggcccgtgtgagggtgactacggcgggccactggtgtgcgagcaacacaagatgcgcatggtgctcggggttatcgtcccaggacgcgggtgcgccatcccaaatcggcccggcattttcgtgcgcgttgcgtactacgccaaatggatccacaaaataattctgacatacaaggttccccagtcc

SEQ ID NO: 13677 - DNA, 2184 bp, Artificial Sequence
  Description of Artificial Sequence: Synthetic coding sequence
atgtgggtgacaaaacttttgcccgctcttctgctgcagcacgttctcttgcatctgttgctcctgccaattgcaattccctacgctgaaggacagagaaaacgacgcaacacaatccacgagtttaaaaagagtgccaaaactactctgattaaaatcgaccctgccctgaaaataaagacgaaaaaagtgaataccgcggatcagtgtgcaaacagatgcacgagaaacaaaggactgcctttcacgtgtaaggcctttgtgttcgacaaggcaagaaaacagtgtctttggtttcctttcaatagcatgtccagtggtgtcaagaaggagttcggtcacgagtttgatctgtacgaaaataaagattatatccggaactgcataattggcaagggaagaagctacaagggcacggtctcgattacgaagagtggcattaagtgccagccttggtcttccatgatcccacacgaacatagcttcctcccgtccagttataggggaaaagacttacaagaaaattactgccgtaatcccaggggtgaggaagggggcccatggtgtttcacctccaacccggaggtgcgctacgaggtgtgtgacattcctcagtgctctgaggtggaatgcatgacctgcaacggcgagagctaccgcgggctaatggaccatacagaatcagggaaaatttgccaacgttgggaccatcagactccccataggcataaatttttacctgagcgataccccgacaaggggtttgatgataattattgcaggaatccagatgggcaaccgcggccttggtgttatacactggatccgcacacccgttgggaatattgtgctatcaaaacttgcgcagacaacactatgaatgataccgatgtgcctttggagaccaccgagtgcatacaaggccagggcgaaggctatcgcgggacagtgaacacgatctggaatgggatcccgtgtcaacggtgggatagccagtacccccacgagcatgacatgaccccagagaacttcaaatgcaaagatctgcgcgaaaactattgtaggaatcccgatggatctgagagtccttggtgctttaccaccgacccgaacatacgagtggggtattgcagccaaatacccaattgcgacatgagtcacggccaggactgttacagggggaatggcaagaactacatgggcaacctgagccagacccgaagtgggctgacctgtagcatgtgggataaaaacatggaggacctgcatcggcatatcttttgggaacctgacgcctcgaaattaaacgagaattactgccggaatccggacgacgatgcccacggtccctggtgctataccgggaatcctctgataccgtgggattactgcccaatctctcggtgtgagggggacaccacacctaccatcgtgaatcttgaccaccccgtaattagctgcgccaaaaccaaacagctaagggttgtgaacggcatcccaactaggacaaacataggctggatggtaagccttagataccgcaacaagcatatctgcggcggcagcctgattaaggaatcatgggtcctgaccgcccgacagtgctttccttcacgagatctgaaggattatgaggcttggttgggaatccacgatgttcacggccggggagatgagaaatgtaagcaggtcctcaatgtctcccagttggtctatgggccggagggcagtgacctggtgctgatgaagcttgcgcgcccagcggttcttgatgatttcgtctcaaccatagatttgcccaactatggctgtacaatcccggagaagaccagctgttctgtgtatgggtggggctacactggcctgatcaattatgatggtttactccgtgtggcccacctgtacattatgggcaacgagaagtgtagccaacatcatcggggaaaggtgactctcaatgaatctgagatctgcgcaggcgctgagaagattggaagcggtccatgtgaaggcgattacggcggcccgcttgtgtgtgagcagcataaaatgaggatggtcctcggagtcatcgtacccggcagagggtgtgccatcccgaacaggccaggaatcttcgtacgcgtagcctattatgcaaagtggatccataaaatcatccttacctataaagtgccccaaagc

SEQ ID NO: 13678 - DNA, 252 bp, Artificial Sequence
  Description of Artificial Sequence: Synthetic coding sequence
atggccttgagttcgcagatctgggcggcatgccttcttttgttgctcctgctggcatcgctgacttccggttcggtgtttccgcagcaaaccggacaactggctgagctgcaaccacaggaccgcgccggcgcacgggcttcgtggatgccaatgtttcagcggagacggagaagagatacccatttcccgatctgcattttctgctgcgggtgttgccaccggtccaagtgcggcatgtgctgtaagact

SEQ ID NO: 13679 - DNA, 252 bp, Artificial Sequence
  Description of Artificial Sequence: Synthetic coding sequence
atggcccttagctcgcaaatatgggcagcctgcctgctgctgctattgctcctcgcaagcctgacatctgggagcgtattcccacaacaaaccgggcagctcgccgaacttcagccccaggatcgagccggagcccgtgcttcttggatgcctatgttccagcgtcggaggcgacgagatacccatttcccgatctgcattttttgctgcggatgttgccacaggtccaagtgcggcatgtgctgcaaaacc

SEQ ID NO: 13680 - DNA, 252 bp, Artificial Sequence
  Description of Artificial Sequence: Synthetic coding sequence
atggccctgtcctcgcagatttgggcagcatgtttgctgcttctgctcctcctggcctcactgactagcggctccgtgtttccgcagcaaactggacaactcgccgaactgcagccgcaagaccgcgctggtgcgagagcgagctggatgcctatgttccagaggcgccgccggagagatacccatttcccaatctgcatcttctgctgtggatgctgccaccggtcgaaatgcgggatgtgttgcaagacc

SEQ ID NO: 13681 - DNA, 252 bp, Artificial Sequence
  Description of Artificial Sequence: Synthetic coding sequence
atggctctgtcctcgcagatctgggcggcatgtctcctgttgctcctgcttctggccagccttacctccggttcggtgtttccgcaacaaactggacagcttgccgaattgcagccccaggaccgcgccggggcccgtgcatcttggatgcctatgttccaaaggcggaggcggcgggatacccacttccccatctgtatcttctgttgcggatgttgccacaggtcaaagtgcggcatgtgctgcaagacc

SEQ ID NO: 13682 - DNA, 252 bp, Artificial Sequence
  Description of Artificial Sequence: Synthetic coding sequence
atggcactgtcatcacagatctgggcggcgtgtctcctcctgctcctcctgttggcctccctgacgtccgggtcggtctttccccagcaaaccggacaactggctgaacttcaaccccaggatcgagccggcgccagagcatcctggatgccgatgtttcagagacgccgccgcagagatactcacttcccgatctgcatcttctgctgcgggtgctgccacaggtcaaaatgcggaatgtgctgcaagacc

SEQ ID NO: 13683 - DNA, 252 bp, Artificial Sequence
  Description of Artificial Sequence: Synthetic coding sequence
atggctctgtccagtcagatctgggctgcctgcctgctcctcctgctcctgttagcgtcattgacctccggatccgtcttcccccagcagacaggacagctagctgagcttcagcctcaggacagagcgggggcaagggcgtcctggatgcctatgtttcagaggaggcgacggcgagatacccacttccctatatgtatcttttgttgcggatgctgccatagaagcaaatgcggtatgtgctgcaaaact

SEQ ID NO: 13684 - DNA, 252 bp, Artificial Sequence
  Description of Artificial Sequence: Synthetic coding sequence
atggccctctcctcacagatttgggcggcatgtctcctcctgcttcttcttttggcctcgctgacctccggatcggtgtttccacagcaaactggacaactcgcagagctgcaaccacaagatagagccggtgcacgggcaagctggatgcctatgtttcaaagacggcgccgccgggacacccattttccaatctgtatcttttgctgcggctgttgtcacagatcgaagtgtggaatgtgttgcaagact

SEQ ID NO: 13685 - DNA, 252 bp, Artificial Sequence
  Description of Artificial Sequence: Synthetic coding sequence
atggcactttcctcgcaaatttgggcagcatgcctgcttcttcttctcctgcttgcttcccttacctcaggtagcgtgtttcctcaacagactggacaactggcggaattgcaaccacaggatagagctggcgcacgtgccagctggatgccaatgtttcaaaggagaaggcgaagagatacgcatttcccaatctgcatcttttgctgcggttgttgccatcgatcgaagtgcggaatgtgctgtaagact

SEQ ID NO: 13686 - DNA, 252 bp, Artificial Sequence
  Description of Artificial Sequence: Synthetic coding sequence
atggcattgtcgtcgcagatctgggctgcctgcttgttgctgctgttgctgttggcttctctgaccagtggtagcgtcttcccccaacagaccggacagctggctgagctacaaccccaagaccgagccggagctcgagccagctggatgccgatgttccagcgacgcaggcgacgggatacccacttccctatatgcattttttgctgtgggtgctgtcatcggtccaagtgcggaatgtgctgcaagacc

SEQ ID NO: 13687 - DNA, 252 bp, Artificial Sequence
  Description of Artificial Sequence: Synthetic coding sequence
atggcactgtcgtcacaaatttgggccgcgtgtctcctgctcctcctcctcttggcctcgcttacctcggggtccgtgtttccgcagcagactggacaattggcggaactgcaaccacaagatcgggccggcgctagagcctcctggatgccgatgttccaacggcgccggagacgcgacacccacttcccgatctgcatcttttgctgcggctgctgccaccggtcgaaatgcggtatgtgctgtaaaact

SEQ ID NO: 13688 - DNA, 252 bp, Artificial Sequence
  Description of Artificial Sequence: Synthetic coding sequence
atggccctgtcgtcacagatctgggccgcctgcctgctgcttctccttttactggccagtctcaccagtggatcagtcttcccgcagcaaactgggcagctggctgagttgcaaccgcaggaccgagctggcgcacgggcatcatggatgcccatgttccagcgtcgacgacgacgggatacacactttcctatctgtatcttctgttgcggctgctgccacaggtctaaatgcggcatgtgctgcaaaact

SEQ ID NO: 13689 - DNA, 252 bp, Artificial Sequence
  Description of Artificial Sequence: Synthetic coding sequence
atggcactttcttcccagatttgggccgcgtgtctccttttgctcctgcttcttgctagcctcactagcggttcagttttcccacagcaaacgggacagctggcagagctccagcctcaagaccgcgcaggtgcgcgggcttcgtggatgccgatgtttcagcgcagacggagacgcgatacccattttcctatatgtatattctgctgcggatgttgccacagatcgaaatgcggaatgtgttgtaagacc

SEQ ID NO: 13690 - DNA, 252 bp, Artificial Sequence
  Description of Artificial Sequence: Synthetic coding sequence
atggcgctgagcagccagatttgggcggcctgtctgctccttttactgctgttggctagcctgacctcagggagcgttttcccacaacaaactggtcagctggccgaattacaacctcaggatcgcgctggtgcacgagcgtcctggatgcctatgttccaacgccgccgccgccgcgatactcacttccctatttgcatcttctgctgcgggtgctgccatcgctctaagtgtggtatgtgttgcaagacg

SEQ ID NO: 13691 - DNA, 252 bp, Artificial Sequence
  Description of Artificial Sequence: Synthetic coding sequence
atggccctttcgtcgcagatctgggcggcctgtctgctgttgttgctgctgctggcttctcttacgagcggttcagtgtttcctcagcagactgggcaactggccgaactgcaaccgcaagaccgggcgggcgcgcgggctagctggatgcccatgttccagaggcgtcgccgccgcgatacccatttcccaatctgtatcttttgctgtggctgctgccacagatccaagtgcggaatgtgctgcaaaacc

SEQ ID NO: 13692 - DNA, 252 bp, Artificial Sequence
  Description of Artificial Sequence: Synthetic coding sequence
atggcactgtcctctcagatttgggccgcttgcctcctgctgcttctgcttctggcatccctgacctccggatcagtcttcccccaacaaacggggcagctggcagaattgcagcctcaagatagggccggtgcacgggcctcttggatgcctatgttccagagacggagacgacgggatactcatttccctatctgcatcttctgctgcgggtgttgccatcggtctaaatgcggaatgtgctgcaagaca

SEQ ID NO: 13693 - DNA, 252 bp, Artificial Sequence
  Description of Artificial Sequence: Synthetic coding sequence
atggcgttgtcctcccagatttgggctgcctgcctgctcctgttgctcctcctcgcctcgctgacgagcggttcagtgttcccccagcagactggacagctggccgaactccaaccacaagaccgcgcaggggcacgcgctagctggatgccgatgtttcagcgccgccgccggagagatacccactttcctatctgcatcttttgctgcggctgctgccaccgctcaaagtgcgggatgtgctgcaaaacc

SEQ ID NO: 13694 - DNA, 252 bp, Artificial Sequence
  Description of Artificial Sequence: Synthetic coding sequence
atggctttgtcgtcgcaaatctgggctgcttgcttgttgcttctgctgttgctcgcatcacttactagtggaagcgtgttcccgcagcagacgggccaactcgcggaactgcaacctcaggatcgggccggggcgcgtgcctcgtggatgccgatgttccagcgccggagacgccgcgacactcatttccccatttgcatcttttgttgtggatgctgtcaccggagcaaatgtggcatgtgctgcaagacc

SEQ ID NO: 13695 - DNA, 252 bp, Artificial Sequence
  Description of Artificial Sequence: Synthetic coding sequence
atggcccttagctcgcagatctgggcggcatgcctgcttctgctgttgctcctggcctccttgacttcggggtccgtgttcccgcagcaaaccggacaactcgccgagctgcagccacaggatcgggctggagctcgcgcgtcatggatgccaatgttccagcgcagaaggaggcgcgacacccattttccgatttgcatcttctgttgtggctgctgccaccgctcaaagtgtggaatgtgctgcaaaacc

SEQ ID NO: 13696 - DNA, 252 bp, Artificial Sequence
  Description of Artificial Sequence: Synthetic coding sequence
atggcgctgtcgtcccagatttgggcggcctgcttgttacttctcttgttattggcgagcttgacttcaggctccgttttcccccaacagacaggacagttggctgaacttcagccacaagatcgtgcaggggctagagcatcgtggatgcccatgttccagcgtcgtcgtcgtcgcgatacccattttccaatctgcatcttctgttgcggatgttgtcataggtctaagtgcgggatgtgttgtaaaact

SEQ ID NO: 13697 - DNA, 252 bp, Artificial Sequence
  Description of Artificial Sequence: Synthetic coding sequence
atggcactttcgagccagatatgggccgcatgccttctgctgcttctcttgctggcctcgcttacctcagggtccgtctttccacaacagaccggacaacttgctgaacttcagcctcaggatagagctggtgcgcgagcgtcctggatgccgatgttccaaaggagacgacgcagggacactcattttcccatctgcatcttttgctgtggttgttgtcaccgaagcaagtgtgggatgtgctgcaaaacc

SEQ ID NO: 13698 - DNA, 252 bp, Artificial Sequence
  Description of Artificial Sequence: Synthetic coding sequence
atggcgctgtcatcccagatttgggcagcttgcctcctcctcctgctccttctcgcctcgctgacttccggttctgtctttccacagcaaacgggtcaactggctgaacttcagccgcaggatcgggcgggagctagagcttcgtggatgccgatgtttcaaagacgcaggcgcagagacactcacttcccgatctgcatcttctgttgcggatgctgtcaccggagcaagtgcggaatgtgctgcaagacg

SEQ ID NO: 13699 - DNA, 252 bp, Artificial Sequence
  Description of Artificial Sequence: Synthetic coding sequence
atggccctctcgagccaaatctgggctgcgtgcctgttgcttttgcttcttctggcatcactgacctccgggagtgtgtttcctcaacagacgggacaattggctgaactgcaaccccaggatcgtgccggagcacgtgcaagttggatgcctatgtttcagagacggcggagacgagacactcacttccctatctgtatattctgttgcggctgttgtcataggtccaagtgcggtatgtgttgcaaaacc

SEQ ID NO: 13700 - DNA, 252 bp, Artificial Sequence
  Description of Artificial Sequence: Synthetic coding sequence
atggctttaagcagccagatttgggccgcctgcttgctcctgctcctcttattggcttctcttactagtggctcagtgttcccgcagcaaaccggacagctagccgaactccaaccccaggaccgcgctggagcccgagcttcttggatgcccatgttccagcgacgacggaggcgggacacgcatttcccgatctgtattttctgttgtggctgttgtcacagatctaagtgcggaatgtgctgcaagaca

SEQ ID NO: 13701 - DNA, 252 bp, Artificial Sequence
  Description of Artificial Sequence: Synthetic coding sequence
atggccctgagcagccagatctgggcagcttgcctcctgctgctgttgctgttggcctctctgaccagcggaagtgtgtttccgcagcagaccggtcaattggctgaactccagccacaggatcgcgccggagccagagcatcgtggatgcccatgtttcagcggaggcgccgccgcgacactcacttcccaatttgcatcttctgttgcggctgttgtcatcgctcgaagtgcgggatgtgctgtaaaact

SEQ ID NO: 13702 - DNA, 252 bp, Artificial Sequence
  Description of Artificial Sequence: Synthetic coding sequence
atggcgctgagcagccaaatttgggccgcttgtctactgctgctgttacttctagcttctttaacatccgggagcgtattcccgcagcagaccgggcagctggctgaattgcagccccaggaccgtgccggggctcgagcgagctggatgccaatgttccagaggcggaggcgtcgggatacccatttccccatttgcatcttttgctgcggatgctgccacaggtcaaaatgtgggatgtgctgcaagaca

SEQ ID NO: 13703 - DNA, 252 bp, Artificial Sequence
  Description of Artificial Sequence: Synthetic coding sequence
atggccctgtcatcccagatctgggctgcctgccttctgcttcttctgctgctggcctcattaaccagcggatcagtctttccgcaacagaccggacagctggcagagcttcaacctcaagacagggctggagcgcgggcgagctggatgccaatgttccagagacgtaggaggagggacactcactttcccatctgtatattctgctgcgggtgctgccacagaagcaaatgcggaatgtgttgtaagaca

SEQ ID NO: 13704 - DNA, 252 bp, Artificial Sequence
  Description of Artificial Sequence: Synthetic coding sequence
atggccctctcttctcagatttgggctgcgtgtttgttattgctcctgttgttggccagtttaaccagtgggagcgtgtttccacaacagacaggacagttggctgagttgcagccgcaggacagggcaggcgctcgtgcttcatggatgccaatgtttcagcgtcgtcgtcgacgggacacacacttcccaatctgtattttttgttgcggatgctgccaccgctcaaagtgcggaatgtgttgtaagaca

SEQ ID NO: 13705 - DNA, 252 bp, Artificial Sequence
  Description of Artificial Sequence: Synthetic coding sequence
atggcactgtcctcccaaatatgggcagcttgcctcctcctgctgctgcttcttgcctcactgacttcgggatcagtgttcccccagcaaactggacaattggcagagcttcaaccacaggatcgcgctggtgcacgtgcgtcgtggatgcctatgtttcaacgtcgaagaaggagggacacccatttcccaatctgcattttctgctgtggctgttgccatagatccaagtgcggaatgtgttgcaagact

SEQ ID NO: 13706 - DNA, 252 bp, Artificial Sequence
  Description of Artificial Sequence: Synthetic coding sequence
atggccctctcaagccaaatctgggctgcctgtctgttgctccttctgctcctggcctccctgacatcaggatctgtgttccctcagcagaccggccagctggccgagctccagccccaggacagggctggcgccagggctagttggatgcccatgttccagagaagaagaaggcgcgacacccatttcccaatctgtatcttctgctgcggctgttgtcacagatctaagtgcggtatgtgctgcaagaca

SEQ ID NO: 13707 - DNA, 252 bp, Artificial Sequence
  Description of Artificial Sequence: Synthetic coding sequence
atggctctgtctagtcagatctgggctgcctgtctactgctcctcctcttgctggctagcctgaccagcgggagcgtcttcccacagcagaccggtcagcttgctgagctgcagcctcaagaccgcgcgggggcccgtgcctcttggatgccgatgttccagcggagaaggcgccgggacacacacttcccgatttgcatcttctgttgcggctgttgccatcgctccaagtgcggtatgtgctgcaagaca

SEQ ID NO: 13708 - DNA, 252 bp, Artificial Sequence
  Description of Artificial Sequence: Synthetic coding sequence
atggctttgtcttcccagatttgggccgcttgtttgctcctcctcctgctcctggcctctcttacaagcggttccgtgtttccacagcagacaggacagctggcagagctgcaaccccaagatcgcgcaggggcacgagcatcatggatgcctatgtttcagaggaggagacgcagagacacacattttcctatctgcatcttttgctgcggatgttgccaccggtccaagtgtgggatgtgttgcaagact

SEQ ID NO: 13709 - DNA, 252 bp, Artificial Sequence
  Description of Artificial Sequence: Synthetic coding sequence
atggctttgtcctcgcagatttgggcggcatgccttctgcttcttctgcttctcgccagcctgacctcaggatcggttttccctcagcagactgggcagctggcagaactccaaccgcaagatagagcaggtgcacgcgcatcatggatgccaatgtttcaaaggcgtagacgccgagacactcattttcctatttgtatcttttgctgtggttgctgccaccgttccaaatgtggcatgtgctgtaagacc

SEQ ID NO: 13710 - DNA, 252 bp, Artificial Sequence
  Description of Artificial Sequence: Synthetic coding sequence
atggccctgtctagtcagatctgggctgcatgcctactgctgctgctgttgctggcatctttgacctcagggagtgtctttccccagcaaacgggccagttggccgaactgcagccccaggatcgggccggggcccgagccagctggatgcctatgtttcagagaaggaggcgtcgtgatacgcactttccaatttgcattttttgctgtggctgctgccacagatccaagtgcggaatgtgctgcaagaca

SEQ ID NO: 13711 - DNA, 252 bp, Artificial Sequence
  Description of Artificial Sequence: Synthetic coding sequence
atggccctctcgtcgcagatttgggcagcttgcctgctgctcctacttttactggcgtccctaacatcgggctccgtttttccacagcagacaggccagctcgcagagctgcagccacaggatcgggctggggcgagagcctcctggatgcccatgttccagagaaggagacggagggacactcacttccccatatgcatcttctgctgcggatgctgtcatagaagtaagtgtgggatgtgttgcaaaact

SEQ ID NO: 13712 - DNA, 252 bp, Artificial Sequence
  Description of Artificial Sequence: Synthetic coding sequence
atggcgctttcaagccagatctgggcagcttgcttgctgcttctgctactcctcgcatctctgacttctggatcagtgttcccccagcagaccggacagctggctgagctgcagcctcaggacagggcaggcgcaagggcgtcctggatgccaatgtttcagcggcggcgccggcgtgatactcactttccgatctgcattttttgctgtggttgctgtcaccggtcgaagtgcggcatgtgttgtaagaca

SEQ ID NO: 13713 - DNA, 252 bp, Artificial Sequence
  Description of Artificial Sequence: Synthetic coding sequence
atggcactgagctcccaaatctgggcggcatgccttcttctgcttctgctgctcgcatcgcttacttctggctcggtgttcccacagcagaccgggcaattggccgagctccaacctcaggaccgggctggtgcgcgcgcgagctggatgccaatgtttcagcgaagaaggcgacgagatacccattttcctatctgtatcttctgttgcggttgctgtcaccggagcaagtgcggaatgtgttgtaagacc

SEQ ID NO: 13714 - DNA, 252 bp, Artificial Sequence
  Description of Artificial Sequence: Synthetic coding sequence
atggcgttaagctcacagatctgggccgcctgtctgctgttgcttctgctattagccagcctgacatctggttctgtgttccctcagcaaacgggccagctagctgaattgcagcctcaggaccgcgccggcgccagggccagctggatgccgatgttccagcgccgccgccggagagatacacactttcctatttgcatcttttgctgtggatgctgccacagatcaaagtgtgggatgtgctgtaaaact

SEQ ID NO: 13715 - DNA, 252 bp, Artificial Sequence
  Description of Artificial Sequence: Synthetic coding sequence
atggccttgagctcccagatctgggctgcctgcctgctcctgcttctgctcttggccagtctcacatccggtagcgtcttcccccagcaaaccggccagctggcagagctacaacctcaggaccgagccggggctcgtgcatcttggatgccaatgtttcagaggaggaggcgacgggatacacacttcccgatttgcattttttgttgcgggtgctgtcaccgatcaaaatgtgggatgtgttgcaagact

SEQ ID NO: 13716 - DNA, 252 bp, Artificial Sequence
  Description of Artificial Sequence: Synthetic coding sequence
atggctctttcgtcacagatttgggcagcatgccttctgctgctgctgttgcttgcttcccttacttcagggtcggtgtttccccaacagactggacaacttgcagaactgcagccacaggatagagcaggagcacgagcatcatggatgcctatgtttcaacgcaggcgccgcagagacacccattttccgatttgtatattctgctgcgggtgttgccatagaagcaagtgtggaatgtgttgcaaaacc

SEQ ID NO: 13717 - DNA, 252 bp, Artificial Sequence
  Description of Artificial Sequence: Synthetic coding sequence
atggctctttcgagccagatctgggccgcttgcctgctgctgctcttgcttcttgcttcgctgacttcaggatctgtgttcccacagcagactggacagctcgccgagctccagcctcaggatcgagccggcgcacgggcttcatggatgccgatgttccagcggcgcagacggcgggacacccactttcccatctgtatcttctgttgcggatgctgtcacagaagcaagtgcggaatgtgctgcaagacc

SEQ ID NO: 13718 - DNA, 252 bp, Artificial Sequence
  Description of Artificial Sequence: Synthetic coding sequence
atggcactaagctcgcagatctgggcagcgtgtctcctgcttctccttttactagcttcactgacctccggtagcgtctttccgcagcagaccgggcaattggcggaactccagccccaggacagagccggcgcccgggcctcttggatgccaatgtttcagaggcgtaggcgtcgcgacacacactttcccatctgtattttctgctgcggctgttgtcataggtcaaaatgcggcatgtgctgcaagaca

SEQ ID NO: 13719 - DNA, 252 bp, Artificial Sequence
  Description of Artificial Sequence: Synthetic coding sequence
atggcattgagcagccaaatctgggccgcttgcctgctgttgctcctcctccttgcttctcttactagcggaagcgtgtttccacaacagacagggcagctcgcggagttgcagccacaagatcgtgccggcgctcgtgcaagttggatgcctatgttccagagaaggagaaggcgggacacccacttcccgatttgtattttctgttgcggatgttgccatcgctctaaatgtggcatgtgttgtaaaact

SEQ ID NO: 13720 - DNA, 252 bp, Artificial Sequence
  Description of Artificial Sequence: Synthetic coding sequence
atggcattgtcgtcgcaaatatgggcggcctgtctattgcttttgctgttactggctagcttgacatctggaagtgtcttcccgcagcaaacaggacagcttgccgaacttcagccacaagatcgtgccggcgcacgagcgtcgtggatgcccatgttccaaagacgcagacgtcgtgatacacattttcccatctgcattttttgttgcggctgttgtcatcgctccaaatgcgggatgtgctgtaagaca

SEQ ID NO: 13721 - DNA, 252 bp, Artificial Sequence
  Description of Artificial Sequence: Synthetic coding sequence
atggctctgtcatcgcagatctgggctgcatgcctgcttctgctcctgcttctcgcaagcctcacttccggatccgtctttccgcagcagactggacaactggccgagctgcaaccacaggatagagcaggcgctcgcgccagctggatgcctatgtttcagagacgcaggaggcgggatacccatttccctatctgcatcttttgttgtggttgctgtcacagatcaaaatgcggcatgtgctgtaagacg

SEQ ID NO: 13722 - DNA, 252 bp, Artificial Sequence
  Description of Artificial Sequence: Synthetic coding sequence
atggcactgagcagccagatctgggctgcttgcctgctactcctgctgctgttggcatcactgactagcggaagcgtgttccctcagcagacaggtcaactggccgagctacagccacaggaccgagccggcgctcgcgcttcttggatgccaatgttccagagacgccgaaggagagacactcattttccaatttgtatcttttgctgcgggtgctgccatcgctccaaatgtgggatgtgttgcaagacg

SEQ ID NO: 13723 - DNA, 252 bp, Artificial Sequence
  Description of Artificial Sequence: Synthetic coding sequence
atggctctgtcttctcaaatctgggccgcctgcctcctgctgctgttgctgctggctagtctgacctcaggatcagtttttcctcagcaaacaggccagctggcggaacttcagccccaggatagagccggcgctagagcttcatggatgccgatgtttcagcggaggcgccgccgcgacacacacttcccgatttgtatattctgttgcgggtgctgtcaccgcagtaaatgtgggatgtgctgcaaaacg

SEQ ID NO: 13724 - DNA, 252 bp, Artificial Sequence
  Description of Artificial Sequence: Synthetic coding sequence
atggctctgtcctcccaaatctgggcagcttgtctcctcttgctgctgttgctggcttcgctcacttccggatccgtgtttccgcagcaaactggacaactggcggagctgcagccacaggaccgggctggtgcccgcgcgtcttggatgccgatgtttcagcgccgcaggcggagagatacccacttcccgatctgtatcttctgctgcgggtgttgtcatcgctcaaagtgcggaatgtgctgtaagact

SEQ ID NO: 13725 - DNA, 252 bp, Artificial Sequence
  Description of Artificial Sequence: Synthetic coding sequence
atggctctctctagccagatctgggctgcatgtcttctgcttctacttctgctcgcatcactgaccagtggcagcgtgttccctcaacaaaccggccagctggctgaactccagccacaggacagagcaggggctcgtgccagctggatgcccatgtttcagagaagacggagaagagacacacatttccctatttgcattttttgttgcggatgttgccataggagcaaatgcgggatgtgctgtaagaca

SEQ ID NO: 13726 - DNA, 252 bp, Artificial Sequence
  Description of Artificial Sequence: Synthetic coding sequence
atggctctctcatcccagatctgggcagcttgtcttctgctcctcttgctgcttgccagtttgaccagcggatcagtgttcccccaacagacgggccagctggcagagctgcagccccaggaccgcgctggcgctcgggcttcttggatgcctatgttccagagaagacggagaagagacacccacttccccatctgcatcttctgttgtgggtgctgtcatcggagtaagtgtggcatgtgttgcaaaaca

SEQ ID NO: 13727 - DNA, 252 bp, Artificial Sequence
  Description of Artificial Sequence: Synthetic coding sequence
atggcgctttcatcgcaaatctgggccgcttgtctccttctcctgctccttttggcatcccttacctcgggtagcgtgttcccccaacagactggtcagctcgctgaactgcagcctcaggatcgcgcaggagcaagagctagctggatgcctatgtttcaaagacgccgccgtcgggacacccatttcccgatttgcatcttttgctgtggatgctgtcaccgatcgaagtgtggcatgtgttgtaagact

SEQ ID NO: 13728 - DNA, 252 bp, Artificial Sequence
  Description of Artificial Sequence: Synthetic coding sequence
atggccctctcgtcccagatctgggccgcttgtctccttctcctgctcttactggcgtcccttactagtggaagtgtgtttccacagcagaccggacagctcgcagagctgcaaccacaggatcgagccggagctcgagcaagctggatgcctatgtttcagaggaggaggaggagggacacacactttcctatctgtatcttttgttgcggatgctgtcatcggagtaaatgcggcatgtgttgcaaaaca

SEQ ID NO: 13729 - DNA, 252 bp, Artificial Sequence
  Description of Artificial Sequence: Synthetic coding sequence
atggccctgtcgtcacagatttgggcagcgtgtctgcttttgctcttgctccttgcctccctgacttccggatcggtgtttccgcaacaaaccggccagcttgcagagctccaacctcaggatcgggccggtgcacgtgcaagctggatgccaatgtttcaacgaaggaggcggcgcgacactcatttccctatatgcatcttttgttgcgggtgttgccatcgatcgaagtgtggtatgtgttgcaaaacc

SEQ ID NO: 13730 - DNA, 252 bp, Artificial Sequence
  Description of Artificial Sequence: Synthetic coding sequence
atggcattgagctcacagatatgggcagcatgcctgttgctgctgctactgctggcctctctcacaagtggtagtgtgttcccacagcagaccgggcagcttgccgagctgcagccgcaagatcgagccggcgcccgagctagctggatgcctatgttccagcgaaggagacgaagggacacccattttcccatctgcatcttctgttgcggctgctgtcataggtcgaaatgcggaatgtgttgcaagacg

SEQ ID NO: 13731 - DNA, 252 bp, Artificial Sequence; identical to SEQ ID NO: 13679
  Description of Artificial Sequence: Synthetic coding sequence

SEQ ID NO: 13732 - DNA, 252 bp, Artificial Sequence
  Description of Artificial Sequence: Synthetic coding sequence
atggccctttcatcccagatttgggcggcttgcctgctcctgctgttgctcttggcgtccctgacttcggggtcggtgtttccgcagcagactggtcagcttgccgagctgcagcctcaagatcgcgcaggagcgcgcgcctcctggatgcctatgttccagcgccggcggcggagggatactcacttcccgatctgcatcttctgttgcggctgctgtcaccgctcgaagtgcggaatgtgctgcaagact

SEQ ID NO: 13733 - DNA, 252 bp, Artificial Sequence
  Description of Artificial Sequence: Synthetic coding sequence
atggcgttaagctctcagatatgggccgcctgcctgctcctgctactccttttggcaagtcttacgtcaggctccgtgtttcctcagcagacgggtcaactggccgagctgcagccacaggatagagccggtgctcgtgcttcctggatgcccatgtttcagagaaggaggaggcgggacacacactttccaatttgcatcttctgttgcggctgctgtcatcggtccaaatgtggaatgtgttgtaaaact

SEQ ID NO: 13734 - DNA, 252 bp, Artificial Sequence
  Description of Artificial Sequence: Synthetic coding sequence
atggccttgtcatctcagatttgggcagcctgcctccttctgctgctgcttttggcttctctcacatcaggaagcgtattcccccagcagacaggacagctggcagagctacagccccaggatcgcgctggcgcacgagcctcttggatgcctatgttccagcgacgcaggcgaagagatacccatttccccatttgtattttctgctgcggctgctgccatcgatcaaagtgcgggatgtgctgcaagacc

SEQ ID NO: 13735 - DNA, 252 bp, Artificial Sequence
  Description of Artificial Sequence: Synthetic coding sequence
atggctctgagttcgcagatttgggctgcctgcctgctcttactgttgctgctagcctccctgacaagcggttccgtattcccacagcagactgggcaattagccgagttacagccgcaggaccgcgccggggctcgcgcatcgtggatgcctatgtttcaacgccgccgacgccgagatacgcatttccctatttgtatcttctgctgtggatgttgccataggtcaaaatgtggtatgtgttgcaagacg

SEQ ID NO: 13736 - DNA, 252 bp, Artificial Sequence
  Description of Artificial Sequence: Synthetic coding sequence
atggccttgagcagtcaaatttgggccgcctgtctgttgttacttttgcttctcgccagtctcacatcagggtctgtgtttcctcagcaaaccgggcagctggctgagcttcaaccacaggaccgcgccggggctcgcgcttcttggatgcccatgtttcagagaaggcgccgaagagatacccacttcccaatctgcatcttctgctgtggctgctgccatcggtcgaaatgcggcatgtgttgtaagaca

SEQ ID NO: 13737 - DNA, 252 bp, Artificial Sequence
  Description of Artificial Sequence: Synthetic coding sequence
atggctctgtcatcacagatttgggcggcctgcctactcttactgcttttactagcaagcctcacgagcggcagtgtttttccacaacagacggggcagctggccgagttacagcctcaggaccgagctggggcacgtgcatcttggatgcctatgttccaacgccggagacgcagagacacccatttcccaatctgcattttctgttgtggctgttgccaccgctccaagtgcgggatgtgttgcaagacg

SEQ ID NO: 13738 - DNA, 252 bp, Artificial Sequence
  Description of Artificial Sequence: Synthetic coding sequence
atggctctctcttctcagatatgggcggcatgcctgctactcctcctccttcttgcctccctgacatcgggatccgtgtttccacagcagacaggacagctagctgagctgcagccacaggatagagcgggagccagggcatcttggatgcctatgtttcagcgacggaggcggcgcgacacacatttccctatatgtatattctgttgtggatgttgtcaccggtctaaatgcggaatgtgctgtaaaaca

SEQ ID NO: 13739 - DNA, 252 bp, Artificial Sequence
  Description of Artificial Sequence: Synthetic coding sequence
atggcccttagctcacagatctgggccgcctgtttgctcctcctgctcctgctggcgagcctgacgagtggttcagtgttccctcagcagactggacagctggcggagctgcagccccaggaccgagcaggcgcgcgagctagctggatgcctatgttccagaggcgcagacgtcgcgacacccattttcccatctgtatcttttgctgcggttgttgccaccgtagtaagtgcggcatgtgctgcaagacc

SEQ ID NO: 13740 - DNA, 252 bp, Artificial Sequence
  Description of Artificial Sequence: Synthetic coding sequence
atggctttgagcagccagatttgggcagcttgcctcttgctgctgctcctcctcgcttccctgacctcaggcagcgtgtttccccagcagaccggacaactcgcagaacttcaaccacaggatagagcgggcgctcgggccagttggatgccaatgttccagcgacggcgcagacgcgacacccacttccccatatgcatattttgttgtggttgctgccaccggagtaaatgcggaatgtgttgtaagacg

SEQ ID NO: 13741 - DNA, 252 bp, Artificial Sequence
  Description of Artificial Sequence: Synthetic coding sequence
atggctctgagctctcagatttgggccgcttgcctgctcctgctgttacttctagccagcctgacaagcggctcagtcttcccgcagcagacaggacaactagcggaactccagccccaagaccgggctggcgctagagcatcatggatgcccatgtttcaaaggagaagaaggagggacacacactttcccatatgcatcttctgttgtggctgctgtcaccgctcaaaatgcgggatgtgctgtaagacc

SEQ ID NO: 13742 - DNA, 252 bp, Artificial Sequence
  Description of Artificial Sequence: Synthetic coding sequence
atggccctgagttcccaaatctgggctgcctgcctgctccttcttctactccttgcgagcctcacgtccggctctgtgttcccgcagcagacagggcagttggcggagctgcagccacaggatagagccggcgctcgtgcctcatggatgccgatgtttcagcggcgcagacgcagagacacgcatttccctatttgcatattctgctgtggatgctgtcacagatccaagtgtggcatgtgttgcaagact

SEQ ID NO: 13743 - DNA, 252 bp, Artificial Sequence
  Description of Artificial Sequence: Synthetic coding sequence
atggccttgtcctcgcaaatttgggcagcatgcctgctgctgcttcttttgctggcgtcacttacttccggttcagtgttcccacaacagaccggacagctcgcagaacttcagccacaagatcgcgcaggtgcaagagcgtcgtggatgccaatgtttcaacgtcgtagacggcgcgacactcattttcctatttgcattttctgttgtgggtgttgtcaccggagcaagtgcggtatgtgctgtaagacc

SEQ ID NO: 13744 - DNA, 252 bp, Artificial Sequence
  Description of Artificial Sequence: Synthetic coding sequence
atggctctttcctcacagatctgggcagcttgtctgcttctgctattgcttttggcaagtctgacctccggaagtgtttttccacagcagaccggccagttagcagagctgcaaccacaggatagagcaggagcacgcgcctcctggatgccgatgttccagagacgccgaaggcgcgatacgcacttccccatctgcattttctgttgcggatgttgccaccggtccaaatgtggaatgtgctgcaagacc

SEQ ID NO: 13745 - DNA, 252 bp, Artificial Sequence
  Description of Artificial Sequence: Synthetic coding sequence
atggccttgagctcacagatttgggcagcgtgtctgctcctgctgctgcttctcgccagcctcacctccgggtccgtctttccgcaacaaaccggacaacttgcagaactgcagcctcaggaccgcgcgggcgcaagagcctcctggatgcctatgttccagcggcgccggagacgcgacacccacttccccatttgcatcttctgttgcggatgctgtcacagatcgaagtgcggcatgtgctgtaagacc

SEQ ID NO: 13746 - DNA, 252 bp, Artificial Sequence
  Description of Artificial Sequence: Synthetic coding sequence
atggcgctgtcctcgcagatttgggcagcctgccttctccttctgttgctgttggctagcctgacttccggatcagtgttcccccaacaaaccgggcaactggcagaacttcagcctcaagacagagcaggcgcccgagcatcatggatgccaatgtttcaacgccgtagaagaagggatacccatttccccatatgcatcttctgttgcggctgctgtcacagatccaagtgtggaatgtgttgtaagact

SEQ ID NO: 13747 - DNA, 252 bp, Artificial Sequence
  Description of Artificial Sequence: Synthetic coding sequence
atggccctgtcgagccaaatatgggccgcttgcttgctccttttgcttctcttggcctcgcttacctcaggatcggtgtttcctcagcagaccggacaactcgccgagcttcaaccgcaagatcgagcaggcgcaagagcgagctggatgcctatgttccaaaggcgacgcagacgggacacccactttccaatctgtattttctgctgtggatgttgccacaggtccaagtgtggaatgtgctgtaagact

SEQ ID NO: 13748 - DNA, 252 bp, Artificial Sequence
  Description of Artificial Sequence: Synthetic coding sequence
atggcattgtccagccagatctgggcagcatgcctcctgctcttgttgctgttggcatctttgactagtggtagtgtatttccacagcagacaggccagctggctgagttgcagccccaagatagagccggcgcgagggcatcatggatgcctatgtttcagcgcaggagacgcagggatactcatttcccgatctgcatcttttgttgcggatgctgtcatcgctctaagtgtggaatgtgttgtaaaacc

SEQ ID NO: 13749 - DNA, 252 bp, Artificial Sequence
  Description of Artificial Sequence: Synthetic coding sequence
atggctttatcttctcaaatatgggctgcttgtcttcttcttttgttacttttagcttctcttacatcaggatcagtttttccacaacaaacaggacaattagcagaattacaaccacaagacagagcaggagctagggcttcttggatgccaatgtttcaacgtagacgaagaagagatacacattttcctatatgcatattttgttgtggttgttgtcatagaagtaaatgtggaatgtgttgtaagaca

SEQ ID NO: 13750 - DNA, 252 bp, Artificial Sequence
  Description of Artificial Sequence: Synthetic coding sequence
atggcgttatcgtcgcaaatatgggcggcgtgtctattattattactactactagcgtcgttaacgtcgggttcggtatttccgcaacaaacgggtcaactagcggaactacaaccgcaagatcgtgcgggtgcgcgagcgtcgtggatgccgatgtttcaacgtcgacgtcgtcgagatacgcattttccgatatgtatattttgttgtggttgttgtcatcgttcgaaatgtggtatgtgttgtaaaacg

SEQ ID NO: 13751 - DNA, 252 bp, Artificial Sequence
  Description of Artificial Sequence: Synthetic coding sequence
atggctctcagctctcagatatgggcagcgtgtttactgttgctcttgttgctggcctcccttaccagtggttctgttttcccacagcaaactggccagctagccgagctgcagccacaggatcgcgccggtgctagggcctcttggatgccaatgttccagcgtcggcggcgcagggacacccattttccaatatgtattttttgttgcggatgctgtcaccggagcaagtgtggcatgtgctgtaagaca

SEQ ID NO: 13752 - DNA, 252 bp, Artificial Sequence
  Description of Artificial Sequence: Synthetic coding sequence
atggcccttagctcgcagatatgggcagcatgtttgctgctgcttcttctgttggcctcgctgacttcaggtagcgtgtttccacaacagaccgggcaactcgcagaactccagccgcaggatagagcaggtgcccgggcatcgtggatgcctatgttccaacggcggaggcgaagagacactcactttcctatttgcatcttttgctgtggctgttgtcataggtccaaatgtggcatgtgctgcaagacc

SEQ ID NO: 13753 - DNA, 252 bp, Artificial Sequence
  Description of Artificial Sequence: Synthetic coding sequence
atggcgctcagcagtcagatttgggcggcgtgcctcctgttgctcttgctcctggcctcgctgacctccggatccgtcttccctcagcaaaccggccaactggccgaactgcagccgcaggatcgggctggtgcgagagcaagctggatgcctatgttccagcggcgccggcgcagagacactcattttccaatttgtatcttctgttgcgggtgctgccaccggtcgaagtgcggcatgtgctgcaagact

SEQ ID NO: 13754 - DNA, 252 bp, Artificial Sequence
  Description of Artificial Sequence: Synthetic coding sequence
atggcactcagttcgcagatatgggcagcctgtctacttcttcttctactgctagcctctctcacatctgggtctgttttccctcagcagacagggcagctggcggaactacagccccaggatagggccggggctcgggcctcgtggatgcccatgtttcagagaaggagacgacgcgatactcacttccctatttgcattttctgctgtggatgttgtcaccggtccaaatgtgggatgtgttgcaaaact

SEQ ID NO: 13755 - DNA, 252 bp, Artificial Sequence
  Description of Artificial Sequence: Synthetic coding sequence
atggctctttctagccagatatgggccgcttgtttgctcctgttgctgctgctcgcgtcccttacatccggttcagtgtttcctcaacagaccggtcaacttgcggagttgcagccccaggatagagctggggcaagagcctcttggatgcctatgttccagcgtaggcgtcggcgggacactcatttcccaatctgtatcttctgttgtgggtgctgccaccgcagcaaatgtggcatgtgttgtaaaacc

SEQ ID NO: 13756 - DNA, 252 bp, Artificial Sequence
  Description of Artificial Sequence: Synthetic coding sequence
atggcactgtcctctcagatttgggcagcgtgtctgctgcttcttttgctgttggcaagccttacctcgggttcggtgttccctcagcagaccggacaacttgccgaactgcagccgcaagatcgagccggagcgcgggcttcgtggatgcctatgtttcagaggcgtagacgaagggacacgcactttccaatttgtatcttttgttgcggatgttgccatcgctcgaaatgcgggatgtgctgcaagacg

SEQ ID NO: 13757 - DNA, 252 bp, Artificial Sequence
  Description of Artificial Sequence: Synthetic coding sequence
atggctctctcgagccagatttgggccgcgtgtctgctcctgttgctgttgctcgcttcactgactagcggatctgtgttcccgcaacagactgggcagctggcagagcttcagccacaagatagagcgggggcacgagcgtcctggatgccgatgttccagagaaggcgccggcgcgacacccatttccctatctgtatcttctgctgcggttgctgtcacagatccaagtgtggtatgtgctgcaaaact

SEQ ID NO: 13758 - DNA, 252 bp, Artificial Sequence
  Description of Artificial Sequence: Synthetic coding sequence
atggctttatctagccagatatgggccgcatgcctgcttctcctgctgctcctcgctagcctaactagtggttctgttttccctcagcagacaggacagctggccgagctgcagccacaggacagagccggagctagagcgtcctggatgccaatgtttcagagacgccggagaagagatacacatttcccgatttgcatcttttgctgtggatgttgtcacagaagcaagtgcggcatgtgctgtaagaca

SEQ ID NO: 13759 - DNA, 252 bp, Artificial Sequence
  Description of Artificial Sequence: Synthetic coding sequence
atggcactgtctagtcagatttgggccgcgtgtcttctgttactcctgctcctggcctccctcacaagcggatccgtattccctcagcagaccggacaactggccgaactgcagccacaggacagagcgggcgcccgggctagctggatgcctatgtttcagcgacgtcgcagaagggacacccacttccccatctgcatcttttgttgcggttgctgtcacagatccaaatgtgggatgtgctgcaagacg

SEQ ID NO: 13760 - DNA, 252 bp, Artificial Sequence
  Description of Artificial Sequence: Synthetic coding sequence
atggctttaagcagtcagatttgggctgcctgtttacttctccttcttctattggcaagcttgacatctggctccgtgttcccccagcagacgggacagcttgccgagctgcagccacaggaccgcgccggtgcccgagcctcttggatgcctatgttccagaggcgacgtaggagggacacccatttcccgatttgcatcttttgctgtgggtgctgccaccgatctaaatgcggtatgtgttgcaaaacg

SEQ ID NO: 13761 - DNA, 252 bp, Artificial Sequence
  Description of Artificial Sequence: Synthetic coding sequence
atggcactgtcgtcgcagatctgggcggcatgcctccttctcctgctgctcctcgcgtccctgaccagcggttcggtgtttccacagcagaccggacagcttgccgagctgcagccacaagaccgggctggagccagagcaagctggatgcctatgtttcaacgccgacggaggcgcgatacccactttccgatttgcatcttctgctgcggctgttgtcatcgctcgaaatgcggaatgtgctgcaagact

SEQ ID NO: 13762 - DNA, 252 bp, Artificial Sequence
  Description of Artificial Sequence: Synthetic coding sequence
atggccctgtcttctcaaatatgggcagcatgcctgctgctgttattactgcttgccagcctgacaagcggctcagtcttccctcagcagactggccagcttgccgaactacagccccaggacagggcaggcgctcgtgcctcctggatgcccatgttccagcgccgccgccgtcgggacacccacttccctatttgtatcttttgctgtggatgctgtcacaggagcaagtgcggtatgtgctgcaaaacc

SEQ ID NO: 13763 - DNA, 252 bp, Artificial Sequence
  Description of Artificial Sequence: Synthetic coding sequence
atggcgctctcctcacagatatgggctgcttgcctgctgcttctgctcctccttgcgtcgctgacttcgggatcggtctttccacagcaaaccggacaacttgccgaactgcagccgcaagaccgcgcaggggcaagagcgtcctggatgcctatgtttcagcgtagacgccggagagatactcacttcccaatttgtattttctgttgtggatgttgtcatcgttcgaagtgtggaatgtgctgcaagacg

SEQ ID NO: 13764 - DNA, 252 bp, Artificial Sequence
  Description of Artificial Sequence: Synthetic coding sequence
atggccctgtccagtcagatatgggcagcttgcctccttctgctgttgttgctggcgagcctgacatctggatccgtgttccctcagcagaccggccagctcgctgagctccagccccaggatcgggcaggggcccgtgcttcgtggatgccgatgttccagcgccgcaggcggcgcgacacgcacttcccaatctgcatcttttgttgcggctgctgccaccgcagcaaatgtggcatgtgttgtaaaaca

SEQ ID NO: 13765 - DNA, 654 bp, Artificial Sequence
  Description of Artificial Sequence: Synthetic coding sequence
atggctacacggtcgccaggagtagtcatttcagacgatgaacctggatacgacttggacctcttctgtattcctaaccattatgccgaagatttggagagagtttttatcccacatggattgattatggatcgtacggagaggttagctagggacgtgatgaaagaaatgggaggacaccacatcgttgcgttgtgtgttcttaaaggtggttataaattctttgcagacctccttgactacattaaagcgctcaacagaaactcggatcgttctattccaatgaccgtggactttatacgtcttaaatcttattgcaatgatcaatctacaggggatatcaaggttataggaggagatgatctcagtacactgactggaaaaaatgttcttatagtagaagatatcattgatactggaaaaacaatgcaaaccttgttgtctctggtccgacagtacaatccaaaaatggtgaaagtggcttccttgttggtcaagcgaaccccaagatcagtgggttataaaccagattttgttggatttgagattcccgataaattcgtcgtgggatacgcattagattacaatgaatattttcgtgatttaaaccatgtttgcgttatttcggaaacgggtaaagccaaatataaagca

SEQ ID NO: 13766 - DNA, 654 bp, Artificial Sequence
  Description of Artificial Sequence: Synthetic coding sequence
atggcaacgcggagtccgggagtggtgatttcagacgatgaaccgggatacgatctggacttattctgcatacctaatcactacgctgaagacctcgaacgcgtttttataccccatggtctgattatggaccgtactgaacgcctggcacgagatgtgatgaaggaaatgggcggccatcatatcgtggcgctctgcgtccttaaaggcggctataaattctttgccgatctactggattatatcaaggcccttaacaggaattcagataggtcaatccctatgacggtggactttatccggttaaaatcatattgtaacgaccaatcaacgggtgacatcaaagtcataggtggagacgatttgtctactctcacaggtaagaacgtgttgatcgtagaagatataattgacacagggaagacaatgcagactctgctcagcctcgtacgtcaatacaatcccaagatggtcaaggtggcatccctcttggtaaagaggacaccgcggtcagtgggttacaaacccgattttgtaggattcgagatacccgacaagttcgttgtgggatacgccctggactacaatgaatactttagagacctgaatcatgtgtgtgttataagtgaaactggcaaagccaagtacaaggcc

SEQ ID NO: 13767 - DNA, 654 bp, Artificial Sequence
  Description of Artificial Sequence: Synthetic coding sequence
atggcaacgcgatcgccgggggtcgtcataagtgacgatgaaccggggtacgaccttgacctcttttgcatccctaaccactacgccgaggatctggaacgtgtgttcatcccacatggactgattatggatcgaaccgagagactggcaagagacgtgatgaaggagatgggaggccaccatatagtggctctctgtgtacttaaaggaggatacaagttttttgcggaccttttggattacattaaagcacttaaccgcaacagcgaccgttcaattcccatgactgtcgactttattcggcttaagtcctattgtaacgatcaatctaccggcgacataaaagtgattggaggggatgatctgtctaccttgacgggaaagaatgtgctcatcgtagaggacattattgatactggtaagaccatgcaaactttgctctcgcttgtgaggcagtacaatcctaagatggtgaaggtcgcatccttgctggttaagcgcactccacgctcagtcggctacaaacctgacttcgttggttttgaaatccccgataagtttgtggtcggctacgccctcgattacaacgaatacttccgggatctgaatcatgtgtgcgtgatttcagaaactggtaaagcaaagtacaaggcg

SEQ ID NO: 13768 - DNA, 654 bp, Artificial Sequence
  Description of Artificial Sequence: Synthetic coding sequence
atggccaccagatcccccggcgtggtgatcagcgatgatgaacccggttacgacctggatctcttttgtattcctaaccactatgctgaggacctcgagcgggtattcatcccccacgggcttatcatggatcgaacagaacgtctggctcgcgatgtgatgaaagaaatgggcggacaccacattgtagctctctgcgtcttaaagggcggctataaattcttcgccgatttgctggactatatcaaggctttgaacaggaatagtgaccggagcatccccatgacggtggatttcatcagacttaagtcctactgtaacgatcagtcaacaggtgatatcaaagtcattggcggtgatgatctgagtaccctgactgggaaaaacgtcctcattgtggaggacattatcgatacagggaaaacaatgcagactctcttgtcacttgtgcgccagtataacccgaagatggtcaaagtggcaagcctgcttgttaagagaaccccccgctctgtcgggtataagccagactttgtcggatttgagatccctgacaagttcgttgttggatatgcgctcgattacaacgaatacttcagagacctcaatcacgtgtgtgtgatttccgaaacagggaaggctaaatataaggcc

SEQ ID NO: 13769 - DNA, 654 bp, Artificial Sequence
  Description of Artificial Sequence: Synthetic coding sequence
atggctaccagatccccgggagtggtgatctcagacgatgagccgggatacgatctcgacctgttttgcattcccaaccactacgccgaagatctggagcgggtgtttatcccacacggtctgatcatggacaggactgagcgcctggcccgcgacgtgatgaaagaaatgggcggacatcacatcgtcgcgctgtgcgtgctgaagggaggatacaagttcttcgctgatctgctggactacatcaaggcgctcaaccgcaattccgaccggtccatcccgatgactgtggacttcattaggctgaagtcatactgcaatgaccaatcgacgggggacatcaaggtcatcggcggagacgatctgtcgaccctgacgggcaagaacgtcttgatcgtggaagatatcattgataccggaaagactatgcaaaccctgctcagtctggttcggcaatacaatccgaagatggtgaaagtggcgtctctgcttgtgaagcgcaccccacgcagcgtgggctacaagccagatttcgtgggatttgaaattcccgataagttcgtggtgggctatgcgttggattacaacgaatactttagagacttgaatcatgtctgcgtgatttcagaaactgggaaagccaaatacaaggca

SEQ ID NO: 13770 - DNA, 654 bp, Artificial Sequence
  Description of Artificial Sequence: Synthetic coding sequence
atggcaactcgttccccaggcgtggtgatatcggatgacgagccaggatacgatcttgaccttttttgcatccctaaccattacgccgaagatctggaaagagtgtttattccgcatggattgataatggatagaaccgagagactggcccgtgatgtgatgaaagagatgggtgggcaccacatcgtggcactttgtgtccttaaaggtggctacaagttctttgctgatcttctggattacattaaagcactgaatcgtaattcggaccgatcaataccaatgaccgtcgatttcattaggctcaagagctactgcaacgatcagagcaccggagatatcaaagtgatcgggggtgatgatctgtccactctcactggaaaaaacgttcttattgtggaagatatcatcgatactggaaagactatgcaaactcttttgtcgctggtgagacagtacaatcctaaaatggtcaaggttgcatcccttcttgtgaagagaaccccgagaagtgtcgggtacaagcctgatttcgtgggattcgaaatccctgacaaatttgtggtcggctacgctctcgactataatgaatactttcgggaccttaatcacgtgtgtgtgatttccgaaaccggaaaggcaaagtacaaggca

SEQ ID NO: 13771 - DNA, 654 bp, Artificial Sequence
  Description of Artificial Sequence: Synthetic coding sequence
atggcaactcgctccccaggtgtggtgatttccgatgacgaacccggttacgacttggacttgttttgtatccctaaccattacgccgaagatttggaacgcgtgtttattccacacgggctcattatggaccgtaccgaaagacttgcccgagatgtgatgaaggaaatgggagggcatcatattgtggctctgtgcgtgctgaaaggcggctacaagttttttgcagatctcttggattacatcaaggcccttaatcgcaactcggacagatctattccaatgaccgtggacttcattcgactgaagtcatactgcaacgatcagtccaccggtgacattaaggtgatcggtggagatgacctgtccacccttaccgggaaaaatgtacttattgtggaggacataatagatacgggtaagaccatgcagactcttttgagccttgtgcgccaatacaatcccaagatggtgaaggttgcgagccttctggtcaagcgcactcctagatcagtcggatacaagccggattttgtgggctttgagattcctgacaaattcgttgtgggctacgcactggactataacgaatacttccgggacctgaaccacgtgtgtgtgatatccgagactggtaaggcgaagtacaaagca

SEQ ID NO: 13772 - DNA, 654 bp, Artificial Sequence
  Description of Artificial Sequence: Synthetic coding sequence
atggccacgcgatctccaggggtggtcataagcgacgatgagcctgggtacgaccttgacctgttttgtatccccaatcactatgcagaggatttggaaagggtcttcatccctcacggcttaatcatggacaggaccgaacggctggctcgagatgtgatgaaagaaatgggtggccaccacattgtggctctttgcgtgctgaaagggggatataagttctttgccgaccttctggattacattaaggctctgaaccggaattcagaccgttccattccgatgacagtggacttcattcgccttaaaagttattgtaatgaccaatctacaggcgacataaaggtgataggcggagacgacctgtcaactctgaccgggaagaacgtcctcattgtcgaggatatcatagacactgggaagacgatgcagacactactgtccctggtccgtcagtataacccaaaaatggtgaaagtggcttctctgctggtaaaaagaaccccacgatccgtggggtataagccagactttgttggcttcgaaatacctgacaaattcgtggtcggctatgccctggactataacgagtacttccgagacctcaaccacgtgtgcgtgatcagcgaaacgggaaaagccaagtataaagct

SEQ ID NO: 13773 - DNA, 654 bp, Artificial Sequence
  Description of Artificial Sequence: Synthetic coding sequence
atggctactcgttcccctggggtagtcatctcggatgatgaacccggctacgatttagacttgttttgcatccctaaccactatgccgaagaccttgaacgcgtattcatccctcacgggcttatcatggatcggactgagaggttggcaagggacgtcatgaaggagatgggcgggcatcacattgtagcgctgtgcgttctaaagggcggatacaaattctttgcggacttgcttgactatataaaagcccttaataggaacagtgaccgaagtatccctatgactgtcgatttcattcggctgaaatcctattgcaacgatcaatccactggagacatcaaagtgattggtggagacgatctttctacattaactggtaagaatgtcttgatagttgaagacataatcgataccgggaagaccatgcagacccttctctctttggttcgacaatataaccctaagatggtaaaggtggcaagtctgctcgtgaaacgtactcccaggagtgttggttacaaacctgacttcgtgggattcgagatcccagacaagttcgtggttggctacgctctagactataacgagtacttccgcgatctaaaccatgtttgtgtaatcagtgagacagggaaggcgaagtacaaagcc

SEQ ID NO: 13774 - DNA, 654 bp, Artificial Sequence
  Description of Artificial Sequence: Synthetic coding sequence
atggcgacgcgatcgccgggtgttgtaatatcggatgatgaaccgggttatgatctagatttattttgtataccgaatcattatgcggaagatttagaacgtgtttttataccgcatggtttaataatggatcgaacggaacgtttagcgcgtgatgttatgaaagaaatgggtggtcatcatatagtagcgttatgtgtattaaaaggtggttataaattttttgcggatttattagattatataaaagcgttaaatcgtaattcggatcgatcgataccgatgacggtagattttatacgattaaaatcgtattgtaatgatcaatcgacgggtgatataaaagtaataggtggtgatgatctatcgacgttaacgggtaaaaatgtattaatagtagaagatataatagatacgggtaaaacgatgcaaacgttattatcgttagttcgtcaatataatccgaaaatggttaaagttgcgtcgctactagttaaacgaacgccgcgttcggtaggttataaaccggattttgtaggttttgaaataccggataaatttgtagtaggttatgcgctagattataatgaatattttcgtgatttaaatcatgtttgtgttatatcggaaacgggtaaagcgaaatataaagcg

SEQ ID NO: 13775 - DNA, 654 bp, Artificial Sequence
  Description of Artificial Sequence: Synthetic coding sequence
atggccactaggtcgccgggcgtggtgatttccgacgatgagccgggatatgacctggaccttttctgcatcccaaatcactacgctgaagatctcgaacgcgtgttcatccctcatggcctcatcatggacaggactgaacgcctggcccgggacgttatgaaagagatgggcgggcatcacatcgtggccctctgcgttcttaagggcggatacaagttcttcgccgatctgcttgactacataaaggcgctgaaccggaacagcgaccgctcgattccgatgactgtcgatttcatcagactgaaatcctactgcaacgaccaatcgaccggagatatcaaggtgatcggaggggacgatctctccacccttactggtaagaacgtgctgatcgtggaggacataatcgacacgggaaaaacgatgcaaaccctgctctccctggtgcgccagtataatccaaagatggttaaagtcgcaagcctcttggtgaagcgcactccaaggagcgtcggctacaaaccagatttcgtgggattcgagatccctgataagttcgtcgtgggctacgctctcgattacaacgaatactttagggacctgaatcacgtgtgcgttatctcagaaaccggcaaagccaagtacaaagca

SEQ ID NO: 13776 - DNA, 654 bp, Artificial Sequence
  Description of Artificial Sequence: Synthetic coding sequence
atggctacacgttctccaggcgtggtgatatcagacgatgaacctggctacgatctggacctcttctgtattcccaatcactacgccgaggatctggagcgggtgttcattccacacggcctaatcatggatagaacagaaagactagctcgagacgtgatgaaggagatgggcggacaccacatagtggcactttgcgtgctgaaaggtggctacaagttttttgctgatctgttagactacatcaaggccctcaacaggaacagcgacaggagcatcccaatgacagtggatttcatcagactgaaatcctattgcaacgatcagtccacaggagacattaaggtcatcggaggcgatgatctgtctacactgacagggaagaatgttctgatcgtggaggatatcatcgacaccggcaaaaccatgcagactctgttaagtttggttagacagtataaccctaagatggtaaaggtggctagtctgcttgtgaagcggacacctcgctccgtgggatataaaccagactttgtcgggtttgagataccagataagttcgtggtgggatatgcattagattataatgagtactttcgcgacctaaatcatgtctgtgtgataagtgagaccggcaaagccaagtacaaagca

SEQ ID NO: 13777 - DNA, 654 bp, Artificial Sequence
  Description of Artificial Sequence: Synthetic coding sequence
atggccactcggagccctggggtcgttatcagcgacgatgagcctggctatgatcttgatctgttctgtatacctaaccactatgccgaagatctggagcgagttttcattccccatggcctcatcatggaccggacagaaagactggcacgcgatgtgatgaaagagatggggggtcaccacattgtcgctctctgcgtccttaaaggagggtacaagttcttcgcggacctgctagactatattaaagccctaaacaggaattccgatagatccataccaatgaccgtcgactttatccgcttgaagtcatactgtaatgatcaaagtacgggcgatattaaggttatcgggggggacgatctcagcacattgactggaaaaaacgtgctgatcgtggaggatatcatcgatactggaaaaacaatgcaaacactgctctccctagtgagacagtacaatccaaagatggtcaaagtcgcgagcctgctagttaagcgcactcccagatccgtggggtacaaacctgattttgtgggcttcgaaataccagataaattcgtggtggggtacgcacttgactacaacgaatactttcgggatctcaatcacgtgtgtgtgataagtgaaaccggcaaggctaaatacaaagcc

SEQ ID NO: 13778 - DNA, 654 bp, Artificial Sequence
  Description of Artificial Sequence: Synthetic coding sequence
atggcaactaggtcaccaggggtggtgatttccgatgacgaacccgggtacgatcttgacctgttttgtatccctaaccattacgccgaggatctggaaagagtgtttatccctcacgggctcattatggaccgcaccgaacgtctcgcaagggatgtaatgaaggaaatgggaggacatcacattgtcgctctgtgtgtccttaaggggggctataagttctttgccgatctgctcgattacataaaggcacttaatagaaacagcgatcggtcgataccgatgactgtcgacttcattcgtcttaaatcctactgcaacgaccaatccactggagatatcaaggtgattgggggagatgatctgagcacccttactggaaagaatgtgcttattgtggaagatatcatagatacgggtaagaccatgcaaaccctcctttccctggtgagacagtacaaccctaagatggtgaaggttgcctcccttctggttaagaggacccctaggtcggtgggatacaagcccgactttgtgggattcgaaatcccagataagtttgtggtgggctacgcccttgattacaacgaatactttcgggaccttaatcatgtgtgcgtgatatccgagactggtaaagccaaatacaaagcg

SEQ ID NO: 13779 - DNA, 654 bp, Artificial Sequence
  Description of Artificial Sequence: Synthetic coding sequence
atggctacccggtccccaggagtggtgatctcggatgacgaaccaggctacgacctggacctgttctgcatccctaaccactacgctgaggacctcgaacgtgtgtttattccgcacggactgatcatggacaggaccgagcgcctcgcccgggatgtcatgaaggaaatgggaggtcaccatatcgtggcgctttgcgtgttgaagggagggtacaagttctttgccgacctgcttgactacataaaggctctcaacaggaatagcgatagaagcattccgatgactgtggacttcatccggctgaaaagctactgcaacgaccagagcactggcgacattaaagtcatcggaggagacgacctgtccaccctcactggaaaaaacgttctgatcgtcgaagatatcatcgacaccggaaagacgatgcagactctgctttccttggtgcgccagtataaccctaaaatggtgaaggtggcatcactgctcgtgaagagaactccgaggtcagtcggctacaaaccagacttcgtcggcttcgaaatccctgacaagttcgttgtgggttacgcccttgactataacgagtacttccgggaccttaaccacgtgtgcgtgatttcggaaaccggtaaggcaaagtacaaggcg

SEQ ID NO: 13780 - DNA, 654 bp, Artificial Sequence
  Description of Artificial Sequence: Synthetic coding sequence
atggctacacggagtccaggtgtggtgatctccgatgacgagcctggctatgatcttgacctgttctgcataccaaaccactacgctgaagacctggagagggtattcatcccccatggattaataatggacagaaccgaacgactggcccgggacgtcatgaaagagatggggggccaccacattgtggcactgtgtgtgctcaagggcggctacaagttttttgccgaccttctggactatattaaggccttaaatcgaaactctgatcgctcaatacctatgactgtagacttcattcggttgaaatcctattgtaatgaccagagcacaggggacattaaagtcattggtggggacgacctgagcacactcaccggaaaaaacgtcctgatcgtggaagacatcatcgacactggcaaaacgatgcagaccttgctgagtctggtacgacaatacaatcctaagatggtcaaggtcgctagtctgctagtcaagagaaccccccgcagcgtggggtacaaacctgatttcgtcggtttcgagattccagacaaatttgtggtcggctacgctttagattacaacgaatactttagggatctcaatcatgtctgtgtgattagcgaaacgggcaaggcgaagtacaaagct

SEQ ID NO: 13781 - DNA, 654 bp, Artificial Sequence
  Description of Artificial Sequence: Synthetic coding sequence
atggctaccaggtcaccaggcgttgtcatttctgacgacgaacccggctacgacttggatttgttctgtattcccaaccactatgccgaggacctggagagggtttttatcccccatgggctaattatggaccggaccgaacggctggcacgcgacgtgatgaaagaaatgggcggccaccatatcgtggctttgtgtgtgctgaaggggggctacaagttcttcgcagacctgctcgattacataaaagccctaaatcgcaattccgatcggtccatccccatgacagtggactttataaggcttaaaagctactgtaatgatcagagcaccggtgacatcaaggtgatcggcggagatgacctctccaccttgaccggaaagaacgtcctgatcgttgaggatataatcgatacaggaaagaccatgcagactctgttatctctcgtccggcagtacaaccctaagatggtcaaagtggcttcgttgctcgtcaaaagaacccccagaagcgtggggtataagcccgattttgtcgggtttgagatccccgataaattcgttgtcgggtacgccttagactataatgaatatttcagagacctcaaccatgtgtgcgttatctctgaaactgggaaagcgaaatataaggcc

SEQ ID NO: 13782 - DNA, 654 bp, Artificial Sequence
  Description of Artificial Sequence: Synthetic coding sequence
atggccacacgcagcccaggggtggtgatctcggatgacgaacccggctatgacttggatcttttctgcattccaaaccactacgctgaggacctagaaagggtcttcattcctcatggactcatcatggacaggactgaacggctggctcgcgatgtgatgaaagaaatgggaggccatcacattgtggccctgtgcgtgctgaagggagggtataagtttttcgccgaccttctggattacatcaaagccctgaatagaaatagcgatagaagcatccccatgaccgttgatttcatcaggctcaagtcttactgtaacgaccagtcaacgggagatatcaaggtcatcggcggggacgatctttctactctcactgggaagaacgtcctcatagtcgaagacatcattgatactggaaaaacaatgcaaacgcttctgagcctggtcaggcaatataaccccaagatggtgaaggtggcttctctcctcgtgaagcgaacaccacgcagtgtgggttacaagccggactttgtcggctttgaaatcccagataaatttgttgttggctacgccctggactacaatgagtatttcagggacctgaaccatgtttgtgtgatttctgaaaccggcaaggctaaatacaaagcc

SEQ ID NO: 13783 - DNA, 654 bp, Artificial Sequence
  Description of Artificial Sequence: Synthetic coding sequence
atggccacacggagcccaggtgtggtaatcagcgacgatgaacctggttatgacttggatttgttctgtatccctaaccactacgctgaagacttggagagggtgtttattccacatggcctgataatggataggactgagaggctggcccgtgacgtgatgaaagaaatggggggccaccatatagtggctctgtgcgtcctgaaaggagggtataagttttttgccgacctgctagactacatcaaagccctcaatcggaatagtgaccgctctatccctatgaccgtggactttatccgcctcaaatcttattgtaatgatcagtcaacaggggatattaaggtaattgggggggatgatctctcaactttgacaggtaagaacgtcctgattgtggaggacattatcgacactggaaagactatgcagaccttgctctcactggttaggcagtacaaccccaaaatggtgaaagttgctagcctgctggtgaagaggacaccgagaagtgtcgggtacaagcccgactttgtgggtttcgaaattcctgacaagttcgtagtgggatatgccttagattataacgaatattttagagatctgaatcatgtgtgtgtaatctccgagactgggaaagccaaatacaaggct

SEQ ID NO: 13784 - DNA, 654 bp, Artificial Sequence
  Description of Artificial Sequence: Synthetic coding sequence
atggcaacccggagcccaggtgtggtgatttccgacgatgagccggggtatgacctggatttgttctgcatccctaatcattacgcggaagatctcgagcgcgtctttataccgcatggtctgattatggacagaactgagagacttgcccgggacgtgatgaaagaaatgggaggccatcatatagtggcactttgtgtgttgaagggaggttacaagtttttcgctgatctgctggactacattaaggcgcttaaccgcaactccgatagatcaatacccatgactgtcgactttattcgtctgaagtcctactgcaacgatcaaagcaccggagacattaaagtcatcggcggagatgacctgtcaacgctgacggggaaaaatgtgcttatagtcgaggacataatagacaccggaaagaccatgcaaacgctcctgtcgctcgtgcggcagtacaaccctaaaatggtgaaggtcgcctcgctgctcgtgaagagaacccctagatcagttgggtataagccggatttcgtgggattcgaaattccagacaaatttgtggtgggttacgcactggattacaacgaatactttcgtgatcttaatcacgtctgcgttatctccgaaaccggtaaggcaaagtacaaggca

SEQ ID NO: 13785 - DNA, 654 bp, Artificial Sequence
  Description of Artificial Sequence: Synthetic coding sequence
atggcaaccagaagcccgggcgtggtgatctcggacgacgaaccaggttacgacctcgacctgttctgcatcccaaatcattacgctgaagatctggagcgcgtgttcatcccccacggactcattatggatcgcactgagcgcctggcccgggacgtgatgaaggagatgggagggcaccacattgtggcactctgtgtgctgaaagggggctacaagttctttgcggatcttctggattacatcaaggctttgaaccggaactcagatcgcagcatcccgatgactgtggacttcatccgccttaagagctactgcaacgaccagtcgacgggcgacattaaggtgatcggtggagacgacctgtcgacgctgaccggcaaaaatgtcctgatcgtcgaggacattatcgacaccggcaagaccatgcaaacgctgctgagcctggtgcggcaatacaacccgaagatggttaaggtggcctcccttctggtcaagagaacccctaggtcagtgggatacaagccggattttgtgggcttcgaaatcccggataagttcgttgtgggatacgccctggactacaatgagtacttccgggatctgaatcatgtgtgcgtcatctccgagactggaaaggctaaatacaaagcg

SEQ ID NO: 13786 - DNA, 654 bp, Artificial Sequence
  Description of Artificial Sequence: Synthetic coding sequence
atggccactcgttcgcctggcgtcgtgatcagcgatgacgaaccaggatacgatctggatttgttctgtattcctaaccactacgctgaggatctcgaacgagtatttatcccacacggtctgattatggacaggaccgagcgactggctagagatgtcatgaaggagatggggggccatcacatcgtcgccctttgcgtcctgaaaggaggctacaaattcttcgcagacctgttggattatattaaggctcttaaccggaattctgatcgttctatacccatgacagtcgacttcatcagactgaagagttactgtaatgaccagagcacaggggacattaaagtgataggaggggatgatctgtcaaccctcaccggaaagaacgtgctgatcgtggaggatatcatcgataccggcaaaaccatgcagaccctgctctccttagtgcgtcagtataacccgaaaatggtcaaggtggcttcactgcttgtcaaaaggacaccacgctccgtggggtacaagcctgactttgtaggctttgaaataccggataaattcgtcgtcggttatgctctagactacaacgagtactttcgtgatttgaaccatgtgtgcgtgatctcggagaccgggaaagcaaagtataaagcc

SEQ ID NO: 13787 - DNA, 654 bp, Artificial Sequence
  Description of Artificial Sequence: Synthetic coding sequence
atggctacaaggtcccctggcgtggttattagcgacgatgaaccaggatacgatcttgacttgttttgcatccccaatcattatgccgaggacctggagcgtgtattcattccacacggactgataatggacagaaccgagcggctggcacgcgacgtcatgaaagagatgggcggtcatcacattgtcgccctatgcgtgctcaaaggcgggtacaagttctttgcagacctactggactacatcaaagctttgaaccgtaactcagaccggtccatcccgatgaccgtcgacttcatccggctcaaatcttactgcaatgaccagtcaactggggacattaaagttatcgggggtgatgacctttccacactgacaggaaagaacgtattaattgtggaggacataatcgacacaggcaagaccatgcagactcttctctctctcgttcggcagtataatcccaagatggtcaaggtggcatctttgctggtcaagagaacaccccgatctgtcgggtacaagccagatttcgtgggttttgagatccccgataagtttgtggtgggatatgccctcgactacaacgaatacttcagggatctaaaccatgtctgtgtgatttccgagaccggaaaggctaaatataaagcc

SEQ ID NO: 13788 - DNA, 654 bp, Artificial Sequence
  Description of Artificial Sequence: Synthetic coding sequence
atggcaaccagatcgccgggagttgtgattagcgatgacgaaccgggttatgatttggatctgttctgcataccgaatcactacgccgaggatctcgaaagggtattcatcccacacggccttatcatggaccggactgaacggttggcgcgggacgtcatgaaggaaatgggaggacatcacatcgttgcactctgcgttttgaagggtggctacaagtttttcgctgatctgctggattacatcaaagcactgaaccggaactcagatcgctccatcccgatgaccgtggacttcatccgactcaaaagttactgcaatgatcagtcgaccggggacatcaaagtgattggcggagacgacctttcaaccctgaccggcaagaacgtcttgatcgtggaggacattatcgacactggtaagaccatgcagactctgctgagcctggtgcgtcaatacaacccaaaaatggtaaaggtggcctccctgctcgtgaagaggactccaaggtcagtcgggtacaaacccgacttcgtcggatttgagatacctgacaagtttgtggtgggctatgcgctcgattacaatgagtacttccgcgacctgaaccatgtgtgtgtgatctccgaaacgggcaaggcgaagtacaaggcc

SEQ ID NO: 13789 - DNA, 654 bp, Artificial Sequence
  Description of Artificial Sequence: Synthetic coding sequence
atggctactagaagcccaggagtggtgatctcggatgacgaaccgggatacgaccttgacctcttttgcattcctaaccattacgcggaggacctggagcgagttttcatcccgcatgggctcatcatggaccgtaccgaacggctggcacgggatgtgatgaaggagatgggaggtcatcacatcgttgcgctttgcgtgttgaagggcggctacaagtttttcgcggacctgctggattacattaaggcactgaaccgcaactcagatagatccatcccaatgaccgtggatttcatcagactgaagagctactgtaatgaccaaagcaccggagatatcaaggttatcggcggggacgacttgtcgaccctcaccggtaagaacgtgctgatcgtggaggatatcatagatactggtaagacgatgcagactctgctctcactcgtccgccagtataatcccaaaatggtcaaagtcgcctccctgctggtgaagagaaccccgcggagcgtgggttacaaacccgacttcgtcggattcgagatcccggacaagtttgtggtgggatatgcgctcgattacaacgaatacttccgggacctgaaccacgtgtgcgttatttcagaaactggaaaagccaagtacaaagcc

SEQ ID NO: 13790 - DNA, 654 bp, Artificial Sequence
  Description of Artificial Sequence: Synthetic coding sequence
atggcaacaagaagtccaggagttgtcatttccgatgatgaaccagggtatgatctggacttattttgtatcccaaatcattacgcggaggacctcgagcgggtgttcatccctcacgggctcattatggatagaaccgagcggcttgccagagatgtcatgaaagagatggggggccatcacatagtcgccttatgcgtgctcaaaggcggttacaaattcttcgcggacctcctggattatatcaaggctttgaatcgtaattcagatcgatctatccccatgacggtcgatttcatacgtttgaagtcatattgcaatgaccaatcgacgggcgacattaaagtcatcggcggtgatgacctttctacactgaccggcaaaaatgtgcttatagtggaagacatcatcgatacaggaaaaaccatgcagacccttctcagcttggtgagacagtacaaccctaagatggtgaaggttgcctccctcctggtaaaacgcaccccgcgcagtgtgggatacaagcccgactttgtgggcttcgagatcccggataagttcgttgttggctatgcgctagattacaacgagtattttagagaccttaaccatgtatgcgttataagtgaaaccggcaaagccaagtataaagca

SEQ ID NO: 13791 - DNA, 654 bp, Artificial Sequence
  Description of Artificial Sequence: Synthetic coding sequence
atggctacaagatctccaggcgttgtcatcagtgacgatgaaccgggatacgatttggatctcttctgcatccctaaccactacgctgaggacttggaaagagtttttattccccatggcctgattatggatagaacagagcgcctggctagagatgtcatgaaggaaatgggcggccaccatatagtagctctttgcgttctgaagggaggttacaagttcttcgctgaccttcttgactatattaaagctttgaacagaaactcagataggagtatccccatgactgtggatttcatcagattgaaatcatattgtaatgaccagtcaaccggcgatataaaagtgattggtggtgacgacctctcaacgctgacaggtaagaatgtcctgattgttgaggacatcattgacactggtaagactatgcaaactctgctttctctggttagacaatacaaccccaaaatggtcaaggtcgcttccttgctggtgaagaggacacccaggagtgtgggttacaagcccgacttcgtcggtttcgaaatccctgataagttcgtggtcggatacgcgctggactacaatgagtactttagggacctcaatcacgtctgtgttatatccgaaactggaaaagccaaatacaaggct

SEQ ID NO: 13792 - DNA, 654 bp, Artificial Sequence
  Description of Artificial Sequence: Synthetic coding sequence
atggctactcggtcgccaggggtggtaatttctgatgacgagcccggctacgacctagatctgttctgcatccccaaccactatgcggaagatctggagagagtattcatcccccatggactgatcatggataggaccgagcgattggcccgtgatgtaatgaaggaaatgggaggccatcatatagttgccctttgcgtgctgaaaggagggtacaaattcttcgcggacctgctggattatattaaagccctaaaccggaactctgatagatcaatcccaatgaccgtagatttcatccgtttgaagtcctattgcaatgaccagtcaacgggggacattaaggttatcggaggggatgacctaagcactctcacaggcaagaacgttttaattgtggaggacataattgacaccggaaaaactatgcagacacttttgtccctcgtgcggcagtacaaccctaagatggtaaaggtggcctccctacttgtaaagcggactccaagaagcgtggggtacaagccggactttgtgggtttcgaaattccggataagttcgttgtcggttatgccctggactacaacgagtatttccgggacctgaatcacgtgtgcgttataagcgaaacaggaaaggcgaaatataaggct

SEQ ID NO: 13793 - DNA, 654 bp, Artificial Sequence
  Description of Artificial Sequence: Synthetic coding sequence
atggcaactcgctccccgggtgtggtcatatcggatgacgagcctgggtacgatcttgacctgttctgcattcctaaccactacgcggaagatctggagagagtgtttattccacatggattgattatggatcgtactgagcgcctggcgcgtgatgtgatgaaagaaatgggcgggcaccacattgtcgcactttgcgtgctcaagggaggttacaagtttttcgcagacctgctcgattacatcaaagcgctgaaccggaattccgataggtccatccccatgaccgtcgactttatccgcctcaaatcgtattgcaatgaccagagcactggtgacattaaggtcatagggggcgatgatctttccacccttaccggcaagaacgtgctgattgtcgaggacattatcgacacggggaaaacgatgcaaactctgcttagcctcgtgaggcagtacaaccctaagatggtgaaggtggcatcgctcctggtgaagcggaccccccgatccgtgggatacaagcccgattttgtcggatttgaaattccggacaagtttgtcgtcggatacgccctggactacaacgagtactttagagatctgaatcacgtgtgcgtgattagcgaaactggtaaagcaaaatacaaggca

SEQ ID NO: 13794 - DNA, 654 bp, Artificial Sequence
  Description of Artificial Sequence: Synthetic coding sequence
atggccactcgttcaccgggggtggttatctcggacgacgaacccggatacgatttggacctcttctgcataccaaatcactacgctgaggaccttgaaagagtgttcatccctcatggactgattatggaccgtaccgagagactggcacgagatgtcatgaaggagatgggaggtcaccatatcgtggcactctgtgtgctgaaagggggttacaagttttttgcggaccttttggattacattaaggcacttaatcgcaactcggatagatccatcccaatgacggttgatttcattcggctgaagagctactgtaacgaccagtcaaccggagatatcaaagtgattggaggagatgatctgtccacgctgaccggaaagaatgtcctgatagtcgaggacattattgacacgggcaaaactatgcaaacccttctctccttggttcgacaatacaaccctaagatggtgaaggttgcatcactgctggttaagaggaccccccgatccgtcggctataagccagattttgtgggattcgaaattcctgataagttcgtcgtgggatacgccttggattacaatgagtactttagagatcttaaccatgtgtgtgtgatttcagaaaccggcaaggcgaaatacaaagcc

SEQ ID NO: 13795 - DNA, 654 bp, Artificial Sequence
  Description of Artificial Sequence: Synthetic coding sequence
atggctaccagatcgcccggagtggtgatttccgacgatgagccaggatacgatctcgatcttttttgtatccctaaccattacgccgaagatcttgaaagagtctttataccccacggcctgattatggatagaactgagcgtctcgctcgcgacgtgatgaaggaaatgggaggacaccatattgtcgcgctgtgtgtgcttaagggtggttacaaattcttcgcagatctgcttgactacatcaaagcactgaataggaactccgatcggtcgattcccatgactgtcgatttcattcgtcttaaaagctactgcaacgatcagtcaacgggggacattaaggtgattggtggagatgacctcagcaccctcaccgggaaaaatgtgttgattgtggaagatatcattgatactggaaagactatgcaaacccttctttccttggtccggcagtacaaccctaagatggtgaaagtggcatcactcctcgtgaagagaactccccgttcggtggggtacaaacccgattttgtgggcttcgagattccagacaagttcgttgttggctatgcacttgattacaatgagtactttcgcgacttgaaccacgtctgcgtaatatcggagactggaaaggcaaagtacaaggcc

SEQ ID NO: 13796 - DNA, 654 bp, Artificial Sequence
  Description of Artificial Sequence: Synthetic coding sequence
atggcgacccgtagccctggggtggtgatctccgatgatgagcctgggtacgaccttgatctgttttgcattccaaatcactacgcagaggacctggaacgcgtgttcattcctcatggactgattatggacagaaccgagcggcttgcgagagacgttatgaaagaaatgggaggacaccacattgtggccctgtgcgtgctgaaagggggatacaagtttttcgcggatctgcttgattacataaaagcacttaatcgcaactcggatagatcgattccgatgaccgtcgacttcattagattgaagtcgtactgtaatgatcaatcgaccggcgacattaaggtcattgggggagatgacctttcaactctgaccggtaagaacgtgctcattgtggaagatatcattgatactggtaagactatgcagaccctgttgtcgctggtgagacagtacaacccaaagatggtgaaggtggcgtcacttctggtcaaacgcactccgcggtccgttggatacaagccagattttgtgggatttgagattccagacaagtttgtggtcggctatgcactggattacaacgaatactttcgggaccttaatcatgtctgtgtaatcagcgaaactgggaaggcaaagtacaaggcc

SEQ ID NO: 13797 - DNA, 654 bp, Artificial Sequence
  Description of Artificial Sequence: Synthetic coding sequence
atggctaccagatccccaggagtggtgatcagcgacgacgaaccaggatacgacctggaccttttctgtatcccgaaccactacgccgaggacttggagcgggtgttcatcccgcacggactcatcatggatcggaccgagcggctggctagggacgtcatgaaagagatgggtgggcatcacatcgtggcactctgcgtgctcaaggggggctacaagttctttgccgacctcctggactacatcaaggccctgaaccgcaactcggatcgctccattccaatgaccgtggactttattcgcctcaagagctactgtaacgaccagtccaccggagatatcaaggtgatcggaggcgacgatctctcaaccctgaccggaaaaaacgtgctcattgtggaggacatcattgatactggaaagactatgcaaactctgctttcgttggtgcgccagtacaacccgaagatggtgaaagtggcctcactgctggtgaaacgcactccgcgcagcgtcggttacaaaccagatttcgtgggcttcgagatcccggacaaattcgtcgtcggatatgctctcgactacaatgagtacttcagggatctgaaccacgtgtgcgtcatctcggaaacgggcaaggcaaagtacaaggcc

SEQ ID NO: 13798 - DNA, 654 bp, Artificial Sequence
  Description of Artificial Sequence: Synthetic coding sequence
atggccaccaggagccccggggtggtaatatccgatgatgaacctggatatgatcttgatctgttctgcatcccaaatcactacgcggaggacctggagcgcgtgttcatcccccatggacttatcatggatcgaacggaaagactggcacgcgatgtgatgaaagagatgggaggtcaccatatagtcgcactgtgtgtgttgaaaggaggttacaagttctttgcggatctcttggactacattaaagcgttgaataggaactcggaccggtcaatcccgatgaccgttgacttcatccgcctcaaatcttactgcaacgaccagagtaccggcgacatcaaggtcatcggcggcgatgatctttcgactctgactggaaaaaacgtcttgattgttgaggacatcatcgacaccggcaagaccatgcaaaccctcctgtccctggtgcggcagtacaacccgaagatggtgaaggtggcctccctgctcgtgaagcggactccgagatccgtggggtacaagccagactttgtgggattcgaaatccctgacaagttcgtcgtcggatacgctctggactataacgaatactttcgggacctgaatcacgtatgcgtcatttcggaaacgggaaaggcaaagtacaaagcc

SEQ ID NO: 13799 - DNA, 654 bp, Artificial Sequence
  Description of Artificial Sequence: Synthetic coding sequence
atggctaccaggtcccctggagttgtgatttctgatgatgagccgggctacgatctggatctcttctgtatcccaaaccactatgccgaagatcttgaacgagtcttcataccacacggcctgatcatggatagaacagaacggctggccagggatgttatgaaagagatgggcggacaccacatcgtggcactgtgcgtcctcaagggaggatacaaattcttcgcagaccttctcgactacattaaggccctgaaccgcaacagcgaccgatcaattccaatgacagtggatttcatacgcttgaaatcatactgcaacgaccaaagcaccggagatatcaaggttattggaggagacgatctgtctaccctgacgggcaagaatgttctgatagttgaagacattatcgatacaggcaaaactatgcagacactactgtcccttgtcaggcaatacaaccccaagatggtcaaggtcgcctcactgctggtgaagcggacacctaggtctgtgggttataagcctgacttcgtgggattcgagatccctgataaattcgttgtgggatatgccctggattacaacgaatacttccgggacctcaaccacgtgtgtgtgattagcgagacaggtaaggccaagtataaggca

SEQ ID NO: 13800 - DNA, 654 bp, Artificial Sequence
  Description of Artificial Sequence: Synthetic coding sequence
atggcgactaggtcgccaggtgtggtgatttccgacgatgaaccgggctacgatctggacctgttctgtatcccaaaccactatgccgaggatctggaacgggtctttataccacacgggctgattatggatcgaactgagcgcctcgccagagacgtgatgaaggagatgggcggacatcacatcgtggctttgtgcgtgcttaaagggggctataagttcttcgcagacctgctggactacatcaaggcgctgaatcggaacagcgaccgctccattcctatgaccgtagactttattcgcctgaagtcctactgcaacgaccaatcaactggcgacattaaggtgattggaggagatgatctctcaaccctgactggtaaaaacgtcctgatcgtcgaggacatcatcgacaccggcaagaccatgcagaccctgctttcactcgtgaggcaatacaatccgaagatggtgaaggtcgcaagcctgctggtgaaacggaccccgagatccgtgggatacaagccggacttcgtcggttttgaaatcccagacaagttcgtggtcggttacgcccttgactacaatgaatactttcgcgatttgaaccatgtgtgcgttatctctgagactgggaaagccaagtataaggct

SEQ ID NO: 13801 - DNA, 654 bp, Artificial Sequence
  Description of Artificial Sequence: Synthetic coding sequence
atggccacccgcagccccggcgtcgtgatttcggacgatgaacccggctacgacctggatctcttctgtattcctaaccattatgctgaggatctcgaacgggtgttcataccacacgggctgattatggatcgcactgaaagactggcgagagacgtgatgaaggagatgggtggtcatcacatcgtggcactgtgtgtgctgaaaggaggttataagtttttcgcagatcttcttgactacattaaggcacttaaccgaaactcggacagatcaatcccaatgaccgttgatttcatccggctgaagtcctactgtaatgatcagtccaccggagacattaaggtcattggaggggacgacttgtcaactctgacgggcaagaacgtgcttattgtggaggatatcatagacactgggaaaactatgcagaccttgctcagcctcgtccgccaatacaatcctaaaatggtcaaggtggcgagcctcctggtgaagcgaacgccgcggtcagtcggctacaagccagacttcgtgggttttgaaattcccgataagtttgttgtgggttacgcccttgattacaatgagtacttcagagatcttaaccacgtctgtgtcatttccgagacgggaaaagcaaagtacaaggca

SEQ ID NO: 13802 - DNA, 654 bp, Artificial Sequence
  Description of Artificial Sequence: Synthetic coding sequence
atggccacaagaagtcctggagttgtcatcagcgatgacgaaccaggttatgacctagatcttttttgcatacccaatcactacgcagaggaccttgagcgcgtattcataccacacggattaattatggatagaaccgagagactggctagggacgttatgaaggagatgggtgggcatcacattgtcgccctgtgcgtgctgaagggtggctataaattttttgccgatctcctcgattacattaaggcgcttaacagaaactcggatagatctatacctatgactgtggactttatccgccttaagagctactgtaacgatcagtctacaggtgatattaaggtcatcggcggcgacgatctgtcaaccctcacaggaaagaatgtgctgatcgtggaggacattatagacaccggcaagactatgcagaccctccttagcctcgttcggcagtacaaccccaaaatggtgaaggtggcttctctccttgttaaaaggacccccagatccgtgggctataaacctgacttcgtgggctttgaaatacctgacaagtttgttgtggggtacgcattagattataacgaatacttccgcgaccttaaccacgtctgcgtcatttcggaaacaggaaaggccaagtataaagcg

SEQ ID NO: 13803 - DNA, 654 bp, Artificial Sequence
  Description of Artificial Sequence: Synthetic coding sequence
atggccactaggtctccgggggttgtgatctctgatgacgaacccgggtacgatctcgatttgttttgcattcctaatcattatgcggaagacctggaacgagtcttcatcccacacggactgattatggacaggacagaaaggttggctagagacgtcatgaaggaaatgggagggcatcatatcgtggcactttgcgtcctgaagggcgggtataagttttttgctgacctgctcgactacatcaaggccctgaatcgcaatagcgaccggtcaatacctatgaccgtggactttatcagactgaagtcttattgcaatgaccagagcaccggcgatatcaaagtgatcggtggcgatgatctgtccactctgactgggaagaacgtgctcatcgttgaagacatcattgatactgggaaaaccatgcagacgctgctgtctctggtgcgacaatataatccaaagatggttaaggtggcttctctgctggtgaagcgaactccaagaagcgtgggttacaagccggattttgtcgggttcgaaatacctgacaaattcgttgtaggctacgccctggattataatgagtacttccgagaccttaaccacgtctgcgttatttcagaaacaggcaaagcgaaatacaaggct

SEQ ID NO: 13804 - DNA, 654 bp, Artificial Sequence
  Description of Artificial Sequence: Synthetic coding sequence
atggctacgcggagcccgggcgtggtgatctcggacgatgaacctggctacgacctggatctgttctgtatcccaaaccattacgcggaagatcttgagcgtgtctttatcccgcacggccttatcatggacagaacggagcgactggccagagatgtgatgaaggaaatggggggccaccacattgtggccctgtgcgttctcaagggtggatacaaattcttcgccgatctgctcgactatatcaaagcattgaacaggaactcggacaggtccatccctatgactgtggacttcattcggctgaagtcgtactgcaatgaccagtcgaccggggacatcaaggtcattggtggagatgatctctcaactttgactgggaagaatgtgctgatagtagaggatatcatcgacaccggcaagactatgcagaccctcctgagccttgtccggcaatacaacccgaaaatggttaaggtggcttcattgctggtcaagagaactccgcggtccgttggatacaaaccagactttgtcgggttcgagatacccgataagttcgtggtgggttacgccctcgactataacgagtacttccgcgatcttaatcatgtgtgcgtgatctctgaaaccggaaaggcgaaatacaaggcc

SEQ ID NO: 13805 - DNA, 654 bp, Artificial Sequence; identical to SEQ ID NO: 13799
  Description of Artificial Sequence: Synthetic coding sequence

SEQ ID NO: 13806 - DNA, 654 bp, Artificial Sequence
  Description of Artificial Sequence: Synthetic coding sequence
atggccacccgatcgcccggagtggttatttcggacgatgaaccaggttacgatctcgaccttttttgcattccgaatcattacgcagaagatcttgaaagagtgttcattccacatgggttgataatggatagaactgaacgccttgcaagagatgtcatgaaggagatggggggccatcatattgtggcactgtgtgtcctcaagggtggatacaagttctttgcagatcttctggattacataaaggcgctgaaccgaaattctgaccggagcatccctatgaccgtcgatttcataagactcaagtcgtactgtaacgatcaatcgactggagatatcaaggtaattggcggcgatgatctttcgactctcactggtaagaacgtgctgattgtggaggacattatcgatactggaaagactatgcagactcttctttcgcttgtgaggcagtacaaccctaaaatggtgaaggttgcatcactgttggtgaagagaactcctcggtccgtcggatacaaacccgactttgtgggatttgaaatccctgataagttcgtcgtgggctatgcgctggattacaatgaatactttcgcgaccttaatcatgtctgcgtgatctccgagactggcaaggccaagtacaaggcc

SEQ ID NO: 13807 - DNA, 654 bp, Artificial Sequence
  Description of Artificial Sequence: Synthetic coding sequence
atggccactcgcagccctggagtcgttatcagcgacgatgaaccgggatacgatctcgatctgttttgcattccgaatcattacgcggaggacctggagcgcgtctttatcccgcacggactcatcatggatcgcaccgaacgcctggcaagggatgtgatgaaggaaatgggtggacatcacattgtggctctgtgcgtcctcaagggcgggtacaaattcttcgccgacctcctggactacatcaaagccctgaaccgcaactcggaccggtcgataccgatgacggtggacttcatcagactgaagtcatactgcaacgaccaatcgactggcgacattaaggtgatcggaggcgacgacctgtcaacccttactggaaagaatgtcctgattgtcgaggacatcatcgataccgggaaaaccatgcagaccctgctgtcacttgtgaggcaatacaacccgaagatggtgaaggtcgcttcactgcttgtcaaacggacgccgcgctccgttggatacaagccagatttcgtgggtttcgaaatcccggacaaattcgtggtggggtacgcactggattacaacgagtacttccgcgacctgaatcatgtgtgtgtgatctcggagactggcaaagccaagtacaaggct

SEQ ID NO: 13808 - DNA, 654 bp, Artificial Sequence
  Description of Artificial Sequence: Synthetic coding sequence
atggctacaaggtcccctggagtggtgatatccgatgatgaacccggatacgacttagatctcttctgcatcccaaaccattacgcagaggatctagaacgggttttcattccacacgggcttataatggacaggacagaaaggcttgcacgggacgtaatgaaagaaatgggagggcatcacatcgtggccctgtgcgttctcaaaggagggtacaaattctttgctgacctcttagattatatcaaggctctgaataggaactctgataggagtatccccatgacagttgattttatcaggctcaaaagttattgcaatgaccagagtactggggatatcaaggtgatagggggagatgatttgtctactctgacaggaaagaacgtgctgatcgtggaagatatcattgatactgggaaaactatgcagacactactgtcgctcgtgcggcaatataacccaaagatggtgaaagtggcaagtctgctggtcaaacggacgccccggtctgtggggtacaaacctgattttgttggattcgagattccagataaattcgtggtggggtacgccttagactataatgaatatttccgagatctaaatcatgtttgcgtgattagtgaaacaggaaaagctaaatataaagct

SEQ ID NO: 13809 - DNA, 654 bp, Artificial Sequence
  Description of Artificial Sequence: Synthetic coding sequence
atggcaaccaggagtccaggagttgttattagcgacgatgagcctggctacgatcttgatctgttttgcatcccaaaccactatgccgaggatttggagagagtgttcatccctcatggtctgatcatggaccgcaccgaaaggctcgccagagatgtcatgaaagaaatgggaggccaccacattgtagctctttgcgtcctcaagggtggatacaaattttttgccgacctgctggactatatcaaagcactcaataggaattccgatcgctctattccaatgaccgttgacttcattagactgaagtcttactgcaacgaccagtctactggcgacattaaagttattggcggcgatgatctgtctactctgactggcaaaaacgttctcatcgtcgaagatattattgataccggtaaaactatgcaaacattgctgtcccttgtgcgtcaatacaaccccaagatggttaaggtagcctctttgcttgtgaagaggacacctcgtagtgtcggctacaagcccgacttcgtcggatttgagattccagataagttcgtagtcggatacgccctggattacaacgagtactttagagacttgaaccacgtatgcgtcattagcgagaccggaaaagccaaatataaggcc

SEQ ID NO: 13810 - DNA, 654 bp, Artificial Sequence
  Description of Artificial Sequence: Synthetic coding sequence
atggccacccggagtcccggagtggtcatctccgatgatgaaccgggatacgatctggacctcttttgcatacctaaccattacgccgaggacttggaaagagttttcatcccgcacggacttatcatggatagaaccgagaggcttgctcgggatgtgatgaaggaaatgggaggccaccatattgttgcactgtgtgtgttgaaagggggatacaaattttttgccgacttgctcgattacataaaggccctgaataggaattctgaccggtccattcctatgactgtggacttcattagactgaagagctactgcaacgaccagagcacaggggatatcaaggtcatcggcggggatgatctgtctactcttaccggcaagaacgtgctgatcgtcgaggatatcatcgataccggaaaaaccatgcagaccctgttgagtctcgtcagacaatacaatcctaagatggttaaagtggcgagtttgttggtgaagcgcaccccaaggagcgtgggttataaaccagatttcgttggctttgagattcctgacaaattcgtagtcggctacgccctcgactacaacgaatattttcgcgacctgaaccacgtctgtgtcatctctgagaccgggaaggccaagtacaaggcc

SEQ ID NO: 13811 - DNA, 654 bp, Artificial Sequence
  Description of Artificial Sequence: Synthetic coding sequence
atggccacccgttcccctggagtggttatatctgacgacgagcctgggtacgatttggacctcttttgcatccctaatcattatgctgaggatcttgaaagggttttcattcctcatggcttgattatggacagaacggagaggctagcgcgagatgttatgaaggagatgggagggcatcatattgtagccttgtgtgttctcaagggtgggtataagtttttcgctgatcttttagactatataaaagctttaaacaggaacagcgatcggtctattccaatgacggttgattttatccggttaaagtcctattgtaatgatcagtcaaccggggatattaaagtcatcggtggtgacgatcttagtaccttgaccggcaagaatgttcttatcgtggaggatattattgatacaggtaagacaatgcagacacttctgtctctcgtaagacaatataatccaaagatggttaaggtagccagtttattggttaaaaggactcctcgttctgttggatataaacccgactttgttgggtttgagattccagataagttcgtcgtgggatatgcccttgactacaacgaatatttcagggatctgaatcacgtttgtgtgattagtgaaactggtaaggcaaaatataaagca

SEQ ID NO: 13812 - DNA, 654 bp, Artificial Sequence
  Description of Artificial Sequence: Synthetic coding sequence
atggcgaccagatcgcctggtgtcgttatctcggacgatgagcctggatacgatctcgatcttttctgcatcccaaaccactatgccgaggacctcgagagggttttcattccgcatgggctgatcatggaccgcacggaacggctggctagggatgtaatgaaagagatgggcggacaccacatcgtggccctctgcgtcctcaaaggcgggtataagttctttgctgaccttcttgactacatcaaagcacttaacagaaacagcgaccggtccattccgatgactgtggatttcatacgactgaagagctactgtaacgaccagtcaaccggcgacatcaaggtcatcggcggcgatgacctgtccaccctcaccgggaagaatgtacttatcgtggaagatatcatcgatactggtaaaacgatgcagaccttgctgtccctggttcggcaatacaatccaaagatggtgaaagtggcctcacttctggtgaaaagaactccacgctcggtcggatacaagccggacttcgtcggatttgaaatccccgacaagtttgtggtgggatacgcattggactacaatgaatacttccgagatctgaaccacgtgtgcgtgatcagcgaaactggaaaggcgaagtacaaagcc

SEQ ID NO: 13813 - DNA, 654 bp, Artificial Sequence
  Description of Artificial Sequence: Synthetic coding sequence
atggccacccgctctcccggggtggtcattagcgacgacgagccagggtatgatctggatctcttctgcatcccgaaccattacgcggaggatctggaacgcgtttttatcccacacggcttgataatggatagaacagaacgcttggccagggacgtgatgaaggagatgggcggccatcatatcgtcgcgctgtgcgtcctcaagggagggtacaagttctttgcggaccttctggactatatcaaggcacttaaccgcaacagcgaccggagcattcctatgaccgttgactttatccgactgaagtcttactgtaatgaccagagcacgggggacattaaggtgatcgggggagacgatctttccactttgactggcaaaaatgtgctgatcgtggaagatatcattgacaccgggaagactatgcagaccctcctcagcctggtccgccagtataacccaaagatggttaaagtggcctcccttttggtgaagaggaccccccggagtgttggctacaaaccagactttgtagggttcgagattcctgataaattcgtcgtcggctatgctctggactacaacgagtattttagggatttgaatcatgtctgtgtaatctccgaaactggcaaagcgaagtataaggcc

SEQ ID NO: 13814 - DNA, 654 bp, Artificial Sequence
  Description of Artificial Sequence: Synthetic coding sequence
atggctactaggtcacctggagtggtgatcagcgacgatgagccgggatatgacctggatctgttttgcatcccaaatcattacgctgaggacttggaacgtgtctttatcccgcatggtctgatcatggaccggaccgagcggctcgcacgagacgtgatgaaggagatgggcggccaccacatcgtggcgctgtgcgtgctcaagggtggctacaagttcttcgctgatctgctggattacattaaagccctgaatagaaactcggaccgctcaataccgatgaccgtggacttcatccgcctgaagtcgtactgtaacgatcagtcgactggggacataaaagtcatcggaggcgatgatctcagcaccctcacgggaaagaacgtgcttattgtggaggacatcatcgacactggaaaaactatgcaaaccctgttgtcactggtgaggcagtacaatccgaagatggtcaaggtggcctccctgctcgtcaaaagaactccgcgcagcgtgggatacaaaccagatttcgtcggctttgaaatcccggacaaatttgtggtgggatacgcgctggactacaacgagtacttcagagacttgaaccacgtgtgtgtgatctccgagactggcaaggcaaagtataaagct

SEQ ID NO: 13815 - DNA, 654 bp, Artificial Sequence
  Description of Artificial Sequence: Synthetic coding sequence
atggcaacccgctcaccaggagtcgtgatttctgacgatgaacccgggtacgacttggaccttttttgtattcccaaccattacgccgaggacctggagcgggttttcatcccccacggtcttatcatggatagaacagaaaggctggccagggacgtgatgaaggaaatgggaggacaccacattgtggcgctctgtgtactcaagggcggctataaattcttcgccgatctgttagattatatcaaggccctgaaccggaactccgaccgatccattcctatgactgtcgattttatcagattaaaatcttactgcaatgaccagagtactggcgacataaaggtgattggaggagatgacctgtccactttaaccggcaaaaacgttctgattgttgaggacatcatcgataccgggaagactatgcagaccttgctgagccttgtcagacagtataatcccaagatggtaaaggtcgcttcccttctggtgaaacgcacgcccaggtctgtgggatacaagcctgatttcgtggggtttgagataccggacaaatttgtggtcggatatgcgctcgattacaacgagtattttagggacctgaaccatgtctgtgttatttccgagaccggcaaagcgaagtataaagcc

SEQ ID NO: 13816 - DNA, 654 bp, Artificial Sequence
  Description of Artificial Sequence: Synthetic coding sequence
atggcgaccaggagtccgggggtggtgatttccgatgatgagcctgggtacgaccttgacttgttctgtattccaaatcattatgcagaggacctcgagcgggtgtttatcccgcatggtctgataatggaccgcaccgagaggcttgctcgcgatgtcatgaaagaaatgggaggacaccacattgtggccctgtgtgttttaaaaggggggtataagttctttgcagacctattagattacataaaggccctcaacagaaatagcgacagaagcatccccatgactgttgactttatcaggttaaagagctattgtaatgatcaatctaccggcgacattaaagtcatcggcggggatgatctgagtacccttaccggtaaaaatgtgctcatcgtggaagatattattgacacgggaaaaacaatgcagaccttgctctccttagtccgtcagtacaatcccaagatggtaaaagtggcgtcgttgctcgtgaagaggaccccacggtccgtgggttacaaaccagactttgtgggttttgaaataccagacaaatttgtcgttggctacgctctggattacaatgaatattttagagacctgaaccacgtgtgcgtgatttcagaaacagggaaagccaaatacaaggcc

SEQ ID NO: 13817 - DNA, 654 bp, Artificial Sequence
  Description of Artificial Sequence: Synthetic coding sequence
atggctacgcgctctccgggggtggtcatcagcgacgacgaaccaggttacgatctggaccttttttgtatccctaaccattacgccgaggacctggagcgagtttttattcctcacggtctgattatggataggacagaaaggttggcacgtgatgttatgaaagaaatgggcggtcaccatattgtcgctctttgtgttcttaagggcggttataaattcttcgccgacttactggattatattaaagcgctgaataggaacagcgatcgctccattccaatgacagtggacttcatcaggcttaaatcctactgtaatgaccagtccaccggcgatatcaaggtgattggaggcgatgatctcagcaccttgactggcaaaaatgtgctgattgtcgaggatatcatcgataccggcaagacaatgcagacgttactctccttggtgcgccaatacaacccgaagatggtcaaggtggcatccctcttggtgaagcgcactccccgcagcgtcggctacaagccagatttcgtgggctttgaaattccggataaattcgtagtgggttacgcactggattataacgaatacttccgggacctgaaccacgtgtgcgtcatcagcgagaccggcaaggcgaagtataaggcg

SEQ ID NO: 13818 - DNA, 654 bp, Artificial Sequence
  Description of Artificial Sequence: Synthetic coding sequence
atggctacaaggtctcctggggtcgtgatctcagatgacgaacctggttacgacctggacctgttctgtataccgaatcattacgcagaagacctggagagggtgttcattcctcatggattaataatggatcgaacggagagactagcccgagatgtcatgaaggaaatggggggacatcacattgtggccctgtgtgttttgaagggcggttataagttcttcgccgacctcctcgattatatcaaagctcttaacaggaactccgaccggagcattcccatgactgtcgattttatccgtttaaagagctattgcaacgaccagagcaccggtgatatcaaggtgatcgggggtgatgacctgtctaccctgactggcaagaatgtgcttatcgtggaggatataattgacacagggaagactatgcagaccttactcagcctggttcgccagtacaatcccaaaatggtgaaggttgccagtctgctcgtgaaaagaacacctagatctgtcgggtataagccggacttcgtgggatttgagatcccggacaagttcgttgtcggttatgctctcgactataacgagtattttcgtgatctaaatcatgtttgtgttatctccgaaacaggaaaagcgaaatacaaagcc

SEQ ID NO: 13819 - DNA, 654 bp, Artificial Sequence
  Description of Artificial Sequence: Synthetic coding sequence
atggctacaaggtctccaggagtagtaattagtgatgatgaaccaggatatgatttagatttattctgtataccaaatcattatgctgaagatcttgaacgtgtatttattccacatggtttaattatggatagaacggagagacttgcaagagatgttatgaaagaaatgggtggacatcatattgttgctctttgtgtattaaaaggtggatacaaattctttgctgatttgcttgactatattaaagcattaaaccgtaattcagatagatctattccaatgactgttgatttcattagattaaaatcatactgtaatgatcaaagtacaggagatattaaagtaatcggaggagatgatttatctacattaactggaaagaatgttcttattgttgaagatattattgatactggaaaaacaatgcaaacattattgtctcttgtccgacaatataatccaaaaatggttaaagttgcttctttattagtaaaacgtacaccaagatcagttggatataagccagattttgttggatttgaaattccagataaatttgttgttggatatgcattagattataatgaatattttagagacttgaaccatgtttgtgttatttctgaaactggtaaggctaaatataaggca

SEQ ID NO: 13820 - DNA, 654 bp, Artificial Sequence
  Description of Artificial Sequence: Synthetic coding sequence
atggctactaggtcccccggagtcgtgatctccgatgatgaacccggatacgatctcgacctattctgcatccccaatcattatgccgaagacctcgagagagtgttcatccctcatggattaatcatggatcggacagaacggcttgcccgcgacgttatgaaggaaatgggagggcatcatatcgtggctctctgcgttctaaaaggggggtataaattttttgcagatctcctggattacatcaaggcacttaacagaaatagtgaccgaagtatccctatgacagtagatttcattcggttgaaatcttactgcaatgatcagtccactggagatatcaaagtgattgggggggatgatctgagtacactgactgggaaaaatgttctcatagtggaagacattatagatacaggaaaaacaatgcagactctcctatctctggtgcggcagtataatccaaaaatggtcaaagtcgcctcactgctggtcaaaaggactccccgctctgtcggatataaacccgatttcgttggattcgaaatacccgataaatttgtcgtgggatatgccctggattacaacgaatattttcgggatctcaaccacgtctgtgttatctctgagacaggaaaagccaaatataaagca

SEQ ID NO: 13821 - DNA, 654 bp, Artificial Sequence
  Description of Artificial Sequence: Synthetic coding sequence
atggccacgagatcaccgggagtggttatttcggatgacgagccagggtatgaccttgacttattttgcatcccgaatcactacgcggaagatttggaacgggttttcattccccatggtcttatcatggatagaaccgaacgtctggcgagggatgtgatgaaggaaatgggcggacaccatattgtagcactatgcgtactcaaaggtggttataaattcttcgctgatctcttagattatattaaagccttaaatcgtaactcggatagatctattccgatgacagtagattttattcgtctaaaatcctattgcaatgatcagtcaacaggagatatcaaagtaataggtggagacgaccttagtacactgacgggaaagaatgttcttatcgtagaggatatcattgatacaggcaagacaatgcaaacattattgtccttggttcgtcagtacaaccctaagatggtaaaagtcgcttctctgctggtcaaacgcacaccgcggtcggtaggttataaaccagactttgtcggatttgaaattcccgataaatttgtggttggctatgctttagattataatgaatattttcgagatttgaatcatgtctgtgttatttcagaaacagggaaagcaaaatataaagct

SEQ ID NO: 13822 - DNA, 654 bp, Artificial Sequence
  Description of Artificial Sequence: Synthetic coding sequence
atggccacgcgatcccctggagtggtgatctccgatgatgaaccaggttatgatcttgatctgttttgcatcccgaaccactatgcggaagatcttgaaagggtgttcatcccgcacggactgattatggacagaaccgaaagactggcgagagacgtcatgaaggagatgggaggacaccatatagtggcactgtgcgtgctgaaaggaggatacaagttcttcgcagatctgctggattacatcaaggcgctcaacaggaactcggaccggtccattcccatgactgtcgactttattcgcctgaagagttactgtaacgaccaatcaactggcgacattaaggtaatcggcggcgacgacctgtcaactttgaccggaaagaatgtgctgatcgtcgaggacattatcgacaccggcaagactatgcagaccctgctgagcctggtgcgccagtacaatccgaagatggtgaaggtcgcatccttgctggttaagagaaccccccgctcagtggggtacaaacctgacttcgtcggattcgagatcccagacaaattcgtcgtcggttacgccctcgactataacgagtattttcgcgatctcaaccacgtgtgcgtgatctcggagacgggaaaagcaaaatacaaggct

SEQ ID NO: 13823 - DNA, 654 bp, Artificial Sequence
  Description of Artificial Sequence: Synthetic coding sequence
atggccacgcgctcccccggtgtggtgatcagcgacgatgagcccggctatgatctggatctgttctgcattcccaaccactacgcggaggatttggagcgcgtgtttataccccatggtttaattatggaccggacggagcgtctggcccgagatgtaatgaaggagatgggaggccaccatatcgtggctttgtgtgttctaaagggaggctataagtttttcgccgatctcctcgattatatcaaagccctgaatcgcaacagtgatcgctcaattcccatgactgtggatttcattcgtctgaagtcatactgcaacgaccagagcacgggagacatcaaagttatcggaggcgatgatctatcgaccctgactggaaagaatgtcctaatagtggaagacattattgataccggcaagactatgcagacattgttgagtctggtccgccaatataaccccaagatggttaaggttgcctcgctgttggtgaagaggacgccgagaagcgttggatacaagccagacttcgtcggttttgagatacctgacaagtttgtcgtcggatacgcattggactataatgagtacttccgcgatctgaaccacgtatgcgttatttcagaaactggcaaggcaaagtacaaggcg

SEQ ID NO: 13824 - DNA, 654 bp, Artificial Sequence
  Description of Artificial Sequence: Synthetic coding sequence
atggctacgcgatctccgggtgtcgtcatttcggacgacgagccaggctacgacctagacttattctgcattccgaaccactatgctgaggatctggagcgcgttttcatcccgcacggactcattatggaccgtacagagcgcttagctagagacgtaatgaaggagatgggggggcatcacatcgtcgcactctgtgtgctgaagggaggctataaattcttcgccgacttgctcgattacattaaggcgctgaacaggaacagcgatcgctccatcccaatgactgtggatttcatccgccttaagtcctactgcaatgatcaatccacgggagacattaaagtcatcggaggcgacgacctctccaccctcacgggaaagaacgtgctaatcgtcgaggacataattgacaccggtaagacgatgcaaacgctgctaagccttgttcgtcagtataaccccaagatggtcaaggtggcgagtcttcttgtgaagcgtactccccgcagcgtgggatataagcccgatttcgttggtttcgagattcctgataagttcgtggtcggatacgcactcgattataacgaatatttccgtgatctgaatcacgtgtgcgtcatctctgagaccggcaaggccaagtacaaggcg

SEQ ID NO: 13825 - DNA, 654 bp, Artificial Sequence
  Description of Artificial Sequence: Synthetic coding sequence
atggccacgcgttcccccggagtcgttattagcgacgatgaacctggatacgatctcgatctgttttgtatacctaaccattacgcagaggacctcgaacgagtctttattccacacggtcttatcatggacagaactgaaagacttgcacgcgatgtcatgaaggagatgggtggacatcacatagtggcactgtgtgtgcttaagggtggttacaagttttttgcagatttgctggattacatcaaggcactgaatagaaattccgacagatccatcccgatgaccgtcgatttcatccgactgaaatcgtactgtaacgatcagtcgaccggggatatcaaagtgatcggaggggacgatctctcgacccttactggaaagaatgtcctgatagtggaggacataatcgataccggcaaaactatgcaaacgcttttgtcactggtgagacaatacaatcctaagatggtgaaagtggccagccttctggtcaaacgcacgccccgtagcgtcggatacaagcccgatttcgtcggtttcgagatccctgacaaatttgtggtgggatacgcactcgattacaacgagtacttccgtgatctcaaccatgtgtgtgtgatcagcgaaactggtaaggcaaagtacaaggcg

SEQ ID NO: 13826 - DNA, 654 bp, Artificial Sequence
  Description of Artificial Sequence: Synthetic coding sequence
atggcaactagatcgcctggagtcgtcatctcggatgatgaacccggatacgaccttgatcttttttgcattcctaatcattacgcagaagatcttgaacgtgtctttattccccacggcctcattatggaccgcaccgagcgactcgcacgggacgttatgaaggagatggggggccatcacatcgtggccctgtgtgtcctgaagggtggttacaagtttttcgcagatctgctggattacattaaagcactcaatcgaaacagcgataggtcgatcccaatgactgtggactttatacgtcttaagtcgtactgtaacgaccaatcaacgggagatatcaaagtaattggtggagacgacctctccactctcaccggtaagaacgtgctcatcgtggaggacatcatagatacgggtaagactatgcaaacgcttctctcgttggtgagacaatacaatcccaagatggtgaaggtggcgtccctgcttgtcaagaggaccccgcgtagcgtgggatacaaaccagattttgtgggattcgagatccctgataagtttgtggtgggttacgctcttgactacaatgaatacttccgcgatctgaatcatgtgtgcgtcattagcgagactgggaaggcaaagtacaaagcg

SEQ ID NO: 13827 - DNA, 654 bp, Artificial Sequence
  Description of Artificial Sequence: Synthetic coding sequence
atggcgacaaggagtccaggcgttgtaatctctgatgacgagccaggctacgacctggaccttttctgtatcccaaatcattatgccgaggatttggaacgcgtctttattccccacgggctgataatggataggactgagcgactggcgcgagacgttatgaaggagatgggcggccatcacatcgttgcactgtgcgttcttaaaggaggctacaaattttttgccgacctgctggactatattaaggcactgaacaggaattcagacagatctattccgatgaccgtcgacttcatccggctgaagagttattgcaacgatcagtcaaccggtgacattaaagttattggtggagacgacctgtccacgttgaccggaaaaaacgtcctgatcgtggaagatattattgatacaggcaaaacaatgcaaacccttctgtcactcgtgcggcagtataatccaaagatggtgaaagtggcctccctgctggtgaaaagaactccccgcagtgtcgggtacaaacccgattttgttggcttcgagatcccggacaaattcgttgttggctatgccctcgactacaacgagtatttcagggacctcaaccatgtgtgcgttattagtgagacgggcaaagccaaatataaggca

SEQ ID NO: 13828 - DNA, 654 bp, Artificial Sequence
  Description of Artificial Sequence: Synthetic coding sequence
atggccactagatcgccaggcgtggtgatctcggatgatgaaccagggtacgacctggatcttttttgtatcccaaatcattatgcagaagatctcgaaagagtgtttattcctcatggcctgattatggatagaactgagagactggctcgggatgtgatgaaagagatggggggacatcatattgtggcgctgtgcgtgctgaaggggggctacaaattctttgcagatcttcttgactacataaaggcacttaaccgcaactcagatagatcgattcctatgaccgtggatttcatacgattgaagtcgtactgtaacgaccagtccaccggagacattaaggtcataggaggcgatgatctttccactcttactggaaagaatgtgctcatagtggaggacattattgataccggtaagactatgcaaacccttctctcactggtgcggcagtacaaccccaaaatggtgaaggtcgcatccctcctggtcaagaggactcctcgctccgtgggctacaaaccagactttgtggggtttgagattccggacaagtttgtggtgggatacgccctggactacaatgaatacttcagagacttgaaccacgtgtgcgtgatctcagaaaccggtaaagcaaagtataaggca

SEQ ID NO: 13829 - DNA, 654 bp, Artificial Sequence
  Description of Artificial Sequence: Synthetic coding sequence
atggccactcgctctccaggtgttgtgatcagcgatgatgaacctggttatgacctggatctgttttgtattcccaaccactacgcagaagacctggagagagtcttcatcccccatgggctcattatggatcgcaccgagagacttgctcgggacgtgatgaaggaaatggggggccaccacattgtcgctctctgcgttctaaaagggggctacaaattctttgcagatctgctcgattatattaaggctttgaatcgcaactcagatcgtagcatcccaatgactgtagacttcatccgcctaaagtcatattgcaatgaccaatcgaccggtgacataaaagtaatcggaggggacgacctcagcactctgacaggaaagaatgtgttgatcgtggaggacatcatcgacacagggaaaacaatgcagaccctcctgagcttggtacgccagtataacccaaaaatggtgaaggtagcctctcttctggtcaaacgcacacctcggagtgtgggctataaacccgattttgtgggattcgagatccccgacaaattcgtagtcggatacgccctcgactataacgaatattttcgggacttgaaccatgtgtgcgtcatttccgaaaccggaaaagccaagtacaaggct

SEQ ID NO: 13830 - DNA, 654 bp, Artificial Sequence
  Description of Artificial Sequence: Synthetic coding sequence
atggccaccaggagtccgggcgtggtaattagcgacgatgagcctggttatgacttagacctcttttgcatccccaatcactatgccgaggaccttgagcgggtgttcatcccccacggcctgattatggatagaaccgagagattagcgagggatgtgatgaaggagatgggaggccaccacattgttgcgctgtgtgtgctgaaaggtgggtacaagtttttcgcagacctgctggactacatcaaagcactcaatcgaaactcagatcgctctattccaatgacagtggatttcatccgcctgaagagttattgtaacgaccaaagtacaggggacatcaaagtcatcggcggagacgatctatcgactctgaccgggaaaaacgtgctgatcgttgaggacattattgacactggcaagactatgcagactctgctgtcgttagtccggcagtacaatccaaagatggtcaaggttgccagcctgctcgtgaaaagaactccccggagcgttgggtataaacctgattttgtgggcttcgaaattccggacaagtttgtcgttggttacgctcttgattacaatgagtactttcgggacctaaatcacgtgtgtgtgatcagtgaaaccggaaaggccaagtacaaagca

SEQ ID NO: 13831 - DNA, 654 bp, Artificial Sequence
  Description of Artificial Sequence: Synthetic coding sequence
atggccactcgttcacccggggtagtgatctctgatgacgagcctgggtacgatctagatctattttgcattccaaaccactacgcggaagacctcgaacgagttttcattccacacggactgatcatggaccggaccgagaggttggccagagatgtcatgaaggagatgggtggccaccacattgttgccttgtgcgttctaaagggaggatataaattcttcgctgacttgcttgattacatcaaggctctcaaccggaactcagaccgatctatccccatgaccgtcgattttattagacttaagtcttactgtaatgaccagtccaccggggatatcaaggtaattggcggtgatgatttgagcaccctgacagggaaaaacgtcttgatcgtggaggacattatcgatacaggtaaaacaatgcagacactgctttctctcgttcgacaatataacccaaaaatggtgaaggtggcctccctactggtaaaaaggacaccgagatccgtcgggtacaagccagactttgtaggctttgagatcccagataaattcgtggtgggctacgcgttggactacaacgaatactttagggatctgaaccatgtctgcgtgattagcgaaacagggaaagcaaaatacaaggct

SEQ ID NO: 13832 - DNA, 654 bp, Artificial Sequence
  Description of Artificial Sequence: Synthetic coding sequence
atggccacccgatcccctggggtggttattagtgacgacgagcctggttacgatttggacctgttctgcatcccaaaccactatgcagaagatctcgagagggttttcataccgcacggcctcattatggacagaacagaacgattagcccgggacgtcatgaaggagatgggaggccatcatatcgtggctctgtgcgtgctgaaagggggttacaagttttttgcagacctgcttgactatatcaaggcactcaaccgcaatagcgacaggagtatcccaatgaccgtggatttcatacgcctcaaaagctactgtaatgaccagagcaccggcgacatcaaagtgatcggcggagacgatctgagcacgctaaccggaaagaacgtcctgatcgtagaggacataattgacacagggaagacgatgcagacccttctgagccttgtacgacagtataatccaaaaatggtcaaggtggctagcctattagtgaagcgcaccccgcgttcggtcgggtacaagcccgattttgtaggattcgaaatacctgataaatttgtggtaggttatgccttggactacaacgagtactttcgggatttgaaccatgtttgcgtaattagtgagaccggtaaagcaaaatataaggcc

SEQ ID NO: 13833 - DNA, 654 bp, Artificial Sequence
  Description of Artificial Sequence: Synthetic coding sequence
atggccactcggtctcctggggtggtgatctcagacgacgagccaggatacgacctagacctgttttgtatacctaatcattacgccgaggacttggaacgagtgtttattccgcacggtcttattatggataggacggaacgactggcgcgcgatgttatgaaagagatgggagggcatcacatcgttgcgttgtgtgtgctcaagggcggatacaagtttttcgctgaccttctggattatatcaaggcgctgaataggaactccgacaggtctatccctatgactgttgattttatcagacttaagagctactgcaatgaccagagcacgggggatattaaagttatcgggggagatgacctgtctacactaactggcaagaatgttctaatcgtagaagacataattgacacagggaagacaatgcagacactgctcagtttggtgcgacagtacaatcctaagatggtgaaggttgcatctctcctagtgaagcgcacccctcgttccgtgggttacaaacccgacttcgttggatttgaaatacccgataagtttgtggttggttacgccctggattacaacgaatattttagggatctgaaccacgtctgtgtcatctccgaaactggaaaggccaaatataaagct

SEQ ID NO: 13834 - DNA, 654 bp, Artificial Sequence
  Description of Artificial Sequence: Synthetic coding sequence
atggccactaggagccctggggttgtcatttcggatgatgaacccggatacgaccttgacctgttttgcatcccgaaccattacgccgaggatctggaaagagtattcataccacatggattgatcatggatcggaccgagcggttggcacgggatgtaatgaaggagatggggggacatcacatcgtggctctctgcgtgctaaaaggcggctacaaattctttgcagacttactggactacataaaggctctgaacagaaacagtgatagatctatacccatgacggtggacttcatcagactcaagagttactgcaatgatcagagcacaggcgatattaaagtcattggcggtgacgatttatcaaccctcaccggcaagaatgtacttatagttgaagacatcatagacacgggcaagactatgcagaccctgctgtctctcgtgaggcagtataaccctaaaatggtcaaagtggcctcccttctcgttaagcgaacccctagatctgtcggttataagccagacttcgttggattcgaaattccagacaagttcgtagtcggctatgcactggactacaacgagtattttagggacctgaaccatgtatgcgtgatttccgaaactggaaaagcgaagtataaggct

SEQ ID NO: 13835 - DNA, 654 bp, Artificial Sequence
  Description of Artificial Sequence: Synthetic coding sequence
atggccaccaggagccctggtgtggtcatttccgatgatgaacccggctatgacttggacctgttctgcatccctaaccattatgccgaggacctggagcgtgtgttcattccccacggcctgataatggacagaaccgagaggctggcacgcgacgtgatgaaggaaatgggcggacaccacatagtggccttgtgcgtgctgaagggcggctataaattttttgcagacctgctggattacatcaaggcactgaacaggaactctgatagatccattcctatgaccgttgactttattcgactcaagtcctattgcaatgaccaaagcactggcgatatcaaggtgatagggggagatgatctttctactcttactggcaaaaacgtgctaatcgtggaagacataattgacactggcaagactatgcagaccctgctgagcctcgtgcgacaatataatcccaagatggtaaaagtagccagcctgcttgtcaagagaactcctcgatctgttggctacaagcccgatttcgtagggttcgaaattccagacaagttcgtggtgggttatgctctcgattacaatgaatatttcagggaccttaaccatgtatgcgtgataagcgagaccggaaaggcgaagtataaggct

SEQ ID NO: 13836 - DNA, 654 bp, Artificial Sequence
  Description of Artificial Sequence: Synthetic coding sequence
atggcaaccagatcgccgggagtagtgatcagcgacgacgaaccgggatatgaccttgacctgttctgcatcccaaatcattacgcagaggacctggaaagggtgttcatccctcacgggctcatcatggaccgcactgagcggttggcacgggacgtgatgaaagagatgggaggccaccacatcgtggccctctgcgtgctcaaagggggctacaagttcttcgccgacctgcttgactacattaaggcgctgaatcggaactccgaccgctcgatccctatgaccgtcgactttattcgcctcaagagttactgcaacgatcagtccacgggcgacatcaaggtgatcggaggtgatgatctgagcactctcacggggaagaatgtgctgattgtagaagatatcatcgacactggaaagactatgcaaacccttctctcgcttgtccgacagtacaacccaaagatggtgaaggtggcctcgctcttggtcaaacggaccccaagatcagtgggatacaagccggactttgtcggatttgaaatcccggacaagttcgtggtgggctatgctttggattacaacgagtacttccgcgatctgaaccatgtgtgtgtcatttctgaaactggaaaggccaagtacaaagcg

SEQ ID NO: 13837 - DNA, 654 bp, Artificial Sequence
  Description of Artificial Sequence: Synthetic coding sequence
atggctaccagatcaccgggagtcgtgattagcgatgacgagcctggttacgatctcgacctgttttgcatcccgaaccactacgctgaggatctcgaacgggtgttcatcccccacgggttgatcatggatcgcaccgaacggcttgctagagacgtcatgaaggagatgggcggccatcatatcgtggccctctgcgtcctcaagggaggatacaagtttttcgcagacctcctggactatatcaaagccctgaaccgaaactccgaccgcagcatcccgatgaccgtcgatttcatccgcctcaagtcctactgcaacgatcaatcgactggtgacatcaaggtgattggaggcgatgatctctcgaccctgaccggaaaaaacgtgctgattgtggaagatatcatcgatactggaaagaccatgcagactctgctgagcctggtacggcagtacaacccaaagatggtgaaggtcgcgtcattgctggtcaaaagaacgcctagatcggtgggatacaagccggacttcgttggatttgagatcccggacaagttcgtggtgggatacgcgctggactataatgagtatttccgagacttgaaccacgtgtgtgtgatctccgagactggtaaggctaagtacaaggcc

SEQ ID NO: 13838 - DNA, 654 bp, Artificial Sequence
  Description of Artificial Sequence: Synthetic coding sequence
atggcaacgcggagccccggtgtggtcatttctgacgacgagccaggttacgatctggaccttttctgcatccccaatcactacgctgaagatttagaaagggtgtttatcccgcacggtctgatcatggaccgtacggagcgcctcgcgcgagacgtgatgaaggaaatgggggggcaccatatcgttgccctctgcgttctgaagggaggatataagttttttgctgacctgcttgactacatcaaagcgcttaatcgaaactcggaccgctccattccaatgacagtggacttcataagacttaaatcgtactgtaatgaccaatccacaggagatattaaggttattggaggagacgatctgtcaacactaacagggaagaacgtcctgatagtggaggatataatagataccggcaagacgatgcagactcttctctccctcgtgcgacagtacaaccccaagatggtcaaggtggctagcctgctcgtgaagcggactcctcggtcagtcggttacaagccagatttcgtcggttttgagataccggataagttcgtggtgggatacgctctagattacaacgagtactttcgggacctaaaccatgtgtgtgtgatctccgagactgggaaggccaagtataaggca

SEQ ID NO: 13839 - DNA, 654 bp, Artificial Sequence
  Description of Artificial Sequence: Synthetic coding sequence
atggccaccagatcccctggcgtggtaatttccgacgatgaacctggatatgatctcgatctcttttgtataccaaaccattacgcagaagatctcgagagagtgttcattccccacggcctgattatggaccgaaccgagagactcgcccgtgatgtaatgaaggaaatgggtggacatcatatcgtggcgctttgcgtactgaaaggagggtacaaattctttgcagacctgctggattacatcaaagcattgaaccgcaactcagaccggtcgattcctatgactgtggactttatcaggcttaaatcgtactgtaatgatcagagcaccggtgacataaaggtcataggtggagatgatctctcgactctgaccgggaagaatgtgcttattgtcgaggacatcatcgacactggaaagacgatgcaaactcttctctctcttgttcgccaatacaacccaaaaatggtgaaggttgcatcgcttcttgtgaagagaaccccacggagcgtcggatacaagcctgatttcgttggctttgaaattcccgataagtttgtggtgggttacgcattggactataatgaatactttagggatctgaaccacgtgtgcgtcataagtgaaactggcaaggccaagtacaaggcg

SEQ ID NO: 13840 - DNA, 654 bp, Artificial Sequence
  Description of Artificial Sequence: Synthetic coding sequence
atggcaactcgctctcctggagtggtgatctcggacgatgaacccggctacgatctcgatttgttctgcatcccaaaccattacgcagaagatctggagcgggtgtttatcccacacggactgatcatggatcgcactgaacgcctcgcccgcgacgtcatgaaggagatgggaggccatcacattgtggctctctgtgtcctcaagggaggctacaaattctttgcggatctgctggactacattaaagctctgaatagaaattccgaccgatccattccgatgaccgtggacttcatcagactcaagagctactgcaacgaccagtcaaccggtgatatcaaggtgatcgggggtgacgacctgtccactttgaccgggaagaacgtcttgatcgtggaggacatcatagatacgggcaagactatgcaaaccctgctgtcgcttgtcaggcagtacaatcctaagatggtgaaagtcgcctcactgctggtgaaaaggaccccgcggtcggtaggatacaaaccggacttcgtgggatttgagatcccggacaagttcgtcgttgggtacgcccttgactataacgaatacttccgggacctcaaccacgtgtgcgtgatcagcgaaactggaaaggcgaagtacaaggcc

SEQ ID NO: 13841 - DNA, 654 bp, Artificial Sequence
  Description of Artificial Sequence: Synthetic coding sequence
atggccactaggtcacccggggttgtgatcagcgacgatgaaccggggtatgatcttgacttgttctgtatccctaatcactacgctgaggatctcgagcgcgtgttcattccgcacggccttatcatggatagaacggaaagactcgcccgggatgtcatgaaggagatgggcgggcaccatatcgtggccctgtgcgtccttaagggcggatacaagttctttgctgacttgttggactacatcaaggccctgaatcgcaactccgacagatcgattccaatgactgttgacttcatacgcctgaaaagctactgcaatgaccagtccaccggcgacatcaaagtgatcggaggggacgacctgtcgacgctgaccggaaaaaacgtactgatcgtcgaggacatcattgataccggcaagaccatgcaaaccctcctgtccttggtgcgtcagtacaaccctaagatggtcaaggtcgcgagcctcctcgtgaagcggactccgcgctcagttggatataagccagattttgtcggcttcgaaatcccggataagtttgtggtgggatacgcgctggattacaacgaatacttccgggacctcaaccatgtgtgcgttatatcggaaactggaaaggcaaaatacaaagca

SEQ ID NO: 13842 - DNA, 654 bp, Artificial Sequence
  Description of Artificial Sequence: Synthetic coding sequence
atggccacccggagtcccggggtcgtgattagtgatgatgagccaggatatgacctcgatctcttttgtattccgaatcattatgctgaggatttggagagagtgttcatccctcatggacttattatggacagaacagagagattggccagggacgtaatgaaggagatgggcggtcaccacatcgtggctctgtgtgtgctgaaaggcggatacaagttctttgccgatctgttagactatatcaaggcacttaaccggaactccgaccggtccatccctatgaccgtggatttcatcaggcttaagtcttactgcaacgatcagagcacgggggacattaaggtcatcggaggggatgacttatcaaccctgacagggaaaaatgtcctgatcgttgaggatattatagacactggcaagactatgcaaaccctgctgtccctggtgcgccaatacaatccgaagatggtgaaggttgcctctctgctggtgaagcgtacaccaaggtccgtgggttacaagcccgatttcgttgggttcgagatacctgacaaattcgtggttggctacgctctggactacaatgagtatttccgagatttgaatcatgtatgtgtgatatctgagacaggcaaggccaaatataaggca

SEQ ID NO: 13843 - DNA, 654 bp, Artificial Sequence
  Description of Artificial Sequence: Synthetic coding sequence
atggccactcggtcacctggagtcgtgatttcagacgatgagccaggatacgacctggacctgttctgcatacccaatcactacgcagaggacctggaacgcgtctttatcccgcatggacttatcatggacagaactgagcgtctggctcgtgatgtcatgaaggaaatgggtggtcatcacattgtggcactgtgtgtgttgaaaggggggtacaagtttttcgccgatttgctcgattacataaaggcacttaatagaaatagcgatcgctccatccctatgactgtcgacttcatcagactgaagtcctattgtaacgatcagtcgactggcgacatcaaggtcattggaggagatgacttgtccacgctgaccgggaagaacgtgcttatagtggaggacattattgataccggaaagactatgcaaacgctgctgtcccttgtgcggcaatacaaccccaagatggtgaaggtggcatcgctcctcgtcaaacgaactccgcgcagcgtgggctataaaccagattttgttggatttgaaatacccgacaaattcgtcgtcggctacgcactcgactataacgaatacttccgagatcttaaccacgtgtgcgtgatttcggaaaccggaaaggcaaagtacaaagcg

SEQ ID NO: 13844 - DNA, 654 bp, Artificial Sequence
  Description of Artificial Sequence: Synthetic coding sequence
atggctacacgcagcccaggggtggtgatctcagatgatgagccggggtacgacctggacttattttgcattccaaaccactacgccgaggacctagaaagagtcttcataccacatggcctgattatggaccggacggaaaggctggctagggacgtcatgaaagaaatgggagggcaccatatcgtcgctttgtgcgtgctgaaagggggatataagtttttcgccgacctgcttgattatatcaaagctttaaacagaaattccgatagatctattcctatgaccgtggatttcatccgcctgaaaagttattgcaacgatcaatccaccggagacataaaggtcatcgggggggacgacctctcaacattgacaggaaagaacgtcctgatcgttgaagatatcatagacacgggaaagaccatgcagactctactctcacttgtaagacagtataatccaaagatggtaaaggttgcaagtcttttggtgaaaagaacccccaggtcagttggctacaaacctgactttgtaggctttgagatccctgataaattcgtggtcggatacgctctcgactacaacgagtacttcagggatctcaatcacgtgtgcgtgattagtgaaacggggaaagctaaatacaaggca

SEQ ID NO: 13845 - DNA, 654 bp, Artificial Sequence
  Description of Artificial Sequence: Synthetic coding sequence
atggctactaggtccccaggtgtcgtaataagtgacgacgaacctgggtatgatctggatctgttctgcattcctaaccattacgctgaggacctcgagagggtctttatcccgcatggcctgattatggacagaactgagcgtctggcccgcgatgtgatgaaagaaatggggggccatcatattgtggccctctgtgtcctaaaaggcggctataagtttttcgccgaccttttagattatatcaaggccctcaaccggaactctgacaggtccatccctatgaccgtggactttatcaggctgaaaagttattgtaatgatcagagtactggcgacatcaaagtgataggaggcgatgatctgtcgacactcaccggcaagaacgtgctgatcgtcgaagacatcatcgatacagggaagactatgcagaccctcctttccctggttcgccagtacaaccccaagatggtcaaggtcgcctcactgctcgtaaaacgcacacccaggtcagtgggctacaagcctgacttcgtgggattcgaaatccctgacaagtttgtggtcgggtatgccctcgactacaatgaatatttccgagaccttaaccacgtgtgtgttatttcagaaactgggaaagccaagtataaggca

SEQ ID NO: 13846 - DNA, 654 bp, Artificial Sequence
  Description of Artificial Sequence: Synthetic coding sequence
atggctactcgctcccctggagttgttatcagcgacgatgagcccggatacgacctggacctgttttgtataccgaatcactatgccgaggatttggaacgggttttcatacctcacgggctgatcatggatagaaccgaaagactggcaagagatgtaatgaaggaaatggggggacaccacattgtggcactgtgcgtactgaagggtgggtacaagttcttcgccgatttgctggattacattaaagcgctcaaccgcaacagcgataggagcataccaatgacagtcgatttcattaggcttaagagttattgtaatgaccagtccaccggggacatcaaagtcattggaggagatgatctctctacactgacagggaaaaacgtgctgatcgtcgaggacataatcgataccggtaagacaatgcaaacattgctctctctggttagacagtacaatcctaaaatggtaaaagtggcttcactccttgtgaagcggactccccgctctgtcggctataagcctgatttcgttggcttcgaaatcccagataaatttgtagtggggtacgccctcgactataacgaatatttccgtgatttgaatcacgtttgtgtcatttccgaaaccggaaaggctaagtataaggcc

SEQ ID NO: 13847 - DNA, 654 bp, Artificial Sequence
  Description of Artificial Sequence: Synthetic coding sequence
atggccacccgcagccccggggtggtgattagcgacgacgagccaggatacgacctggacctgttctgtatccccaatcactacgctgaagatctcgagcgggtgttcataccacatggcctcatcatggaccggactgaaagattggcgcgcgatgtgatgaaggagatgggcggccatcacattgtcgccctctgtgtccttaaagggggttacaagttctttgctgatctccttgactatattaaagcgctgaataggaatagcgacaggtcgatcccaatgaccgtggactttatccgtctcaaatcctattgcaacgaccagagcaccggagacatcaaggtaataggaggcgacgacctgtctacgcttactggaaagaatgtcctgattgtcgaagatatcattgacaccggaaaaaccatgcagactttactctcactcgtccggcaatacaaccccaagatggtcaaggtcgcatctctgctcgtgaagagaacaccacgttcggtgggttacaagcccgacttcgtgggctttgaaattccggacaaatttgttgtggggtacgccctggattataatgaatatttcagggatctgaatcatgtctgtgtcatttccgagaccggcaaagcgaagtataaagcc

SEQ ID NO: 13848 - DNA, 654 bp, Artificial Sequence
  Description of Artificial Sequence: Synthetic coding sequence
atggcgacaagatctcccggggtggtgatttccgatgatgagcccggctatgaccttgatctcttttgcattcctaatcactatgcagaggacctggagcgagtctttattcctcacggcctgatcatggaccgaacagagagattggccagagatgtaatgaaagaaatgggaggccaccacatcgtggccttatgtgttcttaagggcggctacaaatttttcgctgaccttcttgactacatcaaggctcttaacagaaactccgacagaagcatccctatgactgttgatttcattcgactgaagtcgtactgcaacgaccagagtacaggtgacattaaggtgattggtggtgacgacctgtccaccctgacagggaaaaacgtgctgattgttgaagacattatcgacacggggaaaactatgcagaccctgctgtcactcgtgcgccagtataatccgaaaatggtgaaggtcgcaagcctgcttgttaagagaacgccgcgaagtgtgggctacaagccagatttcgtgggtttcgaaattccggacaaatttgtggttggctacgccttggactacaatgagtatttcagggacctgaatcacgtgtgtgtaattagcgagacggggaaggcgaaatacaaagca

SEQ ID NO: 13849 - DNA, 654 bp, Artificial Sequence
  Description of Artificial Sequence: Synthetic coding sequence
atggcgactcgctcccctggcgtggtcatctcggacgatgagccgggatacgacctggacctgttttgcatcccgaatcattacgcagaggatctcgaaagggtgttcatcccgcacggcctcattatggatcgcaccgaaagactggcccgggacgtgatgaaagaaatgggcggccatcacatcgtggcactgtgcgtgctgaagggaggatacaagttcttcgctgacctcctcgattacatcaaggcactgaacagaaactcggacagatcgatcccgatgaccgttgacttcatccggctgaagtcctattgcaacgatcagtcgactggagatatcaaggtgattggcggcgacgatctgtccactcttactggcaagaacgtgttgatcgtcgaggatatcatcgacactggcaaaaccatgcagactttgctctcgctggtccgccagtacaatcctaagatggtgaaagtcgcctctctgctggtgaaaagaacccctcggtcagtgggctacaaaccggattttgtgggattcgaaattcccgacaaatttgtggtcggatacgcccttgactataatgaatactttcgcgacctgaaccatgtgtgcgtgattagcgaaaccggaaaagctaagtacaaggca

SEQ ID NO: 13850 - DNA, 654 bp, Artificial Sequence
  Description of Artificial Sequence: Synthetic coding sequence
atggcgacgcgtagtccaggcgttgtaatatccgacgacgaacctggatacgatctcgatttattttgcatcccaaatcattacgctgaggatctggaaagagtattcattcctcacggacttatcatggaccgcactgagagactggcccgagacgttatgaaggaaatgggcggccaccacatcgtggcactgtgtgttctcaaggggggctataaatttttcgcagacctacttgattatattaaagcactgaatagaaactccgacaggagcatccccatgacagtggatttcattcgactgaaatcatattgtaacgaccagtccactggagacatcaaggttattggcggcgatgatctgtcaactctgaccggaaaaaacgtgttgattgtggaggacatcattgacaccggcaagaccatgcaaaccctactgtccctggtacgccaatacaaccccaaaatggtcaaagtcgcgtccctgctggtgaaacgcacaccacggagcgtcggatacaagcctgatttcgttggatttgaaatccctgacaagttcgtcgtgggctatgctctggattacaacgaatatttcagagacctgaaccatgtgtgcgtcataagcgagaccggcaaagccaagtacaaagcc

SEQ ID NO: 13851 - DNA, 654 bp, Artificial Sequence
  Description of Artificial Sequence: Synthetic coding sequence
atggcaactcggagtcctggcgtggtcatatcggacgacgagcccggatacgatcttgaccttttttgtattccgaatcattacgcagaggatctggaaagagtattcattcctcacgggctcataatggataggaccgaacgtctggccagagatgtgatgaaagagatgggcggacatcatattgtggccctttgtgtgctgaagggtggttataagttctttgcagatctcctggattacattaaagccctgaacagaaacagcgatcgatcaattcctatgaccgtcgacttcatcaggctgaagtcctattgcaatgatcaatccacgggcgatatcaaggtgatcggtggagatgacttgtcaaccctgaccggaaagaatgtgctcattgtggaggacattattgacactggtaagactatgcagacccttctctcgcttgtgcggcaatacaacccaaagatggtaaaagtcgcgtcgttgctcgtgaagcggacgcctcgcagcgttggctacaagccggattttgtcggattcgaaatcccagacaagtttgtcgtcggatacgcactggattacaacgaatactttcgagatttgaaccacgtgtgcgtgatttccgaaactggcaaggccaagtacaaagca

SEQ ID NO: 13852 - DNA, 1959 bp, Artificial Sequence
  Description of Artificial Sequence: Synthetic coding sequence
atgaggcccctgcgaccccgcgctgcattgctggccctgctagcctccttgctggccgcgccaccggtcgccccggcggaggcgccccacctggtccatgttgatgctgctcgcgccctttggccactaagacggttctggcggagcacaggcttctgtcctcctctgcctcactcccaggccgatcaatacgtcctgtcatgggatcagcagcttaacttggcctacgtcggcgcggtccctcatcggggtataaaacaggttagaacacattggctgttagagttggtcacaacacgtggttcaactgggcggggtttatcgtataatttcacccacctcgacggctacctcgacctcctgcgggaaaaccaactgttgccgggctttgaactcatggggtccgcaagcggccacttcaccgattttgaagataaacagcaggtgttcgagtggaaagatctcgttagttcccttgcgaggcggtatattgggagatatggactcgcccacgtaagtaaatggaactttgaaacctggaatgaaccggatcatcacgacttcgataatgtttccatgaccatgcagggatttttgaactactacgacgcgtgctcggaaggtttgcgtgccgctagcccggctctgcggttaggcgggcctggcgacagcttccatacccctcctcggagtccactttcttggggacttttgaggcattgccatgacggcacaaacttttttaccggagaggccggcgtacgcttggactatatttctttacacaggaaaggcgcgcggtcatcaataagcatattagaacaggagaaagtggtggcacaacagatccgccagctcttcccgaaattcgcggacacgcccatttataatgacgaggccgacccactcgtgggttggtcacttccgcagccctggagagccgatgtcacgtatgcggcaatggtcgtaaaggtgattgcgcagcaccagaatcttctcttagccaatacaacaagcgcctttccatatgccttactgagcaatgataatgccttcctaagctaccaccctcacccgttcgcccaacgcactttgacggcccggttccaggtgaacaatacccggccgcctcacgtgcaacttctccggaagccagtattgacagcaatgggcctgctggccctgcttgatgaggaacagctgtgggccgaggtaagccaggccgggaccgttctggatagcaaccacaccgtgggtgtgctagcatcagcgcatcggccccaaggccctgccgacgcctggagagccgccgttcttatctacgcatcagatgatacccgagcacaccccaacagatctgtggcagttacccttagactccggggcgtaccgcccggaccaggcctagtatatgtgaccaggtacttggataatgggctgtgttcccccgacggcgaatggcggcgcctaggacgcccggttttccccaccgcggagcagttccgcagaatgcgagctgctgaagacccggtggccgctgcaccaaggcccctcccagcaggaggcaggctcacactccggcctgcgctaagactccccagcctgttgttggtgcatgtgtgcgcaaggcccgagaagcctcccggccaagtgacgcgcctgagggccctacctctcacacagggccagctggtgctcgtgtggagcgacgagcatgtaggaagcaagtgtctgtggacctacgagatccagttctcacaggatgggaaggcgtatactcctgtgtcgagaaagcccagcacctttaacctgtttgtcttctcacccgataccggggccgttagcgggtcctaccgagtccgagcccttgactattgggctaggccagggcctttctcggatccggtgccatacctggaggtccctgtcccaaggggcccaccaagccctggtaatccc

SEQ ID NO: 13853 - DNA, 1959 bp, Artificial Sequence
  Description of Artificial Sequence: Synthetic coding sequence
atgcggcctctccggccccgggccgccctccttgcactccttgcatctctactagcagctccacctgtggcccctgccgaagctccccatctggttcatgtggatgcagcaagagcactctggcccctacggcgcttctggcggtcaactgggttctgtcctccccttcctcactcacaggccgaccagtatgttttgtcatgggatcagcagcttaacctggcctatgtgggagctgttccccacagggggatcaaacaggtaaggactcactggctgctcgaactggtcactacacgggggtctacagggcgcggactgtcttataacttcacacatctcgacgggtatttagacctgctgagagaaaatcagctcctccccgggtttgaactcatgggatccgcttcaggacattttactgactttgaagataaacagcaggtcttcgaatggaaagatctcgtgagttctctcgcccggcggtatattggaaggtatgggttagcccatgtgtcaaaatggaacttcgagacttggaacgagcctgatcatcacgatttcgacaatgtctccatgactatgcaagggttcctgaattattatgatgcttgttctgaaggattaagagccgccagtcccgcccttcgtctcggagggcctggggactcattccacacacccccgcgctctccactatcctggggactgctacggcattgtcacgatgggactaacttcttcacaggagaggcaggagtgcggttggactatatatccctgcatcggaaaggagcccgttcatcaatttctatcctggaacaggaaaaagtcgtggcacagcagatcagacagcttttccccaaatttgctgatactccaatctataatgatgaggcagacccactcgtaggatggtctctccctcaaccctggcgggccgatgtgacgtatgccgctatggtggtgaaagtaatcgctcagcatcagaatcttctgctcgctaatactactagtgccttcccatatgctcttctttctaacgataacgccttcctgtcttatcatcctcatcctttcgcacagaggacactgacagcccggttccaggtcaacaatacaaggccacctcatgttcaattactgcggaaacccgtgctgacagccatgggactcctagccctattagatgaagagcagttatgggccgaagtgtctcaggccgggactgttcttgactctaaccacactgtaggggtgctggcatcagctcataggccacagggaccagctgatgcctggcgagctgccgtcctgatctatgccagtgatgatacaagagcacaccctaatcgatcagtagcagtgacacttaggctgcgcggggtccctcctgggcctgggctcgtctatgtgacacgatacttagataatggactctgctcccccgacggggaatggcgaagattaggacggcccgtctttccaactgctgaacagtttaggaggatgcgggccgccgaagatcccgtcgctgctgcccccaggcccttgcccgccggagggcggctcactctccggcccgccctcagactcccttctctgctcttagtgcatgtatgtgcccgacccgaaaaacccccaggacaggttacgaggctgagggctctgccactcacacaggggcagctcgtgctggtctggtccgatgaacatgttgggtccaaatgcctctggacatatgaaatacaattttctcaggatgggaaagcttacacacccgtctcaagaaaaccctcaactttcaatcttttcgtattcagtccagatacaggagctgtatccggatcatatcgggtgagggctctcgactattgggccaggcccgggcccttctccgatcccgtaccctatttagaagttccagtgccaagagggccccccagtcctgggaatcca

SEQ ID NO: 13854 - DNA, 1959 bp, Artificial Sequence
  Description of Artificial Sequence: Synthetic coding sequence
atgcgcccattgcgcccccgggccgctctcctcgccctcttggcctcactcctcgccgctccacccgtggctccagccgaggccccccacctggttcatgtcgacgccgcccgtgctctgtggcccctgaggcggttttggcgttctaccgggttttgtcctcccttacctcactctcaggctgatcagtacgtactgtcatgggatcagcaactgaacctggcttacgtgggtgcagtgcctcacaggggcatcaagcaagtgcgaacccattggttgttagagcttgtcacaacaagaggaagtaccgggcggggtctgagttacaacttcacccacctcgatggatacctggacttgcttagggagaaccagctgctgcccggatttgagctcatggggagcgcctcagggcatttcacggatttcgaagacaagcagcaggtatttgagtggaaggacctggtttccagtctcgccagaaggtatatcggccgctatggcctcgcccacgtgagtaagtggaattttgagacatggaatgagcccgaccaccatgattttgacaatgttagtatgaccatgcagggatttctcaattactacgatgcctgttccgaaggcctgcgtgctgcaagcccggcactgcggctgggtggacccggggactcttttcacacccccccacgatctcccctatcttggggacttcttcgacactgccatgacggcactaacttcttcaccggcgaggctggcgttcgtctggattacatttcactccacagaaaaggagccagaagcagcatcagcatccttgagcaggagaaggttgtcgctcagcagatcagacagctgttccccaaatttgcagatactccaatatataatgacgaggctgacccacttgtggggtggagcctcccacagccttggcgggccgacgttacctacgcagccatggttgttaaggtgatagcacagcatcaaaatctgctgctcgctaacacaacctctgccttcccttatgcactgctgtcaaatgataacgccttcttgagctaccatccacaccccttcgcgcaacgcacccttaccgccagattccaagtgaacaatacaaggccccctcacgtacagctcctgaggaagcctgtgctcacagccatggggttactagcactgcttgatgaggaacagctctgggcggaggtctcccaagccgggacggttctggactccaaccacaccgtcggggtgttagcctccgcccatcgtccacaaggacccgctgacgcatggcgcgcggccgtcttaatctatgcgagcgatgacacccgtgcacatccaaatagatctgtcgcagtcaccctgcggttacgcggtgtgccaccaggcccaggactggtttatgtcacccgctacctggataatggcctctgttctcccgacggcgaatggcgacgcctcggcagacctgtctttcctaccgcggagcagttcagacggatgcgggcagccgaggacccagtcgccgcagctcccagaccgctgcccgcgggtggacgactgacgttgcgaccggctctgcgactgccctcgctgctgctggtgcatgtatgcgcaaggcctgagaagccccccggccaggttacaagactgcgggcgctgccgctcacccaaggccagcttgtgctggtatggtctgatgagcacgtgggctctaaatgtctctggacttatgagatccagttcagccaggatgggaaagcctatacacccgtgtcccggaagccttcaaccttcaacctgttcgtattttctccagacaccggcgccgtgtcaggcagctacagggtgcgcgccttggactattgggccaggccgggtccctttagtgatccagtgccgtatctggaagtgcctgtacccagaggacccccaagccctgggaaccca

SEQ ID NO: 13855 - DNA, 1959 bp, Artificial Sequence
  Description of Artificial Sequence: Synthetic coding sequence
atgaggcctctgcggcctcgcgccgccctcctcgcactgctggcctcactcttagctgccccaccagtcgcccccgccgaagcaccccacttagtgcatgtcgacgccgcccgggctctgtggcccctcagaagattctggcgcagcaccggcttttgtcctcccctgcctcactcgcaagcagatcagtacgtgctgtcctgggatcaacagctgaacctggcctacgtaggagcagtgccgcaccggggcatcaaacaggtccgcacccactggctgctggaactggtaaccacgcgaggatccacgggtaggggactttcctacaattttacacacctggatgggtacttggatcttttgcgagaaaaccaactgctaccagggttcgaactgatggggagcgccagcggccattttaccgactttgaagataagcagcaagttttcgagtggaaggacctagtttcttccttggcacgaaggtatatcgggagatatggactggcccatgttagcaagtggaatttcgaaacctggaacgaacctgatcaccacgacttcgacaatgtgtctatgactatgcaagggttcctcaactattacgacgcgtgttccgagggtctaagggctgcctccccagctttgaggctgggaggccctggcgatagtttccatactccccctaggtccccgctttcctggggactgttgcgtcattgtcacgacggaacaaatttctttactggggaggcaggagtgagactggattatatttccttgcatagaaagggtgcaagatcctccatatccatcttggagcaggaaaaagtcgtagcccagcagattcggcagctattcccgaaatttgctgacacacctatatacaatgatgaagcagatcctttggtcggatggtctctgccccaaccttggagagccgatgtgacttatgctgcaatggtcgtgaaggtcatagcccagcaccaaaatcttcttctagctaataccacttccgcttttccatacgcgctcctctctaatgataatgcgttcttgagctaccaccctcatccctttgcacagcggacacttaccgcaaggtttcaggtgaataatactcgacctccacacgtgcaactcttgagaaagccagtgttgaccgccatgggcctgctggctctgctcgatgaagaacagctgtgggcggaggtcagccaggcagggactgtcctagactctaatcacactgtgggcgttctggctagcgctcaccggccccagggacccgctgacgcctggcgcgcggctgttttaatatacgcaagcgacgacaccagggctcatcccaatcgctctgtggcagtgaccctccgcctcaggggcgttccgcccggcccagggttggtgtatgtgacccgctacttggataacggcctgtgtagccccgacggagagtggcgacggctgggacgtcccgtgttccctactgccgagcagttccggcgcatgcgggcggccgaagaccccgtcgccgccgcaccacggccactgcctgctgggggccggcttactttgcgcccggccctcagattaccgagtctactcctggtgcatgtctgcgcacggcctgaaaaacccccgggtcaggtgactaggttgcgcgcccttccgctcacccagggccagctcgtcctggtgtggagtgacgagcatgttggctccaaatgcctctggacttacgagatccagttctcccaagatggaaaggcctacacccctgtctcaagaaagccttcgacattcaatttgtttgttttcagcccagacaccggtgccgtcagcgggtcatatcgggtgcgtgcgctcgattattgggccaggccaggtccatttagcgatccagttccgtatcttgaggtcccggtgccccgagggccaccttctcccggtaaccca

SEQ ID NO: 13856 - DNA, 1959 bp, Artificial Sequence
  Description of Artificial Sequence: Synthetic coding sequence
atgcggcccctaaggccacgtgcagccctgttagctctgctcgcaagccttctggctgccccacctgtagcaccagccgaggccccccatctggtgcatgtggatgctgcccgagcactctggcctctgcgtcgattttggcgttctactgggttctgccctccgttgcctcacagtcaggcagaccagtatgtgctgtcgtgggaccaacagctgaacctggcttatgtgggtgccgtcccccatagaggcattaaacaggtgcgcactcactggctgcttgagctcgttactacccggggctcgaccggacgtggcctgagctacaacttcacccaccttgacggttacctcgacttgctgagagagaatcagctgctgccaggctttgagttaatgggcagtgcctctggccattttacagacttcgaggataagcagcaggtcttcgagtggaaggatctcgtctccagtttggctcggagatatatcggacggtatgggttggcccacgtctctaagtggaacttcgaaacttggaacgagccagatcaccacgacttcgacaacgtttcaatgaccatgcaggggttcttaaactattatgatgcttgctcagaaggcttgcgtgccgccagcccggcccttcgcctggggggaccaggagattcattccatacaccgccaagatcacccctctcttggggcttactgaggcactgccacgacggaactaattttttcaccggggaagcgggggttaggctggactacatctccctgcatcgcaaaggagctcgaagcagcatttccatcctcgagcaggagaaagttgttgcacagcagatacgccagttatttcctaagttcgccgatacccccatttataacgatgaggccgaccctcttgtaggctggtcattacctcagccttggcgggccgacgttacttacgccgccatggtggttaaagtgatagcccagcaccagaacctgctcttggcgaacactacttcagcattcccctatgcactcctatccaacgacaacgcttttttgagctaccatccccacccgtttgcacaacgcacactcactgctagatttcaagttaacaacactcgcccaccccatgtccagctgctgcgaaagcctgtactgaccgccatggggctgttggcactcctggacgaggaacaactgtgggctgaagtttcgcaggctgggacggtgttggattctaatcacacagttggtgtgctcgcttctgcgcataggccacaggggcccgccgatgcctggagagccgccgtcctgatctacgccagcgacgacacacgggcccaccccaaccggtccgttgccgtcaccctcagactgagaggcgtcccccctgggccgggactcgtgtatgtgactaggtacctcgataatggtctgtgctcaccggatggagaatggcgacgactggggaggccagtgttcccgacagcagagcagttcagaaggatgcgtgccgcggaagatcctgtagctgcggcccccagacccctgcccgcagggggccggttgaccttgcggcccgcactgcggttgcctagcctgcttctggtccacgtctgcgcaagaccagaaaagccgcctgggcaggttactcggctccgggccctacctctcacgcaggggcagctagtattggtgtggagcgacgagcacgtgggcagtaagtgcctatggacttacgaaatccagttttcccaggacggaaaagcatacactccagtgtcccgcaagccgtctaccttcaacctgtttgtcttctctcccgacacgggggctgtgtccggatcctacagggtgcgagccctggattactgggcaaggcccggtccattctcggatcctgtgccctatctggaagtccctgtgccgcgcggacctcctagcccagggaatcca

SEQ ID NO: 13857 - DNA, 1959 bp, Artificial Sequence
  Description of Artificial Sequence: Synthetic coding sequence
atgcgaccgctccgccctagggcagccctgctggcgctgctcgccagcctgctcgccgctcccccagtggctccggccgaggctccgcacctcgttcacgtggacgccgcgcgggcgctgtggcctctgcgcagattctggagatcgaccggattctgtccaccactgccacattcccaggccgatcagtatgtgctcagctgggaccagcaactgaatctggcctacgtgggggccgtgccacacaggggaattaagcaggtgcggacgcactggctgcttgaacttgtcactacccgggggtcgactggaaggggactctcctacaatttcacccacctcgacggttacctggatctgctgagggaaaaccagctgctgccgggctttgaattgatgggttcggcctcgggccacttcacggatttcgaggataagcaacaagtgttcgaatggaaggacttggtgtcctccctggcaaggcgctacatcggacgttacggtctggctcatgtctccaagtggaattttgagacgtggaatgagccggaccaccatgatttcgataacgtgtcaatgactatgcagggattcctgaactactatgacgcgtgttctgaaggcctgagagcggcttccccggccctcagattgggtggcccgggagattcattccatactccaccccggtcgccgctgtcctgggggctgctccggcattgtcacgatggaaccaatttcttcactggagaggcaggagtgaggctggactatatctcactgcaccgcaagggagcgcggtcatccatctcaatcctggaacaagagaaagtcgttgctcaacaaatccggcaactcttcccgaagttcgccgacaccccgatttacaacgacgaggccgatcctctggtgggttggtcactgccgcagccgtggcgggccgacgtgacttacgcggcgatggtcgtcaaggtcatcgcccaacaccaaaacctcttgctggcaaataccacttccgccttcccgtacgctctcctctcgaacgataacgctttcttgagctaccacccccacccgtttgctcaacggacgctgactgcccggttccaagtcaataacactcggccaccgcatgtccaactcctgcgcaaaccggtcttgactgccatggggctgctcgctctcctggacgaagaacagctctgggcggaagtgtcgcaggcaggaaccgtgctggactcgaaccacactgtgggagtgcttgcctcggctcaccgaccgcagggaccggccgacgcctggcgggcggctgtgctgatttacgcgtccgatgacactcgagctcacccgaaccggtctgtcgccgtcactctgcggctcagaggtgtcccacccgggccgggccttgtgtacgtgacgagatacctcgataacggactgtgctcgccagacggagagtggcgccggcttggacgcccggtgttcccgactgccgaacagttcagacggatgcgcgccgcagaagatcctgtggctgcagccccaagaccactccctgccggaggaagattgactctgcggcctgcactccgcctcccaagcctcctgcttgtccacgtttgcgcacgtccggaaaagccgccggggcaggttacccgccttcgggcgctgccgctgacccagggccagctcgttctggtgtggtccgacgaacacgtgggatccaagtgcctctggacgtacgagatccagttctcgcaagacggtaaagcctacactccggtgtcgagaaaaccatccacttttaaccttttcgtgttttcccccgatactggagccgtgagcggatcctaccgcgtgcgggcccttgactactgggccaggcccggcccattctcggaccctgtcccgtacctggaggtgccggtgccccggggacccccctcgccgggaaacccg

SEQ ID NO: 13858 - DNA, 1959 bp, Artificial Sequence
  Description of Artificial Sequence: Synthetic coding sequence
atgaggccgcttaggcccagggctgccctgcttgccctgctggcctcactcctggctgctcctcctgtggcacctgcagaggctccccacctggtgcatgtggatgctgccagagcactttggccactacggcgattttggagaagtaccggattctgcccccccctgccccatagccaggccgaccagtacgtcctaagctgggaccaacagttgaacctggcctatgtcggggctgtcccacacaggggcatcaaacaagttcgcacccactggctgctggaactggtcacgacacgaggaagcaccggacgcggactttcctacaacttcacgcatctcgacgggtatcttgaccttctgcgcgagaatcagctcctgcccggcttcgagctgatggggagtgcctccgggcattttaccgactttgaagataagcaacaagtttttgagtggaaggacttggtgtcttccctggcgagacggtacattggacggtatgggctagctcatgtgtccaaatggaacttcgagacctggaatgagcctgaccaccacgacttcgacaacgtgtccatgactatgcagggcttcttgaattactacgacgcctgtagtgagggacttagggccgcaagccctgcactccggctcggagggccgggcgactctttccacacccccccaagatctcccctgtcttggggtctactgaggcactgccacgacggcactaacttttttactggagaggctggagtgcgactagactatatctcacttcaccgtaagggcgctaggtcttctatctcaatcttggaacaggaaaaagtggtcgctcagcagattcggcagctgtttcctaaattcgccgacacccccatttacaatgatgaagctgatccactagtaggctggtctctcccccagccatggcgtgcggatgtcacctacgccgctatggtcgtgaaggttattgcccagcaccagaacctgctccttgcaaacactaccagtgcgtttccctatgccctgctgtcaaacgacaacgccttcctgagctatcatccccatccttttgcgcaaagaactttgactgctcggtttcaggttaataacacacgacctccgcatgttcagctgttgcggaagcctgtcctgacagcaatggggctgctagccttgctggacgaggaacagctttgggcagaggtgagccaggcaggaaccgtgctggacagtaaccatactgtaggggtgctggcaagcgcgcaccgtccacagggcccagctgacgcttggcgggctgcagtactaatctacgccagtgatgacacacgggcacatccaaatcggagcgtagccgtgacattaaggctgcggggggtgccacccggccccgggctcgtctatgtgactcggtatcttgacaacggcttgtgttcccccgacggggagtggcggagactcggccgaccagtgttcccaaccgccgagcagtttagaaggatgcgggcagctgaggacccagttgccgctgcacctagaccactcccagctggcggcagacttacgttgcggcctgctctcagactgccttctctattgctggtccacgtctgtgctcgacccgagaagccccccggccaagtgacccgcctccgggctttgcctttgactcaaggccagctcgtcttggtgtggagcgatgaacacgtgggttctaagtgtctttggacttacgaaatacagttttcccaggatggcaaggcctacacccccgttagtagaaaaccctccactttcaatctctttgtttttagccctgacacaggggccgttagcgggtcctatcgggtgcgcgcactcgattattgggcgaggcccgggcctttttcagatcccgtgccctatctcgaggtgccggtgcctcgcggaccaccaagtccaggcaaccct

SEQ ID NO: 13859 - DNA, 1959 bp, Artificial Sequence
  Description of Artificial Sequence: Synthetic coding sequence
atgaggccgcttagaccgagagcagcactgctcgcactgcttgcatcactgcttgccgcacctccagtagcgcccgcagaggcccctcatctcgtacacgtggatgccgcacgcgccctgtggcccctgcggagattctggcgatcgaccggcttttgtcctcctcttccccattcgcaggcggaccaatacgtgctttcctgggatcaacagctcaacctggcttacgtgggagctgtgccccaccggggaatcaagcaagtgagaacgcattggcttcttgaattggtcactacccggggttcaaccggtagagggttgagctataacttcactcatcttgatggctacctggacctgcttagagaaaaccaactgctgcccgggtttgaacttatgggtagcgcatccggacattttaccgattttgaggacaagcaacaggtgttcgagtggaaagatctcgtgtctagcctggcaagaagatacattggtcgctacggtctggcccatgtgtccaagtggaactttgaaacctggaacgaacctgatcaccacgatttcgacaacgtcagcatgaccatgcaaggattcttgaactactacgatgcatgttccgaaggtctgagagccgcatccccagcccttagacttggaggcccaggtgattcctttcataccccacctcgaagcccgctttcctggggtttgttgagacactgccatgatggtaccaacttctttaccggagaggctggggtgcggcttgattacatctccctgcatagaaagggagctagatcctccatttcaattcttgaacaagaaaaggtggtcgcccaacaaattagacagctgtttccaaagtttgcggataccccaatttacaatgatgaggccgaccctctggtgggttggtcgctgccccagccctggcgggccgacgtgacctacgcagcaatggtcgtcaaggtcatcgcgcaacatcaaaatctgcttcttgcaaacactacttccgcattcccttacgcactgctctcaaatgacaatgcatttctttcgtatcatcctcatccatttgcccagcgcactctgaccgcgcggtttcaagtgaacaatacccgtcccccacatgtgcagctgctgcgtaagcctgtgcttaccgcgatgggacttctcgcacttctcgacgaagaacagctgtgggcggaagtctcgcaagcaggaaccgtcctcgattcgaaccataccgtgggcgtcctggccagcgcacaccgccctcaaggtcctgcggatgcctggagggcggcagtgctcatttacgcatcagacgatactcgggcacaccctaataggtccgtggccgtgactcttcggctgcgaggcgtccccccgggaccggggctggtgtacgtgacgcgttacctcgataacggactttgcagcccggacggtgaatggagacgattgggtagacccgtgtttccgactgctgagcagtttagaagaatgcgggcggcagaagatcctgtggcagcagcccctaggccgctgcctgcagggggcagacttacgctcagaccagcgcttagactgccatcgcttcttcttgtgcatgtctgtgcaaggcccgaaaagcccccgggccaagtgaccaggcttagggcacttcccctgacccaaggccaactggtgctcgtctggtcagacgaacacgttggatccaagtgtctgtggacttatgagattcagttttcacaggatgggaaagcatacacgcccgtgtcgaggaagcccagcactttcaacctttttgtgttctctccagacaccggcgcagtctcaggttcgtaccgggtgcgcgcacttgactattgggcgcgccccggaccgttttccgatcccgtgccatacctggaggtcccagtgcctcgcggcccaccgtctcctggtaatcct

SEQ ID NO: 13860 - DNA, 1959 bp, Artificial Sequence
  Description of Artificial Sequence: Synthetic coding sequence
atgcggcctcttcgaccccgcgcagctcttctggctcttctggcgtctttgctagcagcccctcctgttgctccagctgaagccccccacctggttcacgtggacgctgcaagggcgctgtggcccctccgacggttctggcggagtaccggtttctgccccccactaccgcactcacaggctgaccagtacgttctttcctgggatcagcagttgaacctagcatatgtgggcgccgtgccacaccggggcatcaaacaggtgaggacacattggctgctcgagctggttaccacccgaggttccaccggaaggggcctctcctataatttcacacatctggacgggtacctcgacctcctacgagaaaaccagctcctacccggatttgagctcatgggaagcgcaagtggccatttcactgacttcgaggacaagcagcaggtgttcgaatggaaagaccttgtctcaagtctggcacggcgatacatcgggcgatatggcctcgctcatgttagcaaatggaacttcgaaacctggaacgagcctgaccaccacgatttcgataatgtcagcatgactatgcaggggttccttaattactatgacgcttgctccgaggggctgcgggcagcatctcctgccctgaggcttggcggtccaggagattcattccatacgccccctcgctctcccctgtcatggggtctgctgaggcactgtcacgacggaacaaatttcttcaccggcgaagctggcgtgcggttagattacatttccctccatcgcaaaggcgctcgcagcagtatctcaatacttgaacaggagaaagtagtcgctcagcagatcagacagctctttcctaagtttgctgacacacctatctataatgacgaagccgacccactggtgggatggtccctgccacaaccgtggagagcagatgtcacatatgccgctatggtggtcaaggttatcgcccagcatcagaacctgctcctagcaaacacaacctcagcctttccgtacgcactgctgtcaaatgataacgcatttctttcataccaccctcaccccttcgcacagaggaccctaaccgcccgatttcaggtgaacaatacaaggcctccacacgtgcaactgctgcgtaaacctgtactcactgcaatgggactgctggctctattggatgaggaacagctctgggctgaagtttcccaagccggaaccgtgctcgactccaatcatactgtaggcgtgttagcatcagcgcacagaccccagggaccagccgacgcctggagagctgcagttctcatttacgcatcagatgacaccagagcccaccctaataggtctgtggcagtaaccctaaggctacgcggagtgccaccgggccctggattggtgtacgtgactagatacctggataacggcctgtgcagccccgatggggagtggcggcgcttaggacggcctgtgtttccgaccgcagagcaattccggaggatgagagcagctgaggaccctgtcgcagccgcaccgcggcccttgccagccggcggaaggcttacgctgagacccgccttgcgtctcccttcgctgctgctggtgcacgtgtgcgccaggcccgagaagccgccgggacaggtcacacgtcttcgggctcttccgttgacgcagggacagttagtgttggtgtggagtgatgaacacgttgggtctaagtgtttgtggacttatgagatacagttcagtcaggacggaaaggcctatacccctgtttcaaggaagccgtcgacatttaacctgtttgtgttttctcccgatacgggtgctgtgtctggttcttaccgggtccgagctctggattattgggcgaggcccggtccgttcagcgaccccgttccttacctcgaggtccctgtcccgcgcggccctccgtcgccaggcaatcct

SEQ ID NO: 13861 - DNA, 1959 bp, Artificial Sequence
  Description of Artificial Sequence: Synthetic coding sequence
atgcgccctctgcggcctagggcggcgcttctggcactgctggcatcactcctggcggcgcccccggtggctccggccgaagccccacatctcgtgcacgttgacgctgcccgggccctctggccgctccgcaggttctggagatctaccggcttctgcccgcccctgcctcattcccaagcggaccagtacgtgctgagctgggatcaacaattgaacctggcctacgtgggagcggtgccccatcggggcatcaagcaggtccggactcactggttgctggagctggtcactacccggggttcaacgggacgcggactgtcctacaactttacccacctcgatggctacctggatctgctgcgagaaaaccagttgctgccggggtttgaactgatgggatccgcttcgggacacttcaccgatttcgaggacaaacaacaagtattcgagtggaaggatctggtatcctccctcgcacgccgctacatcgggcggtatggacttgcgcacgtgtcaaagtggaatttcgagacttggaatgaaccagaccatcacgacttcgacaacgtgagcatgaccatgcaggggtttctgaactactacgatgcttgctcggaaggattgcgcgctgcctcgccggccctgagacttggtggacccggcgactccttccatactcccccgcgatcgccactgtcgtggggattgctgcgccactgtcatgacggcactaactttttcaccggggaagccggggtgcggctcgattacatctcactgcaccggaagggcgcgaggtctagcatctccatcctggagcaagaaaaggtggtggctcaacaaatccggcagcttttcccgaagtttgccgataccccgatctacaacgatgaggcggaccccctggtggggtggtcgttgccacagccttggcgcgccgacgtgacctacgccgcgatggtcgtcaaggtgatcgcccaacatcagaacctgctcctggcgaacaccacgtctgccttcccctacgccctgctgtcaaacgacaacgccttcttgtcataccatccacatccattcgcacaacgcaccctgactgcccggttccaagtgaataacacgcggccgcctcacgtgcagctcctgaggaaaccagtcttgaccgctatgggacttcttgcactcctggatgaagagcagctgtgggccgaggtgtcccaggccggaactgttctcgactcgaatcacactgtgggagtcctcgcatcagcccaccggccgcaggggcctgccgacgcgtggcgcgcggcggtgttgatctatgcttcagatgacacccgggcgcacccaaacaggtccgtggccgtcaccctgcgcctgagaggtgtgccgccaggcccaggtttggtgtacgtgacgagatacctggacaacggattgtgcagcccagacggcgagtggcgccgcttgggaaggccagtgttccctactgcggaacagtttcgccgaatgcgcgcggctgaagatcctgttgccgcggctccgcgcccgctcccggccggaggaaggctgactctgaggcctgcgcttcgactgccgtcgctgctgctcgtccatgtgtgcgcacgtccggaaaaaccgccgggccaagtgactagactgagagccctccccctcacgcaggggcaactggtgctcgtgtggtcggacgagcatgtgggatcaaaatgtctgtggacttacgagatccagttttcccaggatggtaaagcctacacccctgtcagcagaaagccctcgacctttaacttgttcgtgttcagccctgacacgggagccgtgtcgggatcataccgcgtgagggccttggattactgggctcggccgggacctttctccgacccggtgccgtacctcgaggtgcctgtgccgaggggccctccgtcgcccgggaatcca

SEQ ID NO: 13862 - DNA, 1959 bp, Artificial Sequence
  Description of Artificial Sequence: Synthetic coding sequence
atgcggcctctccggcctagggcggccttgttggctctcctcgcttcgctgctggccgctccgcctgtcgccccggccgaagcaccgcatctcgtccatgtggacgccgctagggccttgtggccactgcggaggttttggcggtctactgggttttgtcctcctctgccccactcccaagccgatcagtacgtcctgtcgtgggatcagcaactgaacttggcgtatgtgggcgcggtgccacatagaggcatcaagcaggtgaggacccactggctgcttgagttggtgactacgagaggctccaccggaagagggctctcgtacaacttcacccatctcgatggatacttggatctcctccgggagaatcagcttctgccaggtttcgagctgatgggctccgcctcgggacactttactgatttcgaggacaagcagcaagttttcgaatggaaggatctggtatcatcactggcacgccggtacatcggtcgctacgggttggctcatgtttcaaagtggaattttgaaacctggaacgagccggaccatcacgatttcgacaatgtgtcgatgacgatgcaaggcttcctgaattactacgacgcatgcagcgaaggtctgcgggcggcctcgccagccttgcgccttggagggcctggagactcgttccacaccccacccagatcgccgctttcatggggattgctgcgccattgccacgacgggaccaactttttcactggcgaagctggggtcagacttgactacatttccctgcacagaaagggagcccgctcctcgatctccatcctggaacaagaaaaggtggtcgcccaacagattcgccagctcttccctaagttcgcagataccccaatctacaatgatgaagcggaccctctggtggggtggtcactcccacaaccgtggcgcgccgacgtgacctacgcagcgatggtggtgaaggtgatagcacaacaccagaatctgttgttggcgaacactacttctgcgtttccttacgccctcctttccaatgacaacgcgttcctgagctaccacccgcacccattcgcccaaaggacgctcacggcgcggtttcaggtgaacaacacgcgccctccacacgtgcagctcctgaggaaaccggtgctcaccgcaatgggattgctggcgctgctggatgaggagcagctgtgggccgaagtttcacaggcgggtaccgttctggactcgaaccatactgtgggagtgttggcctccgctcaccggccgcaaggccccgccgatgcatggcgcgcagctgtgctcatctatgcctcggacgatacccgcgcacacccgaatcggagcgttgcggtgaccctcaggctccggggagtccccccgggacccggcctggtatacgtcactcggtacctggacaacggactctgcagcccggacggcgagtggcggcggctgggacgcccagtgttccccactgctgaacagttcaggcggatgcgcgctgctgaggacccggtcgcggccgcacccaggccactgccggccgggggccgcctcactctcaggccggcactgcggctgcccagtttgctcttggtccatgtatgtgcacggcctgaaaagccacccggacaggtgacgagactgagagctctccctctgactcagggacagctggtgctggtgtggtcggacgaacatgtgggatcgaagtgcctgtggacctacgagatccaattctcgcaggacgggaaagcctacacccccgtctcgcggaagccatcaactttcaacctgttcgtctttagcccggacaccggagccgtgtccggttcctatagagtgagagcgctggattactgggcgcgcccgggaccgttctccgaccctgtgccataccttgaagtccccgtgcctcgcgggccaccgagcccggggaacccg

SEQ ID NO: 13863 - DNA, 1959 bp, Artificial Sequence
  Description of Artificial Sequence: Synthetic coding sequence
atgaggccccttcggcctagagccgccctgctcgccctgctggcctccctcctggccgcgccaccagtcgcccctgcagaggcgccgcatctggtccatgtcgatgcggccagagcactgtggccgttgcgccgcttctggaggtcaactggattctgcccgcccctgccacacagccaggccgaccagtacgtgcttagctgggaccagcagttgaacctggcgtacgtgggggcggtgccgcacagagggatcaagcaagtgcgcacccactggttgcttgaactggtgactacccggggatccaccggaaggggactgtcctataacttcacgcacctggacggttacctggatctgctgagagagaatcagctgctgccggggtttgaactgatgggatcagcatcgggacattttacggatttcgaagataaacaacaagtattcgagtggaaggacctggtgagctccctggcccgtcggtacatcggccgatacggcctcgcgcacgtgtccaaatggaacttcgaaacctggaatgaacctgaccatcacgacttcgacaacgtcagcatgaccatgcagggcttcttgaattactacgatgcctgctcggagggtctgcgcgcggcatcgccggcattgcggctcggcggccctggagactcgttccatactccgccacggagcccacttagctggggactcctgagacactgccacgacggcaccaacttcttcactggagaagcgggcgtcagactggactatatctcactgcaccgcaagggcgctcggtcatccatctccattctggaacaagagaaagtcgtggcgcagcaaatcagacagttgtttcctaagttcgcggacacccccatctataacgacgaggctgatccgctggtcggctggtcgctgccgcagccgtggcgggctgacgtcacgtacgcggccatggtcgtgaaggtgatcgcgcagcaccagaatcttctgctggcgaacaccacgtcggctttcccttacgccctcctgtccaacgacaacgcattcctgtcgtaccatcctcaccctttcgcccagcgcaccttgactgctcggttccaagttaacaacacccgcccgccgcatgttcagttgctccgcaagcctgtgctcaccgccatggggcttctggctctccttgatgaagagcagctgtgggctgaggtgtcccaggccggaaccgtgctcgacagtaatcatactgtcggggtgctcgcgagcgctcatcgtccccaaggacccgccgacgcgtggcgggccgcagtgctgatctacgcgtcggatgacacccgcgctcacccgaaccggtccgtggcagttaccctgcgcctccgcggtgtgcccccgggaccaggactggtgtacgtcactaggtacctggacaacggactttgctcaccggacggcgagtggcggcgccttggtcgcccggtgttccccaccgcagaacagttccgcagaatgcgggcagcagaagatccggtcgcagccgctccgcgaccgctgccggctggaggaaggctgactctgcgcccggcactccgcttgccttccctgctgctcgtgcatgtgtgcgcgcggccggagaaacccccgggacaagtgaccagactgagagcactgccgcttacccaaggacagctcgtgttggtgtggtccgatgaacatgtgggaagcaagtgtttgtggacctacgaaatccagttttcacaagacgggaaggcatacaccccagtcagcagaaagccttcgacttttaacctgttcgtgttctcgcctgataccggcgctgtgtcaggatcctacagagtgcgggctctggattactgggccaggccgggcccattctcggatccggtgccatacctcgaagtgcccgtcccgcggggaccgccgtcaccgggtaatccg

SEQ ID NO: 13864 - DNA, 1959 bp, Artificial Sequence
  Description of Artificial Sequence: Synthetic coding sequence
atgcgcccactgagacccagggctgcattgctggctctgctggccagcctcctggctgcaccacccgtggctcccgctgaggcaccacacttagttcacgtggatgcagccagggctctgtggccactgcgcaggttttggagatctacaggcttctgccctcctctgcctcattcccaggccgaccagtacgtcttatcttgggaccagcagctgaacctcgcttacgtgggcgctgtccctcaccgcgggatcaaacaagtgaggactcactggcttctggaacttgtgactacaagagggtccaccggacgtggtcttagctacaatttcactcatctcgacggatacctggacctactgcgagagaatcagctgctgccaggctttgaactgatgggcagcgctagcgggcacttcacagactttgaggacaaacagcaggtcttcgagtggaaagacctagtcagttccctggccagacgctacatcggccgctatggcttagcccatgtgagcaagtggaacttcgaaacttggaatgagcctgaccaccatgacttcgacaatgtgtcaatgacaatgcaaggattcctgaactattacgacgcctgcagcgaaggactgagagcagccagcccagcacttaggttaggggggcccggggattccttccatactccccctcgctcacctctcagctgggggctgctcaggcattgtcatgatggcaccaacttctttactggcgaggccggcgtgagactggactacatttctctgcataggaaaggggctcgcagcagcatctccattctcgagcaagaaaaggtggtggctcagcagatccgacagttatttccaaagttcgccgacacccctatctataatgatgaggcagatccattagtgggttggagcttgcctcagccctggcgagccgacgtgacctatgccgccatggtggttaaggttatcgcccagcaccagaatctactactagctaatactacctcagcttttccctacgctctgctctcaaacgacaacgcctttctaagttaccacccacacccttttgctcagagaacattgaccgcccgcttccaggtgaacaacactcgccctcctcacgtgcagttactacgcaagcctgtcctcaccgctatgggtctactggctctgctcgacgaggagcaactgtgggcagaagtgagccaggctggcacagtgctagacagcaaccacactgttggtgtgctcgctagcgcccatagaccacaggggcctgccgatgcctggagagctgccgtcctgatttatgcaagcgatgatacccgtgctcatcccaataggagtgtggccgtgaccctgcgactccgcggcgtgcctcctgggcccggactggtgtacgtgaccagatatctggataatggcctatgctctccagatggggagtggcgaagactgggcagaccagtgtttccaaccgccgaacagttccggcggatgcgcgcagccgaagacccagttgccgctgcccctagaccactgccagctggcggcagactaaccctgaggcctgctttaagactgccatccctgctcttagttcacgtgtgtgctcggcccgagaagcctccagggcaggttacccggctgagggcactacctctcacccaaggccagctcgttttagtatggagtgatgagcacgtgggttccaagtgcctatggacatatgaaattcagttctcccaagacgggaaggcctataccccggttagccgtaagccaagcactttcaacctgtttgtgttttctcctgatactggcgccgtatccggctcttacagagttcgggccctggactactgggcccgaccaggccccttcagcgaccctgtgccctatctggaggttccagtgcccaggggccctccttcccctggcaatcca

SEQ ID NO: 13865 - DNA, 1959 bp, Artificial Sequence
  Description of Artificial Sequence: Synthetic coding sequence
atgagaccgctgcgcccacgagctgccctcctggctcttttggccagtctgctggcagcaccccctgtggcccccgccgaggccccccacttggtacacgttgacgcagcccgagcgctctggccacttagaaggttttggcgtagtaccggcttctgtcctcctctgccccatagccaggccgatcagtacgtactgagctgggaccagcagttgaatctggcctatgtgggcgctgttcctcacagggggatcaaacaggtgaggacccattggcttcttgaacttgtgacaactcgaggctctaccggaaggggcctgtcctacaatttcacacatctcgacggctatctggatctcctacgagaaaaccaactcttgcctgggttcgagctgatgggttcagccagcggacactttactgactttgaggacaagcagcaagtgttcgaatggaaagatctagtgtccagccttgcgcggcgttacattgggagatacggcttggcacacgtgtctaagtggaattttgaaacgtggaatgagcctgaccaccacgacttcgataatgtgtctatgaccatgcaagggttccttaactattatgacgcctgttccgagggcctcagggctgccagcccagcactgaggctaggcggaccaggggactctttccatacccctccaagatctccactgtcctgggggcttctgcggcactgtcacgacggaacaaacttctttactggtgaagccggagtgcgactcgattacattagcctacacaggaagggcgcccgaagctccatcagtatcctagagcaggagaaggtcgtcgcacaacagataaggcagctcttccccaaattcgccgacaccccaatatataatgacgaagcggatcctctggtgggatggtcccttcctcaaccctggagggcagatgtaacttatgccgccatggtggtcaaggtgatcgcccaacaccagaatctgcttctggcaaacaccactagtgcctttccatatgctttgctttcaaacgataatgcattcctgtcgtatcatccccaccctttcgcacagcgtacactgactgccagattccaggtgaacaatacccgacctccacacgtgcagctgctcagaaaaccagtcttgactgccatgggccttttagccctgttggacgaggagcagctctgggcagaggtctctcaggctggaaccgtactcgactctaaccacactgtgggagtacttgcgtccgctcacagaccccagggccctgcggacgcatggcgggctgcagtgctaatatacgccagtgacgatacaagagcacatccgaaccggtcagttgcggtgaccttgcggttgagaggcgtacccccaggaccgggattggtttacgtcacccggtacctggataatgggttgtgttcacctgatggggaatggcggcgcctggggcgtcccgtgttcccgactgctgagcagtttcggcgcatgagggccgctgaggacccagtggctgccgcaccccgtccgcttcccgcggggggaaggctgaccctcaggcctgcccttaggcttccctcactcttactcgtgcacgtgtgtgcgcgccctgagaagcctcctggccaagtgacacgtctgcgagcattgcccctcactcaagggcagttggttctcgtctggtcagatgaacatgtgggttcgaaatgtctgtggacctatgaaatacagttctctcaggacggcaaggcatacactcctgtcagtcggaagccctccactttcaatctcttcgtattctcccccgatacgggagcagtgagcggctcatacagggtgcgtgcactggattactgggcccgtccggggccattttctgatcctgtcccatacttggaagtgccggttccccggggccccccttctccagggaacccc

SEQ ID NO: 13866 - DNA, 1959 bp, Artificial Sequence
  Description of Artificial Sequence: Synthetic coding sequence
atgagacctctgcgtcctagggccgctcttctggcactactggcctcactgctggccgctccgccagtcgcgccagctgaggccccgcatctcgtgcacgtggacgccgccagagcactgtggccacttaggcgattttggcggtccaccggattctgccctccactcccccactctcaggctgatcaatacgtactgtcgtgggaccagcagttaaatctcgcatatgtcggagctgtgcctcatagggggattaagcaggtgcgaacccattggctgctcgaactggtcactacccgtggctccactgggagaggtctgagctacaatttcactcacttggatgggtatctggaccttttacgagagaaccaactgctgcctggatttgagcttatgggctcagcctcaggccatttcacggactttgaggacaaacagcaggtgtttgagtggaaagatctggtgtctagcctggctcgacgatacatagggcgatacggcctggcccacgtcagcaagtggaactttgagacatggaatgagccagatcaccatgattttgataatgttagcatgactatgcaaggattcctgaactattacgacgcctgctcagaggggctgcgggccgccagccctgctctgagactgggagggccaggtgattccttccacaccccaccacgttctcctctctcttggggcctgctgagacattgccacgacggcacaaatttctttactggcgaggctggggtgagacttgactacatttcccttcataggaagggcgcccgaagtagcatcagcatccttgagcaagaaaaggttgtggcacagcaaattcgacagctattcccgaaatttgccgatacacctatatataatgatgaggcagatccactggttggatggtctctacctcagccatggagggctgacgtgacatatgcggccatggtggtgaaggtgatcgcacagcatcaaaaccttttgttggctaatacgacgtctgccttcccatacgcactgcttagtaacgacaatgccttcctatcgtatcacccccacccattcgcccagaggactctaaccgcacgatttcaggttaacaatacgcgcccgccccatgtgcaactgctccgaaagcctgttttgacagccatgggattactggcgctgctagatgaagaacagctgtgggcggaggtgtcacaggctggaaccgtgctggactccaatcataccgtgggtgtattggcctcagcacataggccacaaggccccgcagacgcatggagagctgccgtgctgatttatgcatcagatgatacccgagcacaccctaacagatccgtggctgttacgctgcgccttagaggagtgccccccggcccaggactagtctatgtaactagatatctagacaatgggttgtgtagtcccgacggcgagtggagacgtctgggacgtcctgtgttccctacagcagagcagttcaggagaatgcgtgcggctgaagatcccgtggcggccgctcctagacccctgccagcaggcggccgactgactctgcgaccagccttgaggttgccgtctctccttctggtacacgtgtgcgctaggccagagaagccccctggacaggttactagattgagggccctgcctctgacacagggccagctggtgctggtgtggtcggacgagcacgttggctcaaagtgcctgtggacctatgaaatccagttctcacaggacggcaaagcctacactcccgtgtcaagaaagccatccacatttaatttattcgttttttcacccgacactggggccgtctccggatcctacagagtgcgagctctcgactactgggcacgacctggtcctttctcagatccagtaccctacctggaggtccctgtacctcgtgggccaccctcccccgggaatccc

SEQ ID NO: 13867 - DNA, 1959 bp, Artificial Sequence
  Description of Artificial Sequence: Synthetic coding sequence
atgcgacctttgcgccctcgggcagccctccttgctctgctcgcgtcgctgctggcggccccaccagtcgcgccggccgaggcaccacacctggtgcatgtggacgccgcccgggccctgtggccactccgcagattttggagaagcactggattctgcccacctctcccgcactcccaggccgaccagtacgtgttgtcctgggaccaacagctgaatctcgcctacgtgggtgcagtcccccaccgcggtatcaagcaggtgcggacccattggttgctcgagctcgtgaccaccaggggcagcactggccgcggactgtcctacaatttcactcacctcgatggttacctggacctccttcgcgaaaatcaactgctgccgggcttcgagctgatgggatctgcatcaggacacttcactgatttcgaggataagcaacaagttttcgaatggaaggacctcgtctcgtccctcgcaagaagatacatcggccggtacggactggcgcacgtctccaagtggaacttcgaaacctggaacgaaccggatcaccatgatttcgataacgtttcaatgactatgcaaggatttctgaactattacgatgcctgtagcgagggcttgagagccgcatcccccgcgctgaggcttggaggaccaggagactcgttccatacccctcctcgctcgccactctcgtggggactgctgcggcactgtcatgacggcaccaatttctttacgggggaagccggtgtgaggctcgactacatcagcctgcaccggaagggggcgcgttcctccatcagcattctcgaacaagaaaaagtggtggcccagcaaattcgccagctgttcccgaagttcgcggacacccctatctataatgacgaggccgatccgttggtcggatggtcgctcccgcagccgtggcgcgctgacgtcacttacgccgcgatggtggttaaggtgatcgctcagcaccagaacttgctgttggctaataccacctccgccttcccatacgcgctcctgtcaaacgataacgcattcctgtcctaccacccgcacccattcgcgcagagaaccctcaccgcgagattccaggtcaacaacacccggcccccgcatgtacagctgctgcgcaagcctgtgctgactgctatgggtcttttggccctgctggacgaagaacagctgtgggccgaggtgagccaggcaggaacggtgctggactcaaaccacactgtgggagtcctcgcttcagcgcatcggccgcaaggaccggccgacgcctggcgggcagccgtgctgatctacgcttcagacgatactagagcgcatcccaaccggtcggtcgccgtgactctgcggctcaggggcgtgcccccgggaccggggctggtctacgtgacccgctacctggacaacggtctttgctcgcccgacggggagtggcgaaggttgggacgccctgtctttccaactgcagaacaattccgccgtatgcgcgctgctgaagatccggtcgcagccgcgccgcggccactgcctgctggagggcgcctgactctgaggccggcgctgcgcctgccttcactgcttctcgtgcatgtgtgcgctcggccggaaaaaccgccaggccaggtgacccggcttcgcgccctgccactgacccagggccagctggtgctggtgtggagcgatgagcacgtggggagcaaatgcctttggacgtacgaaatccaattttcgcaggacggaaaggcatacacgcccgtgagccgcaaaccatccacttttaacctcttcgtgttctctcctgacaccggagcagtgagtggatcatacagggtcagagccctcgactactgggccagacctggaccgttttcggatccggtgccgtatctcgaggtgcccgtcccgcggggcccgccgtcgccgggcaatcca

SEQ ID NO: 13868 - DNA, 1959 bp, Artificial Sequence
  Description of Artificial Sequence: Synthetic coding sequence
atgcggcccctgagaccccgagccgcactgttagccctgttagctagccttttagcagctcccccagtcgctcctgctgaggctccacatctggtgcatgtggatgctgcacgggcactgtggcctttgcggaggttctggcgtagtaccggcttttgcccccccctgccccactcacaagcagatcaatacgtgcttagttgggaccagcagctgaacttagcatacgtcggggctgtgccacaccggggaataaagcaggtcaggacccattggcttctggagttggtgaccacacgcgggagcacaggacgtggcctctcttacaattttacacatttagatggctacttagacctgttgagagaaaaccaattgcttcccgggttcgagctgatgggctccgcaagcggacacttcacagattttgaggataaacagcaagtgttcgagtggaaagacctggtctcatctttggctcggcgatacatcggtagatatggccttgcacacgtcagcaaatggaacttcgagacctggaacgagcccgatcatcacgacttcgataacgtcagcatgacaatgcagggttttctgaattactacgacgcttgttctgaaggtcttagagctgcttctcctgcattgcggcttggcggcccgggggacagcttccacacaccaccaaggagcccacttagctggggtctgttgagacactgccatgatgggacgaactttttcactggcgaggccggcgtcagactggattacatctcactgcacagaaagggcgcacgctcatccatttcgattctggaacaggaaaaagtggtggcccagcaaattaggcagcttttccccaaattcgctgacacaccaatatataacgacgaggctgacccactggtgggatggagcctgccacaaccctggagggcagatgtgacgtacgctgctatggtcgtaaaagtcatcgcacagcatcagaatttgctccttgctaacactacatccgcctttccttacgcactcctgagcaacgataacgcattcctctcttaccaccctcacccttttgctcagagaacactgactgcgcgctttcaggtgaacaatacaagacctccacacgtccaacttttgaggaagccagtgctgactgccatgggactgcttgctttgttagacgaagagcagttgtgggctgaggtctcacaggctggtaccgttctcgacagcaaccacactgtgggcgtgctggcatccgctcatcgccctcaggggccagcggacgcctggcgcgctgcagtgctcatttatgccagcgacgatacaagggcgcaccccaaccggagcgtggctgtgacccttagactgaggggcgtacctcctggccccgggctcgtttacgtcacccgatatcttgacaatggcttgtgcagtcctgatggcgagtggagacgactggggagacctgtgtttcctacagcagaacaatttaggaggatgcgtgccgccgaggacccggtggcggcggcgccccgccctctgcctgccggaggccgcctcacactcagaccagcgctgcggctgccgtcgttgttgctggtgcatgtctgcgctcgccccgagaaaccaccaggacaggtcactcgacttcgcgctctccctctgactcaaggacaactggtgctggtctggtcagacgagcatgttggatcaaagtgtctttggacctacgagatccaatttagccaggatggcaaagcatacacacccgtatcaagaaagccctctacattcaacctgtttgtattttcacctgatactggagccgttagtggatcctaccgcgtaagggcattggactattgggctagacccggacctttttcagaccccgtcccgtacctcgaggtgcctgttcctcgtggtcctccaagccccggcaaccca

SEQ ID NO: 13869 - DNA, 1959 bp, Artificial Sequence
  Description of Artificial Sequence: Synthetic coding sequence
atgcgtcccctccggccgagagcggccctgctggcccttctcgcgtcgctcctggccgctccaccggtcgcgccggccgaggcgcctcatctggtccacgtcgacgccgcgcgcgcactgtggccgctgcggcgcttttggcggtcaactggtttttgcccgccgctgccgcactcccaggccgaccagtacgtgctttcctgggaccagcagttgaatttggcttacgtgggagctgtgccgcataggggaatcaagcaggtccggacccactggctgcttgagctggtcactaccagaggctcaaccgggcgcggcctctcgtacaacttcacgcacctcgatggatacctcgacctcctgagggaaaaccagttgctgccaggattcgaactgatgggatcagcgtccggacacttcactgatttcgaggacaagcaacaagtgtttgagtggaaggacctcgtctcaagcctggctcgccggtacatcggccgctacggactggctcatgtgagcaaatggaatttcgaaacctggaatgaacccgaccatcatgacttcgacaacgtgtcgatgactatgcagggcttcctgaattactacgacgcttgctcagaaggattgcgtgcagcctctccggctctgcgcctgggtggaccgggagattcgttccacacccctccccgctcccctctgtcttggggactgctgcgccattgccatgatggaaccaatttcttcaccggcgaggcaggagtgcgcctggattacatctccctccacagaaaaggagcacggtcctccatctcgatcttggagcaggaaaaggtcgtggcacagcagatcaggcaactgttccctaagttcgcggatacccctatatacaacgacgaggccgaccccctcgtggggtggagcctgccgcagccgtggcgggctgacgtgacctacgccgcaatggttgtcaaagtgattgcgcagcaccagaacctgctcctcgcgaacaccacgtccgcattcccatacgctcttctctcgaatgacaacgcgttcctgtcctatcatccccacccgttcgctcaacgcactctgactgcccggtttcaggtcaacaacactcgaccgccccacgttcagctgctccgcaagcctgtgctgaccgctatgggactcctcgcactgttggatgaagaacaactgtgggccgaggtgagccaagcgggcaccgtgctcgactcgaatcacaccgtgggagtgctggcctcggcccatagaccacagggcccggccgatgcttggcgcgccgcggtgctcatatacgcctctgatgatactagggctcaccctaacagatccgtggccgtcactctgcgcctgcggggagtcccgccagggcccgggcttgtctacgtaacccgctatctcgacaacggcctgtgtagcccggacggggagtggcgccggctcggacggccggtctttcctactgccgaacagttccgtaggatgagggcagcagaagatccagtggccgcagcgccgcgcccattgcctgcgggaggccggctcactcttcggcctgccctgcgtctgccatccctgttgctggttcacgtctgtgcccgacctgaaaagccacctggtcaagtgaccagactcagggccctgccactcactcaaggtcaacttgtacttgtgtggtcggatgagcacgtgggatcaaagtgcttgtggacttacgaaatccaattctctcaagacggtaaagcctatacgccggtgtcccgcaagccatccaccttcaacctcttcgtgttttcacccgacacgggggccgtgtcaggaagctacagagtgagggcgttggattactgggcaagaccaggtccattttcagacccagtgccgtacctggaagtgccggtcccgcgggggcctccgtctccaggtaacccg

SEQ ID NO: 13870 - DNA, 1959 bp, Artificial Sequence
  Description of Artificial Sequence: Synthetic coding sequence
atgcggccgctccgtcctcgggctgctctgctggcacttcttgcctcattgcttgccgcaccgccggtggcgccagctgaggcaccacatttggtgcacgtggatgcagcacgagccctgtggccactccggcggttttggcgctcgaccggattctgtcctccacttccccattcgcaagccgaccaatacgtcttgtcctgggatcagcagctgaacctggcctacgtgggagccgtgccacacaggggcatcaagcaagtgcgcactcattggcttcttgagctggtgactactcgggggtccacgggacgcgggctgtcctacaactttacccacctggacgggtatctggatctgctgagagaaaatcaactgctgcctggatttgagctgatgggatcagctagcggacacttcactgactttgaagataaacagcaagttttcgaatggaaggatctcgtctcctcactcgcccggcgttacattggaagatacgggcttgcacatgtgtccaaatggaattttgaaacttggaacgaaccggaccatcacgactttgataatgtgagcatgaccatgcagggcttcctgaattactatgatgcctgctcagaaggcctgcgcgccgcatcacctgcacttaggcttggcggtccgggagacagctttcataccccacctagatcccctctcagctggggccttcttaggcattgtcacgacggaaccaacttcttcactggagaagcaggtgtgcgtcttgattacatttcgcttcatcgcaagggcgcaagatcctcaatttctatactggagcaggagaaggtggttgcacagcaaatccggcaacttttcccaaaattcgcggacactccaatctacaacgacgaggcagatcctctcgtcggttggtcgctgccccagccttggcgtgccgacgtcacctacgcggcgatggtggtcaaagtgatagcacaacaccagaatcttctgctggcaaacaccactagcgctttcccatacgccctcctgtccaacgataatgcattcctgtcttaccatcctcatccttttgcacagagaaccctgactgcaagatttcaagtgaacaacacccgcccacctcacgtgcagcttctgagaaagcccgttctgaccgcaatgggcctccttgcgctccttgacgaagaacagctctgggcagaagtttcacaagcagggaccgtccttgattcgaaccatactgtgggcgtcctcgcatcggcgcatagacctcagggtcccgccgatgcctggcgagccgcagtgctgatttacgcatcggatgacacgcgcgcccatccgaatcgctcggtggccgtgactcttcggctcaggggagtcccacctggaccaggactggtgtacgtcaccagataccttgacaacggcctttgcagccctgatggggaatggagacgcttggggcgacctgtgtttcccaccgccgaacagtttcgtcgtatgcgtgctgcagaggatccggtcgcagctgcacccagaccgctgccagctggaggacgactgaccctcagaccggcgcttagattgccttcgctgttgctggtgcatgtctgtgcaagaccagaaaagccaccaggtcaagtcacccggcttagggctcttcctcttacccaaggacaactggttctggtctggtccgatgaacatgtcggctccaagtgtctgtggacttatgagatccagttttcacaagatggaaaggcatacacgcctgtctcgaggaagccgtcgacttttaacctgtttgttttttcgcctgatactggggcggtgtcaggatcgtaccgcgtgcgcgctctggattactgggcaagaccaggtccgtttagcgatccagtgccctatctggaggtgccggtgcccaggggtccgccttctcctggtaatcct

SEQ ID NO: 13871 - DNA, 1959 bp, Artificial Sequence
  Description of Artificial Sequence: Synthetic coding sequence
atgcggccactcagaccacgggctgctctcttggcccttctcgcctcgctgttggccgccccaccggtggcacctgcggaagcaccgcatctcgtacacgtggacgccgctcgagccctctggccacttcgaaggttctggcgctcgactggattctgcccgccactgccgcacagccaagccgatcagtacgtgctgagctgggatcaacagctgaatctggcttacgttggtgccgtgccccaccgtggaatcaagcaggtgcgcacgcactggctcctggagctcgtgaccactcgcggatcaactggtcgaggactgtcgtacaactttacccatttggacggctacctcgatctgttgagagaaaatcaacttctcccgggttttgagcttatgggctccgcgagcggacatttcacggatttcgaggacaaacagcaagtgtttgaatggaaagatctcgtcagctctctcgccagaaggtatatcgggaggtacggactcgcgcacgtgtctaaatggaacttcgaaacttggaacgaacctgatcaccacgactttgacaatgtgtcgatgaccatgcaaggattcctcaactactatgatgcctgcagcgaagggctgagagccgcgtcaccggctctcagactggggggtcctggtgactcgtttcacactcctccgaggagcccactgtcgtggggcctgctccggcattgtcacgatggtaccaatttcttcaccggtgaggcaggagtccgccttgactacatctcattgcaccgaaagggtgcacgttcctctatcagcatcctcgagcaggagaaggtcgtggcgcagcagatcagacaactgttcccgaagttcgccgacactcctatctacaatgacgaagccgaccctttggtggggtggtcgttgccgcagccatggcgcgctgacgtcacttacgcagcgatggtggtgaaggtgatcgcgcaacaccagaatctgcttctcgccaacactaccagcgcctttccatacgcccttctgagcaacgataacgctttcttgtcttaccacccgcatcctttcgcgcaaagaactctgactgcccggttccaggtgaacaacacccggccgccgcatgtgcagctcctgcggaagcctgtgctgaccgcaatgggactgctggcccttctggacgaagagcaactttgggcggaagtctcacaggctggaactgttctcgatagcaaccacacggtgggggttctggcatccgcacatcggcctcagggtccggctgacgcgtggcgcgccgctgtgctgatttacgcctcggatgacacccgggcacaccctaaccggtcagtggcagtcaccctgcggctgcgaggagtccctccgggcccaggactggtttacgtgacccggtacttggacaatggcctttgctcaccagacggtgaatggcggaggcttggtaggccagtgttcccaaccgccgagcaattccggcgcatgcgcgccgcagaggaccctgtggccgcggccccgcgcccgctgccggcgggaggaaggctgaccctcagacctgcactgagactcccgtcactgctgctggtgcatgtgtgcgcccgccccgagaagccgccaggacaggtcactcgccttagggctctgcccctgacccaaggccagctggtcctcgtgtggagcgatgagcatgtgggctccaaatgtctctggacttatgaaattcagttctcgcaggatgggaaggcgtacactccggtgtcccggaagcctagcacgttcaacctctttgtgttttcccccgacaccggtgcggtgtcagggtcgtaccgggtacgggccctcgactactgggcgcgcccgggaccattctcggatccggtgccttatctggaagtgcccgtgccgcgcggcccgccgtccccaggtaatccc

SEQ ID NO: 13872 - DNA, 1959 bp, Artificial Sequence
  Description of Artificial Sequence: Synthetic coding sequence
atgcgaccgcttcgcccaagggctgcccttcttgccctcctagctagtttgctcgcggccccaccagttgctccagcagaagcaccacatttggttcatgtcgatgctgcccgtgcgttgtggcctcttagaagattctggcgttcaaccggattctgcccaccacttccgcacagtcaggctgatcaatacgtgctcagctgggaccaacagcttaatcttgcatacgtgggagcagttccacatcgtggaattaagcaagttcgaacccattggcttctggaactggtcaccactagaggttccacaggtcgaggattatcttataactttactcacttagatggatacttggatttattgcgagagaatcaactcctgccaggattcgagctgatggggtcagctagcggacattttaccgactttgaggacaagcaacaagttttcgagtggaaggatctcgtctccagtctagcccgtagatatatcggtaggtatggacttgcgcacgttagcaaatggaattttgaaacctggaacgagccagatcatcatgatttcgataacgtttccatgacaatgcagggtttcttgaattattatgacgcgtgctcggaaggactgcgagcggcctccccagccctcagactcggcgggccaggggattccttccacactccgccacggtcaccgctctcatgggggctgcttcgtcattgccacgatggaacgaacttcttcacaggggaggcgggagtaaggctcgattacatctcactccatcgtaagggagctcgctcaagtatttcgatactggagcaagaaaaggttgtagcacaacaaattcgacaacttttcccaaaattcgccgatactccaatatataatgatgaagctgacccattggtcggctggagtttgccacaaccctggcgtgcagatgtaacatatgccgctatggttgtaaaggtaattgcacaacaccaaaatttgttactagctaatacgacgtctgccttcccatatgcacttctttcgaatgacaacgcttttctgtcgtatcacccgcatccatttgctcaacgtacactcaccgccagattccaagtaaacaacacccgccccccacacgtccagctactacggaaacctgtactcacagctatgggactacttgctcttcttgatgaagaacagctttgggccgaggtctcacaagcgggaacagtcttggattcgaaccacactgttggtgttttagcctccgctcatagaccacaagggccggcagacgcatggagagcggctgttctcatttacgcaagcgacgataccagagcgcatccgaatcgttcagtcgctgtaacactgcgtttgcgaggagtacctccgggtcccggacttgtttacgtcacacgatacttggataatggtctgtgcagtccggacggagagtggcggcgactgggaagaccagtcttcccaaccgctgaacaatttcgtcggatgcgagctgccgaagacccggtcgcggccgcacctagaccccttcctgctggcggacgacttaccctacgacctgctttgcgactgccatctcttttacttgtccacgtatgtgctcgtccggaaaaaccaccgggccaagtaactagactgcgcgcattaccactaacacagggacaattggttctcgtgtggtcggatgaacacgttggatctaaatgtctgtggacgtacgaaatccagttctcacaagacggaaaagcatacacaccagtttcgcgaaagcccagcactttcaatctcttcgtttttagtccagataccggagcagtctcaggaagctatcgcgttagggcccttgattattgggcgaggccaggaccattctccgatccagttccttatttggaggtcccagttcctcgaggaccgccaagtcctgggaatcct

SEQ ID NO: 13873 - DNA, 1959 bp, Artificial Sequence
  Description of Artificial Sequence: Synthetic coding sequence
atgaggccactcaggccaagagcagcgcttctcgccctgctggcatccttattggctgctcctcccgtggcccccgccgaggcgccccatcttgtgcatgtggacgcggcccgcgcactgtggcccctgaggcgcttctggagatctaccggcttctgccctcccctgccccactcgcaagctgaccagtatgtgctcagttgggaccagcaactgaacttggcatacgtgggagccgtccctcacaggggcataaagcaggtaagaacacactggctgttagagctggtgaccacacggggaagcaccggtcgtgggttaagctacaattttacgcacctcgatggctacttggatttgctgagggaaaatcagctcctgccaggctttgagctgatgggcagcgcctctggacacttcaccgacttcgaggataagcagcaggtctttgagtggaaagatttggtgtcaagccttgcacgccgctatattgggcggtacgggttagcacatgtgtcaaaatggaactttgagacctggaacgagccggatcatcacgacttcgataatgtgtccatgacaatgcagggatttctgaattactacgatgcatgcagtgaaggactgcgagccgccagcccggctctcaggttgggcggcccaggcgactccttccacacacctccaagaagccctctgagctggggcctgctgcggcactgccacgacggcacaaacttctttaccggagaggccggcgttaggttagattacatatcacttcacaggaaaggcgctcggtcatcaattagcatcctggagcaggaaaaagtcgtcgcccagcagattagacagctgtttcctaagttcgctgatacacccatctataatgatgaggcagatccactcgtcggatggtcactcccacagccctggagagccgacgtgacgtatgcagcgatggtggttaaagttattgcacaacaccagaacctcctgttggcaaacactacctccgcatttccatatgctttgctgtccaacgataacgcatttctgagctaccatccccatccatttgctcagagaacactcactgccagatttcaggtgaacaatacccgacctccacacgtacaacttctcagaaagccagtcctcacagccatggggctgctcgcgctgttagatgaggagcagttatgggcagaggtgtctcaggcagggactgtccttgattctaaccacacagtaggtgtcctggcctctgcacacagacctcagggccctgccgacgcgtggagagctgccgtgctaatttacgcttctgacgatacccgtgcgcatccgaatcgtagcgtcgccgtgaccctccggctcagaggggtgccccccggccctggcctggtgtatgtgactcgatatctggacaacggactgtgcagcccggatggtgaatggcggaggttgggcaggccagtgtttcctacagccgagcaatttcggcgaatgagagctgccgaagaccccgtagccgccgcgccaaggccgctgccagcaggaggcagactcacactgcgacctgcgctacgattaccctctctcctcctcgtacacgtgtgcgcacgcccggagaagcctcccggacaggtgaccagattgcgtgcactccctctgacacagggacagctggtactcgtctggtccgatgagcacgtgggctccaaatgtttgtggacctacgaaatccagtttagccaagacggtaaagcctacacacccgtgtccagaaagccctctacctttaatctgtttgtctttagtccagacacaggcgccgtgtcgggttcatatagagttcgcgccctggactactgggcccgaccagggcctttctctgaccctgtgccctatctggaggtccccgtccctcggggccccccgagcccgggcaatccc

SEQ ID NO: 13874 - DNA, 1959 bp, Artificial Sequence
  Description of Artificial Sequence: Synthetic coding sequence
atgcgcccgctccggccaagagcagcccttctcgcattgcttgcatcgcttctggccgcaccaccggtggctcctgcagaggcacctcatctggtccatgtggatgcggcaagggccctgtggcctctgcgccgattctggagatccactggcttctgtccccctctgcctcatagccaggcggaccagtacgtgctttcgtgggatcaacagcttaacctggcctacgtcggggctgtgccgcaccggggcattaagcaggtgagaacccattggctgcttgaactggtgacgacgcgcggctccactggaagaggcctgtcgtacaactttacgcatcttgacggctacctggacctgctgcgggaaaaccagctgctgcccgggtttgaactgatgggcagcgcatccggacactttactgactttgaggacaaacaacaagtgtttgaatggaaagacctggtgtcctccctcgctcgacgatacatcggcagatacggactggctcatgtgtcgaaatggaactttgagacttggaatgaaccggaccaccatgactttgataatgtatcgatgaccatgcaggggtttctgaactactacgacgcctgctcagaaggtcttagagcagcaagccctgcactcaggctgggaggtcctggtgattcattccacactccgcctagatctcctctgagctgggggctgctccgacactgccatgacggaaccaactttttcaccggcgaagcaggggtcagacttgattacattagcctgcaccggaagggtgctcgcagctcaatttcgatcctcgagcaggagaaggtcgttgcacaacagatccgtcagctcttccctaagttcgcggatacgcctatttacaacgacgaagccgatccgcttgttggatggtcactcccccaaccctggcgcgccgacgtgacttacgcagccatggtggtgaaggtaattgcacaacaccagaatctgctgctcgccaataccacctcagcatttccttacgccctcctgtcgaacgataatgcattcctgtcctaccatccccacccttttgcacaacgaaccttgactgcccggttccaggtcaacaacaccagaccaccgcacgtgcaacttcttcggaagcccgtcctcactgcaatgggtttgctggcccttcttgatgaagaacagctgtgggcagaggtgtcccaagccgggacggtgcttgacagcaaccacaccgtgggtgtcctcgcatcagcacaccgcccccagggtccagctgatgcctggagggcagccgtgctcatttatgcctcagatgacactagggcacatcctaataggtcggtcgccgtcactctgaggctcaggggtgtgcctcctggtcctggactcgtgtacgtgacgcgctacttggacaacggactttgtagccccgatggcgaatggagaaggcttggacgcccagtgtttcctaccgccgagcaatttcgacgcatgagggcggccgaagatccagtcgcagcggcacctcgaccactccccgcggggggcagactgactctgcgtccagcccttaggcttccttcgcttttgttggtgcatgtctgtgcgaggcccgagaagcctcccggccaagtgacccgacttcgtgccctgcctctcacccagggtcagctcgtcctggtgtggtccgatgaacatgtgggatccaaatgtctctggacctacgagattcagttctcccaagatgggaaggcttacactccggtgtcgagaaagccctccacctttaatctcttcgtgttctcaccagatacgggtgcagtctcgggttcgtacagagtcagggcgctggattactgggcccgtcctggaccattttcagacccagtgccgtacttggaggtgccggtgcctcggggtcctccctcacctggaaaccct

SEQ ID NO: 13875 - DNA, 1959 bp, Artificial Sequence
  Description of Artificial Sequence: Synthetic coding sequence
atgcgtccactgagaccgagagccgcactgttagcacttcttgcctctttactggccgcgcctccagtagctcccgccgaggccccccacctagtccatgtagacgccgcccgcgcactgtggcctttgaggcgcttctggagatctaccggtttctgtccgccgcttcctcatagccaagcagaccagtacgtgctgtcctgggatcaacagttgaacctcgcttatgttggcgcggtcccccataggggaatcaaacaggtgcgaactcactggctgctggagctggtaactacgagggggtcgactgggagaggcctgtcctacaatttcacccacctggatggatatctcgacctgttgcgcgagaaccagttgctgcccgggttcgaacttatgggatccgcatcgggtcactttacggacttcgaagataagcaacaggtctttgaatggaaagacctggtgtccagcctcgcccgcagatacatcgggcggtatggactcgcacacgttagcaaatggaatttcgagacttggaatgagcccgaccatcacgacttcgacaatgtgtctatgaccatgcaggggtttctgaattactatgatgcttgctctgagggtctgagagcggcctcccccgcgctgcgtttgggcggccccggagattcattccacactcctcctaggtcacccctgtcttgggggctgctgaggcactgtcatgatggcactaatttcttcacaggtgaagccggagtccggttggactacatcagcctgcatcgcaagggcgcgcggtcaagtatttctatcctcgagcaggagaaagtggttgcccagcaaattcgtcagctgttcccaaaattcgcagacacccctatctataacgatgaggcggacccgctggtcgggtggtccctgccccaaccatggcgcgccgatgtgacatatgccgccatggtggtgaaagtcatcgcccagcaccaaaacctcctattggccaacacaacatccgccttcccctacgccctgctgtctaacgacaatgctttcctcagctatcaccctcacccttttgctcagcgcacactgacggcgcgatttcaggtaaacaatacacgaccgccacatgtgcaactgctgcggaagcctgtgttgaccgcgatgggcctgctggccttgctcgacgaggaacagctgtgggcagaagtctcccaggctgggaccgtgctggactctaaccacactgtgggtgtcttggcaagcgcccatcgccctcagggccccgcagacgcatggagggcagctgtcctgatctatgcctccgacgacacacgtgcccatcctaatcgctctgtggcagtgactctcaggctgaggggcgtgcctcccggcccaggtctggtgtatgtcacgcgctacttggataatggactctgcagcccagatggcgagtggagaaggctcggacggcccgttttcccaaccgccgaacagttcaggcgtatgagagctgccgaggaccccgttgccgccgcccccagacctctgccagccggcggacggcttacgctgagacccgcactccgactcccgtccctccttctggttcacgtctgcgccagacccgaaaaaccccccggccaggtaacacgcctcagggcactgccacttactcaggggcaactggtgctggtgtggtctgatgagcacgtggggagtaaatgtctgtggacctatgagattcagttctctcaggatgggaaggcgtacacccctgttagtcgaaagccctccacattcaatctgttcgtctttagccctgacactggagctgtgagcgggtcctatcgggttcgcgccttagactactgggcacgcccaggtcccttttccgaccccgtgccctacctggaggtgcctgtacctcggggcccccctagccctggcaaccct

SEQ ID NO: 13876 - DNA, 1959 bp, Artificial Sequence
  Description of Artificial Sequence: Synthetic coding sequence
atgagaccgttgcggccacgtgctgccttacttgctctgcttgcttctctgctggccgctcctccggttgccccagctgaggctccacaccttgtgcatgttgatgctgctcgtgccctgtggccacttagacgtttctggaggtcaaccggattctgcccaccacttcctcattcccaggcagatcagtacgtcttgagttgggaccaacagctgaacctcgcttatgttggtgcagtgcctcatcgcgggataaaacaagttagaacccattggcttcttgagctggtgacaactcgtggaagtactggcagaggccttagctataatttcactcaccttgatggctacctcgatctccttcgtgagaaccaactgttgcctggatttgaactgatgggttccgctagtggtcactttactgatttcgaagataagcagcaagttttcgagtggaaggatcttgtctcttcacttgctaggaggtacatcggacgctatggtctcgcacatgttagcaaatggaattttgagacttggaacgaacctgatcatcacgatttcgataacgtctcaatgacaatgcaaggattccttaattattacgatgcctgttctgagggattgagggcagcgagccctgctctgcgtttgggggggcctggtgatagttttcatactcctccccgatcccccctgtcatggggattgttaagacattgtcatgatggtacaaactttttcactggtgaggcgggcgtcagattagactacatctctctacacaggaagggtgcaagatcgtctatcagcattctagagcaagagaaggtagtggcccaacaaatccgtcaactttttccaaagtttgccgatacccctatttataacgatgaggccgatcctttggtcggatggtcgcttccacaaccctggcgagcagatgttacgtacgcagctatggtagtaaaggtgatagcccaacatcaaaaccttttgttggccaatacgactagcgctttcccatatgccttgctctcaaatgataacgcttttctctcttatcatccgcatccattcgctcaaaggacccttacagcccgattccaggtaaacaatactcgaccaccccatgtccaattgctacgcaagcctgttttgactgccatgggtcttcttgctcttctcgatgaggaacaactttgggccgaggtttcccaagccggaaccgtgttagattctaaccatacagtgggtgttctcgctagcgcgcaccgtccacaagggcctgcagatgcttggcgtgctgcggtgctgatttatgctagcgatgacacaagggctcatccaaatcgatcggttgctgtgacactgcggctgcgcggcgtgccacctggtcctggccttgtctatgtaacccgatatttggataacggtctgtgctcgccagacggggagtggaggaggttaggacgtccggttttcccgacggccgagcagttccgaaggatgagagccgctgaagatccggtagctgcagctcctaggccactgcctgctgggggacgactcaccctgcgccccgctttgaggcttccttctctgctccttgttcatgtttgtgccaggccagaaaagccccccgggcaagtgacacggttgagggcccttccacttacccaaggccaactggtgctagtctggtctgacgagcatgttggctctaaatgtctttggacatacgaaatacagtttagccaggatggaaaagcttatacaccagtgtcaaggaagccatccacgtttaatttatttgtcttcagtccagatacaggtgctgtctccggtagctatagggtgagggctctggattactgggcccgtccaggccctttttccgatccagttccgtatcttgaggttccagtcccaagaggcccgccttctcctggaaatccc

SEQ ID NO: 13877 - DNA, 1959 bp, Artificial Sequence
  Description of Artificial Sequence: Synthetic coding sequence
atgcgcccactcagaccgcgtgccgctctccttgcgctgctcgcatcactccttgctgcaccgccagtcgcgcccgctgaagctccgcacctggtgcacgtggacgccgcccgcgcactttggccgctgcggcgattctggcgctccactggattctgtccgcccctgcctcacagccaggccgaccaatacgtgttgtcctgggaccaacaactgaatctcgcgtacgtgggagcggtgccgcatagaggaattaagcaggtgcgcacccattggttgctggaattggtcactacccggggttctaccggacgcggactgtcttacaatttcacccatcttgatgggtatctggacctcctgcgcgagaatcagttgctgcctggattcgaactgatgggctccgcgtcaggacacttcactgatttcgaggacaagcagcaggtgtttgaatggaaagacctcgtgagctctctcgcgcgccgatacatcggccgctacggattggcgcacgtgagcaagtggaacttcgaaacttggaacgaacccgaccaccacgacttcgacaatgtgagcatgaccatgcaaggattcctcaactattacgatgcctgtagtgagggactgcgggccgccagtccggccctcagactcgggggccctggcgactccttccacactccaccccggagccctctgtcatggggtctgctgcggcattgccacgatggtacgaacttcttcaccggagaggccggagtcagactcgattacatctccttgcatcgcaaaggcgcccggtcgtccatctcgatcctggagcaagaaaaggtcgtggcgcagcaaatcaggcagctcttcccgaaatttgcggataccccgatctacaacgacgaagccgaccctctggtgggatggtcgctcccccaaccgtggagggcagacgtcacctacgccgctatggtggtgaaggtcatcgcacagcatcaaaatctcctgctggccaatactacttccgcctttccgtacgcgctcctgtctaatgacaacgcattcttgtcataccatccgcatccgtttgcacaacggacgctgactgccagatttcaggtcaataacacccgccctccgcacgtccagctgctgaggaagcctgtgctcacggccatgggactgctcgcgctgctggacgaagagcagctgtgggcagaagtgtcgcaggccgggactgtgttggactcaaaccataccgtgggagtgcttgcgtccgcccacaggccacagggcccagctgacgcatggcgcgcagcagtgctgatttacgcatcggacgatactcgggctcaccccaaccggagcgtagcagtgaccctccggctgcgcggtgtcccaccaggtccaggactggtgtacgtgacccgttatcttgataacgggctgtgcagccctgatggggaatggcgcaggttgggtcggcccgttttcccgactgcagagcagttccgcagaatgagagcggcggaagatccagtggccgcagcaccaagaccgctgccggcaggcgggcgtctgactttgcggccggcacttaggctgccgtcgctgctgttggttcacgtgtgcgcgcgtccggagaagccaccagggcaggtgacccggcttcgggcgctcccgctgactcagggtcaactcgtgcttgtctggtcggatgaacacgttggatcaaaatgcctttggacgtacgagatccagtttagccaggacggaaaggcctacaccccggtatcgcggaagccgagcaccttcaacttgtttgtcttttcccctgacaccggcgctgtctcaggcagttaccgcgtgagagccctcgattactgggccaggccgggaccgttctcggatccagtgccatacctggaggtccccgtccctcgaggcccaccgtcgccgggaaaccct

SEQ ID NO: 13878 - DNA, 1959 bp, Artificial Sequence
  Description of Artificial Sequence: Synthetic coding sequence
atgcggccacttagacctagagctgcactgcttgcactgctggcctctctgcttgcagcgccccccgtggcacctgcggaagcaccgcacctggtgcatgtggatgcagcaagagcactctggcctctgcggcgattctggcgatccaccgggttttgtcctcctttgcctcactcgcaagccgaccaatatgttctgtcatgggatcaacaactcaaccttgcctacgtgggcgcagtgccacatcgggggatcaagcaagtcagaactcattggttgctggagctggtcacgactcgtggaagcaccggccgagggctttcgtacaactttacgcacctggatgggtacttggatcttctccgggaaaatcaacttctcccaggtttcgaactgatgggttcggcatccggccattttactgattttgaagataagcaacaggtctttgagtggaaagacttggtgtcatccctggcacggcgatatatcggtaggtacggactggcccatgtctccaaatggaacttcgagacttggaacgaaccagatcaccatgattttgataacgtgagcatgaccatgcagggttttctgaactactacgacgcttgttcagaggggctgcgggctgcatcgcctgcactgagactgggtggccccggtgactcctttcatacgccccctagatcgccgcttagctggggactgctgcgtcactgtcacgatggaactaatttcttcacgggagaagcaggtgtgagacttgattacatctcgctgcaccgaaagggcgcaagatcgtcaataagcattctggaacaggagaaagtggtggcacagcaaatccggcaactttttcccaaattcgcagatactcctatttacaatgatgaggcagacccacttgtgggttggtcccttccccaaccatggcgggcagatgtcacctacgccgcgatggtggtgaaggtcatcgctcaacatcagaaccttctgctcgcaaatactacctcggcatttccatacgctctcctttcaaacgataatgccttcttgagctaccatccacatccctttgcccaaagaacccttactgcaagattccaggtaaacaatacccgtccacctcacgtgcagctgcttcggaagcccgtgctgaccgccatgggtcttttggcactcctggacgaagagcaactttgggcagaagtctcgcaggcggggaccgtccttgacagcaaccatactgtcggtgtcttggctagcgcgcatcgcccccaggggccagctgatgcctggcgcgcagcagtgctgatttacgcatccgatgatacccgcgcccatcctaatcggtctgtggcggtcactcttcgcctgcgcggagtgcctccaggccccggacttgtctacgtgactcgctaccttgataacggactttgttcccccgacggagagtggcggcgtcttggacgaccagtctttccgacggccgaacagtttagaagaatgcgagcagcagaagatcccgtcgcagccgctccaagaccacttccagcaggaggtcgtttgacgctccgcccagcacttcggctgccatccttgctcttggtgcacgtgtgcgcgaggcccgagaagccgcccggacaagtgaccaggctgcgcgcactgcctttgactcaaggccagcttgtccttgtctggtcagacgaacatgtgggcagcaagtgcttgtggacctacgagattcaattttcccaagatggtaaggcctacaccccagtgtccagaaagccatctactttcaacctttttgtcttttcaccggataccggcgcagtgagcgggtcctacagggtccgggcgcttgattactgggcaaggcccggtccattttcagatcctgtgccttacctggaggtcccagtgcccagaggccccccaagcccaggaaatcct

SEQ ID NO: 13879 - DNA, 1959 bp, Artificial Sequence
  Description of Artificial Sequence: Synthetic coding sequence
atgcgtccgctgcgcccccgggcggccctgctggcgctgctggcctcgcttttggccgcgccgccagtggctcccgctgaggcaccgcatctggtgcacgtcgacgccgcacgggctttgtggcctctgcgacggttctggagaagcactggcttttgcccgccactgccacatagccaagcggaccaatacgtgctgtcgtgggaccaacagctgaacctcgcctatgtcggagccgtgccccatcgcggcataaaacaggtccgcactcattggctcctggaacttgtgactaccagaggctcgactggacggggactgtcctataacttcactcatctcgacggttacctggatttgcttcgggaaaaccagctgctgcctggcttcgagctgatgggctcagcctcaggacatttcacggactttgaggataaacagcaagtttttgagtggaaggatctggtgagctccctggctcggaggtacatcggacgctatggattggctcatgtgagcaagtggaacttcgaaacgtggaacgaacccgatcatcacgattttgacaacgtgtcgatgaccatgcaaggcttcctcaactactacgacgcctgttcggaaggcctccgagcggcctcgcctgccctcaggctgggtggacctggcgactcgttccacacccctcctcgctctccgctgtcatggggacttctgaggcactgtcacgacggaactaatttcttcactggagaggccggagtccgtctggattacattagcctccaccgcaaaggagcaagatcctccatttccatcctggagcaagaaaaggtagtggcccagcagatccgccagctgtttccgaagttcgcggacaccccaatttacaacgatgaggcggatccacttgtgggctggtcgctgccccagccgtggagagccgacgtcacttacgcagctatggtggtgaaggtgatcgctcagcatcagaacctcctgctcgctaataccacttccgcctttccgtacgccctgctttcgaacgataatgccttcctctcgtaccacccacaccctttcgcccagcggacgctcaccgccaggtttcaagtgaacaacacccggccgccgcacgtgcagctgcttcgcaagccggtgttgaccgcgatgggactgctcgcgctgttggatgaggagcagctgtgggctgaagtgtcacaggctggaactgtcctggactccaaccatactgtgggagtgctggcgagcgctcaccggccacaaggtccggcggatgcgtggcgagcggccgtcctgatttacgcctccgatgataccagggcgcacccgaacagatccgtcgccgtgaccctgagattgcgcggagtcccgcctggaccagggctggtctacgtgactcgatatctggacaatggtctgtgctcgccagatggggaatggcggcggctcggacgcccagtgttccctaccgcggagcagttcaggcgcatgcgcgctgccgaagatcccgtggccgccgcaccgcgtccactcccggccggggggcgcctgaccctgcgaccggcactgaggctgccgtcgctgcttctcgtccatgtgtgcgcgcgcccggagaagccaccgggccaggtcacccgcctccgcgcgctcccactgactcagggccagctggtgttggtctggtcggacgaacacgtgggatctaagtgcctctggacctacgagatccaattctctcaggacggcaaagcatacaccccggtgtcgaggaagccgtcgacgtttaatctgttcgtgttctcgccggacactggggccgtctccggatcctaccgggtgagagccttggactactgggcgcgaccggggccttttagcgacccagtgccttacttggaggtcccagtcccccgcggcccgccgtccccgggaaaccca

SEQ ID NO: 13880 - DNA, 1959 bp, Artificial Sequence
  Description of Artificial Sequence: Synthetic coding sequence
atgcgaccgttacgaccgcgagcggcgttattagcgttattagcgtcgctattagcggcgccgccggtagcgccggcggaagcgccgcatttagtacatgtagatgcggcgcgagcgttatggccgttacgacgtttttggcgttcgacgggtttttgtccgccgctaccgcattcgcaagcggatcaatatgtattatcgtgggatcaacaattaaatttagcgtatgtaggtgcggttccgcatcgtggtataaaacaagtacgaacgcattggttactagaattagttacgacgcgaggttcgacgggtcgtggtctatcgtataattttacgcatttagatggttatttagatttactacgagaaaatcaattactaccgggttttgaactaatgggttcggcgtcgggtcattttacggattttgaagataaacaacaagtatttgaatggaaagatctagtatcgtcgttagcgcgtcgatatataggtcgatatggtctagcgcatgtatcgaaatggaattttgaaacgtggaatgaaccggatcatcatgattttgataatgtttcgatgacgatgcaaggttttctaaattattatgatgcgtgttcggaaggtctacgtgcggcgtcgccggcgttacgtctaggtggtccgggtgattcgtttcatacgccgccgcgatcgccgttatcgtggggtttactacgtcattgtcatgatggtacgaatttttttacgggtgaagcgggtgtacgtctagattatatatcgttacatcgaaaaggtgcgcgttcgtcgatatcgatactagaacaagaaaaagtagtagcgcaacaaatacgtcaactatttccgaaatttgcggatacgccgatatataatgatgaagcggatccgctagtaggttggtcgctaccgcaaccgtggcgagcggatgtaacgtatgcggcgatggttgtaaaagtaatagcgcaacatcaaaatttattattagcgaatacgacgtcggcgtttccgtatgcgctactatcgaatgataatgcgtttttatcgtatcatccgcatccgtttgcgcaacgtacgttaacggcgcgttttcaagtaaataatacgcgtccgccgcatgttcaactactacgtaaaccggtactaacggcgatgggtttattagcgctattagatgaagaacaattatgggcggaagtttcgcaagcgggtacggtattagattcgaatcatacggtaggtgttttagcgtcggcgcatcgaccgcaaggtccggcggatgcgtggcgtgcggcggtactaatatatgcgtcggatgatacgcgtgcgcatccgaatcgatcggtagcggtaacgttacgactacgtggtgttccgccgggtccgggtctagtatatgtaacgcgatatctagataatggtttatgttcgccggatggtgaatggcgtcgtttaggtcgaccggtttttccgacggcggaacaatttcgtcgaatgcgtgcggcggaagatccggtagcggcggcgccgcgaccgttaccggcgggtggtcgtttaacgctacgtccggcgttacgtttaccgtcgttattattagtacatgtatgtgcgcgaccggaaaaaccgccgggtcaagtaacgcgtttacgtgcgttaccgctaacgcaaggtcaattagttctagtttggtcggatgaacatgtaggttcgaaatgtttatggacgtatgaaatacaattttcgcaagatggtaaagcgtatacgccggtttcgcgaaaaccgtcgacgtttaatttatttgtattttcgccggatacgggtgcggtatcgggttcgtatcgtgttcgagcgctagattattgggcgcgtccgggtccgttttcggatccggtaccgtatctagaagtaccggttccgcgtggtccgccgtcgccgggtaatccg

SEQ ID NO: 13881 - DNA, 1959 bp, Artificial Sequence
  Description of Artificial Sequence: Synthetic coding sequence
atgcgcccacttagacccagggcagcacttctcgccctgctcgcgtcacttctcgccgccccgcctgtggcacctgcagaagcccctcatcttgtgcacgtcgacgcggcaagggccctgtggcctctgagacgcttctggaggagcaccggcttctgtcctcccctccctcattcacaggcagatcagtacgtcctttcatgggatcagcagctgaacctggcatacgtgggagcagtgccacatcgtggtatcaaacaggtgcgcactcactggctgttggaactggttaccaccagaggatctaccgggagggggctctcatacaacttcacccacctcgatggctacttggatctccttcgagaaaaccaactgcttcctggattcgaactcatgggttcggcctcaggacattttactgactttgaggacaaacagcaggtttttgagtggaaggacctggtgagctcattggctagacgctacataggcagatacggacttgcacacgtgtcgaagtggaactttgaaacctggaatgagccagaccaccacgattttgataatgtcagcatgactatgcagggattcctgaactactacgacgcctgctccgaggggctgcgggcagcatcccctgcactgcgccttggagggccaggagattcattccacaccccaccacgaagcccactgtcgtggggacttctgaggcattgtcacgatggtaccaacttctttacgggcgaagcaggtgtgagactcgattacatttcccttcaccggaagggtgcgagaagctccattagcatacttgaacaggagaaggtggtggcgcaacagattagacaactgttccctaagtttgcagacacccctatctacaacgatgaggcagacccattggtgggatggtcactgcctcaaccgtggcgggcagatgtgacctatgccgctatggtggtgaaggtcatcgcacaacatcaaaatcttctgctggcaaacactacgtccgccttcccttacgccttgctgagcaacgataatgcttttctttcgtaccatccacatccttttgcacagcgaacgcttaccgcaaggtttcaagtcaacaacactagacctcctcacgttcaattgcttcggaagcccgtccttacggcaatgggactcctcgctcttcttgacgaagagcagctttgggcagaagtgtcgcaagccggtacggtccttgactccaatcatactgtcggtgttctcgcttccgcacatagacctcaaggtcctgcggatgcgtggagagccgcagtgctcatttatgcatcggacgatactcgggcacatccaaacagaagcgtcgcagtgacgcttcgtcttaggggagtccccccaggtcccggtcttgtgtacgtgaccagatacttggataatgggctctgttctccggatggcgaatggaggagacttggaaggccggtgtttccaactgcagaacaattccggcgcatgcgggcggctgaagatcctgtggcggccgctcctcggcccctgcccgcaggaggtaggctcaccctcagacccgctctgagactgccctcccttctgcttgtgcatgtgtgcgcgaggccagagaagccacctggccaagtgactcgccttagggcacttccacttacccaaggacagctcgttttggtctggtcggatgaacatgtgggatccaagtgtctctggacttatgaaattcaattttcgcaggacggaaaggcttatacccctgtgtcgcggaagccatcaacctttaacctgtttgtgttttcgcccgatactggcgcagtgtccgggtcgtaccgggtgagggccctggattactgggcaaggccaggtcctttttcagaccctgtcccttacctcgaagtgcccgtccctagagggcctcctagcccaggaaatccg

SEQ ID NO: 13882 - DNA, 1959 bp, Artificial Sequence
  Description of Artificial Sequence: Synthetic coding sequence
atgcgcccgctcagacccagggccgccctgttggcgctactggcaagtctgctcgccgcacctcccgtggcgccagccgaggccccacacttggtccacgtagatgctgcaagggccctatggccactgaggaggttctggaggtctaccggcttttgccctccactgcctcacagccaggccgaccagtacgtattaagctgggaccagcagttgaatctggcctacgttggggcagtgccacatcggggcattaaacaggttagaactcactggctgctcgaactagtgacgaccagagggtctacgggccggggcctgagttacaacttcactcacctcgatggatacctggaccttctgagggaaaatcagctgctgcctggttttgagctaatggggtccgcctccgggcactttacagacttcgaagataagcaacaggtctttgaatggaaagacctcgtaagctctttggcccgccgatatattggtcggtatggcctggcacacgtttcaaaatggaactttgagacatggaatgaacccgaccaccacgacttcgataacgtgtctatgactatgcagggattccttaattattacgacgcctgctctgagggacttagggcagcctctcctgcacttcgactgggggggccaggagattcttttcacaccccaccccggagccctttgagctgggggctgctacggcattgccacgacggaactaattttttcacaggagaggccggcgtgagactcgactacattagtttacaccgtaaaggcgctagatcgtctattagtattcttgagcaggaaaaggtggtcgcccagcagatccggcagctctttccaaagtttgctgacacacccatctataatgatgaggccgaccccctggtggggtggagtctgcctcagccttggcgcgccgatgttacttacgcggctatggtggttaaggtgattgcccagcatcagaacctgctcttggccaatacgaccagcgcctttccttatgcgctcttaagtaatgataatgctttcttgtcctatcatcctcatccgttcgcgcagaggacattgaccgctcgcttccaggttaataatacccgcccccctcacgtgcaactgctacgcaaacccgtactcacggcgatggggttgctcgccctgctcgatgaagaacagctgtgggcagaggtgtcccaggctggaaccgtactcgatagtaaccataccgtcggggtgctcgcaagtgctcaccgaccccagggaccggctgacgcgtggagggcagccgtcctgatttacgccagcgacgatacccgcgcacacccaaatcgaagcgttgccgtcacccttcggttaaggggagtccctccaggaccaggattggtctacgttactaggtacttggataatggcctctgctcgcctgatggtgaatggaggaggcttgggcggcccgtttttccaacagccgagcagtttcggcgtatgagagctgcagaggatccggtggcagctgctcctcggcccttacccgcaggaggtagactaaccctgcggccagccctgcggctgccttccttgctgttagtgcatgtctgcgctcgccctgagaaaccacctggtcaagtgacccgactccgcgctctgcctttgactcagggtcagctagtgttggtgtggtctgatgaacatgtagggtccaagtgcctttggacctacgagatccaatttagccaagacggaaaagcttatactcctgtttcacggaagccatctaccttcaacttgtttgtgttcagcccagataccggcgccgtttctggcagctacagagtgcgcgctttggactattgggccagacctgggcctttttccgacccagtcccatacctggaggtgcccgtaccaagagggcctccctcccctggcaacccg

SEQ ID NO: 13883 - DNA, 1959 bp, Artificial Sequence
  Description of Artificial Sequence: Synthetic coding sequence
atgcgtcctctcagacctcgcgcagcactgttggccctgctggcttcgctgttggctgcaccgcccgtggctccagccgaggcgccccatctggtgcatgtcgacgccgctagagcactttggcccctgcggcggttctggaggtcaactggcttctgtccgccactcccgcactcacaggccgaccaatacgtgctttcctgggaccagcagctgaatcttgcgtacgtgggcgccgtgccgcatcgcggtattaagcaagtgcgcactcactggctgctcgagctcgtgaccaccagaggatctaccggacggggcctttcctacaacttcacgcacctggatggctacctggatctgcttcgcgaaaatcagctgctgccaggatttgaactgatgggaagcgcatccgggcatttcaccgattttgaagataagcagcaagtgttcgagtggaaagatttggtgtcctcgcttgcgcggagatacatcggtagatacggtctggcacacgtgtcgaagtggaacttcgaaacctggaatgaacccgaccaccacgacttcgataatgtgagcatgaccatgcagggtttcctgaactactacgacgcgtgcagcgagggactgcgggcggcatcacctgcgctcagactggggggacctggagactcattccacacgccgccacggtcgccactgtcgtggggtttgttgcggcactgccatgacggcactaacttcttcacgggagaggccggtgtgcggctggactacattagcctccacagaaagggggcccggtcctccatttctatcctggagcaagaaaaggtcgtcgctcagcagatccgccagcttttcccaaaattcgcagacaccccaatctacaatgacgaggcggaccccctcgtgggctggtcactgccgcagccgtggcgagccgacgtgacgtacgcggccatggtggtgaaagttattgcacaacaccagaacctgctcctcgcaaacaccacctccgcgttcccgtacgcgctgctctccaacgataacgccttcctgtcctatcacccgcacccgtttgcccaaagaactctcaccgcccggtttcaggtcaacaatacgcggccgccgcatgtccaattgctgagaaagccggttctcaccgcaatgggcctcctcgccctgctggatgaggagcaactctgggcggaagtctcgcaagccggcactgttctggacagcaaccacaccgtgggtgtgctggcctcagcacaccgcccgcaaggtccggccgacgcctggcgggcagcagtcctgatctacgcctccgatgatactcgggcacatccgaatcgctccgtggccgtgaccctccggctgcgcggtgtgccaccggggcccggcctggtttacgtcactcgctacctcgataacgggctctgttcaccggacggagaatggcgccgactcggacggccagtgttcccaaccgccgaacagttcagaaggatgagagccgccgaggacccggtggccgccgcaccgaggccactgcctgcgggaggccgcctgacgcttagaccggccctcagactgccgagtttgctgctcgtgcatgtctgcgcccggccagagaagccgccaggacaagtgactcgcctgcgggcgctgccgcttacccaaggccagcttgtgctggtctggtcagatgaacatgtgggttcgaagtgcctttggacctacgagatccagttcagccaggacggaaaagcatacactccggtttcgcgcaaaccttcaactttcaatttgttcgtgttctcccctgataccggggctgtgtcgggctcataccgcgtgcgggcccttgactactgggcgcgcccggggccgttctcagacccggtgccttacctcgaagttcctgtcccgagagggccaccgtcaccaggaaacccg

SEQ ID NO: 13884 - DNA, 1959 bp, Artificial Sequence
  Description of Artificial Sequence: Synthetic coding sequence
atgaggcccttgagaccgcgggcggcgctgcttgcccttctggccagcctgctggctgcccctccagtcgccccagcagaagctccccacctggtccacgtagatgcagcaagggcactgtggccactgcgcaggttctggagatctaccggtttctgcccccctctccctcatagtcaagccgatcaatacgtgttgagctgggaccagcagctgaatctggcatacgtgggcgctgtgccccatcgcggaattaagcaggtccggacacactggctcttggagctggtaaccactcggggctccacaggacggggactgtcttacaatttcacacatttggacgggtacctcgacctgttgagagaaaatcagcttctgcccggtttcgagctcatgggtagtgcctccgggcacttcaccgactttgaagacaaacagcaagtgttcgagtggaaggatttggtgtcctccctggctcggaggtacatcggaaggtacggcctggcgcatgtgtctaagtggaactttgagacctggaatgaacctgatcatcatgacttcgataacgtctccatgaccatgcaagggtttttgaattactacgacgcttgctccgaagggctgcgggcggcttcacctgccctcaggttgggtggcccaggagacagttttcacacacccccacgatccccgcttagctggggcctgctgagacattgtcatgacggaactaatttttttactggggaagctggggtgcgccttgattatatcagtctgcatagaaaaggcgctcgctccagcatctcaatccttgaacaagagaaggtcgtcgcccagcagatccgacaacttttccctaagttcgccgatacgcctatttacaacgatgaggctgatccacttgtgggctggagcctcccacagccgtggagagccgatgtgacatatgcggcaatggtcgtgaaggtgatcgctcagcaccagaacctgctcctggctaatacgacttctgcattcccctatgctcttctttccaatgataatgcctttctgtcctaccacccccatccatttgcgcagcgaacactcaccgctcggttccaggttaacaacaccaggccgccgcacgtccagcttctgcgcaagcctgttctgactgcaatgggtctcctcgccctcctggacgaggagcagctgtgggccgaggtgtctcaggcggggactgtgcttgattctaatcacacagtcggcgtgctggcctctgcccatcgcccacagggccccgccgacgcctggcgggccgctgttttgatctacgctagtgatgacactagggcacaccctaatcgctctgtcgctgtgactctgagactgagaggagtgcctcctggaccaggactggtatacgtgaccaggtaccttgataacggcctttgttctcccgatggcgaatggcggagattgggacgacctgtattccccacagcagagcaattccgacgaatgagggcagcagaggatccagtcgccgccgctccacgaccactccctgctggaggaaggttgacgctgcgccctgccctgcgccttccttcactcttgttggtacatgtatgcgctagacccgagaagcccccgggtcaggtgacacgcctcagggccctcccgctcactcagggacagctggtgttggtctggagtgacgagcacgtgggttcaaaatgcctttggacatacgagatccaatttagccaggacggcaaagcttatacgcctgtgagtagaaagccttccacattcaatctgtttgttttctcccccgataccggcgcagtctctgggtcatacagagtgcgggcactcgactattgggcccggcctgggccctttagtgatccggtcccctatttggaagtgcctgtcccgaggggacccccctccccagggaaccct

SEQ ID NO: 13885 - DNA, 1959 bp, Artificial Sequence
  Description of Artificial Sequence: Synthetic coding sequence
atgcgtccattacgtccgcgggccgctctgctggcattacttgcgagtcttttagcagctccacctgtggcacctgcagaagcccctcatcttgtccatgtggatgccgcacgtgcactctggccactacgtagattctggagatcaaccgggttttgtccacctctacctcattctcaggccgatcagtatgtgctgtcctgggatcagcagctcaacttggcctacgtgggagcagtgccacaccgagggattaagcaggtgaggactcactggcttttggagttagtgacaacgagagggtccaccggacgaggactgtcatacaacttcacccatctggacggttatcttgatctgctgagagagaatcagctgctgcccggttttgagctgatggggagtgcatcaggacatttcaccgactttgaagataagcagcaggtgtttgaatggaaggatttggtgtcatccctggcccgacgatacatcggaagatatggtttggcgcacgtttctaaatggaactttgaaacatggaatgaaccagatcaccacgattttgataatgtttcgatgacaatgcagggttttctgaattattatgatgcctgcagtgagggcctaagggcagccagccccgcattacgcctcggtgggcccggagattcttttcacactccccctagatcacccctgtcttggggactgttgcgtcactgtcatgacgggaccaatttctttaccggagaggcaggcgtcagattagactatatcagcctccacaggaaaggagcaaggtcaagcatctcgatcctggaacaggagaaagtggtagcccagcagatccgacagctgttcccaaagttcgccgataccccaatctacaacgacgaggcagacccactggtgggttggtcattacctcaaccttggagggccgacgtcacctacgcagcaatggtcgtgaaggtgatagctcagcaccagaacctgctgctggcaaacaccacttcggcatttccatacgccttactgtccaacgataacgctttcctgagctaccaccctcaccctttcgcccagaggacgcttactgcacgttttcaggttaacaatacgagaccccctcatgtccaattgcttaggaaacccgtccttaccgccatgggccttcttgcactcttggatgaggagcagctttgggcagaggtctcgcaggcaggtactgtactggatagtaaccataccgtgggggtccttgcgtccgcccacagacctcagggtccagctgatgcatggcgagccgctgtgctgatctacgcaagcgatgacaccagagcgcatccaaataggtcagtggcagtgacgctgaggctccgtggagtccctccagggccggggctggtctatgtgacgaggtacctagacaatggcctgtgttcacccgacggggaatggaggaggttggggcgacctgtctttccaactgctgagcagttcagacggatgcgagcagctgaggatccagtggcagcagcacctcgaccactgcccgccggcggtcggctcacactgcgacccgccttgcgattgccgtcattgctgctggtgcacgtgtgcgcgagaccggaaaaaccgcctggtcaagtaaccaggctgagagctttgcctctgacacagggccaactggtgttggtgtggtctgacgaacacgtgggctcaaaatgtctgtggacctatgaaatacaattcagccaggacggaaaggcatatacccctgtttctaggaagccctccacattcaacctcttcgtctttagccccgacacaggcgcggtgtccggaagctaccgggttagggctttagattactgggctcgcccagggccgtttagcgaccctgtgccctatttggaggtgcccgtaccccgaggacccccttctcctggcaaccca

SEQ ID NO: 13886 - DNA, 1959 bp, Artificial Sequence
  Description of Artificial Sequence: Synthetic coding sequence
atgcgccctctgcggcctagggctgctttgttagccctgctggctagcttactggcagctccacccgtggcccctgcagaggcccctcatctggtacatgtagacgctgcccgcgctctatggccattgaggcgattctggagatctactggtttctgtcctcccttgcctcactcgcaggcggatcagtacgtgctgtcatgggaccaacagctcaacctggcttatgtcggtgccgtgccccaccggggtatcaagcaggtccgaacccactggctgcttgagctggtgactactagagggtccaccggtcgcggcctctcttataactttacacacttagacggctatctcgatctcctcagagaaaaccagcttctgccaggtttcgagttgatgggatccgcatcaggccactttacagatttcgaagacaaacagcaagtgtttgaatggaaagatctggtcagttcattggcccggcggtacattggccgttacggcctggcccacgtgtcgaagtggaacttcgaaacatggaacgagccagatcatcacgactttgataacgtgtctatgacaatgcaggggttcttaaactattacgacgcatgtagtgaggggctgagggctgcctctccagctcttagattgggggggcctggggattcatttcacactccaccacggtcaccactttcttggggattgctcaggcattgccacgatgggaccaactttttcactggagaggccggtgtgcggttggattatatctcacttcaccggaagggggcccggtcctcaatttcaatactggaacaggaaaaagtggtggctcagcagatccgccagctgtttcctaagtttgccgacacaccaatttataacgacgaagctgatccacttgttggatggagcctgcctcagccatggcgagccgacgtcacatatgcagccatggtagtgaaggttattgctcagcaccaaaatttacttttagcgaatacaacgagcgccttcccttacgcactgttgagcaacgacaatgcctttctaagctaccatccacaccctttcgcgcaaagaacactcacagcacggttccaggtgaacaacactcgccccccgcatgtgcaactgctgcgcaagccagtgttaaccgccatgggtctgctggctctgttggacgaggagcagctgtgggctgaggtgtctcaggccggcaccgttttggactctaatcacaccgtgggagtcttggcgagtgcgcaccgtcctcagggacccgcggacgcctggagagcagcagtactcatctacgcttcagacgacactcgggcacatcccaaccgcagcgttgccgttacactcagattgaggggggtccctcctggacctggcctggtctatgtgactcggtacctggacaacggcctttgctcaccagacggagaatggcgacgactgggccgccctgtgtttcctaccgcagagcagttccgcagaatgcgggccgcggaggaccccgtcgccgccgcccccaggcccctgcctgcaggtggcaggctaacactccgccctgctctgagactgccttctctcttgctcgtccacgtttgcgcccgccccgaaaaaccgcccggtcaagtgaccagactacgcgccctgcccctgacccagggacagctggtgctagtctggtccgacgaacacgttggaagcaagtgcttgtggacttatgaaattcagttctcacaggatggaaaagcctatacaccggtgtctcgcaaaccttcaacctttaacctgttcgtgttctctcccgacacgggagccgtgtcgggctcttatcgggtgcgagctctggactactgggctaggcccggccccttttccgaccccgtaccatatctcgaggtgccagtgccccgaggccctccaagtcctggcaatccc

SEQ ID NO: 13887 - DNA, 1959 bp, Artificial Sequence
  Description of Artificial Sequence: Synthetic coding sequence
atgaggcccctgcgccctagagccgcacttcttgcactgctcgcgtcgcttcttgcagcgcctcccgtggcaccggccgaagcccctcatctggtgcacgtcgacgccgcaagggcactttggcccctgagacgcttctggcggagcaccgggttttgtccccccttgcctcacagccaagcagatcagtacgtgcttagctgggatcagcaactgaatctggcgtatgtgggcgcagtcccccatcgcggaatcaagcaggtgcggacccactggctcttggaattggtcaccaccaggggttccactggacggggactgtcatataactttactcacttggatggataccttgacctgctgcgtgagaaccagcttctccctggatttgagctcatgggaagcgcatccggtcattttactgatttcgaggataagcagcaagtttttgaatggaaagatcttgtcagcagcctggcccgaaggtacatcgggcgttacggtctggcgcacgtctcaaagtggaactttgaaacttggaatgagccggatcatcatgatttcgataacgtgtccatgacgatgcaaggatttcttaactactacgacgcgtgttcggaaggactcagagcagcgtcgccagcactccggctcggcggacccggtgactcatttcacaccccgccccggtcacccctctcatggggactcttgaggcactgccatgatggtactaacttcttcaccggcgaagccggcgtccgtcttgattacatcagcctgcatcggaagggggcaagatcaagcatctccattcttgagcaagagaaagtggtggcccaacaaatcagacagcttttcccgaagtttgccgacactccgatttacaacgatgaagcagaccctcttgtgggttggtctttgccacagccgtggcgcgcagacgtcacctacgcggcaatggttgtcaaggtcatcgcgcaacatcaaaaccttcttctcgctaacacgacttccgcattcccgtacgctcttctgtcaaatgacaatgcatttctctcgtaccatcctcatccgttcgcacaacgaactctcacggcccggtttcaagtcaacaacactcgtcctcctcatgttcaacttctgaggaaacctgtgctgaccgcaatgggcctgttggcacttctggatgaggagcaactctgggcagaagtgtcccaagccggtaccgttctcgactcaaaccataccgtgggcgtgcttgcttccgcccatagaccacagggcccagcggacgcgtggcgcgcggcagtcctcatctacgcctccgatgatactcgggcacaccctaatagatccgtcgcagtgactcttcgactgcgaggagtgccacctggccccggactggtgtatgtgacgcgatacctcgataatggactttgttcccccgatggagaatggcgccgcctgggacgtccggtgtttcctactgcagaacagttccggcgcatgagagcggccgaggaccctgtcgcggcggcgcccagaccactgccggcaggtgggagactcactctgcggcccgccctccgcctcccttcgcttctcctcgtgcacgtgtgtgcccggccagaaaaacctcctgggcaggttacccgccttagagcactgcctttgacgcagggtcaacttgtcctggtctggtccgacgaacatgtggggtcgaagtgcctctggacctatgaaattcaattttctcaagatggaaaggcatacacccctgtgtcgagaaagccatcgactttcaatctgttcgtgttttcgccagataccggtgcagtgtcaggatcctacagagtgagggctctggattactgggcccgccctggcccatttagcgatccagtcccatacttggaagtccctgtccctaggggaccaccgagcccaggaaatcca

SEQ ID NO: 13888 - DNA, 1959 bp, Artificial Sequence
  Description of Artificial Sequence: Synthetic coding sequence
atgaggccgcttagaccacgcgcagcactgcttgcacttctcgcatccctgttggcagcacctcccgtggcacctgcagaggcaccacatctggtgcatgtggatgcggcgcgggcactgtggccactgcgtagattctggcgctcgactggattttgtccaccactgcctcacagccaagcagaccagtacgtgctttcttgggatcaacagctgaaccttgcatacgtgggagcagtgcctcaccgaggaatcaaacaagtgcgcactcactggctgcttgaacttgttactactaggggcagcaccgggcggggtctgtcgtacaactttacccatcttgatggataccttgatttgctccgagagaatcaattgctcccaggcttcgagctgatggggtcagcatccggtcatttcaccgatttcgaagataagcaacaagtgtttgagtggaaggatctcgtgagctcactcgccaggagatacatcggccgctacggtctggcgcatgtctcgaagtggaattttgaaacttggaacgaaccggatcatcatgatttcgataacgttagcatgacgatgcagggttttttgaactactacgatgcttgctccgaaggtttgcgcgcggcgagccccgcattgagacttggaggcccaggcgacagcttccataccccaccacggtcgcctctgtcgtggggtctgctgcggcactgtcacgacggtactaacttctttaccggagaagctggagtgcggcttgattacatctcacttcaccggaagggagctaggagctcgattagcattctggaacaagaaaaagtggtggcccagcagattagacagctcttcccgaaatttgccgacactcctatttacaacgacgaagcagatccactcgtcggctggagcctgccacagccatggagagcagacgtgacctacgcagcaatggtcgtcaaggtcattgcgcaacaccagaatctcctcctggcaaacacgacttcggcctttccttacgctcttctgtccaatgataatgcgttcctgtcgtaccacccccatccgtttgcacagcgcaccctcaccgcacgcttccaagtcaacaatacgcggccaccacatgtgcagttgctcagaaagccagtccttaccgcaatgggacttctggcactgctggatgaagaacagctgtgggcagaagtttcacaggcaggtaccgtccttgactccaaccacactgtcggcgtgctggcatccgcgcacagaccacagggtcctgcggatgcgtggcgagccgcagtgctgatctacgcatcggatgatacccgagcccatcctaaccggtccgtggcagtgactctgcgactgcggggtgtccctcctgggccaggtctggtctacgtaaccagataccttgacaatggcctgtgttcaccagacggggagtggaggcggctgggcagaccggtattccccaccgctgaacaattcagaaggatgagagcagctgaggaccccgtcgcggctgcacctagaccgctccctgcgggaggtagactgaccctgcggcccgctctgcgcctgccctcactccttcttgtgcacgtctgcgcacgccctgaaaaaccacctgggcaagtcacccggctcagagcactcccactgacccaaggtcaacttgtgctggtgtggagcgatgagcatgtgggttcgaagtgcctttggacttacgaaattcaattttcccaagatggtaaggcttatactcctgtgtcgcgtaagccgtccacctttaacctctttgtgttctcgccagatactggagctgtgtccggctcgtacagagtgagagccctcgactattgggcccgaccaggaccgttttcggacccagtgccgtacctggaggtgccagtgccacggggacctccaagtccaggtaaccca

SEQ ID NO: 13889 - DNA, 1959 bp, Artificial Sequence
  Description of Artificial Sequence: Synthetic coding sequence
atgcggcctcttagaccgcgcgccgcgctccttgcactgctggcaagcctgctcgccgctcccccagtcgccccagcggaagccccgcatcttgtgcacgtggacgccgctagggccctgtggccactccgccgcttttggcggtccactggattttgcccaccacttccgcacagccaagcagaccagtacgtgctgtcctgggatcagcaactgaacctggcatacgtgggagctgtgccgcatcggggaatcaagcaagtgagaacccactggctgctggagctcgtgaccacccgcggatccaccggtcggggactctcatacaatttcacccatctggacggatacctcgatctcctgagagagaatcagctgctgccaggatttgaactgatgggttccgccagcgggcacttcaccgacttcgaggataagcagcaggtgttcgaatggaaggacctcgtctcgtccctggcacggcgctacatcggacggtatggcctcgcgcacgtcagcaaatggaacttcgagacttggaatgaaccggaccatcacgatttcgataacgtgtccatgacgatgcagggattcctgaactactacgacgcttgttcagagggactgcgcgccgcctctccggccctcagattgggcggtcctggtgattcgttccataccccacctaggtcaccactgtcatggggtctgctgagacactgtcacgacggcacgaactttttcactggcgaagcaggcgtaaggctcgactacatttcgcttcatcgcaagggggctcgctcgagcatcagcatcctggagcaggaaaaagttgtagcacaacagatccgccaactcttcccaaagttcgccgacactccgatctacaacgatgaagcagacccgctggtggggtggagtctgccacagccgtggagagccgacgtgacttacgccgcgatggtcgtgaaggtgatcgcccaacaccagaatcttctgctcgccaacaccaccagcgcgttcccttacgcattgctgtccaatgacaacgcgtttctttcgtatcatccacaccctttcgcgcaacgcactttgacggctcgcttccaggtgaataacacccgccccccgcacgtccaactccttcggaagccggtgttgaccgcgatggggcttctcgcactgctcgacgaagaacaattgtgggccgaggtttcgcaagccggcaccgtcctcgactccaatcacaccgtgggtgtgcttgcctcagcccatcgccctcaggggccagccgatgcctggcgggccgcggtgctgatctacgcttccgacgatactagggctcaccctaatcggtcagtggcggtcactcttagattgagaggagtgcctcccggacctggattggtatatgtgactcggtacctcgataacggactgtgctcgcccgacggagagtggcggcggctgggtcggccggtgttcccgaccgccgaacagtttcgccgcatgagagcggctgaagatcctgttgcggctgcaccccggccgctgccagccgggggacgtctgactctgcgcccggcactcagactgccgtcactcctgttggtccacgtgtgcgctaggccggagaaaccaccgggtcaggtcaccaggctgcgggcgctgcccctcactcagggacagctcgtgctcgtctggagcgatgagcatgtcggatccaagtgcctgtggacctatgaaattcagttcagccaagacgggaaggcgtacacgccagtatcgcgtaaaccctcgactttcaacctgttcgtgttctctccagacacgggcgctgtgtcaggctcctaccgggtgagagccctggactactgggccagaccgggaccgttttcggatccggttccgtacctcgaagtgccagttcccagaggccctccgtcccctggcaacccg

SEQ ID NO: 13890 - DNA, 1959 bp, Artificial Sequence
  Description of Artificial Sequence: Synthetic coding sequence
atgcgccctcttcgcccgcgcgcggctctgttggcccttctggcctccctgttagctgccccgccagtggcgccggccgaggcgccgcacttggtccatgtcgacgcagctcgtgctctctggcccttacgtcgtttctggcgttcaaccgggttctgtccccctctcccgcacagtcaggccgatcagtacgtgctctcttgggatcagcagctaaacttggcttacgtgggcgcagtaccacacagaggcatcaagcaggtccgcacccattggctgttggaactcgtcaccactaggggatccacgggccgaggcctctcctataatttcactcacctggatggctacctggatctcctgcgcgagaaccagctcctgccgggtttcgagctcatgggcagcgcgagcggccacttcaccgattttgaggacaagcagcaggtattcgagtggaaggacttggtgagctccctcgcccgtcgttacatcggtcgttacggcctggcccacgtcagtaagtggaacttcgagacttggaacgagcccgaccaccacgacttcgataacgtgtcaatgaccatgcagggcttccttaactattacgatgcatgctccgaggggcttcgtgcggcttcgccagcgctccgactgggcggaccgggcgacagctttcacaccccccctcgtagcccgttgtcgtggggcttgcttagacattgccacgacggtaccaacttctttactggtgaggctggcgtccgtctcgactacatttccctgcaccgcaagggcgcgcgttccagcatctccatccttgagcaagagaaagtcgtggcgcagcaaatccgacaactgttccctaagttcgcggacacaccaatctacaacgacgaggccgaccccctcgttggctggtcgctcccccagccctggcgcgccgatgtcacctacgctgctatggtggtcaaagtgattgcccagcaccaaaatctcctgttggccaacacaacttccgctttcccttacgcgttgctctccaacgacaacgctttcctgtcctatcaccctcatcctttcgctcagcgaaccttgactgccaggttccaagtcaacaacacccgtcccccccatgttcaactgctccgcaagcccgtcttgactgccatgggtttgctcgccttgcttgatgaggagcagctctgggccgaggtctcccaggcaggcacagtcctggactccaaccatacggtcggcgtgcttgcctcggcgcacagacctcagggtcccgcagacgcgtggcgcgccgccgtcttgatctatgcttccgatgataccagggcacatccgaaccgttccgtcgccgtcaccttacgtctgcgcggcgtgccccctggacccggtttagtttacgtcacccgctatcttgacaacggattgtgcagcccggatggtgagtggcggcgtctaggccgtccagtcttcccgaccgcggagcaatttcgtcggatgcgggcggctgaagacccagtcgcggctgcgcctcgacctctgcctgccggtggtcgcctcacgctgaggcccgccctgcgtttgccatcattgctactggtccacgtctgcgcccgaccggaaaaaccccccggtcaggtgactcgcttacgcgcgctgcctctgactcagggtcagctcgtcctcgtctggtctgatgaacacgtcggcagcaaatgcttgtggacgtacgaaatccagttctcgcaggacggcaaggcgtatacccccgttagccgtaagccctcgacgttcaaccttttcgttttcagccccgatactggtgctgtgtccggttcctaccgcgtccgtgccttggactactgggctcgaccaggaccgttctcggatccagttccgtacttggaggtccccgttcccaggggcccgccgtcaccgggaaacccc

SEQ ID NO: 13891 - DNA, 1959 bp, Artificial Sequence
  Description of Artificial Sequence: Synthetic coding sequence
atgcgcccgcttagaccccgggccgccttgctggccctcctcgcgtccctcctcgcggcaccgccagtggcgccagcagaagccccccacctcgtgcatgtggacgcagcaagggcgctctggcctctgcgccgcttttggcgcagcaccggattctgcccaccgctcccgcactcgcaagcggatcagtacgtgctgtcttgggatcaacaattgaacctggcgtacgtcggtgcggtcccacaccggggaataaagcaggtgcggactcactggttgctcgaactcgtgaccactagagggtcgactggacgcggactttcgtacaacttcacccatctggacggctacctggacctgctgcgcgagaaccagctgctgccgggcttcgaattgatgggaagtgcaagcggacatttcactgacttcgaggacaagcagcaggtgtttgaatggaaggaccttgtcagctcgcttgcccgccggtacatcgggcgatacgggctggcacacgtctccaagtggaatttcgagacttggaatgagcccgaccaccacgatttcgacaatgtgtcaatgactatgcagggattcctcaactattacgacgcctgctcagaaggactccgggctgcttcacctgccctccgcctcgggggacccggtgactcgtttcacaccccacctagatcaccactgtcgtggggactgctccgccactgccacgatggaacgaatttcttcactggtgaagctggagtgaggttggattacatctcattgcatagaaaaggtgccagatcgagcatctcaatcctcgaacaggaaaaagttgtggcgcagcaaatcagacagctgttcccgaagttcgccgacactccgatctacaacgacgaggccgaccctctggtgggatggagcctcccgcagccatggcgggccgatgtcacttacgccgcaatggtggttaaggtcatcgcgcaacaccaaaatctgctcttggcgaacaccacctccgcctttccgtacgcattgctgtccaatgacaatgccttcctgtcctaccacccgcacccctttgcacagaggactctgacggcgagattccaggtgaacaatactaggcccccgcatgtgcagctccttcgtaagccggtgctgaccgcaatggggctgctcgctcttcttgatgaagagcagctttgggctgaggtgtcccaggcgggaaccgtgctggactcgaaccacaccgttggtgtgttggcatccgcccatagaccacagggaccggcggatgcatggagagccgccgtgctcatctacgcaagcgatgatacgcgggctcaccctaaccgcagtgtggccgttaccctgcggctccgcggagtgccgccggggccggggctggtctacgtgactcgctacctcgataacggactgtgctcaccagatggagagtggcgccggctcggcaggccggtgttcccgactgctgaacagttcagacggatgagagcggccgaagatccagtcgccgctgctcctcgccccctccctgcgggagggcggctgactctgcgtcctgccctccggctcccaagcctgctgttggtgcacgtgtgcgcaagaccggaaaagccgcctggacaggtgactcgcctgagagccctgccgcttacccaaggccagctggtgctggtctggtctgatgaacacgtcggaagcaagtgtctgtggacctacgaaattcagttctcccaggacggtaaggcttacactccggtgtcccggaagccttcgactttcaatctgttcgtgttttccccagataccggagccgtgagcggatcataccgcgtgcgggcgttggattactgggcgcggccgggacctttctcagaccccgtcccgtatttggaggtcccggtgccgagaggccctccatccccggggaatcca

SEQ ID NO: 13892 - DNA, 1959 bp, Artificial Sequence
  Description of Artificial Sequence: Synthetic coding sequence
atgcgccccctgcggcctagagctgcccttttggccctgctcgcctccctgctcgctgcaccgccggtggctccagcagaggcgcctcacctcgtccacgtcgacgctgccagagcgctgtggccgttgcggcggttctggcgctcgaccggtttctgcccaccactccctcatagccaggccgaccagtacgtgctgagctgggaccaacagttgaatctggcttatgtgggcgctgtgcctcaccgcgggatcaagcaggtgcgcacgcattggctgctcgaactcgtgactaccaggggatccactggaagggggctgagctacaatttcacccacctggatggttacctggatctcttgagggaaaaccagctcctgcctggattcgaactgatggggtcggcgtccggacactttacggacttcgaggataagcagcaggtgttcgaatggaaagacctggtttcatcccttgcacgccggtacatcggaagatacggcctggcccacgtgtccaagtggaacttcgaaacctggaatgagccagatcatcacgactttgataacgtgtcgatgactatgcagggatttctgaactactacgatgcgtgctcagagggactccgcgcagcctcacctgccctgagactgggcggcccaggcgactcttttcacaccccgccgcgatcccccctgtcgtggggactgctccggcattgccatgacggaaccaatttcttcactggtgaagctggagtgcggctcgactatatctcgctgcataggaagggcgcacggagctcgatctctatactcgagcaggaaaaggtcgtggcgcagcagatccgccaactgttcccaaagttcgctgacactccgatctacaacgacgaggccgatcccctcgtcggttggtccctgccgcaaccgtggagagccgatgtcacttatgcagcaatggtggtcaaagtgattgcgcagcatcaaaaccttctgctggcaaataccacctcggccttcccatacgccctgctgagcaatgacaacgccttcctgagctaccacccccacccgttcgcgcaacggactctgaccgcgcggttccaggttaacaacactaggccgccgcatgtccagttgctgcgcaagccagtgctgaccgcgatgggacttcttgcgcttctggatgaggaacaactgtgggcggaagtgtcccaggcgggaaccgtgctcgactcaaaccacactgtcggggtcctggcaagcgcccatcgccctcaaggccccgctgacgcttggcgcgcagccgtcttgatctacgcgtctgatgacacccgggcccacccgaacagatcggtcgctgtcacgctgagactcagaggtgtgcctccgggaccgggactggtgtacgtgacccggtacctcgacaatggactgtgcagcccagacggagagtggcgcaggctcggacgtccagtgtttcccaccgcagaacagtttcggaggatgagagcagcggaagatcccgtggcagccgcccctcgacctctgccagcgggagggcggttgaccctgcgcccggcactcaggcttccttcgctcctcctggtgcacgtctgtgcgcgcccagaaaagccgccagggcaagtgacgcgtctgcgcgctttgcccctcacccaaggacagctcgtcctggtttggtcagatgagcacgtgggatcgaagtgtctgtggacctacgagattcaattttctcaagatggaaaggcatacacgccagttagcaggaagccgtccactttcaatttgtttgtgttctctccggatactggggccgtctcaggtagctacagggtgcgggctctggactactgggcgaggccgggtcctttctcggaccctgtgccgtatttggaagtgccggtgccaagaggaccgccctcgcccggaaacccg

SEQ ID NO: 13893 - DNA, 1959 bp, Artificial Sequence
  Description of Artificial Sequence: Synthetic coding sequence
atgcggccgctgagacctcgcgcagcacttctggctctcctcgcgtctctcctagcggccccgcctgtggctccagctgaggcgcctcatctggttcacgttgatgctgcacgcgccctttggcctctgaggagattctggcgctccacaggtttctgccctcccctaccccactctcaggccgaccagtacgtgctctcatgggaccagcagctaaacttggcctacgtgggggcagtaccgcatagaggaattaaacaagttcgcacacactggcttctggaactcgtgaccacacgggggagcactgggcgcggactcagttataatttcacccatctggacggctacctggatctgctgcgagagaatcagctgctaccaggcttcgaacttatgggctcagctagcggccacttcacagattttgaggacaagcagcaggtattcgaatggaaggatctcgtatcatccctcgcacgacgatacatcggacggtacggtttggcgcacgtgtcaaaatggaactttgagacatggaacgagcctgatcaccacgatttcgacaacgtgagtatgaccatgcagggatttctgaactattatgatgcgtgttcagaagggctgcgggccgcaagtccggcccttcggctgggaggacctggggattcctttcatacccctccacggtcccctctttcatggggactgctgaggcactgccacgacggtaccaattttttcaccggcgaggccggggtgagactggattacatctccctccacagaaaaggcgcgagaagtagcataagcattctggagcaagagaaggtagtggcccagcaaatccgtcagctgttccccaagttcgccgatactccgatttataacgatgaggcagatcccttggtagggtggagtctcccacagccttggagagcagatgtcacatacgctgcgatggtcgtaaaagtcatcgcacaacatcagaatcttctgcttgcaaatactacctctgcctttccatacgccctgctaagtaatgacaatgccttcctctcctatcatccccacccatttgctcaaagaaccttgacggcgcggttccaggtaaacaacactcggccaccccacgtgcaactacttagaaagccagtactcaccgccatgggcctgctggcactgctggatgaagaacagctttgggcagaagtcagccaggccggcaccgttctagattccaatcacacagtgggcgtgctggctagcgcacaccggccgcaaggtccagctgatgcttggagagcggccgtcctgatctacgcaagtgatgacacaagggcacatcccaacagaagtgtcgcggtgaccttaaggctgcggggcgtgcctccaggaccgggcctggtgtacgtaactagatatctcgataacggcctctgctctcccgacggtgaatggagacggttgggacggcctgtgtttcctacagcagagcagtttaggcggatgagagccgccgaggaccctgttgctgcagcgcctaggccacttccagctggcggtcgccttacattgaggcccgcgctgagactgccttccctgttactagtacacgtgtgcgcccgccctgagaagcccccgggtcaggtgacaaggctgcgggcactgccattaacccaaggacagctggtgttagtgtggagcgacgagcatgtggggtccaaatgtctctggacctatgagattcagttctctcaagacggcaaggcctacacgcctgtatcccgcaaacctagcaccttcaatctgttcgtattcagtccagatacaggggctgtttctgggtcttaccgtgtgcgtgccctggattattgggcccggcccgggccctttagcgaccctgtgccttatctcgaggttcccgtgcctaggggccccccctctccaggcaatccg

SEQ ID NO: 13894 - DNA, 1959 bp, Artificial Sequence
  Description of Artificial Sequence: Synthetic coding sequence
atgagaccattaagacctagagcagcattattagccttacttgcaagtttacttgcagctccaccagttgcaccagctgaagcaccacatttagttcatgtagacgctgctagagctctttggccattacgtaggttttggcgtagtactggattttgtccaccattaccacattcccaagctgatcaatatgttctttcatgggaccaacaattaaaccttgcttatgttggagctgttcctcacagaggtattaaacaagttagaacacattggcttcttgaattagtaacaacaagaggttcaacaggaagaggattatcatataattttactcatcttgatggataccttgatctacttagagaaaatcaattattgccaggttttgaacttatgggatctgcatctggacattttactgattttgaagataaacaacaagtttttgaatggaaagatcttgttagttcattagctagaagatatattgggagatatggattagcacatgtaagtaaatggaatttcgaaacatggaatgaaccagatcatcatgattttgataatgtttcaatgaccatgcaagggtttcttaattattatgatgcatgtagtgaaggattaagagcagcaagtccagctttacgtcttggtggaccaggagattcatttcatactccaccacgttcaccattgtcatgggggcttttgagacattgtcatgatggaacaaattttttcactggtgaagctggagttagattagattatatttcattgcatagaaaaggtgctagaagttcaattagtatacttgaacaagaaaaagtagttgcccaacaaattcgtcaattatttccaaaatttgctgatactccaatttataatgacgaagcagatccacttgttggatggagtcttccacaaccatggagagcagatgtaacatatgctgcaatggttgttaaagtaattgctcaacatcaaaatttactcttggcaaatactacaagtgcatttccttatgctttactttctaatgataatgcttttttatcttatcatccacatccatttgcacaaagaacattaactgctcgatttcaagtcaataatacaagaccaccacatgttcaattgttacgtaagccagttcttacagcaatggggttattagctttattagatgaagaacaattatgggctgaagtttcacaagccgggaccgtattagattcaaatcatacagtaggggtacttgcatcagctcataggcctcaaggaccagcagatgcttggagagcagctgtacttatttatgcttccgatgatactagagctcatcctaatagatcagttgcagtaacattaagattaagaggagtaccaccaggaccaggattagtttatgttacaagatatcttgataatggtttatgtagtccagatggagaatggagaagacttggaagaccagttttcccaacagctgaacaatttagaagaatgagagcagctgaagatccagtagctgcagcacctagacctttacctgctggtggtagattaacattgagaccagcattacgtttaccatcattacttttagttcatgtttgtgctagaccagaaaaaccacctggtcaagtaactagacttagagcattaccacttacacaaggacaattagtgctagtttggagtgatgaacatgtaggaagtaaatgtctttggacatatgaaattcagtttagtcaagatggaaaagcttacactccagtcagtagaaaaccatcaacatttaatctttttgtattttctccagatacaggtgcagttagtggatcctatagagtaagagcacttgattattgggcaagaccaggaccattttcagatccagttccatatttagaagtaccagtaccaaggggacctccatcaccaggaaatcca

SEQ ID NO: 13895 - DNA, 1959 bp, Artificial Sequence
  Description of Artificial Sequence: Synthetic coding sequence
atgcgacctctgcgcccacgagccgcattgctggcactgctggcctcgttgctggcggccccgcccgtggccccggcagaggcaccccatcttgtgcatgtggacgccgcccgcgccctgtggccacttagaagattctggcgatcgactggattctgcccaccgctgcctcattcccaggcggaccaatacgtcctgtcgtgggaccagcaattgaatcttgcctacgtgggggcggtgccacaccggggaatcaaacaagtcagaacccactggctgctggagctggtgactacccgcgggtctactggaagaggcctgtcgtacaacttcacgcatctcgacggatacctggacttgctccgcgagaaccagctcctcccgggtttcgaattgatgggatcagcgtcgggccacttcacggacttcgaggacaaacaacaggtgtttgaatggaaggaccttgtctcgtcgctggctaggcgctacattggacggtacgggctcgcgcacgtgtcgaagtggaatttcgaaacctggaatgaacccgatcatcacgacttcgacaatgtgagcatgactatgcagggtttccttaactactacgatgcatgctccgaaggactgagagccgcctccccagccttgaggttgggaggccccggcgactcctttcacacccctcctagatcgccgctgtcatgggggcttctccgccattgccacgacggaaccaacttctttaccggagaagcgggagtcagactcgattacatttcgctccaccggaagggcgcccgctcctcaatctccatcctcgaacaggagaaggtggtggcgcagcagatccggcaacttttccctaagttcgctgatactccgatttacaatgacgaagccgatccgctggtgggctggtcccttccgcagccgtggcgggcggatgtgacctacgccgcaatggtcgtgaaagtcatcgctcagcaccaaaaccttctgctggccaataccacttccgcatttccgtacgcactgctgtcgaatgataacgctttcctctcgtaccacccgcatcctttcgcacagcgcaccctgaccgctcggtttcaggtgaacaacacccggccgccgcacgtccaactgctgcggaagccggttttgacggccatgggtctgctggcgctgctggatgaggagcagctgtgggccgaagtgtcacaggccggaaccgtgctggatagcaatcacactgtgggcgtgctcgcttctgctcacagaccccagggccctgcggacgcctggcgggccgctgtcctcatctacgctagcgacgatacccgcgcgcatccgaaccggtcggtggctgtgaccttgcgccttcggggagtgccacctggacctggtcttgtctacgtgactagatacctggacaacggactctgctccccggacggagaatggcgccggctgggacggccagtgttccctacggccgaacaattccggaggatgcgggccgctgaagatcctgtggcggctgcgcctcgccctttgccggcgggaggacggttgacccttcggccggctctgcggctcccatcactcctccttgtgcacgtgtgcgcgcgcccagaaaaaccgcctggacaggtgactcgcctgcgcgcgttgccactgactcaagggcagctggtgcttgtgtggtccgacgagcatgtggggtcaaagtgcctgtggacctacgaaatccagttctcccaggatggtaaggcctacactccggtgtcgcggaagccgagcactttcaacctgttcgtgttcagcccggacaccggggccgtcagcggctcgtaccgggtgcgggctctggactactgggcgcgcccgggaccattctcggacccggtgccctatctcgaagtgccggtgccgcgcggtcctccatcaccagggaatcct

SEQ ID NO: 13896 - DNA, 1959 bp, Artificial Sequence
  Description of Artificial Sequence: Synthetic coding sequence
atgcggcccttgagaccacgggctgctctgcttgccctgctggcatctttgcttgcagcccctcctgtcgccccagctgaggctccacacctggtgcacgtcgacgccgcccgcgccctttggccactcagacgcttctggagaagcactggcttctgtcccccgctaccacattcacaggcggaccagtatgtactgtcttgggaccagcaacttaatctcgcctatgtcggcgcggtaccccacagggggatcaagcaggtaagaactcactggctccttgaactggtgaccactagagggagcaccggacgcgggttgtcttacaactttacacatctggacggttacctggacctccttcgagaaaatcagctccttcctggttttgagctcatgggatcagccagtggtcactttacagacttcgaggacaaacagcaggtgtttgagtggaaagatcttgttagttctttggcccggaggtacataggtcggtatggcctcgcccacgtcagcaagtggaacttcgagacctggaacgagccagaccaccacgacttcgataatgtatccatgactatgcaaggctttttgaactactacgatgcttgctctgagggcctgcgcgcagcgtctccggcgcttcggctcggtggcccaggggatagttttcacactcccccccggagtccattgtcttggggtctcctccgtcactgccacgacgggacgaactttttcacgggtgaggctggcgttcgcctcgattacatctctctccatcgcaagggtgccagatcgtccatcagcatccttgaacaggagaaggtggtcgcacagcagatcaggcaacttttcccaaaatttgctgacactcctatctataacgacgaagcagatccactagtgggctggtcactcccacaaccatggagagccgacgtgacgtatgccgccatggtggtcaaagtcattgcccagcaccagaatctcctgctcgcgaatacaacctcagcatttccgtatgccctcctatccaacgacaacgctttcttgtcataccacccgcacccgttcgcgcagagaacgctgacagctcgatttcaagtgaacaatacaaggccacctcacgttcagctgctgagaaagccggttttgacagcgatggggctgcttgcactgctggacgaggaacagctatgggccgaagtttcccaggccggcaccgtgctggatagcaatcacaccgtcggagtgctcgcttctgcccaccgcccccaggggcccgccgacgcatggcgcgcggccgtgctgatatacgctagcgatgacactagggcacatccaaaccgctccgttgctgtcaccttgagattgaggggagtgccacccggccctggtttagtgtatgtcactaggtacctcgacaatggcttgtgctctcctgacggtgagtggcgcaggctggggcgccctgtcttcccaacagctgaacagttcagacgaatgcgagccgccgaagatccagtcgccgccgcaccccgccccttacccgccggagggcgcctgactctcagaccagcactacggctgccctctctgctgctggtccatgtgtgcgccagacctgaaaaaccgcccggccaagtgacaagacttcgagctctccccctcacccagggacaattggttctggtttggagcgatgagcatgtgggctctaagtgcctttggacctacgagattcagttttcgcaagatgggaaggcatatacacctgtgtccaggaagccatcaaccttcaatttgttcgtttttagcccagataccggtgctgtgtctgggagttatcgcgttcgggctctcgattactgggctaggcctgggcctttttccgaccctgtgccatacctcgaagtgcccgttcctcgagggcccccatcgcccggaaatccc

SEQ ID NO: 13897 - DNA, 1959 bp, Artificial Sequence
  Description of Artificial Sequence: Synthetic coding sequence
atgcgcccgctcaggcctagagccgcattgcttgccctcctcgcctcgctgcttgcggccccgccggtggcgccagccgaggccccgcatctggtgcatgtggacgcggcccgcgccctttggcccctgagacgcttctggcggtcgactggcttttgtccgcctctgccgcattcccaagccgaccagtacgtgctctcctgggaccaacaactgaacctggcatacgttggagcagtaccgcatcgcgggatcaagcaagtgcgaacccattggctcctggaactcgtcactactcggggatcaaccggtaggggactgtcgtacaacttcactcatctggacggctacctggacctgctgcgagaaaaccagcttttgccgggtttcgaactcatgggctcggcctccggacacttcaccgacttcgaggataagcaacaagtgttcgagtggaaagaccttgttagctcattggctagaagatatatcggtaggtacggtctggcgcacgtgagcaagtggaattttgagacttggaatgaacctgatcaccacgactttgataatgtctccatgactatgcagggatttctcaattactacgacgcttgctccgaaggattgagggccgcgtcgccggcgctccggctgggaggcccgggggactcctttcacacgcccccacgctcaccgctgagttggggactgctccggcactgccacgacggcactaacttcttcaccggggaggcaggtgtccggttggattacatatcgttgcatcgaaaaggggcacggtcatccatctcaattctggaacaggaaaaggtggtggcccaacagatcagacagctcttccctaagttcgctgacacgcctatctacaacgatgaggccgaccccctcgtgggatggtcgctgccacagccatggagagcggatgtgacctacgcagccatggtggtcaaggtcatcgcgcagcaccagaacctcctcttggcaaacaccacttcggcgttcccatacgctctgctctccaacgacaacgcattcctgtcttaccacccgcatccgttcgcccagaggacgctgaccgctcgcttccaggtgaacaataccaggccgccgcacgtgcaactgctcaggaaaccagtcctgactgcgatgggacttctggcgcttttggacgaagagcaactgtgggcggaggtcagtcaggccggaaccgtcctggattccaatcacaccgtgggcgtgctcgcgagtgcacacagaccgcaggggccggcagatgcatggcgggctgccgtgctgatctatgcatcagatgatactcgtgcccaccccaatagatcagtggctgtgactctgcggctgcgcggggtcccgcctggaccgggcctggtgtacgtcacccggtacctggacaacggtctgtgctcgccggacggagaatggcgccggctgggacgccccgtgttccctactgctgagcaattccggagaatgagagcagcggaagatcccgtcgctgccgcgccaagaccacttccagctggaggtcgcctgactctcagaccggcgctgagacttccttcattgctgctggttcacgtgtgtgcccgcccggagaagcctcctggtcaagtaactcggctgcgggccttgccgctcactcagggccagctggtgctcgtttggtcagacgagcatgtgggctcgaaatgcttgtggacgtacgaaattcagttctcacaggatggtaaggcctacacccctgtgtccagaaagccaagcactttcaacttgtttgtgttttccccggacacgggagcagtctcgggctcttatagagtgcgggccctcgattactgggcccgcccgggaccattctcggatccggtcccatacctggaagtgcccgtgccgagaggcccgccatctcccggaaatcca

SEQ ID NO: 13898 - DNA, 1959 bp, Artificial Sequence
  Description of Artificial Sequence: Synthetic coding sequence
atgcgtccactgcgaccacgcgctgcactcctggcactgctggcaagtctgcttgccgcaccgccagtcgccccagctgaagccccgcatctggtgcatgtggacgcggctcgggcactctggccactgcgaaggttttggcgttcaacgggcttttgcccaccgctgccacattcgcaagcggatcaatatgtcttgagctgggaccagcagctaaacctggcttacgtgggagccgtgccccatcgcggaataaagcaggtacgcacccactggctgctggaactggtcaccactcgcggatcgactggccgtggcctgtcctataatttcacgcacctggatggttacctggacctattgcgggaaaatcagctcctcccgggcttcgagctcatgggaagtgcctcaggacatttcaccgattttgaggacaagcagcaggtctttgagtggaaggatctcgtttcctccctggcccgacgttatattggaaggtatggattggctcacgtgtcgaaatggaatttcgagacgtggaatgagccagaccaccacgactttgataacgtgagtatgacaatgcaaggattcctaaactactatgatgcctgctcggagggactgcgcgccgcttccccggctctgcgccttggaggtccgggtgacagcttccacacgccgccgcgctcgcccctcagctggggcctcctacgacattgccacgacggaaccaactttttcaccggcgaggcaggtgtgcgtttggattacatcagcttacaccgaaaaggcgcgcgcagctccatttcaatcctcgaacaggagaaagtcgtcgcccagcagatccggcagttgtttcctaagtttgcggataccccaatatacaacgatgaggcagaccctttggtgggctggtcgctcccccagccgtggcgagctgatgtcacgtacgccgcaatggtcgtaaaagtcatagctcaacatcagaatctcctgttggctaatactacatcagcctttccctacgccctgctcagcaacgataatgcctttctgtcctaccacccccacccttttgcccagagaactctgaccgctcgttttcaggtgaataatacccgaccgccgcatgtccagcttctccggaagccagttttgaccgctatgggcttgttggctttattggatgaggaacagctttgggctgaggttagccaggcgggaacggtattagactctaaccacaccgtgggagtcctggcgtccgcgcaccgtccccaaggccccgccgacgcctggcgtgctgcggtcctcatttacgccagcgatgacacgcgcgcgcacccaaacaggtctgtggcggtgaccctccggctgaggggagtacccccaggacccggcctagtctacgttacgcgctatctcgataacggcctgtgcagtccagacggcgaatggagacgcttgggccgacccgtttttccaacggctgagcaattccgtagaatgcgcgcagccgaagaccccgtggcggccgcgccaagaccgcttccagcaggtggtcgactcacccttcgacccgccctgcgactgccatcattgcttctcgtccatgtttgcgcccgccccgagaagccgcccggacaggtgacaaggttgcgggcgctgcccttgacgcagggtcagctggtgctggtctggagtgatgagcatgtgggttcgaagtgtttgtggacttacgaaatacaattcagccaagacggtaaggcatacacccccgtgagcaggaagccctctacattcaatctatttgtgtttagcccagacacaggtgcagtttccggcagctaccgtgtgcgagcgttggattactgggctaggcccggaccattctccgacccggtgccctacctggaggttcccgttccgcgcggtccgccaagccccggtaatccg

SEQ ID NO: 13899 - DNA, 1959 bp, Artificial Sequence
  Description of Artificial Sequence: Synthetic coding sequence
atgcggccactccggccccgagcggccctcttggccttgcttgcaagtctgctcgctgcgcccccagtggcccccgctgaggcacctcacctcgtacatgttgacgcggcccgcgcactgtggccattgaggcgcttctggaggagtaccggcttctgtccaccactgcctcatagtcaggcagatcagtacgtgctcagctgggatcagcagctgaacctcgcttacgttggcgccgtgcctcacagagggatcaagcaggtgaggacccactggctgttggagctggtcacaacccgcgggtccaccgggcggggcctcagttacaacttcacccacttggatggctatcttgacctgctgcgagagaaccaactcttaccaggattcgaattgatgggatcggctagcgggcactttaccgactttgaggacaaacagcaggtattcgaatggaaggacctagtcagctcattggctcgcaggtacattggcaggtatggcctcgcccacgtgagcaagtggaatttcgagacatggaacgaacccgaccaccacgatttcgacaatgtgtcaatgaccatgcaggggttcctaaattattacgacgcttgttcggaagggctgagggcagcgagccctgctctgcgtctgggtggaccaggggactctttccacacgcccccccggtcgccgctgtcctggggcttacttcgacactgtcacgacggcaccaatttcttcactggggaagcaggggtaagactcgactatatcagtctccataggaaaggcgcccggagctctattagcatacttgagcaggagaaggtggttgctcagcagatccgccaactctttcctaagttcgcagatacaccaatttataatgatgaggcagatccgcttgtaggatggtctctcccacagccctggagggctgatgtgacttacgccgctatggtggtgaaggttatcgcccagcaccagaatcttttgctcgctaatacgacatcagcttttccctatgctcttctgagcaacgacaatgcgttcctcagttatcacccacatcctttcgctcagcgaaccctgacagccaggttccaagtcaataacacgagacctccacacgtgcaactgctgcgcaagccggttctcaccgcgatgggattactcgcccttctggacgaagaacaactgtgggccgaagtgtctcaagctggtacagtgctggattcaaatcataccgtgggcgttctggcttcagcccacagacctcaaggccctgccgatgcttggcgtgctgccgttttaatctacgctagtgatgatacccgagcgcatcccaacagatctgtggcagttacactccggctacgcggggtgccaccaggaccagggctggtttacgtgacccgctatctcgataacggactgtgcagcccggacggagaatggcgaagactggggagacctgtcttcccaacagcagagcagttcaggagaatgcgcgctgccgaagacccagttgcagcagccccgcgcccgttgcccgccggagggcgtctgacgttgcgaccggcccttagattgccaagtctgctgcttgttcatgtatgcgcaagacccgagaaaccccccgggcaggtgactcgtctccgcgcactcccactcacacagggccagcttgtgctggtctggagcgatgaacacgtcggctcaaagtgcctttggacctacgaaatccagttctctcaggatggcaaggcttacactcctgtgagtagaaaaccaagcaccttcaacctgtttgtgttcagtcctgacacaggagcggtgtcaggatcgtaccgcgtccgggccctcgattactgggcccgcccaggccctttttcagacccagttccctatctggaggtcccagtaccaagagggcctccttcccccggaaatccc

SEQ ID NO: 13900 - DNA, 1959 bp, Artificial Sequence
  Description of Artificial Sequence: Synthetic coding sequence
atgcgccccctcaggccaagagccgccctcttggctctgctggccagcctcctggcagcccctcccgttgctcctgctgaagcaccccacttggttcatgttgatgcagccagggccctgtggccacttaggaggttttggagaagtaccggtttctgcccccctctgcctcacagtcaagctgaccagtacgtgctgagttgggaccagcagcttaaccttgcctatgtaggcgcggtgccccatagaggtatcaagcaagtgcgcacccattggctgctcgagctggtaactaccagaggttcaactggtcgcggcttgtcttacaatttcacccacctcgacggatacctcgatttgctgcgcgaaaaccagcttctccctggcttcgagctgatgggaagcgcctcaggccacttcactgacttcgaagacaaacaacaggtgttcgagtggaaagatctggtctcttccttggctcgcagatacatcggaaggtacggcctggcccacgtgtcaaagtggaacttcgaaacctggaacgaaccagaccaccatgacttcgataacgtatccatgaccatgcaaggattccttaactactatgacgcgtgctcagagggcttgagggcagcaagccccgccctccgcttgggtggccccggcgacagctttcacactcccccaaggagcccgctgagctggggtcttctgagacattgtcatgatggcactaacttcttcaccggagaagccggagtgcgcctggattacatctccctgcacagaaagggcgctcgcagctccatcagcattctggagcaggagaaggtcgtcgcacagcagatcaggcagctcttcccaaaatttgctgatactccgatttataacgacgaggctgaccccctggtgggctggtcccttcctcaaccctggagggctgacgttacctatgcggctatggtagtcaaagtcatcgcccagcatcagaatttgcttcttgcaaacaccactagcgcttttccctacgcactgttgtcaaacgacaatgcctttctgtcataccacccccaccccttcgcccagaggaccctcaccgccaggtttcaggttaacaatactaggcctccgcatgttcaacttctgagaaagccggtactcaccgctatgggactgctggccctgctcgacgaagaacaactgtgggcggaggtcagtcaggccggcactgtgctggatagtaatcatacggtgggcgtcctcgcttctgcccatcgccctcagggtccggcagatgcatggcgcgccgccgtactcatctacgcctccgacgataccagggcccaccccaatcgctcagtggctgtcacgctccgcttgcgcggcgtgccccccggaccaggtctggtgtacgtgactcgctacttggacaatggtctgtgttccccagatggtgagtggagacgcctgggtcgcccggtctttccaaccgccgagcagtttaggagaatgagggccgctgaggatcctgttgctgcagccccgcgccccctcccagctggcggaaggttgacactcagacctgctctgagactcccaagcctcctcctggtgcatgtgtgcgcaaggcccgagaaaccacctggacaagtgaccagacttagggcactgccactcacccaaggccagctcgtgcttgtttggtcagacgaacacgtcggttccaaatgcctgtggacctacgaaatacagttctcacaggacggcaaggcctacacccctgtgtccaggaagccaagtactttcaacctgttcgtgttttctcccgacacgggtgccgtgagcggctcctatcgcgtgcgcgctcttgattactgggctcgccccggacctttctccgacccagtgccttacttggaggttcccgtcccgcgcggacctccttcccctggtaacccc

SEQ ID NO: 13901 - DNA, 1959 bp, Artificial Sequence
  Description of Artificial Sequence: Synthetic coding sequence
atgcgtcctctccgcccccgggcagcccttctcgctcttctggcgtcccttcttgcagctccaccagtggcacctgcagaagctccccatctcgtgcatgtggacgcagcgcgcgccctctggccgctccggaggttttggcggtcgactggattctgccctcctctgccacattctcaagccgatcaatacgtgcttagctgggatcagcaactgaaccttgcatacgtgggggcagtgccgcaccgcggaatcaagcaggtgcgcacccactggctccttgagctggtcacgactagaggctcgaccgggcgcggactcagctacaacttcacccatctcgatggttacctggacttgcttagagaaaatcagctgttgcctggttttgaactgatgggatccgcgagcggtcattttacggacttcgaggacaaacagcaggtgtttgagtggaaggatctcgtgtcgagccttgctcgccgttacattggccgctacgggttggcacatgtctcgaaatggaattttgaaacctggaatgaacctgatcatcatgactttgataatgtgtcaatgaccatgcaaggtttcctgaattactacgacgcgtgtagcgaaggactgcgagcagcatcgccagcactcagactgggaggtccgggtgactcctttcatactccacctcgctcgcctctttcgtggggacttctccggcattgtcatgacggcaccaatttctttaccggagaggcaggagtgcgcttggactacatttcgctgcatagaaagggtgcgaggtcgtcgatctccattctggaacaggagaaggttgtcgcgcaacagataagacagcttttccccaaatttgcagatactccaatttacaacgatgaagctgatccacttgtggggtggtcactcccacagccttggagagcagatgtgacctacgcagcgatggtggtgaaggtgatagcccaacaccaaaatctcctccttgcaaacacgacttcggctttcccctatgcccttctgagcaacgataacgcattcctctcgtaccatccccaccctttcgcacaacgcactctgaccgcacggtttcaggtcaacaacactaggccaccacatgtgcagcttttgcgcaaacctgtgctcaccgcaatgggactgctggcactgcttgatgaagagcaactttgggcagaagtctcgcaagccggtaccgtgctggactcaaaccatactgtgggagtgcttgcatccgcacatagaccccaaggtcctgctgatgcatggcgggctgcagtcctgatttacgcctccgacgacaccagagcccaccctaatcgctcagtggccgttacccttagactcaggggagtgcctcctggcccaggactcgtgtacgtgactcgctaccttgataatggactctgctcgcctgacggtgagtggcgacggctgggtagaccagtgtttcccactgcggagcagtttcggcgcatgagggcggcagaggatccagtcgcggccgcgcctaggcctctgccggcaggcggtagacttacgctgcggcccgccctgaggctgccatccttgttgcttgtgcatgtgtgcgcgcgtcccgaaaaacctcctggacaggtcacccgccttagagcacttccacttactcaaggacagcttgtccttgtgtggagcgatgaacatgtgggttcgaagtgcctgtggacctatgaaattcaattttcacaggatggaaaagcatacacccctgtctccaggaagccgtccacctttaatctttttgtgttttcccccgacaccggagcagtctctggaagctacagagtgcgggcactggattattgggccaggccaggaccctttagcgatccagtaccataccttgaagtcccagtgccacgaggccctccatcacccggaaacccc

SEQ ID NO: 13902 - DNA, 1959 bp, Artificial Sequence
  Description of Artificial Sequence: Synthetic coding sequence
atgaggccacttcgtcctcgggcagcactgttagcactccttgcttccctgttagctgctccccctgtcgctcctgcggaagctcctcacctcgtccacgtggacgccgccagagccctttggccactgagacgattttggcggtctacgggattttgtcccccactgccccacagccaggctgatcaatacgtcctgagttgggatcaacagttgaacttagcatacgtgggggccgtgccccatcgcggcattaagcaggtcagaactcattggctgctggagctggttaccacacgcgggtctactggacggggattatcatataactttactcatcttgatggctacctggatcttctgagagaaaatcagcttttgcccggcttcgagttgatgggctcggcgtccggacactttacagactttgaggacaaacaacaggttttcgaatggaaggacttggtttcttctttggcccggaggtacatcgggcgttatggcctcgctcacgtttccaagtggaactttgaaacgtggaacgaaccagaccatcatgattttgataacgtgtcaatgacgatgcaggggtttttaaactattacgatgcttgtagtgagggcttacgcgctgcttccccagctctgaggttaggtggcccgggcgatagcttccataccccgcctaggtctcccctgagctggggactgctgagacactgccacgacggtacaaacttctttacgggtgaggcaggagtacgtcttgattatatctctctgcacaggaaaggagctaggtcctctatctcaattctggagcaagagaaggtggtcgcccaacaaatccggcagcttttccctaaatttgctgatactccaatttataatgacgaggcagatccactggtgggttggagtttgccacaaccatggagggccgatgtcacatatgccgctatggtcgtgaaggtcattgcccagcaccagaacttactccttgctaacacaacatctgcctttccttatgcactcctgagcaacgacaatgctttcctaagttaccatcctcatccattcgctcagcgtactctcacggctaggttccaggtgaacaatacccggcccccgcatgtccaactcttgcgaaagcccgtactaaccgctatgggcctgcttgctctgttggacgaggaacagctctgggccgaggtgagccaggctggaacggtactcgattcgaaccatacagttggtgttctggcctcagctcatcgcccccagggccccgcagacgcatggcgggcggcagttctgatatatgcgtcggatgatacccgggctcatcctaaccggagcgtcgccgtaaccctcagactgcgaggggtgccgcccggcccaggcttagtttacgtgactcgataccttgacaacggcttgtgtagtcccgacggagagtggaggagactcgggagacccgtcttccctacagccgagcagttcaggaggatgcgggctgcagaggacccagtggccgcagcaccaagaccacttcccgcaggtggccgtctgaccttacgcccggcattgcggttaccctctcttctcctcgttcacgtgtgcgctcgaccggagaaaccacccgggcaggttactagactccgggcgctgcctctgacacagggccagttggtgctggtctggtccgatgaacacgtaggcagcaaatgtctctggacgtacgagattcagttttcacaagatggcaaggcatacacacccgtttccagaaaacctagcacttttaacctgttcgtcttttcaccagatacaggggctgtcagtggatcttatagagtccgggccctagactactgggcgagaccaggccccttcagtgatccagtgccatatttagaggtcccagtccctagggggccgccctcaccaggtaaccct

SEQ ID NO: 13903 - DNA, 1959 bp, Artificial Sequence
  Description of Artificial Sequence: Synthetic coding sequence
atgcggccgcttaggccccgcgccgccctcctggcactgctggcatcccttttggcagctccaccagtggctcctgcagaggcacctcacttggtgcatgtggatgcagcaagagcactgtggccgctgcggagattttggcgaagcaccggattctgtccaccacttccacattcccaagccgatcagtacgtccttagctgggatcagcagctcaatttggcttacgtcggggcagtccctcatcggggaattaagcaggtgagaacccattggcttctggagttggtgactactcgtggttcgaccgggcggggactctcatacaacttcactcatctggatggttaccttgaccttctgcgtgaaaatcagcttcttccgggatttgagctgatgggttcagcctcggggcattttactgacttcgaagataagcagcaggtctttgaatggaaggatctcgtgtcgtcactggcgaggagatatatcggacggtacgggctggcacatgtgtcgaagtggaactttgaaacttggaatgagccggatcatcacgattttgataatgtgtccatgaccatgcagggtttcctgaactactacgacgcatgcagcgaaggactccgtgcggcctcgcccgcgctgcgactcggcgggccaggtgattcattccacactccacctcggtcaccacttagctggggattgctgagacattgccatgacggtaccaacttctttacgggcgaagcaggggtcaggttggactacatctccttgcatcgtaagggtgcaagatcgtcaattagcatcctggagcaagagaaggtggtggcgcaacagattaggcaactttttcctaagtttgcggacactcctatttacaacgacgaagcagatcccttggtgggctggagcctgccccaaccgtggcgtgcagatgtcacttacgccgcaatggtcgtgaaggtgatcgctcaacatcagaatcttttgctcgccaataccacctccgctttcccgtacgccctcctctcgaacgacaatgcgtttctgagctaccaccctcaccctttcgcccagcgtactctcaccgcaagatttcaagtcaacaacactaggcctcctcatgtccaacttcttcggaaacctgtgctgactgcaatgggccttcttgcccttcttgatgaggagcaattgtgggccgaggtttcgcaggcgggaaccgtccttgactcgaaccatactgtgggagtccttgcttcggcacaccgcccccaagggccggctgatgcatggcgagcagcagtgttgatttatgcatccgatgatacccgagcacaccccaataggagcgtcgcagtgaccctcagacttagaggagtgccgcctggacctgggctggtgtacgtcacgcgttacctcgataatggtctttgttcaccagatggagagtggcgtagacttggtcggcctgtgttccccaccgcagagcaattccgtcggatgcgcgcggcagaagatcctgtggctgccgcccctcggcctctgcctgccggaggcaggcttactctgcgccccgcgctcaggctcccatcgctcctcctggtccatgtgtgtgctcgaccagaaaagccaccaggtcaggtcacccggctcagagcacttcctctgacccagggacagcttgtgctggtgtggagcgacgaacatgtgggttccaaatgtctttggacttacgaaatccaattctcgcaagacggtaaggcctacacccctgtgtcgagaaagccctccacctttaacctctttgttttctcccctgataccggggcagtgtcgggatcgtacagagtgcgggcactggactactgggcaaggcccggtccattctcagatccggtgccttacctcgaagtgcccgtgcccagagggccgccatcaccaggaaaccca

SEQ ID NO: 13904 - DNA, 1959 bp, Artificial Sequence
  Description of Artificial Sequence: Synthetic coding sequence
atgcgacccttacgcccccgggccgccctgctcgccctattagcatccctgctggcggctccacccgtggctccagcagaggccccgcatctcgttcacgtagatgccgccagggcactatggcctctgcgcagattctggcggtcaaccggcttttgtccaccgctaccccattcacaggccgatcaatacgtgttgagctgggaccagcaactcaacctagcgtatgtgggggcagtgccacaccgcgggatcaaacaggtacgcacccactggctactagagctggtaaccaccagggggtcaaccgggcgcgggctttcatacaacttcacacacttggatggctaccttgatcttttacgggagaatcagcttttaccgggctttgagcttatgggcagtgctagcggtcattttacagacttcgaagacaaacagcaggtgttcgagtggaaggacctggtatccagcctggctagacgatatataggacggtatggccttgctcacgtgtcaaagtggaatttcgagacatggaatgaaccagatcaccacgactttgataatgttagcatgaccatgcaggggttcctgaactattatgatgcctgctccgaaggtctgagggccgcatcccctgcactgagattgggaggcccaggcgactcttttcatactcctccgcggtcaccattaagttggggcctgctgcgccattgtcacgacggcactaactttttcaccggggaagcgggagtacgcctcgactatatatcactccacagaaaaggcgcccgttcttccatttccattctggagcaggaaaaggtagtagctcagcaaatcagacagctgttccccaaattcgccgacaccccgatctataacgatgaggccgaccctcttgtcgggtggtccctgccacagccgtggagagcagacgtgacctatgcagccatggttgtcaaggtcatcgcccagcatcagaatctgctcctggctaataccactagcgcctttccttacgccctgctgtccaacgacaacgcgttcctttcttatcatcctcacccattcgcgcagcggacactaaccgcaagattccaggtcaataatacaagacccccacatgtgcagttgctcagaaaaccagttctgactgctatggggctactcgccttactcgacgaggagcagctgtgggccgaagtttcccaggcaggaacagtcctcgactccaatcacacggttggcgtcttggcgtcagctcacaggccgcagggacctgccgatgcttggcgggcagccgtgcttatttatgccagtgacgataccagagcccacccaaaccgcagtgtggccgtcaccctgagactgaggggcgttcccccaggtcctgggctggtgtacgttacaagatatctggataatggactgtgctctcccgacggtgaatggaggagactgggccgacctgtgtttcctactgctgagcagttccgacggatgagggcagctgaagacccagtggcggctgcccctagacccctgcccgctggcggaaggctgactctgcggccagccctgcgcctccctagtctgttgttggtgcatgtctgcgcccgacccgaaaaaccccctggccaggtaacacgacttcgagctcttccgctgacacagggtcagctcgtgctagtttggtctgacgaacacgtgggcagtaaatgcctgtggacttacgaaatccaattctcccaggacggaaaagcctacacgcccgtgtcgcgaaagcccagtacttttaacttgttcgtgttctcccccgacaccggtgccgtcagtggctcatatagagttagagcactggattactgggctagacccggcccattttcagaccctgtaccatatctcgaggtgcccgtgcctcgggggccccctagccccggcaaccca

SEQ ID NO: 13905 - DNA, 1959 bp, Artificial Sequence
  Description of Artificial Sequence: Synthetic coding sequence
atgcgcccccttcgtccgagagctgcacttcttgccctgctcgcaagcctcctggcagcccctcctgtggcacccgcagaagcaccgcatctggtacacgtggacgcagcccgggcattgtggccattgcggaggttttggcggtccaccggcttctgccctccacttccacattcgcaagcagatcaatatgtgctgtcatgggaccagcagttgaatctggcttacgtgggagccgttccgcatagaggcattaagcaggtgcgcactcactggctgctggagctcgtcaccactcgtggatctaccgggagaggactttcatacaactttacccatctggacggttaccttgatctgcttagggagaaccagctgctcccaggatttgaactcatggggtcggcgagtggtcattttactgactttgaggacaagcagcaagtgttcgaatggaaggacctggtgtcatcgctcgcacgccgttacataggacgttacggcctggcccatgtgtcaaaatggaattttgaaacctggaacgagcccgatcaccatgatttcgacaacgtctctatgaccatgcagggattccttaactactatgatgcatgttctgaaggtctgagagctgcgagccctgcactgcgtctgggaggcccaggtgatagcttccatactccaccacgcagcccattgagctggggacttcttaggcattgccacgatggtactaatttctttaccggagaggccggcgtccggcttgactacatttcactccaccgcaaaggagcaaggtcctcgatctcaatactggaacaagaaaaggtggtggcccagcaaatcagacaactttttccaaaattcgcagatacccctatttacaacgacgaagcagatcctcttgtcggttggtccctcccccaaccctggagagccgatgtcacctacgccgcaatggtggtgaaggtgattgcgcagcatcaaaacctcctgcttgcaaacaccacctcggcatttccatacgcactcctgtcgaatgataacgctttcctcagctaccatccacaccccttcgcgcaacgtactctgaccgcacggttccaagtgaataacactcgccctccccatgttcaacttctgcgaaagcccgtccttaccgccatgggattgctggccctgctcgatgaagaacaactctgggcggaggtcagccaggcaggaactgtgcttgactcgaatcataccgtgggcgtcctcgcatcggctcaccggccgcaaggtccagctgatgcatggcgcgcagcagtcctgatctacgcctcggatgacactcgcgcccatccaaacaggtccgtggctgtcacccttcggctgagaggtgtgcctccaggaccgggactggtgtacgtgacgagatacctcgataatgggctgtgtagccctgatggagaatggaggaggttgggaaggcctgtgttccctacggccgagcagtttcgaagaatgcgggcagccgaggatccagtggcagcggctccacgaccacttccggcaggtggtagactgactctgcggccagcactcagactcccttccctgttgttggtccatgtttgcgcacgaccggaaaaacctcctggacaagtgacgagacttagggcacttcctctcacccaagggcaactcgtgcttgtgtggtccgatgagcacgtaggctcaaagtgcctgtggacctacgaaattcaatttagccaggacggtaaggcctacactccggtatcgcgcaagccctccacttttaacctctttgtcttttcccccgatactggcgcagtgtcgggctcgtacagagtcagagcgttggattactgggcaaggccgggaccattctcagatccggtcccatatctggaagtgccagtccctagaggaccgccatcccccgggaaccct

SEQ ID NO: 13906 - DNA, 1959 bp, Artificial Sequence
  Description of Artificial Sequence: Synthetic coding sequence
atgcgcccactcagaccccgtgccgcacttctggctctgctggctagccttctggcggcacctccagtggccccggctgaagcacctcacttggttcacgtggacgccgcacgagcgttgtggcctctgagacggttttggagatcgactgggttttgtcccccactgccacattcgcaagcagatcaatatgttctctcctgggaccaacagcttaatcttgcatacgtgggcgcggttcctcatcgcggtattaagcaagtgagaacgcactggttgctggaactggtgactactagaggatcgaccgggagaggactgagctacaactttactcatcttgatggttaccttgatctcttgcgggagaaccaattgctgccaggattcgaacttatgggctccgcatccggccacttcactgactttgaagataagcagcaggttttcgagtggaaagatttggtgtcgagccttgcccgccgctacatcggcagatacggactggcacatgtgtcgaagtggaacttcgagacttggaacgagcctgaccaccacgattttgacaatgtcagcatgactatgcagggtttcttgaattactacgatgcatgttcagaaggtctgcgcgcagcgtcgcctgcactgagactggggggccccggggacagctttcatacgcctccaagaagcccactttcgtggggccttctcaggcactgtcacgacggcactaacttctttaccggagaagcgggagtcagactcgactacatatccttgcatagaaagggagccagatcaagcatttccatcctggagcaggagaaggtggtcgcccagcagattcgacagttgttcccgaaattcgcggatacccctatttacaacgatgaggcagatccactggtcggctggtcccttccccaaccttggcgcgccgatgtgacctacgccgcaatggtggtgaaggtgatcgcacaacaccagaatctcctgctcgctaataccacctccgccttcccatacgcccttctgtcgaacgacaatgcatttctctcctaccatccgcatccctttgcccaacgaacgcttacggccaggtttcaagtgaacaacacccgacccccgcacgttcagctcctgagaaagcccgtgcttaccgcgatgggactcttggcccttctggatgaggagcagctctgggcagaagtctcgcaggctggaacggtccttgactcgaatcataccgtcggagtgctggcatctgcccacagacctcaaggacctgccgacgcatggagagcagcggtgctgatctacgctagcgatgatactagagcacatcctaacagatcggtggccgtgactctccggctgcgtggtgtcccacccggacctggccttgtgtacgtgaccagatacctcgacaacgggctgtgttcacctgatggtgagtggcggaggttgggcaggcccgtgtttcctactgccgaacaattcagacgcatgcgcgcagcagaagatcctgtggcagcggcacccagaccacttccagcagggggcaggctcactctcagacctgcactcagactgccatccttgctccttgtgcatgtctgtgcaagacctgaaaaaccgccgggacaggtgacccggcttcgagccctcccactgacccagggtcaactcgtgcttgtgtggagcgatgagcacgtgggaagcaagtgcctctggacttatgaaattcaattttcgcaagatgggaaagcgtatacccctgtaagccggaagccttcaaccttcaatctgtttgtgttttctcctgataccggagctgtctctggttcgtacagggtgcgggcccttgactactgggcgaggccaggacctttctcggatccagtcccctatctggaggttcccgtgcctagaggccctcctagccctggaaatcct

SEQ ID NO: 13907 - DNA, 1959 bp, Artificial Sequence
  Description of Artificial Sequence: Synthetic coding sequence
atgcgtcccctgcgccctcgcgcggcactactcgcgttgctggccagcctgcttgccgctcccccagtcgccccagctgaagccccacatctggtacacgtggacgccgcaagggcgctgtggccactgcggagattctggagaagtactggattctgtcctccattgccccactcccaagcagaccagtacgtgttgtcctgggatcagcagcttaatctggcttacgtgggcgccgtgccccataggggcattaaacaggtccgcactcattggctgttggaacttgtaacgacacgggggtcaaccggtcgtggtctcagctataatttcacacacctggacggatatcttgacctcctcagggagaatcagctgttgccaggattcgaacttatgggcagtgccagtggccacttcacggacttcgaagacaagcagcaggtcttcgagtggaaagatctggtatcctcattggcgcggcgatacatcggccggtatgggctagctcatgtttcaaagtggaacttcgagacctggaacgaaccggaccaccacgacttcgacaatgtgtctatgacaatgcagggattcctgaactattacgacgcttgtagcgagggtctacgagctgccagtcccgcccttaggcttgggggtcccggggatagcttccacacacccccacggtctccactttcgtggggcctgcttaggcattgccatgacgggacaaactttttcaccggggaagcaggggtacgcctggattacatcagcctccacaggaaaggagcccggtcttcaatctcaatactggaacaggagaaagtggttgctcaacagatacgccagctcttcccaaaattcgctgatactcccatatataatgatgaggcagatccccttgtcggctggagcctaccacagccgtggcgcgcggatgtgacttatgccgccatggtcgtcaaagtgatcgcgcagcatcagaacctattgctcgcaaataccaccagtgcgttcccttatgccctgctgtccaatgacaatgcgtttctgtcttaccaccctcacccttttgctcaacgtacactgaccgcccgcttccaggttaacaacacaaggcccccccacgtgcaacttctgaggaagccggtgctaacagccatggggctcttagccctgctcgacgaggagcagctctgggccgaagtcagtcaggcagggacagtgctcgattccaatcacaccgtgggtgtgctagcttcagcacataggccgcagggccccgccgatgcctggcgcgccgccgtgttgatttacgcttctgatgacacgcgcgcgcatcctaaccggtcagtggccgtgacactgcggctcagaggcgtccctcccggccctggcctcgtatacgtaacgcggtatttggataacggcttgtgcagccctgacggcgagtggcggagactgggtaggccagtctttcctacggcagagcaatttagacgaatgcgtgccgcagaagaccccgtggctgccgctccaaggcccctgcccgccggaggccggttaacactgaggccggccttgcggctcccctccctcctgttggtgcacgtatgcgcacgcccggagaaaccccctggacaggttacgagactccgagccctgccactcacccagggtcagctggtcctggtgtggtcagacgagcacgtcgggtcaaaatgcctgtggacctacgagatccagtttagccaggacgggaaggcctacacccccgtgtcacgcaagccatcaacttttaacctcttcgtcttttcccctgacacaggagctgtgagtgggtcataccgcgtgcgcgcccttgactattgggcacgacctggaccattcagtgatcctgtcccgtatctggaggtccctgtgccccggggccctccgtctccggggaatcca

SEQ ID NO: 13908 - DNA, 1959 bp, Artificial Sequence
  Description of Artificial Sequence: Synthetic coding sequence
atgcggccattgcggccacgcgcagctttattggctttgctcgcatccctgttggctgcgccacccgtggcacctgcagaggccccccacttggttcacgtcgacgcagctagagctctgtggccactccggcgcttttggagatctaccggattctgcccccctctgcctcattcccaagcagatcaatacgtcctgtcctgggatcaacagttgaacctggcatacgttggagcagtgccccacaggggaatcaaacaggttagaacacactggctgctggaactggtcactacaaggggaagcaccggacggggcttgagctataacttcacacatttggatggttacctcgacctcttaagagaaaaccagctgctacccggctttgaactcatggggtctgccagcggccactttacagatttcgaggataaacaacaagtctttgagtggaaggatctggtgagcagccttgctagacgctacattgggaggtacggcctggcccacgtgagtaagtggaattttgaaacctggaatgagcctgatcaccatgatttcgataatgtcagtatgacgatgcagggatttctgaattattacgatgcatgtagtgaaggcctgagggcagcctctcccgcgctgcggctcggaggacccggggactcttttcacaccccgccaaggtctcctctgagctggggccttctgagacattgccatgacggcacaaacttctttaccggagaagctggcgtgcgcctggattacatcagcttgcacaggaaaggagctagatcttccatttccatactggagcaagaaaaagttgtggcgcagcagatccgccagcttttcccaaagttcgccgatactcctatctacaatgacgaggccgaccctctcgtgggatggtctctgcctcaaccatggcgagcagacgttacatatgccgccatggtcgtaaaagtgatcgctcaacaccagaacctgcttctggcgaacaccacctccgctttcccatacgctctgctttctaacgacaacgcattccttagctatcacccacatccttttgcccaaaggacactcacagctagattccaggtcaacaacaccaggcctccccacgtgcagctgctgcggaaacccgtgttgaccgccatgggcttgctcgcactcctggacgaggagcagctgtgggcagaagtcagccaagccggaactgtcttggactcaaatcataccgtaggagtcctggcttcagcccatagaccgcagggccctgcagacgcttggagggccgctgtgttgatctacgcatcagatgacactcgagctcatcctaaccgatccgtagccgtaaccctccgcttaaggggggtaccccccggtcctggcctggtttacgtcacaaggtatctggacaacggcctctgtagccctgatggagaatggaggcgccttgggcgaccagtctttcccaccgccgagcagttccgcaggatgcgcgctgcagaggatccagtggcagcagctccacgcccactgcctgctgggggacgcctcacactcagacccgccttgagacttcccagcctgcttcttgtgcatgtatgtgcaaggccggagaaaccacccggccaggtcacccggctgagggcattacccctgacccagggacagttggttctcgtgtggtccgacgagcatgtcggcagtaagtgtttatggacatacgaaatacaatttagtcaggatgggaaggcatatactcctgtatccagaaagccttcaaccttcaacctgtttgtctttagtcccgataccggcgccgtgagtggaagctaccgggtgcgcgctctggattattgggcaaggccaggcccctttagtgacccggtcccttaccttgaagtgccagtcccccgcggcccaccatcacctgggaatccc

SEQ ID NO: 13909 - DNA, 1959 bp, Artificial Sequence
  Description of Artificial Sequence: Synthetic coding sequence
atgagacctttgcggccgcgagccgccttgctggccttattggcaagtttgttagcagcaccacctgtcgcacctgcggaagcgcctcatttagttcatgtggatgcggcccgcgcgttgtggccattgcggagattctggcgctctacggggttctgtccgcctcttccgcattctcaagctgaccaatacgtgctttcttgggatcagcaacttaatcttgcctatgtcggagccgtaccccaccgtggcattaaacaggtcaggacacattggcttttagaactagtaacaactaggggttctactgggagaggacttagttataacttcacacatttggatggatatctggatttactccgggaaaatcagctgcttcctggatttgagctgatggggtctgcgagtggccacttcacggattttgaagataaacaacaggtttttgaatggaaagatctcgtttcttctcttgcacgacgctacattggaagatacgggctggcgcacgtaagcaaatggaattttgaaacgtggaacgagcctgaccaccatgatttcgataacgtatctatgactatgcagggttttctgaactactatgatgcctgttcagaagggctccgagctgcttctcctgctttaagacttggcggtcctggggattcttttcatacccctcctcgttcccccttgtcatggggcttactgcgccattgccatgacggaacgaacttctttacaggcgaagcgggagtaagacttgattatatcagcctacacagaaagggcgctcgctcctcgattagcattctagaacaggaaaaagtagtcgcccagcaaatcagacaattgtttcccaaattcgcagatacaccgatttataacgacgaagcggatcctttggttggttggtccctcccacagccgtggcgcgctgatgttacgtatgccgccatggtcgttaaagtaatcgcccagcaccaaaatttgctcttagcaaacactacatccgcctttccgtatgcgttattgtctaatgataacgcgttcctctcatatcatccacatccgttcgcgcaaagaacacttacggcgagatttcaagtaaacaatacacgcccgccgcatgtccagttgcttaggaagcctgttctgacagctatgggtctcttagcgttgcttgacgaggaacagctctgggcggaagtgagccaagctggcacagttctcgactcaaatcataccgtgggggtcttggcgtcagcgcatcgcccgcaaggccccgcagatgcatggagggcggctgtcctgatttatgcgagcgatgatactagagcccatccgaatcggagtgtagctgttacactgcggctgcgtggagttccacctgggccgggactggtctatgtgacacgatacttagacaacggactttgctcgccggatggtgagtggcgcaggcttgggagacccgtattcccaacggcagaacagtttagacgtatgcgtgcagctgaagaccctgtagctgctgcaccgagaccgttgccagctggtggcagactgacattaagacctgccttgagattgccgtctctgctactagtccatgtttgcgcgcgccctgaaaaaccgccaggccaagtcactcgtcttcgtgcacttccgcttacacagggccaattggtgcttgtttggtctgacgaacatgtgggtagcaaatgtttgtggacgtacgagattcaattctctcaagatggcaaagcttacacaccggtgtctcgcaaaccttctacattcaatctttttgtcttctcaccagatacaggagcagttagcggctcataccgagtaagggcgttggattattgggcgcgtccgggcccgttttcagatccggtgccctaccttgaagtcccggtaccgaggggtccgccgagccctggcaaccct

SEQ ID NO: 13910 - DNA, 1959 bp, Artificial Sequence
  Description of Artificial Sequence: Synthetic coding sequence
atgcgacctctgaggccccgagctgccttgttggctctcctggcctctctgctggccgcacctcccgtagcccccgctgaggccccccatcttgttcacgtcgacgccgcaagagccctttggcccttgcgccgcttctggagatcaaccgggttttgtcctcccctcccacacagccaggctgaccaatacgtcctctcatgggaccagcagcttaacctggcttatgttggtgccgtgccccaccgcggcatcaagcaagtgaggacgcattggctcctcgagcttgtgaccactagaggctccacagggcgcgggcttagctataactttacacacctggacggatacctggatctgctgagggagaatcagctgttgcctggttttgagctgatggggagcgcgtctgggcatttcacagactttgaggacaaacagcaggtatttgagtggaaagatttggtgagctcactggcacggagatatatcgggaggtacggactggctcacgtgagcaagtggaattttgaaacatggaacgagccggatcaccatgattttgataatgtctcaatgactatgcaaggcttcctgaactactacgacgcttgctcagaaggtctccgagccgctagccctgccctccgacttgggggccctggtgattccttccacacccctcccagatccccactctcttggggcctccttagacattgccatgacgggaccaactttttcaccggggaagctggagttaggctcgactatattagcctgcaccgcaaaggcgcccgctcatcaatctctattctggagcaggagaaggtggtggcgcagcagatcaggcagctctttcccaagttcgctgatacgcctatttataacgatgaggccgatcctctggtgggctggagtcttccccaaccctggagagctgacgtgacttacgcagctatggtcgttaaagtgattgctcaacaccagaacctcctgctggccaatacaacctcagccttcccctatgccctgttgagtaacgataatgcctttttgtcctatcatccgcaccctttcgcccagagaaccctgacggcccgatttcaggttaataatactagacctccgcatgtccagctcttgagaaagcccgtgctgaccgccatgggcttgctggccctcctcgacgaagagcagctttgggccgaagtgagtcaggcaggcacagtcctggacagcaatcataccgtcggcgtgctcgccagcgcccatagaccacagggccccgcggacgcttggagagcggcagtgctgatctacgcttctgacgatactcgagctcaccccaacaggagtgtggctgtcactctgaggcttagaggcgtgccacccggacccggtctggtttacgtcacgagatacttggacaatggtctgtgctcacctgatggagagtggcgacgactcggacgacctgtgttccccactgccgaacagttccgaaggatgagggccgccgaagatcccgtggctgctgccccaaggcccctgcctgcaggaggccgcctcacgctgagacccgctctgcgactgccttccctcttgctcgtgcacgtgtgtgcaaggcccgaaaaaccgccggggcaggtcaccaggttgcgggccttgcccctcacacagggccagctggtgctggtatggagcgacgaacatgtcggctccaagtgtttgtggacttacgagatacaattctcccaggatggcaaggcgtatacgcccgtctctcgcaaaccttcaacttttaatctgtttgtgtttagtcccgacaccggtgctgtgagtggttcatatcgagttcgggccctggactactgggctaggcctggtcctttctccgatcctgtgccatatttggaagtacccgttcctaggggacctccctctcctgggaacccc

SEQ ID NO: 13911 - DNA, 1959 bp, Artificial Sequence
  Description of Artificial Sequence: Synthetic coding sequence
atgagaccactccggccgagggctgccctgctagccctgctagcatcattgctggcagcccctcctgtagctccagcagaggccccacacctcgtgcatgtggacgctgcacgggccttatggccgttaaggcgtttctggaggagcacaggcttctgtccgcccttgcctcacagtcaggctgaccagtatgtgctgagttgggatcagcagctgaatctggcctacgttggggctgtgcctcacaggggaatcaagcaagtaaggactcactggctgctggagcttgtgaccactaggggatccaccgggcgcggactttcatacaacttcactcacctggatgggtacctggacctgttgagggagaatcaattgctgccagggtttgaactgatgggcagcgccagcggtcactttacagacttcgaagacaaacagcaggtgttcgagtggaaggatctggttagcagcctggcacgtaggtacataggcagatatggcctagctcacgtctctaagtggaactttgagacttggaacgaacctgaccaccatgacttcgataatgtgagcatgacaatgcagggatttctaaattactacgacgcttgctcagaagggctgcgggcagcaagcccagcacttcgtctgggcgggcccggggacagtttccacacccccccacgtagccctctatcatgggggttactaaggcactgccatgatggtaccaactttttcacaggcgaggcaggagtacggctggattatatcagcctccatagaaaaggcgcgagaagttctatttctatcctggagcaggagaaggtggtggcacagcagattcggcagctgtttccaaagtttgccgatacccctatttacaatgacgaggctgatcctcttgtcggttggagcttgccgcagccatggcgcgccgacgtaacatacgctgctatggtggtgaaggtaatcgcacagcaccagaatctgttactggctaatacgacctccgccttcccttacgcattactaagcaatgacaacgccttcctcagctatcacccccatcctttcgcacaaagaactcttaccgcaaggttccaggtgaataacactcgcccaccacacgtgcagctactgcggaagcccgtgctgactgccatggggctcctggcgttgcttgatgaggagcagttgtgggccgaagtcagccaggcggggacagtcctggattccaaccacaccgtcggggtgctggcctctgctcaccgccctcaggggcctgcggacgcttggcgggctgcagtgcttatatacgccagcgacgacacgcgcgcccatcccaaccgttcagtcgctgtgactcttcggctgcgaggtgtgcctccgggcccgggcctggtgtatgtgacaagatacttggacaacggcctctgttccccagacggagaatggcgacgcctcggaagacctgtatttccaactgcggagcagttcaggagaatgcgcgccgctgaggatcccgtggcagcagcgcctcggccactgcctgcaggtggacgcctgaccctcaggcccgcgctgagactgccaagcctgctccttgtgcacgtgtgcgcccgaccagaaaagccccctgggcaagtcactcgcctgagggctctccctctgacccagggccaactggtgttggtgtggtctgacgagcatgtaggcagcaagtgcctctggacatatgagatacagtttagccaagatgggaaagcatacactccagtgtcgcggaagccttccacatttaacttattcgtctttagcccagatactggagctgttagtggatcataccgagtccgggcgctcgattactgggccaggcccggcccattctcggatccagttccctatctggaagtacccgttccccgtggcccaccctctccaggcaatcca

SEQ ID NO: 13912 - DNA, 1959 bp, Artificial Sequence
  Description of Artificial Sequence: Synthetic coding sequence
atgcggccactgcggccacgtgcggctctgcttgcactcctcgcgtccctgctggccgcgccgcccgtcgccccggccgaggccccgcacctggtgcacgtggacgccgccagggccctgtggccgctgcgacggttctggagatccaccggattctgtcccccactgccgcactcccaggccgaccagtacgtcctgtcttgggaccaacagttgaatcttgcgtacgtgggtgctgttccccatcgcggtatcaaacaagtgcggacccattggctcctggaactggtgactaccaggggatctactggccgggggctctcctacaacttcactcacctcgacggatacctggatctgctccgcgagaatcaactgttgcccggattcgaattgatgggttcagcctcgggacattttaccgacttcgaggacaagcagcaagtgttcgaatggaaggacctggtatcaagcctcgcaagacggtacatcggtcggtatggactcgcccacgtgtcgaaatggaatttcgagacttggaatgagccggaccaccacgacttcgacaacgtctcgatgactatgcaaggctttctgaactactacgacgcctgcagcgagggactccgggcagcctcaccagctctgagactgggcgggccaggtgattcgttccacacgccccctagatcaccgctgtcatggggtttgctccgccactgccatgacgggaccaacttcttcactggggaagccggagtgcgcctggactacatctcgcttcatagaaaaggcgcacggtcctccatttcgatcctcgaacaagagaaagtcgttgcccaacagatccggcagctgttccctaagttcgccgacacccccatttacaacgacgaagccgaccctctcgtgggatggtcgctccctcagccgtggagggctgacgtgacctatgccgcgatggtggttaaagttatcgcgcagcatcagaacctgctgctggcgaataccacttcggcattcccttacgcactgctctccaatgacaatgcctttctgtcctaccacccccatcctttcgcccaacggacgcttactgcccgattccaggtgaacaatactaggccaccgcacgtgcagctgctgcggaagcccgtactgactgctatgggcttgctcgccttgttggacgaagaacagctgtgggcagaggtgagccaagcaggcaccgtcctggactcgaaccatactgtcggggtgctcgcttccgcccatcggccgcagggacctgcggatgcatggcgggcagcagtgctcatatatgcatccgacgacacccgggcgcacccgaaccgatcagtcgctgtgaccttgagactgagaggagtgcctcctgggccgggcttggtgtacgtcacccgatacctggataatggactttgctcccccgatggcgagtggcgcaggctggggcgccctgtgttcccgaccgcagagcagttcagaaggatgcgcgcggcggaagatccggtcgcagcggctccccggccactcccggctgggggtcgccttactctgcgccctgccttgcgccttccttcgttgctgctcgtgcacgtctgcgcacggcccgaaaagccgccaggccaggtcactaggctgagagccctccctctgactcagggccagctcgtcctggtctggtctgacgagcatgtgggatcgaagtgcctctggacctatgaaatccaatttagccaagatgggaaagcgtacactcctgtgtcacgcaagccatccacgttcaacctgtttgtgttctccccggatactggagcagtgtccggaagctacagagtccgggccctggactactgggccagaccgggacctttttccgatccggtcccgtacctcgaggtgccggtgcctcgcggaccgccgtccccgggtaatccg

SEQ ID NO: 13913 - DNA, 1959 bp, Artificial Sequence
  Description of Artificial Sequence: Synthetic coding sequence
atgcggccgctgcgcccacgcgcggctctgctggcccttttggcaagccttctggccgcgccgccggtggcgcctgcagaagcgccacacttggtgcatgtggatgccgctcgggcgctctggccgctgcgtcgcttctggagatccaccggtttctgcccgccgctgccgcattcccaggccgaccagtacgtcttgtcatgggatcaacagctcaatttggcctatgtgggagcggtcccgcacaggggtatcaaacaagtgcggacccactggctgctcgagctcgtgactactagaggttcgactggcagaggtctgtcatacaattttactcatctggacggttacctggacctgctcagagagaaccaactgttgccggggtttgaactcatgggatcggccagcggacacttcactgattttgaggataagcaacaggtcttcgaatggaaggacctggtgtcctcactcgcccgtagatacattggaagatacgggcttgcacatgtgtcgaagtggaatttcgaaacttggaatgaacctgaccaccatgattttgacaacgtgtcgatgaccatgcagggatttctcaattactatgacgcgtgctcggagggacttagggcggctagcccggctctccgcctcggtggacctggagacagctttcacactcctccgcgatcccccctcagctggggccttctgagacattgccacgacggcaccaacttcttcacgggcgaggcgggcgttcgcctcgattacatctcccttcaccgcaagggggcacgctcgtcgatctcgatcctcgaacaggaaaaagtggtggctcaacagatccgtcagctgtttccgaagtttgccgacacccctatttacaacgatgaggctgaccctctggtgggatggtcgctcccacaaccttggcgcgccgacgtgacctacgcggccatggtggtcaaggtgatcgcccaacaccagaacctgctgctggctaacaccacgtccgccttcccttacgcccttctctccaacgacaacgccttcctgtcgtatcatccgcatccattcgcgcagcgcaccctgactgcccgcttccaggtgaataacacgcgcccgccgcacgtccagttgctcagaaagcccgtcctgacggcgatgggcttgcttgcactcctggatgaagaacagttgtgggccgaagtgtcgcaggcgggaactgtgctcgactctaatcataccgtgggagtgctggcgtcggcacaccggccgcagggaccggccgatgcgtggagggccgcggtcctgatctacgcatcagacgacaccagagcccaccccaaccgctccgtggcagtcacccttagactcagaggggtcccgccgggtccggggctggtgtacgtgacccggtacctcgacaacggactgtgcagcccggacggtgaatggcggagactgggacgcccggtgttcccgaccgccgagcaattccggcggatgcgcgccgcggaagatccggtggccgccgcaccacggccgttgccggcgggtggacgcctcaccctcagacccgccctccggctgccatcactgctgctggtgcacgtgtgcgcgcgccctgaaaagccaccgggacaggtgaccagactcagggccctcccactcactcagggacagctcgtgctggtctggtccgacgaacatgtcggttccaagtgcctgtggacctacgaaatccagttttcacaagacggaaaagcctacactccggtcagccggaaaccgtccactttcaacctgttcgtgttctcgccagacaccggagcagtctcagggtcctaccgcgtgcgggctctggactactgggcgcggccgggaccgtttagcgacccagtgccatacttggaggtcccggtgccgcgcggaccgccctcgcctggcaacccg

SEQ ID NO: 13914 - DNA, 1959 bp, Artificial Sequence
  Description of Artificial Sequence: Synthetic coding sequence
atgcggccactgcgccctcgcgcggcccttctggcactcctggcaagcctcctggccgcaccacccgtggccccagcagaagcgccacacttggtgcatgtggatgcagcacgtgcactctggccgttgaggcgattttggagatcgaccggcttttgccctcctcttccacattcgcaagccgatcaatacgtgctgagctgggaccaacagctcaacctggcgtacgtcggtgcagtgccgcataggggaattaagcaagtgcgtacgcattggttgctggaacttgtgactacccggggatcaaccggacgagggctttcctacaacttcacccatcttgatggttatctggatcttctgcgcgagaaccaactgctgcctggttttgaactgatgggtagcgcatccgggcacttcactgattttgaagataagcagcaagtgttcgagtggaaagatcttgtgtcatcactggcaaggcggtacattggcagatacggacttgcacatgtgtccaagtggaacttcgagacttggaacgaacctgatcaccacgattttgataatgtgagcatgacgatgcagggctttctcaattactacgacgcatgttcggaaggacttagggcagcaagcccagctctgcgcctgggtggtcctggtgattccttccatactcccccacgatcacccctctcctggggacttctgcggcattgccatgacgggactaacttctttactggagaggcaggggtgagacttgactacatttcgcttcatcgtaagggcgccagatcctcaatttccatccttgaacaggagaaagtcgttgcccaacaaatccggcagctgttccctaagtttgcagatactccgatttacaatgacgaagcagacccccttgtgggatggtcactgccacagccatggcgcgcagacgtgacctacgctgcaatggtggtgaaagtgattgcccaacaccagaacctcctcctggcgaacaccacgagcgcgtttccctacgctctccttagcaacgataatgcgttcctgtcttaccatcctcatccattcgcacagaggacccttactgcgcgctttcaagtcaacaacaccagacctccacatgtgcagctcctgaggaagcctgtcctgaccgccatggggcttcttgcgcttcttgacgaagaacaactgtgggccgaagtctcacaagcaggtaccgtgctggattccaatcacacggtgggagttctggccagcgcacatagaccacaaggcccggcagatgcctggagggcagcagtgctgatttatgcatcagatgatacccgagcacatcccaaccggtcagtggcggtgaccctgagattgcgcggagtgcccccaggtccaggcctcgtgtacgtgactcggtacttggacaacggtctgtgctcccctgatggtgagtggagacgcctcggccgccccgtgttccccactgcggaacaatttcggcgtatgagagccgctgaagatccagtggcagctgcaccaagacccctgccggcgggtggacgacttactcttagacccgcgctgcgccttccgtcactcctgcttgtgcatgtgtgtgcaagaccagaaaagccacccggccaagtgactcgtctgagagcacttcctctcacccaaggccaacttgtgcttgtctggagcgacgaacacgtgggaagcaagtgcctgtggacttacgaaatccaattctcccaagatggtaaagcctacactccagtgtcccggaaaccttctacgttcaatcttttcgtgttttcaccagataccggggcagtcagtggtagctacagagtcagagcacttgactattgggccaggccgggtcctttctcagatccagtgccttacctggaggtgcccgtgccccgcggaccaccgtccccaggaaatcct

SEQ ID NO: 13915 - DNA, 1959 bp, Artificial Sequence
  Description of Artificial Sequence: Synthetic coding sequence
atgagacccctccgcccccgagccgctcttctggcactgctggcctcattgctggcagccccaccagtcgcgccggccgaggcaccccatttggtccacgtagacgctgcgagggccctgtggccattgagacgattttggcggagcactgggttctgccctccactcccgcactcccaagcagaccaatatgtcctcagctgggatcaacagcttaatttggcatacgtgggtgcggtgccgcaccggggtatcaagcaagtgcgcacacattggttgctggagctcgtcaccacaagaggtagcactggacgaggtctttcttataacttcacacaccttgacggatacctcgatctcctgcgggagaatcagctgctgccaggcttcgagctgatgggttccgctagtggccatttcaccgacttcgaagacaagcagcaggtatttgagtggaaagatctggttagtagcctcgcacggcggtacattgggcgctatggtctggcgcacgtctcaaagtggaacttcgaaacatggaatgagcccgaccaccatgactttgataacgtgtctatgacgatgcaggggtttcttaactactatgacgcctgtagtgaagggctcagagccgccagccccgctctccgccttgggggacctggagacagctttcacacccctcccaggagtccgctctcctggggactgcttcggcactgccacgatggcactaatttttttacaggcgaagctggcgtaaggctggactacatcagcctgcatagaaagggggctagaagttccattagtatcttggagcaggagaaggtagtcgcccagcagatccggcaactgtttcctaaattcgctgataccccaatttacaacgacgaggccgatccgctggtgggctggtccttgccacagccatggcgcgccgacgtgacatacgccgctatggttgtcaaggtaatcgcacagcaccagaatctcctgctcgccaacactaccagcgcgttcccctatgctctgctgtccaatgacaatgctttcctgtcctatcatccccatccatttgcacagcggacattgactgcccgctttcaagtgaacaacaccaggcccccacacgtccagctgctgcggaaaccagtgcttaccgctatggggctgcttgccctgctggatgaggagcaattgtgggccgaggtaagccaggcaggaacggtcctcgatagtaaccatacagtcggagtgttggcttccgcacacagacctcagggtcctgcagacgcttggcgggcagccgtgctgatatacgcttctgacgacacccgcgcccacccgaaccggtccgtggcggtaacactccgcctccgcggcgtgccacctgggccgggcctggtttacgtgacacgctacttggataatgggctctgtagccctgatggtgagtggcgaagacttgggagaccagtcttccccacagccgaacagtttcggcggatgcgagcggctgaggaccctgtcgcggcagctcctcggcctctgcccgccgggggaaggctgaccttgaggccggcgcttagattgcctagcctccttctggtccatgtgtgcgcccggcctgagaagcctcccgggcaggttactaggcttagggcactgcccctgacccagggtcagctggtactggtgtggagcgatgagcacgtgggctctaagtgtctgtggacttacgaaatccagttttctcaggatggcaaggcatacacacccgtatccagaaagcctagtactttcaatctgttcgtgttctcccctgacaccggggcagtttctggaagctacagagtgcgggcactcgattactgggcacgacccggccccttctccgaccccgtgccatacctggaggtccctgtgccacggggtcctccttccccgggaaaccct

SEQ ID NO: 13916 - DNA, 1959 bp, Artificial Sequence
  Description of Artificial Sequence: Synthetic coding sequence
atgaggcctttgcgcccgcgggccgcgcttctcgccctgctggccagcctcctggccgcccctcctgtagccccagccgaagcaccccacctggtgcatgtcgatgccgccagagcgctgtggcctctcaggagattctggagaagtacaggtttttgtcccccacttccgcactcccaagcagaccagtacgtgctttcctgggaccagcagctgaacctggcctacgtgggtgccgtgccccacagaggcataaagcaggtaaggacccactggcttctggaacttgttacaactagaggatcaaccgggcggggtctgagctataattttacacatctggatgggtacttggatctgcttagagaaaaccagctgctgcccggcttcgaactaatggggagtgccagtggtcactttactgatttcgaagacaagcagcaggtcttcgagtggaaggatcttgtctcgtccctagcgaggcgatatataggaagatatggcttagcccatgtgtctaagtggaatttcgagacgtggaacgagcctgatcatcacgatttcgacaatgtaagcatgactatgcagggctttctgaactattacgacgcttgctcggaaggccttagagccgccagcccagccctgcggttagggggtccgggtgactcttttcatacccccccccgtagccccctgtcctggggtctccttagacattgccacgacggtaccaactttttcacgggggaggctggggtgcgtttagactacatctctctacacagaaagggcgctcggtcatcaatttctatcctggaacaagaaaaagtagttgcgcagcagatccggcagctctttcccaagttcgctgacacacccatctacaatgatgaagcagatcccctggtgggctggtcattaccgcagccttggagagctgatgtgacctatgccgctatggttgtgaaggtcatcgcgcagcatcagaatctgctgctagcgaataccacaagtgcgttcccttacgctctgctgtctaatgataacgcatttttgtcttaccacccccatccttttgcacagcggacccttaccgcccggtttcaggtcaataatacgcggccaccccacgtgcagcttctgaggaaaccggtcctcacagcaatggggttgctggcactgttagatgaggaacagctttgggctgaagtctcacaggccggaacagtgctcgactctaatcacacagtcggtgtcctggcctccgcccaccggccccagggacctgcagacgcttggagggccgccgtcttgatttatgcaagcgatgacaccagggcacaccccaatagaagcgtcgccgtgacgcttcgtctgcggggggtcccccccggcccgggcctcgtttacgtgacacgctacctggacaacgggctttgctcgcctgacggcgagtggaggaggctgggtcgccctgtcttcccgaccgctgaacagtttagacgcatgagagccgcggaggaccccgtcgcagccgcccccaggcctttgccggcagggggcagactaactcttcgcccagccctacgcctgccctcactcctgttggtgcacgtttgtgctagacccgagaagcctcccggccaggttactcgtctaagggccttacccttgacccagggccagctggtcctcgtctggtccgacgaacacgtcggatccaaatgcctttggacatatgagattcagttctcccaggatgggaaggcatatacccccgtgagccggaagccatcgacattcaatctatttgtcttctcacccgacaccggggcggtcagtggcagctatcgtgtacgcgccctggattattgggctcggcctgggccattcagcgatcctgtgccctacctggaagtccctgtgccccgtgggcctccaagccccggcaatccc

SEQ ID NO: 13917 - DNA, 1959 bp, Artificial Sequence; identical to SEQ ID NO: 13856
  Description of Artificial Sequence: Synthetic coding sequence

SEQ ID NO: 13918 - DNA, 1959 bp, Artificial Sequence
  Description of Artificial Sequence: Synthetic coding sequence
atgaggcctctgcggccgagggccgcacttctagccctgttggcctcactcctggcggcaccaccggtggctccggccgaggctccccatctggtccacgtggatgccgcacgggctctgtggcctttgaggcggttttggcgatcgaccggattttgtccgccgctcccccactcacaggcagatcagtatgtcctgtcttgggaccagcaactgaacctggcctacgttggagctgttccccataggggaataaaacaggtgcggacccattggctcttagaactggttaccacacgggggagcaccgggcggggactctcctacaacttcacacacttagatgggtacctcgacctgcttcgcgagaaccagctgctcccgggttttgagttgatggggtccgccagtggtcactttacagattttgaggataaacagcaggtgttcgaatggaaagatctggtgtcttccctcgctagaagatatataggccggtacggcctggcccacgtgagcaaatggaatttcgaaacttggaacgagccagaccaccatgactttgataacgtgtctatgacaatgcagggttttttgaattactacgacgcgtgcagcgagggactacgtgccgcaagccctgctttacggctcggcggtccaggcgattcctttcatacaccaccccgatcccccttgtcttgggggttgctgcgtcattgtcacgacggaaccaacttcttcaccggagaggccggtgtgaggctcgattacatcagtcttcacagaaagggcgctcgctcctctatctctatattagaacaggagaaggtggtcgcccaacagatacgccaactgtttcctaaatttgccgacaccccaatctacaacgatgaagctgacccactggtaggctggtccttacctcagccgtggagagccgacgtaacgtatgccgcgatggttgttaaggtgatcgctcaacaccagaatctgctgctagcaaacacgacatccgcatttccttatgcacttctgtccaacgacaatgccttcttaagttaccatccccatccatttgcccaacggactttgactgcccgcttccaggtgaataacactcgtccacctcatgtgcagttattgcgcaagcccgtgctgactgccatgggccttcttgctctcctggacgaagagcagctatgggccgaggtatcacaggctgggactgtgcttgatagtaatcacacagtgggagttttggccagcgcacaccgacctcaagggccggcagatgcgtggagggccgccgtgctcatctacgcctcagacgatacacgcgctcaccccaaccgatccgtcgccgtgaccctccgcctccggggcgtgccaccgggcccagggctagtctatgtaacgagatatctcgacaacggcctctgcagtccagacggcgaatggcgccgactcgggcgcccagtcttcccaacagcagaacaattccgcagaatgcgagctgctgaagacccggtggctgctgcccccaggccgttgccagccggcggccgcctaactctacggccagccctaaggttgccaagtctactgcttgttcacgtgtgtgccagacccgaaaaacctccgggacaggtgacgaggctgagggcactgcccctgacgcagggtcaactggtgctggtctggtccgacgaacacgtgggctctaaatgcctgtggacctacgagatccagttttcccaggacggcaaggcctatactcctgtcagcagaaagccctccacatttaatttatttgttttcagccctgataccggcgccgtgtctggttcgtatagagttcgtgctcttgattattgggcacggccaggacccttttctgatcccgtcccttatttagaggtccccgtcccacgtgggcctccttcccctggcaatcct

SEQ ID NO: 13919 - DNA, 1959 bp, Artificial Sequence
  Description of Artificial Sequence: Synthetic coding sequence
atgcgaccattgcgtcctcgcgcagccctgcttgcgctcttggcttcgctcctggcggccccaccagtcgcaccggcggaagcgcctcatctagttcatgttgacgccgcacgcgcactgtggcctctgcgccgcttctggcgcagcaccgggttctgcccccctttgccacatagccaggccgaccagtatgtactcagctgggatcagcagctgaatttggcgtatgtgggggctgtgccccatcgcggtataaagcaagtgcgcacacactggctcttggagctcgtgaccacccgaggatctacaggaagagggctctcttacaatttcacccatttggacggatatctagacctccttagagagaatcagctgctccccggctttgaattgatgggctctgcctcgggccatttcacagacttcgaggataagcaacaggtattcgaatggaaagatttggtatctagcctggcgcgcagatacatcggtaggtacgggttggctcacgtaagcaaatggaacttcgaaacatggaatgaacccgaccatcacgacttcgacaatgtgtccatgacaatgcaagggtttctgaactattacgacgcatgctctgagggactccgggcggccagtccagctctacgtctcgggggccccggtgactccttccatacaccaccgcgctctcccctcagctggggacttttacgacattgccacgacggtactaacttctttaccggggaggcgggtgtgcgtcttgactatatctctctccacaggaaaggcgcccgttcatccatctcgattctcgaacaggagaaggtggtcgctcaacagattcggcagctgttccccaaattcgccgatacaccgatctacaacgatgaggcagacccccttgttggttggtcgctgccacaaccttggcgggctgacgtcacttacgccgctatggttgtgaaggttatagctcaacatcaaaatcttctccttgccaataccacgtctgcgttcccctatgcactgctcagtaatgacaacgcctttctaagttaccacccgcacccgtttgcacaacgtacgctgacagcccggttccaggtcaataacacacgacctccccacgttcagctccttcgcaaaccagtccttactgcaatgggccttctggctctccttgatgaagagcagctctgggccgaagtctcgcaggctggaaccgttctcgattcgaatcacaccgttggcgtccttgccagcgctcaccgacctcaaggccctgcagatgcttggcgggctgcggttcttatttatgcttctgacgatactcgggcccacccaaaccgctctgtggcagttaccctcaggcttcgtggtgtcccaccaggacctgggctggtttatgtaacccgatatctggataacgggttatgctcaccggacggcgagtggcgacgactcggacgtcctgtttttcctacggcggagcagttccgccgtatgcgtgccgccgaggatccagtagctgccgctccccggccacttcccgcgggtggtcgtttaactttgagacctgccctccggctgccatccttgcttttagttcacgtttgcgcgaggccagagaagccacctggccaggtcacccggctacgggccctacctctgactcagggccaactagtgctagtgtggagcgatgagcacgtgggatccaaatgtttgtggacttacgaaatacagttttcgcaagacggaaaggcatatacacccgtttcccggaagccgagcacatttaatcttttcgttttttcgcctgacaccggggcagtgtcgggttcgtatcgggtgcgtgcactcgactattgggcacgtcctggcccgttctctgatccagttccctatctagaggtgccggttccgcgcggtcccccctcgccaggtaatccg

SEQ ID NO: 13920 - DNA, 1959 bp, Artificial Sequence
  Description of Artificial Sequence: Synthetic coding sequence
atgcggccacttcggccaagagccgccctgcttgccctgcttgcttcacttttggcggcaccacctgtcgctccagcagaggcaccacacctggtgcatgttgacgcagcaagagcactttggccactgagaagattttggcggtccacgggtttttgccctcccctgccacacagccaagcagatcaatacgtgctgtcctgggatcagcagctgaacctggcatatgtgggcgccgtgccgcaccgtggaatcaaacaggtccggactcattggctgcttgaactcgtgaccacgaggggtagcactggcaggggactttcatacaactttacccacctggacggatacctcgacctgctgcgggagaaccaactccttcccggtttcgagcttatgggttcggcgtcagggcattttactgatttcgaggacaagcagcaagtctttgaatggaaggaccttgtgtcctctcttgctagacggtacattggtcgctacggactggctcatgtgtcaaaatggaacttcgaaacttggaacgaacctgaccatcacgacttcgacaacgtctcgatgaccatgcagggatttcttaactactacgatgcgtgttcggaggggcttagagccgcatcccccgcactgcggctgggcggaccgggtgattcatttcatacccctcctcgttcacccctttcgtggggactgcttagacactgccacgatggtaccaactttttcaccggagaagcaggcgtccgtctcgattacatttcacttcaccgcaagggagcccggagctcgatatcaatcctcgaacaagaaaaagtcgtggcacagcagattcgtcaattgtttcctaagtttgcagacactccaatttacaatgatgaagcagatccgctggtcgggtggtccctcccacagccttggcgggcagatgtcacttacgccgcgatggtcgtgaaagtcatagcgcagcaccagaacctgctgttggcgaatacgacctccgcgtttccttacgcactgctctccaacgacaatgcatttctttcataccacccccatccttttgcacaaagaactcttaccgcccgatttcaggtgaacaatactcgccctccgcatgtgcagctgctgaggaagcctgtgcttaccgcaatgggtctgcttgcccttttggacgaagagcagctctgggcagaagtgtcacaggcaggtactgtgctggattcaaaccacaccgttggcgtactcgcatccgcacataggccccagggaccagcagatgcgtggagggcagcagtgctgatttacgcatcagacgatactcgagcccacccgaacagaagcgtcgcggtcacccttagactccggggagtgcctcctggaccgggactggtctacgtgactcggtaccttgacaacggcctgtgtagccctgacggagaatggcgcaggctggggaggccagtctttcccactgcagaacagttcagaagaatgagagccgcagaagatccagtggcagcagcgcctcgacctcttcctgcagggggacgtctgactctgcggcccgcgcttaggcttccttcgctccttcttgtgcatgtgtgcgcccgaccggagaagccccctggacaggtgacgcgattgagggcactgcctctcacccaaggacaactcgtgctggtttggagcgacgaacacgtgggaagcaagtgcctctggacgtacgaaattcaattctcccaagacggtaaagcgtacacgccagtgtccaggaagcccagcacgtttaacctgtttgtcttttccccagacaccggtgcagtgtccggcagctaccgggtgcgagcattggattattgggcacggccagggcctttctccgatccagtgccttacctcgaagtgcctgtcccccgtggcccaccttccccaggtaacccc

SEQ ID NO: 13921 - DNA, 1959 bp, Artificial Sequence
  Description of Artificial Sequence: Synthetic coding sequence
atgagaccactaaggccgagagcggcactgctggctctacttgcatctctgctggcggctccacctgttgcacccgcagaagccccccatcttgttcacgtggatgccgctcgggctctgtggccactgcggaggttttggaggtcgactggtttctgtccacccctcccacattcacaagccgatcagtatgtcctgtcatgggaccagcagctcaatctggcctatgtgggtgcggtgccgcaccggggtatcaaacaggtcaggacacattggctccttgagctcgtcactacaaggggatccacgggtagaggtctgtcttacaactttacccatctggacggttatttggacctgctcagagaaaaccagctcctgccagggttcgagctgatgggcagtgcctctggccactttaccgacttcgaagacaagcagcaagtattcgaatggaaagatttggtgtcgtccctggctaggcggtatattgggcggtacgggttggcacacgtcagcaaatggaatttcgagacttggaacgaaccagaccatcacgatttcgacaatgtgagcatgaccatgcagggcttcttgaattactacgacgcatgctccgagggcttgcgggcagccagtcccgctctccgcttgggaggacccggggacagctttcacactccccctcggtcaccattgagctgggggctgctcaggcactgtcatgatggaacaaatttcttcaccggagaggccggagtgagactcgattacatcagcctgcacagaaagggagcccgctcctccattagcatattggaacaggaaaaggtcgtggcgcaacagatccggcaactgtttccaaagtttgctgatactccaatatacaatgacgaagccgatcctctggtcggctggagcctgccgcagccctggcgtgctgacgttacctacgcagccatggtggtgaaagtcatcgcacagcaccagaatctgttgctggcaaacacaacatccgctttcccatacgctctcctctccaatgataatgctttcctttcctaccatcctcatcccttcgcgcaaaggaccttgaccgcaaggttccaggtgaacaacaccaggccccctcacgtgcagcttctgcgaaaaccagtgctgacagccatgggcctcctagccctcttggatgaggagcagttgtgggctgaagtgagtcaggcaggcaccgtcttggactctaatcatacagttggagttctggcctctgctcaccggccacagggacccgcagacgcatggcgggcggctgtgctgatatatgcatcagatgatacaagggcccatccaaaccggtcggttgctgtcacacttaggctccgcggggtgcccccaggacctggcctggtctacgtgacacgctaccttgacaatggcctgtgctctcctgatggtgagtggaggcgtctagggaggcccgttttcccaaccgctgaacagtttaggcgcatgcgtgccgccgaagaccccgtagccgcggcaccaagaccactgcctgccgggggccggctgacactgcggcccgcattgaggttgcccagcctcctcctggttcatgtgtgcgccagacccgaaaagcctccaggtcaggtgacacggctgagagctctgcccctgacgcaggggcagttagtcctggtatggagtgatgagcacgtggggtcaaagtgcctgtggacctatgagatccagttttctcaagacgggaaggcatacacaccggtcagccggaagccctctacattcaacctttttgtgttcagccctgacactggcgctgtgtccgggagctacagggtgcgggcactcgattactgggctagaccaggccccttctccgacccggtgccctacctggaggttccagtcccccgaggacccccctcacccggaaacccc

SEQ ID NO: 13922 - DNA, 1959 bp, Artificial Sequence
  Description of Artificial Sequence: Synthetic coding sequence
atgcggccacttcgcccccgggcggccctcctggcactcctcgcatcacttctcgccgccccgcctgtcgctcccgcagaagctccccatttggttcacgtcgacgctgcccgagcgctctggcctcttcgccgattttggcgctccaccggattttgtcccccactcccacactcacaagccgatcagtatgttttatcatgggaccagcagttaaatttggcctatgtgggagctgtcccccaccggggcattaagcaggtgcgcactcactggctgcttgagctcgttacgacacgaggctccacagggcgcgggttgtcttataatttcacacatctggacggctacctggaccttcttcgtgagaatcaactcctgccaggattcgaacttatgggctcggcaagcggacatttcactgattttgaggataagcagcaagtgtttgaatggaaagacctggtcagctccttggcacgacgctacatcggccgttacgggcttgcacatgttagcaagtggaatttcgagacctggaatgagcctgatcatcacgacttcgacaatgtctctatgaccatgcagggcttcctcaattattacgatgcctgttcggaaggcctgcgcgccgccagccccgcccttcgactgggcggcccaggcgatagctttcacaccccaccacggtctccgttgagttggggactgctaaggcattgccacgatggtactaacttctttacgggtgaagctggagttaggctcgactatatatccttacacaggaaaggagcgcggtcatcaatctcaattctggaacaggaaaaagttgtggcacagcagatcaggcaactgtttccaaaattcgccgatacccctatttacaatgatgaggccgatcctctagtggggtggagcctgccccagccatggcgcgccgacgtcacctatgctgccatggtcgtcaaagtgatagctcagcaccagaacctactcctggcaaacacaacgagtgccttcccttacgctctgctgtcaaacgataacgcgtttctcagctaccatccgcacccctttgcgcaacggaccctcaccgctcggtttcaggtcaacaatacccgacccccccacgtccagctgctgagaaagcccgtcttaacagccatggggctccttgcgctgttagacgaagagcagctgtgggctgaagtgtcgcaagccggaaccgtgctggattctaaccatacggtgggggttctggccagtgcgcatcgcccacaggggccagcagacgcctggcgcgcagccgtccttatctatgcttcagacgacactagagcacaccctaaccggtcagtggcggttacactccgcttacgaggggtgcctcccggaccaggactggtctatgtcactcgttatctggataatggactctgttcacctgacggagaatggcgccgccttggccgcccagtgtttcccaccgctgaacaattcaggaggatgcgggccgcagaggatccagtggctgctgccccacgacctttgcctgctggcggtcggttgacactgaggcctgccctccgactgccctctctactcctggtccacgtttgcgctagacccgaaaagccgcctggccaggtcacaagacttcgcgcactacccctgacacaaggacagctggtgttggtttggtccgatgagcacgtgggcagtaaatgcttgtggacttacgagatacagttcagtcaggatggtaaagcctacaccccagtctcccggaagcccagcacttttaatttgtttgtgttcagtcccgacacgggagcagtttccggctcctacagagtccgtgcactcgattactgggcccggcccggcccattctccgatccggtaccctacctggaagtgccagtacctaggggaccgccctctcccggtaatccc

SEQ ID NO: 13923 - DNA, 1959 bp, Artificial Sequence
  Description of Artificial Sequence: Synthetic coding sequence
atgcggcctctcaggcctcgcgccgcattactggcccttctggcatcattgctggccgctccccctgtggctcctgctgaggcgccccacctggtgcacgtagatgctgcgcgggccttgtggccattgaggcgcttctggcggtccaccggattctgccccccgttaccccattcacaggctgaccagtatgtgttaagctgggaccagcaactgaaccttgcatacgtgggtgccgtgccccacagggggattaagcaggtacgcactcattggctgttggagctggtgacgacacggggttccactggacgcggactctcctacaacttcacacatctagacgggtatcttgatcttttgagagaaaatcagcttctcccaggcttcgaattaatgggctctgcgtctggacactttactgacttcgaggataagcagcaggtttttgagtggaaagatctggtgtcttctctggcccgccgctatatcgggcgatacggcctcgcccacgtatccaaatggaatttcgagacttggaacgaacctgaccatcacgacttcgacaacgtatccatgactatgcagggctttctgaattactacgacgcctgtagcgagggcctgcgtgcggcgagcccagcacttcgactcggaggccccggagattctttccacaccccgccccgctctccccttagttggggactgctgaggcactgtcacgatggaacgaatttctttactggcgaggcgggcgtcagactagactatatctctctccaccgaaaaggcgccagatcctctatctctatcctggagcaggaaaaggtggttgcacagcagattaggcaactgtttccaaagtttgcagataccccaatatacaacgacgaagccgatcctctcgtagggtggtccctgccccagccttggagggccgacgtaacttatgccgccatggtcgtgaaggttattgctcagcatcagaatctcttgctggcaaataccacttctgccttcccttacgcattgctttccaacgacaatgcattcttatcttaccacccacatcccttcgcccagcggaccctaactgcaagatttcaagtgaacaacactaggcccccccacgtgcaactgctgagaaagcccgtgctgacggcaatgggtctgctggctcttctcgacgaagagcagctttgggcggaagtaagccaggcggggacagtgctcgattccaaccatacagtgggggtgctcgccagcgctcaccgccctcaaggccccgctgatgcatggagagccgccgtgctgatatatgcatcagacgacactagggcccacccaaacagaagcgtggctgtaacactgcgcttgcgcggggtcccccctggccctggactggtatacgtgacacgatatctggacaatggcctgtgttctcctgatggcgagtggcggcggttgggtcggcccgtttttcccacagccgagcagttcagaagaatgcgggctgccgaagaccccgtggcagcagctccccgccctctccctgccggcggaagactgaccttgcgtcccgccctcaggctcccttcactcctgttagtgcacgtgtgcgcacgccccgaaaagcccccaggccaggtcaccagactgagggcccttcctcttacacaaggtcagctggtactcgtgtggtctgacgagcatgtgggaagcaagtgtctgtggacatacgagatacagttttcccaagacggtaaggcatacacccccgtttcacgtaaaccttcaacttttaatttattcgtgttctctcccgatacaggcgccgtgagcggtagctacagggtaagggctctggactattgggcccggcctggaccattctccgatcccgtgccttacctggaggtgcctgtcccaagaggcccaccttcgcccggcaacccc

SEQ ID NO: 13924 - DNA, 1959 bp, Artificial Sequence
  Description of Artificial Sequence: Synthetic coding sequence
atgagaccactcaggccccgtgcagccttgcttgccctgttggctagtctcttggctgccccaccagtcgctcccgctgaagctccccacctggtgcacgttgatgccgcccgtgctctgtggcctctgaggaggttttggagatctactggattctgcccaccactgccacactcacaagctgatcagtatgtattgtcctgggatcaacagttgaatctggcttatgtgggtgctgtgccacaccgcggcatcaagcaggtccgtacccactggcttcttgagctggtaaccaccaggggctctaccggtcgcggactgtcttataatttcacacaccttgatggatacctcgatcttttgcgcgaaaatcagctgctccctggatttgagctcatgggcagcgcctctggacatttcactgactttgaagataagcagcaggtgttcgaatggaaggatctcgtttcctccctggcccgtaggtacattggcaggtacggacttgctcacgtgagcaaatggaatttcgagacctggaacgagcccgaccatcacgattttgacaacgtttccatgacaatgcagggtttcctgaactactacgatgcttgctcagagggcctcagagccgcctcccctgctctcagactcggaggacccggcgattctttccataccccccctaggagccccctgtcttggggcctgctgaggcattgccacgacggtactaacttttttactggtgaggctggcgtgaggctggattatatctccttgcatcgcaagggagcacgcagcagtatatcaatccttgagcaagagaaagtcgtcgcacaacagatcaggcagctgttccccaagtttgccgatacccccatatataacgacgaggccgatcccttggttggatggagtctgcctcagccctggcgcgctgacgtcacctacgctgctatggtagtcaaggtgatcgcccagcatcagaacttgctccttgccaacaccacctcagctttcccatatgccctcctgtccaacgataacgccttcctgagctaccatccacatcccttcgcccagcgcaccttgactgccaggttccaggtcaacaacactcgcccaccccacgtccagcttctgaggaaacccgtactgacagccatgggtctcctggccttgctggacgaggagcaactgtgggctgaagtgagtcaagccggaactgtgctggattccaaccacaccgtgggcgtgctcgcatctgctcacaggccccagggacctgccgatgcctggcgtgcagctgtccttatctatgctagcgatgatactagggcccatccaaatagaagcgtggccgtcaccctgagacttcgtggagtgcctccaggcccaggactcgtgtacgttacacgttacctcgacaacggcctgtgcagtcccgatggtgagtggaggcgcttgggtcgccccgttttccctactgcagagcagttccgtaggatgagggccgctgaagatcccgtcgctgctgcccctcgcccactgccagccggtggtaggctgacattgaggcccgccctccgcttgccctcattgctgctggtccacgtctgtgctcgccctgagaagcctccaggtcaggtgactcgtctgagggccttgcctcttacacagggtcaattggtgttggtttggtcagatgagcacgtcggaagcaagtgtctctggacatatgagattcaattcagtcaggatggaaaggcctatacccctgtgagtcgtaagccatccaccttcaacctgttcgtgttctcccccgacactggcgcagtcagcggctcctaccgcgttagagctctggattactgggcccgcccaggccccttcagcgaccccgtaccctatctcgaggtacccgtgccccgcggcccaccaagccccggtaaccct

SEQ ID NO: 13925 - DNA, 1959 bp, Artificial Sequence
  Description of Artificial Sequence: Synthetic coding sequence
atgcggcccctacgcccccgggctgccctactagccctgctggccagccttttagcagctccacccgtggcccctgcggaagccccccacctcgtgcatgtagacgctgcgcgcgccttgtggccactccggcgattttggcgtagtacagggttctgtcctcccttaccccactctcaggccgatcagtacgtgctcagctgggaccagcagctgaacctggcctacgtgggtgctgtcccacatagggggatcaaacaagtgagaacccattggctactggagctggtcaccaccagaggctcaaccgggagagggctgagctacaattttacacatcttgacggctacttggacctgttacgggagaatcagcttctccctggattcgagctgatgggctctgcatctggtcattttacagattttgaagataaacagcaggtgttcgaatggaaggacctcgtctcaagcttggctcgcaggtacataggacgctatggactggctcacgtgtccaagtggaacttcgaaacatggaacgaacctgaccaccacgacttcgataacgtcagcatgaccatgcaaggcttcctcaactactatgacgcatgttcagagggattacgggccgcctccccagccctgagactggggggcccaggagattccttccacacgcctcctcggtcacctctatcgtggggcctcctccgtcactgccacgatggaaccaattttttcaccggggaagccggggttcggctggactacatttcccttcatcgaaaaggagcccggtcgtctataagcatccttgagcaggagaaagttgttgcccaacagattcggcagttatttcccaaattcgcggacactccaatttacaacgacgaggccgatcctctggtgggttggagtctgccacagccttggagggccgatgtaacttacgccgctatggtagttaaagttatcgcgcagcatcagaacctgttactggcaaacactacctcagcttttccttacgccctgctctcaaacgacaatgcatttctgagctaccacccccacccttttgcccagagaactctgactgcccggtttcaagtgaacaatacacgacctccccatgtacagctgctgaggaagccagtgttgacggcaatgggcctcttggctctcctggacgaggaacagctttgggcagaagtcagccaagctggcacagtgctggactctaatcacaccgtgggtgtcttggcctcggcccaccgtccccaaggaccagccgacgcatggagggcagccgttcttatctacgcgagtgatgatacacgggcccatccgaaccgctcggttgccgtgacattgcgcttgcgcggcgtgccgcctggccccgggcttgtgtacgtgacacggtacttagataacggcctttgcagccccgacggagagtggagacgcctgggcagacccgtgttcccgaccgccgagcaattccgaagaatgagagctgcagaggatcctgtcgccgctgcccctcgccctcttccagctggaggacgcctgacgctgcgccccgcccttcggctcccatctctcctattagtccacgtgtgcgcccgcccggaaaagcctccagggcaagtcactaggctccgggctcttcccctcactcaaggacaactggtgctggtctggtccgacgaacatgtgggctctaaatgtttatggacatatgagatccagttctcccaggacgggaaagcttacacaccagtctctagaaagccgtctacttttaatttgtttgtgttctcccccgacactggggctgtgagcggttcttatcgtgtgcgtgccttggactactgggctagaccgggcccattctcagaccctgttccgtaccttgaagtccccgtgccaagagggccaccctctcccggtaatccc

SEQ ID NO: 13926 - DNA, 1959 bp, Artificial Sequence
  Description of Artificial Sequence: Synthetic coding sequence
atgagacccctccgacctcgcgctgcactcctggccctgctggccagcctgcttgcggctcctccggttgctcccgccgaagcgcctcacctggtacatgtggacgcagccagggccctatggcccctaagacgcttttggcgttccacgggcttctgtcccccattgcctcatagccaggccgatcagtacgtcctctcgtgggaccagcagcttaacctcgcctacgttggggctgtcccccacaggggaatcaagcaggtgcgcacacactggctgctggagctggtgactacaagagggtccacagggagagggcttagttataacttcactcacttagatggatacctggaccttcttcgtgaaaaccagctgctcccaggatttgaactgatgggctcagctagcggtcattttactgactttgaggacaagcagcaagtgtttgagtggaaggatctggtttcttcgctggctaggcgctatattgggcgatatggattagcacacgtgtctaaatggaatttcgagacttggaacgaacctgatcaccacgactttgacaacgtatctatgacaatgcagggcttcctgaattactatgacgcttgctccgaggggctgcgtgctgcttcacccgcccttcgccttggggggccaggcgattctttccatacacccccacggagcccactgtcctggggtctgctgcggcattgccatgatggcactaacttctttaccggagaagccggagtacgattggattatataagcctacaccggaaaggggctcggtcaagtataagtattctagagcaggaaaaggtggttgcccagcagattcgccagctctttcccaagtttgccgatacacccatctataacgacgaggcagatccccttgtcggttggtcgctgccccagccttggcgcgcagacgtgacgtacgcagctatggtcgtgaaggtgatcgcacagcaccaaaacctgttattggctaacacgacatcagcctttccctatgcactcctgtcaaacgacaatgccttcctgagttaccatcctcatccatttgcccaacggacccttaccgccaggttccaggtaaacaacaccaggccccctcacgtgcagcttctgagaaagcccgttctcacggccatgggactattagcccttctcgatgaggaacagctgtgggcagaggtgagccaggccgggaccgttctggatagcaatcacacggtcggcgtgttagctagcgcccaccggccccagggcccggccgatgcctggcgtgccgccgtactcatctacgccagcgacgatacgagagcccatcctaaccggtctgtagctgtgaccctccggttgcgtggcgtgccgcctggccccgggctggtctacgtaactagatatttggacaatggcctctgtagccctgacggcgagtggagaagacttgggaggcctgtgttccccaccgcagaacagtttcggagaatgcgagcggctgaagatccggtggcagctgctccacgtccattgcctgccgggggcaggctgaccctgcgccccgctctgcggctgccaagcctgctgctcgtgcatgtttgcgcaaggccagagaaacctcccgggcaagtgacacgtcttcgggcccttccgttgacacagggtcagctggtgttggtgtggagcgacgagcacgtgggaagcaagtgtctttggacctatgagatacagttttcccaggatggtaaggcatacacccccgtaagcaggaaaccctcaacctttaacttgttcgtcttttctcccgacactggcgctgtgtccggctcctaccgagtaagggccctggattactgggcccgtcctggtccctttagcgaccctgtgccttacctggaggtgcccgttccccgggggccgcccagtccagggaaccca

SEQ ID NO: 13927 - DNA, 1959 bp, Artificial Sequence
  Description of Artificial Sequence: Synthetic coding sequence
atgagaccacttagacctagagcagccctacttgcattacttgcttccttacttgccgctccacctgtggcccccgccgaagctccacatctagtgcacgtagatgctgcaagggctctgtggcccctacggcgcttctggaggtctactgggttctgcccaccacttccccattctcaggcagatcagtatgttctctcttgggatcaacagcttaacctcgcatatgtaggagccgtgcctcaccgcgggataaaacaggtacggactcattggcttctagaacttgtgactactagagggtccactgggagggggcttagttataattttacgcaccttgacgggtatctcgatctcctgagggaaaatcagttactgccagggtttgaactgatggggtccgctagtggacattttacagatttcgaggataaacagcaggtgtttgaatggaaggatttagtgtcttcgctagctcggagatatatagggagatatggactggctcatgtgtcaaaatggaactttgaaacatggaatgaacccgatcaccatgatttcgataatgtatcaatgactatgcaaggatttctcaactattatgatgcctgctctgaagggttgcgagcagcaagtccagctctacggctggggggaccaggggattcctttcacactcctcctcgttctcccttaagttgggggctcctccggcattgtcatgatgggactaacttcttcacaggagaagctggagtacggttggattacatctccttacaccgaaaaggggcccgcagttctatttccatacttgagcaggagaaagtcgtggcccagcagattaggcagctgttcccaaagttcgccgatacgccaatctataatgatgaagccgaccctcttgtaggatggagtctgcctcagccttggcgagctgatgtaacatatgcagccatggtggttaaagtcatcgcccagcatcaaaatctcctcctagcaaatactacttcagcttttccctacgcccttctttccaatgataatgcttttctaagttaccatccccatcctttcgcccaacgcacactcacagcccggttccaggtcaacaatactcggcccccacacgtccaactcctcagaaaacctgtcttaacagccatggggctcctggctctcctagatgaagaacagctctgggccgaagtatcccaggctgggactgttctcgattctaaccatacagtcggggtgctcgcgtcagcacaccgaccccaggggccagctgacgcttggcgcgctgcggtgctgatctatgcatccgatgatactcgcgcccatcccaacagatctgtcgcggtaactttacgtctgaggggagtgcctcccggaccaggactagtctacgtgacacggtacctggataatggactgtgctcacccgatggagaatggaggcgcctgggaagacccgtattcccgacagctgaacagttcaggcggatgcgggctgctgaagatcccgttgccgcagctccacgccctctgccagcaggggggcgactcactctccgcccagctctccggctccctagtttattgctcgtccacgtctgtgcacggccagaaaaacctcccggacaggtcactagacttcgagccttaccccttacacagggacagttggtgttggtgtggtctgatgaacatgtagggtctaaatgtctttggacttatgaaatacagtttagtcaggatgggaaggcatatacacccgtgagtaggaaaccttctactttcaacctcttcgtgttctcacccgatacaggggccgtttctgggtcgtatcgggtaagggccttggattattgggctagacctggacctttctctgaccccgtgccgtatctggaagtcccagtaccccgaggacccccttctcctgggaatcct

SEQ ID NO: 13928 - DNA, 1959 bp, Artificial Sequence
  Description of Artificial Sequence: Synthetic coding sequence
atgcggccacttcggccgcgcgccgcacttctggcactgcttgcttcactgctggctgcaccgccggtggcaccagccgaggcgccccacctcgtccacgtggatgcagctcgcgcgttgtggcctttgcgccgcttttggcggtccaccggcttctgccctccgctcccccattcccaagcagaccagtatgtgctgtcatgggatcaacaactgaatctggcctacgtcggggctgtgccgcatcgcggaatcaagcaggtgaggacccactggctcctggaactggtgactactcggggatcgaccggaaggggcctgtcctacaatttcacgcacttggacggataccttgaccttctcagagagaaccagctgctccctgggtttgaattgatgggatccgcctccggtcatttcacggacttcgaggacaagcagcaagtctttgaatggaaagacctcgtgtcctccctggcccgcagatatatcggaagatacggactggcgcacgtgagcaagtggaacttcgaaacttggaacgagccggaccatcatgattttgataacgtttcgatgactatgcagggctttctgaattactacgatgcttgcagcgaaggacttcgggcagcgtcacctgcgttgagactcggaggcccgggggactcattccatactcccccgcggtcaccactctcctggggcctgctgcggcactgccatgacggtactaacttctttactggagaggcgggagtgcggctcgactacatctcgctccatcggaagggagctaggtcctcgatcagcatcctggaacaggagaaggtggtcgcgcagcagatccgacagctcttccctaagttcgcagatacccccatttacaacgacgaggcggatccgctcgtgggctggagcctgcctcagccgtggcgggccgatgtgacctacgcggcgatggtcgtgaaagtgatcgcacagcatcagaacctcctgctcgccaacactacgtccgctttcccgtacgcgctcctcagcaacgataatgcatttctgtcctaccatcctcatcctttcgcgcagaggaccctgactgcgcgctttcaagtcaacaatacccggccgccgcatgtgcagctgctgcgcaagccggtgctgaccgcaatgggactcctcgccctgctggacgaagagcagttgtgggcggaagtttcccaagcaggaaccgtgctggactccaaccacactgtcggtgtgctcgcctcggcccaccgcccacaaggtccagccgatgcttggcgcgcggcggttctgatttacgcgtccgatgacaccagggcgcaccctaaccgctccgtggccgtgactctcagactgcgcggtgtgccgcccggaccgggtttggtgtacgtgactaggtaccttgacaatggactgtgtagcccggacggagagtggcggcgcctcggtagacctgtgtttccgactgcagaacagttcagacgcatgagagcagctgaggacccagttgccgctgcacccagaccactgcccgccggcggacgactgacccttcgccctgccctccgcctcccatctctgctgctggtccatgtgtgtgcccgcccggaaaaaccgccaggacaggtgactcgcctgcgcgcacttccgttgacccaaggacaattggtgctcgtgtggagcgacgaacacgtcgggagcaagtgcctctggacctacgagatccagttttcgcaagatggtaaggcatacaccccggtcagccgcaagccttcaacgttcaatctcttcgtgttctctcccgataccggagctgtgagcggctcgtaccgggtccgggcgctggactactgggcccgccctggacctttctcggacccagtgccataccttgaagtgccggtgccgcgcggcccaccgtcccccggcaacccg

SEQ ID NO: 13929 - DNA, 1959 bp, Artificial Sequence
  Description of Artificial Sequence: Synthetic coding sequence
atgaggcctctgcgtcccagggccgcgctccttgcgctccttgcttctcttcttgccgcgccgcccgtggcacccgccgaggcaccacatctagtccatgtggacgccgctagagctctgtggcctcttcgacgcttttggcgttcaacagggttctgccctccccttccccactcccaggccgaccagtatgtccttagttgggatcagcagctaaatctggcatacgtgggggccgttccccaccgcggcataaaacaggttcgtacccactggctgctggaactcgtgactacacgaggatctaccggtcgggggctgtcctacaacttcacccatctggacggctacctcgacctgttacgcgaaaatcagcttctgcctgggttcgagctgatggggtcagcctccggccacttcaccgattttgaggataagcaacaggtgtttgagtggaaggacctcgtgtcttcattggcgaggaggtacatagggcggtacggcctggctcacgtgtctaaatggaacttcgagacatggaacgagcctgaccaccacgacttcgataacgtaagtatgactatgcagggctttcttaactactatgacgcctgcagcgaaggcttaagagcagcctctcccgcactgaggttaggaggccccggggattcattccacacccccccccggagcccgctgagctggggcctcctgcgccactgccacgatgggactaacttcttcactggagaagctggagtccgattggactacattagcctccatcggaaaggcgccaggagttccatcagtattctggagcaggagaaagtggtggcccagcagatcagacagctgttcccgaagtttgccgatacaccgatttacaacgatgaagcggacccgctcgtgggatggtcgctgcctcagccgtggagggcagacgtaacatatgctgctatggttgtaaaagtgattgcccagcatcagaatctgctgctggccaacaccacttcagcttttccttacgcgttactaagcaacgataatgccttcctttcataccacccacaccctttcgcacaaagaacacttactgctcgattccaagtgaacaacacccgaccccctcacgtgcagctgttacgtaagccagtgctgaccgcaatgggactcttggccctactggatgaagagcagctgtgggcggaagtctctcaggccggtactgtgctggacagcaatcacaccgtgggggtgctggcctccgcacatcggcctcagggacctgccgacgcgtggagagccgctgtgctcatctacgcaagcgacgatacccgggctcacccgaaccgcagtgtggccgtcacactccgcctaaggggcgtaccgcccggtcctggcctggtgtacgtgacacggtacctggacaacggactctgttctcctgatggcgaatggcgaagattgggccgacccgtttttcccacggctgagcagtttagaaggatgcgggccgccgaggatcccgtggctgccgccccaagaccactgcccgccggcggacggttgactcttcggccggccttacgactcccctcactgctgttagtccacgtgtgcgcacggcctgagaaacccccagggcaggtcacccgactgagagcactgccccttacccagggccaactggtcctcgtgtggtccgatgaacacgttgggagtaaatgcctctggacctacgaaatccaattttcgcaggacggcaaggcgtatactccagtgtcgcggaaaccgagtacattcaacttgtttgtattttctcctgatactggggccgtttctgggagctacagagtgcgggcgctggattactgggctaggccagggcccttctccgacccagtgccctatctcgaggtgcctgtgcccagagggccgccatctcctgggaacccg

SEQ ID NO: 13930 - DNA, 1959 bp, Artificial Sequence
  Description of Artificial Sequence: Synthetic coding sequence
atgaggccactccggcccagagcagcattgctggcgctacttgcctcattgctggccgcccctcctgttgctcccgccgaagctccacacctggtacacgtagacgcggcgcgcgccttgtggcctttgcggcgattttggcgctctaccggcttctgcccgcccctcccccactctcaagcagatcaatacgttctcagctgggaccagcagttaaacctggcgtacgtaggagcagttccccatagaggaatcaaacaagtgcggacccattggctgttagaattggtgaccacacgaggatcaaccggtcggggtctcagctacaatttcacgcatctggatgggtacctggacctcttgcgcgagaaccagctgcttccagggtttgaactgatggggtccgcctccggccacttcacagacttcgaggataagcagcaggtattcgagtggaaggaccttgtctcatccctggcccggcgctacatcggacggtacggattagctcacgtgtcaaagtggaacttcgagacgtggaacgagcccgatcaccacgatttcgacaacgtgagcatgactatgcagggattcttaaattattatgatgcatgctctgagggcctacgcgctgccagccctgctcttcggctgggcggtcccggtgattcattccacacaccgccccgtagccccctgtcctggggactgctgcggcactgccacgacggcacaaacttttttacgggtgaggctggagttcgcttggactatatctcgctccacaggaagggcgcccggagctcgatctctatcctggaacaggagaaggtggtggcccagcagattaggcagttattccctaagtttgcggatactcccatctataacgatgaagcagatcccctcgtcgggtggtctctgccccagccttggcgcgcggatgtgacctatgctgcaatggtggtgaaggtcatcgcacagcatcagaatcttcttctggctaacaccactagtgcgtttccttatgcgctgcttagcaacgataatgcattcctgtcctatcatccacacccgtttgcacaacgtacgctgactgctagattccaggtgaacaacactcgccccccccatgttcagttgctccggaaaccagtgctcacagccatgggcctgctggccctgctggatgaagagcaactatgggcggaagtgtcgcaagcgggcacagtcctggattcgaaccatacagtcggggtgctagcctcggcccaccgaccccagggccccgctgacgcctggcgcgcggcagttctaatctatgccagcgacgatacgagggcccacccaaatagaagcgtcgccgttacgctacgtctgagaggggttccacccggcccggggttggtgtatgtaactagatatctagataatgggctgtgttctcccgacggagagtggagacgtttggggcgacccgtgtttccgactgcagaacagtttagaagaatgagggcagcagaagacccggtagcagcggcgccgcgcccgctgcctgcgggaggtagacttaccttgcggcctgccttaagacttccaagtttgctacttgtccacgtatgcgctagaccagaaaagccacctggacaggttactagattgcgtgccctcccactcactcagggtcagcttgtattggtgtggagtgacgaacatgtgggatctaaatgcttgtggacctacgaaatccagttttctcaagacggaaaggcatatactccagtctcccgaaaaccctctacctttaatctgtttgtattctctccagacacaggtgccgtgagcggctcataccgggtgcgggccttggactattgggcgagacctgggccttttagcgaccctgtgccttacctggaggtgccagtgccgcgcggccccccctctcctgggaacccc

SEQ ID NO: 13931 - DNA, 1959 bp, Artificial Sequence
  Description of Artificial Sequence: Synthetic coding sequence
atgcgacccctgcggccacgggccgcactgctggctcttctcgcttcgctcctcgcggcccctccagtggcaccggccgaggccccgcatctcgtgcacgtcgatgccgctcgggcgctgtggcctctgcgccgcttttggcgaagcaccggattctgcccgccgctgccgcactcacaggcggatcagtacgtgctgtcctgggatcagcaactgaacctggcctatgtgggcgccgtgccacatcgcgggatcaaacaggtcaggacccattggctgcttgaactcgtgacgactaggggctcgacggggcgcggactctcctacaacttcacgcacctcgacggatacctcgatctcctccgcgagaaccaactgctgccaggcttcgagttgatgggaagcgcttcgggacatttcaccgacttcgaggacaaacagcaagtgttcgagtggaaggatttggtgtcatcattggcccggcggtacatcggacgctacggactggcccatgtctctaagtggaacttcgagacttggaatgaaccggatcaccacgattttgacaatgtgtcaatgactatgcaggggttcctgaactactacgatgcctgcagcgaggggctgcgggctgcgtccccggcgctccgactcggaggcccgggtgatagctttcacactccgccacggtcaccactgagctgggggctgctccgccactgccacgacggaactaatttcttcactggagaggccggagtgcgcctggactacatctcactgcaccggaagggcgccagatcatcgatcagtatcctggaacaagaaaaggtcgtggcgcagcaaattagacagctgtttccgaaattcgcagacacgccgatctacaacgacgaagccgacccactggtgggatggtcgctgccacaaccctggcgcgctgatgtcacttacgcagccatggtagtgaaggtgatcgcacagcatcagaatctgctgctggctaataccacctcagctttcccttacgccctcctctcgaacgataacgcctttctgtcgtaccatccacaccccttcgcacagagaactctcaccgcgcgcttccaggtcaataacacgcgcccgcctcacgtgcagctcctcagaaagccagtcctgaccgccatgggcctgctcgccctccttgacgaggaacaactttgggctgaagtgtcccaggcgggcaccgtcctggatagcaatcatactgtgggtgtgctggcttcggctcaccgcccacaaggaccggcggatgcttggcgcgccgccgtgctcatctacgcctcagacgatacccgagcccaccccaaccggagcgtggccgtgacgctccgcctcaggggtgtacctccaggtccgggactggtgtacgtgacccgctacttggacaacggcctttgcagcccggacggtgagtggcgaaggctcggacgccctgtttttccgactgctgagcaatttcggaggatgcgcgcagccgaagatccagtggctgccgcacctcggccactcccagcgggaggtcgcctgacgttgcggccggccctgcggctgccgtcactgttgctggtgcatgtgtgcgcgcggcctgaaaaaccccctggacaggttacgagactcagggcgctgccactgacccagggccaactggtcctggtgtggtctgacgaacatgtgggctcgaaatgcctctggacttacgaaattcagttctcgcaggacggcaaggcttacaccccggtgtcgcggaagccttcgacctttaaccttttcgtgttctccccagatactggagcggtttccgggtcttacagggtcagagctctcgactactgggcgcggcctgggccgttctcagatcccgtcccgtatctggaggtcccggtcccacgcgggccgccctccccggggaaccca

SEQ ID NO: 13932 - DNA, 1959 bp, Artificial Sequence
  Description of Artificial Sequence: Synthetic coding sequence
atgcgtcccctaagacctcgggccgcactgctggcactgctcgcatcgttgctggcagcacctcctgtcgcccccgccgaggcccctcacttggtgcacgtagacgctgcccgtgctctctggcccctgagaagattctggagaagtaccggcttctgccctcctctgccccatagccaggcggaccagtatgtgctgagctgggaccagcagcttaacctcgcttacgtgggcgctgtgcctcaccgggggatcaagcaggtccgtactcattggctgcttgaattggtgacaacgcgcggttccactggtcggggactttcgtacaacttcactcatctggatggttatctggatctgctgagagagaatcaattgctccctgggttcgagctgatggggagcgcatcagggcactttacagacttcgaggacaagcagcaagtcttcgaatggaaagatctggtgtcgagcctcgcaagaagatacattggcagatacgggctagcccatgtgtctaaatggaactttgaaacctggaacgagcctgaccatcacgactttgataatgtctccatgaccatgcaggggttcttgaattactacgatgcttgttctgaggggctgcgcgctgcttccccggccctgaggctcggaggaccaggagattcttttcacacccccccccgatcaccactaagctggggtctgctgcgacactgccacgacggaacaaacttctttactggcgaggcaggcgtgaggctggattacatttccctgcatcgtaagggggcacgatcatctatctctattttggaacaagagaaggtggtggcacagcagattcggcagctttttccgaagttcgccgataccccaatctacaatgacgaggcggatcctctggtggggtggtcacttccgcaaccatggcgcgcggacgtcacgtacgcagcgatggtggtaaaagtgattgcacagcaccagaatttgcttctggcgaacactacctcagcattcccctacgcgctcctgtccaacgacaacgcctttctcagctaccatcctcacccgttcgcgcagagaaccctcacggctcgctttcaggtcaataatactcgaccaccccatgttcagcttctacggaaacctgtgctcactgccatggggctcctagcactgttagatgaggaacaattgtgggcggaagtgtcccaggcaggtaccgtgctggactctaatcacaccgtcggcgtgctagccagcgcccatcggccacagggcccagctgacgcatggcgcgcagccgtgctgatctacgcgagcgacgacacgagagcgcatcccaataggtcagtcgctgtgacgttgaggcttcgcggggtgccgccaggcccaggcctcgtgtacgtgacacgctacctggacaacggactttgctctcctgacggcgagtggcgaagattgggccggcccgtatttccaaccgccgagcaattcagacgaatgagggcggctgaggacccagtggctgccgccccgaggccattgcccgccggtggtcggctgaccttgcgtcctgcgctccgcctgccatcactgttgctggtgcatgtgtgcgcgagacccgagaaaccacccggccaggtaacacgcctgagagccctccccctgacacagggacagcttgtgctcgtctggagtgatgagcacgtcggatcgaaatgcctctggacctatgagatccagttcagccaggatggcaaggcctatactcccgtgtcgcggaagccaagcacattcaatctcttcgtcttctcccccgacactggagctgtgagcggatcctaccgggtgcgggctctcgactactgggcccggcccggacctttttccgaccccgtgccatacctggaagtgcccgtcccgaggggaccaccctcccccgggaaccct

SEQ ID NO: 13933 - DNA, 1959 bp, Artificial Sequence
  Description of Artificial Sequence: Synthetic coding sequence
atgcgccctcttagacctcgggctgcactgcttgcactccttgcctcgctgctcgcggcacctcccgtggcacctgcagaagcaccacatcttgtgcacgtggatgccgcgagagcactctggccacttcgacgtttctggcgatccactggattttgtccaccacttccacattcgcaggcagatcaatacgttctgtcctgggatcaacagttgaacttggcgtacgtcggggcagtgcctcaccgtgggattaagcaggtccgcactcattggctgcttgaactggtcaccaccagggggagtactgggcgcggactttcctacaactttactcatctcgatggatacctcgacctgcttagagaaaatcagctgttgcccggcttcgaacttatgggtagcgccagcggccacttcactgattttgaagataagcaacaagtgttcgaatggaaggatctggtgtcatccctggcacgacgctacattggccggtacggtctggcacatgtgagcaagtggaacttcgagacttggaacgagcccgatcatcacgatttcgacaatgtgtcaatgacgatgcaaggttttttgaactactacgatgcgtgttcggagggacttcgcgctgccagcccagcccttcgactgggaggcccaggggattcgtttcatactccacctcgctcacctctttcgtgggggcttctgcgacactgtcatgacggcaccaactttttcactggagaagcgggagtgcgactggactatatctcactgcatcggaagggcgcgcggtcctcaatctcgatccttgaacaagaaaaggtggtcgcacagcaaattcgccagctttttcctaagtttgcagatactcccatttacaacgatgaggcagatcctctcgtcggctggagccttccacagccttggcgcgctgacgtcacctacgctgcaatggtggtgaaagtgattgcgcagcatcaaaatcttctcctggccaacaccacctccgcatttccttacgctcttttgtccaacgacaatgcatttctgtcgtaccatcctcacccctttgcgcaacgaacgctgactgcaagattccaggtgaacaatacccgaccacctcatgtgcagctgctgaggaaaccagtgctgaccgcaatgggtctgctggcccttctcgatgaagaacagctttgggcagaagtgagccaggccgggaccgtccttgattcaaaccatactgtcggcgtcctggcaagcgctcatcggccacagggtccagcagacgcgtggagagcagcggtcctgatttacgcatcagatgatactagggcacatccaaaccggtcggtggctgtgactctgcgacttcgcggtgtgccacctggacctgggctcgtgtacgtgacccggtatctggacaacggtctgtgttcgcccgacggagagtggagaaggcttggtagaccagtctttccaaccgcagaacagtttcggaggatgcgcgccgcagaagatccagtggcagctgctccacggccacttccggcaggagggaggcttaccttgcggcccgcccttcgtctgccttcactgttgcttgtccatgtgtgcgcgaggcccgaaaagcctccgggacaggtgacccggttgcgagcactccctctcacccaaggtcagctcgtactcgtgtggagcgacgaacatgtgggatcgaagtgtttgtggacctacgaaattcaattctcccaagacggaaaggcatacactccagtgtctcgcaagccctccacctttaacctcttcgtgtttagcccagataccggagccgtgtcagggtcataccgagttcgtgcgcttgattactgggcacgcccgggccccttttcggacccagtcccgtatctcgaagtgcccgtgccgagaggaccaccctcaccaggaaatcct

SEQ ID NO: 13934 - DNA, 1959 bp, Artificial Sequence
  Description of Artificial Sequence: Synthetic coding sequence
atgcgccccctgcgtccccgagctgcattgctcgcgctgcttgcctctctccttgccgcacctcctgtggcacccgcggaagcacctcaccttgtccatgtggacgcagcccgcgcactttggcctctgaggagattttggcgatccacgggattctgtcctcccctgcctcactcgcaagcggatcagtacgtgttgagctgggaccagcaactgaacctcgcatacgtgggcgcagtgccacacagaggcataaaacaagtccggacgcactggttgcttgaactcgtgaccaccagagggtccaccggtcggggactgtcctacaatttcacccatcttgacggttacctggatctgctgcgggagaaccagctcttgcctgggtttgaactgatgggatccgcttcaggtcactttaccgatttcgaagataaacaacaggtgtttgaatggaaagatttggtcagtagcctggcacggcgctacattggtcggtatggactggctcatgtgtcaaagtggaatttcgagacttggaatgaacctgaccaccatgattttgataacgtgagcatgacgatgcagggttttcttaactattacgacgcatgctccgaagggttgagagcagcgtcgcctgcactgagacttggcggtcccggtgattcatttcatactccccctagatcgcctcttagctggggattgctgcgacattgtcatgatgggaccaatttctttaccggagaggcaggcgtgaggcttgattacatctcgctgcacaggaagggagcgcgaagctcgatctcgatacttgagcaagaaaaggtggtggcccagcaaatccgccaattgtttcctaaattcgctgatactccaatttacaacgacgaagcagacccgcttgtcggatggtctttgccccaaccatggagagctgatgtaacgtacgcagccatggtcgtcaaagtcattgcacaacatcagaacctgttgcttgcaaatactacctcagcctttccatatgccctgctgtcgaacgacaacgcatttctttcgtaccatcctcatccgttcgcgcaaaggactctgactgcccgctttcaagtgaacaataccaggcctccccacgtgcagcttcttcggaagcctgtgctgaccgctatgggactccttgcactcctggacgaggagcaattgtgggcggaggtgagccaagcgggtactgtgctggactccaatcatactgtgggtgtgcttgcttcggcacaccggccacagggtcctgcagacgcatggcgggccgcggttctgatctacgcatcagacgacactcgcgcccatcccaatcgatcggtggccgtcaccctgcgtctcaggggtgtcccgccaggcccaggacttgtatacgtgacgcggtacctggataacggtctgtgtagccctgatggagaatggagaaggctggggcgcccggtttttcctaccgcagaacaatttaggagaatgcgtgccgcagaagatcccgtcgcagcagcaccccgcccactcccagcaggaggccgtcttactcttcggcctgccctgaggcttccatcgttgctcctggttcatgtatgcgcgcggcccgaaaagcctccaggtcaagtgactcgccttagagcccttcctctcactcagggccaactcgttttggtgtggagcgacgagcatgttggcagcaaatgcctgtggacttacgaaattcagtttagccaagatggaaaggcgtacacccccgtctcaaggaagccatcgacgttcaaccttttcgtgtttagccctgatacgggagcagtgtccggatcctacagggtccgtgccctggactactgggcaagaccgggtcccttctcggatcctgtcccatacctcgaggtgcctgtgcctagaggaccaccatcgcctgggaaccca

SEQ ID NO: 13935 - DNA, 1959 bp, Artificial Sequence
  Description of Artificial Sequence: Synthetic coding sequence
atgcggccgttgcgtccgagagcggcccttctggcgcttctcgccagcctgctggcagcacctccagtggctcccgctgaggccccgcacttggttcacgtggacgccgctcgtgccctgtggcccttgcgccgcttttggagaagtacagggttttgtcctcctctgccgcatagccaggcggatcagtacgttctgagctgggaccagcagttaaacttggcatatgtaggtgctgtgccgcaccgcggtattaagcaggtgaggacgcactggctgctagaacttgtgacaacccgcggttctactggccgtggtctgagctataatttcactcacctcgatggttatcttgatctgctgcgagaaaaccagttgctaccggggttcgagctgatggggtccgcaagtggccatttcaccgactttgaggataagcagcaagtgtttgagtggaaggatctggtgtcctccctggcgagacgctacatcggccgctacggcctggctcacgtgagcaaatggaacttcgaaacttggaatgagccggatcatcacgacttcgacaacgtgtccatgaccatgcaaggcttcctgaattactacgacgcctgtagcgagggtttgagagcggcgtccccagccctgcgactcggcggcccgggcgactccttccatactccaccacgctcccctctgagttggggattgctgcggcattgccacgacggaactaacttttttactggtgaggcaggcgtgcgcctggactatattagcctgcaccgcaagggtgctcgcagcagcataagcatcctggagcaagagaaggtcgttgcgcagcagatccgacaactttttccgaagttcgccgatacccccatctataatgatgaggccgatcctctggtcggttggtccctgccacagccttggcgggcggacgtgacctacgcggcgatggtggtgaaggtaattgcgcagcaccagaatctgctgctggccaatacgactagtgcattcccatacgctctgttatcgaacgacaacgcttttctgagctaccaccctcatcctttcgcgcaacggaccctgactgcgagattccaagtgaacaatactcggccacctcacgttcagttactccgaaagccggtgctgactgcgatgggtctgctggctcttctggacgaggagcagctgtgggctgaggtgtcccaggcaggaaccgtcctggactctaatcatacggttggcgtcctggcgtctgctcacaggccacaaggcccagccgacgcgtggcgcgcagccgttctgatctacgcctcagacgataccagagcacaccctaatcgctctgtggctgttaccctgcgcttgcgcggggtccccccagggccaggccttgtttatgtgacgcgatatctcgacaacgggctctgctccccggacggcgagtggcgtcgcttagggcggcctgtcttcccgaccgccgagcagttccgacgaatgcgcgccgccgaggaccctgttgcggcggctccgcgtccacttcctgccggcggccgcctgacgctacgcccagccctgcgtctgcctagtctcctgctggtgcatgtctgcgcgcgtccggaaaaacctcctgggcaggtgacgcgcctgcgagccctgccgttgacccaaggtcaactggtcctggtctggagcgacgaacacgttgggtcgaaatgtctgtggacgtacgaaatccaatttagtcaagatgggaaagcctacacgccagtgtctaggaaaccgagcacctttaatctgttcgtgttctcccctgacacaggagccgtgagcggtagctaccgagtgcgcgcgctggattactgggcgcggccgggaccatttagcgacccggtaccgtatctggaggtgccggttcctcggggtccgccaagcccaggcaatcca

SEQ ID NO: 13936 - DNA, 1959 bp, Artificial Sequence
  Description of Artificial Sequence: Synthetic coding sequence
atgcggcccctccgccctcgggcagcgctgctagcactcttggcttcgcttcttgccgctcccccagtagcgccagcagaggcgccccacctggtccatgtggacgccgcccgagcattgtggcccttgcggcggttctggaggtcaacaggcttctgccccccattacctcattcacaggctgaccaatacgtgttatcttgggaccagcagctcaacctggcctatgtcggagccgttccccatagggggattaagcaagtcaggacccattggctgctggagctggtgacaacaaggggctcaacgggccgcggtctgtcttacaacttcactcacttggatggttacctggacctactgcgcgaaaatcaactactgcctggctttgagctcatgggatctgcaagcgggcatttcacagactttgaggacaaacagcaggtgtttgaatggaaggatttggtgtcttcactggctcgcagatatatcgggcgctatggactggcccacgtttctaaatggaacttcgaaacatggaacgaacctgatcaccacgactttgacaatgtgagcatgactatgcaggggtttttgaattattatgatgcttgcagtgagggcttacgcgctgcttcacctgcactcaggctcgggggacctggagacagcttccacaccccccccaggagccccttgtcatggggtttgctgcgccactgtcacgacggtacgaacttctttaccggtgaagccggcgttcgacttgactacatctccctgcatagaaaaggagccagaagtagtatttcaatcctggagcaggagaaggtcgtggcacagcagataaggcaactgtttcccaagtttgctgacacgcccatttacaatgatgaggctgatcccctggttggatggagtctcccccagccctggcgggccgacgttacctacgccgcgatggtggttaaggtaatcgcccaacatcagaatctgctgttggctaatactacctctgcttttccatacgctctgctctctaatgacaatgcctttttaagttaccacccgcaccctttcgcacaacgaactctgacagcgcggttccaggttaacaatactcggcccccccatgtccagctattaagaaagccagtcctaacggctatgggacttctggctctactggatgaagaacagctgtgggccgaggtatctcaggcaggaacggttttggactcaaaccataccgtcggagttctcgcatccgcacatcggccgcaggggcctgcggatgcttggcgggccgcagtgctgatttacgccagcgatgacaccagggcccatcccaatcggagtgtcgcagtgacgttgcgtctacgcggcgtgcccccaggacccggtctggtgtacgttactagatatcttgataacggcctgtgttcccccgacggagaatggagaaggttgggaaggccagtctttcctaccgccgaacagtttcgtcgcatgagggccgccgaggacccggtcgctgcggcgccacggcccctccctgcgggcggacgtctcactttgcgccccgccctccgtctgccatcactgctactggtccatgtgtgtgcgcgaccagagaagcctccaggccaggtcacccggcttagggctctgccccttacacaaggccaactcgtgcttgtctggtctgacgagcatgttgggtctaagtgtctgtggacatatgagattcagtttagccaggacggaaaggcgtacaccccggtcagtcgaaagccaagcacctttaacctgttcgtgtttagcccagatacaggagctgtctccgggagttatcgagtaagagcactcgactactgggcgcgccccgggccatttagtgatccagtaccctacctcgaagtgcctgttccccgaggaccgccaagtccaggaaacccc

SEQ ID NO: 13937 - DNA, 1959 bp, Artificial Sequence
  Description of Artificial Sequence: Synthetic coding sequence
atgcggccactcagacccagggccgcgctcctcgccctgctggcgtcgcttctggcagctccgccagtggcccctgcagaggcacctcacctggttcacgttgatgcagcaagagcactgtggcctctgaggagattttggcggtccaccggcttttgtccacctcttccacactcacaggcagaccaatacgtgcttagctgggatcagcaactcaatttggcatacgtgggagcagtgccccataggggtattaagcaagtgagaacccactggcttctggaactggtgactacccgaggaagcaccggtcgcgggcttagctacaactttacccacctcgacggatacctcgacctgctcagagaaaatcaactccttcctgggtttgagcttatgggttccgcgtcgggtcattttactgattttgaggacaagcaacaggtgttcgaatggaaagatctggtgtcatcgctggcacggcggtacatcggtagatacggactggcacatgtgtcgaaatggaacttcgaaacttggaacgaacccgatcaccatgatttcgataacgtcagcatgactatgcagggatttttgaactactacgatgcttgttcggaaggcctcagggcggcctcgcccgcactgcgccttggagggcctggtgactcatttcatacccctccgcgctcacctctgtcgtggggactcctgagacattgtcatgatggcaccaacttctttactggcgaagcaggagtgaggcttgattacatcagcctccacagaaaaggtgcaagatcgagcatttcgattctggaacaggaaaaggtggtggctcagcaaattcggcagctctttcccaaatttgcagataccccaatctacaacgacgaagcggatccactggtcggctggtcccttcctcagccttggagagcagatgtcacctacgccgccatggtcgtcaaagttattgcacaacaccagaatttgctcctggctaacacgaccagcgcattcccatacgcactgctgtcgaacgataacgcatttctttcgtaccatccacatccatttgcacaaagaaccctgactgcgcgctttcaagtgaacaatactcgacctcctcacgtgcagctgctgcgtaaacctgtcctcaccgctatggggctcctggccctgcttgacgaggaacaactgtgggcggaagtgagccaagcaggaaccgtcctcgactcaaaccatactgtcggagtgctcgcctccgcgcaccgccctcagggaccggcagatgcctggagggcggcagtgttgatatacgcatcagatgacacgcgagcgcacccaaatcggtcggtggctgtgactctgcgccttaggggagtgcctcccgggccgggactggtgtacgtgactcggtacctggataatggcctttgttccccggacggagaatggcgcagactcggtcggccagtgtttccgaccgcagaacagtttcggagaatgcgggcagcagaagatcccgtggcagcagctccacgccccctgccagccggtggtaggctgaccctccgccctgctcttaggctgccttcgcttcttctggtgcatgtatgtgcccgtccggaaaaaccaccaggacaagtcacccgccttagggcccttcctcttactcaaggacagctcgtccttgtctggtccgatgagcatgtcggatccaagtgtctgtggacctacgaaattcaattttcccaagatggaaaagcatatactccggtttcgagaaagccatcaacgttcaacctgttcgtgttctccccagataccggagcagtgtccggtagctatagggtcagagcacttgattattgggcgcgccctgggcctttctcggatccagttccataccttgaggtgccggtcccacgcggtccccccagccctgggaacccg

SEQ ID NO: 13938 - DNA, 1959 bp, Artificial Sequence
  Description of Artificial Sequence: Synthetic coding sequence
atgaggccccttagacctcgagcagcacttctggcacttctcgcctccctccttgcggctccacccgtggcaccggccgaagccccccacctcgtgcacgtggacgcagcgagagcgctttggcctctgaggcgtttctggaggagcacgggattctgtccacctctccctcactcgcaagcagaccaatacgtgctgtcgtgggatcaacaacttaaccttgcatacgtgggtgccgtgcctcatcggggcattaagcaagtaagaacccactggctgctcgaactcgtcaccacgcgaggctccaccggtagggggctgtcctacaacttcacccatcttgacggatatcttgatctcctgcgggaaaatcagttgctgcctggcttcgagctcatgggatcggcctctggtcattttactgactttgaggacaagcagcaggtgttcgaatggaaggatcttgtgagctcgctcgctagaagatacattggtagatacggactggcccacgtgagtaaatggaattttgagacgtggaacgaacctgaccatcacgattttgataacgtgtccatgactatgcaaggctttctgaattactacgatgcctgttcggaagggctgagagcagcatcccctgcgctgcggttgggcggtccaggagattcgtttcacacgcctccaagatcgcccctctcctggggcctccttcgccattgtcatgacggaacgaactttttcaccggcgaagcaggagtgcgacttgattacatttcactgcatagaaagggcgctcgctcatccatctcaattcttgagcaagagaaggtggtcgcacaacaaatccgtcagcttttcccaaagtttgccgacactcctatttacaacgatgaagcagatccgctcgtcggttggtccctgccgcaaccttggcgtgctgacgtgacctacgcagcaatggtcgtgaaggtaattgcccagcaccagaatcttctgctcgccaacactactagcgcgtttccatacgcactgctgtcgaacgataacgcatttctttcataccacccccatccgtttgcacagcgcactctgaccgcacgatttcaagtgaacaacacccgcccacctcatgtgcaacttctgcgtaaaccagtgcttaccgcaatgggtcttttggccctgctcgacgaagaacagttgtgggccgaggtgtcacaagcaggcactgtgctggattcaaaccacaccgtgggagtcctggcctcggcgcacaggccgcagggacctgccgacgcctggcgggcagctgtcctcatctatgcatcagacgatactcgggcacatcctaatcgttcagtggcagttaccctgcggctgcgaggtgttccccctggacccggactggtgtatgtgacccgatacctcgataatgggctgtgctcgcctgatggagaatggagaaggcttggcaggccggtgtttcccaccgcggaacagtttcggcgaatgcgagcagcagaagatcctgtggcagcggcccccagacctctgccggcgggcggacgtctcactctccgacctgcactgagacttccgtctctgcttttggttcatgtctgcgcacgaccagagaagcctccaggacaagtcactcgtctccgggcgctgccgcttactcaaggacaactcgtgcttgtgtggtcggacgaacatgtcggtagcaaatgtctctggacttatgagattcagttcagccaggacggtaaagcctacacccccgtctcccggaagccttcaaccttcaaccttttcgtgttctcgcctgatactggtgccgtgtcaggttcgtacagggtgcgcgcactggattactgggccaggccagggccattttcagatcctgtgccttaccttgaagtcccagtgccaagaggtcccccctccccaggtaatccc

SEQ ID NO: 13939 - DNA, 330 bp, Artificial Sequence
  Description of Artificial Sequence: Synthetic coding sequence
atggctctgtggatgcgcctgctgccgcttctggccctgttggcgctctggggtcctgacccagccgctgcattcgttaatcaacacttgtgcggatcgcacctcgtcgaggcactgtacctggtgtgcggtgaacgcggctttttctacactccaaaaactcgccgtgaagccgaggatctgcaggtgggccaggtggagctgggagggggacccggcgcaggctctcttcaaccgctggctctcgaaggatcgttgcagaagcggggaattgtcgagcagtgttgcacctcaatctgcagcctttaccagctggagaactactgcggt

SEQ ID NO: 13940 - DNA, 330 bp, Artificial Sequence
  Description of Artificial Sequence: Synthetic coding sequence
atggcactgtggatgcgccttttgccgttgctggcccttctggctctgtggggtcctgaccccgcagccgcttttgtcaatcagcatttgtgtggatcccacctggtggaagcgttgtacctggtctgtggagagagaggattcttttacactcctaagactcggcgtgaggcggaagatctgcaagtgggacaagtggagctggggggtggccctggagccggaagcctccagccgcttgcgctcgaaggctcgctccagaaaagaggcattgtggaacaatgctgtaccagcatctgctctctctatcagcttgaaaactactgcgga

SEQ ID NO: 13941 - DNA, 330 bp, Artificial Sequence
  Description of Artificial Sequence: Synthetic coding sequence
atggcactttggatgagactgcttcctctcctcgctctcctggccctgtggggaccggacccagcggccgcctttgtgaatcagcacttgtgcggaagccacctcgtggaagccctctatctggtgtgcggcgagagaggatttttctacaccccaaagacccgccgagaagcggaggacctgcaagtgggacaggtggagctggggggcggacccggagcgggcagcctccaaccgctggctctcgaggggtccttgcagaaacgtggaattgtggaacaatgttgcacctcgatctgcagcctgtaccagctcgaaaactactgtgga

SEQ ID NO: 13942 - DNA, 330 bp, Artificial Sequence
  Description of Artificial Sequence: Synthetic coding sequence
atggctctatggatgcgacttctccctttgttagcactactcgccctctggggtccggatcccgcggcagccttcgttaaccaacacctttgtggcagtcatctggttgaagccctctaccttgtttgtggggaacgcggcttcttctacactcccaagacccgaagagaggcagaggacttacaggttgggcaagtagagttgggtggtgggcccggcgcaggttcactgcagcctctcgccttagagggctccctgcaaaagagaggaatagtagagcaatgttgtacctcaatctgctcactctatcagctggagaattattgtgga

SEQ ID NO: 13943 - DNA, 330 bp, Artificial Sequence
  Description of Artificial Sequence: Synthetic coding sequence
atggctctgtggatgcggctgctgcctctcctggcactgctcgccctttggggccctgaccctgctgcagctttcgtcaatcagcatctctgcggctcgcacctggtggaggccttgtacctcgtctgtggagagagaggattcttctacacccccaaaactaggcgcgaggctgaagatctccaggtggggcaggtggagctgggcggtggaccgggtgccgggtccttgcagccactggcactggagggctcgctgcaaaagcgcggtatcgtggaacaatgctgcacttcgatctgcagcctgtaccaactggaaaactactgtggc

SEQ ID NO: 13944 - DNA, 330 bp, Artificial Sequence
  Description of Artificial Sequence: Synthetic coding sequence
atggcactgtggatgcgcctgctccctctgctcgccctgctcgcattgtggggtcctgatcctgctgcagcgttcgtgaatcagcatctctgcggatcccacctggtcgaagcgctttacttggtttgtggagaacgtggctttttctacactccaaagaccaggagagaagccgaggatttgcaagtggggcaggtggagcttggtggagggccgggtgcagggagccttcaaccgcttgctcttgagggatcgcttcaaaagcgcggcattgtcgaacaatgctgtacttcaatctgttcgctctatcaactggagaactactgtggg

SEQ ID NO: 13945 - DNA, 330 bp, Artificial Sequence
  Description of Artificial Sequence: Synthetic coding sequence
atggcgctctggatgcggttactccccctattggccttgctggccctttggggtcctgaccctgccgccgccttcgttaaccagcacctttgcgggtcacacctggtggaggcactttatcttgtctgtggcgaacgaggttttttttacaccccaaagacgcgccgggaggcagaggatctccaggtcggtcaggtggagctcggcggcggacccggcgcaggcagcctgcagccactcgctttggaggggtccctgcagaagcggggcatcgttgagcagtgctgtacctctatttgcagtttgtatcagcttgaaaattattgtggt

SEQ ID NO: 13946 - DNA, 330 bp, Artificial Sequence
  Description of Artificial Sequence: Synthetic coding sequence
atggcgctgtggatgcgcttgctgccgctcctcgccctgttggcactgtggggaccggacccggccgcagcgttcgtgaaccagcatctctgtggatcccatctggtggaggccctgtacctcgtctgcggtgagcgcggtttcttttacaccccgaagactcgccgggaggcagaagatctccaggtcggtcaagtggagctgggaggaggaccgggggccggatcgctccaaccccttgcactcgaaggctcactccaaaagcgagggatcgtggagcagtgttgcacctcaatctgcagcctgtaccaactcgagaattactgtgga

SEQ ID NO: 13947 - DNA, 330 bp, Artificial Sequence
  Description of Artificial Sequence: Synthetic coding sequence
atggctctttggatgcgcctcctgcctcttttggcattgctggctttatggggacctgaccccgcagctgcattcgttaatcaacacctgtgtgggtcacatctcgtagaagccctgtaccttgtttgcggggagcggggttttttttatacccccaagactcgccgcgaagccgaggatttacaggtgggccaggtagagttgggaggtggacccggggccggaagcttacagcccttagctctggagggttccctgcaaaaaagaggtatcgtcgaacaatgttgcacatcaatttgctccctttatcagctggagaattactgtggg

SEQ ID NO: 13948 - DNA, 330 bp, Artificial Sequence
  Description of Artificial Sequence: Synthetic coding sequence
atggcactttggatgcgcctgcttcctttgctggcccttctggcattgtggggacccgaccctgcagccgcatttgtgaatcagcatctctgtggatcacatcttgtggaggcgctgtacctggtgtgtggggagcggggcttcttttacacccctaagactcgtcgagaagccgaagatctccaggttggccaagtcgagcttggtggcggccctggcgcggggagccttcagccgttggcgctggaggggtcgcttcaaaagcggggaatagtggaacaatgctgcacctctatctgttccctgtaccaattggagaactattgtgga

SEQ ID NO: 13949 - DNA, 330 bp, Artificial Sequence
  Description of Artificial Sequence: Synthetic coding sequence
atggcgctctggatgaggctactgcccctgctcgctctgttagcgctctggggaccagatcctgcagccgcattcgtgaaccaacacttatgcgggtcacacctcgtagaggccctgtatttggtctgtggcgagcgtggatttttttatacccctaagactcgtcgtgaagcggaagatttgcaggtcggacaggtcgagctgggcggtgggcctggcgctgggagtctgcagcctctcgcccttgaagggtctttgcagaagcgcggcatcgtcgagcagtgctgtacatctatctgctccctttatcaactcgagaactattgtggg

SEQ ID NO: 13950 - DNA, 330 bp, Artificial Sequence
  Description of Artificial Sequence: Synthetic coding sequence
atggccttgtggatgaggctgcttccactgctagcgctgctcgctctctggggtcctgatccagctgccgcctttgttaaccagcacctgtgtgggtcacatttggtcgaagctctgtatctggtttgtggggagcgtggtttcttttatactcccaagacacgcagggaggccgaggacctgcaagtgggtcaggtggaactcggaggagggcctggtgccgggagcctccagcccttggcgcttgagggttcccttcagaaacgggggattgtggagcagtgctgtacctctatttgcagtctgtatcagctggagaattattgcggg

SEQ ID NO: 13951 - DNA, 330 bp, Artificial Sequence
  Description of Artificial Sequence: Synthetic coding sequence
atggcactttggatgagactcttgccactccttgccctccttgcactctggggccctgatcctgcagcagcctttgtcaaccaacatctgtgtgggtcgcatctggtcgaggccctgtaccttgtgtgtggagaaagaggctttttctacactcctaaaactcggcgcgaggcagaggacctccaggtgggccaagtcgagctgggaggaggcccgggagctgggagccttcagccacttgcattggagggtagcctgcaaaagcgcgggatcgtggagcagtgctgtacctcgatatgctctctgtaccagctggaaaactactgtgga

SEQ ID NO: 13952 - DNA, 330 bp, Artificial Sequence
  Description of Artificial Sequence: Synthetic coding sequence
atggctttatggatgcgcctcttgccccttctggctctgctggccctgtgggggcccgatcctgctgccgcttttgtcaatcagcatctctgcggctcgcacctagtggaggcgctgtaccttgtttgcggagaacgaggtttcttctataccccaaagactaggcgggaggcagaggacttgcaagtcggccaggtcgaactgggaggcggcccaggagctgggtccttgcagccactcgcactcgaaggaagtcttcaaaagagaggcatcgtggaacaatgttgcacttccatttgcagtttgtatcagctggaaaactactgcggc

SEQ ID NO: 13953 - DNA, 330 bp, Artificial Sequence
  Description of Artificial Sequence: Synthetic coding sequence
atggccctctggatgcgccttctgcccctgctggccctgttggccctgtggggcccggaccccgccgcagcatttgtgaaccagcatctgtgtggctcacaccttgtcgaggcactgtacttagtttgcggagagagaggtttcttctacacccccaagactcggcgggaagcggaggacctacaggtgggacaggtagagctaggagggggtcccggcgctggaagtctccagcccctggccctggagggatctctccagaaacgggggatcgtggaacagtgttgtaccagtatttgcagtttgtaccaattggagaattactgtggc

SEQ ID NO: 13954 - DNA, 330 bp, Artificial Sequence
  Description of Artificial Sequence: Synthetic coding sequence
atggctttgtggatgcggctcctgccgctcctcgcactcctcgcgctgtgggggccagatcctgccgcggcatttgtcaaccagcatctctgcgggtcgcaccttgtggaagctctgtacctggtgtgcggggagcggggcttcttctacaccccgaaaacccgccgggaagcagaagatctgcaagtgggccaggtggagctcggaggaggacctggtgccgggtcacttcaaccgctcgccctggagggttcccttcagaagagaggtattgtggaacagtgctgtacttcgatttgcagcctgtaccagctggaaaactactgcgga

SEQ ID NO: 13955 - DNA, 330 bp, Artificial Sequence
  Description of Artificial Sequence: Synthetic coding sequence
atggccctctggatgcgactccttccgctgctggctttgcttgcactctggggaccggacccggcagccgctttcgtgaaccaacatctgtgtggatcgcacctggtggaagccctttacttggtgtgcggcgaaaggggttttttctacacccctaagactcggcgcgaggcggaggatctgcaagtcggtcaggtggagttgggcggcggccctggtgctggatcgctccagccactggcactggaaggaagccttcagaaacgcggaatcgtggaacaatgctgcacgtctatctgctctctgtaccagctggagaattactgtggg

SEQ ID NO: 13956 - DNA, 330 bp, Artificial Sequence
  Description of Artificial Sequence: Synthetic coding sequence
atggctctgtggatgcgccttctgccactgctcgccctgctggccttgtgggggccggacccggcggcggccttcgtgaaccaacacctgtgtggatcgcatctggtggaagctctctacctggtgtgtggagaacggggattcttttacactcctaaaacccgccgagaggccgaggatctgcaagtcggacaggtagagctgggaggcggtcctggcgcgggatcgctgcagccgctggctctggaaggaagtctccagaagagaggaatcgtcgaacagtgctgcaccagcatctgctcactctaccaactcgagaattactgtggc

SEQ ID NO: 13957 - DNA, 330 bp, Artificial Sequence
  Description of Artificial Sequence: Synthetic coding sequence
atggccctctggatgagacttctcccacttctcgcactcctcgcactttggggtcctgacccagcagcagcctttgtgaatcaacacctttgtggatcacatctggtggaggcgctctatctggtctgtggtgaaaggggttttttctacacccctaagacccgtagggaagctgaggacctccaggtgggccaagtggagctcggagggggacctggagcaggtagcttgcagcctctggcactcgaaggatcactgcagaaaagaggaatagtggagcaatgctgtacttccatctgcagcctttaccaactcgaaaactactgcggg

SEQ ID NO: 13958 - DNA, 330 bp, Artificial Sequence
  Description of Artificial Sequence: Synthetic coding sequence
atggcactgtggatgagactgctgccgctgctggccctgctggctctgtggggaccggaccctgccgccgctttcgtgaatcagcacttgtgcggatcgcatctggttgaagcgctctacctggtctgcggagaaagagggttcttctacaccccaaagacgcggcgggaagctgaggacctgcaagtgggacaggtggagctcgggggaggacctggagcgggaagcctccaaccgctggctcttgagggatcgctccaaaagaggggtattgtggaacagtgttgcacttcgatctgctcgctctaccaactcgagaactattgcgga

SEQ ID NO: 13959 - DNA, 330 bp, Artificial Sequence
  Description of Artificial Sequence: Synthetic coding sequence
atggcactctggatgcgattgcttcctttactggcgttattagcactatggggcccagacccagccgccgccttcgtcaaccaacacctgtgcggctcacatcttgtcgaggccctatatcttgtgtgtggggaacgaggctttttctatacaccgaagacacgaagagaagccgaagacctgcaggtgggccaggttgagcttggaggtggcccaggggcaggaagtctccagcccctggcactcgaaggcagcttgcagaagcgaggaatcgtcgaacagtgttgtactagcatatgttccctgtaccaactagagaactattgtggc

SEQ ID NO: 13960 - DNA, 330 bp, Artificial Sequence
  Description of Artificial Sequence: Synthetic coding sequence
atggcactctggatgcgtctattgcctttgttggccctgctggcactgtggggccccgatcccgcagcggccttcgtgaaccagcacctgtgcgggagccacctggtcgaagccttatacctcgtgtgtggagaaagaggatttttttacacgccaaagacccggcgcgaggcagaggacctacaagtcggacaggtggaactgggaggtggcccgggcgcaggtagcctccagcccctggcactggaggggagcctgcagaagcgcgggatagtggagcagtgttgcacatcaatatgtagcctgtaccagctcgagaattactgtgga

SEQ ID NO: 13961 - DNA, 330 bp, Artificial Sequence
  Description of Artificial Sequence: Synthetic coding sequence
atggcactctggatgaggctgctaccacttctggccctcctggccttgtggggccccgatccggcggccgcttttgtcaaccaacatttgtgcggtagtcatctggtggaagctctctatttggtgtgcggcgagcgagggtttttctataccccgaagacacgacgcgaagcagaggaccttcaggtgggtcaggttgagctggggggaggacccggcgctggcagcctgcagcctctagcgctcgaaggcagcctccaaaagcgcggaatcgtagagcagtgctgcacatcgatctgctccttgtatcaattggaaaactactgtgga

SEQ ID NO: 13962 - DNA, 330 bp, Artificial Sequence
  Description of Artificial Sequence: Synthetic coding sequence
atggctctttggatgcgcctccttcctctgctggccttgctggcactgtggggtcccgaccctgcagctgcgttcgtgaatcaacacctgtgcggatcccatttggtggaggccctctacctggtttgcggagaaaggggttttttctacaccccaaagaccagacgagaggccgaagatctccaggtgggacaggtagaactcggcgggggaccgggggcgggatcgcttcagccactggctctggaaggctctttgcagaaaaggggcattgtcgagcagtgttgtactagcatctgctcattgtaccaactcgagaactattgcgga

SEQ ID NO: 13963 - DNA, 330 bp, Artificial Sequence
  Description of Artificial Sequence: Synthetic coding sequence
atggccctttggatgagattgttaccacttcttgcacttctagcattatggggtcctgacccagcagcagctttcgtcaatcaacatctctgcggaagtcacttggtggaagccctctacctcgtctgtggagaacggggatttttttatacccccaaaacacgcagggaggctgaagatctgcaggtgggccaggtggagcttggaggagggcctggtgccggctcccttcaacctttggctctagagggcagtttgcaaaaaaggggaatagtcgagcaatgttgtacctcaatttgttccctctatcagctcgaaaattattgcggc

SEQ ID NO: 13964 - DNA, 330 bp, Artificial Sequence
  Description of Artificial Sequence: Synthetic coding sequence
atggccttgtggatgcggctgcttcctttgctggcactcctggcgctgtgggggccagacccggccgcggcgttcgtgaaccagcatctttgtggctcccacctcgtcgaagcgttgtacctggtgtgcggagaacgcggattcttctacaccccgaaaacgaggagagaagcagaagatctgcaagtgggacaggtggaactgggtggaggacctggggccggatcgctgcagccgctggcgctcgagggttcgctccagaagcgcggaatcgtggaacagtgctgcacttctatctgctccctctaccagctggagaattactgtgga

SEQ ID NO: 13965 - DNA, 330 bp, Artificial Sequence
  Description of Artificial Sequence: Synthetic coding sequence
atggccctctggatgaggctccttcctttgctcgctctcctcgcactgtggggccctgatccagcagccgccttcgttaaccaacatctgtgtgggtcacatcttgtggaggccctttaccttgtgtgtggagaaagagggtttttctatacccctaagactagaagagaggcagaagatctgcaagttggtcaggtggaactgggcggcggacctggcgcaggttcgctgcagccacttgcgcttgaggggtccctgcagaagcgcggtatcgtcgaacaatgctgtacttcgatttgttcattgtaccagctcgaaaactactgcggt

SEQ ID NO: 13966 - DNA, 330 bp, Artificial Sequence
  Description of Artificial Sequence: Synthetic coding sequence
atggcactttggatgcggttgctgcctctgctggcactcttggcactttggggcccggaccctgcagccgccttcgtgaaccaacacctgtgcgggtcacatctcgtcgaggcactttacctcgtgtgtggagagcgcggattcttttacacccccaagaccaggcgtgaggccgaagatcttcaagtgggtcaagtggaactgggaggaggaccaggggcgggatcgcttcaaccccttgctcttgaaggatcgctccagaaaagagggatagtggaacagtgctgtacctcgatttgttcactttaccaacttgaaaactactgcgga

SEQ ID NO: 13967 - DNA, 330 bp, Artificial Sequence
  Description of Artificial Sequence: Synthetic coding sequence
atggccctgtggatgcgactcctgccgctcttggcccttcttgcactgtggggaccggaccctgcggcggctttcgtgaatcagcatctgtgcggatcgcaccttgttgaggccttgtacctggtgtgcggagagagaggttttttctacactcccaaaaccaggcgcgaagctgaggatctccaagtaggccaggtcgaattgggaggaggcccaggagcaggttcgctgcaacctttggccctggaaggatcactccaaaagcggggtatcgtagagcagtgttgcacgagcatctgctccctctaccagctcgaaaactattgtggg

SEQ ID NO: 13968 - DNA, 330 bp, Artificial Sequence
  Description of Artificial Sequence: Synthetic coding sequence
atggccttatggatgcggctgctgccgcttctcgcacttctggcactctggggcccagatcctgctgcagcttttgtgaaccagcacctttgtgggagccacctcgtggaggctctatacctggtctgtggggaacgcgggttcttctacacccccaagacaaggcgcgaagcagaggacctccaggtcggccaggtggagcttggcggcggcccgggtgcaggtagcctccagccccttgctctagaaggcagcctgcaaaagaggggcatcgttgagcagtgttgcaccagtatctgttctttgtatcaactggaaaattattgcggc

SEQ ID NO: 13969 - DNA, 330 bp, Artificial Sequence
  Description of Artificial Sequence: Synthetic coding sequence
atggcattgtggatgagacttcttccacttcttgcgctgctggcactctggggaccagatcccgcagcggcctttgtcaaccagcacctgtgtgggtcacacctcgtggaagcactgtaccttgtgtgtggagaacgcggcttcttttacacgcccaagactcgtcgagaagcagaagatcttcaggtgggccaggtggagctgggaggtggacctggagccggtagccttcaacccttggcgcttgagggttcacttcaaaagagaggaattgttgaacagtgttgtacttcgatctgttccctgtaccagctggagaattactgtggt

SEQ ID NO: 13970 - DNA, 330 bp, Artificial Sequence
  Description of Artificial Sequence: Synthetic coding sequence
atggcactctggatgaggctgttaccgttgcttgcgctgctcgcactttggggaccagacccagccgccgcctttgtgaaccagcacctttgcgggtcccacttagtagaggccttgtatttagtgtgcggagagcgcggttttttctataccccaaagacaagacgggaggccgaggacttacaggtcggacaggttgagcttggcggtgggcctggggctgggtcgctgcagcccttagcattggaaggttctttgcagaagcgggggatcgttgaacagtgctgtaccagtatttgcagcctctatcagcttgagaactactgtggt

SEQ ID NO: 13971 - DNA, 330 bp, Artificial Sequence
  Description of Artificial Sequence: Synthetic coding sequence
atggcactttggatgaggctgctgcctctcttggcccttttggccctctgggggcccgaccctgctgcagcctttgtgaatcagcacctgtgcggctcacacctcgttgaggctctctatctcgtctgcggagagcgcggatttttctacacacctaagactcggcgtgaggctgaagaccttcaagtgggtcaagtggagctgggtggggggccaggtgccgggtccctgcagcccctcgccttagagggctccctgcagaagcggggcattgtcgaacagtgttgtacttccatttgcagtctttatcaactcgaaaactactgcggt

SEQ ID NO: 13972 - DNA, 330 bp, Artificial Sequence
  Description of Artificial Sequence: Synthetic coding sequence
atggcgctgtggatgcggcttctgcccctgctggcgctcctggcgctctggggacccgacccagccgccgccttcgtgaaccagcatttatgtgggagtcacctggttgaagcactgtacctggtctgcggcgagcgaggcttcttttacacacccaagacgcgtagagaggcagaggatctccaagttggtcaggtggagctggggggtgggcccggagccggttccctacagcctttggccctagagggatcactgcagaaaagaggcattgtcgaacagtgctgcaccagcatatgttctctctatcaactagagaattattgtgga

SEQ ID NO: 13973 - DNA, 330 bp, Artificial Sequence
  Description of Artificial Sequence: Synthetic coding sequence
atggccctgtggatgagactgcttccactgttggcgcttctagcactatgggggccagatcccgccgctgccttcgttaaccagcacctctgcggatctcacctagtagaagccctatacctcgtgtgtggggaacgcgggttcttctatactccaaaaacacggcgtgaggccgaagatctccaggttgggcaggttgaactgggaggagggcctggggctgggtcacttcagccacttgctcttgaagggtctctacagaagaggggaattgtggagcagtgttgtacttcaatatgttccctttaccagctggagaactactgtggg

SEQ ID NO: 13974 - DNA, 330 bp, Artificial Sequence
  Description of Artificial Sequence: Synthetic coding sequence
atggccctatggatgcgattgctcccactactagccctcctcgctttgtggggtcctgatccagcggcagcgtttgtcaaccagcacctctgcggaagtcaccttgtggaggcactctatcttgtatgtggtgagcgtggattcttctacacgccgaagacccgtcgcgaggccgaggaccttcaggtaggccaggttgagctgggcgggggacctggggctggatccctacaaccgttggccctagaaggctcgttacagaaacgcggtatcgtcgaacagtgctgcacgtctatctgtagtttgtatcaactcgagaattactgcggc

SEQ ID NO: 13975 - DNA, 330 bp, Artificial Sequence
  Description of Artificial Sequence: Synthetic coding sequence
atggcactctggatgcggctgctcccgctgctggcgctgttggcgctctggggccctgatcctgccgccgcttttgtcaaccagcacttatgtgggagtcaccttgtggaagccttatatctagtgtgcggagagcgcgggttcttctacactccaaaaacgcgccgggaagccgaagatctccaggtcggacaggtggaactaggtggcggccctggcgcaggatctcttcagcctctcgccctggaggggtcacttcagaagcggggtatcgtggaacagtgttgtaccagcatttgcagcctgtaccagctggagaactattgtggc

SEQ ID NO: 13976 - DNA, 330 bp, Artificial Sequence
  Description of Artificial Sequence: Synthetic coding sequence
atggcgctgtggatgcgccttctgccactgttggcactgctggcgctttgggggccagaccctgcagcagccttcgtgaaccaacacctgtgcggtagccatctggtcgaggcgctctaccttgtctgcggagagcgcggatttttctacaccccgaaaacccggagggaggctgaagatctgcaagtgggacaggtcgagctggggggaggtccaggggctggatcgctccagcctcttgcccttgagggatcgcttcagaagcggggcatcgtggaacagtgttgtacctcaatttgtagcctctaccaactggaaaactactgtgga

SEQ ID NO: 13977 - DNA, 330 bp, Artificial Sequence
  Description of Artificial Sequence: Synthetic coding sequence
atggctctgtggatgcggctccttccccttcttgccttgttggccctttggggaccggatcctgcagccgcttttgtgaatcaacacctttgtggaagtcatctggtcgaagcactttaccttgtttgcggggagagaggattcttttacaccccaaagacgcgtcgcgaagccgaggacctgcaagtgggccaggtcgaactggggggcggacccggtgcaggtagcctgcaacctcttgcattggaaggatcgttgcagaaaagagggattgtcgaacagtgttgcacctcaatctgttcgttgtatcaactcgaaaactactgcggc

SEQ ID NO: 13978 - DNA, 330 bp, Artificial Sequence
  Description of Artificial Sequence: Synthetic coding sequence
atggctttgtggatgcggttgcttccccttctggcccttctggccctctggggtccggatcccgctgccgcattcgtcaaccagcatttgtgcggatcacacttggttgaggccctgtatcttgtttgtggcgaaaggggatttttctacaccccaaagaccaggagagaagcagaagacctccaggtgggacaggtcgaactcggaggggggcccggagccggaagtctgcagcccttagccttggaaggcagtctccagaaaagaggcatcgtggaacagtgttgtacctccatctgcagcctgtatcagcttgagaactactgtggg

SEQ ID NO: 13979 - DNA, 330 bp, Artificial Sequence
  Description of Artificial Sequence: Synthetic coding sequence
atggcgctctggatgcgcctgcttccgcttctggccctgctggctctctggggaccggatcctgcggccgctttcgtgaatcaacacctctgtggctcgcatctcgttgaagcactgtacctggtgtgcggagagcggggattcttctacacccctaagactcggcgcgaagccgaggatctgcaagtcggacaggtggaattgggaggtggtcccggcgccggctcccttcagccgctggcgttggagggatctctccaaaagagagggatcgtggaacaatgctgtacctcgatctgctcactttaccagctggaaaactactgcggc

SEQ ID NO: 13980 - DNA, 330 bp, Artificial Sequence
  Description of Artificial Sequence: Synthetic coding sequence
atggcactttggatgagactccttcctctgctggcacttctggcgctgtggggtccagaccctgccgcagcatttgtgaaccaacatttgtgtggctcccatttggtcgaagccttgtacctggtctgtggcgaacgcggttttttctacacccctaagacccggcgtgaagcagaggatctgcaagtgggacaggtggaactgggtggagggcctggtgcaggttccctgcaaccacttgctctggagggatcgctgcagaaaaggggaatagtggagcagtgttgcacttcgatatgctcactctaccaactggaaaactattgcggg

SEQ ID NO: 13981 - DNA, 330 bp, Artificial Sequence
  Description of Artificial Sequence: Synthetic coding sequence
atggcactgtggatgcggctgcttccacttcttgctctgttggcgctgtggggacctgaccctgcagcagcctttgtgaaccagcatctgtgcggaagccatctcgtggaagcactctacctggtgtgtggcgaacggggattcttctacacccctaaaactagacgcgaagccgaggacctgcaggtgggccaagtggagctgggcggcggaccaggagcaggatccttgcaaccacttgccctggagggatcgcttcaaaagaggggtatcgtggaacagtgttgtacttccatttgtagcctttaccagctggagaactactgcgga

SEQ ID NO: 13982 - DNA, 330 bp, Artificial Sequence
  Description of Artificial Sequence: Synthetic coding sequence
atggcactctggatgcgcctcctccctctgctggccctgctggcactctggggccccgatcctgccgccgcattcgtgaaccagcacctgtgcggctcccatttggtagaagccctgtatcttgtctgtggcgagcgtggtttcttctacactccaaaaacacgtagggaagccgaagacctccaggttggccaagtggagctcggcggcggccccggcgctggaagtctccaacccctcgctcttgaaggaagtctgcagaagagaggcatcgtggagcagtgctgcacctccatttgttcactttaccagctggagaactactgtgga

SEQ ID NO: 13983 - DNA, 330 bp, Artificial Sequence
  Description of Artificial Sequence: Synthetic coding sequence
atggctctgtggatgaggctccttcctctcctggcattattagcattatggggcccggatcctgcggcggcatttgtcaaccagcacttatgcgggtcccacttggttgaagccctctatcttgtctgcggcgaacggggctttttctatacgccgaaaactagaagagaagccgaagatttacaggttggtcaagttgagcttggaggtggacctggcgcaggctctttacaaccgctggccctggagggaagtctgcaaaagcgcggcatcgtggaacagtgttgtacgtctatctgttctctctatcagctggaaaactattgcggc

SEQ ID NO: 13984 - DNA, 330 bp, Artificial Sequence
  Description of Artificial Sequence: Synthetic coding sequence
atggccttatggatgagactactgcctctgttagctttgcttgctctttgggggcctgaccccgctgccgccttcgttaatcagcacttgtgcggttctcacttggtggaggctctgtacctagtatgcggtgaaagaggtttcttctatacaccgaaaacccgcagagaagccgaggatttgcaggtcggccaggtcgaattaggaggaggcccaggcgctggtagtctccaacctctagcccttgaaggatccctgcagaagcggggcatagttgaacagtgctgtacttccatttgttccctctaccagctggaaaactattgtggc

SEQ ID NO: 13985 - DNA, 330 bp, Artificial Sequence
  Description of Artificial Sequence: Synthetic coding sequence
atggccctctggatgcgccttctgcctctgctggccctcctggcactttggggtccagatcctgcggctgcatttgtgaaccagcacctgtgtgggtcccatctggtagaggcactctatctggtgtgtggcgaaagagggttcttctatactcccaaaacacgccgagaagctgaagacctccaggttggacaagttgaactgggaggagggcccggtgccggatccctccagcccctggcattggagggaagcttgcagaagcggggaatcgttgagcagtgctgtacttcaatctgctcactctaccagctcgagaattattgcgga

SEQ ID NO: 13986 - DNA, 330 bp, Artificial Sequence
  Description of Artificial Sequence: Synthetic coding sequence
atggcactgtggatgagactgctgcctcttctggcactgcttgcactctgggggccggatccagcagccgcttttgtgaaccagcacctgtgtggctcccatcttgtggaggcactttacctggtgtgtggggagagaggctttttctatactccaaaaacccggagagaagcagaggatctccaagtgggtcaagtggagctcggaggaggacctggtgctggatcactccaacccctggctctggagggtagcttgcaaaagagaggaattgtggaacagtgttgcacttcaatttgttccctctaccagcttgagaattactgcggt

SEQ ID NO: 13987 - DNA, 330 bp, Artificial Sequence
  Description of Artificial Sequence: Synthetic coding sequence
atggcattgtggatgcgtctgctccctcttctggcgcttcttgctctctggggtcctgatcctgccgccgcgtttgtaaatcaacacctgtgtggatcccatcttgtggaagccttgtacctcgtctgtggcgagaggggtttcttttacacgcctaaaactagacgggaagcagaggacctgcaggtgggacaggtcgaactgggcggcgggcccggagcagggtcacttcagccgctggcacttgagggatcgctccaaaagcggggaattgtcgaacagtgctgcacctcgatctgctcattgtaccaactggagaactactgtgga

SEQ ID NO: 13988 - DNA, 330 bp, Artificial Sequence
  Description of Artificial Sequence: Synthetic coding sequence
atggcactgtggatgcgcctgcttcctcttctggcgctgctcgcactctggggaccagatcctgcggccgcctttgttaatcagcatctttgtggttcacacctcgtggaggcactctatctggtgtgcggcgagcgcgggtttttctacacccctaagactcgcagggaagcagaggacctgcaagtgggccaagttgaacttggcggaggtcccggagcaggatctctgcaaccactggcccttgaaggaagccttcagaaacgtggaatagtggaacagtgttgtacgtcgatttgctcgctctaccaattggagaattactgcggt

SEQ ID NO: 13989 - DNA, 330 bp, Artificial Sequence
  Description of Artificial Sequence: Synthetic coding sequence
atggcactgtggatgagactcctgcctctgcttgcattgctcgccctttgggggccggatcctgcagcagctttcgtcaaccagcacctttgcggcagccatttggttgaagctctctacttggtttgcggggagcgcggttttttttatacacccaagacccgaagggaggccgaggatctgcaagttggccaggtggaattggggggcggccctggggctgggtccctccagccattggctctggaaggtagcttgcagaagaggggcatagtggagcagtgttgtacatctatctgctctctgtaccagctggagaactactgtggt

SEQ ID NO: 13990 - DNA, 330 bp, Artificial Sequence
  Description of Artificial Sequence: Synthetic coding sequence
atggcgttatggatgcgactcttgccactcctcgcgttgctggcgctttggggccccgaccctgctgcagcgttcgttaaccagcacctgtgcggtagtcacctggtggaggccctatacctggtgtgtggagagaggggcttcttctacactcccaaaaccaggcgggaggctgaggatttgcaggtgggccaggtggagctgggaggaggtccaggagcaggctctcttcagcctttagcactggagggcagtctgcagaaaagaggtatagtcgagcagtgctgcacgagcatttgctcactctatcagttagagaattactgtggc

SEQ ID NO: 13991 - DNA, 330 bp, Artificial Sequence
  Description of Artificial Sequence: Synthetic coding sequence
atggcactgtggatgcgattgctgccactcctggctctgctggccttgtgggggccggaccccgcagccgcttttgtcaaccaacacctgtgtggatcacatctggtggaagccctatatctagtatgtggcgaacgcggattcttttacacaccaaaaactcgtagagaggccgaagatctgcaggtcggccaggtggagcttggaggagggcccggagccggctccctccagccattagccctcgaaggctcactccagaagcgagggatcgttgagcagtgttgcaccagcatctgctccctgtaccagctggagaactactgtggg

SEQ ID NO: 13992 - DNA, 330 bp, Artificial Sequence
  Description of Artificial Sequence: Synthetic coding sequence
atggcactgtggatgagactgttgccactacttgctctcctggctctgtgggggcccgatcctgcagccgccttcgtcaaccagcacttatgcggatcgcacctggtggaagccctgtacttagtgtgtggggaaaggggctttttctacacacctaaaacaagaagggaagcggaagacctgcaggtcggccaggtggagctcggtggtgggcccggggccgggagtcttcagcccttggcactggagggatccctacagaaaagagggatcgtggagcagtgttgtacttcaatttgcagtctttaccagcttgagaattattgtggc

SEQ ID NO: 13993 - DNA, 330 bp, Artificial Sequence
  Description of Artificial Sequence: Synthetic coding sequence
atggccctgtggatgcggctactgcccttattagcccttctggcactgtgggggccagatccagccgccgccttcgtgaatcagcacctctgtggaagtcatctggtagaggcactctatttggtatgcggggaacggggattcttctacaccccaaagacccggagggaggccgaggacctgcaagtaggccaggtggagctgggtggtgggccaggggccggatcactgcagcccctcgcgttagagggcagtctccagaaacgcggtatcgtcgagcaatgttgtacctcaatctgcagtctctatcaacttgagaactattgcggc

SEQ ID NO: 13994 - DNA, 330 bp, Artificial Sequence; identical to SEQ ID NO: 13984
  Description of Artificial Sequence: Synthetic coding sequence

SEQ ID NO: 13995 - DNA, 330 bp, Artificial Sequence
  Description of Artificial Sequence: Synthetic coding sequence
atggcactgtggatgcggttgctcccgctgctggccctgctcgcactgtggggcccagacccggctgctgcatttgttaatcaacatctgtgcggctctcatctagtcgaggcactgtacttggtgtgcggtgagcgcggttttttctatacgcctaaaacccgccgcgaggccgaagacctgcaggtgggtcaggtagagcttggcggtggtccaggggctggttcactgcaaccactcgccctcgaaggcagcctccagaagcgcggcattgtggagcagtgttgtacgtctatctgtagcctgtaccagctggaaaattactgcggt

SEQ ID NO: 13996 - DNA, 330 bp, Artificial Sequence
  Description of Artificial Sequence: Synthetic coding sequence
atggcactttggatgcgattgctcccactgctcgccctcctggccctttggggccccgaccccgctgccgcattcgtgaatcaacacctctgcgggagccatctagtggaagcactttacttagtgtgcggggagaggggcttcttttacacccccaagaccagaagagaggcagaggatctgcaggtcggacaagtcgaactgggcggcggcccgggtgctggctccctccagcctcttgccctcgagggaagtttgcagaagagaggcatcgtcgagcagtgttgcacatccatttgttctctctaccagctggaaaactattgcgga

SEQ ID NO: 13997 - DNA, 330 bp, Artificial Sequence
  Description of Artificial Sequence: Synthetic coding sequence
atggcactgtggatgagacttctcccattgctcgcgctattagcattatggggaccagatccagcagctgcttttgtaaaccagcacctgtgcggtagtcatctagtcgaagctctctaccttgtttgtggagaaagaggcttcttctacacacccaagactcgacgcgaagccgaagatctgcaagtcgggcaagttgagcttgggggaggacccggagccggatccctgcagccgctcgctctggagggatctcttcaaaaacgtggaatcgttgaacaatgttgtacttcgatctgcagcctgtatcaactcgagaattattgtgga
